United States Patent
Palma et al.

(10) Patent No.: US 7,374,927 B2
(45) Date of Patent: May 20, 2008

(54) METHODS OF ANALYSIS OF DEGRADED NUCLEIC ACID SAMPLES

(75) Inventors: John F. Palma, San Ramon, CA (US); Eric B. Schell, Mountain View, CA (US); Alan J. Williams, Albany, CA (US)

(73) Assignee: Affymetrix, Inc., Santa Clara, CA (US)

( * ) Notice: Subject to any disclaimer, the term of this patent is extended or adjusted under 35 U.S.C. 154(b) by 133 days.

(21) Appl. No.: 11/121,849

(22) Filed: May 3, 2005

(65) Prior Publication Data

US 2005/0272080 A1    Dec. 8, 2005

Related U.S. Application Data

(60) Provisional application No. 60/567,949, filed on May 3, 2004.

(51) Int. Cl.
*C12M 1/34* (2006.01)
*C12M 3/00* (2006.01)
*C07H 21/04* (2006.01)
*C12Q 1/68* (2006.01)

(52) U.S. Cl. .................. 435/287.2; 435/91.1; 435/6; 536/23.1; 536/24.3

(58) Field of Classification Search .................. None
See application file for complete search history.

(56) References Cited

U.S. PATENT DOCUMENTS

| | | | |
|---|---|---|---|
| 5,800,992 A | | 9/1998 | Fodor et al. |
| 5,837,832 A | | 11/1998 | Chee et al. |
| 6,133,436 A | * | 10/2000 | Koster et al. ............... 536/24.3 |
| 6,582,906 B1 | | 6/2003 | Cao et al. |
| 2001/0051344 A1 | * | 12/2001 | Shalon et al. .................. 435/6 |
| 2001/0053519 A1 | * | 12/2001 | Fodor et al. ..................... 435/6 |
| 2002/0009738 A1 | | 1/2002 | Zehantner et al. |
| 2003/0143593 A1 | | 7/2003 | Hermitte et al. |
| 2003/0198983 A1 | | 10/2003 | Zhou |
| 2003/0207312 A1 | | 11/2003 | Sorge |
| 2003/0236633 A1 | | 12/2003 | Mei et al. |
| 2005/0014168 A1 | | 1/2005 | Erlander et al. |

OTHER PUBLICATIONS

Dudin G et al 'Sorting of chromosomes by magnetic separation.' Hum Genet. Oct. 1988;80(2):111-6.*
Svensson A-C et al 'Chromosomal distribution, localization and expression of the human endogenous retrovirus ERV9.' Cytogenet Cell Genet. 2001;92(1-2):89-96.*
Deb-Rinker P et al 'Molecular characterization of a 2.7-kb, 12q13-specific, retroviral-related sequence isolated by RDA from monozygotic twin pairs discordant for schizophrenia.' Genome. Apr. 2002;45(2):381-90.*
Affymetrix Product Catalog 2002 and GenChip Human Genome U95 Set, available from www.affymetrix.com, 4 pages.*
Details for HG-U95AV2:40846_G_AT, available from www.affymetrix.com, pp. 1-5.*
Details for HG_U95AV2:38267_AT, available from www.affymetrix.com, pp. 1-7.*
GenBank Locus NM_004170, available from www.ncbi.nlh.nih.gov, pp. 1-5.*
GenBank Locus AF167570, available from www.ncbi.nlh.nih.gov, pp. 1-3.*
Godfrey TE et al 'Quantitative mRNA expression analysis from formalin-fixed, paraffin-embedded tissues using 5' nuclease quantitative reverse transcription-polymerase chain reaction.' J Mol Diagn. May 2000;2(2):84-91.*
D'mell V et al 'Alternative mRNA polyadenylation can potentially affect detection of gene expression by affymetrix genechip arrays.' Appl Bioinformatics. 2006;5(4):249-53.*
Cheung VG et al 'Natural variation in human gene expression assessed in lymphoblastoid cells.' Nat Genet. Mar. 2003;33(3):422-5.*
Affymetrix, Inc. "Array Design for the GENECHIP Human Genome U133 Set", Gene Expression Monitoring Technical Note, Product No. 701133 Rev. 1 (2001) p. 1-10.
Affymetrix, Inc. "Performance and Validation of the GENECHIP Human Genome U133 Set", Gene Expression Monitoring-Technical Note Product No. 701211 Rev. 1, (2002) p. 1-10.
Lockhart et al. "Expression monitoring by hybridization to high-density oligonucleotide arrays", Nature Biotech. 14:1675-1680 (1996).

* cited by examiner

*Primary Examiner*—Jehanne Sitton
*Assistant Examiner*—Stephen Kapushoc
(74) *Attorney, Agent, or Firm*—Sandra E. Wells

(57) ABSTRACT

The invention provides arrays for analysis of compromised nucleic acid samples, for example, nucleic acids obtained from formalin fixed paraffin embedded samples and methods to analyzed these compromised samples. Arrays are disclosed in which the probe selection region used to select probes for the array is the 300 bases of the target MRNA that are immediately upstream of the start of the poly(A) tail of the mRNA. The probes selected for the array are more biased toward the 3' end of the mRNA than other arrays that are currently available.

4 Claims, No Drawings

METHODS OF ANALYSIS OF DEGRADED NUCLEIC ACID SAMPLES

RELATED APPLICATIONS

This application claims the benefit of U.S. Provisional Application No. 60/567,949 filed May 3, 2004. The entire disclosure of the above applications is incorporated herein by reference in its entirety for all purposes.

FIELD OF THE INVENTION

The present invention provides a method of analyzing nucleic acid samples that may be degraded, for example, formalin fixed paraffin embedded samples. Methods of selecting probes and arrays of probes are provided. A unique pool of nucleic acid sequences useful for analyzing degraded human nucleic acid samples is provided. The invention therefore relates to diverse fields impacted by the nature of molecular interaction, including chemistry, biology, medicine, and medical diagnostics.

REFERENCE TO SEQUENCE LISTING

The Sequence Listing submitted on compact disk is hereby incorporated by reference. The file on the disk is named 3684.1seqlist the file is 96.3 MB and the date of creation is May 3, 2005.

BACKGROUND OF THE INVENTION

Many biological functions are carried out by regulating the expression levels of various genes, either through changes in levels of transcription (e.g. through control of initiation, provision of RNA precursors, RNA processing, etc.) of particular genes, through changes in the copy number of the genetic DNA, through changes in RNA processing such as polyadenylation and splicing or RNA stability or through changes in protein synthesis. Changes in the expression levels of particular genes (e.g. oncogenes or tumor suppressors), serve as signposts for the presence and progression of various diseases.

Gene expression analysis using microarrays allows study of entire expressed genomes and has led to insights into the involvement of diverse molecular interactions as well as the pathologies that result from their disruption. Microarrays have been used to distinguish between pathologically similar diseases such as Acute Myeloblastic Leukemia and Acute Lymphoblastic Leukemia, Golub et al. *Science,* 286 (5439), 531-7 (1999), to provide insight into inflammatory diseases such as psoriasis and systemic lupus erythematosus (SLE), see for example, Zhou et al. *Physiological Genomics,* 13(1), 69-78, (2003) and to study diseases such as diabetes, Mootha et al. *Nature Genetics,* 34, 267-273 (2003).

SUMMARY OF THE INVENTION

An array comprising each of the sequences listed in SEQ ID NO: 1-673,904 is disclosed. In a preferred embodiment each of the sequences is present on the array in a known location. Each of the sequences of the sequence listing is present in a distinct feature and the location of a given probe is known or determinable. Control sequences may also be present on the array. The probes may be attached to a solid support, such as a glass chip, beads or particles.

In a preferred aspect a nucleic acid sample is amplified by hybridizing a primer to the poly(A) tail and extending the primer with a reverse transcriptase. The resulting first strand cDNA is copies to make double stranded cDNA with an RNA polymerase promoter. An RNA polymerase is used to make multiple RNA copies. The RNA copies are fragmented and hybridized to the array and a hybridization pattern is detected and analyzed to obtain expression measurements for a plurality of mRNA targets.

In some aspects the RNAs that are targeted are sets of 1,000 or more RNAs that share a common feature, for example, they may all be differentially expressed between a cancerous sample and a normal, non-cancerous sample. The probe sets for most of the targets consist of probes from the 300 bases immediately 5' of the polyA tail.

DETAILED DESCRIPTION OF THE INVENTION a) General

The present invention has many preferred embodiments and relies on many patents, applications and other references for details known to those of the art. Therefore, when a patent, application, or other reference is cited or repeated below, it should be understood that it is incorporated by reference in its entirety for all purposes as well as for the proposition that is recited.

As used in this application, the singular form "a," "an," and "the" include plural references unless the context clearly dictates otherwise. For example, the term "an agent" includes a plurality of agents, including mixtures thereof.

An individual is not limited to a human being but may also be other organisms including but not limited to mammals, plants, bacteria, or cells derived from any of the above.

Throughout this disclosure, various aspects of this invention can be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

The practice of the present invention may employ, unless otherwise indicated, conventional techniques and descriptions of organic chemistry, polymer technology, molecular biology (including recombinant techniques), cell biology, biochemistry, and immunology, which are within the skill of the art. Such conventional techniques include polymer array synthesis, hybridization, ligation, and detection of hybridization using a label. Specific illustrations of suitable techniques can be had by reference to the example herein below. However, other equivalent conventional procedures can, of course, also be used. Such conventional techniques and descriptions can be found in standard laboratory manuals such as *Genome Analysis: A Laboratory Manual Series* (Vols. I-IV), *Using Antibodies: A Laboratory Manual, Cells: A Laboratory Manual, PCR Primer: A Laboratory Manual,* and *Molecular Cloning: A Laboratory Manual* (all from Cold Spring Harbor Laboratory Press), Stryer, L. (1995) *Biochemistry* (4th Ed.) Freeman, New York, Gait, "*Oligonucleotide Synthesis: A Practical Approach*" 1984, IRL Press, London, Nelson and Cox (2000), Lehninger, *Prin-*

*ciples of Biochemistry* 3rd Ed., W. H. Freeman Pub., New York, N.Y. and Berg et al. (2002) *Biochemistry*, 5th Ed., W. H. Freeman Pub., New York, N.Y., all of which are herein incorporated in their entirety by reference for all purposes.

The present invention can employ solid substrates, including arrays in some preferred embodiments. Methods and techniques applicable to polymer (including protein) array synthesis have been described in U.S. Ser. No. 09/536,841, WO 00/58516, U.S. Pat. Nos. 5,143,854, 5,242,974, 5,252,743, 5,324,633, 5,384,261, 5,405,783, 5,424,186, 5,451,683, 5,482,867, 5,491,074, 5,527,681, 5,550,215, 5,571,639, 5,578,832, 5,593,839, 5,599,695, 5,624,711, 5,631,734, 5,795,716, 5,831,070, 5,837,832, 5,856,101, 5,858,659, 5,936,324, 5,968,740, 5,974,164, 5,981,185, 5,981,956, 6,025,601, 6,033,860, 6,040,193, 6,090,555, 6,136,269, 6,269,846 and 6,428,752, in PCT applications Ser. Nos. PCT/US99/00730 (International Publication No. WO 99/36760) and PCT/US01/04285 (International Publication No. WO01/58593), which are all incorporated herein by reference in their entirety for all purposes.

Patents that describe synthesis techniques in specific embodiments include U.S. Pat. Nos. 5,412,087, 6,147,205, 6,262,216, 6,310,189, 5,889,165, and 5,959,098. Nucleic acid arrays are described in many of the above patents, but the same techniques are applied to polypeptide arrays.

Nucleic acid arrays that are useful in the present invention include those that are commercially available from Affymetrix (Santa Clara, Calif.) under the brand name GeneChip®). Example arrays are shown on the website at affymetrix.com.

The present invention also contemplates many uses for polymers attached to solid substrates. These uses include gene expression monitoring, profiling, library screening, genotyping and diagnostics. Gene expression monitoring and profiling methods can be shown in U.S. Pat. Nos. 5,800,992, 6,013,449, 6,020,135, 6,033,860, 6,040,138, 6,177,248 and 6,309,822. Genotyping and uses therefore are shown in U.S. Ser. Nos. 10/442,021, 10/013,598 (U.S. patent application publication 20030036069), and U.S. Pat. Nos. 5,856,092, 6,300,063, 5,858,659, 6,284,460, 6,361,947, 6,368,799 and 6,333,179. Other uses are embodied in U.S. Pat. Nos. 5,871,928, 5,902,723, 6,045,996, 5,541,061, and 6,197,506.

The present invention also contemplates sample preparation methods in certain preferred embodiments. Prior to or concurrent with genotyping, the genomic sample may be amplified by a variety of mechanisms, some of which may employ PCR. See, for example, *PCR Technology: Principles and Applications for DNA Amplification* (Ed. H. A. Erlich, Freeman Press, NY, N.Y., 1992); *PCR Protocols: A Guide to Methods and Applications* (Eds. Innis, et al., Academic Press, San Diego, Calif., 1990); Mattila et al., *Nucleic Acids Res.* 19, 4967 (1991); Eckert et al., *PCR Methods and Applications* 1, 17 (1991); *PCR* (Eds. McPherson et al., IRL Press, Oxford); and U.S. Pat. Nos. 4,683,202, 4,683,195, 4,800,159 4,965,188, and 5,333,675, and each of which is incorporated herein by reference in their entireties for all purposes. The sample may be amplified on the array. See, for example, U.S. Pat. No. 6,300,070 and U.S. Ser. No. 09/513,300, which are incorporated herein by reference.

Other suitable amplification methods include the ligase chain reaction (LCR) (for example, Wu and Wallace, *Genomics* 4, 560 (1989), Landegren et al., *Science* 241, 1077 (1988) and Barringer et al. *Gene* 89:117 (1990)), transcription amplification (Kwoh et al., *Proc. Natl. Acad. Sci. USA* 86, 1173 (1989) and WO88/10315), self-sustained sequence replication (Guatelli et al., *Proc. Nat. Acad. Sci. USA*, 87, 1874 (1990) and WO90/06995), selective amplification of target polynucleotide sequences (U.S. Pat. No. 6,410,276), consensus sequence primed polymerase chain reaction (CP-PCR) (U.S. Pat. No. 4,437,975), arbitrarily primed polymerase chain reaction (AP-PCR) (U.S. Pat. Nos. 5,413,909, 5,861,245) and nucleic acid based sequence amplification (NABSA). (See, U.S. Pat. Nos. 5,409,818, 5,554,517, and 6,063,603, each of which is incorporated herein by reference). Other amplification methods that may be used are described in, U.S. Pat. Nos. 5,242,794, 5,494,810, 4,988,617 and in U.S. Ser. No. 09/854,317, each of which is incorporated herein by reference.

Additional methods of sample preparation and techniques for reducing the complexity of a nucleic sample are described in Dong et al., *Genome Research* 11, 1418 (2001), in U.S. Pat. No. 6,361,947, 6,391,592 and U.S. Ser. Nos. 09/916,135, 09/920,491 (U.S. patent application publication 20030096235), U.S. Ser. No. 09/910,292 (U.S. patent application publication 20030082543), and 10/013,598.

Methods for conducting polynucleotide hybridization assays have been well developed in the art. Hybridization assay procedures and conditions will vary depending on the application and are selected in accordance with the general binding methods known including those referred to in: Maniatis et al. *Molecular Cloning: A Laboratory Manual* (2nd Ed. Cold Spring Harbor, N.Y., 1989); Berger and Kimmel *Methods in Enzymology*, Vol. 152, *Guide to Molecular Cloning Techniques* (Academic Press, Inc., San Diego, Calif., 1987); Young and Davism, *P.N.A.S*, 80: 1194 (1983). Methods and apparatus for carrying out repeated and controlled hybridization reactions have been described in U.S. Pat. Nos. 5,871,928, 5,874,219, 6,045,996 and 6,386,749, 6,391,623 each of which are incorporated herein by reference The present invention also contemplates signal detection of hybridization between ligands in certain preferred embodiments. See U.S. Pat. Nos. 5,143,854, 5,578,832; 5,631,734; 5,834,758; 5,936,324; 5,981,956; 6,025,601; 6,141,096; 6,185,030; 6,201,639; 6,218,803; and 6,225,625, in U.S. Ser. No. 10/389,194 and in PCT Application PCT/US99/06097 (published as WO99/47964), each of which also is hereby incorporated by reference in its entirety for all purposes.

Methods and apparatus for signal detection and processing of intensity data are disclosed in, for example, U.S. Pat. Nos. 5,143,854, 5,547,839, 5,578,832, 5,631,734, 5,800,992, 5,834,758; 5,856,092, 5,902,723, 5,936,324, 5,981,956, 6,025,601, 6,090,555, 6,141,096, 6,185,030, 6,201,639; 6,218,803; and 6,225,625, in U.S. Ser. Nos. 10/389,194, 60/493,495 and in PCT Application PCT/US99/06097 (published as WO99/47964), each of which also is hereby incorporated by reference in its entirety for all purposes.

The practice of the present invention may also employ conventional biology methods, software and systems. Computer software products of the invention typically include computer readable medium having computer-executable instructions for performing the logic steps of the method of the invention. Suitable computer readable medium include floppy disk, CD-ROM/DVD/DVD-ROM, hard-disk drive, flash memory, ROM/RAM, magnetic tapes and etc. The computer executable instructions may be written in a suitable computer language or combination of several languages. Basic computational biology methods are described in, for example Setubal and Meidanis et al., *Introduction to Computational Biology Methods* (PWS Publishing Company, Boston, 1997); Salzberg, Searles, Kasif, (Ed.), *Computational Methods in Molecular Biology*, (Elsevier, Amsterdam, 1998); Rashidi and Buehler, *Bioinformatics*

*Basics: Application in Biological Science and Medicine* (CRC Press, London, 2000) and Ouelette and Bzevanis *Bioinformatics: A Practical Guide for Analysis of Gene and Proteins* (Wiley & Sons, Inc., 2$^{nd}$ ed., 2001). See U.S. Pat. No. 6,420,108.

The present invention may also make use of various computer program products and software for a variety of purposes, such as probe design, management of data, analysis, and instrument operation. See, U.S. Pat. Nos. 5,593,839, 5,795,716, 5,733,729, 5,974,164, 6,066,454, 6,090,555, 6,185,561, 6,188,783, 6,223,127, 6,229,911 and 6,308,170.

Additionally, the present invention may have preferred embodiments that include methods for providing genetic information over networks such as the Internet as shown in U.S. Ser. Nos. 10/97,621, 10/063,559 (U.S. publication No. 20020183936), U.S. Ser. Nos. 10/065,856, 10/065,868, 10/328,818, 10/328,872, 10/423,403, and 60/482,389. All references, patents and patent applications sited herein are incorporated by reference for all purposes.

b) Definitions

The term "array" as used herein refers to an intentionally created collection of molecules which can be prepared either synthetically or biosynthetically. The molecules in the array can be identical or different from each other. The array can assume a variety of formats, for example, libraries of soluble molecules; libraries of compounds tethered to resin beads, silica chips, or other solid supports.

The term "array plate" as used herein refers to a body having a plurality of arrays in which each microarray is separated by a physical barrier resistant to the passage of liquids and forming an area or space, referred to as a well, capable of containing liquids in contact with the probe array.

The term "biomonomer" as used herein refers to a single unit of biopolymer, which can be linked with the same or other biomonomers to form a biopolymer (for example, a single amino acid or nucleotide with two linking groups one or both of which may have removable protecting groups) or a single unit which is not part of a biopolymer. Thus, for example, a nucleotide is a biomonomer within an oligonucleotide biopolymer, and an amino acid is a biomonomer within a protein or peptide biopolymer; avidin, biotin, antibodies, antibody fragments, etc., for example, are also biomonomers.

The terms "biopolymer" and "biological polymer" as used herein are intended to mean repeating units of biological or chemical moieties. Representative biopolymers include, but are not limited to, nucleic acids, oligonucleotides, amino acids, proteins, peptides, hormones, oligosaccharides, lipids, glycolipids, lipopolysaccharides, phospholipids, synthetic analogues of the foregoing, including, but not limited to, inverted nucleotides, peptide nucleic acids, Meta-DNA, and combinations of the above.

The term "biopolymer synthesis" as used herein is intended to encompass the synthetic production, both organic and inorganic, of a biopolymer. Related to a bioploymer is a "biomonomer".

The term "cartridge" as used herein refers to a body forming an area or space referred to as a well wherein a microarray is contained and separated from the passage of liquids.

The term "combinatorial synthesis strategy" as used herein refers to a combinatorial synthesis strategy is an ordered strategy for parallel synthesis of diverse polymer sequences by sequential addition of reagents which may be represented by a reactant matrix and a switch matrix, the product of which is a product matrix. A reactant matrix is a 1 column by m row matrix of the building blocks to be added. The switch matrix is all or a subset of the binary numbers, preferably ordered, between 1 and m arranged in columns. A "binary strategy" is one in which at least two successive steps illuminate a portion, often half, of a region of interest on the substrate. In a binary synthesis strategy, all possible compounds which can be formed from an ordered set of reactants are formed. In most preferred embodiments, binary synthesis refers to a synthesis strategy which also factors a previous addition step. For example, a strategy in which a switch matrix for a masking strategy halves regions that were previously illuminated, illuminating about half of the previously illuminated region and protecting the remaining half (while also protecting about half of previously protected regions and illuminating about half of previously protected regions). It will be recognized that binary rounds may be interspersed with non-binary rounds and that only a portion of a substrate may be subjected to a binary scheme. A combinatorial "masking" strategy is a synthesis which uses light or other spatially selective deprotecting or activating agents to remove protecting groups from materials for addition of other materials such as amino acids.

The term "complementary" as used herein refers to the hybridization or base pairing between nucleotides or nucleic acids, such as, for instance, between the two strands of a double stranded DNA molecule or between an oligonucleotide primer and a primer binding site on a single stranded nucleic acid to be sequenced or amplified. Complementary nucleotides are, generally, A and T (or A and U), or C and G. Two single stranded RNA or DNA molecules are said to be complementary when the nucleotides of one strand, optimally aligned and compared and with appropriate nucleotide insertions or deletions, pair with at least about 80% of the nucleotides of the other strand, usually at least about 90% to 95%, and more preferably from about 98 to 100%. Alternatively, complementarity exists when an RNA or DNA strand will hybridize under selective hybridization conditions to its complement. Typically, selective hybridization will occur when there is at least about 65% complementary over a stretch of at least 14 to 25 nucleotides, preferably at least about 75%, more preferably at least about 90% complementary. See, M. Kanehisa Nucleic Acids Res. 12:203 (1984), incorporated herein by reference. In some aspects the probes of the array are completely complementary to the target sequence over the length of the probe. A 25 base probe, for example would be complementary over that 25 bases to a contiguous 25 bases of the target. The target may be longer than 25 bases.

The term "effective amount" as used herein refers to an amount sufficient to induce a desired result.

The term "excitation energy" as used herein refers to energy used to energize a detectable label for detection, for example illuminating a fluorescent label. Devices for this use include coherent light or non coherent light, such as lasers, UV light, light emitting diodes, an incandescent light source, or any other light or other electromagnetic source of energy having a wavelength in the excitation band of an excitable label, or capable of providing detectable transmitted, reflective, or diffused radiation.

The term "genome" as used herein is all the genetic material in the chromosomes of an organism. DNA derived from the genetic material in the chromosomes of a particular organism is genomic DNA. A genomic library is a collection of clones made from a set of randomly generated overlapping DNA fragments representing the entire genome of an organism.

The term "hybridization" as used herein refers to the process in which two single-stranded polynucleotides bind non-covalently to form a stable double-stranded polynucleotide; triple-stranded hybridization is also theoretically possible. The resulting (usually) double-stranded polynucleotide is a "hybrid." The proportion of the population of polynucleotides that forms stable hybrids is referred to herein as the "degree of hybridization." Hybridizations are usually performed under stringent conditions, for example, at a salt concentration of no more than 1 M and a temperature of at least 25° C. For example, conditions of 5×SSPE (750 mM NaCl, 50 mM NaPhosphate, 5 mM EDTA, pH 7.4) and a temperature of 25-30° C. are suitable for allele-specific probe hybridizations. For stringent conditions, see, for example, Sambrook, Fritsche and Maniatis. "Molecular Cloning A laboratory Manual" $2^{nd}$ Ed. Cold Spring Harbor Press (1989) which is hereby incorporated by reference in its entirety for all purposes above.

The term "hybridization conditions" as used herein will typically include salt concentrations of less than about 1M, more usually less than about 500 mM and preferably less than about 200 mM. Hybridization temperatures can be as low as 5° C., but are typically greater than 22° C., more typically greater than about 30° C., and preferably in excess of about 37° C. Longer fragments may require higher hybridization temperatures for specific hybridization. As other factors may affect the stringency of hybridization, including base composition and length of the complementary strands, presence of organic solvents and extent of base mismatching, the combination of parameters is more important than the absolute measure of any one alone.

The term "hybridization probes" as used herein are oligonucleotides capable of binding in a base-specific manner to a complementary strand of nucleic acid. Such probes include peptide nucleic acids, as described in Nielsen et al., Science 254, 1497-1500 (1991), and other nucleic acid analogs and nucleic acid mimetics.

The term "hybridizing specifically to" as used herein refers to the binding, duplexing, or hybridizing of a molecule only to a particular nucleotide sequence or sequences under stringent conditions when that sequence is present in a complex mixture (for example, total cellular) DNA or RNA.

The term "initiation biomonomer" or "initiator biomonomer" as used herein is meant to indicate the first biomonomer which is covalently attached via reactive nucleophiles to the surface of the polymer, or the first biomonomer which is attached to a linker or spacer arm attached to the polymer, the linker or spacer arm being attached to the polymer via reactive nucleophiles.

The term "isolated nucleic acid" as used herein mean an object species invention that is the predominant species present (i.e., on a molar basis it is more abundant than any other individual species in the composition). Preferably, an isolated nucleic acid comprises at least about 50, 80 or 90% (on a molar basis) of all macromolecular species present. Most preferably, the object species is purified to essential homogeneity (contaminant species cannot be detected in the composition by conventional detection methods).

The term "label" as used herein refers to a luminescent label, a light scattering label or a radioactive label. Fluorescent labels include, inter alia, the commercially available fluorescein phosphoramidites such as Fluoreprime (Pharmacia), Fluoredite (Millipore) and FAM (ABI). See U.S. Pat. No. 6,287,778.

The term "ligand" as used herein refers to a molecule that is recognized by a particular receptor. The agent bound by or reacting with a receptor is called a "ligand," a term which is definitionally meaningful only in terms of its counterpart receptor. The term "ligand" does not imply any particular molecular size or other structural or compositional feature other than that the substance in question is capable of binding or otherwise interacting with the receptor. Also, a ligand may serve either as the natural ligand to which the receptor binds, or as a functional analogue that may act as an agonist or antagonist. Examples of ligands that can be investigated by this invention include, but are not restricted to, agonists and antagonists for cell membrane receptors, toxins and venoms, viral epitopes, hormones (for example, opiates, steroids, etc.), hormone receptors, peptides, enzymes, enzyme substrates, substrate analogs, transition state analogs, cofactors, drugs, proteins, and antibodies.

The term "linkage disequilibrium" or sometimes refer by allelic association as used herein refers to the preferential association of a particular allele or genetic marker with a specific allele, or genetic marker at a nearby chromosomal location more frequently than expected by chance for any particular allele frequency in the population. For example, if locus X has alleles a and b, which occur equally frequently, and linked locus Y has alleles c and d, which occur equally frequently, one would expect the combination ac to occur with a frequency of 0.25. If ac occurs more frequently, then alleles a and c are in linkage disequilibrium. Linkage disequilibrium may result from natural selection of certain combination of alleles or because an allele has been introduced into a population too recently to have reached equilibrium with linked alleles.

The term "microtiter plates" as used herein refers to arrays of discrete wells that come in standard formats (96, 384 and 1536 wells) which are used for examination of the physical, chemical or biological characteristics of a quantity of samples in parallel.

The term "mixed population" or sometimes refer by "complex population" as used herein refers to any sample containing both desired and undesired nucleic acids. As a non-limiting example, a complex population of nucleic acids may be total genomic DNA, total genomic RNA or a combination thereof. Moreover, a complex population of nucleic acids may have been enriched for a given population but include other undesirable populations. For example, a complex population of nucleic acids may be a sample which has been enriched for desired messenger RNA (mRNA) sequences but still includes some undesired ribosomal RNA sequences (rRNA).

The term "monomer" as used herein refers to any member of the set of molecules that can be joined together to form an oligomer or polymer. The set of monomers useful in the present invention includes, but is not restricted to, for the example of (poly)peptide synthesis, the set of L-amino acids, D-amino acids, or synthetic amino acids. As used herein, "monomer" refers to any member of a basis set for synthesis of an oligomer. For example, dimers of L-amino acids form a basis set of 400 "monomers" for synthesis of polypeptides. Different basis sets of monomers may be used at successive steps in the synthesis of a polymer. The term "monomer" also refers to a chemical subunit that can be combined with a different chemical subunit to form a compound larger than either subunit alone.

The term "mRNA" or sometimes refer by "MRNA transcripts" as used herein, include, but not limited to pre-mRNA transcript(s), transcript processing intermediates, mature mRNA(s) ready for translation and transcripts of the gene or genes, or nucleic acids derived from the mRNA transcript(s). Transcript processing may include splicing, editing and degradation. As used herein, a nucleic acid derived from an mRNA transcript refers to a nucleic acid for whose synthesis the MRNA transcript or a subsequence thereof has ultimately served as a template. Thus, a cDNA reverse transcribed from an MRNA, an RNA transcribed from that cDNA, a DNA amplified from the cDNA, an RNA transcribed from the amplified DNA, etc., are all derived from the mRNA transcript and detection of such derived products is indicative of the presence and/or abundance of the original transcript in a sample. Thus, mRNA derived samples include, but are not limited to, mRNA transcripts of the gene or genes, cDNA reverse transcribed from the MRNA, cRNA transcribed from the cDNA, DNA amplified from the genes, RNA transcribed from amplified DNA, and the like.

The term "nucleic acid library" or sometimes refer by "array" as used herein refers to an intentionally created collection of nucleic acids which can be prepared either synthetically or biosynthetically and screened for biological activity in a variety of different formats (for example, libraries of soluble molecules; and libraries of oligos tethered to resin beads, silica chips, or other solid supports). Additionally, the term "array" is meant to include those libraries of nucleic acids which can be prepared by spotting nucleic acids of essentially any length (for example, from 1 to about 1000 nucleotide monomers in length) onto a substrate. The term "nucleic acid" as used herein refers to a polymeric form of nucleotides of any length, either ribonucleotides, deoxyribonucleotides or peptide nucleic acids (PNAs), that comprise purine and pyrimidine bases, or other natural, chemically or biochemically modified, non-natural, or derivatized nucleotide bases. The backbone of the polynucleotide can comprise sugars and phosphate groups, as may typically be found in RNA or DNA, or modified or substituted sugar or phosphate groups. A polynucleotide may comprise modified nucleotides, such as methylated nucleotides and nucleotide analogs. The sequence of nucleotides may be interrupted by non-nucleotide components. Thus the terms nucleoside, nucleotide, deoxynucleoside and deoxynucleotide generally include analogs such as those described herein. These analogs are those molecules having some structural features in common with a naturally occurring nucleoside or nucleotide such that when incorporated into a nucleic acid or oligonucleoside sequence, they allow hybridization with a naturally occurring nucleic acid sequence in solution. Typically, these analogs are derived from naturally occurring nucleosides and nucleotides by replacing and/or modifying the base, the ribose or the phosphodiester moiety. The changes can be tailor made to stabilize or destabilize hybrid formation or enhance the specificity of hybridization with a complementary nucleic acid sequence as desired.

The term "nucleic acids" as used herein may include any polymer or oligomer of pyrimidine and purine bases, preferably cytosine, thymine, and uracil, and adenine and guanine, respectively. See Albert L. Lehninger, PRINCIPLES OF BIOCHEMISTRY, at 793-800 (Worth Pub. 1982). Indeed, the present invention contemplates any deoxyribonucleotide, ribonucleotide or peptide nucleic acid component, and any chemical variants thereof, such as methylated, hydroxymethylated or glucosylated forms of these bases, and the like. The polymers or oligomers may be heterogeneous or homogeneous in composition, and may be isolated from naturally-occurring sources or may be artificially or synthetically produced. In addition, the nucleic acids may be DNA or RNA, or a mixture thereof, and may exist permanently or transitionally in single-stranded or double-stranded form, including homoduplex, heteroduplex, and hybrid states.

The term "oligonucleotide" or sometimes refer by "polynucleotide" as used herein refers to a nucleic acid ranging from at least 2, preferable at least 8, and more preferably at least 20 nucleotides in length or a compound that specifically hybridizes to a polynucleotide. Polynucleotides of the present invention include sequences of deoxyribonucleic acid (DNA) or ribonucleic acid (RNA) which may be isolated from natural sources, recombinantly produced or artificially synthesized and mimetics thereof. A further example of a polynucleotide of the present invention may be peptide nucleic acid (PNA). The invention also encompasses situations in which there is a nontraditional base pairing such as Hoogsteen base pairing which has been identified in certain tRNA molecules and postulated to exist in a triple helix. "Polynucleotide" and "oligonucleotide" are used interchangeably in this application.

The term "polymorphism" as used herein refers to the occurrence of two or more genetically determined alternative sequences or alleles in a population. A polymorphic marker or site is the locus at which divergence occurs. Preferred markers have at least two alleles, each occurring at frequency of greater than 1%, and more preferably greater than 10% or 20% of a selected population. A polymorphism may comprise one or more base changes, an insertion, a repeat, or a deletion. A polymorphic locus may be as small as one base pair. Polymorphic markers include restriction fragment length polymorphisms, variable number of tandem repeats (VNTR's), hypervariable regions, minisatellites, dinucleotide repeats, trinucleotide repeats, tetranucleotide repeats, simple sequence repeats, and insertion elements such as Alu. The first identified allelic form is arbitrarily designated as the reference form and other allelic forms are designated as alternative or variant alleles. The allelic form occurring most frequently in a selected population is sometimes referred to as the wildtype form. Diploid organisms may be homozygous or heterozygous for allelic forms. A diallelic polymorphism has two forms. A triallelic polymorphism has three forms. Single nucleotide polymorphisms (SNPs) are included in polymorphisms.

The term "primer" as used herein refers to a single-stranded oligonucleotide capable of acting as a point of initiation for template-directed DNA synthesis under suitable conditions for example, buffer and temperature, in the presence of four different nucleoside triphosphates and an agent for polymerization, such as, for example, DNA or RNA polymerase or reverse transcriptase. The length of the primer, in any given case, depends on, for example, the intended use of the primer, and generally ranges from 15 to 30 nucleotides. Short primer molecules generally require cooler temperatures to form sufficiently stable hybrid complexes with the template. A primer need not reflect the exact sequence of the template but must be sufficiently complementary to hybridize with such template. The primer site is the area of the template to which a primer hybridizes. The primer pair is a set of primers including a 5' upstream primer that hybridizes with the 5' end of the sequence to be amplified and a 3' downstream primer that hybridizes with the complement of the 3' end of the sequence to be amplified.

The term "probe" as used herein refers to a surface-immobilized molecule that can be recognized by a particular target. See U.S. Pat. No. 6,582,908 for an example of arrays having all possible combinations of probes with 10, 12, and more bases. Examples of probes that can be investigated by this invention include, but are not restricted to, agonists and antagonists for cell membrane receptors, toxins and venoms, viral epitopes, hormones (for example, opioid peptides, steroids, etc.), hormone receptors, peptides, enzymes, enzyme substrates, cofactors, drugs, lectins, sugars, oligonucleotides, nucleic acids, oligosaccharides, proteins, and monoclonal antibodies.

The term probe selection region refers to the region of the target that is used to design probes. The probes in a probe set will generally be complementary to that region. Probes may be designed to be complementary to the mRNA or to be complementary to the opposite strand. The orientation of the probes (sense or antisense) will depend on the nature of the sample that is hybridized to the array, i.e. sense or anitsense. Methods and computer software for probe selection are disclosed, for example in U.S. patent application Ser. Nos. 11/036,498, 11/036,317, 10/738,546, 10/028,416, 10/308, 379, and 11/078,138, each of which is incorporated herein by reference for all purposes.

The term "reader" or "plate reader" as used herein refers to a_device which is used to identify hybridization events on an array, such as the hybridization between a nucleic acid probe on the array and a fluorescently labeled target. Readers are known in the art and are commercially available through Affymetrix, Santa Clara Calif. and other companies. Generally, they involve the use of an excitation energy (such as a laser) to illuminate a fluorescently labeled target nucleic acid that has hybridized to the probe. Then, the reemitted radiation (at a different wavelength than the excitation energy) is detected using devices such as a CCD, PMT, photodiode, or similar devices to register the collected emissions. See U.S. Pat. No. 6,225,625.

The term "receptor" as used herein refers to a molecule that has an affinity for a given ligand. Receptors may be naturally-occurring or manmade molecules. Also, they can be employed in their unaltered state or as aggregates with other species. Receptors may be attached, covalently or noncovalently, to a binding member, either directly or via a specific binding substance. Examples of receptors which can be employed by this invention include, but are not restricted to, antibodies, cell membrane receptors, monoclonal antibodies and antisera reactive with specific antigenic determinants (such as on viruses, cells or other materials), drugs, polynucleotides, nucleic acids, peptides, cofactors, lectins, sugars, polysaccharides, cells, cellular membranes, and organelles. Receptors are sometimes referred to in the art as anti-ligands. As the term receptors is used herein, no difference in meaning is intended. A "Ligand Receptor Pair" is formed when two macromolecules have combined through molecular recognition to form a complex. Other examples of receptors which can be investigated by this invention include but are not restricted to those molecules shown in U.S. Pat. No. 5,143,854, which is hereby incorporated by reference in its entirety.

The term "solid support", "support", and "substrate" as used herein are used interchangeably and refer to a material or group of materials having a rigid or semi-rigid surface or surfaces. In many embodiments, at least one surface of the solid support will be substantially flat, although in some embodiments it may be desirable to physically separate synthesis regions for different compounds with, for example, wells, raised regions, pins, etched trenches, or the like. According to other embodiments, the solid support(s) will take the form of beads, resins, gels, microspheres, or other geometric configurations. See U.S. Pat. No. 5,744,305 for exemplary substrates.

The term "surface" or "active probe surface" or "target surface" as used herein refers to the area of the microarray to be analyzed with reagents.

The term "target" as used herein refers to a molecule that has an affinity for a given probe. Targets may be naturally-occurring or man-made molecules. Also, they can be employed in their unaltered state or as aggregates with other species. Targets may be attached, covalently or noncovalently, to a binding member, either directly or via a specific binding substance. Examples of targets which can be employed by this invention include, but are not restricted to, antibodies, cell membrane receptors, monoclonal antibodies and antisera reactive with specific antigenic determinants (such as on viruses, cells or other materials), drugs, oligonucleotides, nucleic acids, peptides, cofactors, lectins, sugars, polysaccharides, cells, cellular membranes, and organelles. Targets are sometimes referred to in the art as anti-probes. As the term targets is used herein, no difference in meaning is intended. A "Probe Target Pair" is formed when two macromolecules have combined through molecular recognition to form a complex.

The term "wafer" as used herein refers to a substrate having surface to which a plurality of arrays are bound. In a preferred embodiment, the arrays are synthesized on the surface of the substrate to create multiple arrays that are physically separate. In one preferred embodiment of a wafer, the arrays are physically separated by a distance of at least about 0.1, 0.25, 0.5, 1 or 1.5 millimeters. The arrays that are on the wafer may be identical, each one may be different, or there may be some combination thereof. Particularly preferred wafers are about 8"×8" and are made using the photolithographic process.

The term "well plate" as used herein refers to a body with a plurality of cavities open at both wherein the cavities form an area or space referred to as a well wherein each well will hold an array.

Arrays for Analysis of Compromised Samples

Arrays of short oligonucleotide probes are commonly used for a variety of methods of nucleic acid analysis. The probes which may be, for example, 15 to 100 bases in length, are typically designed to be complementary to a specific target. A preferred array includes multiple different probes that are complementary to each target. The probes may be short, for example 20-30 bases and may target overlapping or non-overlapping regions of the target. If the target is to be amplified using an amplification scheme that is biased toward the 3' end of the target it is preferable to target the 3' region for probe design as that is the region most likely to be amplified and most likely to be detected in the amplification product.

The probes on many arrays such as the Affymetrix human U133 array are designed to detect sequences that are within about 600 bases of the polyA tail. This minimizes bias resulting from 3' based amplification methods but provides a relatively large region of sequence for optimal probe design. For most sample preparations this gives satisfactory results, however, sample preparations that contain large amounts of degraded or fragmented RNA resulting from the method of preparation or from environmental exposure of the sample, may be difficult to analyze using such an array. If an RNA is fragmented at a point 3' of the region that a probe is complementary to then that probe will not generate signal from that target. During a 3' based amplification scheme a primer is extended from the 3' end of the transcript to the 5' end to make first strand cDNA. If the first strand cDNA is prematurely terminated because of a strand break in the target then any region 5' of the break will not be amplified. In a preferred embodiment of the disclosed invention probes for an array are designed based on the sequence of the MRNA that is within about 300 bases proximal to the 3' end of the mRNA. The probe selection region for each target mRNA is selected to be bound on the 3' end by the 5' end of the poly(A) tail and to extend 300 bases 5' of that 3' boundary.

For any given MRNA there preferably are a plurality of different probes that hybridize to the target, for example, there may be 2 to 16 probe pairs for a single mRNA target. The probe pairs or probes directed at a given target make up a probe set for that target. In a preferred aspect there are 8, 9, 10, 11 or 12 probe pairs for each target. If probe pairs are used, perfect match and mismatch probes, the probe set would thus include 16, 18, 20, 22 or 24 probes. In some aspects different targets may have different numbers of probe pairs, for example, for some targets being interrogated by the array there may be 11 probe pairs, for other targets being interrogated by the array there may be 9, 10 or 12 probe pairs. A probe pair is the perfect match probe and the corresponding mismatch probe. In some aspects all or some of the probe sets include only perfect match probes and mismatch probes are not used. In a preferred aspect the mismatch probe is identical to the perfect match probe except for the central position which is a different base that is not complementary to the target at that position. For example, in a 25 mer probe the $13^{th}$ base is the mismatch position.

Arrays for use with samples that may have some degree of degradation such as formalin fixed paraffin embedded (FFPE) samples may be designed to improve detection of degraded samples. Biopsy samples from tumors are routinely stored after surgical procedures by FFPE, which may compromise DNA and RNA integrity. In a preferred embodiment the probes of the array are designed to hybridize to a region of the mRNA that is within 300 bases of the 3' end of the mRNA (probe selection region). In some aspects the probe selection region is the 200, 350, 400, or 500 bases immediately 5' of the poly(A) tail.

Recent advances in laser-capture microdissection (LCM) facilitate the investigation of cancer by allowing isolation of pure cell populations that can be evaluated for changes in gene expression or genomic material that accompany the development of cancer. Methods to extract high-quality genetic material from archived clinical samples have been limited though, resulting in samples that may be difficult to analyze by microarray based methods. Fine needle aspiration or ductal lavage, for example, may be used to obtain samples of cells from a tissue of interest. Ductal lavage is a washing procedure that can identify cancerous and precancerous cells in the milk ducts of the breast. The procedure involves threading a hair-thin catheter into the duct opening in the nipple, infusing a saline solution through the catheter into the duct and sucking the saline solution and some cells back out. The cells are collected and analyzed. Microdissection may also be used to obtain sample. Reagent kits, for example, the Paradise Reagent System from Arcturus, have been developed to facilitate analysis of FFPE samples.

In many methods of gene expression analysis the MRNA is amplified prior to hybridization using a method of amplification that is biased toward amplification of the 3' end. For example, mRNA may be reverse transcribed using an primer containing a 3' oligo dT region and a 5' phage promoter sequence, (T7, T3, SP6 for example). The first strand cDNA is then used as template for second strand cDNA synthesis resulting in a double stranded cDNA with a promoter for an RNA polymerase. Multiple copies of antisense RNA may be transcribed. These may be labeled and used for hybridization to an array. This amplification method is typically biased toward amplification of the 3' end of the MRNA since reverse transcription is primed from the 3' end. The amount of bias may be increased for mRNAs that are longer. Amplification methods that prime amplification from the 3' end of mRNAs also result in reduced amplification of mRNAs that have been degraded. For example, if an mRNA has been fragmented into two portions, a 5' portion and a 3' portion, only the 3' portion which carries the poly A tail will be amplified. The amplification products won't hybridize to any probes that are 5' of the break in the mRNA. To minimize the loss of signal do to degradation an array with probes designed to be closer to the 3' end of the mRNA are disclosed.

The arrays disclosed herein are particularly well suited for whole-genome expression profiling of formalin-fixed, paraffin embedded (FFPE) samples or other samples that may be compromised or more degraded than a normal sample used for expression analysis, for example, archived samples or forensic samples. In one aspect the arrays disclosed herein may be used to hybridize samples prepared using the Paradise™ Reagent System from Arcturus for expression analysis of FFPE samples.

FFPE samples introduce unique challenges for microarray analysis, including potential fragmentation and chemical modification of RNA molecules. In order to overcome these challenges, the Paradise Reagent System was developed to provide RNA isolation and amplification reagents optimized for FFPE samples. The resulting amplified RNA may be analyzed by hybridization to an array designed to focus on interrogating sequences located closer to the 3' end of the transcripts compared with standard arrays. Together, the reagents and array accommodate the characteristics of the FFPE RNA samples, enabling genome-wide profiling.

In one aspect the target sequences on the array are identical to those used for designing the GeneChip Human Genome U133 Plus 2.0 Array, for a total of more than 47,000 transcripts with more than 61,000 probe sets, although the probes on the two types of arrays are significantly different. The probe selection criteria for the arrays disclosed herein are modified to accommodate the unique characteristics of FFPE samples. The probe selection region in one aspect is restricted to the 300 bases at the most 3' end of the transcripts immediately upstream of the poly(A) tail. In contrast, the design strategy for other arrays employed selection of probe sets within the region 600 bases proximal to the 3' ends of targets.

In some aspects some targets were not amenable to selection of high-performance probe sets within the shorter probe selection region and for approximately 4,000 transcripts, two sets of probe sets were selected for an array 1) the original probe sets from the standard HG-U133 Plus 2.0 Array design, and 2) a new, more 3' probe set that did not meet the minimum probe score selection threshold but is more biased toward the 3' end. In addition, for fewer than 200 transcripts where no probe sets within the smaller (300 bps) probe selection region could be found, only the HG-U133 Plus 2.0 Array probe sets are represented on the array.

Oligonucleotide probes are synthesized in situ complementary to each corresponding sequence. For many target sequences eleven pairs of oligonucleotide probes are used to measure the level of transcription of each sequence represented. Each probe is synthesized in a different feature of the array or associated with a different feature of the array and the location of the probes is known or determinable. In some aspects each probe is attached to a bead and the array is an array of beads. The beads may be associated with a solid support in a manner that allows determination of the location of different probe sequences, for example, through marking each bead or probe with a detectable marker such as a tag. The tag may be a sequence associated with the probe.

Preferred arrays have more than 100,000, more than 500,000, more than 1,000,000, more than 5,000,000 or more than 10,000,000 different features or probes. However, arrays with fewer probes are also contemplated. For example, arrays with 1,000 to 2,000, 2,000 to 5,000 or 5,000 to 100,000 probes are contemplated. In some aspects arrays are designed to interrogate a selected set of transcripts. The transcripts for interrogation may be from genes that have been associated with a particular disease state, for example genes that are known to be differentially expressed in a particular type of cancer, a particular stage of cancer, or associated with a particular treatment outcome. Gene expression profiles have been identified that are associated with, for example, breast cancer, prostate cancer, and lung cancer or with different stages or treatment outcomes of these cancers. Gene expression profiles that are associated with many different cancers or disease states have been identified by researchers and are continually being identified and further refined. Arrays that target a subset of genes which may be measured to diagnose, stage or predict treatment outcome are contemplated. The arrays, preferably would target the region 300 bases upstream of the poly A site as a probe selection region. Preferably all of the probes of a probe set for a selected target are complementary to a region within the probe selection region.

In a preferred aspect the arrays disclosed herein include a plurality of control probes. Control probes may include, for example, probes to a plurality of different human maintenance genes. The maintenance genes may be used to facilitate the normalization and scaling of array experiments. In a preferred aspect the control probe sets are the same as the control probe sets on the HG-U133 Plus 2.0 Array. This set of genes serves as a tool to normalize or scale your data prior to performing data comparison. This set of normalization genes shows consistent levels of expression over a diverse set of tissues. Mask files enabling the use of these probe sets for normalization and scaling are available on the Affymetrix web site.

In a preferred embodiment the array is designed to detect human genes, but arrays may be designed using the disclosed methods to detect expression of any organism, for example, rat, mouse, fly, Arabidopsis, yeast, E. coli, bovine, chicken and zebra fish.

In a preferred embodiment the array is designed to detect more than 40,000 different transcripts from human. Other human arrays and methods of using human arrays are disclosed in U.S. patent application Ser. No. 10/355,577 (publication No. 20030198983A1), U.S. Ser. Nos. 09/953, 115, 10/098,263, and 09/660,222 the disclosures of which are incorporated herein by reference in their entireties for all purposes.

Other methods of making or using arrays or of preparing samples for analysis are disclosed in U.S. Pat. Nos. 6,610,482, 6,576,424 and 6,506,558, and in U.S. patent publication No. 20050014168 which are incorporated herein by reference in their entireties. In some aspects arrays are designed to target alternatively spliced products.

In addition to arrays the invention also provides articles of manufacture such as kits for the practice of the methods of the invention. In a preferred aspect the kits contain a reagent set comprising buffers, primers and enzymes ready to load into one or more reaction tubes along with extracted or amplified nucleic acid samples, as a non-limiting example. The sequences of the primer or primers preferably comprise a sequence that is complementary to the 3' region of one or more cellular transcripts, oligo dT for example, and capable of quantitatively amplifying sequences within the 3' region as described herein. In another aspect the reagent set is packaged in a kit with one or more arrays as disclosed herein. The reagent set may be optimized for amplification of the 300 bases immediately 5' of the polyA tail of mRNA. A kit according to the present invention also preferably comprises suitable packaging material. Preferably, the packaging includes a label or instructions for the use of the article in a method disclosed herein.

EXAMPLE 1

The GeneChip X3P array was designed for whole genome analysis of degraded samples, such as FFPE samples. The array comprises a plurality of individual features. An oligo of known sequence is synthesized in each feature of the array. Each of SEQ ID NOs: 1-673,904 is present on the array in a different feature on the array, for example, there is a feature that comprises multiple copies of SEQ ID NO: 1 and a second feature the includes multiple copies of SEQ ID NO: 2 and so on. The feature may also include prematurely terminated probes. The location of the features and the sequence of the oligonucleotides present at each feature are known. A nucleic acid sample is obtained and prepared using the Paradise Reagent System from Arcturus. The labeled sample is hybridized to the array according to the protocol provided in the Affymetrix GeneChip Expression Analysis Technical Manual Rev. 5 (PN 701021) which is incorporated herein by reference in its entirety for all purposes. The hybridization pattern is analyzed and relative levels of expression for different transcripts can be determined. Exogenously added controls and endogenous transcripts may be used to normalize expression measurements between samples.

CONCLUSION

It is to be understood that the above description is intended to be illustrative and not restrictive. Many variations of the invention will be apparent to those of skill in the art upon reviewing the above description. The scope of the invention should be determined with reference to the appended claims, along with the full scope of equivalents to which such claims are entitled. All cited references, including patent and non-patent literature, are incorporated herewith by reference in their entireties for all purposes.

SEQUENCE LISTING (673904 sequences)

SEQ ID NO: 1 - DNA, 25 bp, Homo sapien
agggtggcaggaactgcctcactcc

SEQ ID NO: 2 - DNA, 25 bp, Homo sapien
gggtggcaggaactgcctcactcct

SEQ ID NO: 3 - DNA, 25 bp, Homo sapien
ggcaggaactgcctcactcctagga

SEQ ID NO: 4 - DNA, 25 bp, Homo sapien
aggaactgcctcactcctaggaact

SEQ ID NO: 5 - DNA, 25 bp, Homo sapien
ggaactgcctcactcctaggaactg

SEQ ID NO: 6 - DNA, 25 bp, Homo sapien
ttgagggtgtccagcgcccttaggt

SEQ ID NO: 7 - DNA, 25 bp, Homo sapien
tgagggtgtccagcgcccttaggtc

SEQ ID NO: 8 - DNA, 25 bp, Homo sapien
gtgtccagcgcccttaggtcatttt

SEQ ID NO: 9 - DNA, 25 bp, Homo sapien
tgtccagcgcccttaggtcattttc

SEQ ID NO: 10 - DNA, 25 bp, Homo sapien
gtccagcgcccttaggtcattttct

SEQ ID NO: 11 - DNA, 25 bp, Homo sapien
tcccttttctggattctcaagcagt

SEQ ID NO: 12 - DNA, 25 bp, Homo sapien
aattatcacaacgaccttttcaagt

SEQ ID NO: 13 - DNA, 25 bp, Homo sapien
ttatcacaacgaccttttcaagtag

SEQ ID NO: 14 - DNA, 25 bp, Homo sapien
acaacgaccttttcaagtaggcatt

SEQ ID NO: 15 - DNA, 25 bp, Homo sapien
acaggttgaggaccgtgaggcacgc

SEQ ID NO: 16 - DNA, 25 bp, Homo sapien
tgaggcacgctggagttatttgact

SEQ ID NO: 17 - DNA, 25 bp, Homo sapien
ggcacgctggagttatttgactcga

SEQ ID NO: 18 - DNA, 25 bp, Homo sapien
gagttatttgactcgacttgcccag

SEQ ID NO: 19 - DNA, 25 bp, Homo sapien
ttatttgactcgacttgcccagggt

SEQ ID NO: 20 - DNA, 25 bp, Homo sapien
ttcccgaaagaaggtccaccatcag

SEQ ID NO: 21 - DNA, 25 bp, Homo sapien
gatgaatatggaacatctcctatgt

SEQ ID NO: 22 - DNA, 25 bp, Homo sapien
aatatggaacatctcctatgtacca

SEQ ID NO: 23 - DNA, 25 bp, Homo sapien
tgggtcaccctcctatgcagaaggg

SEQ ID NO: 24 - DNA, 25 bp, Homo sapien
gtgaggcctcagtgttcacccatct

SEQ ID NO: 25 - DNA, 25 bp, Homo sapien
cagtgttcacccatctgttctgtct

SEQ ID NO: 26 - DNA, 25 bp, Homo sapien
tttctctagagaaactcactgcaga

SEQ ID NO: 27 - DNA, 25 bp, Homo sapien
ggaaaagcttcagacagagcttggt

SEQ ID NO: 28 - DNA, 25 bp, Homo sapien
gacagagcttggtaagtgacccctc

SEQ ID NO: 29 - DNA, 25 bp, Homo sapien
gcttggtaagtgacccctcttagaa

SEQ ID NO: 30 - DNA, 25 bp, Homo sapien
ggtaagtgacccctcttagaactat

SEQ ID NO: 31 - DNA, 25 bp, Homo sapien
agtgacccctcttagaactatttct

SEQ ID NO: 32 - DNA, 25 bp, Homo sapien
gacccctcttagaactatttctcct

SEQ ID NO: 33 - DNA, 25 bp, Homo sapien
tatttctcctcagggccgggtccag

SEQ ID NO: 34 - DNA, 25 bp, Homo sapien
ttatccttctacttatggcctagcc

SEQ ID NO: 35 - DNA, 25 bp, Homo sapien
tagcccagtggttcaatgacctcct

SEQ ID NO: 36 - DNA, 25 bp, Homo sapien
gagaactcgatacttggacacaaga

SEQ ID NO: 37 - DNA, 25 bp, Homo sapien
tgtcgtgtggctatccggcttcttc

SEQ ID NO: 38 - DNA, 25 bp, Homo sapien
agtccttcttaactgcaatcatgca

SEQ ID NO: 39 - DNA, 25 bp, Homo sapien
gctcgaaaaaatgagtggcccctgg

SEQ ID NO: 40 - DNA, 25 bp, Homo sapien
tggcccctggataaaacgcgcttga

SEQ ID NO: 41 - DNA, 25 bp, Homo sapien
acgcgcttgactgctgatgttacca

SEQ ID NO: 42 - DNA, 25 bp, Homo sapien
aagattatggacacccgccaaggga

SEQ ID NO: 43 - DNA, 25 bp, Homo sapien
gggacacccaagcaggaaccattgt

SEQ ID NO: 44 - DNA, 25 bp, Homo sapien
gaaccattgttgaagcccgtctcaa

SEQ ID NO: 45 - DNA, 25 bp, Homo sapien
ttttttgtgatgagatctcgctctg

SEQ ID NO: 46 - DNA, 25 bp, Homo sapien
tttttgtgatgagatctcgctctgt

SEQ ID NO: 47 - DNA, 25 bp, Homo sapien
cctcaagtgatgctctcaccctggc

SEQ ID NO: 48 - DNA, 25 bp, Homo sapien
aggattacaggccatttcaactatt

SEQ ID NO: 49 - DNA, 25 bp, Homo sapien
ggattacaggccatttcaactattt

SEQ ID NO: 50 - DNA, 25 bp, Homo sapien
gattacaggccatttcaactatttt

SEQ ID NO: 51 - DNA, 25 bp, Homo sapien
attacaggccatttcaactattttt

SEQ ID NO: 52 - DNA, 25 bp, Homo sapien
ttacaggccatttcaactatttttt

SEQ ID NO: 53 - DNA, 25 bp, Homo sapien
tacaggccatttcaactattttttg

SEQ ID NO: 54 - DNA, 25 bp, Homo sapien
caggccatttcaactattttttgtt

SEQ ID NO: 55 - DNA, 25 bp, Homo sapien
ggccatttcaactattttttgtttg

SEQ ID NO: 56 - DNA, 25 bp, Homo sapien
aaacaggaatcctctccccaaaatg

SEQ ID NO: 57 - DNA, 25 bp, Homo sapien
caggaatcctctccccaaaatgggt

SEQ ID NO: 58 - DNA, 25 bp, Homo sapien
ggtacagaggccaaagacgcagctg

SEQ ID NO: 59 - DNA, 25 bp, Homo sapien
ggccaaagacgcagctgcatgtcct

SEQ ID NO: 60 - DNA, 25 bp, Homo sapien
gacgccccgtagtgaagagtgatgt

SEQ ID NO: 61 - DNA, 25 bp, Homo sapien
gaagagtgatgtggcccaaatgtca

SEQ ID NO: 62 - DNA, 25 bp, Homo sapien
agtgccagtgtcagactcctgctaa

SEQ ID NO: 63 - DNA, 25 bp, Homo sapien
cagtgtcagactcctgctaagagac

SEQ ID NO: 64 - DNA, 25 bp, Homo sapien
gactcctgctaagagacagtatcaa

SEQ ID NO: 65 - DNA, 25 bp, Homo sapien
aatacactttctggaggcctggcgc

SEQ ID NO: 66 - DNA, 25 bp, Homo sapien
acactttctggaggcctggcgcggt

SEQ ID NO: 67 - DNA, 25 bp, Homo sapien
gtcaagtgtcattagcaactgttgc

SEQ ID NO: 68 - DNA, 25 bp, Homo sapien
aactgttgctgtggatgactttgaa

SEQ ID NO: 69 - DNA, 25 bp, Homo sapien
gtggatgtagtcaccctctctggga

SEQ ID NO: 70 - DNA, 25 bp, Homo sapien
tctctgggatgccttacctctcttt

SEQ ID NO: 71 - DNA, 25 bp, Homo sapien
tctctttcccttgacctatttcaat

SEQ ID NO: 72 - DNA, 25 bp, Homo sapien
atccagctttcatcttccatcaatg

SEQ ID NO: 73 - DNA, 25 bp, Homo sapien
tttgggcatgccagcccatggagtg

SEQ ID NO: 74 - DNA, 25 bp, Homo sapien
atggagtgctctcccactggcaaca

SEQ ID NO: 75 - DNA, 25 bp, Homo sapien
tcccactggcaacatcttgtagctt

SEQ ID NO: 76 - DNA, 25 bp, Homo sapien
cttctgtttttagcactgtagacac

SEQ ID NO: 77 - DNA, 25 bp, Homo sapien
ttatgtggtcatgccgttgtttttc

SEQ ID NO: 78 - DNA, 25 bp, Homo sapien
ctaatggcatcctgagcgtgacagc

SEQ ID NO: 79 - DNA, 25 bp, Homo sapien
ccaaaaactcgctggaggcccatgt

SEQ ID NO: 80 - DNA, 25 bp, Homo sapien
tggaggcccatgtcttccatgtgaa

SEQ ID NO: 81 - DNA, 25 bp, Homo sapien
cccatgtcttccatgtgaaaggttc

SEQ ID NO: 82 - DNA, 25 bp, Homo sapien
tcttccatgtgaaaggttctttgca

SEQ ID NO: 83 - DNA, 25 bp, Homo sapien
ttagggacaagattcccgaagagga

SEQ ID NO: 84 - DNA, 25 bp, Homo sapien
acaagattcccgaagaggacaggcg

SEQ ID NO: 85 - DNA, 25 bp, Homo sapien
ttcccgaagaggacaggcgcaaaat

SEQ ID NO: 86 - DNA, 25 bp, Homo sapien
tgcaagacaagtgtcgggaagtcct

SEQ ID NO: 87 - DNA, 25 bp, Homo sapien
acaagtgtcgggaagtccttgcctg

SEQ ID NO: 88 - DNA, 25 bp, Homo sapien
gtcgggaagtccttgcctggctgga

SEQ ID NO: 89 - DNA, 25 bp, Homo sapien
ttgcctggctggagcacaaccagct

SEQ ID NO: 90 - DNA, 25 bp, Homo sapien
agctggagcaaatctgtcgccccat

SEQ ID NO: 91 - DNA, 25 bp, Homo sapien
ggggcagcagttgtggcactcaagc

SEQ ID NO: 92 - DNA, 25 bp, Homo sapien
gcagttgtggcactcaagcccgcca

SEQ ID NO: 93 - DNA, 25 bp, Homo sapien
gtggcactcaagcccgccaggggga

SEQ ID NO: 94 - DNA, 25 bp, Homo sapien
tcactctctcaatcttatccatcat

SEQ ID NO: 95 - DNA, 25 bp, Homo sapien
actctctcaatcttatccatcatag

SEQ ID NO: 96 - DNA, 25 bp, Homo sapien
caatcttatccatcatagcaggcag

SEQ ID NO: 97 - DNA, 25 bp, Homo sapien
tcttatccatcatagcaggcagttg

SEQ ID NO: 98 - DNA, 25 bp, Homo sapien
atccatcatagcaggcagttgaggt

SEQ ID NO: 99 - DNA, 25 bp, Homo sapien
taccgtacaaccctaacataaccat

SEQ ID NO: 100 - DNA, 25 bp, Homo sapien
gtacaaccctaacataaccattctt

SEQ ID NO: 101 - DNA, 25 bp, Homo sapien
aactatttatattatcctaactact

SEQ ID NO: 102 - DNA, 25 bp, Homo sapien
gaattcacaaaaaacaatagcctca

SEQ ID NO: 103 - DNA, 25 bp, Homo sapien
taatctactccacctcaatcacact

SEQ ID NO: 104 - DNA, 25 bp, Homo sapien
tactccccatatctaacaacgtaaa

SEQ ID NO: 105 - DNA, 25 bp, Homo sapien
agtgtgagggatgctgaatctccca

SEQ ID NO: 106 - DNA, 25 bp, Homo sapien
ggatgctgaatctcccagagagctc

SEQ ID NO: 107 - DNA, 25 bp, Homo sapien
tgaatctcccagagagctcacactg

SEQ ID NO: 108 - DNA, 25 bp, Homo sapien
cagagagctcacactggccaggaat

SEQ ID NO: 109 - DNA, 25 bp, Homo sapien
cacactggccaggaatgctgagagt

SEQ ID NO: 110 - DNA, 25 bp, Homo sapien
tgctgagagtagcagatgcttttct

SEQ ID NO: 111 - DNA, 25 bp, Homo sapien
aatttagaaccagatatgctttgtc

SEQ ID NO: 112 - DNA, 25 bp, Homo sapien
gaaccagatatgctttgtcttgatt

SEQ ID NO: 113 - DNA, 25 bp, Homo sapien
aaaagtggccaggagcggtagctca

SEQ ID NO: 114 - DNA, 25 bp, Homo sapien
ggccaggagcggtagctcatacttg

SEQ ID NO: 115 - DNA, 25 bp, Homo sapien
gctgggtgtgatggccacttgggag

SEQ ID NO: 116 - DNA, 25 bp, Homo sapien
gtttttagttattttgggctgccat

SEQ ID NO: 117 - DNA, 25 bp, Homo sapien
tttttagttattttgggctgccata

SEQ ID NO: 118 - DNA, 25 bp, Homo sapien
tttagttattttgggctgccatatt

SEQ ID NO: 119 - DNA, 25 bp, Homo sapien
gttattttgggctgccatattgaat

SEQ ID NO: 120 - DNA, 25 bp, Homo sapien
tttgggctgccatattgaatttttt

SEQ ID NO: 121 - DNA, 25 bp, Homo sapien
tgggctgccatattgaattttttgt

SEQ ID NO: 122 - DNA, 25 bp, Homo sapien
gctaagttttgtattgccatattga

SEQ ID NO: 123 - DNA, 25 bp, Homo sapien
aagttttgtattgccatattgaatt

SEQ ID NO: 124 - DNA, 25 bp, Homo sapien
tgtattgccatattgaatttttgtt

SEQ ID NO: 125 - DNA, 25 bp, Homo sapien
aagatatgtgtttatgtttccagtt

SEQ ID NO: 126 - DNA, 25 bp, Homo sapien
ttacctttcactatttataataaag

SEQ ID NO: 127 - DNA, 25 bp, Homo sapien
aaatggtactacctctttggagagc

SEQ ID NO: 128 - DNA, 25 bp, Homo sapien
gagctttctggcaatatggacccaa

SEQ ID NO: 129 - DNA, 25 bp, Homo sapien
tgcaaattacatgtgccctctaacc

SEQ ID NO: 130 - DNA, 25 bp, Homo sapien
tgggcccgaagtcatctgcacaagg

SEQ ID NO: 131 - DNA, 25 bp, Homo sapien
gcacaaggctaccaactgcaatgtc

SEQ ID NO: 132 - DNA, 25 bp, Homo sapien
ttgcagcagcaaaacacgggatccc

SEQ ID NO: 133 - DNA, 25 bp, Homo sapien
acatctgggaggttctattggctga

SEQ ID NO: 134 - DNA, 25 bp, Homo sapien
agtactcagagaatggaagcaccac

SEQ ID NO: 135 - DNA, 25 bp, Homo sapien
attggagcagtcttcaagttggtga

SEQ ID NO: 136 - DNA, 25 bp, Homo sapien
gggagatcctacctctacaagaaaa

SEQ ID NO: 137 - DNA, 25 bp, Homo sapien
gcttgagcccatgaagtcaggctgc

SEQ ID NO: 138 - DNA, 25 bp, Homo sapien
cagtcatctgctgcccttggctgtt

SEQ ID NO: 139 - DNA, 25 bp, Homo sapien
aagaggcctggaggccactatggaa

SEQ ID NO: 140 - DNA, 25 bp, Homo sapien
ctttcccagccctgtggtcttggga

SEQ ID NO: 141 - DNA, 25 bp, Homo sapien
agtcatttaactctgctaagcctca

SEQ ID NO: 142 - DNA, 25 bp, Homo sapien
aagtgggaagaatcctctccacctt

SEQ ID NO: 143 - DNA, 25 bp, Homo sapien
tctccaccttaagccttgctatgag

SEQ ID NO: 144 - DNA, 25 bp, Homo sapien
atgagatgcgtgtacagagtttagt

SEQ ID NO: 145 - DNA, 25 bp, Homo sapien
agagtttagtacacggcctgccaca

SEQ ID NO: 146 - DNA, 25 bp, Homo sapien
gcctgccacattgtgagtgctcaat

SEQ ID NO: 147 - DNA, 25 bp, Homo sapien
caataaatgttggccgttctcttca

SEQ ID NO: 148 - DNA, 25 bp, Homo sapien
actctctgaaatcaccttgttctcc

SEQ ID NO: 149 - DNA, 25 bp, Homo sapien
gggttctcttgagtctgtactgagg

SEQ ID NO: 150 - DNA, 25 bp, Homo sapien
gagtctgtactgaggaccagcctgt

SEQ ID NO: 151 - DNA, 25 bp, Homo sapien
aggaccagcctgtacatgtatagaa

SEQ ID NO: 152 - DNA, 25 bp, Homo sapien
agaagaaaactccacaaagccaggc

SEQ ID NO: 153 - DNA, 25 bp, Homo sapien
ggagcatgtaaggtgaacaacttcc

SEQ ID NO: 154 - DNA, 25 bp, Homo sapien
agacctcgcacacggtcatgacata

SEQ ID NO: 155 - DNA, 25 bp, Homo sapien
ggtcatgacatactgaagctccagc

SEQ ID NO: 156 - DNA, 25 bp, Homo sapien
ggagactcaggaggagccacaccgt

SEQ ID NO: 157 - DNA, 25 bp, Homo sapien
gccacaccgtgggaacagggctgat

SEQ ID NO: 158 - DNA, 25 bp, Homo sapien
gctcgtctagaacctgcctgagaaa

SEQ ID NO: 159 - DNA, 25 bp, Homo sapien
ctgcagctacagaaatccaaggcct

SEQ ID NO: 160 - DNA, 25 bp, Homo sapien
atgggagctgagaaagtccaatcct

SEQ ID NO: 161 - DNA, 25 bp, Homo sapien
agctgagaaagtccaatcctgagat

SEQ ID NO: 162 - DNA, 25 bp, Homo sapien
ccctgacaacagtctccccaaaagt

SEQ ID NO: 163 - DNA, 25 bp, Homo sapien
aaaagtgaccacatcaccaggctca

SEQ ID NO: 164 - DNA, 25 bp, Homo sapien
atcaccaggctcagttccaggaagg

SEQ ID NO: 165 - DNA, 25 bp, Homo sapien
tgcccagtacactgaggatgcacct

SEQ ID NO: 166 - DNA, 25 bp, Homo sapien
gaggatgcacctcagttacataaaa

SEQ ID NO: 167 - DNA, 25 bp, Homo sapien
aatgaaactggagtactaacgtaca

SEQ ID NO: 168 - DNA, 25 bp, Homo sapien
tggagtactaacgtacagtttaaag

SEQ ID NO: 169 - DNA, 25 bp, Homo sapien
gagttcatgcatgtgttaaattgct

SEQ ID NO: 170 - DNA, 25 bp, Homo sapien
taaattgctttactgtagtaatcat

SEQ ID NO: 171 - DNA, 25 bp, Homo sapien
ggagactgtctcactgatgttgatt

SEQ ID NO: 172 - DNA, 25 bp, Homo sapien
tattcatttccgcatctgttacacg

SEQ ID NO: 173 - DNA, 25 bp, Homo sapien
tccgcatctgttacacgaacttcgt

SEQ ID NO: 174 - DNA, 25 bp, Homo sapien
gaacttcgtgtcataaattgctatc

SEQ ID NO: 175 - DNA, 25 bp, Homo sapien
ataaattgctatcctttcatttgaa

SEQ ID NO: 176 - DNA, 25 bp, Homo sapien
ttcctgcatttttatcatttctgta

SEQ ID NO: 177 - DNA, 25 bp, Homo sapien
gattgttatgttaggcgacactgta

SEQ ID NO: 178 - DNA, 25 bp, Homo sapien
gttaggcgacactgtataaaattgt

SEQ ID NO: 179 - DNA, 25 bp, Homo sapien
agtaaaattcacatgtatttccttt

SEQ ID NO: 180 - DNA, 25 bp, Homo sapien
tttcatccaatttcttgacaacttg

SEQ ID NO: 181 - DNA, 25 bp, Homo sapien
taaatttcataaagagccttcctaa

SEQ ID NO: 182 - DNA, 25 bp, Homo sapien
atctcatcaacaaccgactaatcac

SEQ ID NO: 183 - DNA, 25 bp, Homo sapien
gactaatcaaactaacctcaaaaca

SEQ ID NO: 184 - DNA, 25 bp, Homo sapien
taaccatacacaacactaaaggacg

SEQ ID NO: 185 - DNA, 25 bp, Homo sapien
ggacgaacctgatctcttatactag

SEQ ID NO: 186 - DNA, 25 bp, Homo sapien
cttatactagtatccttaatcattt

SEQ ID NO: 187 - DNA, 25 bp, Homo sapien
ttttattgccacaactaacctcctc

SEQ ID NO: 188 - DNA, 25 bp, Homo sapien
accacccaactatctataaacctag

SEQ ID NO: 189 - DNA, 25 bp, Homo sapien
atctataaacctagccatggccatc

SEQ ID NO: 190 - DNA, 25 bp, Homo sapien
gctttcgctctaagattaaaaatgc

SEQ ID NO: 191 - DNA, 25 bp, Homo sapien
actcatgcacctaattggaagcgcc

SEQ ID NO: 192 - DNA, 25 bp, Homo sapien
gcacctaattggaagcgccacccta

SEQ ID NO: 193 - DNA, 25 bp, Homo sapien
tgctgcgacctctctatatggatgt

SEQ ID NO: 194 - DNA, 25 bp, Homo sapien
atgtgcaagctacaactcctctgga

SEQ ID NO: 195 - DNA, 25 bp, Homo sapien
ggtgcttgatgccatgctcccttac

SEQ ID NO: 196 - DNA, 25 bp, Homo sapien
tgctcccttacctaatcaactacta

SEQ ID NO: 197 - DNA, 25 bp, Homo sapien
taatcaactactatgggaacccaca

SEQ ID NO: 198 - DNA, 25 bp, Homo sapien
actcccggacacatgcttatggctg

SEQ ID NO: 199 - DNA, 25 bp, Homo sapien
aggcagccatggaacgtgctcgtca

SEQ ID NO: 200 - DNA, 25 bp, Homo sapien
gtgctcgtcagcaagtagcatctct

SEQ ID NO: 201 - DNA, 25 bp, Homo sapien
atctctgattggagctgatcctcgt

SEQ ID NO: 202 - DNA, 25 bp, Homo sapien
atcctcgtgagatcatttttactag

SEQ ID NO: 203 - DNA, 25 bp, Homo sapien
tactagtggtgctactgaatccaac

SEQ ID NO: 204 - DNA, 25 bp, Homo sapien
agaggcatgctcctggcatcgagtg

SEQ ID NO: 205 - DNA, 25 bp, Homo sapien
ggtggagaccagagaagccgctcaa

SEQ ID NO: 206 - DNA, 25 bp, Homo sapien
agaagccgctcaacatcctgcaatg

SEQ ID NO: 207 - DNA, 25 bp, Homo sapien
tcctgcaatgcatgggacaggccct

SEQ ID NO: 208 - DNA, 25 bp, Homo sapien
atgggacaggccctgcctagaaaca

SEQ ID NO: 209 - DNA, 25 bp, Homo sapien
tgcctagaaacaccagctcagcatg

SEQ ID NO: 210 - DNA, 25 bp, Homo sapien
accagctcagcatggcagcagtgcg

SEQ ID NO: 211 - DNA, 25 bp, Homo sapien
gaggccaggaaaccctgatcgccag

SEQ ID NO: 212 - DNA, 25 bp, Homo sapien
ggaaaccctgatcgccagtttctaa

SEQ ID NO: 213 - DNA, 25 bp, Homo sapien
tgatcgccagtttctaacgccctca

SEQ ID NO: 214 - DNA, 25 bp, Homo sapien
tctaacgccctcaccatttttattt

SEQ ID NO: 215 - DNA, 25 bp, Homo sapien
ataaatatgtcggtgctggaatgct

SEQ ID NO: 216 - DNA, 25 bp, Homo sapien
gtcggtgctggaatgcttaggaatt

SEQ ID NO: 217 - DNA, 25 bp, Homo sapien
cttcttttgagattattgctgtcca

SEQ ID NO: 218 - DNA, 25 bp, Homo sapien
tattgctgtccatatttaggtttca

SEQ ID NO: 219 - DNA, 25 bp, Homo sapien
gtgcattgatataacagctgtttcc

SEQ ID NO: 220 - DNA, 25 bp, Homo sapien
gctgtttcctttcatactctgtaga

SEQ ID NO: 221 - DNA, 25 bp, Homo sapien
actctgtagattatgtatctgccta

SEQ ID NO: 222 - DNA, 25 bp, Homo sapien
ggaggctttgaatgtatcataatca

SEQ ID NO: 223 - DNA, 25 bp, Homo sapien
gtatcaacctaaatgcttcttttat

SEQ ID NO: 224 - DNA, 25 bp, Homo sapien
tttctatgaccatgttacagtttaa

SEQ ID NO: 225 - DNA, 25 bp, Homo sapien
tccctactaacggagccaacaaata

SEQ ID NO: 226 - DNA, 25 bp, Homo sapien
ctgccctttgaggatgatctgagga

SEQ ID NO: 227 - DNA, 25 bp, Homo sapien
acctcgggcgccagttctcagtgga

SEQ ID NO: 228 - DNA, 25 bp, Homo sapien
agttctcagtggagcgcctgccggc

SEQ ID NO: 229 - DNA, 25 bp, Homo sapien
ggcggtcgtggtgctcaagccggac

SEQ ID NO: 230 - DNA, 25 bp, Homo sapien
gcctgcttcgccaactggcaggagg

SEQ ID NO: 231 - DNA, 25 bp, Homo sapien
aggagccacggagcctcaccgagtg

SEQ ID NO: 232 - DNA, 25 bp, Homo sapien
gccgccacaagtaccgcgtggaaaa

SEQ ID NO: 233 - DNA, 25 bp, Homo sapien
tgttctgacccgctagggtggagga

SEQ ID NO: 234 - DNA, 25 bp, Homo sapien
tggggtttgttgatgaacctccacc

SEQ ID NO: 235 - DNA, 25 bp, Homo sapien
gagaccctgactctacgaaaattaa

SEQ ID NO: 236 - DNA, 25 bp, Homo sapien
ggcgcgcacctgtggcttagctacc

SEQ ID NO: 237 - DNA, 25 bp, Homo sapien
gaccttatgaaacgcacccccaaag

SEQ ID NO: 238 - DNA, 25 bp, Homo sapien
tgaagatccgccactgcagcaccgc

SEQ ID NO: 239 - DNA, 25 bp, Homo sapien
gtgcaggcgcgggttccctgaggtc

SEQ ID NO: 240 - DNA, 25 bp, Homo sapien
tgaggtcccgggtctcttcacgctc

SEQ ID NO: 241 - DNA, 25 bp, Homo sapien
ggactcccaggcaattgtattcatt

SEQ ID NO: 242 - DNA, 25 bp, Homo sapien
attcattcagcgtcactgcaaccgt

SEQ ID NO: 243 - DNA, 25 bp, Homo sapien
tcactgcaaccgtccaagccggtgg

SEQ ID NO: 244 - DNA, 25 bp, Homo sapien
gaacccgagggctgctttccccaga

SEQ ID NO: 245 - DNA, 25 bp, Homo sapien
aggaaggacattttcttcgccagcc

SEQ ID NO: 246 - DNA, 25 bp, Homo sapien
cattttcttcgccagccacgaggaa

SEQ ID NO: 247 - DNA, 25 bp, Homo sapien
cttcgccagccacgaggaaatccgt

SEQ ID NO: 248 - DNA, 25 bp, Homo sapien
gtgtgtctgttcgactcccctcgcc

SEQ ID NO: 249 - DNA, 25 bp, Homo sapien
taccggaggaagtgagaaggattca

SEQ ID NO: 250 - DNA, 25 bp, Homo sapien
agaaggattcactatgtgcatgcat

SEQ ID NO: 251 - DNA, 25 bp, Homo sapien
aggattcactatgtgcatgcatttg

SEQ ID NO: 252 - DNA, 25 bp, Homo sapien
gtgcatgcatttgccaaaggcgaac

SEQ ID NO: 253 - DNA, 25 bp, Homo sapien
gcatgcatttgccaaaggcgaactt

SEQ ID NO: 254 - DNA, 25 bp, Homo sapien
atgcatttgccaaaggcgaacttag

SEQ ID NO: 255 - DNA, 25 bp, Homo sapien
ttgccaaaggcgaacttagctcgct

SEQ ID NO: 256 - DNA, 25 bp, Homo sapien
gccaaaggcgaacttagctcgctgt

SEQ ID NO: 257 - DNA, 25 bp, Homo sapien
aaggcgaacttagctcgctgtgcta

SEQ ID NO: 258 - DNA, 25 bp, Homo sapien
gcgaacttagctcgctgtgctagga

SEQ ID NO: 259 - DNA, 25 bp, Homo sapien
tctgtggcttcattccttaagttag

SEQ ID NO: 260 - DNA, 25 bp, Homo sapien
tgtggcttcattccttaagttagca

SEQ ID NO: 261 - DNA, 25 bp, Homo sapien
tggcttcattccttaagttagcaag

SEQ ID NO: 262 - DNA, 25 bp, Homo sapien
attccttaagttagcaagaccacga

SEQ ID NO: 263 - DNA, 25 bp, Homo sapien
aaactccggacacactagcacttac

SEQ ID NO: 264 - DNA, 25 bp, Homo sapien
actccggacacactagcacttacag

SEQ ID NO: 265 - DNA, 25 bp, Homo sapien
tccggacacactagcacttacagga

SEQ ID NO: 266 - DNA, 25 bp, Homo sapien
cggacacactagcacttacaggagg

SEQ ID NO: 267 - DNA, 25 bp, Homo sapien
gacacactagcacttacaggaggcc

SEQ ID NO: 268 - DNA, 25 bp, Homo sapien
cactagcacttacaggaggcccagg

SEQ ID NO: 269 - DNA, 25 bp, Homo sapien
gtgaactatgatcaaaccactgtag

SEQ ID NO: 270 - DNA, 25 bp, Homo sapien
atgggcctgctcttcgggaagattg

SEQ ID NO: 271 - DNA, 25 bp, Homo sapien
gaaccagctgcgcatgtacctgacc

SEQ ID NO: 272 - DNA, 25 bp, Homo sapien
aagtgcagtaccaacaggacacccc

SEQ ID NO: 273 - DNA, 25 bp, Homo sapien
tgcagtaccaacaggacaccccggt

SEQ ID NO: 274 - DNA, 25 bp, Homo sapien
gctttgacgtcaatgccccggacct

SEQ ID NO: 275 - DNA, 25 bp, Homo sapien
ggacctctacattccagcaatggct

SEQ ID NO: 276 - DNA, 25 bp, Homo sapien
tcatcacctacgttttggtggctgg

SEQ ID NO: 277 - DNA, 25 bp, Homo sapien
cctacgttttggtggctggtcttgc

SEQ ID NO: 278 - DNA, 25 bp, Homo sapien
ggacccaggataggttctccccaga

SEQ ID NO: 279 - DNA, 25 bp, Homo sapien
tctatctggtcactgtcaacaccga

SEQ ID NO: 280 - DNA, 25 bp, Homo sapien
cttcttgggctacaaatatgtcggg

SEQ ID NO: 281 - DNA, 25 bp, Homo sapien
tgagattctgtcatttgcaataata

SEQ ID NO: 282 - DNA, 25 bp, Homo sapien
agattctgtcatttgcaataatata

SEQ ID NO: 283 - DNA, 25 bp, Homo sapien
aaaggaggcccttatgtgaagtgaa

SEQ ID NO: 284 - DNA, 25 bp, Homo sapien
aacagtgtgactactgtcaataatc

SEQ ID NO: 285 - DNA, 25 bp, Homo sapien
gtgtgactactgtcaataatcattt

SEQ ID NO: 286 - DNA, 25 bp, Homo sapien
gtgactcagcaatcctgctgctggg

SEQ ID NO: 287 - DNA, 25 bp, Homo sapien
gactcagcaatcctgctgctgggta

SEQ ID NO: 288 - DNA, 25 bp, Homo sapien
gaaaaggaagccagtatattgaaga

SEQ ID NO: 289 - DNA, 25 bp, Homo sapien
gaagccagtatattgaagaggtatc

SEQ ID NO: 290 - DNA, 25 bp, Homo sapien
gccagtatattgaagaggtatctgc

SEQ ID NO: 291 - DNA, 25 bp, Homo sapien
attgaagaggtatctgcacccccat

SEQ ID NO: 292 - DNA, 25 bp, Homo sapien
ccatgaccgcgggacggagactcat

SEQ ID NO: 293 - DNA, 25 bp, Homo sapien
catgaccgcgggacggagactcatt

SEQ ID NO: 294 - DNA, 25 bp, Homo sapien
atgaccgcgggacggagactcattc

SEQ ID NO: 295 - DNA, 25 bp, Homo sapien
tgaccgcgggacggagactcattct

SEQ ID NO: 296 - DNA, 25 bp, Homo sapien
gaccgcgggacggagactcattctg

SEQ ID NO: 297 - DNA, 25 bp, Homo sapien
accgcgggacggagactcattctgt

SEQ ID NO: 298 - DNA, 25 bp, Homo sapien
ccgcgggacggagactcattctgtc

SEQ ID NO: 299 - DNA, 25 bp, Homo sapien
cgcgggacggagactcattctgtcg

SEQ ID NO: 300 - DNA, 25 bp, Homo sapien
gcgggacggagactcattctgtcgc

SEQ ID NO: 301 - DNA, 25 bp, Homo sapien
cgggacggagactcattctgtcgcc

SEQ ID NO: 302 - DNA, 25 bp, Homo sapien
atcgcaccgggcctaatattttatt

SEQ ID NO: 303 - DNA, 25 bp, Homo sapien
ggcctcagccactttgtgcaaagga

SEQ ID NO: 304 - DNA, 25 bp, Homo sapien
tttgtgcaaaggactgcagaggcgt

SEQ ID NO: 305 - DNA, 25 bp, Homo sapien
gtggcaaggccatgatgtgtccgtc

SEQ ID NO: 306 - DNA, 25 bp, Homo sapien
atgatgtgtccgtccaccgaaggcc

SEQ ID NO: 307 - DNA, 25 bp, Homo sapien
caccgaaggcctccctggttttgag

SEQ ID NO: 308 - DNA, 25 bp, Homo sapien
atctcctgcctgtgagttaggccta

SEQ ID NO: 309 - DNA, 25 bp, Homo sapien
gagttaggcctaatcaacgtaaatc

SEQ ID NO: 310 - DNA, 25 bp, Homo sapien
aatcaacgtaaatctgtcctccagg

SEQ ID NO: 311 - DNA, 25 bp, Homo sapien
ctccagatgaggtgcgcaaccagtg

SEQ ID NO: 312 - DNA, 25 bp, Homo sapien
caaccagtggtgctgctggacgttt

SEQ ID NO: 313 - DNA, 25 bp, Homo sapien
ggtgctgctggacgtttgaaaatac

SEQ ID NO: 314 - DNA, 25 bp, Homo sapien
aaagtggtgatagtctggtgttaca

SEQ ID NO: 315 - DNA, 25 bp, Homo sapien
ggtgttacagaagccacttcttttg

SEQ ID NO: 316 - DNA, 25 bp, Homo sapien
cacttcttttggctctctaggataa

SEQ ID NO: 317 - DNA, 25 bp, Homo sapien
tgaaccctcaagttaccatcaaact

SEQ ID NO: 318 - DNA, 25 bp, Homo sapien
aactacttctctttgaactaccaat

SEQ ID NO: 319 - DNA, 25 bp, Homo sapien
gaactaccaatactgttgaatgcca

SEQ ID NO: 320 - DNA, 25 bp, Homo sapien
ttgaatgccattacacctatctctg

SEQ ID NO: 321 - DNA, 25 bp, Homo sapien
tacacctatctctgtgtaagtcata

SEQ ID NO: 322 - DNA, 25 bp, Homo sapien
cataatgatgactctttaggataag

SEQ ID NO: 323 - DNA, 25 bp, Homo sapien
gaatatttgcatgcttaaggcactg

SEQ ID NO: 324 - DNA, 25 bp, Homo sapien
ggcactgttttagaagcttacttag

SEQ ID NO: 325 - DNA, 25 bp, Homo sapien
tcattaggtgacccaggttctcagc

SEQ ID NO: 326 - DNA, 25 bp, Homo sapien
ccaggttctcagcattgtacatggc

SEQ ID NO: 327 - DNA, 25 bp, Homo sapien
gtacatggcaataagcttgttctat

SEQ ID NO: 328 - DNA, 25 bp, Homo sapien
ataagcttgttctatctggatacat

SEQ ID NO: 329 - DNA, 25 bp, Homo sapien
ttttactttgctcatttgtttcagg

SEQ ID NO: 330 - DNA, 25 bp, Homo sapien
tgctcatttgtttcaggtatactaa

SEQ ID NO: 331 - DNA, 25 bp, Homo sapien
gaaactgactaatacattctagaag

SEQ ID NO: 332 - DNA, 25 bp, Homo sapien
aatgcggtgagatgacccttgcgaa

SEQ ID NO: 333 - DNA, 25 bp, Homo sapien
gacccttgcgaagcctcaaatacaa

SEQ ID NO: 334 - DNA, 25 bp, Homo sapien
gcgaagcctcaaatacaatacttat

SEQ ID NO: 335 - DNA, 25 bp, Homo sapien
ttagaaattattggccaggtacggt

SEQ ID NO: 336 - DNA, 25 bp, Homo sapien
actgggaatcggagtgggcacctct

SEQ ID NO: 337 - DNA, 25 bp, Homo sapien
ggcacctctgtgtttctctagggag

SEQ ID NO: 338 - DNA, 25 bp, Homo sapien
ctctagggagtaacattcaacattt

SEQ ID NO: 339 - DNA, 25 bp, Homo sapien
aattgaatcgtgtatcctgataggt

SEQ ID NO: 340 - DNA, 25 bp, Homo sapien
tttaacttttggctaaacgacatgc

SEQ ID NO: 341 - DNA, 25 bp, Homo sapien
aaacgacatgccttggattgagtgt

SEQ ID NO: 342 - DNA, 25 bp, Homo sapien
gattgagtgtatatgtcttccccaa

SEQ ID NO: 343 - DNA, 25 bp, Homo sapien
gttgaagcttaaatcctgaatgtga

SEQ ID NO: 344 - DNA, 25 bp, Homo sapien
aaggttattaggtcttgagggcaga

SEQ ID NO: 345 - DNA, 25 bp, Homo sapien
tcgcttgaaccaggcagtcggaact

SEQ ID NO: 346 - DNA, 25 bp, Homo sapien
gcagtcggaacttgtagtgagccaa

SEQ ID NO: 347 - DNA, 25 bp, Homo sapien
tacatttcattcatataacccttaa

SEQ ID NO: 348 - DNA, 25 bp, Homo sapien
tggccaaatctttgcatgtttattt

SEQ ID NO: 349 - DNA, 25 bp, Homo sapien
gaatacatccatatgttcatacaga

SEQ ID NO: 350 - DNA, 25 bp, Homo sapien
tacagcagtatggaatgtttaatca

SEQ ID NO: 351 - DNA, 25 bp, Homo sapien
atttgagtcatgtttttgctttgca

SEQ ID NO: 352 - DNA, 25 bp, Homo sapien
catgtttttgctttgcagtttcctc

SEQ ID NO: 353 - DNA, 25 bp, Homo sapien
gtttcctcaagtgtctgataccacc

SEQ ID NO: 354 - DNA, 25 bp, Homo sapien
gtgtctgataccacctatgtaagtg

SEQ ID NO: 355 - DNA, 25 bp, Homo sapien
gtttttcagaaaaagcttacaacat

SEQ ID NO: 356 - DNA, 25 bp, Homo sapien
agcttacaacatttctgaagatatt

SEQ ID NO: 357 - DNA, 25 bp, Homo sapien
gaggcaagaattactcaaacaggga

SEQ ID NO: 358 - DNA, 25 bp, Homo sapien
gttggcattcgaggaacagctggaa

SEQ ID NO: 359 - DNA, 25 bp, Homo sapien
atctgatgggccagcacaaggacct

SEQ ID NO: 360 - DNA, 25 bp, Homo sapien
gacctctgggacttccacatgccag

SEQ ID NO: 361 - DNA, 25 bp, Homo sapien
ttccacatgccagagcggctggcaa

SEQ ID NO: 362 - DNA, 25 bp, Homo sapien
gagcagctgctcaaggaagagaagc

SEQ ID NO: 363 - DNA, 25 bp, Homo sapien
aagagaagctggtcaaggcgacact

SEQ ID NO: 364 - DNA, 25 bp, Homo sapien
tcaaggcgacactggaagacgtgaa

SEQ ID NO: 365 - DNA, 25 bp, Homo sapien
agacgtgaagcatcagctgtgctcc

SEQ ID NO: 366 - DNA, 25 bp, Homo sapien
ctccacccttgatgagggactcttt

SEQ ID NO: 367 - DNA, 25 bp, Homo sapien
agggactctttctccgcagccagga

SEQ ID NO: 368 - DNA, 25 bp, Homo sapien
aagcatggaatgcaagtccctgccc

SEQ ID NO: 369 - DNA, 25 bp, Homo sapien
aaccagctctggcatgaactaacag

SEQ ID NO: 370 - DNA, 25 bp, Homo sapien
gctattcatgaggaatccgcctcca

SEQ ID NO: 371 - DNA, 25 bp, Homo sapien
tttgcactagtggaataacttaagg

SEQ ID NO: 372 - DNA, 25 bp, Homo sapien
ttttccagtcatttttgtagattag

SEQ ID NO: 373 - DNA, 25 bp, Homo sapien
gaaaactgtacctgggattcagagt

SEQ ID NO: 374 - DNA, 25 bp, Homo sapien
ctgggattcagagtgacttgcctaa

SEQ ID NO: 375 - DNA, 25 bp, Homo sapien
ttacacagctagtttatggaagaac

SEQ ID NO: 376 - DNA, 25 bp, Homo sapien
taaaagctttgtcttttgatttcca

SEQ ID NO: 377 - DNA, 25 bp, Homo sapien
aaaataatgtcctaccaggtatggt

SEQ ID NO: 378 - DNA, 25 bp, Homo sapien
accaggtatggtagctcatgtggga

SEQ ID NO: 379 - DNA, 25 bp, Homo sapien
agcaagatgctgtctgtaccgaaaa

SEQ ID NO: 380 - DNA, 25 bp, Homo sapien
ctgctgcaccagcattgtgactgga

SEQ ID NO: 381 - DNA, 25 bp, Homo sapien
actggaggctccaacatcattctgg

SEQ ID NO: 382 - DNA, 25 bp, Homo sapien
atcattctgggctctgggaaggacc

SEQ ID NO: 383 - DNA, 25 bp, Homo sapien
tttggattcctgctctgtgtctggc

SEQ ID NO: 384 - DNA, 25 bp, Homo sapien
gagtctgaagacatccatcacctac

SEQ ID NO: 385 - DNA, 25 bp, Homo sapien
aaatcaataaagtctcccctcctgc

SEQ ID NO: 386 - DNA, 25 bp, Homo sapien
tgaatgctctaagtgcttgcacacc

SEQ ID NO: 387 - DNA, 25 bp, Homo sapien
tcctctcctcggaaggcaattgtgg

SEQ ID NO: 388 - DNA, 25 bp, Homo sapien
gcaattgtggcatatctgtgtccag

SEQ ID NO: 389 - DNA, 25 bp, Homo sapien
atctgtgtccagacgtgttctattg

SEQ ID NO: 390 - DNA, 25 bp, Homo sapien
gttctattggtatctcactccacat

SEQ ID NO: 391 - DNA, 25 bp, Homo sapien
tcctcaatgaatcacttgaagatga

SEQ ID NO: 392 - DNA, 25 bp, Homo sapien
gaaaattctaagtaatctcaccagg

SEQ ID NO: 393 - DNA, 25 bp, Homo sapien
tctaagtaatctcaccaggttggac

SEQ ID NO: 394 - DNA, 25 bp, Homo sapien
gtaatctcaccaggttggacaactg

SEQ ID NO: 395 - DNA, 25 bp, Homo sapien
ctcaccaggttggacaactggctat

SEQ ID NO: 396 - DNA, 25 bp, Homo sapien
ggttggacaactggctatgaaatgg

SEQ ID NO: 397 - DNA, 25 bp, Homo sapien
cattttgaatattgaacgtggatag

SEQ ID NO: 398 - DNA, 25 bp, Homo sapien
attgaacgtggatagatgtatttaa

SEQ ID NO: 399 - DNA, 25 bp, Homo sapien
gatgaatctacagtatctcagggcc

SEQ ID NO: 400 - DNA, 25 bp, Homo sapien
gaatctacagtatctcagggcctta

SEQ ID NO: 401 - DNA, 25 bp, Homo sapien
ttttcaatatcttaactggattttt

SEQ ID NO: 402 - DNA, 25 bp, Homo sapien
gcatgggatgggacagtctgggcca

SEQ ID NO: 403 - DNA, 25 bp, Homo sapien
agaagtgcggcaccagggcaggagc

SEQ ID NO: 404 - DNA, 25 bp, Homo sapien
ggcaggagctgcagtagctaccctc

SEQ ID NO: 405 - DNA, 25 bp, Homo sapien
agatcactcccagatcaccaggtca

SEQ ID NO: 406 - DNA, 25 bp, Homo sapien
aggtcaccccatctctaggcggcac

SEQ ID NO: 407 - DNA, 25 bp, Homo sapien
aatgtcaccgcacaccaggcagtgg

SEQ ID NO: 408 - DNA, 25 bp, Homo sapien
gggacacggcagtaagcacaagaaa

SEQ ID NO: 409 - DNA, 25 bp, Homo sapien
acggcagtaagcacaagaaagattt

SEQ ID NO: 410 - DNA, 25 bp, Homo sapien
tctccacaaacgtttttaaaatgtg

SEQ ID NO: 411 - DNA, 25 bp, Homo sapien
aaaatgtgccgggtgtactggtgca

SEQ ID NO: 412 - DNA, 25 bp, Homo sapien
atgtgccgggtgtactggtgcacac

SEQ ID NO: 413 - DNA, 25 bp, Homo sapien
aaagcagcaggatggtcggaattaa

SEQ ID NO: 414 - DNA, 25 bp, Homo sapien
attaagtgagagagatgccatctac

SEQ ID NO: 415 - DNA, 25 bp, Homo sapien
agaattctccttccacaattttaat

SEQ ID NO: 416 - DNA, 25 bp, Homo sapien
ggcatttggctttatgtcccgagtt

SEQ ID NO: 417 - DNA, 25 bp, Homo sapien
tttatgtcccgagttgccctacaag

SEQ ID NO: 418 - DNA, 25 bp, Homo sapien
gagttgccctacaagcagagaagat

SEQ ID NO: 419 - DNA, 25 bp, Homo sapien
cacccagaatggttcaatgtataca

SEQ ID NO: 420 - DNA, 25 bp, Homo sapien
gtatacaacaaggtccagataactc

SEQ ID NO: 421 - DNA, 25 bp, Homo sapien
agataactctcacctcacatgactg

SEQ ID NO: 422 - DNA, 25 bp, Homo sapien
gaggagaggaaccaagctatacttg

SEQ ID NO: 423 - DNA, 25 bp, Homo sapien
gctatacttgaccttaaagcagcag

SEQ ID NO: 424 - DNA, 25 bp, Homo sapien
gtcaggagcacatcgggctctgctg

SEQ ID NO: 425 - DNA, 25 bp, Homo sapien
ggagacctgggtttgcctcttggct

SEQ ID NO: 426 - DNA, 25 bp, Homo sapien
tgctgaatgagctctgtgaccttag

SEQ ID NO: 427 - DNA, 25 bp, Homo sapien
gaccttagcaagtcattctacattt

SEQ ID NO: 428 - DNA, 25 bp, Homo sapien
accaacctcttggtgtcattttgag

SEQ ID NO: 429 - DNA, 25 bp, Homo sapien
gctaatgagtacaaagtgcctgaca

SEQ ID NO: 430 - DNA, 25 bp, Homo sapien
gtgcctgacatgtagtagttgctct

SEQ ID NO: 431 - DNA, 25 bp, Homo sapien
agtattatgatcaacatctttgctt

SEQ ID NO: 432 - DNA, 25 bp, Homo sapien
ctttgcttttgccagatccagggct

SEQ ID NO: 433 - DNA, 25 bp, Homo sapien
gggctggccctttgattaccaagta

SEQ ID NO: 434 - DNA, 25 bp, Homo sapien
agattaagattctgaaccccggccg

SEQ ID NO: 435 - DNA, 25 bp, Homo sapien
gctcctggccaccaacgggacccct

SEQ ID NO: 436 - DNA, 25 bp, Homo sapien
atctgtaaataaggcccaaggaaca

SEQ ID NO: 437 - DNA, 25 bp, Homo sapien
aggcccaaggaacatgtcgggaggg

SEQ ID NO: 438 - DNA, 25 bp, Homo sapien
tggacacaaaaaccggccttgccct

SEQ ID NO: 439 - DNA, 25 bp, Homo sapien
acaaaaaccggccttgccctgcagg

SEQ ID NO: 440 - DNA, 25 bp, Homo sapien
gctccacaggccgtgcccaactggg

SEQ ID NO: 441 - DNA, 25 bp, Homo sapien
gcgggggagctgtttctattttatt

SEQ ID NO: 442 - DNA, 25 bp, Homo sapien
tatttattgatcaatctctctgcgg

SEQ ID NO: 443 - DNA, 25 bp, Homo sapien
atttattgatcaatctctctgcggg

SEQ ID NO: 444 - DNA, 25 bp, Homo sapien
tattgatcaatctctctgcggggtg

SEQ ID NO: 445 - DNA, 25 bp, Homo sapien
ttgatcaatctctctgcggggtggg

SEQ ID NO: 446 - DNA, 25 bp, Homo sapien
tatgactgtgatggcctgcctacct

SEQ ID NO: 447 - DNA, 25 bp, Homo sapien
gcctacctgccagcatttcaaatat

SEQ ID NO: 448 - DNA, 25 bp, Homo sapien
aaatatgcccagatggtaacatttg

SEQ ID NO: 449 - DNA, 25 bp, Homo sapien
gcccagatggtaacatttgtgcagg

SEQ ID NO: 450 - DNA, 25 bp, Homo sapien
gtaacatttgtgcaggtgaaaacca

SEQ ID NO: 451 - DNA, 25 bp, Homo sapien
ggtgaaaaccagtgccaagcttcct

SEQ ID NO: 452 - DNA, 25 bp, Homo sapien
gaaaaccagtgccaagcttcctttt

SEQ ID NO: 453 - DNA, 25 bp, Homo sapien
tcctataaataaagtgggtaatccg

SEQ ID NO: 454 - DNA, 25 bp, Homo sapien
gtgggtaatccggttataatatgtt

SEQ ID NO: 455 - DNA, 25 bp, Homo sapien
tactcttcccctaaatcctctatga

SEQ ID NO: 456 - DNA, 25 bp, Homo sapien
tcccctaaatcctctatgactgtga

SEQ ID NO: 457 - DNA, 25 bp, Homo sapien
tcaccagaagatatcattggcaaca

SEQ ID NO: 458 - DNA, 25 bp, Homo sapien
atcattggcaacatctttcgagtgt

SEQ ID NO: 459 - DNA, 25 bp, Homo sapien
ggcaacatctttcgagtgtgtaaaa

SEQ ID NO: 460 - DNA, 25 bp, Homo sapien
tgtaaaactttccaaatggcagaat

SEQ ID NO: 461 - DNA, 25 bp, Homo sapien
ggatacactcacatgaaaatagcgg

SEQ ID NO: 462 - DNA, 25 bp, Homo sapien
actcacatgaaaatagcggaaggag

SEQ ID NO: 463 - DNA, 25 bp, Homo sapien
gtgaactctcttttgcagatggcag

SEQ ID NO: 464 - DNA, 25 bp, Homo sapien
tctcttttgcagatggcaggcctcc

SEQ ID NO: 465 - DNA, 25 bp, Homo sapien
atggcaggcctcctggcaaggctgt

SEQ ID NO: 466 - DNA, 25 bp, Homo sapien
agagacttcactgactgacttacag

SEQ ID NO: 467 - DNA, 25 bp, Homo sapien
gactgacttacaggtgccctattct

SEQ ID NO: 468 - DNA, 25 bp, Homo sapien
ggtgccctattctgaggtacaggag

SEQ ID NO: 469 - DNA, 25 bp, Homo sapien
ctattctgaggtacaggagccgcgg

SEQ ID NO: 470 - DNA, 25 bp, Homo sapien
atgcgccttaggctgagccaacatg

SEQ ID NO: 471 - DNA, 25 bp, Homo sapien
ctgagccaacatgactgtcccccaa

SEQ ID NO: 472 - DNA, 25 bp, Homo sapien
aactccagtggctggccaggcgcgg

SEQ ID NO: 473 - DNA, 25 bp, Homo sapien
tccccatgagtttggcccgcagagt

SEQ ID NO: 474 - DNA, 25 bp, Homo sapien
ggcccgcagagtcaaaaaggacacc

SEQ ID NO: 475 - DNA, 25 bp, Homo sapien
gggcaccgaagtgtaccctatgctg

SEQ ID NO: 476 - DNA, 25 bp, Homo sapien
ctctgtgctgagagaccccagtttc

SEQ ID NO: 477 - DNA, 25 bp, Homo sapien
atccccagcacttcctgaatgagaa

SEQ ID NO: 478 - DNA, 25 bp, Homo sapien
tgtgcccttttccatcggaaagcgg

SEQ ID NO: 479 - DNA, 25 bp, Homo sapien
agcggaactgtttcggagaaggcct

SEQ ID NO: 480 - DNA, 25 bp, Homo sapien
tcggagaaggcctggccagaatgga

SEQ ID NO: 481 - DNA, 25 bp, Homo sapien
agaatggagctctttctcttcttca

SEQ ID NO: 482 - DNA, 25 bp, Homo sapien
cttcaccaccgtcatgcagaacttc

SEQ ID NO: 483 - DNA, 25 bp, Homo sapien
tcctcccagtcacctaaggacattg

SEQ ID NO: 484 - DNA, 25 bp, Homo sapien
aggacattgacgtgtcccccaaaca

SEQ ID NO: 485 - DNA, 25 bp, Homo sapien
ctttgccacgatcccacgaaactac

SEQ ID NO: 486 - DNA, 25 bp, Homo sapien
gggctcagttcaccttgataaggtg

SEQ ID NO: 487 - DNA, 25 bp, Homo sapien
ccttgataaggtgcttccgagctgg

SEQ ID NO: 488 - DNA, 25 bp, Homo sapien
aaggaaacccttacattatgctatg

SEQ ID NO: 489 - DNA, 25 bp, Homo sapien
gagtatcacgatctgactgcatttt

SEQ ID NO: 490 - DNA, 25 bp, Homo sapien
acaattgttctggtaactgcatgaa

SEQ ID NO: 491 - DNA, 25 bp, Homo sapien
gggactcacacaggagctgggcact

SEQ ID NO: 492 - DNA, 25 bp, Homo sapien
tgggcactgagtgctcttgagccac

SEQ ID NO: 493 - DNA, 25 bp, Homo sapien
aggcccacaaggcaacatattctgt

SEQ ID NO: 494 - DNA, 25 bp, Homo sapien
ggcaacatattctgtgtggcacaac

SEQ ID NO: 495 - DNA, 25 bp, Homo sapien
gtggcacaaccgatcaggaattcta

SEQ ID NO: 496 - DNA, 25 bp, Homo sapien
aattctaggagttctcggtgagatc

SEQ ID NO: 497 - DNA, 25 bp, Homo sapien
ctggcgtttatgtaatgcttctcaa

SEQ ID NO: 498 - DNA, 25 bp, Homo sapien
ttttgcccaaatgtctataccaaag

SEQ ID NO: 499 - DNA, 25 bp, Homo sapien
agcatgaactactgattttgttttc

SEQ ID NO: 500 - DNA, 25 bp, Homo sapien
tgactccaaggaagctcagatgcct

SEQ ID NO: 501 - DNA, 25 bp, Homo sapien
ccaaggaagctcagatgcctgcagt

SEQ ID NO: 502 - DNA, 25 bp, Homo sapien
cagatgcctgcagtcattaggtttt

SEQ ID NO: 503 - DNA, 25 bp, Homo sapien
gcagtcattaggttttagcgtccca

SEQ ID NO: 504 - DNA, 25 bp, Homo sapien
cattaggttttagcgtcccatgagc

SEQ ID NO: 505 - DNA, 25 bp, Homo sapien
taggttttagcgtcccatgagcctt

SEQ ID NO: 506 - DNA, 25 bp, Homo sapien
ttttagcgtcccatgagccttggta

SEQ ID NO: 507 - DNA, 25 bp, Homo sapien
agcgtcccatgagccttggtatcaa

SEQ ID NO: 508 - DNA, 25 bp, Homo sapien
cgtcccatgagccttggtatcaaga

SEQ ID NO: 509 - DNA, 25 bp, Homo sapien
gagccttggtatcaagaggccacaa

SEQ ID NO: 510 - DNA, 25 bp, Homo sapien
aagaggccacaagagtgggacccca

SEQ ID NO: 511 - DNA, 25 bp, Homo sapien
ggcaaatttttcatgctattagtat

SEQ ID NO: 512 - DNA, 25 bp, Homo sapien
gtattttcataccttagtcacattt

SEQ ID NO: 513 - DNA, 25 bp, Homo sapien
cataccttagtcacatttggagaat

SEQ ID NO: 514 - DNA, 25 bp, Homo sapien
gccatcagtcaaagaaactaccttg

SEQ ID NO: 515 - DNA, 25 bp, Homo sapien
gtttagtatcaaattcacgccatgc

SEQ ID NO: 516 - DNA, 25 bp, Homo sapien
caaattcacgccatgcaaaaagatt

SEQ ID NO: 517 - DNA, 25 bp, Homo sapien
ggagattcagtcataacccaacgct

SEQ ID NO: 518 - DNA, 25 bp, Homo sapien
ataacccaacgctcattcaacatca

SEQ ID NO: 519 - DNA, 25 bp, Homo sapien
tttgggtgtagtaaatggcagatct

SEQ ID NO: 520 - DNA, 25 bp, Homo sapien
atggcagatctttcaataggagttt

SEQ ID NO: 521 - DNA, 25 bp, Homo sapien
ggagtttaactagtctttgtcatat

SEQ ID NO: 522 - DNA, 25 bp, Homo sapien
atcccctccagattctgagtcaaag

SEQ ID NO: 523 - DNA, 25 bp, Homo sapien
ctccagattctgagtcaaagcctga

SEQ ID NO: 524 - DNA, 25 bp, Homo sapien
atcctaagccctgggtgtacaccag

SEQ ID NO: 525 - DNA, 25 bp, Homo sapien
ctaagccctgggtgtacaccagtga

SEQ ID NO: 526 - DNA, 25 bp, Homo sapien
aagccctgggtgtacaccagtgaat

SEQ ID NO: 527 - DNA, 25 bp, Homo sapien
gccctgggtgtacaccagtgaataa

SEQ ID NO: 528 - DNA, 25 bp, Homo sapien
cctgggtgtacaccagtgaataaga

SEQ ID NO: 529 - DNA, 25 bp, Homo sapien
gacagacaaaactcttgtcctcagg

SEQ ID NO: 530 - DNA, 25 bp, Homo sapien
acaaaactcttgtcctcaggaagtc

SEQ ID NO: 531 - DNA, 25 bp, Homo sapien
aaactcttgtcctcaggaagtccat

SEQ ID NO: 532 - DNA, 25 bp, Homo sapien
actcttgtcctcaggaagtccatgc

SEQ ID NO: 533 - DNA, 25 bp, Homo sapien
aacctggaaacatcatcagtgaata

SEQ ID NO: 534 - DNA, 25 bp, Homo sapien
atcagtgaataacacgccaagcagc

SEQ ID NO: 535 - DNA, 25 bp, Homo sapien
tgaataacacgccaagcagcagtaa

SEQ ID NO: 536 - DNA, 25 bp, Homo sapien
taacacgccaagcagcagtaaccct

SEQ ID NO: 537 - DNA, 25 bp, Homo sapien
aatgcaggtggtattctagagagga

SEQ ID NO: 538 - DNA, 25 bp, Homo sapien
ggaaggcctccctgaggacatatga

SEQ ID NO: 539 - DNA, 25 bp, Homo sapien
aaggcctccctgaggacatatgagc

SEQ ID NO: 540 - DNA, 25 bp, Homo sapien
gcctccctgaggacatatgagcaga

SEQ ID NO: 541 - DNA, 25 bp, Homo sapien
gaggacatatgagcagagacctgca

SEQ ID NO: 542 - DNA, 25 bp, Homo sapien
atatgagcagagacctgcaggaaat

SEQ ID NO: 543 - DNA, 25 bp, Homo sapien
gggagtgagacctgcaactgctggg

SEQ ID NO: 544 - DNA, 25 bp, Homo sapien
atttattaaaggagagcctctaagt

SEQ ID NO: 545 - DNA, 25 bp, Homo sapien
taagtccacatcctgagcccatgtg

SEQ ID NO: 546 - DNA, 25 bp, Homo sapien
gctgctgggttctgttccaccacca

SEQ ID NO: 547 - DNA, 25 bp, Homo sapien
cccaggaattcaagtttaacatgag

SEQ ID NO: 548 - DNA, 25 bp, Homo sapien
ggaattcaagtttaacatgagcagc

SEQ ID NO: 549 - DNA, 25 bp, Homo sapien
attcaagtttaacatgagcagcaac

SEQ ID NO: 550 - DNA, 25 bp, Homo sapien
tcaagtttaacatgagcagcaacat

SEQ ID NO: 551 - DNA, 25 bp, Homo sapien
caagtttaacatgagcagcaacatt

SEQ ID NO: 552 - DNA, 25 bp, Homo sapien
gtttaacatgagcagcaacattagc

SEQ ID NO: 553 - DNA, 25 bp, Homo sapien
taacatgagcagcaacattagcaag

SEQ ID NO: 554 - DNA, 25 bp, Homo sapien
aacatgagcagcaacattagcaaga

SEQ ID NO: 555 - DNA, 25 bp, Homo sapien
ttggcagtgggctacccacggttgt

SEQ ID NO: 556 - DNA, 25 bp, Homo sapien
tacccacggttgtcatccacaaagt

SEQ ID NO: 557 - DNA, 25 bp, Homo sapien
gtcatccacaaagtgcatggcaaat

SEQ ID NO: 558 - DNA, 25 bp, Homo sapien
gaaaaattattctgacacttgttaa

SEQ ID NO: 559 - DNA, 25 bp, Homo sapien
acttgttaaaatggccaggaggact

SEQ ID NO: 560 - DNA, 25 bp, Homo sapien
gtagaaattgagctccactctgaat

SEQ ID NO: 561 - DNA, 25 bp, Homo sapien
gagctccactctgaatacaacaagg

SEQ ID NO: 562 - DNA, 25 bp, Homo sapien
acatcacaggatgggaaattaccaa

SEQ ID NO: 563 - DNA, 25 bp, Homo sapien
aagtgacctaacaggattcatgcta

SEQ ID NO: 564 - DNA, 25 bp, Homo sapien
attcatgctaaaggcaggccaagga

SEQ ID NO: 565 - DNA, 25 bp, Homo sapien
ggcaggccaaggacttacacatcaa

SEQ ID NO: 566 - DNA, 25 bp, Homo sapien
tcctgatccaagcagaaccctgtta

SEQ ID NO: 567 - DNA, 25 bp, Homo sapien
aaatgtcctgggagtgcatccaaag

SEQ ID NO: 568 - DNA, 25 bp, Homo sapien
aaagtgaaacttgggtatcctcaat

SEQ ID NO: 569 - DNA, 25 bp, Homo sapien
tatcctcaatactaagaaatctctg

SEQ ID NO: 570 - DNA, 25 bp, Homo sapien
gagaatgactgggtcttggctcttt

SEQ ID NO: 571 - DNA, 25 bp, Homo sapien
ttggctctttgatcttacctctact

SEQ ID NO: 572 - DNA, 25 bp, Homo sapien
tgatcttacctctactcctctgaaa

SEQ ID NO: 573 - DNA, 25 bp, Homo sapien
ttgtgttaggtggatgaaccgcatc

SEQ ID NO: 574 - DNA, 25 bp, Homo sapien
tgaaccgcatcaaagacttccagaa

SEQ ID NO: 575 - DNA, 25 bp, Homo sapien
gaagccactccagtgaccataagat

SEQ ID NO: 576 - DNA, 25 bp, Homo sapien
ataaatgtcagaatcgcataacccc

SEQ ID NO: 577 - DNA, 25 bp, Homo sapien
caatctgtaatttattccttcccca

SEQ ID NO: 578 - DNA, 25 bp, Homo sapien
aattcagcctgtttgcatttatcca

SEQ ID NO: 579 - DNA, 25 bp, Homo sapien
gtttgcatttatccagctctatgta

SEQ ID NO: 580 - DNA, 25 bp, Homo sapien
aataccttcttcagggcataatgta

SEQ ID NO: 581 - DNA, 25 bp, Homo sapien
gtatgtaacttgtatttgtcctgaa

SEQ ID NO: 582 - DNA, 25 bp, Homo sapien
ttgtcctgaatgtggcctagtgtgt

SEQ ID NO: 583 - DNA, 25 bp, Homo sapien
tgtggcctagtgtgtcatcttacag

SEQ ID NO: 584 - DNA, 25 bp, Homo sapien
agtggactgcttccttagtttaata

SEQ ID NO: 585 - DNA, 25 bp, Homo sapien
ttaatagagttcttcatctccagtc

SEQ ID NO: 586 - DNA, 25 bp, Homo sapien
gcaccatccagctttattcatcaaa

SEQ ID NO: 587 - DNA, 25 bp, Homo sapien
taagagcctactacaggccaggtgt

SEQ ID NO: 588 - DNA, 25 bp, Homo sapien
tcatcagtattgactcctaaggagc

SEQ ID NO: 589 - DNA, 25 bp, Homo sapien
aagagcttactgaggagctcaccaa

SEQ ID NO: 590 - DNA, 25 bp, Homo sapien
actggagcaactgagcctccaacat

SEQ ID NO: 591 - DNA, 25 bp, Homo sapien
tgagcctccaacatagacgagccca

SEQ ID NO: 592 - DNA, 25 bp, Homo sapien
gacgagcccagctgctagatatcaa

SEQ ID NO: 593 - DNA, 25 bp, Homo sapien
atatcaatgggaagctgcgggagat

SEQ ID NO: 594 - DNA, 25 bp, Homo sapien
gaagcagtacttggatggcatctca

SEQ ID NO: 595 - DNA, 25 bp, Homo sapien
ggatggcatctcagtgagtgacgaa

SEQ ID NO: 596 - DNA, 25 bp, Homo sapien
gagtgacgaagtgctgagccagctc

SEQ ID NO: 597 - DNA, 25 bp, Homo sapien
agctcaacccactctttatagtcaa

SEQ ID NO: 598 - DNA, 25 bp, Homo sapien
aactatcaaagcaacttactccagc

SEQ ID NO: 599 - DNA, 25 bp, Homo sapien
gggtgaacttacgtgctcgctgaca

SEQ ID NO: 600 - DNA, 25 bp, Homo sapien
acgtgctcgctgacaatgtccttaa

SEQ ID NO: 601 - DNA, 25 bp, Homo sapien
caatgtccttaaagtcctggcatcc

SEQ ID NO: 602 - DNA, 25 bp, Homo sapien
gctctggaagtatggaggcccctct

SEQ ID NO: 603 - DNA, 25 bp, Homo sapien
gaggcagaactcacaggcaacacct

SEQ ID NO: 604 - DNA, 25 bp, Homo sapien
acctggtttctgcacagatgcagct

SEQ ID NO: 605 - DNA, 25 bp, Homo sapien
ggtgtcgctccctagaagggcacct

SEQ ID NO: 606 - DNA, 25 bp, Homo sapien
aagggcaccttttctgatatatggg

SEQ ID NO: 607 - DNA, 25 bp, Homo sapien
gtcagatgggccttggtgcacacag

SEQ ID NO: 608 - DNA, 25 bp, Homo sapien
ttggtgcacacaggcaggcttccca

SEQ ID NO: 609 - DNA, 25 bp, Homo sapien
gacaaggaggcaacagtcctctctc

SEQ ID NO: 610 - DNA, 25 bp, Homo sapien
gaggcactgaggaaacaaggagctt

SEQ ID NO: 611 - DNA, 25 bp, Homo sapien
gaaacaaggagcttcacctctccct

SEQ ID NO: 612 - DNA, 25 bp, Homo sapien
ctcagagtcgaaggaggagacagac

SEQ ID NO: 613 - DNA, 25 bp, Homo sapien
ggagacagacttcccttatatgaat

SEQ ID NO: 614 - DNA, 25 bp, Homo sapien
aggaagcagaaattgcctgtcccct

SEQ ID NO: 615 - DNA, 25 bp, Homo sapien
ttgcctgtcccctcaaaaagtaaag

SEQ ID NO: 616 - DNA, 25 bp, Homo sapien
gggacactcaatccaggttttgagg

SEQ ID NO: 617 - DNA, 25 bp, Homo sapien
gaagagacggacatttgaaacagaa

SEQ ID NO: 618 - DNA, 25 bp, Homo sapien
ggaatgggatgtaagaaggcaccaa

SEQ ID NO: 619 - DNA, 25 bp, Homo sapien
aggcaccaagaaagatgctgctaat

SEQ ID NO: 620 - DNA, 25 bp, Homo sapien
gcagagtagtgtatgtaatccttca

SEQ ID NO: 621 - DNA, 25 bp, Homo sapien
gtttctcctacggttaattcttcag

SEQ ID NO: 622 - DNA, 25 bp, Homo sapien
aattcttcaggatgcagcccggagg

SEQ ID NO: 623 - DNA, 25 bp, Homo sapien
gcccggaggaacgtggatttgactt

SEQ ID NO: 624 - DNA, 25 bp, Homo sapien
aaagagcatcgtattaccgtttcta

SEQ ID NO: 625 - DNA, 25 bp, Homo sapien
gtattaccgtttctatgagcgcatt

SEQ ID NO: 626 - DNA, 25 bp, Homo sapien
tgttcggtgtttgtagatcccatcc

SEQ ID NO: 627 - DNA, 25 bp, Homo sapien
gtgtttgtagatcccatccatccgg

SEQ ID NO: 628 - DNA, 25 bp, Homo sapien
taaactgggctgagagagcttgaaa

SEQ ID NO: 629 - DNA, 25 bp, Homo sapien
tccttttcttgttgaataccttaga

SEQ ID NO: 630 - DNA, 25 bp, Homo sapien
aactgcttacaccagaagcctttta

SEQ ID NO: 631 - DNA, 25 bp, Homo sapien
gagaagcatgagactgtttgactag

SEQ ID NO: 632 - DNA, 25 bp, Homo sapien
tgttagtcacagaggccgcaaggcc

SEQ ID NO: 633 - DNA, 25 bp, Homo sapien
gaggcgacggcaaccccagggccaa

SEQ ID NO: 634 - DNA, 25 bp, Homo sapien
gcccgccttcggcttgaagcagaag

SEQ ID NO: 635 - DNA, 25 bp, Homo sapien
tggtggctgtaattcaggatgacct

SEQ ID NO: 636 - DNA, 25 bp, Homo sapien
cctggacttagcagatagcgggcca

SEQ ID NO: 637 - DNA, 25 bp, Homo sapien
gccaggcgggttggaattgacacca

SEQ ID NO: 638 - DNA, 25 bp, Homo sapien
gttggaattgacaccacctgtggtc

SEQ ID NO: 639 - DNA, 25 bp, Homo sapien
tgtggtctcactaaccccaaaactg

SEQ ID NO: 640 - DNA, 25 bp, Homo sapien
ccggctgcgtccagggtctctagtc

SEQ ID NO: 641 - DNA, 25 bp, Homo sapien
gagactgagaagttgcctcgcaaac

SEQ ID NO: 642 - DNA, 25 bp, Homo sapien
ggcttgttgggaccaccaaccaagg

SEQ ID NO: 643 - DNA, 25 bp, Homo sapien
aaagcagcttcctacacaatgcagc

SEQ ID NO: 644 - DNA, 25 bp, Homo sapien
tggcactctgtatctcagtacacat

SEQ ID NO: 645 - DNA, 25 bp, Homo sapien
atctcagtacacattctaccttcaa

SEQ ID NO: 646 - DNA, 25 bp, Homo sapien
gtacacattctaccttcaaaaacag

SEQ ID NO: 647 - DNA, 25 bp, Homo sapien
aaaacagctaagtcaaacgtgtcaa

SEQ ID NO: 648 - DNA, 25 bp, Homo sapien
aagtcaaacgtgtcaaaatagctat

SEQ ID NO: 649 - DNA, 25 bp, Homo sapien
aaatagctatttcctcttgagtttg

SEQ ID NO: 650 - DNA, 25 bp, Homo sapien
tcctcttgagtttgagcatctgcag

SEQ ID NO: 651 - DNA, 25 bp, Homo sapien
agtttgagcatctgcagttgcccag

SEQ ID NO: 652 - DNA, 25 bp, Homo sapien
gcccagccccaattctttatttgga

SEQ ID NO: 653 - DNA, 25 bp, Homo sapien
atttcctcaaatagacattcacttt

SEQ ID NO: 654 - DNA, 25 bp, Homo sapien
ggctcttaaagactatatacatctg

SEQ ID NO: 655 - DNA, 25 bp, Homo sapien
atttttcatcctatagttagtaaga

SEQ ID NO: 656 - DNA, 25 bp, Homo sapien
atcctatagttagtaagatgcataa

SEQ ID NO: 657 - DNA, 25 bp, Homo sapien
gatgcataaaatcaatccactactg

SEQ ID NO: 658 - DNA, 25 bp, Homo sapien
taaaatcaatccactactgaaatag

SEQ ID NO: 659 - DNA, 25 bp, Homo sapien
aaatagtttcaagtcagacatttct

SEQ ID NO: 660 - DNA, 25 bp, Homo sapien
gtcagacatttctgagttcagacat

SEQ ID NO: 661 - DNA, 25 bp, Homo sapien
gagttcagacatttctcaacattct

SEQ ID NO: 662 - DNA, 25 bp, Homo sapien
agttcagacatttctcaacattctt

SEQ ID NO: 663 - DNA, 25 bp, Homo sapien
ttttgattcccatgtatcacatgaa

SEQ ID NO: 664 - DNA, 25 bp, Homo sapien
ccatgtatcacatgaattacacttc

SEQ ID NO: 665 - DNA, 25 bp, Homo sapien
gaaactgcgaatctaaaaggaatat

SEQ ID NO: 666 - DNA, 25 bp, Homo sapien
acactgcagagactccttacggaaa

SEQ ID NO: 667 - DNA, 25 bp, Homo sapien
actgcagagactccttacggaaata

SEQ ID NO: 668 - DNA, 25 bp, Homo sapien
gcagagactccttacggaaataaaa

SEQ ID NO: 669 - DNA, 25 bp, Homo sapien
taaacacttaccactcatgttgcat

SEQ ID NO: 670 - DNA, 25 bp, Homo sapien
acacttaccactcatgttgcatgtg

SEQ ID NO: 671 - DNA, 25 bp, Homo sapien
ttaccactcatgttgcatgtgaatc

SEQ ID NO: 672 - DNA, 25 bp, Homo sapien
ccactcatgttgcatgtgaatccac

SEQ ID NO: 673 - DNA, 25 bp, Homo sapien
acatcctgaagggaggctacaactg

SEQ ID NO: 674 - DNA, 25 bp, Homo sapien
cctgaagggaggctacaactggaat

SEQ ID NO: 675 - DNA, 25 bp, Homo sapien
gggaggctacaactggaataaaaat

SEQ ID NO: 676 - DNA, 25 bp, Homo sapien
aaatgtaataatgggagcctcatat

SEQ ID NO: 677 - DNA, 25 bp, Homo sapien
taatgggagcctcatatgtaattgt

SEQ ID NO: 678 - DNA, 25 bp, Homo sapien
gtaattgtacattttctagcagtaa

SEQ ID NO: 679 - DNA, 25 bp, Homo sapien
gaggcttggaaatccaggagccaca

SEQ ID NO: 680 - DNA, 25 bp, Homo sapien
tggaaatccaggagccacaggaagc

SEQ ID NO: 681 - DNA, 25 bp, Homo sapien
cagtgagctttctgcggagccggat

SEQ ID NO: 682 - DNA, 25 bp, Homo sapien
agccggatccggtggagccaattca

SEQ ID NO: 683 - DNA, 25 bp, Homo sapien
ggtggagccaattcaccagcaggtc

SEQ ID NO: 684 - DNA, 25 bp, Homo sapien
gagccaattcaccagcaggtcccgg

SEQ ID NO: 685 - DNA, 25 bp, Homo sapien
cggcagcaactcttctacaacagat

SEQ ID NO: 686 - DNA, 25 bp, Homo sapien
aactcttctacaacagattcctgcc

SEQ ID NO: 687 - DNA, 25 bp, Homo sapien
ctgtaaagtctaagtgctgcagttt

SEQ ID NO: 688 - DNA, 25 bp, Homo sapien
tctaagtgctgcagtttccctacga

SEQ ID NO: 689 - DNA, 25 bp, Homo sapien
gtttccctacgaccattggattttg

SEQ ID NO: 690 - DNA, 25 bp, Homo sapien
ttctttagttttcaagagggactct

SEQ ID NO: 691 - DNA, 25 bp, Homo sapien
aagagggactctacatgtttccttg

SEQ ID NO: 692 - DNA, 25 bp, Homo sapien
tcatgtgtacactgcctatttatcc

SEQ ID NO: 693 - DNA, 25 bp, Homo sapien
ccccactgcccgaacatgttgatgg

SEQ ID NO: 694 - DNA, 25 bp, Homo sapien
gcccgaacatgttgatggcatttta

SEQ ID NO: 695 - DNA, 25 bp, Homo sapien
ggcattttatatagtaagctgtcag

SEQ ID NO: 696 - DNA, 25 bp, Homo sapien
agctgtcagttacttaatgtacaaa

SEQ ID NO: 697 - DNA, 25 bp, Homo sapien
aatgtacaaatattcttccattcca

SEQ ID NO: 698 - DNA, 25 bp, Homo sapien
gatttctaggtcactggggactccg

SEQ ID NO: 699 - DNA, 25 bp, Homo sapien
gggactccggcagcacattcggctt

SEQ ID NO: 700 - DNA, 25 bp, Homo sapien
cggcagcacattcggcttcagaata

SEQ ID NO: 701 - DNA, 25 bp, Homo sapien
cagcacattcggcttcagaataaag

SEQ ID NO: 702 - DNA, 25 bp, Homo sapien
gcttcagaataaagggcgcccgcgg

SEQ ID NO: 703 - DNA, 25 bp, Homo sapien
tgagggtcccttcagccacccttaa

SEQ ID NO: 704 - DNA, 25 bp, Homo sapien
ggccaggccatgaccctgaaagcct

SEQ ID NO: 705 - DNA, 25 bp, Homo sapien
aggccatgaccctgaaagcctagcc

SEQ ID NO: 706 - DNA, 25 bp, Homo sapien
ctgctgctggcctctgggtcgtgcc

SEQ ID NO: 707 - DNA, 25 bp, Homo sapien
gtgccccgcagactgagctgcgctt

SEQ ID NO: 708 - DNA, 25 bp, Homo sapien
gaacccaggcggtcggagcccggcg

SEQ ID NO: 709 - DNA, 25 bp, Homo sapien
ggctctggaggctttcagttctaag

SEQ ID NO: 710 - DNA, 25 bp, Homo sapien
ttcagttctaagcaggccctcgagt

SEQ ID NO: 711 - DNA, 25 bp, Homo sapien
agttcttcacgtcttaactctgtga

SEQ ID NO: 712 - DNA, 25 bp, Homo sapien
tctgtgaccccggacgagtttaagt

SEQ ID NO: 713 - DNA, 25 bp, Homo sapien
gacgagtttaagttgctaagccttg

SEQ ID NO: 714 - DNA, 25 bp, Homo sapien
tttctcatccgtaaaatagggctgc

SEQ ID NO: 715 - DNA, 25 bp, Homo sapien
tagggctgcaagtattacatgacat

SEQ ID NO: 716 - DNA, 25 bp, Homo sapien
gttttcaccctatgccacatatttt

SEQ ID NO: 717 - DNA, 25 bp, Homo sapien
aaatagcgatgtcggtcgcttgcct

SEQ ID NO: 718 - DNA, 25 bp, Homo sapien
cagagccttggagtggtagtatcaa

SEQ ID NO: 719 - DNA, 25 bp, Homo sapien
aaagtgggccttgcattatcgctcc

SEQ ID NO: 720 - DNA, 25 bp, Homo sapien
agaggcgtgcaaggcagatcgtcaa

SEQ ID NO: 721 - DNA, 25 bp, Homo sapien
tgcaaggcagatcgtcaaggcccca

SEQ ID NO: 722 - DNA, 25 bp, Homo sapien
aaggcagatcgtcaaggccccatgt

SEQ ID NO: 723 - DNA, 25 bp, Homo sapien
ggcagatcgtcaaggccccatgttc

SEQ ID NO: 724 - DNA, 25 bp, Homo sapien
tcgtcaaggccccatgttccagcat

SEQ ID NO: 725 - DNA, 25 bp, Homo sapien
atgttccagcatggagttccgctca

SEQ ID NO: 726 - DNA, 25 bp, Homo sapien
cagcatggagttccgctcaccaaca

SEQ ID NO: 727 - DNA, 25 bp, Homo sapien
cagagccctgggtgcatctagactt

SEQ ID NO: 728 - DNA, 25 bp, Homo sapien
gagccctgggtgcatctagacttta

SEQ ID NO: 729 - DNA, 25 bp, Homo sapien
gccctgggtgcatctagactttaaa

SEQ ID NO: 730 - DNA, 25 bp, Homo sapien
ctgggtgcatctagactttaaaaaa

SEQ ID NO: 731 - DNA, 25 bp, Homo sapien
tgatatcacgtggatggtcctcctg

SEQ ID NO: 732 - DNA, 25 bp, Homo sapien
gtcctcctgggagatggtctacaca

SEQ ID NO: 733 - DNA, 25 bp, Homo sapien
tggtctacacaacctcactgatggg

SEQ ID NO: 734 - DNA, 25 bp, Homo sapien
cactgatgggctggccataggtgct

SEQ ID NO: 735 - DNA, 25 bp, Homo sapien
accttagcggtcttctgccatgagc

SEQ ID NO: 736 - DNA, 25 bp, Homo sapien
atgagctgccccacgaactgggtga

SEQ ID NO: 737 - DNA, 25 bp, Homo sapien
cccacgaactgggtgactttgccat

SEQ ID NO: 738 - DNA, 25 bp, Homo sapien
atgctgctccagtcagggctgtcct

SEQ ID NO: 739 - DNA, 25 bp, Homo sapien
tgctgagcctcgtgtctggagccct

SEQ ID NO: 740 - DNA, 25 bp, Homo sapien
gggtcttcctctatgtggcccttgt

SEQ ID NO: 741 - DNA, 25 bp, Homo sapien
ttgtggacatgctaccagccctgct

SEQ ID NO: 742 - DNA, 25 bp, Homo sapien
ggcttagcccacctggcggctcagg

SEQ ID NO: 743 - DNA, 25 bp, Homo sapien
ccgcgggccgtgagctgccaccaga

SEQ ID NO: 744 - DNA, 25 bp, Homo sapien
gggcaccggacgatgtgcctctctt

SEQ ID NO: 745 - DNA, 25 bp, Homo sapien
caccggacgatgtgcctctcttggc

SEQ ID NO: 746 - DNA, 25 bp, Homo sapien
cccactccaccactcgggtataggg

SEQ ID NO: 747 - DNA, 25 bp, Homo sapien
tggcccggccactccgaaggcaggg

SEQ ID NO: 748 - DNA, 25 bp, Homo sapien
ccggccactccgaaggcagggagga

SEQ ID NO: 749 - DNA, 25 bp, Homo sapien
ggaggaggacttggcaactggcttt

SEQ ID NO: 750 - DNA, 25 bp, Homo sapien
gatgcgtgtctttcccacgcagaga

SEQ ID NO: 751 - DNA, 25 bp, Homo sapien
atgcgtgtctttcccacgcagagaa

SEQ ID NO: 752 - DNA, 25 bp, Homo sapien
gcgtgtctttcccacgcagagaagc

SEQ ID NO: 753 - DNA, 25 bp, Homo sapien
cctggttctcagtccacatggaaga

SEQ ID NO: 754 - DNA, 25 bp, Homo sapien
atccatgagagggtatgcagtcttc

SEQ ID NO: 755 - DNA, 25 bp, Homo sapien
gggtatgcagtcttctgacatccca

SEQ ID NO: 756 - DNA, 25 bp, Homo sapien
ttctgacatcccacagagcacagct

SEQ ID NO: 757 - DNA, 25 bp, Homo sapien
attgaaagaccaagctaccctctga

SEQ ID NO: 758 - DNA, 25 bp, Homo sapien
gaccaagctaccctctgaagaaata

SEQ ID NO: 759 - DNA, 25 bp, Homo sapien
gctaccctctgaagaaatactcact

SEQ ID NO: 760 - DNA, 25 bp, Homo sapien
aatactcactgcatgaacagagata

SEQ ID NO: 761 - DNA, 25 bp, Homo sapien
ttaaggagaatcatgaagagctcac

SEQ ID NO: 762 - DNA, 25 bp, Homo sapien
caattgaagcatccttaaagaaatg

SEQ ID NO: 763 - DNA, 25 bp, Homo sapien
ctttttgttgtctgtgttgagtcac

SEQ ID NO: 764 - DNA, 25 bp, Homo sapien
acatatcttgtctttgtgtaacacg

SEQ ID NO: 765 - DNA, 25 bp, Homo sapien
gtgtaacacgttcttagttgacaaa

SEQ ID NO: 766 - DNA, 25 bp, Homo sapien
gtgattctaaccaaaactttatgag

SEQ ID NO: 767 - DNA, 25 bp, Homo sapien
tgaggtaggcataacaattcttaat

SEQ ID NO: 768 - DNA, 25 bp, Homo sapien
gagagtggattttcagagactttaa

SEQ ID NO: 769 - DNA, 25 bp, Homo sapien
aatggccttcgatggatctgggacc

SEQ ID NO: 770 - DNA, 25 bp, Homo sapien
gggaccagaacttacacatcaggct

SEQ ID NO: 771 - DNA, 25 bp, Homo sapien
gggcctatgctggttttccttatgt

SEQ ID NO: 772 - DNA, 25 bp, Homo sapien
gttttccttatgtctggcaccgagg

SEQ ID NO: 773 - DNA, 25 bp, Homo sapien
ggcaccgaggtgtacacaatcagca

SEQ ID NO: 774 - DNA, 25 bp, Homo sapien
aaagaaggcttcatactagtaagat

SEQ ID NO: 775 - DNA, 25 bp, Homo sapien
gaatccgagaacttctccaggacac

SEQ ID NO: 776 - DNA, 25 bp, Homo sapien
aggacaggcgtgcaggacaacccca

SEQ ID NO: 777 - DNA, 25 bp, Homo sapien
aatggcgtctctcaggcagacctgc

SEQ ID NO: 778 - DNA, 25 bp, Homo sapien
tcaggcagacctgctggacggctgc

SEQ ID NO: 779 - DNA, 25 bp, Homo sapien
tgctcctatgacctgaagtctcatg

SEQ ID NO: 780 - DNA, 25 bp, Homo sapien
ctgctagaatctgcgggagcccgtg

SEQ ID NO: 781 - DNA, 25 bp, Homo sapien
gggagcccgtggtgtagcctcctct

SEQ ID NO: 782 - DNA, 25 bp, Homo sapien
tctggcctgaaaggtctgcctcaca

SEQ ID NO: 783 - DNA, 25 bp, Homo sapien
gaaaggtctgcctcacacaggcctt

SEQ ID NO: 784 - DNA, 25 bp, Homo sapien
agccggaggtgcgtaagcccactga

SEQ ID NO: 785 - DNA, 25 bp, Homo sapien
tgcgtaagcccactgaacgctgcag

SEQ ID NO: 786 - DNA, 25 bp, Homo sapien
tcacctacggcaacagctgcgccaa

SEQ ID NO: 787 - DNA, 25 bp, Homo sapien
aggaactaccgcgaccacctgcgcg

SEQ ID NO: 788 - DNA, 25 bp, Homo sapien
gcttccagcgctgttcgggccgctc

SEQ ID NO: 789 - DNA, 25 bp, Homo sapien
acagcccactgacagcctcgtgctg

SEQ ID NO: 790 - DNA, 25 bp, Homo sapien
tgacgctgctcttcgccaccagcat

SEQ ID NO: 791 - DNA, 25 bp, Homo sapien
atcgggctgctctacgcgcgcctgg

SEQ ID NO: 792 - DNA, 25 bp, Homo sapien
tcgcagcgcgcctccttcaagcggg

SEQ ID NO: 793 - DNA, 25 bp, Homo sapien
tgggcatcgtgctgctcttctgggc

SEQ ID NO: 794 - DNA, 25 bp, Homo sapien
agctgctcgcccagtaccaccaggc

SEQ ID NO: 795 - DNA, 25 bp, Homo sapien
gcggacggcgcgcatcgtcaactac

SEQ ID NO: 796 - DNA, 25 bp, Homo sapien
ggacggcgcgcatcgtcaactacct

SEQ ID NO: 797 - DNA, 25 bp, Homo sapien
cccactggcagaggcgagagctctg

SEQ ID NO: 798 - DNA, 25 bp, Homo sapien
aatggacagatgcagtccctcgggc

SEQ ID NO: 799 - DNA, 25 bp, Homo sapien
agtccctcgggcaggtgttcatcgc

SEQ ID NO: 800 - DNA, 25 bp, Homo sapien
gtgttcatcgccctcatcctaggta

SEQ ID NO: 801 - DNA, 25 bp, Homo sapien
atcctaggtactagccctggatgtc

SEQ ID NO: 802 - DNA, 25 bp, Homo sapien
ttcacacacagaagagcccttggtt

SEQ ID NO: 803 - DNA, 25 bp, Homo sapien
gggcactatgctctcaaccagtttg

SEQ ID NO: 804 - DNA, 25 bp, Homo sapien
agtttgtcagcccactcctcaggac

SEQ ID NO: 805 - DNA, 25 bp, Homo sapien
ctcaggacacttcctcaggtgcaga

SEQ ID NO: 806 - DNA, 25 bp, Homo sapien
caggtgcagacccttggacttgtaa

SEQ ID NO: 807 - DNA, 25 bp, Homo sapien
cagacccttggacttgtaataataa

SEQ ID NO: 808 - DNA, 25 bp, Homo sapien
acttcctatgggactcacgcctttg

SEQ ID NO: 809 - DNA, 25 bp, Homo sapien
cacgcctttgtctcgggcttttggt

SEQ ID NO: 810 - DNA, 25 bp, Homo sapien
tccaggctgagacaccggacactga

SEQ ID NO: 811 - DNA, 25 bp, Homo sapien
gctgagacaccggacactgagagaa

SEQ ID NO: 812 - DNA, 25 bp, Homo sapien
gagacaccggacactgagagaataa

SEQ ID NO: 813 - DNA, 25 bp, Homo sapien
taagggaaaatcagccccgacagcc

SEQ ID NO: 814 - DNA, 25 bp, Homo sapien
gacagccagggctaacaagacggtt

SEQ ID NO: 815 - DNA, 25 bp, Homo sapien
caagacggttaattacagcccgaga

SEQ ID NO: 816 - DNA, 25 bp, Homo sapien
ttacagcccgagaagaacgttaaca

SEQ ID NO: 817 - DNA, 25 bp, Homo sapien
gcccgagaagaacgttaacagtatt

SEQ ID NO: 818 - DNA, 25 bp, Homo sapien
gtattaattctaaccacaaaggagg

SEQ ID NO: 819 - DNA, 25 bp, Homo sapien
tccaagcctttaagacagcactgcc

SEQ ID NO: 820 - DNA, 25 bp, Homo sapien
agcactgccttctctggaactaaaa

SEQ ID NO: 821 - DNA, 25 bp, Homo sapien
ctgccttctctggaactaaaattac

SEQ ID NO: 822 - DNA, 25 bp, Homo sapien
ataatgtgtcttatttcagtataaa

SEQ ID NO: 823 - DNA, 25 bp, Homo sapien
atagtcatcagtagaattataagga

SEQ ID NO: 824 - DNA, 25 bp, Homo sapien
aattataaggatgccatatcatgac

SEQ ID NO: 825 - DNA, 25 bp, Homo sapien
atatcatgacattttagaagtggag

SEQ ID NO: 826 - DNA, 25 bp, Homo sapien
gtggagagtgcatcatatgtagaaa

SEQ ID NO: 827 - DNA, 25 bp, Homo sapien
aataaatattcagacgtggctcatt

SEQ ID NO: 828 - DNA, 25 bp, Homo sapien
atattcagacgtggctcattaatgt

SEQ ID NO: 829 - DNA, 25 bp, Homo sapien
tcattttaagaaaagtgcagccagg

SEQ ID NO: 830 - DNA, 25 bp, Homo sapien
aagtgttcttgtataccatgtttga

SEQ ID NO: 831 - DNA, 25 bp, Homo sapien
gcagttactctgatctagtccatta

SEQ ID NO: 832 - DNA, 25 bp, Homo sapien
gatctagtccattatgctatatact

SEQ ID NO: 833 - DNA, 25 bp, Homo sapien
gctatatactgttttcgctcatctc

SEQ ID NO: 834 - DNA, 25 bp, Homo sapien
tgttttcgctcatctcttttcagat

SEQ ID NO: 835 - DNA, 25 bp, Homo sapien
cgctcatctcttttcagattggaag

SEQ ID NO: 836 - DNA, 25 bp, Homo sapien
agattggaagcctgccttttacaca

SEQ ID NO: 837 - DNA, 25 bp, Homo sapien
gcctgccttttacacattgcttttt

SEQ ID NO: 838 - DNA, 25 bp, Homo sapien
tgctttttaccacacgtttccagaa

SEQ ID NO: 839 - DNA, 25 bp, Homo sapien
gagggaataaactacagggagacaa

SEQ ID NO: 840 - DNA, 25 bp, Homo sapien
ggttattattttgggcacagtggct

SEQ ID NO: 841 - DNA, 25 bp, Homo sapien
ctttatagaaatccctcagtttggc

SEQ ID NO: 842 - DNA, 25 bp, Homo sapien
cccaccattctacagagttgtactc

SEQ ID NO: 843 - DNA, 25 bp, Homo sapien
gagttgtactcaagacagatactga

SEQ ID NO: 844 - DNA, 25 bp, Homo sapien
ctaataccttcccttgtattttcag

SEQ ID NO: 845 - DNA, 25 bp, Homo sapien
attttcagcattaccatctatacag

SEQ ID NO: 846 - DNA, 25 bp, Homo sapien
atattatcacaatcatgcccttcca

SEQ ID NO: 847 - DNA, 25 bp, Homo sapien
aatcatgcccttccattgaattatt

SEQ ID NO: 848 - DNA, 25 bp, Homo sapien
ttctccacaatattaccatgcaagt

SEQ ID NO: 849 - DNA, 25 bp, Homo sapien
taccatgcaagttatctctgaaatt

SEQ ID NO: 850 - DNA, 25 bp, Homo sapien
ggatgtgtaaagcttctatgtattg

SEQ ID NO: 851 - DNA, 25 bp, Homo sapien
ttttttgtcagtgtaaagcagtcat

SEQ ID NO: 852 - DNA, 25 bp, Homo sapien
aatccaatgggaactctggccaaga

SEQ ID NO: 853 - DNA, 25 bp, Homo sapien
aatgggaactctggccaagactcta

SEQ ID NO: 854 - DNA, 25 bp, Homo sapien
ggaactctggccaagactctactac

SEQ ID NO: 855 - DNA, 25 bp, Homo sapien
aagactctactacccagacaccaaa

SEQ ID NO: 856 - DNA, 25 bp, Homo sapien
gaagaaatgattaaccctggaggct

SEQ ID NO: 857 - DNA, 25 bp, Homo sapien
aaatgattaaccctggaggctgcct

SEQ ID NO: 858 - DNA, 25 bp, Homo sapien
gaggctgccttggtctaggtgaaaa

SEQ ID NO: 859 - DNA, 25 bp, Homo sapien
aggctgccttggtctaggtgaaaaa

SEQ ID NO: 860 - DNA, 25 bp, Homo sapien
atatatgtacgatgacagtgcaatc

SEQ ID NO: 861 - DNA, 25 bp, Homo sapien
cgatgacagtgcaatcatactagaa

SEQ ID NO: 862 - DNA, 25 bp, Homo sapien
tagagacacacaagaacccttcaaa

SEQ ID NO: 863 - DNA, 25 bp, Homo sapien
gaaggaactcggttacaaatccata

SEQ ID NO: 864 - DNA, 25 bp, Homo sapien
tggaaaagccacacaactcttacat

SEQ ID NO: 865 - DNA, 25 bp, Homo sapien
gccacacaactcttacatactgata

SEQ ID NO: 866 - DNA, 25 bp, Homo sapien
ttagaaaggtgcttttgttctccag

SEQ ID NO: 867 - DNA, 25 bp, Homo sapien
ttgttctccagactccagtgattct

SEQ ID NO: 868 - DNA, 25 bp, Homo sapien
gtgattctgcactgggcattatgga

SEQ ID NO: 869 - DNA, 25 bp, Homo sapien
acgaaacgcagggaaaccgtgcaag

SEQ ID NO: 870 - DNA, 25 bp, Homo sapien
gaaaccgtgcaagagagaacagtag

SEQ ID NO: 871 - DNA, 25 bp, Homo sapien
gatttaacatgtagcttcccagaaa

SEQ ID NO: 872 - DNA, 25 bp, Homo sapien
atgtgtttgtgaatgcctcatgaca

SEQ ID NO: 873 - DNA, 25 bp, Homo sapien
tgcctcatgacataagcatctgaag

SEQ ID NO: 874 - DNA, 25 bp, Homo sapien
agcccaagcatcactgcccgaggcg

SEQ ID NO: 875 - DNA, 25 bp, Homo sapien
agtttcaccgtccacgtccacaagg

SEQ ID NO: 876 - DNA, 25 bp, Homo sapien
ggtcagtgctggaaagcgcccctca

SEQ ID NO: 877 - DNA, 25 bp, Homo sapien
tgacaagggcccttctctactgtct

SEQ ID NO: 878 - DNA, 25 bp, Homo sapien
agggcccttctctactgtctgtggg

SEQ ID NO: 879 - DNA, 25 bp, Homo sapien
tgcctcctttgcacctgattttgaa

SEQ ID NO: 880 - DNA, 25 bp, Homo sapien
ctcctttgcacctgattttgaaggt

SEQ ID NO: 881 - DNA, 25 bp, Homo sapien
tgcacctgattttgaaggtgtctct

SEQ ID NO: 882 - DNA, 25 bp, Homo sapien
gtctctttcatccatggttaagtca

SEQ ID NO: 883 - DNA, 25 bp, Homo sapien
ctttcatccatggttaagtcataaa

SEQ ID NO: 884 - DNA, 25 bp, Homo sapien
gtcataaaaagcttattggttttgg

SEQ ID NO: 885 - DNA, 25 bp, Homo sapien
gagcagggactacttggaatgataa

SEQ ID NO: 886 - DNA, 25 bp, Homo sapien
ggactacttggaatgataaaggcaa

SEQ ID NO: 887 - DNA, 25 bp, Homo sapien
tggaccctgaaattacctggacctt

SEQ ID NO: 888 - DNA, 25 bp, Homo sapien
agccctgaaccagaagcctgagcaa

SEQ ID NO: 889 - DNA, 25 bp, Homo sapien
gaagcctgagcaactacggacgcaa

SEQ ID NO: 890 - DNA, 25 bp, Homo sapien
tgagcaactacggacgcaagccgag

SEQ ID NO: 891 - DNA, 25 bp, Homo sapien
actacggacgcaagccgaggaccgt

SEQ ID NO: 892 - DNA, 25 bp, Homo sapien
gtgctgccgccgtccacgaaaagac

SEQ ID NO: 893 - DNA, 25 bp, Homo sapien
atcggcctccagtttgcgtcgagaa

SEQ ID NO: 894 - DNA, 25 bp, Homo sapien
ggcctccagtttgcgtcgagaattc

SEQ ID NO: 895 - DNA, 25 bp, Homo sapien
ctccagtttgcgtcgagaattcctg

SEQ ID NO: 896 - DNA, 25 bp, Homo sapien
ccctggtgcgcattgagatccatgg

SEQ ID NO: 897 - DNA, 25 bp, Homo sapien
actgtgcccggcaggagactgacta

SEQ ID NO: 898 - DNA, 25 bp, Homo sapien
caggagactgactacgtgctcaaca

SEQ ID NO: 899 - DNA, 25 bp, Homo sapien
tccggagctggcactggtccggttt

SEQ ID NO: 900 - DNA, 25 bp, Homo sapien
gtggaagattatgacgccacctccc

SEQ ID NO: 901 - DNA, 25 bp, Homo sapien
ggccagtttacactgcctcttagca

SEQ ID NO: 902 - DNA, 25 bp, Homo sapien
ttacactgcctcttagcagcctaaa

SEQ ID NO: 903 - DNA, 25 bp, Homo sapien
tgcctcttagcagcctaaagcaagg

SEQ ID NO: 904 - DNA, 25 bp, Homo sapien
taaagcaagggtaccgccacataca

SEQ ID NO: 905 - DNA, 25 bp, Homo sapien
acatacacctgctttccaaggacgg

SEQ ID NO: 906 - DNA, 25 bp, Homo sapien
ccgtaggtttgtaactgtttcatag

SEQ ID NO: 907 - DNA, 25 bp, Homo sapien
gggtgtccggctcatccacaagacc

SEQ ID NO: 908 - DNA, 25 bp, Homo sapien
agcactcaggcccatgccagtgttg

SEQ ID NO: 909 - DNA, 25 bp, Homo sapien
caggcccatgccagtgttgactcta

SEQ ID NO: 910 - DNA, 25 bp, Homo sapien
agggttaaagcagtcccagccttag

SEQ ID NO: 911 - DNA, 25 bp, Homo sapien
ttaaagcagtcccagccttagccca

SEQ ID NO: 912 - DNA, 25 bp, Homo sapien
ggagtgttaatatctctctggagga

SEQ ID NO: 913 - DNA, 25 bp, Homo sapien
ggacaaatgacagaagggttcatat

SEQ ID NO: 914 - DNA, 25 bp, Homo sapien
aacagtatcctgacacagtcatgct

SEQ ID NO: 915 - DNA, 25 bp, Homo sapien
gacacagtcatgcttcctggatttt

SEQ ID NO: 916 - DNA, 25 bp, Homo sapien
ctggattttggagtcgaggctttct

SEQ ID NO: 917 - DNA, 25 bp, Homo sapien
tggagtcgaggctttctacagaaaa

SEQ ID NO: 918 - DNA, 25 bp, Homo sapien
ttggcataattgtggagtaggaaga

SEQ ID NO: 919 - DNA, 25 bp, Homo sapien
cagtggctgcgggtgaagtcatggg

SEQ ID NO: 920 - DNA, 25 bp, Homo sapien
tgaagtcatgggaaggcaagtcatg

SEQ ID NO: 921 - DNA, 25 bp, Homo sapien
agggcattaatcaaggatatgttct

SEQ ID NO: 922 - DNA, 25 bp, Homo sapien
cattaatcaaggatatgttctggga

SEQ ID NO: 923 - DNA, 25 bp, Homo sapien
gccacagttaaagactgcctacctt

SEQ ID NO: 924 - DNA, 25 bp, Homo sapien
cagtctcaaccatccaaactaataa

SEQ ID NO: 925 - DNA, 25 bp, Homo sapien
gtctcaaccatccaaactaataagc

SEQ ID NO: 926 - DNA, 25 bp, Homo sapien
ctcaaccatccaaactaataagctg

SEQ ID NO: 927 - DNA, 25 bp, Homo sapien
caaccatccaaactaataagctgaa

SEQ ID NO: 928 - DNA, 25 bp, Homo sapien
accatccaaactaataagctgaatt

SEQ ID NO: 929 - DNA, 25 bp, Homo sapien
gatcccatggaaaagaggctggaac

SEQ ID NO: 930 - DNA, 25 bp, Homo sapien
ttcagtgtcactgccaggagtcggg

SEQ ID NO: 931 - DNA, 25 bp, Homo sapien
gagtcgggagctgacaccctaggca

SEQ ID NO: 932 - DNA, 25 bp, Homo sapien
gggcttttgaccagggtagtgatat

SEQ ID NO: 933 - DNA, 25 bp, Homo sapien
accagggtagtgatatgtgcagccg

SEQ ID NO: 934 - DNA, 25 bp, Homo sapien
gtgatatgtgcagccgggtaattta

SEQ ID NO: 935 - DNA, 25 bp, Homo sapien
ggtaatttagggtgacgcctccgtg

SEQ ID NO: 936 - DNA, 25 bp, Homo sapien
tagggtgacgcctccgtgtggatta

SEQ ID NO: 937 - DNA, 25 bp, Homo sapien
tgacgcctccgtgtggattaggagt

SEQ ID NO: 938 - DNA, 25 bp, Homo sapien
tggaggatgcaccaggaaacagcat

SEQ ID NO: 939 - DNA, 25 bp, Homo sapien
aataggtgttcaatcaggccgggca

SEQ ID NO: 940 - DNA, 25 bp, Homo sapien
ttagccgatgaattacatatgccat

SEQ ID NO: 941 - DNA, 25 bp, Homo sapien
atatgccatctctccctgaaatgat

SEQ ID NO: 942 - DNA, 25 bp, Homo sapien
gagacaacgttttaagaatccagca

SEQ ID NO: 943 - DNA, 25 bp, Homo sapien
gagttcaatgctacagatgcgttaa

SEQ ID NO: 944 - DNA, 25 bp, Homo sapien
gtaaacaactaccaaggaatgctta

SEQ ID NO: 945 - DNA, 25 bp, Homo sapien
gaatgcttaaagtggcctgtgctga

SEQ ID NO: 946 - DNA, 25 bp, Homo sapien
gcctgtgctgaagagtggcaagaaa

SEQ ID NO: 947 - DNA, 25 bp, Homo sapien
gcaggacggagggtgaacactccaa

SEQ ID NO: 948 - DNA, 25 bp, Homo sapien
taaaccatatgattggacctataca

SEQ ID NO: 949 - DNA, 25 bp, Homo sapien
gggaaccttacttggagaatctctt

SEQ ID NO: 950 - DNA, 25 bp, Homo sapien
tcatggagtttcaagcctgagtgtg

SEQ ID NO: 951 - DNA, 25 bp, Homo sapien
actttgacccacacactaacaagtg

SEQ ID NO: 952 - DNA, 25 bp, Homo sapien
gagtttgtgtgctccaatgtccaaa

SEQ ID NO: 953 - DNA, 25 bp, Homo sapien
ggagttgccacatacaatggattct

SEQ ID NO: 954 - DNA, 25 bp, Homo sapien
ggctttctgactgtgtggaacggta

SEQ ID NO: 955 - DNA, 25 bp, Homo sapien
gtgattcatggtcaactgtggcacc

SEQ ID NO: 956 - DNA, 25 bp, Homo sapien
aactgtggcacctctgagtgttcct

SEQ ID NO: 957 - DNA, 25 bp, Homo sapien
tgagtgttcctcgagatgctgttgc

SEQ ID NO: 958 - DNA, 25 bp, Homo sapien
gagatgctgttgctgtgtgccctct

SEQ ID NO: 959 - DNA, 25 bp, Homo sapien
tgtgccctcttggagacaaactcta

SEQ ID NO: 960 - DNA, 25 bp, Homo sapien
gacggacatacttatttgaacacag

SEQ ID NO: 961 - DNA, 25 bp, Homo sapien
aacacagttgagtcatatgatgcac

SEQ ID NO: 962 - DNA, 25 bp, Homo sapien
ccttggaaagcagtcgttgcgccag

SEQ ID NO: 963 - DNA, 25 bp, Homo sapien
tggaaagcagtcgttgcgccagaca

SEQ ID NO: 964 - DNA, 25 bp, Homo sapien
aaagcagtcgttgcgccagacagcc

SEQ ID NO: 965 - DNA, 25 bp, Homo sapien
tcgttgcgccagacagcccagggaa

SEQ ID NO: 966 - DNA, 25 bp, Homo sapien
ttgcgccagacagcccagggaagag

SEQ ID NO: 967 - DNA, 25 bp, Homo sapien
ccagacagcccagggaagagcggca

SEQ ID NO: 968 - DNA, 25 bp, Homo sapien
ggcagcctgaggacctagggccacc

SEQ ID NO: 969 - DNA, 25 bp, Homo sapien
aggacctagggccacctgctgttcc

SEQ ID NO: 970 - DNA, 25 bp, Homo sapien
ggacccaggacaatggctgctgttc

SEQ ID NO: 971 - DNA, 25 bp, Homo sapien
gacaatggctgctgttcatgatctg

SEQ ID NO: 972 - DNA, 25 bp, Homo sapien
ctgttcatgatctggagatggagag

SEQ ID NO: 973 - DNA, 25 bp, Homo sapien
gtcagattaatcatttcggcagaac

SEQ ID NO: 974 - DNA, 25 bp, Homo sapien
taatcatttcggcagaacaaacaat

SEQ ID NO: 975 - DNA, 25 bp, Homo sapien
tttaatccttaaaattgtgatctcc

SEQ ID NO: 976 - DNA, 25 bp, Homo sapien
tcagaataacccagaccaaggctta

SEQ ID NO: 977 - DNA, 25 bp, Homo sapien
taacccagaccaaggcttaattgta

SEQ ID NO: 978 - DNA, 25 bp, Homo sapien
ccaagagaaaatgctggctttcagt

SEQ ID NO: 979 - DNA, 25 bp, Homo sapien
gctggctttcagtagaagttaatat

SEQ ID NO: 980 - DNA, 25 bp, Homo sapien
gaaacccaaatctggttctgaaagt

SEQ ID NO: 981 - DNA, 25 bp, Homo sapien
agtgtgtatcagatgtacggtgaac

SEQ ID NO: 982 - DNA, 25 bp, Homo sapien
gatgtacggtgaacaaacttgggaa

SEQ ID NO: 983 - DNA, 25 bp, Homo sapien
aaatcaatgagcgttggccaggcac

SEQ ID NO: 984 - DNA, 25 bp, Homo sapien
tctctgctttccctcttatgaaaat

SEQ ID NO: 985 - DNA, 25 bp, Homo sapien
gtgaaggtctcaaagcccacttcat

SEQ ID NO: 986 - DNA, 25 bp, Homo sapien
aaaggcccgcttttgaagtgcctga

SEQ ID NO: 987 - DNA, 25 bp, Homo sapien
ggtggcaaatcttgagactccctat

SEQ ID NO: 988 - DNA, 25 bp, Homo sapien
gagactccctattagagagcttcga

SEQ ID NO: 989 - DNA, 25 bp, Homo sapien
agagagcttcgattttcctgaaatt

SEQ ID NO: 990 - DNA, 25 bp, Homo sapien
ggtttgatcttggtttctataccta

SEQ ID NO: 991 - DNA, 25 bp, Homo sapien
ctatacctattatggctgcctgact

SEQ ID NO: 992 - DNA, 25 bp, Homo sapien
gcaggcctaagccacttggttttgc

SEQ ID NO: 993 - DNA, 25 bp, Homo sapien
acttggttttgcttcacatattggg

SEQ ID NO: 994 - DNA, 25 bp, Homo sapien
tgccttctaggtgctcctgggaaat

SEQ ID NO: 995 - DNA, 25 bp, Homo sapien
ggagagccaggtgccacgggcaggg

SEQ ID NO: 996 - DNA, 25 bp, Homo sapien
ggtgccacgggcagggcgaggcggg

SEQ ID NO: 997 - DNA, 25 bp, Homo sapien
ggtgctgggcccttcatagagcccc

SEQ ID NO: 998 - DNA, 25 bp, Homo sapien
cagaccctccttagaatcccacagt

SEQ ID NO: 999 - DNA, 25 bp, Homo sapien
cttagaatcccacagtccccaagat

SEQ ID NO: 1000 - DNA, 25 bp, Homo sapien
ttagaatcccacagtccccaagatc

SEQ ID NO: 1001 - DNA, 25 bp, Homo sapien
acagtccccaagatcctccttagaa

SEQ ID NO: 1002 - DNA, 25 bp, Homo sapien
agtccccaagatcctccttagaatc

SEQ ID NO: 1003 - DNA, 25 bp, Homo sapien
aagatcctccttagaatcccacagt

SEQ ID NO: 1004 - DNA, 25 bp, Homo sapien
tcaaaccttgagataggctgggtgc

SEQ ID NO: 1005 - DNA, 25 bp, Homo sapien
caaaccttgagataggctgggtgcg

SEQ ID NO: 1006 - DNA, 25 bp, Homo sapien
gggccttgcctgagccatgtgcaga

SEQ ID NO: 1007 - DNA, 25 bp, Homo sapien
ccttgcctgagccatgtgcagagct

SEQ ID NO: 1008 - DNA, 25 bp, Homo sapien
ggtccagcggtctgcttccttggag

SEQ ID NO: 1009 - DNA, 25 bp, Homo sapien
agcggtctgcttccttggagccagt

SEQ ID NO: 1010 - DNA, 25 bp, Homo sapien
gagccagtgtggatggttacagccc

SEQ ID NO: 1011 - DNA, 25 bp, Homo sapien
gttacagcccatccatttggtgcag

SEQ ID NO: 1012 - DNA, 25 bp, Homo sapien
ccatccatttggtgcagttgtactt

SEQ ID NO: 1013 - DNA, 25 bp, Homo sapien
catttggtgcagttgtacttggtct

SEQ ID NO: 1014 - DNA, 25 bp, Homo sapien
agttgtacttggtctgttatattca

SEQ ID NO: 1015 - DNA, 25 bp, Homo sapien
tctgttatattcaatcaaggtttaa

SEQ ID NO: 1016 - DNA, 25 bp, Homo sapien
aggtttaatagatagggctgggcat

SEQ ID NO: 1017 - DNA, 25 bp, Homo sapien
atctcccttgactgcagagcaggtt

SEQ ID NO: 1018 - DNA, 25 bp, Homo sapien
gactgcagagcaggttcctccactg

SEQ ID NO: 1019 - DNA, 25 bp, Homo sapien
gaccccatcaggttaatcccctgtt

SEQ ID NO: 1020 - DNA, 25 bp, Homo sapien
taatcccctgttgccatggttatgg

SEQ ID NO: 1021 - DNA, 25 bp, Homo sapien
ttgccatggttatggagagcttgca

SEQ ID NO: 1022 - DNA, 25 bp, Homo sapien
agctgccatcttagatgtgctcttt

SEQ ID NO: 1023 - DNA, 25 bp, Homo sapien
gaagcccatctaacaggaggacatt

SEQ ID NO: 1024 - DNA, 25 bp, Homo sapien
gggaaggctttctctaggatcagat

SEQ ID NO: 1025 - DNA, 25 bp, Homo sapien
aggctttctctaggatcagattcaa

SEQ ID NO: 1026 - DNA, 25 bp, Homo sapien
caagctgatctggtggtgcatccac

SEQ ID NO: 1027 - DNA, 25 bp, Homo sapien
ctgatctggtggtgcatccacgcac

SEQ ID NO: 1028 - DNA, 25 bp, Homo sapien
ttggtgcatgtggtcagcagcctta

SEQ ID NO: 1029 - DNA, 25 bp, Homo sapien
tactcaaccttctgataacctgctt

SEQ ID NO: 1030 - DNA, 25 bp, Homo sapien
aacctgcttcattattgttatgtac

SEQ ID NO: 1031 - DNA, 25 bp, Homo sapien
gttatgtacactgctatcttaagat

SEQ ID NO: 1032 - DNA, 25 bp, Homo sapien
tatttggtttccaggcaggactgac

SEQ ID NO: 1033 - DNA, 25 bp, Homo sapien
gcaggactgacgtctttggattgca

SEQ ID NO: 1034 - DNA, 25 bp, Homo sapien
gcagtggatcttactgcttacctgt

SEQ ID NO: 1035 - DNA, 25 bp, Homo sapien
tcagcactgctctttatgggaaact

SEQ ID NO: 1036 - DNA, 25 bp, Homo sapien
ggaaacttctgaaactccccacatg

SEQ ID NO: 1037 - DNA, 25 bp, Homo sapien
ctggaccaaaagatctcagattgct

SEQ ID NO: 1038 - DNA, 25 bp, Homo sapien
tgccgggattggaggcccaagccac

SEQ ID NO: 1039 - DNA, 25 bp, Homo sapien
ccagaaattccttgttagactttag

SEQ ID NO: 1040 - DNA, 25 bp, Homo sapien
aattccttgttagactttagatcca

SEQ ID NO: 1041 - DNA, 25 bp, Homo sapien
gttagactttagatccaaatgacat

SEQ ID NO: 1042 - DNA, 25 bp, Homo sapien
tagatccaaatgacatggcacatgt

SEQ ID NO: 1043 - DNA, 25 bp, Homo sapien
tgacatggcacatgtgtgcccagac

SEQ ID NO: 1044 - DNA, 25 bp, Homo sapien
atgtgtgcccagaccagttcccaac

SEQ ID NO: 1045 - DNA, 25 bp, Homo sapien
agttcccaacacatgcttactagta

SEQ ID NO: 1046 - DNA, 25 bp, Homo sapien
gcttactagtaacgcccctgcatga

SEQ ID NO: 1047 - DNA, 25 bp, Homo sapien
gcatgaccccttcatgaataatcat

SEQ ID NO: 1048 - DNA, 25 bp, Homo sapien
ataagaagcatctccccagccaggt

SEQ ID NO: 1049 - DNA, 25 bp, Homo sapien
aagcatctccccagccaggtgtggt

SEQ ID NO: 1050 - DNA, 25 bp, Homo sapien
gtctgcaaagtagagctgttatgtt

SEQ ID NO: 1051 - DNA, 25 bp, Homo sapien
agtagagctgttatgtttttcttga

SEQ ID NO: 1052 - DNA, 25 bp, Homo sapien
ttttcttgaactttagagggcagca

SEQ ID NO: 1053 - DNA, 25 bp, Homo sapien
ggcagcagaggagctgtctgaaaaa

SEQ ID NO: 1054 - DNA, 25 bp, Homo sapien
gagctgtctgaaaaaaatccctact

SEQ ID NO: 1055 - DNA, 25 bp, Homo sapien
tccctacttgaccaggaaaagcatt

SEQ ID NO: 1056 - DNA, 25 bp, Homo sapien
acttgaccaggaaaagcatttttgt

SEQ ID NO: 1057 - DNA, 25 bp, Homo sapien
tactctgtagtaattgatgattaac

SEQ ID NO: 1058 - DNA, 25 bp, Homo sapien
tgattaacttgggaagaagtctcag

SEQ ID NO: 1059 - DNA, 25 bp, Homo sapien
aaggctatagtgagacacgattgca

SEQ ID NO: 1060 - DNA, 25 bp, Homo sapien
gtgagacacgattgcaccacttcat

SEQ ID NO: 1061 - DNA, 25 bp, Homo sapien
gactttgaagttgtatattcttgca

SEQ ID NO: 1062 - DNA, 25 bp, Homo sapien
gaagttgtatattcttgcaatgcat

SEQ ID NO: 1063 - DNA, 25 bp, Homo sapien
gacattataatcaacaaacttatgg

SEQ ID NO: 1064 - DNA, 25 bp, Homo sapien
caaacttatggtttgtttcaattga

SEQ ID NO: 1065 - DNA, 25 bp, Homo sapien
ttgtttcaattgatgcacacaaaaa

SEQ ID NO: 1066 - DNA, 25 bp, Homo sapien
ttctatttcaagtaaagctttgagt

SEQ ID NO: 1067 - DNA, 25 bp, Homo sapien
atattcatcatgtaccctttattgt

SEQ ID NO: 1068 - DNA, 25 bp, Homo sapien
catcatgtaccctttattgtttcta

SEQ ID NO: 1069 - DNA, 25 bp, Homo sapien
gtttctaggtgttgatatactttaa

SEQ ID NO: 1070 - DNA, 25 bp, Homo sapien
agatgtaacacttatttgctgtcaa

SEQ ID NO: 1071 - DNA, 25 bp, Homo sapien
ttatttgctgtcaaattctgaatta

SEQ ID NO: 1072 - DNA, 25 bp, Homo sapien
ttttacattctgtttactgccacaa

SEQ ID NO: 1073 - DNA, 25 bp, Homo sapien
ttacattctgtttactgccacaagc

SEQ ID NO: 1074 - DNA, 25 bp, Homo sapien
acattctgtttactgccacaagcac

SEQ ID NO: 1075 - DNA, 25 bp, Homo sapien
attctgtttactgccacaagcactg

SEQ ID NO: 1076 - DNA, 25 bp, Homo sapien
tctgtttactgccacaagcactgtg

SEQ ID NO: 1077 - DNA, 25 bp, Homo sapien
gtttactgccacaagcactgtggca

SEQ ID NO: 1078 - DNA, 25 bp, Homo sapien
agcactgtggcaataacttttgaat

SEQ ID NO: 1079 - DNA, 25 bp, Homo sapien
cactgtggcaataacttttgaattt

SEQ ID NO: 1080 - DNA, 25 bp, Homo sapien
aggaattgctagatagtgttttgaa

SEQ ID NO: 1081 - DNA, 25 bp, Homo sapien
gctagatagtgttttgaaagcatat

SEQ ID NO: 1082 - DNA, 25 bp, Homo sapien
gatagtgttttgaaagcatatcttt

SEQ ID NO: 1083 - DNA, 25 bp, Homo sapien
attttgtttcttgcccacacagata

SEQ ID NO: 1084 - DNA, 25 bp, Homo sapien
gataatatccacatacacattcact

SEQ ID NO: 1085 - DNA, 25 bp, Homo sapien
tacacattcactggctcttgtgagc

SEQ ID NO: 1086 - DNA, 25 bp, Homo sapien
agacagcagttgttctaattagtgg

SEQ ID NO: 1087 - DNA, 25 bp, Homo sapien
attagtgggagccatgtactcacca

SEQ ID NO: 1088 - DNA, 25 bp, Homo sapien
gggagccatgtactcaccagttaaa

SEQ ID NO: 1089 - DNA, 25 bp, Homo sapien
tcaccagttaaaatgggccacaaca

SEQ ID NO: 1090 - DNA, 25 bp, Homo sapien
gagagcatgtacttatcttgctttt

SEQ ID NO: 1091 - DNA, 25 bp, Homo sapien
caccaacagtggtttggttacctag

SEQ ID NO: 1092 - DNA, 25 bp, Homo sapien
ttcacttaattgtgcatgcttacat

SEQ ID NO: 1093 - DNA, 25 bp, Homo sapien
ctagcaaatctgcataccaaattat

SEQ ID NO: 1094 - DNA, 25 bp, Homo sapien
aggtgtcgtgccagctccagtcctt

SEQ ID NO: 1095 - DNA, 25 bp, Homo sapien
tttccagtcatacccctcaagaggc

SEQ ID NO: 1096 - DNA, 25 bp, Homo sapien
aagaggcaggatgacatctttcagc

SEQ ID NO: 1097 - DNA, 25 bp, Homo sapien
taatttactttgagacacttatgct

SEQ ID NO: 1098 - DNA, 25 bp, Homo sapien
gagacacttatgctcaagttggaga

SEQ ID NO: 1099 - DNA, 25 bp, Homo sapien
acaaactccatggtgttctctgtgt

SEQ ID NO: 1100 - DNA, 25 bp, Homo sapien
tctgtgtctctctttgtgcctctgg

SEQ ID NO: 1101 - DNA, 25 bp, Homo sapien
ctttgtgcctctggactggcaagat

SEQ ID NO: 1102 - DNA, 25 bp, Homo sapien
actggcaagatgtccaggagcccac

SEQ ID NO: 1103 - DNA, 25 bp, Homo sapien
ggagcccactgccttagaaagctga

SEQ ID NO: 1104 - DNA, 25 bp, Homo sapien
gcagtgagccgaatttttgcaatca

SEQ ID NO: 1105 - DNA, 25 bp, Homo sapien
ccctgaggttgcaggtctgggatca

SEQ ID NO: 1106 - DNA, 25 bp, Homo sapien
aggactctggcagggacgatgacct

SEQ ID NO: 1107 - DNA, 25 bp, Homo sapien
agggacgatgacctccttggcacct

SEQ ID NO: 1108 - DNA, 25 bp, Homo sapien
tgtgatcaggctcccaagtctggtt

SEQ ID NO: 1109 - DNA, 25 bp, Homo sapien
aagtctggttcccatgaggtgagat

SEQ ID NO: 1110 - DNA, 25 bp, Homo sapien
gagatgcaacctgaatcatggccac

SEQ ID NO: 1111 - DNA, 25 bp, Homo sapien
aatcatggccacctaaaattccgct

SEQ ID NO: 1112 - DNA, 25 bp, Homo sapien
aaaattccgctatcatgccaggtgc

SEQ ID NO: 1113 - DNA, 25 bp, Homo sapien
ggaggcacctgcctggactatgtcc

SEQ ID NO: 1114 - DNA, 25 bp, Homo sapien
gggctgtcttcgtattcccattaga

SEQ ID NO: 1115 - DNA, 25 bp, Homo sapien
catcggctatcgttagtgctagtgg

SEQ ID NO: 1116 - DNA, 25 bp, Homo sapien
gttgtggcccttatactgcagtatt

SEQ ID NO: 1117 - DNA, 25 bp, Homo sapien
tatactgcagtattatatgctccat

SEQ ID NO: 1118 - DNA, 25 bp, Homo sapien
tatatgctccatgagactgtggcac

SEQ ID NO: 1119 - DNA, 25 bp, Homo sapien
tgggacctggactctggacactaca

SEQ ID NO: 1120 - DNA, 25 bp, Homo sapien
acctggactctggacactacaggag

SEQ ID NO: 1121 - DNA, 25 bp, Homo sapien
ggcttctggtctatcgttctctgca

SEQ ID NO: 1122 - DNA, 25 bp, Homo sapien
tctggtctatcgttctctgcacttt

SEQ ID NO: 1123 - DNA, 25 bp, Homo sapien
cccagtgacctcctgagttggagtt

SEQ ID NO: 1124 - DNA, 25 bp, Homo sapien
cttggtctccttcacatgtgtgggc

SEQ ID NO: 1125 - DNA, 25 bp, Homo sapien
atgtgtgggctatgcggtcaccaag

SEQ ID NO: 1126 - DNA, 25 bp, Homo sapien
cattccgaggtggttgtggccctta

SEQ ID NO: 1127 - DNA, 25 bp, Homo sapien
aaatcagctgtggtaaagtagcctg

SEQ ID NO: 1128 - DNA, 25 bp, Homo sapien
tgaaagccagtggtgcaaccccatc

SEQ ID NO: 1129 - DNA, 25 bp, Homo sapien
cacctctagcacctccagtgataag

SEQ ID NO: 1130 - DNA, 25 bp, Homo sapien
acctctagcacctccagtgataagc

SEQ ID NO: 1131 - DNA, 25 bp, Homo sapien
ctctagcacctccagtgataagcac

SEQ ID NO: 1132 - DNA, 25 bp, Homo sapien
tctagcacctccagtgataagcact

SEQ ID NO: 1133 - DNA, 25 bp, Homo sapien
tagcacctccagtgataagcactaa

SEQ ID NO: 1134 - DNA, 25 bp, Homo sapien
agcacctccagtgataagcactaat

SEQ ID NO: 1135 - DNA, 25 bp, Homo sapien
gcacctccagtgataagcactaatt

SEQ ID NO: 1136 - DNA, 25 bp, Homo sapien
acctccagtgataagcactaattgc

SEQ ID NO: 1137 - DNA, 25 bp, Homo sapien
attgcctatatacaacccttttttg

SEQ ID NO: 1138 - DNA, 25 bp, Homo sapien
caatctcacagtcaatctacttcac

SEQ ID NO: 1139 - DNA, 25 bp, Homo sapien
tacttcactgtaatgttgcttttct

SEQ ID NO: 1140 - DNA, 25 bp, Homo sapien
tgttgcttttcttattttagtcggg

SEQ ID NO: 1141 - DNA, 25 bp, Homo sapien
tttagtcgggcaaacctcttgttga

SEQ ID NO: 1142 - DNA, 25 bp, Homo sapien
aaacctcttgttgatcatagtcttc

SEQ ID NO: 1143 - DNA, 25 bp, Homo sapien
tttgaacgtcaaagaagactctatt

SEQ ID NO: 1144 - DNA, 25 bp, Homo sapien
ttttaccccaaattcaatgaaatgc

SEQ ID NO: 1145 - DNA, 25 bp, Homo sapien
gatattaacctcatcactactaact

SEQ ID NO: 1146 - DNA, 25 bp, Homo sapien
ctcatcactactaactcactcatat

SEQ ID NO: 1147 - DNA, 25 bp, Homo sapien
gtagcataatttgttctacatttat

SEQ ID NO: 1148 - DNA, 25 bp, Homo sapien
taatctcttttttagtgggaatatg

SEQ ID NO: 1149 - DNA, 25 bp, Homo sapien
tatactcttattgataacttgccta

SEQ ID NO: 1150 - DNA, 25 bp, Homo sapien
ataacttgcctaattgctatgctga

SEQ ID NO: 1151 - DNA, 25 bp, Homo sapien
attgctatgctgaaagagactgcag

SEQ ID NO: 1152 - DNA, 25 bp, Homo sapien
gaaataggcatctatctctgcatct

SEQ ID NO: 1153 - DNA, 25 bp, Homo sapien
ggcatctatctctgcatctgttttc

SEQ ID NO: 1154 - DNA, 25 bp, Homo sapien
tgttttccccaccatgcctttggag

SEQ ID NO: 1155 - DNA, 25 bp, Homo sapien
accatgcctttggagttgccaagat

SEQ ID NO: 1156 - DNA, 25 bp, Homo sapien
tatggtagtagatgagccacagcca

SEQ ID NO: 1157 - DNA, 25 bp, Homo sapien
caggtgcccatgtactaatcatgat

SEQ ID NO: 1158 - DNA, 25 bp, Homo sapien
gataacctgacatgccattctcaaa

SEQ ID NO: 1159 - DNA, 25 bp, Homo sapien
tgccattctcaaaatgctgagttgt

SEQ ID NO: 1160 - DNA, 25 bp, Homo sapien
agcttttcctgtgtgccttgaaggc

SEQ ID NO: 1161 - DNA, 25 bp, Homo sapien
tgccttgaaggccagagcatttagg

SEQ ID NO: 1162 - DNA, 25 bp, Homo sapien
atgagcccaggcatagaggactaga

SEQ ID NO: 1163 - DNA, 25 bp, Homo sapien
ggactagagcccaggtgcacggtta

SEQ ID NO: 1164 - DNA, 25 bp, Homo sapien
agagcccaggtgcacggttagcttc

SEQ ID NO: 1165 - DNA, 25 bp, Homo sapien
aggtgcacggttagcttcacagcaa

SEQ ID NO: 1166 - DNA, 25 bp, Homo sapien
gtgcacggttagcttcacagcaaca

SEQ ID NO: 1167 - DNA, 25 bp, Homo sapien
acttaaggaaggatcagcatcacgg

SEQ ID NO: 1168 - DNA, 25 bp, Homo sapien
ggatcagcatcacggaaggtcttgt

SEQ ID NO: 1169 - DNA, 25 bp, Homo sapien
agcatcacggaaggtcttgtcaaaa

SEQ ID NO: 1170 - DNA, 25 bp, Homo sapien
tgccttgtttgtaatgttaaagttt

SEQ ID NO: 1171 - DNA, 25 bp, Homo sapien
atgaggttggcatttataccttccc

SEQ ID NO: 1172 - DNA, 25 bp, Homo sapien
tgaggttggcatttataccttccct

SEQ ID NO: 1173 - DNA, 25 bp, Homo sapien
gaggttggcatttataccttccctt

SEQ ID NO: 1174 - DNA, 25 bp, Homo sapien
aggttggcatttataccttcccttg

SEQ ID NO: 1175 - DNA, 25 bp, Homo sapien
ggttggcatttataccttcccttga

SEQ ID NO: 1176 - DNA, 25 bp, Homo sapien
gttggcatttataccttcccttgaa

SEQ ID NO: 1177 - DNA, 25 bp, Homo sapien
atggtgggagtgctgtagtccagta

SEQ ID NO: 1178 - DNA, 25 bp, Homo sapien
tggtgggagtgctgtagtccagtac

SEQ ID NO: 1179 - DNA, 25 bp, Homo sapien
gtgggagtgctgtagtccagtactc

SEQ ID NO: 1180 - DNA, 25 bp, Homo sapien
tgggagtgctgtagtccagtactca

SEQ ID NO: 1181 - DNA, 25 bp, Homo sapien
ttggagaaaacttttatgttagaca

SEQ ID NO: 1182 - DNA, 25 bp, Homo sapien
aagatgacactttgaggcatcgtgt

SEQ ID NO: 1183 - DNA, 25 bp, Homo sapien
gaggcatcgtgtctatggttcatta

SEQ ID NO: 1184 - DNA, 25 bp, Homo sapien
tatggttcattactacagaagcttc

SEQ ID NO: 1185 - DNA, 25 bp, Homo sapien
gaagcttctctggatgtgtaaagca

SEQ ID NO: 1186 - DNA, 25 bp, Homo sapien
cacagggtgctctccagaacgagaa

SEQ ID NO: 1187 - DNA, 25 bp, Homo sapien
gaagccagctcctggagttgtttgc

SEQ ID NO: 1188 - DNA, 25 bp, Homo sapien
gagttgtttgctgcaactgccattc

SEQ ID NO: 1189 - DNA, 25 bp, Homo sapien
tgcaactgccattccccgttgatga

SEQ ID NO: 1190 - DNA, 25 bp, Homo sapien
gttgatgaccatgctcttccttcag

SEQ ID NO: 1191 - DNA, 25 bp, Homo sapien
caagtggttcccatttgaacattta

SEQ ID NO: 1192 - DNA, 25 bp, Homo sapien
agactaggcagagaattggttgaac

SEQ ID NO: 1193 - DNA, 25 bp, Homo sapien
cagttcaggtcaaaaaagtatgcat

SEQ ID NO: 1194 - DNA, 25 bp, Homo sapien
acatcaaggcaaattaaggaatcaa

SEQ ID NO: 1195 - DNA, 25 bp, Homo sapien
tcaagatcacagaaacacacacgga

SEQ ID NO: 1196 - DNA, 25 bp, Homo sapien
gaaacacacacggatactgaaagaa

SEQ ID NO: 1197 - DNA, 25 bp, Homo sapien
gaaacacagtattaccgagactcat

SEQ ID NO: 1198 - DNA, 25 bp, Homo sapien
gagactcatgaatgtttcactgcat

SEQ ID NO: 1199 - DNA, 25 bp, Homo sapien
gtttcactgcatgcagccagcgtct

SEQ ID NO: 1200 - DNA, 25 bp, Homo sapien
gaaatctctaagttctatctaaagg

SEQ ID NO: 1201 - DNA, 25 bp, Homo sapien
gctgtacaggtgattgactgggtat

SEQ ID NO: 1202 - DNA, 25 bp, Homo sapien
atgatacataatcattctctttaag

SEQ ID NO: 1203 - DNA, 25 bp, Homo sapien
gtttgagggatgctatgttaatgta

SEQ ID NO: 1204 - DNA, 25 bp, Homo sapien
cttgccccaacatctacttttataa

SEQ ID NO: 1205 - DNA, 25 bp, Homo sapien
aagtcagtctcttttcacacattgc

SEQ ID NO: 1206 - DNA, 25 bp, Homo sapien
ttgcatcagtttcttcctagataag

SEQ ID NO: 1207 - DNA, 25 bp, Homo sapien
aaatttggacttgtgggtagtcaga

SEQ ID NO: 1208 - DNA, 25 bp, Homo sapien
gagcattaattcctatgttgataac

SEQ ID NO: 1209 - DNA, 25 bp, Homo sapien
ggaaaaccatctcaatgctgaaact

SEQ ID NO: 1210 - DNA, 25 bp, Homo sapien
gctgaaacttcattgtgggtacagt

SEQ ID NO: 1211 - DNA, 25 bp, Homo sapien
acttcattgtgggtacagttgtaaa

SEQ ID NO: 1212 - DNA, 25 bp, Homo sapien
gttgtaaagcatgtgaagacaggcc

SEQ ID NO: 1213 - DNA, 25 bp, Homo sapien
gaagatctcttaggagtgcaccagt

SEQ ID NO: 1214 - DNA, 25 bp, Homo sapien
taggagtgcaccagtactctcagtc

SEQ ID NO: 1215 - DNA, 25 bp, Homo sapien
ggtaatgcacaattccaactaacgt

SEQ ID NO: 1216 - DNA, 25 bp, Homo sapien
aactaacgtacattcaacagatcat

SEQ ID NO: 1217 - DNA, 25 bp, Homo sapien
caacagatcatgaaattgggttatt

SEQ ID NO: 1218 - DNA, 25 bp, Homo sapien
gacagtaaatcacacaacaggtttc

SEQ ID NO: 1219 - DNA, 25 bp, Homo sapien
atcacacaacaggtttctactctct

SEQ ID NO: 1220 - DNA, 25 bp, Homo sapien
acaggtttctactctcttttaatat

SEQ ID NO: 1221 - DNA, 25 bp, Homo sapien
aaaattttatagtctgaaagcaggt

SEQ ID NO: 1222 - DNA, 25 bp, Homo sapien
agcaggttaacagctgtctatgtat

SEQ ID NO: 1223 - DNA, 25 bp, Homo sapien
gataacagatttgcatatgtctata

SEQ ID NO: 1224 - DNA, 25 bp, Homo sapien
tttcctgcataatcatatggttgac

SEQ ID NO: 1225 - DNA, 25 bp, Homo sapien
ggttgacagtatgcattaagaaggt

SEQ ID NO: 1226 - DNA, 25 bp, Homo sapien
ggtcaacagagctgtgtgctgcact

SEQ ID NO: 1227 - DNA, 25 bp, Homo sapien
aacagagctgtgtgctgcactgtgg

SEQ ID NO: 1228 - DNA, 25 bp, Homo sapien
caggccgggtctgccctaaggataa

SEQ ID NO: 1229 - DNA, 25 bp, Homo sapien
tctgccctaaggataaatgatcact

SEQ ID NO: 1230 - DNA, 25 bp, Homo sapien
catagcccggtaatgactgggtcca

SEQ ID NO: 1231 - DNA, 25 bp, Homo sapien
ccggtaatgactgggtccagagcct

SEQ ID NO: 1232 - DNA, 25 bp, Homo sapien
ccagagcctcgtgagaggtcaccgg

SEQ ID NO: 1233 - DNA, 25 bp, Homo sapien
tctgtcagggccagggctcatgaat

SEQ ID NO: 1234 - DNA, 25 bp, Homo sapien
agggccagggctcatgaatctcatt

SEQ ID NO: 1235 - DNA, 25 bp, Homo sapien
agggctcatgaatctcattctctta

SEQ ID NO: 1236 - DNA, 25 bp, Homo sapien
aacagataactcatcctaaacagag

SEQ ID NO: 1237 - DNA, 25 bp, Homo sapien
gggagacccaggcaagattacttga

SEQ ID NO: 1238 - DNA, 25 bp, Homo sapien
agacccaggcaagattacttgagcc

SEQ ID NO: 1239 - DNA, 25 bp, Homo sapien
aggctgcggtgagtcgtgatggcgc

SEQ ID NO: 1240 - DNA, 25 bp, Homo sapien
ctgcggtgagtcgtgatggcgccac

SEQ ID NO: 1241 - DNA, 25 bp, Homo sapien
agtcgtgatggcgccacttcactgc

SEQ ID NO: 1242 - DNA, 25 bp, Homo sapien
gtcgtgatggcgccacttcactgca

SEQ ID NO: 1243 - DNA, 25 bp, Homo sapien
aaagcaggcaaatctcttgagccca

SEQ ID NO: 1244 - DNA, 25 bp, Homo sapien
cagtcatggtgccacatacctatgg

SEQ ID NO: 1245 - DNA, 25 bp, Homo sapien
agtcatggtgccacatacctatggt

SEQ ID NO: 1246 - DNA, 25 bp, Homo sapien
gtcatggtgccacatacctatggtc

SEQ ID NO: 1247 - DNA, 25 bp, Homo sapien
tcatggtgccacatacctatggtcc

SEQ ID NO: 1248 - DNA, 25 bp, Homo sapien
ataaatttcagagtgcttcagtaaa

SEQ ID NO: 1249 - DNA, 25 bp, Homo sapien
gagtgcttcagtaaaaagctactat

SEQ ID NO: 1250 - DNA, 25 bp, Homo sapien
atgcaaatgtctgttatctaactac

SEQ ID NO: 1251 - DNA, 25 bp, Homo sapien
tgttatctaactacaaattgtcaga

SEQ ID NO: 1252 - DNA, 25 bp, Homo sapien
aaggacactgtcaggcaaatttgaa

SEQ ID NO: 1253 - DNA, 25 bp, Homo sapien
ttttcctgttaaatagcgacttcag

SEQ ID NO: 1254 - DNA, 25 bp, Homo sapien
ttaaatagcgacttcagtattgtgt

SEQ ID NO: 1255 - DNA, 25 bp, Homo sapien
cgttaaaacaactatgaagatctgc

SEQ ID NO: 1256 - DNA, 25 bp, Homo sapien
cagtattctttgtcttgaatagaga

SEQ ID NO: 1257 - DNA, 25 bp, Homo sapien
gagaagtctatgttcgtaaagtcat

SEQ ID NO: 1258 - DNA, 25 bp, Homo sapien
tataaaaggttataccactatttag

SEQ ID NO: 1259 - DNA, 25 bp, Homo sapien
tcgggcgccgtcaacccgttgagca

SEQ ID NO: 1260 - DNA, 25 bp, Homo sapien
gtcaacccgttgagcagcgtgttcc

SEQ ID NO: 1261 - DNA, 25 bp, Homo sapien
ttgagcagcgtgttccggctggcac

SEQ ID NO: 1262 - DNA, 25 bp, Homo sapien
tggagcctccgctgccgggagcaat

SEQ ID NO: 1263 - DNA, 25 bp, Homo sapien
tgccgggagcaatcagaccttccag

SEQ ID NO: 1264 - DNA, 25 bp, Homo sapien
ttaattctctgcctgacatttgctg

SEQ ID NO: 1265 - DNA, 25 bp, Homo sapien
tggaggcaaaacaacaaaaactgga

SEQ ID NO: 1266 - DNA, 25 bp, Homo sapien
gataactgaagattctgccatgtaa

SEQ ID NO: 1267 - DNA, 25 bp, Homo sapien
taaatgtcagcttgagtggactcca

SEQ ID NO: 1268 - DNA, 25 bp, Homo sapien
gttttccctcctagacaaaagtctg

SEQ ID NO: 1269 - DNA, 25 bp, Homo sapien
tagacaaaagtctgccggctcccgg

SEQ ID NO: 1270 - DNA, 25 bp, Homo sapien
aaaagataatttgctcctgacagtc

SEQ ID NO: 1271 - DNA, 25 bp, Homo sapien
agataatttgctcctgacagtcata

SEQ ID NO: 1272 - DNA, 25 bp, Homo sapien
aatttgctcctgacagtcatacctg

SEQ ID NO: 1273 - DNA, 25 bp, Homo sapien
tttgctcctgacagtcatacctgaa

SEQ ID NO: 1274 - DNA, 25 bp, Homo sapien
gctcctgacagtcatacctgaaaca

SEQ ID NO: 1275 - DNA, 25 bp, Homo sapien
gacagtcatacctgaaacaatcaat

SEQ ID NO: 1276 - DNA, 25 bp, Homo sapien
gttatatcacgtggtttgtattgga

SEQ ID NO: 1277 - DNA, 25 bp, Homo sapien
tatatcacgtggtttgtattggaga

SEQ ID NO: 1278 - DNA, 25 bp, Homo sapien
cctatgaaacaaacctcacatcctg

SEQ ID NO: 1279 - DNA, 25 bp, Homo sapien
acaaacctcacatcctgcatatgta

SEQ ID NO: 1280 - DNA, 25 bp, Homo sapien
aacctcacatcctgcatatgtacct

SEQ ID NO: 1281 - DNA, 25 bp, Homo sapien
agaaaggatcgtgtgctgcatctcc

SEQ ID NO: 1282 - DNA, 25 bp, Homo sapien
gaaaggatcgtgtgctgcatctcct

SEQ ID NO: 1283 - DNA, 25 bp, Homo sapien
tccttggcgcctcattgctgtaatt

SEQ ID NO: 1284 - DNA, 25 bp, Homo sapien
cttggcgcctcattgctgtaatttt

SEQ ID NO: 1285 - DNA, 25 bp, Homo sapien
tggcgcctcattgctgtaattttgg

SEQ ID NO: 1286 - DNA, 25 bp, Homo sapien
tgctgtaattttgggaatcctatgc

SEQ ID NO: 1287 - DNA, 25 bp, Homo sapien
aattttgggaatcctatgcttggta

SEQ ID NO: 1288 - DNA, 25 bp, Homo sapien
ttgggaatcctatgcttggtaatac

SEQ ID NO: 1289 - DNA, 25 bp, Homo sapien
gggaatcctatgcttggtaatactg

SEQ ID NO: 1290 - DNA, 25 bp, Homo sapien
taatactggtgatagctgtggtcct

SEQ ID NO: 1291 - DNA, 25 bp, Homo sapien
atactggtgatagctgtggtcctgg

SEQ ID NO: 1292 - DNA, 25 bp, Homo sapien
ggctcaagcgaactgtcagcctcag

SEQ ID NO: 1293 - DNA, 25 bp, Homo sapien
gcatgagctactatgcccaacctat

SEQ ID NO: 1294 - DNA, 25 bp, Homo sapien
gcccaacctatcctgttcttttaat

SEQ ID NO: 1295 - DNA, 25 bp, Homo sapien
gaaagtttatatgcttctaagaggt

SEQ ID NO: 1296 - DNA, 25 bp, Homo sapien
gaggtagataccagaatgttgcttt

SEQ ID NO: 1297 - DNA, 25 bp, Homo sapien
cagaatgttgctttctgaattttgc

SEQ ID NO: 1298 - DNA, 25 bp, Homo sapien
attttgctttttaagatgtctatta

SEQ ID NO: 1299 - DNA, 25 bp, Homo sapien
taaaaattgcgctacttgcctggga

SEQ ID NO: 1300 - DNA, 25 bp, Homo sapien
aaattgcgctacttgcctgggaaac

SEQ ID NO: 1301 - DNA, 25 bp, Homo sapien
attgcgctacttgcctgggaaacat

SEQ ID NO: 1302 - DNA, 25 bp, Homo sapien
aacatagcagacctcgtttctacta

SEQ ID NO: 1303 - DNA, 25 bp, Homo sapien
gaaagatgcacctagaacctcactg

SEQ ID NO: 1304 - DNA, 25 bp, Homo sapien
gaacctcactgataaaacttcttaa

SEQ ID NO: 1305 - DNA, 25 bp, Homo sapien
cttcttaagttcacgaccctaacat

SEQ ID NO: 1306 - DNA, 25 bp, Homo sapien
gaccctaacatttccccatacaaag

SEQ ID NO: 1307 - DNA, 25 bp, Homo sapien
tttccccatacaaagctggtcagag

SEQ ID NO: 1308 - DNA, 25 bp, Homo sapien
acacaggccaggactcgcagcgcgt

SEQ ID NO: 1309 - DNA, 25 bp, Homo sapien
cagcgaggtgccgaccaatgaaggt

SEQ ID NO: 1310 - DNA, 25 bp, Homo sapien
gaccaatgaaggtcacacctggttc

SEQ ID NO: 1311 - DNA, 25 bp, Homo sapien
cccagtgatccccattagtagtatt

SEQ ID NO: 1312 - DNA, 25 bp, Homo sapien
tagtagtatttctcaagtatgtgtt

SEQ ID NO: 1313 - DNA, 25 bp, Homo sapien
aaatgtgacatattaggccgggcgc

SEQ ID NO: 1314 - DNA, 25 bp, Homo sapien
ccaaaggcaaggatctggaggtgct

SEQ ID NO: 1315 - DNA, 25 bp, Homo sapien
gaggtgctgcggcaccttaacttct

SEQ ID NO: 1316 - DNA, 25 bp, Homo sapien
cggcaccttaacttcttcccagagt

SEQ ID NO: 1317 - DNA, 25 bp, Homo sapien
agagtcatggctcgaccaggttaca

SEQ ID NO: 1318 - DNA, 25 bp, Homo sapien
gctcgaccaggttacagtcaaccat

SEQ ID NO: 1319 - DNA, 25 bp, Homo sapien
agtcaaccattaccacgcactggag

SEQ ID NO: 1320 - DNA, 25 bp, Homo sapien
gggcgacatggtccacctgaaagat

SEQ ID NO: 1321 - DNA, 25 bp, Homo sapien
catggtccacctgaaagatcttaac

SEQ ID NO: 1322 - DNA, 25 bp, Homo sapien
aaagatcttaacacccaggctgtga

SEQ ID NO: 1323 - DNA, 25 bp, Homo sapien
atttgggctgctctttaaccaggag

SEQ ID NO: 1324 - DNA, 25 bp, Homo sapien
ggctgctctttaaccaggagaatac

SEQ ID NO: 1325 - DNA, 25 bp, Homo sapien
tgttcttaagccggccacagaagga

SEQ ID NO: 1326 - DNA, 25 bp, Homo sapien
gcgcctgaagctggcccagtttgac

SEQ ID NO: 1327 - DNA, 25 bp, Homo sapien
gaagctggcccagtttgactacggg

SEQ ID NO: 1328 - DNA, 25 bp, Homo sapien
agctggcccagtttgactacgggag

SEQ ID NO: 1329 - DNA, 25 bp, Homo sapien
tggcccagtttgactacgggaggaa

SEQ ID NO: 1330 - DNA, 25 bp, Homo sapien
gcccagtttgactacgggaggaagt

SEQ ID NO: 1331 - DNA, 25 bp, Homo sapien
aggaagtgctcggaggtcgctcggc

SEQ ID NO: 1332 - DNA, 25 bp, Homo sapien
tcggctgacggagggcatgtcgggc

SEQ ID NO: 1333 - DNA, 25 bp, Homo sapien
atgtcgggccgggagatcgctcagc

SEQ ID NO: 1334 - DNA, 25 bp, Homo sapien
ggagatcgctcagctggccgtgtcc

SEQ ID NO: 1335 - DNA, 25 bp, Homo sapien
gatcgctcagctggccgtgtcctgg

SEQ ID NO: 1336 - DNA, 25 bp, Homo sapien
atgccaggactactctggtcaacct

SEQ ID NO: 1337 - DNA, 25 bp, Homo sapien
ccaggactactctggtcaacctagt

SEQ ID NO: 1338 - DNA, 25 bp, Homo sapien
aggactactctggtcaacctagtga

SEQ ID NO: 1339 - DNA, 25 bp, Homo sapien
ggactactctggtcaacctagtgag

SEQ ID NO: 1340 - DNA, 25 bp, Homo sapien
gactactctggtcaacctagtgaga

SEQ ID NO: 1341 - DNA, 25 bp, Homo sapien
actactctggtcaacctagtgagac

SEQ ID NO: 1342 - DNA, 25 bp, Homo sapien
ctactctggtcaacctagtgagacc

SEQ ID NO: 1343 - DNA, 25 bp, Homo sapien
aacattttctaagtgtggtagcaca

SEQ ID NO: 1344 - DNA, 25 bp, Homo sapien
ttctaagtgtggtagcacaccctgt

SEQ ID NO: 1345 - DNA, 25 bp, Homo sapien
tctaagtgtggtagcacaccctgta

SEQ ID NO: 1346 - DNA, 25 bp, Homo sapien
gagctgagatctaccactacacccc

SEQ ID NO: 1347 - DNA, 25 bp, Homo sapien
gatctacatggcattaattgattta

SEQ ID NO: 1348 - DNA, 25 bp, Homo sapien
gaaataattcttcagtgtttgcctt

SEQ ID NO: 1349 - DNA, 25 bp, Homo sapien
ttgcctttgagcagtgataggttgt

SEQ ID NO: 1350 - DNA, 25 bp, Homo sapien
tgcctaagagcatatataccaaaca

SEQ ID NO: 1351 - DNA, 25 bp, Homo sapien
gagcatatataccaaacactacaaa

SEQ ID NO: 1352 - DNA, 25 bp, Homo sapien
aaaactgcacattacatttttggtg

SEQ ID NO: 1353 - DNA, 25 bp, Homo sapien
aaatatagtgcattctgaggatagc

SEQ ID NO: 1354 - DNA, 25 bp, Homo sapien
gcattctgaggatagcatatttcat

SEQ ID NO: 1355 - DNA, 25 bp, Homo sapien
aagcattctctaggtttgcatgtag

SEQ ID NO: 1356 - DNA, 25 bp, Homo sapien
ggtttgcatgtagctatagtcacta

SEQ ID NO: 1357 - DNA, 25 bp, Homo sapien
gctatagtcactatattttgccttt

SEQ ID NO: 1358 - DNA, 25 bp, Homo sapien
gatgcatgacgtacatgttcagagt

SEQ ID NO: 1359 - DNA, 25 bp, Homo sapien
taaattgcttttaccagttgcacat

SEQ ID NO: 1360 - DNA, 25 bp, Homo sapien
gcttttaccagttgcacatttatgt

SEQ ID NO: 1361 - DNA, 25 bp, Homo sapien
gattgtgtgtgaaccttactcaagg

SEQ ID NO: 1362 - DNA, 25 bp, Homo sapien
tctagtaatttctttttccagtggc

SEQ ID NO: 1363 - DNA, 25 bp, Homo sapien
tggctttaaacaccaaataagttga

SEQ ID NO: 1364 - DNA, 25 bp, Homo sapien
gaagaatattgttctcatgttaaat

SEQ ID NO: 1365 - DNA, 25 bp, Homo sapien
ggtacatggtatgtgtatacattca

SEQ ID NO: 1366 - DNA, 25 bp, Homo sapien
ggcatagatgggttactttgataca

SEQ ID NO: 1367 - DNA, 25 bp, Homo sapien
gatgggttactttgatacagacatg

SEQ ID NO: 1368 - DNA, 25 bp, Homo sapien
acagacatgcaacatgtaatcacat

SEQ ID NO: 1369 - DNA, 25 bp, Homo sapien
cagaatgaggatggattttccatat

SEQ ID NO: 1370 - DNA, 25 bp, Homo sapien
atggattttccatatgaaggagccg

SEQ ID NO: 1371 - DNA, 25 bp, Homo sapien
ggattttccatatgaaggagccggg

SEQ ID NO: 1372 - DNA, 25 bp, Homo sapien
aagaacacagtatgtgtggagagcg

SEQ ID NO: 1373 - DNA, 25 bp, Homo sapien
tgttgaactgtctagaaaacagagc

SEQ ID NO: 1374 - DNA, 25 bp, Homo sapien
aaaacagagccacaggaatgcgtgt

SEQ ID NO: 1375 - DNA, 25 bp, Homo sapien
gactacaagggtgagcactgagcca

SEQ ID NO: 1376 - DNA, 25 bp, Homo sapien
tacaagggtgagcactgagccatgc

SEQ ID NO: 1377 - DNA, 25 bp, Homo sapien
aagggtgagcactgagccatgctct

SEQ ID NO: 1378 - DNA, 25 bp, Homo sapien
ggtgagcactgagccatgctctcgg

SEQ ID NO: 1379 - DNA, 25 bp, Homo sapien
gctctcggggaaccttcactggagt

SEQ ID NO: 1380 - DNA, 25 bp, Homo sapien
ggctgacgtctacagcccgtgagcc

SEQ ID NO: 1381 - DNA, 25 bp, Homo sapien
ggctacttcggtcattacctgttgc

SEQ ID NO: 1382 - DNA, 25 bp, Homo sapien
ggtcattacctgttgccttctcctg

SEQ ID NO: 1383 - DNA, 25 bp, Homo sapien
gcctcaagttttcactgcagtctaa

SEQ ID NO: 1384 - DNA, 25 bp, Homo sapien
agttttcactgcagtctaagggcgt

SEQ ID NO: 1385 - DNA, 25 bp, Homo sapien
agtctaagggcgtgctgggaccaca

SEQ ID NO: 1386 - DNA, 25 bp, Homo sapien
gggaccacagaagcctctcactaaa

SEQ ID NO: 1387 - DNA, 25 bp, Homo sapien
gaagcctctcactaaagacccattg

SEQ ID NO: 1388 - DNA, 25 bp, Homo sapien
aactgggtcagacccaacctcagca

SEQ ID NO: 1389 - DNA, 25 bp, Homo sapien
atactgtcagagaactggctcttca

SEQ ID NO: 1390 - DNA, 25 bp, Homo sapien
tgtcagagaactggctcttcagccc

SEQ ID NO: 1391 - DNA, 25 bp, Homo sapien
cagggagtttgggtaccagaagctt

SEQ ID NO: 1392 - DNA, 25 bp, Homo sapien
gtttgggtaccagaagcttgatgtg

SEQ ID NO: 1393 - DNA, 25 bp, Homo sapien
tttgggtaccagaagcttgatgtga

SEQ ID NO: 1394 - DNA, 25 bp, Homo sapien
cagagtcgcccgagaaaaacggagc

SEQ ID NO: 1395 - DNA, 25 bp, Homo sapien
gagtcgcccgagaaaaacggagcac

SEQ ID NO: 1396 - DNA, 25 bp, Homo sapien
agtcgcccgagaaaaacggagcaca

SEQ ID NO: 1397 - DNA, 25 bp, Homo sapien
gtcgcccgagaaaaacggagcacac

SEQ ID NO: 1398 - DNA, 25 bp, Homo sapien
gcccgagaaaaacggagcacactct

SEQ ID NO: 1399 - DNA, 25 bp, Homo sapien
ccgagaaaaacggagcacactctgt

SEQ ID NO: 1400 - DNA, 25 bp, Homo sapien
gagaaaaacggagcacactctgtca

SEQ ID NO: 1401 - DNA, 25 bp, Homo sapien
agaaaaacggagcacactctgtcac

SEQ ID NO: 1402 - DNA, 25 bp, Homo sapien
aggaagatcttcctgttacagagga

SEQ ID NO: 1403 - DNA, 25 bp, Homo sapien
ttcctgttacagaggataactttgt

SEQ ID NO: 1404 - DNA, 25 bp, Homo sapien
aagttaaagcttgtgctctgagcca

SEQ ID NO: 1405 - DNA, 25 bp, Homo sapien
aaagcttgtgctctgagccagataa

SEQ ID NO: 1406 - DNA, 25 bp, Homo sapien
gataaatacaaagcttctggcagaa

SEQ ID NO: 1407 - DNA, 25 bp, Homo sapien
gttggaagcaaggtatcattctttc

SEQ ID NO: 1408 - DNA, 25 bp, Homo sapien
aaggtatcattctttcaaccagatg

SEQ ID NO: 1409 - DNA, 25 bp, Homo sapien
cggctcagaggcaggtgactatgaa

SEQ ID NO: 1410 - DNA, 25 bp, Homo sapien
ggcaggtgactatgaaaggcttata

SEQ ID NO: 1411 - DNA, 25 bp, Homo sapien
atgaaaggcttatatttccaacaga

SEQ ID NO: 1412 - DNA, 25 bp, Homo sapien
tatttccaacagagttccacagatg

SEQ ID NO: 1413 - DNA, 25 bp, Homo sapien
tcaggcttagccagtacttctatgg

SEQ ID NO: 1414 - DNA, 25 bp, Homo sapien
tacttctatgggatgagacctataa

SEQ ID NO: 1415 - DNA, 25 bp, Homo sapien
ataatcccacctatagcagcaagta

SEQ ID NO: 1416 - DNA, 25 bp, Homo sapien
gcagcaagtaactacccttcatgat

SEQ ID NO: 1417 - DNA, 25 bp, Homo sapien
gatagtgtacatggagctgtgatta

SEQ ID NO: 1418 - DNA, 25 bp, Homo sapien
attatgaacatgctgcctttcgtgc

SEQ ID NO: 1419 - DNA, 25 bp, Homo sapien
cctttcgtgctgcaattggcattct

SEQ ID NO: 1420 - DNA, 25 bp, Homo sapien
ggtatcacactctccaaaaatgcag

SEQ ID NO: 1421 - DNA, 25 bp, Homo sapien
aatgcagggtatttggttacataac

SEQ ID NO: 1422 - DNA, 25 bp, Homo sapien
gctaatgattagttgggctttcctt

SEQ ID NO: 1423 - DNA, 25 bp, Homo sapien
ataatataatcaggccgagtgcagc

SEQ ID NO: 1424 - DNA, 25 bp, Homo sapien
gaagctcatatttcgtgagtcggac

SEQ ID NO: 1425 - DNA, 25 bp, Homo sapien
aacgaccggaaggttatgctccagt

SEQ ID NO: 1426 - DNA, 25 bp, Homo sapien
tcttcgactacttcaaccaggaggt

SEQ ID NO: 1427 - DNA, 25 bp, Homo sapien
gttttccgagacaacaacggcaccg

SEQ ID NO: 1428 - DNA, 25 bp, Homo sapien
gcaccgcgctcttggagtttgacaa

SEQ ID NO: 1429 - DNA, 25 bp, Homo sapien
gtatgaactggacatctcgttccct

SEQ ID NO: 1430 - DNA, 25 bp, Homo sapien
gcccgccagggtgagcagtacatga

SEQ ID NO: 1431 - DNA, 25 bp, Homo sapien
gagcagtacatgaacacccggtgcc

SEQ ID NO: 1432 - DNA, 25 bp, Homo sapien
gggctacgtgctggacagaatcatt

SEQ ID NO: 1433 - DNA, 25 bp, Homo sapien
cagcgattcgagaaggtttcctact

SEQ ID NO: 1434 - DNA, 25 bp, Homo sapien
tggtgatttcaacttccggctggat

SEQ ID NO: 1435 - DNA, 25 bp, Homo sapien
gcatgtatttcaagtgtacgatttg

SEQ ID NO: 1436 - DNA, 25 bp, Homo sapien
tcaagtgtacgatttgacaagtttg

SEQ ID NO: 1437 - DNA, 25 bp, Homo sapien
ggttatattatatacacctacgaaa

SEQ ID NO: 1438 - DNA, 25 bp, Homo sapien
ttatatacacctacgaaaccatcac

SEQ ID NO: 1439 - DNA, 25 bp, Homo sapien
tgagcatagctatcacacacaaaag

SEQ ID NO: 1440 - DNA, 25 bp, Homo sapien
tgatctgatttctgccgctatcaat

SEQ ID NO: 1441 - DNA, 25 bp, Homo sapien
atttctgccgctatcaattcgtttg

SEQ ID NO: 1442 - DNA, 25 bp, Homo sapien
ctgccgctatcaattcgtttgcatt

SEQ ID NO: 1443 - DNA, 25 bp, Homo sapien
ctgaaaacatacattaagaactctt

SEQ ID NO: 1444 - DNA, 25 bp, Homo sapien
gaactctttttctctggccgagtgt

SEQ ID NO: 1445 - DNA, 25 bp, Homo sapien
ctctttttctctggccgagtgtggt

SEQ ID NO: 1446 - DNA, 25 bp, Homo sapien
gaccacgagcccaggacaggtgtgc

SEQ ID NO: 1447 - DNA, 25 bp, Homo sapien
acctgaccgctgaggagaaggacca

SEQ ID NO: 1448 - DNA, 25 bp, Homo sapien
gaccagatatgtgacttcctctatg

SEQ ID NO: 1449 - DNA, 25 bp, Homo sapien
tgacttcctctatggccgtgtgcag

SEQ ID NO: 1450 - DNA, 25 bp, Homo sapien
aaccttccaggcctttcacagcgta

SEQ ID NO: 1451 - DNA, 25 bp, Homo sapien
tgctcggccgctactttgaggaaga

SEQ ID NO: 1452 - DNA, 25 bp, Homo sapien
aagttctccagcagggctgtggccc

SEQ ID NO: 1453 - DNA, 25 bp, Homo sapien
tgtacgggcaggaccgacgcttctg

SEQ ID NO: 1454 - DNA, 25 bp, Homo sapien
ggagaaaatacctgcacctgagctt

SEQ ID NO: 1455 - DNA, 25 bp, Homo sapien
acctgagcttccatgccctggtggg

SEQ ID NO: 1456 - DNA, 25 bp, Homo sapien
gcctggccacggaagagctcctgca

SEQ ID NO: 1457 - DNA, 25 bp, Homo sapien
tccttatacttttatttctgagaca

SEQ ID NO: 1458 - DNA, 25 bp, Homo sapien
tggaactacaggcttaccccaccag

SEQ ID NO: 1459 - DNA, 25 bp, Homo sapien
ggaactacaggcttaccccaccagg

SEQ ID NO: 1460 - DNA, 25 bp, Homo sapien
gctggtctccagcttgtgggctcaa

SEQ ID NO: 1461 - DNA, 25 bp, Homo sapien
tggtctccagcttgtgggctcaagc

SEQ ID NO: 1462 - DNA, 25 bp, Homo sapien
tctccagcttgtgggctcaagcaat

SEQ ID NO: 1463 - DNA, 25 bp, Homo sapien
aaatgctacaattacaggcataaac

SEQ ID NO: 1464 - DNA, 25 bp, Homo sapien
gcctcttgtattcttaaattatctc

SEQ ID NO: 1465 - DNA, 25 bp, Homo sapien
cttgtattcttaaattatctctaaa

SEQ ID NO: 1466 - DNA, 25 bp, Homo sapien
gtaaaagctatgtaaggctgggcat

SEQ ID NO: 1467 - DNA, 25 bp, Homo sapien
aaaagctatgtaaggctgggcatgg

SEQ ID NO: 1468 - DNA, 25 bp, Homo sapien
aagatgagacaatcacaaggcccat

SEQ ID NO: 1469 - DNA, 25 bp, Homo sapien
atgagacaatcacaaggcccatccc

SEQ ID NO: 1470 - DNA, 25 bp, Homo sapien
aggcccatcccctcggaagaaacat

SEQ ID NO: 1471 - DNA, 25 bp, Homo sapien
tcccctcggaagaaacatccacagg

SEQ ID NO: 1472 - DNA, 25 bp, Homo sapien
ataaacattacaacggtggctattc

SEQ ID NO: 1473 - DNA, 25 bp, Homo sapien
aacattacaacggtggctattccat

SEQ ID NO: 1474 - DNA, 25 bp, Homo sapien
ttacaacggtggctattccattggt

SEQ ID NO: 1475 - DNA, 25 bp, Homo sapien
acaacggtggctattccattggtgc

SEQ ID NO: 1476 - DNA, 25 bp, Homo sapien
aacggtggctattccattggtgctc

SEQ ID NO: 1477 - DNA, 25 bp, Homo sapien
acggtggctattccattggtgctcc

SEQ ID NO: 1478 - DNA, 25 bp, Homo sapien
ggtggctattccattggtgctcctt

SEQ ID NO: 1479 - DNA, 25 bp, Homo sapien
gtaacgtgggcgcatccctcttttc

SEQ ID NO: 1480 - DNA, 25 bp, Homo sapien
ttttccttccctgggttcagtgtgg

SEQ ID NO: 1481 - DNA, 25 bp, Homo sapien
cagtgtggctgggtaaggaccgtct

SEQ ID NO: 1482 - DNA, 25 bp, Homo sapien
gaccgtctgtttgtagggctgccag

SEQ ID NO: 1483 - DNA, 25 bp, Homo sapien
cgtctgtttgtagggctgccaggct

SEQ ID NO: 1484 - DNA, 25 bp, Homo sapien
agctgcagctgatccaatacaccaa

SEQ ID NO: 1485 - DNA, 25 bp, Homo sapien
gatccaatacaccaagcctgtgtct

SEQ ID NO: 1486 - DNA, 25 bp, Homo sapien
aagcctgtgtctccctcttctatca

SEQ ID NO: 1487 - DNA, 25 bp, Homo sapien
cactgacccaaaatggaaccgtaca

SEQ ID NO: 1488 - DNA, 25 bp, Homo sapien
ggaaccgtacaaagcctatccgtgt

SEQ ID NO: 1489 - DNA, 25 bp, Homo sapien
gtacaaagcctatccgtgtatatgg

SEQ ID NO: 1490 - DNA, 25 bp, Homo sapien
gtttcttttcccagtggttgccata

SEQ ID NO: 1491 - DNA, 25 bp, Homo sapien
gtggttgccatacagacactaatgc

SEQ ID NO: 1492 - DNA, 25 bp, Homo sapien
actaatgccagtgtgtctgctctat

SEQ ID NO: 1493 - DNA, 25 bp, Homo sapien
agtgtgtctgctctattgcctcttc

SEQ ID NO: 1494 - DNA, 25 bp, Homo sapien
tattgcctcttcacccatgtcattt

SEQ ID NO: 1495 - DNA, 25 bp, Homo sapien
tcacccatgtcatttgatgtagtgt

SEQ ID NO: 1496 - DNA, 25 bp, Homo sapien
gtagtgtttcttgttcctaagccag

SEQ ID NO: 1497 - DNA, 25 bp, Homo sapien
gttcctaagccagataaccaagctt

SEQ ID NO: 1498 - DNA, 25 bp, Homo sapien
aaattttgtcttactgtatgtactg

SEQ ID NO: 1499 - DNA, 25 bp, Homo sapien
attgagtttcttgaagcgcagaaca

SEQ ID NO: 1500 - DNA, 25 bp, Homo sapien
gaagcgcagaacattattctaccta

SEQ ID NO: 1501 - DNA, 25 bp, Homo sapien
ggtgggcagagagccctagcctgga

SEQ ID NO: 1502 - DNA, 25 bp, Homo sapien
ggactcaaccgcgtccagtccatcc

SEQ ID NO: 1503 - DNA, 25 bp, Homo sapien
gctcccacgtccactgggaggctgg

SEQ ID NO: 1504 - DNA, 25 bp, Homo sapien
gctgggaaaacgtgactcccggaga

SEQ ID NO: 1505 - DNA, 25 bp, Homo sapien
tgggaaaacgtgactcccggagaga

SEQ ID NO: 1506 - DNA, 25 bp, Homo sapien
ggaaaacgtgactcccggagagaag

SEQ ID NO: 1507 - DNA, 25 bp, Homo sapien
gaaaacgtgactcccggagagaagc

SEQ ID NO: 1508 - DNA, 25 bp, Homo sapien
acgtgactcccggagagaagcatgt

SEQ ID NO: 1509 - DNA, 25 bp, Homo sapien
gtgactcccggagagaagcatgttg

SEQ ID NO: 1510 - DNA, 25 bp, Homo sapien
tgactcccggagagaagcatgttga

SEQ ID NO: 1511 - DNA, 25 bp, Homo sapien
actcccggagagaagcatgttgact

SEQ ID NO: 1512 - DNA, 25 bp, Homo sapien
cccgatcagctgtaccgcacagaga

SEQ ID NO: 1513 - DNA, 25 bp, Homo sapien
gagaaagacaatgccgcactcgctc

SEQ ID NO: 1514 - DNA, 25 bp, Homo sapien
gcactcgctcgagagacagatgaat

SEQ ID NO: 1515 - DNA, 25 bp, Homo sapien
attcattgcctccaggacttcaagg

SEQ ID NO: 1516 - DNA, 25 bp, Homo sapien
gaaaagccacaggagcacgagtctt

SEQ ID NO: 1517 - DNA, 25 bp, Homo sapien
agcagcggctgcgagtagtgaccac

SEQ ID NO: 1518 - DNA, 25 bp, Homo sapien
gtagtgaccacgaaaatccgatccg

SEQ ID NO: 1519 - DNA, 25 bp, Homo sapien
aaatccgatccgcacgtgaaaacaa

SEQ ID NO: 1520 - DNA, 25 bp, Homo sapien
gaaaacaaacccagcggccgacaga

SEQ ID NO: 1521 - DNA, 25 bp, Homo sapien
agcggccgacagacaaagatgatct

SEQ ID NO: 1522 - DNA, 25 bp, Homo sapien
cgctgaccccggaaatggagagatg

SEQ ID NO: 1523 - DNA, 25 bp, Homo sapien
ttgctgtcctgtggtacagacatta

SEQ ID NO: 1524 - DNA, 25 bp, Homo sapien
gctgtcctgtggtacagacattaaa

SEQ ID NO: 1525 - DNA, 25 bp, Homo sapien
ccacacaccacttttattggccata

SEQ ID NO: 1526 - DNA, 25 bp, Homo sapien
caccacttttattggccataaggaa

SEQ ID NO: 1527 - DNA, 25 bp, Homo sapien
gaacacctgacgaataggatacagt

SEQ ID NO: 1528 - DNA, 25 bp, Homo sapien
taggatacagtgaattcctcttcaa

SEQ ID NO: 1529 - DNA, 25 bp, Homo sapien
gaattcctcttcaaagattttagcc

SEQ ID NO: 1530 - DNA, 25 bp, Homo sapien
gattttagcctgtaaacatccttta

SEQ ID NO: 1531 - DNA, 25 bp, Homo sapien
tagcctgtaaacatcctttaaaatt

SEQ ID NO: 1532 - DNA, 25 bp, Homo sapien
agtacaatgagttctgagttcctca

SEQ ID NO: 1533 - DNA, 25 bp, Homo sapien
gagttctgagttcctcatcaaagaa

SEQ ID NO: 1534 - DNA, 25 bp, Homo sapien
gagcgctgcttcgtcttctgagggc

SEQ ID NO: 1535 - DNA, 25 bp, Homo sapien
agggaagttcgccatccgacctgac

SEQ ID NO: 1536 - DNA, 25 bp, Homo sapien
ttcgccatccgacctgacaaaaagt

SEQ ID NO: 1537 - DNA, 25 bp, Homo sapien
gacaaaaagtccaaccctatcatca

SEQ ID NO: 1538 - DNA, 25 bp, Homo sapien
accctatcatcaggacagtgaagtc

SEQ ID NO: 1539 - DNA, 25 bp, Homo sapien
cagtgaagtctgtgggcatgatcgc

SEQ ID NO: 1540 - DNA, 25 bp, Homo sapien
atcgcgggagggacaggcatcaccc

SEQ ID NO: 1541 - DNA, 25 bp, Homo sapien
ggcatcaccccgatgctgcaggtga

SEQ ID NO: 1542 - DNA, 25 bp, Homo sapien
catgaaggaccctgatgaccacact

SEQ ID NO: 1543 - DNA, 25 bp, Homo sapien
agaaggacatcctgctgcgacctga

SEQ ID NO: 1544 - DNA, 25 bp, Homo sapien
ggaacaaacattctgcacgcttcaa

SEQ ID NO: 1545 - DNA, 25 bp, Homo sapien
catgttagtgtcatctctattagat

SEQ ID NO: 1546 - DNA, 25 bp, Homo sapien
atctctattagatgctttggagcaa

SEQ ID NO: 1547 - DNA, 25 bp, Homo sapien
tttggagcaaacatgaacttgggtt

SEQ ID NO: 1548 - DNA, 25 bp, Homo sapien
tttccttttaagatgtcctgtgatt

SEQ ID NO: 1549 - DNA, 25 bp, Homo sapien
agatgtcctgtgattccagattcag

SEQ ID NO: 1550 - DNA, 25 bp, Homo sapien
gaaagaaaattccactcggccagcc

SEQ ID NO: 1551 - DNA, 25 bp, Homo sapien
ggccagccaaccttgggtgtgcaga

SEQ ID NO: 1552 - DNA, 25 bp, Homo sapien
ccaaccttgggtgtgcagagcctgc

SEQ ID NO: 1553 - DNA, 25 bp, Homo sapien
actttgtcctgagaagctgggtcct

SEQ ID NO: 1554 - DNA, 25 bp, Homo sapien
tgagtgacactctaggattgcagat

SEQ ID NO: 1555 - DNA, 25 bp, Homo sapien
actctaggattgcagatggcaggct

SEQ ID NO: 1556 - DNA, 25 bp, Homo sapien
ttctggtgagaaaaagcgtgacatt

SEQ ID NO: 1557 - DNA, 25 bp, Homo sapien
tgacatttgctctgatccctggaat

SEQ ID NO: 1558 - DNA, 25 bp, Homo sapien
tgctctgatccctggaataggtgtt

SEQ ID NO: 1559 - DNA, 25 bp, Homo sapien
ccctggaataggtgttgcgtatcaa

SEQ ID NO: 1560 - DNA, 25 bp, Homo sapien
aggtgttgcgtatcaaatacagatg

SEQ ID NO: 1561 - DNA, 25 bp, Homo sapien
gaaaccagagatggatggcagatct

SEQ ID NO: 1562 - DNA, 25 bp, Homo sapien
agatggatggcagatctgggatcta

SEQ ID NO: 1563 - DNA, 25 bp, Homo sapien
taaaatataagctcccggaaggcag

SEQ ID NO: 1564 - DNA, 25 bp, Homo sapien
taagctcccggaaggcagggatgtt

SEQ ID NO: 1565 - DNA, 25 bp, Homo sapien
gatgttgaagtatcccaagggctta

SEQ ID NO: 1566 - DNA, 25 bp, Homo sapien
aaaggaatgtgtggcttatagtagg

SEQ ID NO: 1567 - DNA, 25 bp, Homo sapien
agtcctgcccctctaatgaatgaga

SEQ ID NO: 1568 - DNA, 25 bp, Homo sapien
ctctgggtgcctgaagctatagtgc

SEQ ID NO: 1569 - DNA, 25 bp, Homo sapien
tatagtgcaatggttcccaaccctg

SEQ ID NO: 1570 - DNA, 25 bp, Homo sapien
ctgcatgcacattcgaatcacctgg

SEQ ID NO: 1571 - DNA, 25 bp, Homo sapien
aaccccagacactcttatttcattg

SEQ ID NO: 1572 - DNA, 25 bp, Homo sapien
tcttatttcattggtctgggtggac

SEQ ID NO: 1573 - DNA, 25 bp, Homo sapien
ctgggtggacctggcatcagaagtc

SEQ ID NO: 1574 - DNA, 25 bp, Homo sapien
tcagaagtcatgtagctcctcaggg

SEQ ID NO: 1575 - DNA, 25 bp, Homo sapien
agcactgagggctcctctatgaggc

SEQ ID NO: 1576 - DNA, 25 bp, Homo sapien
tctatgaggcctcaagcccaggtga

SEQ ID NO: 1577 - DNA, 25 bp, Homo sapien
aagcccaggtgactctgtgaggtct

SEQ ID NO: 1578 - DNA, 25 bp, Homo sapien
accccaaccaaagctaatggcctag

SEQ ID NO: 1579 - DNA, 25 bp, Homo sapien
taatggcctagttgggtcctgcccg

SEQ ID NO: 1580 - DNA, 25 bp, Homo sapien
ctagttgggtcctgcccgccaataa

SEQ ID NO: 1581 - DNA, 25 bp, Homo sapien
cccacgggtcagagacaggctcctt

SEQ ID NO: 1582 - DNA, 25 bp, Homo sapien
ctcaggctcagtgggccttggacaa

SEQ ID NO: 1583 - DNA, 25 bp, Homo sapien
agtgggccttggacaacccagcagg

SEQ ID NO: 1584 - DNA, 25 bp, Homo sapien
atctgagaccgaagtggacagtggt

SEQ ID NO: 1585 - DNA, 25 bp, Homo sapien
ccgaagtggacagtggttaagattg

SEQ ID NO: 1586 - DNA, 25 bp, Homo sapien
gtctctattgggagtacaaaaatta

SEQ ID NO: 1587 - DNA, 25 bp, Homo sapien
aattagccggccatagtggctcgtg

SEQ ID NO: 1588 - DNA, 25 bp, Homo sapien
tagccggccatagtggctcgtgcct

SEQ ID NO: 1589 - DNA, 25 bp, Homo sapien
aggatgcctcctgtgggatgtccca

SEQ ID NO: 1590 - DNA, 25 bp, Homo sapien
ggatgcctcctgtgggatgtcccag

SEQ ID NO: 1591 - DNA, 25 bp, Homo sapien
gatgcctcctgtgggatgtcccagc

SEQ ID NO: 1592 - DNA, 25 bp, Homo sapien
tcacttggagctgtccagatcagca

SEQ ID NO: 1593 - DNA, 25 bp, Homo sapien
cacttggagctgtccagatcagcat

SEQ ID NO: 1594 - DNA, 25 bp, Homo sapien
acttggagctgtccagatcagcatg

SEQ ID NO: 1595 - DNA, 25 bp, Homo sapien
ttggagctgtccagatcagcatggg

SEQ ID NO: 1596 - DNA, 25 bp, Homo sapien
ggagctgtccagatcagcatgggcc

SEQ ID NO: 1597 - DNA, 25 bp, Homo sapien
agctgtccagatcagcatgggccca

SEQ ID NO: 1598 - DNA, 25 bp, Homo sapien
gctgtccagatcagcatgggcccat

SEQ ID NO: 1599 - DNA, 25 bp, Homo sapien
tgtccagatcagcatgggcccatcc

SEQ ID NO: 1600 - DNA, 25 bp, Homo sapien
atttcatacaccctcgaggatgaga

SEQ ID NO: 1601 - DNA, 25 bp, Homo sapien
aggatgagacccaagcacctccaag

SEQ ID NO: 1602 - DNA, 25 bp, Homo sapien
gcacctccaaggaatagcacccgag

SEQ ID NO: 1603 - DNA, 25 bp, Homo sapien
gaatagcacccgaggtcttcaggac

SEQ ID NO: 1604 - DNA, 25 bp, Homo sapien
gaggtcttcaggacaccgaccggta

SEQ ID NO: 1605 - DNA, 25 bp, Homo sapien
acaccgaccggtagccatggccaga

SEQ ID NO: 1606 - DNA, 25 bp, Homo sapien
gtggccacgccctggatattcgacc

SEQ ID NO: 1607 - DNA, 25 bp, Homo sapien
tgatatcaggccacgccctccgagg

SEQ ID NO: 1608 - DNA, 25 bp, Homo sapien
gggaccggtggcaaactccagccct

SEQ ID NO: 1609 - DNA, 25 bp, Homo sapien
gttctgcagacacttgtccagcgtc

SEQ ID NO: 1610 - DNA, 25 bp, Homo sapien
gtggctagtttgtgtggccctgccc

SEQ ID NO: 1611 - DNA, 25 bp, Homo sapien
agaaggacaggaacttacaccgatt

SEQ ID NO: 1612 - DNA, 25 bp, Homo sapien
ggaacttacaccgattgattgccag

SEQ ID NO: 1613 - DNA, 25 bp, Homo sapien
attgattgccaggtgtgcctagcac

SEQ ID NO: 1614 - DNA, 25 bp, Homo sapien
gcacctcacatcaactatcttactt

SEQ ID NO: 1615 - DNA, 25 bp, Homo sapien
ggtgcctaagattagactttgggct

SEQ ID NO: 1616 - DNA, 25 bp, Homo sapien
gaacaaatcaccacggaactcctgt

SEQ ID NO: 1617 - DNA, 25 bp, Homo sapien
gaactcctgtgcatgaggcactgta

SEQ ID NO: 1618 - DNA, 25 bp, Homo sapien
aggcactgtatcaaggctagggcaa

SEQ ID NO: 1619 - DNA, 25 bp, Homo sapien
gctagggcaaagaaccagtcacata

SEQ ID NO: 1620 - DNA, 25 bp, Homo sapien
gtcacataaagttctgctctcttgg

SEQ ID NO: 1621 - DNA, 25 bp, Homo sapien
gcagatcacttaggctaggaattca

SEQ ID NO: 1622 - DNA, 25 bp, Homo sapien
agagccctaggaccccacagaagag

SEQ ID NO: 1623 - DNA, 25 bp, Homo sapien
agccccagaaggagcctcggccgag

SEQ ID NO: 1624 - DNA, 25 bp, Homo sapien
atcgggttgcgatgccctctgcata

SEQ ID NO: 1625 - DNA, 25 bp, Homo sapien
atgccctctgcatagtttctttctc

SEQ ID NO: 1626 - DNA, 25 bp, Homo sapien
tctttctcttccttcatagatgaca

SEQ ID NO: 1627 - DNA, 25 bp, Homo sapien
tagatgacacggtcactagctctgc

SEQ ID NO: 1628 - DNA, 25 bp, Homo sapien
gtcactagctctgcctcagaaagct

SEQ ID NO: 1629 - DNA, 25 bp, Homo sapien
gaaagctctgcgctttccagaaagc

SEQ ID NO: 1630 - DNA, 25 bp, Homo sapien
agaaagcgctttaccctgcagggtt

SEQ ID NO: 1631 - DNA, 25 bp, Homo sapien
tgcagggttttgctaacctcaaagg

SEQ ID NO: 1632 - DNA, 25 bp, Homo sapien
ggttttgctaacctcaaaggtcaga

SEQ ID NO: 1633 - DNA, 25 bp, Homo sapien
caaagcctttgcaaaagcattttgg

SEQ ID NO: 1634 - DNA, 25 bp, Homo sapien
atggataggcttttaggtcttggaa

SEQ ID NO: 1635 - DNA, 25 bp, Homo sapien
agaaaagaagtgtccagggttcaat

SEQ ID NO: 1636 - DNA, 25 bp, Homo sapien
cagggttcaatggagtggctgctct

SEQ ID NO: 1637 - DNA, 25 bp, Homo sapien
ctgctctgcagttacttgtatattg

SEQ ID NO: 1638 - DNA, 25 bp, Homo sapien
acttgtatattggaaggcaaaccta

SEQ ID NO: 1639 - DNA, 25 bp, Homo sapien
aaacctaaaagtccttatgctcata

SEQ ID NO: 1640 - DNA, 25 bp, Homo sapien
ctgggtgtcatctgtcacatttgta

SEQ ID NO: 1641 - DNA, 25 bp, Homo sapien
atattatcacacaatccttcgcaac

SEQ ID NO: 1642 - DNA, 25 bp, Homo sapien
ttccctagcaaactgcaaacttgag

SEQ ID NO: 1643 - DNA, 25 bp, Homo sapien
gtaccattaaactctgtcacctagt

SEQ ID NO: 1644 - DNA, 25 bp, Homo sapien
ttgtctcagaggttaaaaacattct

SEQ ID NO: 1645 - DNA, 25 bp, Homo sapien
tcagaggttaaaaacattctggaga

SEQ ID NO: 1646 - DNA, 25 bp, Homo sapien
cagcctttgggcaggtgtagaaatt

SEQ ID NO: 1647 - DNA, 25 bp, Homo sapien
attatttcagatacaagcatgtaac

SEQ ID NO: 1648 - DNA, 25 bp, Homo sapien
tacaagcatgtaacaaaaaaggtgt

SEQ ID NO: 1649 - DNA, 25 bp, Homo sapien
aaaatgtctaggctaagtatgcacc

SEQ ID NO: 1650 - DNA, 25 bp, Homo sapien
aaatgtctaggctaagtatgcacct

SEQ ID NO: 1651 - DNA, 25 bp, Homo sapien
aatgtctaggctaagtatgcaccta

SEQ ID NO: 1652 - DNA, 25 bp, Homo sapien
atgtctaggctaagtatgcacctaa

SEQ ID NO: 1653 - DNA, 25 bp, Homo sapien
gtctaggctaagtatgcacctaaat

SEQ ID NO: 1654 - DNA, 25 bp, Homo sapien
ctaggctaagtatgcacctaaatat

SEQ ID NO: 1655 - DNA, 25 bp, Homo sapien
ttagcaacaatcatcagagtgacgc

SEQ ID NO: 1656 - DNA, 25 bp, Homo sapien
atcatcagagtgacgctgatggttt

SEQ ID NO: 1657 - DNA, 25 bp, Homo sapien
tttggggcaccagctatacatcagc

SEQ ID NO: 1658 - DNA, 25 bp, Homo sapien
tattcattattttacgcctcagagc

SEQ ID NO: 1659 - DNA, 25 bp, Homo sapien
attttacgcctcagagcaaggccct

SEQ ID NO: 1660 - DNA, 25 bp, Homo sapien
gcaaggccctcagggagggtcatcc

SEQ ID NO: 1661 - DNA, 25 bp, Homo sapien
agggtcatcctccatgttttgaaga

SEQ ID NO: 1662 - DNA, 25 bp, Homo sapien
gtcatcctccatgttttgaagaaga

SEQ ID NO: 1663 - DNA, 25 bp, Homo sapien
gtgtcagcaccaggatttgaagcca

SEQ ID NO: 1664 - DNA, 25 bp, Homo sapien
ttgtctaaaagcacactgcaagccg

SEQ ID NO: 1665 - DNA, 25 bp, Homo sapien
ctaaaagcacactgcaagccgggct

SEQ ID NO: 1666 - DNA, 25 bp, Homo sapien
gtagaaacaggcttggagacttaat

SEQ ID NO: 1667 - DNA, 25 bp, Homo sapien
ggagacttaatcgaattacccaggt

SEQ ID NO: 1668 - DNA, 25 bp, Homo sapien
attacccaggtcacagccaataagt

SEQ ID NO: 1669 - DNA, 25 bp, Homo sapien
ggcaggaacttgaacattcagacta

SEQ ID NO: 1670 - DNA, 25 bp, Homo sapien
gtgctattttctagctgtttcccat

SEQ ID NO: 1671 - DNA, 25 bp, Homo sapien
gtttcccattctatgttgatcccat

SEQ ID NO: 1672 - DNA, 25 bp, Homo sapien
ttctatgttgatcccattcttgaaa

SEQ ID NO: 1673 - DNA, 25 bp, Homo sapien
tactaaagatatttgcctgaggtta

SEQ ID NO: 1674 - DNA, 25 bp, Homo sapien
gagtcgactgtctagaaaggaggct

SEQ ID NO: 1675 - DNA, 25 bp, Homo sapien
ggaggctaaatccttagtttcagta

SEQ ID NO: 1676 - DNA, 25 bp, Homo sapien
gtaaaatttgtcctcaacttgtact

SEQ ID NO: 1677 - DNA, 25 bp, Homo sapien
gcttactagagagcccatcgcctgg

SEQ ID NO: 1678 - DNA, 25 bp, Homo sapien
cagaagccaactagccaacacagag

SEQ ID NO: 1679 - DNA, 25 bp, Homo sapien
agaccatccatccagaagcatgtga

SEQ ID NO: 1680 - DNA, 25 bp, Homo sapien
agcatgtgataagacctccttccat

SEQ ID NO: 1681 - DNA, 25 bp, Homo sapien
tccttccatactggccatattttgg

SEQ ID NO: 1682 - DNA, 25 bp, Homo sapien
gaacactgacctagacatgtccaga

SEQ ID NO: 1683 - DNA, 25 bp, Homo sapien
gggagtcccattcctagcagacaag

SEQ ID NO: 1684 - DNA, 25 bp, Homo sapien
gacaagctgagcaccgttgtaacca

SEQ ID NO: 1685 - DNA, 25 bp, Homo sapien
gagaactattactaggccttgaaga

SEQ ID NO: 1686 - DNA, 25 bp, Homo sapien
gaacctgtctaactggatgctcatt

SEQ ID NO: 1687 - DNA, 25 bp, Homo sapien
aactggatgctcattgcctgggcaa

SEQ ID NO: 1688 - DNA, 25 bp, Homo sapien
aatatacgcatatatataagcacat

SEQ ID NO: 1689 - DNA, 25 bp, Homo sapien
ataagcacatatactcagttatata

SEQ ID NO: 1690 - DNA, 25 bp, Homo sapien
gatttttaatccattgtatcttcca

SEQ ID NO: 1691 - DNA, 25 bp, Homo sapien
tttaatccattgtatcttccaaagc

SEQ ID NO: 1692 - DNA, 25 bp, Homo sapien
atcttccaaagctaaagcattatta

SEQ ID NO: 1693 - DNA, 25 bp, Homo sapien
agttgtaatattttagtcagtcaat

SEQ ID NO: 1694 - DNA, 25 bp, Homo sapien
tagtcagtcaattctaataatgagc

SEQ ID NO: 1695 - DNA, 25 bp, Homo sapien
gtcaattctaataatgagcaactat

SEQ ID NO: 1696 - DNA, 25 bp, Homo sapien
tctgtattgtagttgattaggaagg

SEQ ID NO: 1697 - DNA, 25 bp, Homo sapien
ggaaggtataacattttactatagc

SEQ ID NO: 1698 - DNA, 25 bp, Homo sapien
ggtataacattttactatagctatt

SEQ ID NO: 1699 - DNA, 25 bp, Homo sapien
taatcttcataaagctcaacctgca

SEQ ID NO: 1700 - DNA, 25 bp, Homo sapien
aagctcaacctgcagagagattttt

SEQ ID NO: 1701 - DNA, 25 bp, Homo sapien
ctgcagagagattttttgaccctaa

SEQ ID NO: 1702 - DNA, 25 bp, Homo sapien
gagagattttttgaccctaatcaac

SEQ ID NO: 1703 - DNA, 25 bp, Homo sapien
tgaccctaatcaacgagggaaagcc

SEQ ID NO: 1704 - DNA, 25 bp, Homo sapien
gagggaaagccctccaccaaaagca

SEQ ID NO: 1705 - DNA, 25 bp, Homo sapien
ctccaccaaaagcaagcccttagaa

SEQ ID NO: 1706 - DNA, 25 bp, Homo sapien
agcaagcccttagaaaaagtcagag

SEQ ID NO: 1707 - DNA, 25 bp, Homo sapien
agcaaacttagttgtacatcaaaga

SEQ ID NO: 1708 - DNA, 25 bp, Homo sapien
tgaatgctgcgaatgtgcaaaagcc

SEQ ID NO: 1709 - DNA, 25 bp, Homo sapien
agaagtcaaccctcatagcacacca

SEQ ID NO: 1710 - DNA, 25 bp, Homo sapien
tcctcacgtttcctccttgcaggtt

SEQ ID NO: 1711 - DNA, 25 bp, Homo sapien
gagctgccatccctggtttgtagct

SEQ ID NO: 1712 - DNA, 25 bp, Homo sapien
atccctggtttgtagcttggcggtg

SEQ ID NO: 1713 - DNA, 25 bp, Homo sapien
agcgaggagggtgctcatctcttga

SEQ ID NO: 1714 - DNA, 25 bp, Homo sapien
ggtgctcatctcttgatccttggac

SEQ ID NO: 1715 - DNA, 25 bp, Homo sapien
tgatccttggacttgagccgagctt

SEQ ID NO: 1716 - DNA, 25 bp, Homo sapien
gacttgagccgagctttcggctgat

SEQ ID NO: 1717 - DNA, 25 bp, Homo sapien
gagctttcggctgattatctccacc

SEQ ID NO: 1718 - DNA, 25 bp, Homo sapien
ctgattatctccacccaccaaagtt

SEQ ID NO: 1719 - DNA, 25 bp, Homo sapien
caccaaagtttctcatccgaccttg

SEQ ID NO: 1720 - DNA, 25 bp, Homo sapien
ttttgtaccatggagtgggtatggc

SEQ ID NO: 1721 - DNA, 25 bp, Homo sapien
gaagacagcatcatacgctgccgaa

SEQ ID NO: 1722 - DNA, 25 bp, Homo sapien
gcatcatacgctgccgaaatcgtaa

SEQ ID NO: 1723 - DNA, 25 bp, Homo sapien
aatcgtaaacggtgctgtgttccta

SEQ ID NO: 1724 - DNA, 25 bp, Homo sapien
tgctgtgttcctagtcgttatttaa

SEQ ID NO: 1725 - DNA, 25 bp, Homo sapien
gtcgttatttaacaatccaaccagt

SEQ ID NO: 1726 - DNA, 25 bp, Homo sapien
acaatccaaccagtaacaattcatg

SEQ ID NO: 1727 - DNA, 25 bp, Homo sapien
aattcatggaatccttggctggacc

SEQ ID NO: 1728 - DNA, 25 bp, Homo sapien
ttggctggaccactcctcagatgtc

SEQ ID NO: 1729 - DNA, 25 bp, Homo sapien
gatgtccacaacagctccaaaaatg

SEQ ID NO: 1730 - DNA, 25 bp, Homo sapien
tgtttcaggttgcttagggtccaca

SEQ ID NO: 1731 - DNA, 25 bp, Homo sapien
atggatggacactgccggttgttgt

SEQ ID NO: 1732 - DNA, 25 bp, Homo sapien
aaacgcctagatgacgtgtccaacg

SEQ ID NO: 1733 - DNA, 25 bp, Homo sapien
acgtgtccaacgatgtgaggatggc

SEQ ID NO: 1734 - DNA, 25 bp, Homo sapien
tcctgtcggcagagcagatacggga

SEQ ID NO: 1735 - DNA, 25 bp, Homo sapien
agatacgggacgtgcaggaaacact

SEQ ID NO: 1736 - DNA, 25 bp, Homo sapien
gcaggaaacactgatgccccaggtc

SEQ ID NO: 1737 - DNA, 25 bp, Homo sapien
gattcgaagatgacgcgactgatct

SEQ ID NO: 1738 - DNA, 25 bp, Homo sapien
gcgactgatctcatgccgtattatc

SEQ ID NO: 1739 - DNA, 25 bp, Homo sapien
gccgtattatcaacacgttcttaaa

SEQ ID NO: 1740 - DNA, 25 bp, Homo sapien
gttcttaaaaacctcgggcggcatg

SEQ ID NO: 1741 - DNA, 25 bp, Homo sapien
cctcgggcggcatgacggatccaga

SEQ ID NO: 1742 - DNA, 25 bp, Homo sapien
tatcctgaactcttaaaacgcctag

SEQ ID NO: 1743 - DNA, 25 bp, Homo sapien
acatagcccagttcaagtccctgtc

SEQ ID NO: 1744 - DNA, 25 bp, Homo sapien
tcaagtccctgtctccacaggagct

SEQ ID NO: 1745 - DNA, 25 bp, Homo sapien
tccacaggagctgcaggcctttaag

SEQ ID NO: 1746 - DNA, 25 bp, Homo sapien
gctgcaggcctttaagagggccaaa

SEQ ID NO: 1747 - DNA, 25 bp, Homo sapien
taagagggccaaagatgccttagaa

SEQ ID NO: 1748 - DNA, 25 bp, Homo sapien
aaagatgccttagaagagtcgcttc

SEQ ID NO: 1749 - DNA, 25 bp, Homo sapien
tagaagagtcgcttctgctgaagga

SEQ ID NO: 1750 - DNA, 25 bp, Homo sapien
tgatggccgcagtgctgaccgtgac

SEQ ID NO: 1751 - DNA, 25 bp, Homo sapien
cctcacgcgagacctgaattgtgtt

SEQ ID NO: 1752 - DNA, 25 bp, Homo sapien
cacgcgagacctgaattgtgttgcc

SEQ ID NO: 1753 - DNA, 25 bp, Homo sapien
tgctgaccgtgactggagcagttcc

SEQ ID NO: 1754 - DNA, 25 bp, Homo sapien
gcttcgaagctttatgagtgccaac

SEQ ID NO: 1755 - DNA, 25 bp, Homo sapien
tgagtgccaacaccttcggcaatgc

SEQ ID NO: 1756 - DNA, 25 bp, Homo sapien
aatgcccgggtcagatgccatctgg

SEQ ID NO: 1757 - DNA, 25 bp, Homo sapien
tgccatctgggcctaaagatccctc

SEQ ID NO: 1758 - DNA, 25 bp, Homo sapien
gggcctaaagatccctcctggctgt

SEQ ID NO: 1759 - DNA, 25 bp, Homo sapien
ggcactgtctactggtggacgactc

SEQ ID NO: 1760 - DNA, 25 bp, Homo sapien
tggtggacgactcttttctacacac

SEQ ID NO: 1761 - DNA, 25 bp, Homo sapien
agatgggcctcgagtggtcttcatc

SEQ ID NO: 1762 - DNA, 25 bp, Homo sapien
gcctcgagtggtcttcatcgtggac

SEQ ID NO: 1763 - DNA, 25 bp, Homo sapien
gagcgccaggccctcgactttgtct

SEQ ID NO: 1764 - DNA, 25 bp, Homo sapien
tcgccccagacccttgaaggaaggt

SEQ ID NO: 1765 - DNA, 25 bp, Homo sapien
atagcgataggcctcgctgcacagg

SEQ ID NO: 1766 - DNA, 25 bp, Homo sapien
cacaggtcctgtgggatcaactgca

SEQ ID NO: 1767 - DNA, 25 bp, Homo sapien
ggatcaactgcacatccactttctg

SEQ ID NO: 1768 - DNA, 25 bp, Homo sapien
cactttctgcagagcgttgctgatg

SEQ ID NO: 1769 - DNA, 25 bp, Homo sapien
ggcctgtccgtggtcaagggcagaa

SEQ ID NO: 1770 - DNA, 25 bp, Homo sapien
agaagtgagatctcaggagcctgga

SEQ ID NO: 1771 - DNA, 25 bp, Homo sapien
tctattctccctaacattattccct

SEQ ID NO: 1772 - DNA, 25 bp, Homo sapien
attattccctttgcatctcaggagc

SEQ ID NO: 1773 - DNA, 25 bp, Homo sapien
ttgcatctcaggagcctacttctct

SEQ ID NO: 1774 - DNA, 25 bp, Homo sapien
actttattctagctctttctctgtg

SEQ ID NO: 1775 - DNA, 25 bp, Homo sapien
cgaccaaagcccatgtggagggccg

SEQ ID NO: 1776 - DNA, 25 bp, Homo sapien
atttctctggtattatattatatcc

SEQ ID NO: 1777 - DNA, 25 bp, Homo sapien
ctctggtattatattatatccttct

SEQ ID NO: 1778 - DNA, 25 bp, Homo sapien
ggtattatattatatccttcttaaa

SEQ ID NO: 1779 - DNA, 25 bp, Homo sapien
aagtaacagtatttgaatggcatca

SEQ ID NO: 1780 - DNA, 25 bp, Homo sapien
gtaacagtatttgaatggcatcaaa

SEQ ID NO: 1781 - DNA, 25 bp, Homo sapien
tttgaatggcatcaaaacattttca

SEQ ID NO: 1782 - DNA, 25 bp, Homo sapien
aaaaaagtgtccaagcagccgggcg

SEQ ID NO: 1783 - DNA, 25 bp, Homo sapien
aaaaagtgtccaagcagccgggcgc

SEQ ID NO: 1784 - DNA, 25 bp, Homo sapien
aaaagtgtccaagcagccgggcgca

SEQ ID NO: 1785 - DNA, 25 bp, Homo sapien
aagtgtccaagcagccgggcgcagt

SEQ ID NO: 1786 - DNA, 25 bp, Homo sapien
attaggaaaccctgacaaaatgatg

SEQ ID NO: 1787 - DNA, 25 bp, Homo sapien
ttacattatattacagttacaaggt

SEQ ID NO: 1788 - DNA, 25 bp, Homo sapien
caaggtaaaattcctcaactgctat

SEQ ID NO: 1789 - DNA, 25 bp, Homo sapien
tcctcaactgctatttatttattcc

SEQ ID NO: 1790 - DNA, 25 bp, Homo sapien
agaacgtttcaccataatgaccctc

SEQ ID NO: 1791 - DNA, 25 bp, Homo sapien
gtttcaccataatgaccctccagag

SEQ ID NO: 1792 - DNA, 25 bp, Homo sapien
cataatgaccctccagagctgggaa

SEQ ID NO: 1793 - DNA, 25 bp, Homo sapien
tgaccctccagagctgggaaaccta

SEQ ID NO: 1794 - DNA, 25 bp, Homo sapien
gggaaacctaccacaagatctaaag

SEQ ID NO: 1795 - DNA, 25 bp, Homo sapien
agatctaaagttctggctgtccatt

SEQ ID NO: 1796 - DNA, 25 bp, Homo sapien
ctaaagttctggctgtccattaacc

SEQ ID NO: 1797 - DNA, 25 bp, Homo sapien
ctggtgtgtatcaacattatttaat

SEQ ID NO: 1798 - DNA, 25 bp, Homo sapien
gagagattgctccacagaagcacag

SEQ ID NO: 1799 - DNA, 25 bp, Homo sapien
cagaggaacgtgtgtggcccactgc

SEQ ID NO: 1800 - DNA, 25 bp, Homo sapien
gggacaccgcacacatttttagtct

SEQ ID NO: 1801 - DNA, 25 bp, Homo sapien
atttttagtctgttcacctgccgag

SEQ ID NO: 1802 - DNA, 25 bp, Homo sapien
ttcacctgccgagtgagtggttccc

SEQ ID NO: 1803 - DNA, 25 bp, Homo sapien
ccccttgcgttacagcatggcagtg

SEQ ID NO: 1804 - DNA, 25 bp, Homo sapien
agagttgttggcattggtcaatagt

SEQ ID NO: 1805 - DNA, 25 bp, Homo sapien
gtcagatggccaacgtcagtgtcaa

SEQ ID NO: 1806 - DNA, 25 bp, Homo sapien
ggatgacttacattcacctacagct

SEQ ID NO: 1807 - DNA, 25 bp, Homo sapien
acattcacctacagctttgtggcta

SEQ ID NO: 1808 - DNA, 25 bp, Homo sapien
cagctttgtggctatctaacttaca

SEQ ID NO: 1809 - DNA, 25 bp, Homo sapien
atgtggagtccttgtgccatcagga

SEQ ID NO: 1810 - DNA, 25 bp, Homo sapien
gccatcaggaagcaggagacctgca

SEQ ID NO: 1811 - DNA, 25 bp, Homo sapien
gacctgcagaataatgctgcccctg

SEQ ID NO: 1812 - DNA, 25 bp, Homo sapien
tgaaggcccgcatcctttatggaga

SEQ ID NO: 1813 - DNA, 25 bp, Homo sapien
catcctttatggagacaaccccttt

SEQ ID NO: 1814 - DNA, 25 bp, Homo sapien
accccttttcacgtcagctaggttg

SEQ ID NO: 1815 - DNA, 25 bp, Homo sapien
cgtcagctaggttgcaaggataata

SEQ ID NO: 1816 - DNA, 25 bp, Homo sapien
taccaaatactttatgttccctcat

SEQ ID NO: 1817 - DNA, 25 bp, Homo sapien
tttatgttccctcataccttaacca

SEQ ID NO: 1818 - DNA, 25 bp, Homo sapien
taaccactaccctttaaagttcatg

SEQ ID NO: 1819 - DNA, 25 bp, Homo sapien
gggcaatattaccagtatcttacac

SEQ ID NO: 1820 - DNA, 25 bp, Homo sapien
ctgagaactggggaaaccgacctat

SEQ ID NO: 1821 - DNA, 25 bp, Homo sapien
ttttctttgaaagctctgcacagtt

SEQ ID NO: 1822 - DNA, 25 bp, Homo sapien
tgaaagctctgcacagttcaggcat

SEQ ID NO: 1823 - DNA, 25 bp, Homo sapien
agctctgcacagttcaggcatcaat

SEQ ID NO: 1824 - DNA, 25 bp, Homo sapien
gcacagttcaggcatcaattttgat

SEQ ID NO: 1825 - DNA, 25 bp, Homo sapien
caattttgatgatgtatctgcctgt

SEQ ID NO: 1826 - DNA, 25 bp, Homo sapien
tgatgatgtatctgcctgtaaaaga

SEQ ID NO: 1827 - DNA, 25 bp, Homo sapien
gtatctgcctgtaaaagattgtcat

SEQ ID NO: 1828 - DNA, 25 bp, Homo sapien
gattgtcattattttcaacacatct

SEQ ID NO: 1829 - DNA, 25 bp, Homo sapien
attttcaacacatctgtatctcaga

SEQ ID NO: 1830 - DNA, 25 bp, Homo sapien
acacatctgtatctcagattggact

SEQ ID NO: 1831 - DNA, 25 bp, Homo sapien
atgtcagtttccatttactgtctca

SEQ ID NO: 1832 - DNA, 25 bp, Homo sapien
agtttccatttactgtctcaccaca

SEQ ID NO: 1833 - DNA, 25 bp, Homo sapien
tactgtctcaccacatttattgggt

SEQ ID NO: 1834 - DNA, 25 bp, Homo sapien
cacatttattgggttattgcctttg

SEQ ID NO: 1835 - DNA, 25 bp, Homo sapien
gaagggtaggaatcccaaattctgt

SEQ ID NO: 1836 - DNA, 25 bp, Homo sapien
gttgcctaaggcagccagttgtcag

SEQ ID NO: 1837 - DNA, 25 bp, Homo sapien
ggcagccagttgtcagaatggactt

SEQ ID NO: 1838 - DNA, 25 bp, Homo sapien
gtcagaatggactttcctcattttc

SEQ ID NO: 1839 - DNA, 25 bp, Homo sapien
atagaagagagagggcccggcacgg

SEQ ID NO: 1840 - DNA, 25 bp, Homo sapien
cagtgaaccgaaccgagatcgcgtc

SEQ ID NO: 1841 - DNA, 25 bp, Homo sapien
accgaaccgagatcgcgtcgctgga

SEQ ID NO: 1842 - DNA, 25 bp, Homo sapien
tggacaagcatcgtttgaaaacccc

SEQ ID NO: 1843 - DNA, 25 bp, Homo sapien
gtttgaaaaccccatgtatgataca

SEQ ID NO: 1844 - DNA, 25 bp, Homo sapien
ttaaaacccacagaagccaaggctg

SEQ ID NO: 1845 - DNA, 25 bp, Homo sapien
gccaaggctgtgaggtttgacacaa

SEQ ID NO: 1846 - DNA, 25 bp, Homo sapien
gctgtgaggtttgacacaactctga

SEQ ID NO: 1847 - DNA, 25 bp, Homo sapien
gacacaactctgaacacagtctgta

SEQ ID NO: 1848 - DNA, 25 bp, Homo sapien
cagtctgtacagtggtatagccctc

SEQ ID NO: 1849 - DNA, 25 bp, Homo sapien
gtacagtggtatagccctcagtgcc

SEQ ID NO: 1850 - DNA, 25 bp, Homo sapien
agtggtatagccctcagtgccccaa

SEQ ID NO: 1851 - DNA, 25 bp, Homo sapien
aatcaaggcacactccaggaagact

SEQ ID NO: 1852 - DNA, 25 bp, Homo sapien
gcacactccaggaagactgccgcgt

SEQ ID NO: 1853 - DNA, 25 bp, Homo sapien
gtgctcctcaatcctgtgagtgctc

SEQ ID NO: 1854 - DNA, 25 bp, Homo sapien
gtgagtgctccacagcccatggctg

SEQ ID NO: 1855 - DNA, 25 bp, Homo sapien
agtgcctggcagttgggagacccac

SEQ ID NO: 1856 - DNA, 25 bp, Homo sapien
tgtgaccttggctaaagaatccgag

SEQ ID NO: 1857 - DNA, 25 bp, Homo sapien
ttttcctttcctaatcatgtacttt

SEQ ID NO: 1858 - DNA, 25 bp, Homo sapien
ggcatttttatgcatgttcccttca

SEQ ID NO: 1859 - DNA, 25 bp, Homo sapien
tatgcatgttcccttcagtctttgc

SEQ ID NO: 1860 - DNA, 25 bp, Homo sapien
cagtctttgctcatgtgtgtataca

SEQ ID NO: 1861 - DNA, 25 bp, Homo sapien
tgagttttctaggtctcgctttcct

SEQ ID NO: 1862 - DNA, 25 bp, Homo sapien
ctaggtctcgctttccttatttgta

SEQ ID NO: 1863 - DNA, 25 bp, Homo sapien
aaaatgcaaacaattacctctgctt

SEQ ID NO: 1864 - DNA, 25 bp, Homo sapien
caggatggcattagctctgtgtctg

SEQ ID NO: 1865 - DNA, 25 bp, Homo sapien
tggctctcgctctatatttctttct

SEQ ID NO: 1866 - DNA, 25 bp, Homo sapien
tttctgccacctgaataagcaccga

SEQ ID NO: 1867 - DNA, 25 bp, Homo sapien
gaagctatgagtggagctgccgcct

SEQ ID NO: 1868 - DNA, 25 bp, Homo sapien
catggagtcctctctataggcctct

SEQ ID NO: 1869 - DNA, 25 bp, Homo sapien
taggcctctccgcttatattggctt

SEQ ID NO: 1870 - DNA, 25 bp, Homo sapien
atattggcttcattgatggcccatg

SEQ ID NO: 1871 - DNA, 25 bp, Homo sapien
tgtgtctcaccttgggctacttcat

SEQ ID NO: 1872 - DNA, 25 bp, Homo sapien
gcatctggcgctttgcatggaggaa

SEQ ID NO: 1873 - DNA, 25 bp, Homo sapien
ggcagctgaaacacaacggacatct

SEQ ID NO: 1874 - DNA, 25 bp, Homo sapien
tagccaaggcttgctccagattatg

SEQ ID NO: 1875 - DNA, 25 bp, Homo sapien
gaagtccgtttgatgattccactgt

SEQ ID NO: 1876 - DNA, 25 bp, Homo sapien
acgagcccctgcattggagtcagag

SEQ ID NO: 1877 - DNA, 25 bp, Homo sapien
tgaagcagggccgtactttgctgca

SEQ ID NO: 1878 - DNA, 25 bp, Homo sapien
ttgctgcactgtgctgctggtgtga

SEQ ID NO: 1879 - DNA, 25 bp, Homo sapien
tgtgcctcgcctacctcatgaagta

SEQ ID NO: 1880 - DNA, 25 bp, Homo sapien
tcatgaagtaccacgccatgtccct

SEQ ID NO: 1881 - DNA, 25 bp, Homo sapien
acacgtggaccaagtcatgccggcc

SEQ ID NO: 1882 - DNA, 25 bp, Homo sapien
gcttttgggagcagctcatccacta

SEQ ID NO: 1883 - DNA, 25 bp, Homo sapien
ggcaagaacactgtgcacatggtca

SEQ ID NO: 1884 - DNA, 25 bp, Homo sapien
cacatggtcagttccccagtgggaa

SEQ ID NO: 1885 - DNA, 25 bp, Homo sapien
cagtgggaatgatccctgacatcta

SEQ ID NO: 1886 - DNA, 25 bp, Homo sapien
agatgcttcggtcagtctgatccac

SEQ ID NO: 1887 - DNA, 25 bp, Homo sapien
tgatccacgagatatctcaggctgg

SEQ ID NO: 1888 - DNA, 25 bp, Homo sapien
acatcttgggccaacttccacagca

SEQ ID NO: 1889 - DNA, 25 bp, Homo sapien
agcagccatgcgtccaaggatacag

SEQ ID NO: 1890 - DNA, 25 bp, Homo sapien
ggatacagaatcaggcaggccgata

SEQ ID NO: 1891 - DNA, 25 bp, Homo sapien
aaggaggtatgccatcaaaccccac

SEQ ID NO: 1892 - DNA, 25 bp, Homo sapien
caaaccccactgtagtcaaggatca

SEQ ID NO: 1893 - DNA, 25 bp, Homo sapien
gaagctttttagtataaggcccact

SEQ ID NO: 1894 - DNA, 25 bp, Homo sapien
ataaggcccacttagggtgccagca

SEQ ID NO: 1895 - DNA, 25 bp, Homo sapien
agtgtccctttaatccacttcagat

SEQ ID NO: 1896 - DNA, 25 bp, Homo sapien
acttcagatctggttgactcatcat

SEQ ID NO: 1897 - DNA, 25 bp, Homo sapien
gacaaaatgctaattatttccctga

SEQ ID NO: 1898 - DNA, 25 bp, Homo sapien
atgctaattatttccctgattagga

SEQ ID NO: 1899 - DNA, 25 bp, Homo sapien
tatttccctgattaggaaagtttct

SEQ ID NO: 1900 - DNA, 25 bp, Homo sapien
aaaacacgtaattttgcctagtgct

SEQ ID NO: 1901 - DNA, 25 bp, Homo sapien
aaacacgtaattttgcctagtgctt

SEQ ID NO: 1902 - DNA, 25 bp, Homo sapien
gctttttctctacctgcccttgggc

SEQ ID NO: 1903 - DNA, 25 bp, Homo sapien
ctgcccttgggctcactaatatcac

SEQ ID NO: 1904 - DNA, 25 bp, Homo sapien
tgggctcactaatatcaccagtatt

SEQ ID NO: 1905 - DNA, 25 bp, Homo sapien
ggctcactaatatcaccagtattat

SEQ ID NO: 1906 - DNA, 25 bp, Homo sapien
tcaccagtattattaccaagaaaat

SEQ ID NO: 1907 - DNA, 25 bp, Homo sapien
gaaaatattgagtttacctgattaa

SEQ ID NO: 1908 - DNA, 25 bp, Homo sapien
acctcttcatctcagactttgcata

SEQ ID NO: 1909 - DNA, 25 bp, Homo sapien
catctcagactttgcatactgctgg

SEQ ID NO: 1910 - DNA, 25 bp, Homo sapien
gcaaccgactgcctgctaacaggcg

SEQ ID NO: 1911 - DNA, 25 bp, Homo sapien
taacaggcgcttccagatcacctgg

SEQ ID NO: 1912 - DNA, 25 bp, Homo sapien
gtttgtatcatggaacccctgcctg

SEQ ID NO: 1913 - DNA, 25 bp, Homo sapien
gaaggtgaccaaattcttggctgag

SEQ ID NO: 1914 - DNA, 25 bp, Homo sapien
caaattcttggctgagcaccccaat

SEQ ID NO: 1915 - DNA, 25 bp, Homo sapien
tactactaccgggatagagattggc

SEQ ID NO: 1916 - DNA, 25 bp, Homo sapien
ggtgggtgctcctcaggctgcataa

SEQ ID NO: 1917 - DNA, 25 bp, Homo sapien
gtgctcctcaggctgcataaggcag

SEQ ID NO: 1918 - DNA, 25 bp, Homo sapien
aacagcctcagagatggatggatct

SEQ ID NO: 1919 - DNA, 25 bp, Homo sapien
tatatgtacttcatacatttttgaa

SEQ ID NO: 1920 - DNA, 25 bp, Homo sapien
atgtgcttaggaatataatctttta

SEQ ID NO: 1921 - DNA, 25 bp, Homo sapien
ggataatcaattaccaaatcaatgg

SEQ ID NO: 1922 - DNA, 25 bp, Homo sapien
tcaattaccaaatcaatggcaatgg

SEQ ID NO: 1923 - DNA, 25 bp, Homo sapien
gaaagtccagagttgttattgtata

SEQ ID NO: 1924 - DNA, 25 bp, Homo sapien
gtaaggtatgtcgttatatatataa

SEQ ID NO: 1925 - DNA, 25 bp, Homo sapien
agaacttcttagtgaaatgggtact

SEQ ID NO: 1926 - DNA, 25 bp, Homo sapien
atgggtactacatttgttacagaat

SEQ ID NO: 1927 - DNA, 25 bp, Homo sapien
acatttgttacagaatttgctaaac

SEQ ID NO: 1928 - DNA, 25 bp, Homo sapien
taagcctttaagtttcagaaatact

SEQ ID NO: 1929 - DNA, 25 bp, Homo sapien
gaaatactctctcagattgtttaaa

SEQ ID NO: 1930 - DNA, 25 bp, Homo sapien
gctttgctaccactttctatcagca

SEQ ID NO: 1931 - DNA, 25 bp, Homo sapien
ttctatcagcacctggcagattcca

SEQ ID NO: 1932 - DNA, 25 bp, Homo sapien
aatgataacattttcctgtcacccc

SEQ ID NO: 1933 - DNA, 25 bp, Homo sapien
acggcttttgctatgaccaagctgg

SEQ ID NO: 1934 - DNA, 25 bp, Homo sapien
gctatgaccaagctgggtgcctgta

SEQ ID NO: 1935 - DNA, 25 bp, Homo sapien
taatgacaccctccagcaactgatg

SEQ ID NO: 1936 - DNA, 25 bp, Homo sapien
aagtttgacaccatatctgagaaaa

SEQ ID NO: 1937 - DNA, 25 bp, Homo sapien
tgccgactctatcgaaaagccaaca

SEQ ID NO: 1938 - DNA, 25 bp, Homo sapien
aaagccaacaaatcctccaagttag

SEQ ID NO: 1939 - DNA, 25 bp, Homo sapien
atgtctcagatgcattccataaggc

SEQ ID NO: 1940 - DNA, 25 bp, Homo sapien
ccaacagggtgactttcaaggccaa

SEQ ID NO: 1941 - DNA, 25 bp, Homo sapien
agatgtgaagcgtcagagtcgctga

SEQ ID NO: 1942 - DNA, 25 bp, Homo sapien
gaagcgtcagagtcgctgagcttgt

SEQ ID NO: 1943 - DNA, 25 bp, Homo sapien
ctcgccagcgctgctgcaagaagga

SEQ ID NO: 1944 - DNA, 25 bp, Homo sapien
ctgcaagaaggaccccggagacccg

SEQ ID NO: 1945 - DNA, 25 bp, Homo sapien
tccgggcgggcagctacgtgcctgg

SEQ ID NO: 1946 - DNA, 25 bp, Homo sapien
gggacgcggcgagactgtcggcggg

SEQ ID NO: 1947 - DNA, 25 bp, Homo sapien
cctgtgtgcgctgcagcgttgcggg

SEQ ID NO: 1948 - DNA, 25 bp, Homo sapien
gtatggagatgcaatttgggactgc

SEQ ID NO: 1949 - DNA, 25 bp, Homo sapien
agatgcaatttgggactgcggtcgc

SEQ ID NO: 1950 - DNA, 25 bp, Homo sapien
tggtgcgggtgggttcggaacacgg

SEQ ID NO: 1951 - DNA, 25 bp, Homo sapien
ttcggaacacggtgcgagtgggtga

SEQ ID NO: 1952 - DNA, 25 bp, Homo sapien
ctcttcctgggaaagtaattgctga

SEQ ID NO: 1953 - DNA, 25 bp, Homo sapien
taattgctgagccagtacagccaca

SEQ ID NO: 1954 - DNA, 25 bp, Homo sapien
tgagccagtacagccacaaacagta

SEQ ID NO: 1955 - DNA, 25 bp, Homo sapien
aacagtactattttgcagatgctca

SEQ ID NO: 1956 - DNA, 25 bp, Homo sapien
gatgctcatgtaagcagcttttcga

SEQ ID NO: 1957 - DNA, 25 bp, Homo sapien
ataaagttaggctggcattgctccc

SEQ ID NO: 1958 - DNA, 25 bp, Homo sapien
attgctcccttaagatcttgctcct

SEQ ID NO: 1959 - DNA, 25 bp, Homo sapien
tcttgctcctttattaaccctgtaa

SEQ ID NO: 1960 - DNA, 25 bp, Homo sapien
agtcttgtttatcctctaatggcca

SEQ ID NO: 1961 - DNA, 25 bp, Homo sapien
gtttatcctctaatggccaggcttt

SEQ ID NO: 1962 - DNA, 25 bp, Homo sapien
ggccaggcttttgggacagcagcat

SEQ ID NO: 1963 - DNA, 25 bp, Homo sapien
gtctgtgggtgtaaacaaggccaac

SEQ ID NO: 1964 - DNA, 25 bp, Homo sapien
acaaggccaacaacgttaacggatg

SEQ ID NO: 1965 - DNA, 25 bp, Homo sapien
taacggatggcatcagtgcctctgg

SEQ ID NO: 1966 - DNA, 25 bp, Homo sapien
tggcatcagtgcctctgggccccag

SEQ ID NO: 1967 - DNA, 25 bp, Homo sapien
gggccccagagttctgctaggccca

SEQ ID NO: 1968 - DNA, 25 bp, Homo sapien
atcaccatcaagcactcctgcaaga

SEQ ID NO: 1969 - DNA, 25 bp, Homo sapien
catcaagcactcctgcaagaatagg

SEQ ID NO: 1970 - DNA, 25 bp, Homo sapien
gaataggaagaaaccctttctgctt

SEQ ID NO: 1971 - DNA, 25 bp, Homo sapien
accctttctgcttagggctgtttat

SEQ ID NO: 1972 - DNA, 25 bp, Homo sapien
gcttagggctgtttattttacaact

SEQ ID NO: 1973 - DNA, 25 bp, Homo sapien
tatctatctggatggccgggtgcgg

SEQ ID NO: 1974 - DNA, 25 bp, Homo sapien
ttaagagctttatcttgtgaagtga

SEQ ID NO: 1975 - DNA, 25 bp, Homo sapien
gagtggacacttaatgtctttataa

SEQ ID NO: 1976 - DNA, 25 bp, Homo sapien
gggagcataatttgcaaatggaata

SEQ ID NO: 1977 - DNA, 25 bp, Homo sapien
aatttgcaaatggaatatctgttat

SEQ ID NO: 1978 - DNA, 25 bp, Homo sapien
ctgttattttactaagatgcttcat

SEQ ID NO: 1979 - DNA, 25 bp, Homo sapien
gatgcttcatggatacaagagttaa

SEQ ID NO: 1980 - DNA, 25 bp, Homo sapien
caagagttaaaacttcctgtcccat

SEQ ID NO: 1981 - DNA, 25 bp, Homo sapien
aaagcttgtaagttagaaatggcaa

SEQ ID NO: 1982 - DNA, 25 bp, Homo sapien
gaaatggcaagataatcagctatat

SEQ ID NO: 1983 - DNA, 25 bp, Homo sapien
gataatcagctatatgaagaatctc

SEQ ID NO: 1984 - DNA, 25 bp, Homo sapien
tgaagaatctcagctgggtgttttg

SEQ ID NO: 1985 - DNA, 25 bp, Homo sapien
tgacaagccaacctcccgtacggcg

SEQ ID NO: 1986 - DNA, 25 bp, Homo sapien
gaccacacacccctgggatagaaag

SEQ ID NO: 1987 - DNA, 25 bp, Homo sapien
cacacccctgggatagaaagaccct

SEQ ID NO: 1988 - DNA, 25 bp, Homo sapien
gggatagaaagacccttagatgtct

SEQ ID NO: 1989 - DNA, 25 bp, Homo sapien
caaccccaaactccctgtacagaag

SEQ ID NO: 1990 - DNA, 25 bp, Homo sapien
gaagggaaacaaacgccaggcacgg

SEQ ID NO: 1991 - DNA, 25 bp, Homo sapien
tggccaggcccagtttggcctgtct

SEQ ID NO: 1992 - DNA, 25 bp, Homo sapien
gcccagtttggcctgtctgcctcgg

SEQ ID NO: 1993 - DNA, 25 bp, Homo sapien
gggcccagcgctgagggtcacccaa

SEQ ID NO: 1994 - DNA, 25 bp, Homo sapien
ttagtgaccccatctatgctgctga

SEQ ID NO: 1995 - DNA, 25 bp, Homo sapien
tgaccccatctatgctgctgacaag

SEQ ID NO: 1996 - DNA, 25 bp, Homo sapien
aatctcaacatacttcatttaatag

SEQ ID NO: 1997 - DNA, 25 bp, Homo sapien
acatacttcatttaatagctcgtta

SEQ ID NO: 1998 - DNA, 25 bp, Homo sapien
acttcatttaatagctcgttaccaa

SEQ ID NO: 1999 - DNA, 25 bp, Homo sapien
atttaatagctcgttaccaagtgtg

SEQ ID NO: 2000 - DNA, 25 bp, Homo sapien
taatagctcgttaccaagtgtgaat

SEQ ID NO: 2001 - DNA, 25 bp, Homo sapien
atatgtcataatagagtagccactg

SEQ ID NO: 2002 - DNA, 25 bp, Homo sapien
tagagtagccactggttgcataata

SEQ ID NO: 2003 - DNA, 25 bp, Homo sapien
gtagccactggttgcataataatag

SEQ ID NO: 2004 - DNA, 25 bp, Homo sapien
ccactggttgcataataatagagac

SEQ ID NO: 2005 - DNA, 25 bp, Homo sapien
gagacctaaattctcaaatagggaa

SEQ ID NO: 2006 - DNA, 25 bp, Homo sapien
ttaaaatcaaatttgaggccaggtg

SEQ ID NO: 2007 - DNA, 25 bp, Homo sapien
attaaattattatctgctctgaaag

SEQ ID NO: 2008 - DNA, 25 bp, Homo sapien
gctctgaaagaattccagccggtct

SEQ ID NO: 2009 - DNA, 25 bp, Homo sapien
gaattccagccggtctttaaaatga

SEQ ID NO: 2010 - DNA, 25 bp, Homo sapien
tccagccggtctttaaaatgaagat

SEQ ID NO: 2011 - DNA, 25 bp, Homo sapien
gaagggagaggtaactatagcacag

SEQ ID NO: 2012 - DNA, 25 bp, Homo sapien
acagatcagctgtgtgttcttgaca

SEQ ID NO: 2013 - DNA, 25 bp, Homo sapien
gatcagctgtgtgttcttgacaatg

SEQ ID NO: 2014 - DNA, 25 bp, Homo sapien
gctgtgtgttcttgacaatgtgaaa

SEQ ID NO: 2015 - DNA, 25 bp, Homo sapien
atttgcgaagatttattgcttatca

SEQ ID NO: 2016 - DNA, 25 bp, Homo sapien
attgcttatcaagaaactgttgaga

SEQ ID NO: 2017 - DNA, 25 bp, Homo sapien
aactgttgagaaaagactgacttct

SEQ ID NO: 2018 - DNA, 25 bp, Homo sapien
acacttggttgggtcctcacatctt

SEQ ID NO: 2019 - DNA, 25 bp, Homo sapien
actccctcaaagcacacgtcatgtt

SEQ ID NO: 2020 - DNA, 25 bp, Homo sapien
aagcacacgtcatgtttcttcatcc

SEQ ID NO: 2021 - DNA, 25 bp, Homo sapien
atgtttcttcatccggcagcctgga

SEQ ID NO: 2022 - DNA, 25 bp, Homo sapien
ccctgtttaatgattgacgtactta

SEQ ID NO: 2023 - DNA, 25 bp, Homo sapien
gattgacgtacttagcagctatctc

SEQ ID NO: 2024 - DNA, 25 bp, Homo sapien
cttagcagctatctctcagtgaact

SEQ ID NO: 2025 - DNA, 25 bp, Homo sapien
cagtgaactgtgagggtaaaggcta

SEQ ID NO: 2026 - DNA, 25 bp, Homo sapien
aaaggctatacttgtcttgttcacc

SEQ ID NO: 2027 - DNA, 25 bp, Homo sapien
atgtcagggcgtgggacatctagta

SEQ ID NO: 2028 - DNA, 25 bp, Homo sapien
gacatctagtaggtgcttgacataa

SEQ ID NO: 2029 - DNA, 25 bp, Homo sapien
tttctcctcctttggatgtattggg

SEQ ID NO: 2030 - DNA, 25 bp, Homo sapien
tcctcctttggatgtattgggcttc

SEQ ID NO: 2031 - DNA, 25 bp, Homo sapien
tttggatgtattgggcttcctgact

SEQ ID NO: 2032 - DNA, 25 bp, Homo sapien
atgtattgggcttcctgactctttg

SEQ ID NO: 2033 - DNA, 25 bp, Homo sapien
gactctttgaagaatctatccagtg

SEQ ID NO: 2034 - DNA, 25 bp, Homo sapien
gaagaatctatccagtgtctttaag

SEQ ID NO: 2035 - DNA, 25 bp, Homo sapien
gaatctatccagtgtctttaagata

SEQ ID NO: 2036 - DNA, 25 bp, Homo sapien
tccagtgtctttaagatagcaaaac

SEQ ID NO: 2037 - DNA, 25 bp, Homo sapien
tctcctttgagagtgaccactggtt

SEQ ID NO: 2038 - DNA, 25 bp, Homo sapien
gagagtgaccactggttcctagagc

SEQ ID NO: 2039 - DNA, 25 bp, Homo sapien
tgaccactggttcctagagcttttc

SEQ ID NO: 2040 - DNA, 25 bp, Homo sapien
cagacccacttctgggtgtgtggtg

SEQ ID NO: 2041 - DNA, 25 bp, Homo sapien
acttctgggtgtgtggtgcgacttt

SEQ ID NO: 2042 - DNA, 25 bp, Homo sapien
gtgcgactttgcaagggctgtgata

SEQ ID NO: 2043 - DNA, 25 bp, Homo sapien
gctgtgatagactcaccttgcactt

SEQ ID NO: 2044 - DNA, 25 bp, Homo sapien
tgatagactcaccttgcacttactg

SEQ ID NO: 2045 - DNA, 25 bp, Homo sapien
actcaccttgcacttactgtgttta

SEQ ID NO: 2046 - DNA, 25 bp, Homo sapien
caccttgcacttactgtgtttatga

SEQ ID NO: 2047 - DNA, 25 bp, Homo sapien
gcacttactgtgtttatgaatgtct

SEQ ID NO: 2048 - DNA, 25 bp, Homo sapien
actgtgtttatgaatgtctgttaga

SEQ ID NO: 2049 - DNA, 25 bp, Homo sapien
aatgccattacttaatcggtctccg

SEQ ID NO: 2050 - DNA, 25 bp, Homo sapien
ccattacttaatcggtctccgctgg

SEQ ID NO: 2051 - DNA, 25 bp, Homo sapien
ggaaaagcaacataactacttgatt

SEQ ID NO: 2052 - DNA, 25 bp, Homo sapien
aactacttgatttaccactaattcg

SEQ ID NO: 2053 - DNA, 25 bp, Homo sapien
gatttaccactaattcgtcataggc

SEQ ID NO: 2054 - DNA, 25 bp, Homo sapien
cactaattcgtcataggcacatatt

SEQ ID NO: 2055 - DNA, 25 bp, Homo sapien
attcgtcataggcacatatttttaa

SEQ ID NO: 2056 - DNA, 25 bp, Homo sapien
gtttttataatctcaacctctagag

SEQ ID NO: 2057 - DNA, 25 bp, Homo sapien
aacctctagaggaagccattgttgc

SEQ ID NO: 2058 - DNA, 25 bp, Homo sapien
gaggaagccattgttgcaaatatat

SEQ ID NO: 2059 - DNA, 25 bp, Homo sapien
ttttcatagatttttctctacacag

SEQ ID NO: 2060 - DNA, 25 bp, Homo sapien
gacagggagtatgtgagaaatttct

SEQ ID NO: 2061 - DNA, 25 bp, Homo sapien
tgctatgaatccaaaactgcttcaa

SEQ ID NO: 2062 - DNA, 25 bp, Homo sapien
cagtccactgctttattcaaccaaa

SEQ ID NO: 2063 - DNA, 25 bp, Homo sapien
aagtcagtgtccagctactcttagt

SEQ ID NO: 2064 - DNA, 25 bp, Homo sapien
atagctggttttctcattgctgtct

SEQ ID NO: 2065 - DNA, 25 bp, Homo sapien
tctcctatactacttccttctattt

SEQ ID NO: 2066 - DNA, 25 bp, Homo sapien
tattttttactcttctgtggaccaa

SEQ ID NO: 2067 - DNA, 25 bp, Homo sapien
attttttctgtgatttcgctccctt

SEQ ID NO: 2068 - DNA, 25 bp, Homo sapien
ttacttgaactctcctgttctgata

SEQ ID NO: 2069 - DNA, 25 bp, Homo sapien
gttctgatatcagtgtctccacagt

SEQ ID NO: 2070 - DNA, 25 bp, Homo sapien
tccacagttgttctctcattttctt

SEQ ID NO: 2071 - DNA, 25 bp, Homo sapien
ttcttctggatccatcattgtggtc

SEQ ID NO: 2072 - DNA, 25 bp, Homo sapien
gtcatagccgtctgctacatctata

SEQ ID NO: 2073 - DNA, 25 bp, Homo sapien
gcagatttttggaagcattgtaatt

SEQ ID NO: 2074 - DNA, 25 bp, Homo sapien
accaatgtttgacaactacccagag

SEQ ID NO: 2075 - DNA, 25 bp, Homo sapien
gagacataaaagaagacatactgaa

SEQ ID NO: 2076 - DNA, 25 bp, Homo sapien
gaaatatatagaaggtgacaaagct

SEQ ID NO: 2077 - DNA, 25 bp, Homo sapien
cttcaaccggtcctcatgcctgtaa

SEQ ID NO: 2078 - DNA, 25 bp, Homo sapien
ttcaaccggtcctcatgcctgtaat

SEQ ID NO: 2079 - DNA, 25 bp, Homo sapien
tttgagatcagactgaccaaaacgg

SEQ ID NO: 2080 - DNA, 25 bp, Homo sapien
tgagatcagactgaccaaaacggag

SEQ ID NO: 2081 - DNA, 25 bp, Homo sapien
gatcagactgaccaaaacggagaaa

SEQ ID NO: 2082 - DNA, 25 bp, Homo sapien
gaaaatataaaattggccatgcatg

SEQ ID NO: 2083 - DNA, 25 bp, Homo sapien
gttgtggtgagtcgagatcattgca

SEQ ID NO: 2084 - DNA, 25 bp, Homo sapien
gaggttcaacggaccttaaaacatg

SEQ ID NO: 2085 - DNA, 25 bp, Homo sapien
gttcaacggaccttaaaacatgaag

SEQ ID NO: 2086 - DNA, 25 bp, Homo sapien
tgaatgaatttagcaccaaaggtga

SEQ ID NO: 2087 - DNA, 25 bp, Homo sapien
tttagcaccaaaggtgaagagctga

SEQ ID NO: 2088 - DNA, 25 bp, Homo sapien
gtgaagagctgataaaagacatttt

SEQ ID NO: 2089 - DNA, 25 bp, Homo sapien
acatgaaggtcttttttctgtttgc

SEQ ID NO: 2090 - DNA, 25 bp, Homo sapien
atgaaggtcttttttctgtttgctg

SEQ ID NO: 2091 - DNA, 25 bp, Homo sapien
tgaaggtcttttttctgtttgctgt

SEQ ID NO: 2092 - DNA, 25 bp, Homo sapien
ttgctgttctcttttgtttggtcca

SEQ ID NO: 2093 - DNA, 25 bp, Homo sapien
gctgttctcttttgtttggtccaaa

SEQ ID NO: 2094 - DNA, 25 bp, Homo sapien
tgttctcttttgtttggtccaaaca

SEQ ID NO: 2095 - DNA, 25 bp, Homo sapien
gatcattgatttccttgtgtatgga

SEQ ID NO: 2096 - DNA, 25 bp, Homo sapien
atttccttgtgtatggataatccgg

SEQ ID NO: 2097 - DNA, 25 bp, Homo sapien
gataatccgggaacaggccaactaa

SEQ ID NO: 2098 - DNA, 25 bp, Homo sapien
gggaacaggccaactaaatatttga

SEQ ID NO: 2099 - DNA, 25 bp, Homo sapien
tttcaaatacagtgaattccctggg

SEQ ID NO: 2100 - DNA, 25 bp, Homo sapien
aatacagtgaattccctgggagtca

SEQ ID NO: 2101 - DNA, 25 bp, Homo sapien
aattccctgggagtcatcaaagaag

SEQ ID NO: 2102 - DNA, 25 bp, Homo sapien
gtcatcaaagaagaccggcatttta

SEQ ID NO: 2103 - DNA, 25 bp, Homo sapien
aagtgtatattctttgctcctgaaa

SEQ ID NO: 2104 - DNA, 25 bp, Homo sapien
gtatattctttgctcctgaaaatgt

SEQ ID NO: 2105 - DNA, 25 bp, Homo sapien
tctttgctcctgaaaatgttattaa

SEQ ID NO: 2106 - DNA, 25 bp, Homo sapien
atctggatgttcaccatggaaacgg

SEQ ID NO: 2107 - DNA, 25 bp, Homo sapien
aacggtacccagcaggccttttatg

SEQ ID NO: 2108 - DNA, 25 bp, Homo sapien
tgaccccagcatcctgtacatttca

SEQ ID NO: 2109 - DNA, 25 bp, Homo sapien
tacatttcactccatcgctatgatg

SEQ ID NO: 2110 - DNA, 25 bp, Homo sapien
ccctggcagtggagccccaaatgag

SEQ ID NO: 2111 - DNA, 25 bp, Homo sapien
ggagatgttgagtaccttgaagcat

SEQ ID NO: 2112 - DNA, 25 bp, Homo sapien
cttgaagcattcaggaccatcgtga

SEQ ID NO: 2113 - DNA, 25 bp, Homo sapien
gaccatcgtgaagcctgtggccaaa

SEQ ID NO: 2114 - DNA, 25 bp, Homo sapien
caaagagtttgatccagacatggtc

SEQ ID NO: 2115 - DNA, 25 bp, Homo sapien
gacatggtcttagtatctgctggat

SEQ ID NO: 2116 - DNA, 25 bp, Homo sapien
ttgatgcattggaaggccacacccc

SEQ ID NO: 2117 - DNA, 25 bp, Homo sapien
tccgcaagcatcatccctggatgtg

SEQ ID NO: 2118 - DNA, 25 bp, Homo sapien
tggatgtggatttcacaccccattc

SEQ ID NO: 2119 - DNA, 25 bp, Homo sapien
atacatcttgtacccagcgctaatt

SEQ ID NO: 2120 - DNA, 25 bp, Homo sapien
gcgctaattttgaatgccctcacta

SEQ ID NO: 2121 - DNA, 25 bp, Homo sapien
gccctcactattgatgcatttttaa

SEQ ID NO: 2122 - DNA, 25 bp, Homo sapien
ggagacttggtacccactgggacat

SEQ ID NO: 2123 - DNA, 25 bp, Homo sapien
gggacatttttctgatgatcattgc

SEQ ID NO: 2124 - DNA, 25 bp, Homo sapien
gatcattgctggcatgaagctgttg

SEQ ID NO: 2125 - DNA, 25 bp, Homo sapien
gaagctgttgcggacatcattctgc

SEQ ID NO: 2126 - DNA, 25 bp, Homo sapien
tctgcaacccggtttaccagtttat

SEQ ID NO: 2127 - DNA, 25 bp, Homo sapien
catggtgtccattttatttagcaag

SEQ ID NO: 2128 - DNA, 25 bp, Homo sapien
tggaacagtccggtgcttctgtaag

SEQ ID NO: 2129 - DNA, 25 bp, Homo sapien
gaacagtccggtgcttctgtaagag

SEQ ID NO: 2130 - DNA, 25 bp, Homo sapien
gtccggtgcttctgtaagaggcgtt

SEQ ID NO: 2131 - DNA, 25 bp, Homo sapien
cggtgcttctgtaagaggcgtttga

SEQ ID NO: 2132 - DNA, 25 bp, Homo sapien
tgcttctgtaagaggcgtttgaacc

SEQ ID NO: 2133 - DNA, 25 bp, Homo sapien
aagaggcgtttgaacctgggcaact

SEQ ID NO: 2134 - DNA, 25 bp, Homo sapien
gatggttaaagcattctaagtcacg

SEQ ID NO: 2135 - DNA, 25 bp, Homo sapien
aaagcattctaagtcacgggatcag

SEQ ID NO: 2136 - DNA, 25 bp, Homo sapien
acgggatcaggtaggaggtcagcac

SEQ ID NO: 2137 - DNA, 25 bp, Homo sapien
ggtcagcacaagataacgggtcata

SEQ ID NO: 2138 - DNA, 25 bp, Homo sapien
acgggtcataaagaacctgctgata

SEQ ID NO: 2139 - DNA, 25 bp, Homo sapien
tgatgccccagccacagttgggaga

SEQ ID NO: 2140 - DNA, 25 bp, Homo sapien
gggccagtcacaggtttgccaggga

SEQ ID NO: 2141 - DNA, 25 bp, Homo sapien
agggccgtaagacaactcagcatta

SEQ ID NO: 2142 - DNA, 25 bp, Homo sapien
tcagcattagcactgcccaagccag

SEQ ID NO: 2143 - DNA, 25 bp, Homo sapien
aagccagtctgctgctgtcatattc

SEQ ID NO: 2144 - DNA, 25 bp, Homo sapien
gctgctgtcatattccctgtgtggg

SEQ ID NO: 2145 - DNA, 25 bp, Homo sapien
taaggatgtacacgtcccagtccaa

SEQ ID NO: 2146 - DNA, 25 bp, Homo sapien
atgtacacgtcccagtccaagaacc

SEQ ID NO: 2147 - DNA, 25 bp, Homo sapien
tggccgtgccaccttatgtggcagc

SEQ ID NO: 2148 - DNA, 25 bp, Homo sapien
aggagggacggagcaggatcacact

SEQ ID NO: 2149 - DNA, 25 bp, Homo sapien
acactggatgctctctgtgggccca

SEQ ID NO: 2150 - DNA, 25 bp, Homo sapien
gaccatacaccgtgatccttattga

SEQ ID NO: 2151 - DNA, 25 bp, Homo sapien
ccatacaccgtgatccttattgaga

SEQ ID NO: 2152 - DNA, 25 bp, Homo sapien
gagagagccatgaaggacatccact

SEQ ID NO: 2153 - DNA, 25 bp, Homo sapien
gagagccatgaaggacatccactat

SEQ ID NO: 2154 - DNA, 25 bp, Homo sapien
agagccatgaaggacatccactatt

SEQ ID NO: 2155 - DNA, 25 bp, Homo sapien
aatgaagatagaacgtgctcacatg

SEQ ID NO: 2156 - DNA, 25 bp, Homo sapien
agatagaacgtgctcacatgaggct

SEQ ID NO: 2157 - DNA, 25 bp, Homo sapien
atagaacgtgctcacatgaggcttc

SEQ ID NO: 2158 - DNA, 25 bp, Homo sapien
aaagaaaagctcaagccactgatca

SEQ ID NO: 2159 - DNA, 25 bp, Homo sapien
agaaaagctcaagccactgatcaag

SEQ ID NO: 2160 - DNA, 25 bp, Homo sapien
aagattatggccaacagttagaaat

SEQ ID NO: 2161 - DNA, 25 bp, Homo sapien
ataacaggtttgcagagactggaga

SEQ ID NO: 2162 - DNA, 25 bp, Homo sapien
ttgttttattaattccagtgactaa

SEQ ID NO: 2163 - DNA, 25 bp, Homo sapien
gtgactaattctacttcatcaacat

SEQ ID NO: 2164 - DNA, 25 bp, Homo sapien
atcaccatgcatcaaaggtagggcc

SEQ ID NO: 2165 - DNA, 25 bp, Homo sapien
cccataccccactcatggtagtaaa

SEQ ID NO: 2166 - DNA, 25 bp, Homo sapien
tataaatgaaagttcccctggacaa

SEQ ID NO: 2167 - DNA, 25 bp, Homo sapien
aagttcccctggacaagttctcttg

SEQ ID NO: 2168 - DNA, 25 bp, Homo sapien
agatgtacctttgctactcattcac

SEQ ID NO: 2169 - DNA, 25 bp, Homo sapien
ttgctactcattcaccttctgtcat

SEQ ID NO: 2170 - DNA, 25 bp, Homo sapien
gtataatgatctagtcctgtacaga

SEQ ID NO: 2171 - DNA, 25 bp, Homo sapien
tggtggctaaagctaggaataactt

SEQ ID NO: 2172 - DNA, 25 bp, Homo sapien
catgtaagaattcccgggagctcca

SEQ ID NO: 2173 - DNA, 25 bp, Homo sapien
taaggtcccgaaggtggaacatgct

SEQ ID NO: 2174 - DNA, 25 bp, Homo sapien
ggaacatgcttcatggtcacacata

SEQ ID NO: 2175 - DNA, 25 bp, Homo sapien
atgcttcatggtcacacatacaggc

SEQ ID NO: 2176 - DNA, 25 bp, Homo sapien
aaacagcattatgtggacgcctcat

SEQ ID NO: 2177 - DNA, 25 bp, Homo sapien
gcattatgtggacgcctcatgtatt

SEQ ID NO: 2178 - DNA, 25 bp, Homo sapien
tgtggacgcctcatgtattttttat

SEQ ID NO: 2179 - DNA, 25 bp, Homo sapien
tattttccctcattgaaagatgcaa

SEQ ID NO: 2180 - DNA, 25 bp, Homo sapien
atgcaaaacagctctctattgtgta

SEQ ID NO: 2181 - DNA, 25 bp, Homo sapien
aacagctctctattgtgtacagaaa

SEQ ID NO: 2182 - DNA, 25 bp, Homo sapien
aataatgcaaaatacctggtagtaa

SEQ ID NO: 2183 - DNA, 25 bp, Homo sapien
ataatttttattccacaagcactgt

SEQ ID NO: 2184 - DNA, 25 bp, Homo sapien
tccacaagcactgttgggacactgt

SEQ ID NO: 2185 - DNA, 25 bp, Homo sapien
aagcactgttgggacactgtgctgg

SEQ ID NO: 2186 - DNA, 25 bp, Homo sapien
aaggctgaggtcttactttccagga

SEQ ID NO: 2187 - DNA, 25 bp, Homo sapien
actttccaggaattcatcatctaga

SEQ ID NO: 2188 - DNA, 25 bp, Homo sapien
tcatcatctagaacagtggtctcca

SEQ ID NO: 2189 - DNA, 25 bp, Homo sapien
aaaggtagtgagataacccacagga

SEQ ID NO: 2190 - DNA, 25 bp, Homo sapien
gataacccacaggagtgaagcagaa

SEQ ID NO: 2191 - DNA, 25 bp, Homo sapien
atactggtgcccctgtggaataatt

SEQ ID NO: 2192 - DNA, 25 bp, Homo sapien
aaaacttcaacattttgtgcaggct

SEQ ID NO: 2193 - DNA, 25 bp, Homo sapien
aaatgtgtgtgatagactgggcatg

SEQ ID NO: 2194 - DNA, 25 bp, Homo sapien
ttggatatagaggtctgggactcaa

SEQ ID NO: 2195 - DNA, 25 bp, Homo sapien
gggactcaagagagacatctcagct

SEQ ID NO: 2196 - DNA, 25 bp, Homo sapien
tagtcattagcaagtaagtggtggc

SEQ ID NO: 2197 - DNA, 25 bp, Homo sapien
aagtggtggctcaggctacaggttt

SEQ ID NO: 2198 - DNA, 25 bp, Homo sapien
tggctcaggctacaggtttagatga

SEQ ID NO: 2199 - DNA, 25 bp, Homo sapien
tactcagtagagtgacagtgaagca

SEQ ID NO: 2200 - DNA, 25 bp, Homo sapien
gcctcagggagctacaacatcaagt

SEQ ID NO: 2201 - DNA, 25 bp, Homo sapien
gagctacaacatcaagttacgagga

SEQ ID NO: 2202 - DNA, 25 bp, Homo sapien
actgatgtcagggatggagagatat

SEQ ID NO: 2203 - DNA, 25 bp, Homo sapien
ggaggagtaatcaacagtaacgaaa

SEQ ID NO: 2204 - DNA, 25 bp, Homo sapien
aatagacggctagggactgggcaca

SEQ ID NO: 2205 - DNA, 25 bp, Homo sapien
gtatttttggttcaaacctgcacta

SEQ ID NO: 2206 - DNA, 25 bp, Homo sapien
tggttcaaacctgcactatttaata

SEQ ID NO: 2207 - DNA, 25 bp, Homo sapien
acatgtggctattgaccactcggca

SEQ ID NO: 2208 - DNA, 25 bp, Homo sapien
tggctattgaccactcggcattatg

SEQ ID NO: 2209 - DNA, 25 bp, Homo sapien
ccactcggcattatggttagtctga

SEQ ID NO: 2210 - DNA, 25 bp, Homo sapien
atggttagtctgaattgcccactgc

SEQ ID NO: 2211 - DNA, 25 bp, Homo sapien
ttagtctgaattgcccactgctgga

SEQ ID NO: 2212 - DNA, 25 bp, Homo sapien
gaattgcccactgctggatgtgtaa

SEQ ID NO: 2213 - DNA, 25 bp, Homo sapien
gcccactgctggatgtgtaaaatgt

SEQ ID NO: 2214 - DNA, 25 bp, Homo sapien
gtacactggaatttaaagacagcgc

SEQ ID NO: 2215 - DNA, 25 bp, Homo sapien
aagacagcgcagaaaacatcgtgta

SEQ ID NO: 2216 - DNA, 25 bp, Homo sapien
gccgaggttgttataatgagccgag

SEQ ID NO: 2217 - DNA, 25 bp, Homo sapien
gttgttataatgagccgagatagtg

SEQ ID NO: 2218 - DNA, 25 bp, Homo sapien
gattcactgacagaagagaccagga

SEQ ID NO: 2219 - DNA, 25 bp, Homo sapien
gacttggaggcaggcagaaagacaa

SEQ ID NO: 2220 - DNA, 25 bp, Homo sapien
gaggcaggcagaaagacaaaggaca

SEQ ID NO: 2221 - DNA, 25 bp, Homo sapien
acaaaggacaaacagctgcagcgca

SEQ ID NO: 2222 - DNA, 25 bp, Homo sapien
agctgcagcgcaaaccctaaagaca

SEQ ID NO: 2223 - DNA, 25 bp, Homo sapien
gcgcaaaccctaaagacaggctgac

SEQ ID NO: 2224 - DNA, 25 bp, Homo sapien
acaggctgacagtaaccggtcggca

SEQ ID NO: 2225 - DNA, 25 bp, Homo sapien
gacagtaaccggtcggcagagactg

SEQ ID NO: 2226 - DNA, 25 bp, Homo sapien
atataggcaaaggagctgacaaaga

SEQ ID NO: 2227 - DNA, 25 bp, Homo sapien
taccccactcctttctgcaggagtt

SEQ ID NO: 2228 - DNA, 25 bp, Homo sapien
atcagggtaatgttggtggattcat

SEQ ID NO: 2229 - DNA, 25 bp, Homo sapien
gttggtggattcataaagctagata

SEQ ID NO: 2230 - DNA, 25 bp, Homo sapien
tatagcatgtcattcttctcccaca

SEQ ID NO: 2231 - DNA, 25 bp, Homo sapien
aattgcccctttgctaaagatccta

SEQ ID NO: 2232 - DNA, 25 bp, Homo sapien
aagatcctatatgtctccaatcctg

SEQ ID NO: 2233 - DNA, 25 bp, Homo sapien
ctatatgtctccaatcctgccaggt

SEQ ID NO: 2234 - DNA, 25 bp, Homo sapien
aatcctgccaggtgtagagtcagat

SEQ ID NO: 2235 - DNA, 25 bp, Homo sapien
aggtgtagagtcagatagttggctt

SEQ ID NO: 2236 - DNA, 25 bp, Homo sapien
tggcctttaattttgctgctagcta

SEQ ID NO: 2237 - DNA, 25 bp, Homo sapien
tctgaaattaattttcccctcccag

SEQ ID NO: 2238 - DNA, 25 bp, Homo sapien
gatctcttcttctctgagcaactta

SEQ ID NO: 2239 - DNA, 25 bp, Homo sapien
tctctgagcaacttattgggcttat

SEQ ID NO: 2240 - DNA, 25 bp, Homo sapien
ttgggcttattctcagtaatcatac

SEQ ID NO: 2241 - DNA, 25 bp, Homo sapien
gttttgcactcaattgttttcttgg

SEQ ID NO: 2242 - DNA, 25 bp, Homo sapien
tcttgcactcaattgttttctattt

SEQ ID NO: 2243 - DNA, 25 bp, Homo sapien
tccagttataagatatgctccctag

SEQ ID NO: 2244 - DNA, 25 bp, Homo sapien
ttataagatatgctccctagggaca

SEQ ID NO: 2245 - DNA, 25 bp, Homo sapien
tgctccctagggacataaatagtat

SEQ ID NO: 2246 - DNA, 25 bp, Homo sapien
gtatatgtcttttatggtgttacaa

SEQ ID NO: 2247 - DNA, 25 bp, Homo sapien
taagatgtgcctgtagtaaataatt

SEQ ID NO: 2248 - DNA, 25 bp, Homo sapien
aatcacattttatctcattatccag

SEQ ID NO: 2249 - DNA, 25 bp, Homo sapien
gaatgcttagtactgcaagactgtt

SEQ ID NO: 2250 - DNA, 25 bp, Homo sapien
tactgcaagactgttgaatacctgt

SEQ ID NO: 2251 - DNA, 25 bp, Homo sapien
atacctgttgaatattcctattgag

SEQ ID NO: 2252 - DNA, 25 bp, Homo sapien
actggagaaatgttgatccctggct

SEQ ID NO: 2253 - DNA, 25 bp, Homo sapien
tccctggctggaatgtcataccatt

SEQ ID NO: 2254 - DNA, 25 bp, Homo sapien
gaatgtcataccattgacccatttg

SEQ ID NO: 2255 - DNA, 25 bp, Homo sapien
gacccatttgaagagttaaagctgg

SEQ ID NO: 2256 - DNA, 25 bp, Homo sapien
ctggatttgactgctctattctacc

SEQ ID NO: 2257 - DNA, 25 bp, Homo sapien
tgactgctctattctaccaggaata

SEQ ID NO: 2258 - DNA, 25 bp, Homo sapien
gtaatcatttattgactcagcaatt

SEQ ID NO: 2259 - DNA, 25 bp, Homo sapien
tcagcaattcctcagataacaggtc

SEQ ID NO: 2260 - DNA, 25 bp, Homo sapien
attcaagatacagagccagacagga

SEQ ID NO: 2261 - DNA, 25 bp, Homo sapien
ggatggccatctttcttctgatagc

SEQ ID NO: 2262 - DNA, 25 bp, Homo sapien
ggccatctttcttctgatagcaata

SEQ ID NO: 2263 - DNA, 25 bp, Homo sapien
atagcaataagctggatgctgggat

SEQ ID NO: 2264 - DNA, 25 bp, Homo sapien
atgctgggatagaagcctgatacct

SEQ ID NO: 2265 - DNA, 25 bp, Homo sapien
ggatagaagcctgatacctcctcca

SEQ ID NO: 2266 - DNA, 25 bp, Homo sapien
tagtccttggcctctagtttactcg

SEQ ID NO: 2267 - DNA, 25 bp, Homo sapien
ctctagtttactcgcctgaggcaag

SEQ ID NO: 2268 - DNA, 25 bp, Homo sapien
tttactcgcctgaggcaagggtaga

SEQ ID NO: 2269 - DNA, 25 bp, Homo sapien
gatttagggaaagcaagtagtccgt

SEQ ID NO: 2270 - DNA, 25 bp, Homo sapien
aaaccaacatctggttggccgggca

SEQ ID NO: 2271 - DNA, 25 bp, Homo sapien
atgtattgagaaagagctaactgct

SEQ ID NO: 2272 - DNA, 25 bp, Homo sapien
agagctaactgcttgagtcagtata

SEQ ID NO: 2273 - DNA, 25 bp, Homo sapien
gcttgagtcagtataatggaggcag

SEQ ID NO: 2274 - DNA, 25 bp, Homo sapien
tggatttcaggctcttaaaggaata

SEQ ID NO: 2275 - DNA, 25 bp, Homo sapien
ttaattcttctaacgggatcgcagc

SEQ ID NO: 2276 - DNA, 25 bp, Homo sapien
ttctaacgggatcgcagccatcatt

SEQ ID NO: 2277 - DNA, 25 bp, Homo sapien
gggatcgcagccatcattgttattt

SEQ ID NO: 2278 - DNA, 25 bp, Homo sapien
attttggtgttactgctactcctgg

SEQ ID NO: 2279 - DNA, 25 bp, Homo sapien
tttgatgtggtggttttggcccctt

SEQ ID NO: 2280 - DNA, 25 bp, Homo sapien
gttttggcccctttgctgcaaagtg

SEQ ID NO: 2281 - DNA, 25 bp, Homo sapien
ggcccctttgctgcaaagtggttat

SEQ ID NO: 2282 - DNA, 25 bp, Homo sapien
ggcacagagcatggcctccagagga

SEQ ID NO: 2283 - DNA, 25 bp, Homo sapien
tccttctcctcttgtagccagaatt

SEQ ID NO: 2284 - DNA, 25 bp, Homo sapien
tccctgtccccaatagtgcttatgg

SEQ ID NO: 2285 - DNA, 25 bp, Homo sapien
tattcctctcccaagcttcgtggaa

SEQ ID NO: 2286 - DNA, 25 bp, Homo sapien
gtgaactgcggagcaacagccactc

SEQ ID NO: 2287 - DNA, 25 bp, Homo sapien
ccactccactgtggcggagggacag

SEQ ID NO: 2288 - DNA, 25 bp, Homo sapien
gagggacaggacaggccactaccta

SEQ ID NO: 2289 - DNA, 25 bp, Homo sapien
cccaagaagcgcctgattgtcagta

SEQ ID NO: 2290 - DNA, 25 bp, Homo sapien
aggtactcagtgcaccaactgccag

SEQ ID NO: 2291 - DNA, 25 bp, Homo sapien
accaccacgacactgtggcggagaa

SEQ ID NO: 2292 - DNA, 25 bp, Homo sapien
agcactactgtggtggctccgctca

SEQ ID NO: 2293 - DNA, 25 bp, Homo sapien
cgatcctgggctaccggtctgtggg

SEQ ID NO: 2294 - DNA, 25 bp, Homo sapien
gggaaatcctcattgacgattcaat

SEQ ID NO: 2295 - DNA, 25 bp, Homo sapien
gatgaatattctatctttcctcaga

SEQ ID NO: 2296 - DNA, 25 bp, Homo sapien
attctatctttcctcagacatactc

SEQ ID NO: 2297 - DNA, 25 bp, Homo sapien
ctttcctcagacatactccatagat

SEQ ID NO: 2298 - DNA, 25 bp, Homo sapien
ggctatattcttgtgtattctgtta

SEQ ID NO: 2299 - DNA, 25 bp, Homo sapien
gtgtattctgttacatcaatcaaaa

SEQ ID NO: 2300 - DNA, 25 bp, Homo sapien
gtgattaaagttatccatggcaaat

SEQ ID NO: 2301 - DNA, 25 bp, Homo sapien
ttgggaataagaaagacctgcatat

SEQ ID NO: 2302 - DNA, 25 bp, Homo sapien
agacctgcatatggaaagggtgatc

SEQ ID NO: 2303 - DNA, 25 bp, Homo sapien
gaagggaaagctttggcagaatctt

SEQ ID NO: 2304 - DNA, 25 bp, Homo sapien
aggagcctccaagagtttgcagaat

SEQ ID NO: 2305 - DNA, 25 bp, Homo sapien
gagtttgcagaatggccccctaggc

SEQ ID NO: 2306 - DNA, 25 bp, Homo sapien
gccccctaggcagtggaaggcagca

SEQ ID NO: 2307 - DNA, 25 bp, Homo sapien
gggcctcactatgaagaagctaagt

SEQ ID NO: 2308 - DNA, 25 bp, Homo sapien
gtaatggacgataggaatgtattct

SEQ ID NO: 2309 - DNA, 25 bp, Homo sapien
ggaatgtattctgtattctgctgaa

SEQ ID NO: 2310 - DNA, 25 bp, Homo sapien
gtggtggaacaggaatggaccccat

SEQ ID NO: 2311 - DNA, 25 bp, Homo sapien
gaatggaccccatgcagttggcctg

SEQ ID NO: 2312 - DNA, 25 bp, Homo sapien
tggaccccatgcagttggcctgcag

SEQ ID NO: 2313 - DNA, 25 bp, Homo sapien
tatgctcctctccattcaggagcct

SEQ ID NO: 2314 - DNA, 25 bp, Homo sapien
ttcaggagcctccaagagtttgcag

SEQ ID NO: 2315 - DNA, 25 bp, Homo sapien
ggtggcctctggatcctccgtggac

SEQ ID NO: 2316 - DNA, 25 bp, Homo sapien
ggaacacaccttcaggtagaccccg

SEQ ID NO: 2317 - DNA, 25 bp, Homo sapien
ggtagaccccgaagcctcaaggccg

SEQ ID NO: 2318 - DNA, 25 bp, Homo sapien
tggactcaggactgtcctgtcaact

SEQ ID NO: 2319 - DNA, 25 bp, Homo sapien
tgtcctgtcaactccagacaactga

SEQ ID NO: 2320 - DNA, 25 bp, Homo sapien
gtcctgtcaactccagacaactgaa

SEQ ID NO: 2321 - DNA, 25 bp, Homo sapien
caactgaataaacaggccgggtaca

SEQ ID NO: 2322 - DNA, 25 bp, Homo sapien
actgaataaacaggccgggtacagt

SEQ ID NO: 2323 - DNA, 25 bp, Homo sapien
gggtggaccacttgacgtccgtagt

SEQ ID NO: 2324 - DNA, 25 bp, Homo sapien
gtggaccacttgacgtccgtagttc

SEQ ID NO: 2325 - DNA, 25 bp, Homo sapien
accacttgacgtccgtagttcgaga

SEQ ID NO: 2326 - DNA, 25 bp, Homo sapien
tggcgcaggagtatgacaagcgaaa

SEQ ID NO: 2327 - DNA, 25 bp, Homo sapien
gacacacagtttaattaccatcgca

SEQ ID NO: 2328 - DNA, 25 bp, Homo sapien
cacagtttaattaccatcgcaagaa

SEQ ID NO: 2329 - DNA, 25 bp, Homo sapien
caagaaaaatattgcggctgaacgc

SEQ ID NO: 2330 - DNA, 25 bp, Homo sapien
gaaagaagaggctgaccggtaccag

SEQ ID NO: 2331 - DNA, 25 bp, Homo sapien
tgaccggtaccagcgcctgaaggat

SEQ ID NO: 2332 - DNA, 25 bp, Homo sapien
tagtacgggctcaggtacagctgca

SEQ ID NO: 2333 - DNA, 25 bp, Homo sapien
ggtacagctgcagctctttaagctt

SEQ ID NO: 2334 - DNA, 25 bp, Homo sapien
gctgcagctctttaagctttaccat

SEQ ID NO: 2335 - DNA, 25 bp, Homo sapien
gctctttaagctttaccataatgaa

SEQ ID NO: 2336 - DNA, 25 bp, Homo sapien
aaggaactggcctcaaagaacaagg

SEQ ID NO: 2337 - DNA, 25 bp, Homo sapien
gtggtagttacacaactgtataaat

SEQ ID NO: 2338 - DNA, 25 bp, Homo sapien
ttcaaagaactatacacctaaaggg

SEQ ID NO: 2339 - DNA, 25 bp, Homo sapien
tacacctaaagggaagacttctact

SEQ ID NO: 2340 - DNA, 25 bp, Homo sapien
gaagacttctactgtacgaagtata

SEQ ID NO: 2341 - DNA, 25 bp, Homo sapien
ttctactgtacgaagtatacctcat

SEQ ID NO: 2342 - DNA, 25 bp, Homo sapien
actgtacgaagtatacctcataaat

SEQ ID NO: 2343 - DNA, 25 bp, Homo sapien
agtatacctcataaataaccaacca

SEQ ID NO: 2344 - DNA, 25 bp, Homo sapien
tgaaaatattctgcatcagccaggc

SEQ ID NO: 2345 - DNA, 25 bp, Homo sapien
gcggaaggtgcagtgggcccagatt

SEQ ID NO: 2346 - DNA, 25 bp, Homo sapien
aaggtgcagtgggcccagattgcac

SEQ ID NO: 2347 - DNA, 25 bp, Homo sapien
aatattctgcatcagccaggcatgg

SEQ ID NO: 2348 - DNA, 25 bp, Homo sapien
cggcctccaagccagcatctttaat

SEQ ID NO: 2349 - DNA, 25 bp, Homo sapien
ggcctccaagccagcatctttaatc

SEQ ID NO: 2350 - DNA, 25 bp, Homo sapien
cctccaagccagcatctttaatctt

SEQ ID NO: 2351 - DNA, 25 bp, Homo sapien
ctccaagccagcatctttaatctta

SEQ ID NO: 2352 - DNA, 25 bp, Homo sapien
tccaagccagcatctttaatcttac

SEQ ID NO: 2353 - DNA, 25 bp, Homo sapien
caagccagcatctttaatcttacag

SEQ ID NO: 2354 - DNA, 25 bp, Homo sapien
aagccagcatctttaatcttacaga

SEQ ID NO: 2355 - DNA, 25 bp, Homo sapien
agccagcatctttaatcttacagat

SEQ ID NO: 2356 - DNA, 25 bp, Homo sapien
atctttaatcttacagatgcgtgcc

SEQ ID NO: 2357 - DNA, 25 bp, Homo sapien
tttaatcttacagatgcgtgcccct

SEQ ID NO: 2358 - DNA, 25 bp, Homo sapien
ttaatcttacagatgcgtgcccctg

SEQ ID NO: 2359 - DNA, 25 bp, Homo sapien
tattaatcccaggtactaaggaggt

SEQ ID NO: 2360 - DNA, 25 bp, Homo sapien
aggccagagaggctgacctacctgc

SEQ ID NO: 2361 - DNA, 25 bp, Homo sapien
aagaatccagaggacctctcccgga

SEQ ID NO: 2362 - DNA, 25 bp, Homo sapien
acctctcccggaggaggcacgagaa

SEQ ID NO: 2363 - DNA, 25 bp, Homo sapien
gagaagcccacgtggcagccaagaa

SEQ ID NO: 2364 - DNA, 25 bp, Homo sapien
tgggccccggaagcacaatgccagg

SEQ ID NO: 2365 - DNA, 25 bp, Homo sapien
acaccttcagtgagcacagggtctg

SEQ ID NO: 2366 - DNA, 25 bp, Homo sapien
cacagggtctgggtaggcttcggga

SEQ ID NO: 2367 - DNA, 25 bp, Homo sapien
ggaggccctgcctaattctgtaaag

SEQ ID NO: 2368 - DNA, 25 bp, Homo sapien
ggccctgcctaattctgtaaagact

SEQ ID NO: 2369 - DNA, 25 bp, Homo sapien
gactaggattagaaacatgacaaaa

SEQ ID NO: 2370 - DNA, 25 bp, Homo sapien
gggcttgggctatgactccaggacc

SEQ ID NO: 2371 - DNA, 25 bp, Homo sapien
ggaggctagaggctcatctctctac

SEQ ID NO: 2372 - DNA, 25 bp, Homo sapien
tttccgaagctctgttctctgaggg

SEQ ID NO: 2373 - DNA, 25 bp, Homo sapien
gagggcttctggaaatacccgcttt

SEQ ID NO: 2374 - DNA, 25 bp, Homo sapien
gaaatacccgctttaatcagagtta

SEQ ID NO: 2375 - DNA, 25 bp, Homo sapien
aagccggatttgaaggttgcgatga

SEQ ID NO: 2376 - DNA, 25 bp, Homo sapien
taacacccaacgctgtcaagaatgt

SEQ ID NO: 2377 - DNA, 25 bp, Homo sapien
tcaattggtacccattttttggagg

SEQ ID NO: 2378 - DNA, 25 bp, Homo sapien
ttggagggagtttgctagtatcatt

SEQ ID NO: 2379 - DNA, 25 bp, Homo sapien
aaatagatatgctttcagactcaac

SEQ ID NO: 2380 - DNA, 25 bp, Homo sapien
ttcagactcaacatttccacttcta

SEQ ID NO: 2381 - DNA, 25 bp, Homo sapien
gttacaggcctgagcagactcacaa

SEQ ID NO: 2382 - DNA, 25 bp, Homo sapien
gcagactcacaagacccgggcaggt

SEQ ID NO: 2383 - DNA, 25 bp, Homo sapien
aggtggtgccgtcctcctcttttca

SEQ ID NO: 2384 - DNA, 25 bp, Homo sapien
ttttcaagcctaacgcccagtgcag

SEQ ID NO: 2385 - DNA, 25 bp, Homo sapien
taacgcccagtgcagccctggtaga

SEQ ID NO: 2386 - DNA, 25 bp, Homo sapien
gccctggtagaaaccctctctggca

SEQ ID NO: 2387 - DNA, 25 bp, Homo sapien
agatgagtgtccaagaatgagaaga

SEQ ID NO: 2388 - DNA, 25 bp, Homo sapien
aaaaagtgctatgactggctgcctg

SEQ ID NO: 2389 - DNA, 25 bp, Homo sapien
gactggctgcctgcgatggctcacg

SEQ ID NO: 2390 - DNA, 25 bp, Homo sapien
aggagcctaaggtcgaagatcgctt

SEQ ID NO: 2391 - DNA, 25 bp, Homo sapien
gcctaaggtcgaagatcgcttgagt

SEQ ID NO: 2392 - DNA, 25 bp, Homo sapien
ggaaggactgaaaagtcttgtggac

SEQ ID NO: 2393 - DNA, 25 bp, Homo sapien
tttccctgatgttctcgtggctgct

SEQ ID NO: 2394 - DNA, 25 bp, Homo sapien
ctgatgttctcgtggctgctgttgg

SEQ ID NO: 2395 - DNA, 25 bp, Homo sapien
tgtgtatgtgtcttccccggaatcc

SEQ ID NO: 2396 - DNA, 25 bp, Homo sapien
tgtcccgtggtttcatcatatctct

SEQ ID NO: 2397 - DNA, 25 bp, Homo sapien
gtggtttcatcatatctctttgcat

SEQ ID NO: 2398 - DNA, 25 bp, Homo sapien
atatctctttgcataccccatgtct

SEQ ID NO: 2399 - DNA, 25 bp, Homo sapien
ggtttctgattgtggcaacgtttgc

SEQ ID NO: 2400 - DNA, 25 bp, Homo sapien
ttgtggcaacgtttgcaaccgttca

SEQ ID NO: 2401 - DNA, 25 bp, Homo sapien
acgtttgcaaccgttcacgattcaa

SEQ ID NO: 2402 - DNA, 25 bp, Homo sapien
accgttcacgattcaataaatattg

SEQ ID NO: 2403 - DNA, 25 bp, Homo sapien
gaagagggcactagagataaatgga

SEQ ID NO: 2404 - DNA, 25 bp, Homo sapien
ggacagttcaaagaattatcaccaa

SEQ ID NO: 2405 - DNA, 25 bp, Homo sapien
attatcaccaattacaatgccctcc

SEQ ID NO: 2406 - DNA, 25 bp, Homo sapien
accaattacaatgccctcctagaga

SEQ ID NO: 2407 - DNA, 25 bp, Homo sapien
attacaatgccctcctagagaaaca

SEQ ID NO: 2408 - DNA, 25 bp, Homo sapien
aacagaacattcttgtccagacgtg

SEQ ID NO: 2409 - DNA, 25 bp, Homo sapien
acattcttgtccagacgtggtggct

SEQ ID NO: 2410 - DNA, 25 bp, Homo sapien
ggcagatgtgatggcccacgcctgt

SEQ ID NO: 2411 - DNA, 25 bp, Homo sapien
gaaatagaacattctggcactccag

SEQ ID NO: 2412 - DNA, 25 bp, Homo sapien
attctggcactccagaagcctccta

SEQ ID NO: 2413 - DNA, 25 bp, Homo sapien
ctttccccaagaagtaatgtgttga

SEQ ID NO: 2414 - DNA, 25 bp, Homo sapien
gccacgatcacaccaatgtgacaca

SEQ ID NO: 2415 - DNA, 25 bp, Homo sapien
acgatcacaccaatgtgacacagtg

SEQ ID NO: 2416 - DNA, 25 bp, Homo sapien
gatcacaccaatgtgacacagtgag

SEQ ID NO: 2417 - DNA, 25 bp, Homo sapien
tcacaccaatgtgacacagtgagac

SEQ ID NO: 2418 - DNA, 25 bp, Homo sapien
gaggtcaggaactcgagacgagacc

SEQ ID NO: 2419 - DNA, 25 bp, Homo sapien
gaactcgagacgagaccaggctggg

SEQ ID NO: 2420 - DNA, 25 bp, Homo sapien
actccactccagtccaggtgaaaga

SEQ ID NO: 2421 - DNA, 25 bp, Homo sapien
ctccactccagtccaggtgaaagag

SEQ ID NO: 2422 - DNA, 25 bp, Homo sapien
tccactccagtccaggtgaaagagc

SEQ ID NO: 2423 - DNA, 25 bp, Homo sapien
tccagtccaggtgaaagagccagat

SEQ ID NO: 2424 - DNA, 25 bp, Homo sapien
cagtccaggtgaaagagccagatcc

SEQ ID NO: 2425 - DNA, 25 bp, Homo sapien
tgacagtcctcccactaaggaattc

SEQ ID NO: 2426 - DNA, 25 bp, Homo sapien
gtcctcccactaaggaattcctggt

SEQ ID NO: 2427 - DNA, 25 bp, Homo sapien
actaaggaattcctggtgactggaa

SEQ ID NO: 2428 - DNA, 25 bp, Homo sapien
gactcctgtggagcctggcaggcaa

SEQ ID NO: 2429 - DNA, 25 bp, Homo sapien
tggcaggcaactccatgatctgacc

SEQ ID NO: 2430 - DNA, 25 bp, Homo sapien
tagtgtgccagccagcgctcagcct

SEQ ID NO: 2431 - DNA, 25 bp, Homo sapien
gtgacctcctggaaggctggagcac

SEQ ID NO: 2432 - DNA, 25 bp, Homo sapien
tggagcacaactgcctctcaataaa

SEQ ID NO: 2433 - DNA, 25 bp, Homo sapien
ggcaccccccgaatggacaatcttt

SEQ ID NO: 2434 - DNA, 25 bp, Homo sapien
gcaggcctagtttgactctgacagt

SEQ ID NO: 2435 - DNA, 25 bp, Homo sapien
gcctagtttgactctgacagtcctc

SEQ ID NO: 2436 - DNA, 25 bp, Homo sapien
taatcttatgggaccgcatcctata

SEQ ID NO: 2437 - DNA, 25 bp, Homo sapien
gggaccgcatcctatatgcagtttg

SEQ ID NO: 2438 - DNA, 25 bp, Homo sapien
ctatatgcagtttgtcattgaccaa

SEQ ID NO: 2439 - DNA, 25 bp, Homo sapien
gcatgactatatttgcaaaggacta

SEQ ID NO: 2440 - DNA, 25 bp, Homo sapien
tatttgcaaaggactagtatctaga

SEQ ID NO: 2441 - DNA, 25 bp, Homo sapien
gatacaaagcaacatttcactggag

SEQ ID NO: 2442 - DNA, 25 bp, Homo sapien
aagatgtttgataccattagggaaa

SEQ ID NO: 2443 - DNA, 25 bp, Homo sapien
gataccattagggaaacgcttcttt

SEQ ID NO: 2444 - DNA, 25 bp, Homo sapien
gaaacgcttctttaaaccaggagat

SEQ ID NO: 2445 - DNA, 25 bp, Homo sapien
aaccaggagatatcaccacgtgtta

SEQ ID NO: 2446 - DNA, 25 bp, Homo sapien
tatcaccacgtgttagaatcaacaa

SEQ ID NO: 2447 - DNA, 25 bp, Homo sapien
ggatcacaggtataattcaagcttt

SEQ ID NO: 2448 - DNA, 25 bp, Homo sapien
aattcaagcttttcatgtagtcatg

SEQ ID NO: 2449 - DNA, 25 bp, Homo sapien
catgtagatcactagactccttggt

SEQ ID NO: 2450 - DNA, 25 bp, Homo sapien
agactccttggtgtactgacgtagc

SEQ ID NO: 2451 - DNA, 25 bp, Homo sapien
tattctgaagagttgtaacctttta

SEQ ID NO: 2452 - DNA, 25 bp, Homo sapien
aatactaacagtgacatggttttgt

SEQ ID NO: 2453 - DNA, 25 bp, Homo sapien
ggtttagcaatatttagcccattat

SEQ ID NO: 2454 - DNA, 25 bp, Homo sapien
aattgttgtgcatgagtgttactac

SEQ ID NO: 2455 - DNA, 25 bp, Homo sapien
gcatgagtgttactacttttggaat

SEQ ID NO: 2456 - DNA, 25 bp, Homo sapien
aaacttctttctcttgattcacagc

SEQ ID NO: 2457 - DNA, 25 bp, Homo sapien
ttctcttgattcacagccgaaggag

SEQ ID NO: 2458 - DNA, 25 bp, Homo sapien
gccttccctctggaattatgagaaa

SEQ ID NO: 2459 - DNA, 25 bp, Homo sapien
gtctcaggaacctttagaatccatt

SEQ ID NO: 2460 - DNA, 25 bp, Homo sapien
gaatccattgtccaacactgctaga

SEQ ID NO: 2461 - DNA, 25 bp, Homo sapien
ggagaattcctatagttcttaggta

SEQ ID NO: 2462 - DNA, 25 bp, Homo sapien
agtgcaagacatggcacagggatcc

SEQ ID NO: 2463 - DNA, 25 bp, Homo sapien
acagggatccctatccacataaagg

SEQ ID NO: 2464 - DNA, 25 bp, Homo sapien
gaatctggatgctgcacacctcaat

SEQ ID NO: 2465 - DNA, 25 bp, Homo sapien
gatgctgcacacctcaattctgaga

SEQ ID NO: 2466 - DNA, 25 bp, Homo sapien
aattctgagaaatccctgactgaac

SEQ ID NO: 2467 - DNA, 25 bp, Homo sapien
tcgtcctttagttttctagagcagc

SEQ ID NO: 2468 - DNA, 25 bp, Homo sapien
gaggcagaagattacagtaagccaa

SEQ ID NO: 2469 - DNA, 25 bp, Homo sapien
gggcaaatagctaatcaaactgtca

SEQ ID NO: 2470 - DNA, 25 bp, Homo sapien
ctgtcaatagaaatcatggccactt

SEQ ID NO: 2471 - DNA, 25 bp, Homo sapien
gacaatcaagatttctgaaaacgat

SEQ ID NO: 2472 - DNA, 25 bp, Homo sapien
tgaaaacgatgttgttttcagcaga

SEQ ID NO: 2473 - DNA, 25 bp, Homo sapien
ttcagcagatggtgctgagacatct

SEQ ID NO: 2474 - DNA, 25 bp, Homo sapien
tatccacatgccaaagaacgaggtt

SEQ ID NO: 2475 - DNA, 25 bp, Homo sapien
caaagaacgaggttgagcccctctt

SEQ ID NO: 2476 - DNA, 25 bp, Homo sapien
agcccctcttttacaccatgtagat

SEQ ID NO: 2477 - DNA, 25 bp, Homo sapien
acaccatgtagattgattacctaaa

SEQ ID NO: 2478 - DNA, 25 bp, Homo sapien
tatattttcaggactttggtcgggc

SEQ ID NO: 2479 - DNA, 25 bp, Homo sapien
attttcaggactttggtcgggcgcg

SEQ ID NO: 2480 - DNA, 25 bp, Homo sapien
attcaggttccggtgccatccgcag

SEQ ID NO: 2481 - DNA, 25 bp, Homo sapien
aggttccggtgccatccgcagtaaa

SEQ ID NO: 2482 - DNA, 25 bp, Homo sapien
ttccggtgccatccgcagtaaattc

SEQ ID NO: 2483 - DNA, 25 bp, Homo sapien
ggtgccatccgcagtaaattccctt

SEQ ID NO: 2484 - DNA, 25 bp, Homo sapien
tccgcagtaaattcccttccttttg

SEQ ID NO: 2485 - DNA, 25 bp, Homo sapien
ttttgctccaaattcctcctctgcg

SEQ ID NO: 2486 - DNA, 25 bp, Homo sapien
tctgcgtccaggagagggacccccg

SEQ ID NO: 2487 - DNA, 25 bp, Homo sapien
ggtcgggccgcgacgagggaagctc

SEQ ID NO: 2488 - DNA, 25 bp, Homo sapien
cgacgagggaagctcgcctgggcaa

SEQ ID NO: 2489 - DNA, 25 bp, Homo sapien
ggaagctcgcctgggcaagtgccgc

SEQ ID NO: 2490 - DNA, 25 bp, Homo sapien
aggggctggagctttccctctgatc

SEQ ID NO: 2491 - DNA, 25 bp, Homo sapien
tacccggccctattcctctgaaaag

SEQ ID NO: 2492 - DNA, 25 bp, Homo sapien
gaaaagcttagtaaacagcagttct

SEQ ID NO: 2493 - DNA, 25 bp, Homo sapien
cagcagttctttataccagggaaga

SEQ ID NO: 2494 - DNA, 25 bp, Homo sapien
cagttctttataccagggaagagga

SEQ ID NO: 2495 - DNA, 25 bp, Homo sapien
gatgtgatagtttattcagtgaaga

SEQ ID NO: 2496 - DNA, 25 bp, Homo sapien
agtacagaaatgagttagggcccct

SEQ ID NO: 2497 - DNA, 25 bp, Homo sapien
agaaatgagttagggcccctgctct

SEQ ID NO: 2498 - DNA, 25 bp, Homo sapien
gctctctaagaattacagaccttac

SEQ ID NO: 2499 - DNA, 25 bp, Homo sapien
gaccttacaaggtaggcctgggccg

SEQ ID NO: 2500 - DNA, 25 bp, Homo sapien
tggtggtggcgcctggattcccagc

SEQ ID NO: 2501 - DNA, 25 bp, Homo sapien
aatcgctggacctgggaaggcggag

SEQ ID NO: 2502 - DNA, 25 bp, Homo sapien
gagccaccatgactagcctaaaaaa

SEQ ID NO: 2503 - DNA, 25 bp, Homo sapien
agccaccatgactagcctaaaaaat

SEQ ID NO: 2504 - DNA, 25 bp, Homo sapien
gccaccatgactagcctaaaaaata

SEQ ID NO: 2505 - DNA, 25 bp, Homo sapien
ccaccatgactagcctaaaaaataa

SEQ ID NO: 2506 - DNA, 25 bp, Homo sapien
tgactagcctaaaaaataataatgt

SEQ ID NO: 2507 - DNA, 25 bp, Homo sapien
aatgtatcaaacagccttttatgac

SEQ ID NO: 2508 - DNA, 25 bp, Homo sapien
atgtatcaaacagccttttatgact

SEQ ID NO: 2509 - DNA, 25 bp, Homo sapien
gccttttatgactttctagtaatgg

SEQ ID NO: 2510 - DNA, 25 bp, Homo sapien
ccttttatgactttctagtaatggt

SEQ ID NO: 2511 - DNA, 25 bp, Homo sapien
tgactttctagtaatggtttatctg

SEQ ID NO: 2512 - DNA, 25 bp, Homo sapien
gactttctagtaatggtttatctga

SEQ ID NO: 2513 - DNA, 25 bp, Homo sapien
atggtagagtccaccactcttactg

SEQ ID NO: 2514 - DNA, 25 bp, Homo sapien
gagtccaccactcttactggaaaga

SEQ ID NO: 2515 - DNA, 25 bp, Homo sapien
gagcttgagatttatcacctgctaa

SEQ ID NO: 2516 - DNA, 25 bp, Homo sapien
cacctgctaatgtgaggtcattttc

SEQ ID NO: 2517 - DNA, 25 bp, Homo sapien
atgtggttgcccttagacctattcc

SEQ ID NO: 2518 - DNA, 25 bp, Homo sapien
gacctattccaaatcccaactggta

SEQ ID NO: 2519 - DNA, 25 bp, Homo sapien
ttctaacctgttctaacctctaagc

SEQ ID NO: 2520 - DNA, 25 bp, Homo sapien
cctgttctaacctctaagcattttc

SEQ ID NO: 2521 - DNA, 25 bp, Homo sapien
tggatgaacatttgtggcttttctt

SEQ ID NO: 2522 - DNA, 25 bp, Homo sapien
cttaaagaattacgtctggtggcac

SEQ ID NO: 2523 - DNA, 25 bp, Homo sapien
acgtctggtggcacgttggctcatg

SEQ ID NO: 2524 - DNA, 25 bp, Homo sapien
ggcctcagtaaaagtttcttgcaag

SEQ ID NO: 2525 - DNA, 25 bp, Homo sapien
ctcagtaaaagtttcttgcaaggca

SEQ ID NO: 2526 - DNA, 25 bp, Homo sapien
agtaaaagtttcttgcaaggcatct

SEQ ID NO: 2527 - DNA, 25 bp, Homo sapien
gtaaaagtttcttgcaaggcatctg

SEQ ID NO: 2528 - DNA, 25 bp, Homo sapien
taaaagtttcttgcaaggcatctgg

SEQ ID NO: 2529 - DNA, 25 bp, Homo sapien
aaaagtttcttgcaaggcatctgga

SEQ ID NO: 2530 - DNA, 25 bp, Homo sapien
atctggatacaccttagtaactact

SEQ ID NO: 2531 - DNA, 25 bp, Homo sapien
ctgagtggatgggagtaatcaatcc

SEQ ID NO: 2532 - DNA, 25 bp, Homo sapien
gtggatgggagtaatcaatcccagt

SEQ ID NO: 2533 - DNA, 25 bp, Homo sapien
gatgggagtaatcaatcccagtggt

SEQ ID NO: 2534 - DNA, 25 bp, Homo sapien
tgggagtaatcaatcccagtggtgg

SEQ ID NO: 2535 - DNA, 25 bp, Homo sapien
ggcagatagggctagactaggcata

SEQ ID NO: 2536 - DNA, 25 bp, Homo sapien
ctagactaggcatagtgtagccaca

SEQ ID NO: 2537 - DNA, 25 bp, Homo sapien
aagggctttcagtcagtgataagga

SEQ ID NO: 2538 - DNA, 25 bp, Homo sapien
gtcagtgataaggatttgggtcttt

SEQ ID NO: 2539 - DNA, 25 bp, Homo sapien
ggagaatccatgttacatattttaa

SEQ ID NO: 2540 - DNA, 25 bp, Homo sapien
gcaacgagacaggaatggtgaaact

SEQ ID NO: 2541 - DNA, 25 bp, Homo sapien
ggtgaaactctgttagtctacaatg

SEQ ID NO: 2542 - DNA, 25 bp, Homo sapien
ttagtctacaatgtgcaaggtggca

SEQ ID NO: 2543 - DNA, 25 bp, Homo sapien
gcagaagtgcatgccaaaagtggac

SEQ ID NO: 2544 - DNA, 25 bp, Homo sapien
caaaagtggacataggcaggccagg

SEQ ID NO: 2545 - DNA, 25 bp, Homo sapien
aaaaaagtggacataggcattctag

SEQ ID NO: 2546 - DNA, 25 bp, Homo sapien
aaggatcctccccacacgcagggtg

SEQ ID NO: 2547 - DNA, 25 bp, Homo sapien
cccacacgcagggtgagtgtgcact

SEQ ID NO: 2548 - DNA, 25 bp, Homo sapien
tgagtgtgcactgctgtcccagggc

SEQ ID NO: 2549 - DNA, 25 bp, Homo sapien
agggccctccctggttatgctgggt

SEQ ID NO: 2550 - DNA, 25 bp, Homo sapien
tatgctgggtgtggctctgtcagcc

SEQ ID NO: 2551 - DNA, 25 bp, Homo sapien
gaaagaactggctcttctctgcagc

SEQ ID NO: 2552 - DNA, 25 bp, Homo sapien
gcatcaactcagttctagagaaaag

SEQ ID NO: 2553 - DNA, 25 bp, Homo sapien
gagaaaaggcttgatatttatgtaa

SEQ ID NO: 2554 - DNA, 25 bp, Homo sapien
gatgttcatctcatattgaaaagca

SEQ ID NO: 2555 - DNA, 25 bp, Homo sapien
catattgaaaagcagttactggctg

SEQ ID NO: 2556 - DNA, 25 bp, Homo sapien
agatcactcgaggttaggatttcca

SEQ ID NO: 2557 - DNA, 25 bp, Homo sapien
ctgtcttctgggagtgacctttatt

SEQ ID NO: 2558 - DNA, 25 bp, Homo sapien
gtgacctttattagtccacttcttg

SEQ ID NO: 2559 - DNA, 25 bp, Homo sapien
ccacttcttggagctagacgtccta

SEQ ID NO: 2560 - DNA, 25 bp, Homo sapien
acttcttggagctagacgtcctata

SEQ ID NO: 2561 - DNA, 25 bp, Homo sapien
ttcttggagctagacgtcctatact

SEQ ID NO: 2562 - DNA, 25 bp, Homo sapien
tcttggagctagacgtcctatactt

SEQ ID NO: 2563 - DNA, 25 bp, Homo sapien
gctagacgtcctatacttagtcact

SEQ ID NO: 2564 - DNA, 25 bp, Homo sapien
tagacgtcctatacttagtcactgg

SEQ ID NO: 2565 - DNA, 25 bp, Homo sapien
agacgtcctatacttagtcactggg

SEQ ID NO: 2566 - DNA, 25 bp, Homo sapien
ctgaggtgacaatgtgtgataaaaa

SEQ ID NO: 2567 - DNA, 25 bp, Homo sapien
aaactagagctagtgggccaggcgc

SEQ ID NO: 2568 - DNA, 25 bp, Homo sapien
tgatgctgagcatccgggtccctgg

SEQ ID NO: 2569 - DNA, 25 bp, Homo sapien
cctgaggcagacagaagtttggaca

SEQ ID NO: 2570 - DNA, 25 bp, Homo sapien
ttggacaactcaggacagggagctt

SEQ ID NO: 2571 - DNA, 25 bp, Homo sapien
agggcagcccctacatgtcggagtg

SEQ ID NO: 2572 - DNA, 25 bp, Homo sapien
tacatgtcggagtggtccctacctg

SEQ ID NO: 2573 - DNA, 25 bp, Homo sapien
gtggtccctacctgtgttgactcaa

SEQ ID NO: 2574 - DNA, 25 bp, Homo sapien
tgttgactcaactcttccttcaagg

SEQ ID NO: 2575 - DNA, 25 bp, Homo sapien
ttccttcaaggcaagagccgctaag

SEQ ID NO: 2576 - DNA, 25 bp, Homo sapien
gagccgctaaggacagtcaggacat

SEQ ID NO: 2577 - DNA, 25 bp, Homo sapien
aaggacagtcaggacatcctaccgc

SEQ ID NO: 2578 - DNA, 25 bp, Homo sapien
taccgcccaacgctgttgagctcgg

SEQ ID NO: 2579 - DNA, 25 bp, Homo sapien
accaggttccttccatgacaggtgg

SEQ ID NO: 2580 - DNA, 25 bp, Homo sapien
gacacaaagcctaactatatcacag

SEQ ID NO: 2581 - DNA, 25 bp, Homo sapien
atatcacagagctagggttttaacc

SEQ ID NO: 2582 - DNA, 25 bp, Homo sapien
acagagctagggttttaacccatgt

SEQ ID NO: 2583 - DNA, 25 bp, Homo sapien
acccatgtttgtttgattgctgtgt

SEQ ID NO: 2584 - DNA, 25 bp, Homo sapien
gtttgattgctgtgtctatattctt

SEQ ID NO: 2585 - DNA, 25 bp, Homo sapien
tctatattcttcttctctaccaata

SEQ ID NO: 2586 - DNA, 25 bp, Homo sapien
cttcttctctaccaatatcattacc

SEQ ID NO: 2587 - DNA, 25 bp, Homo sapien
atatcattaccaaacgttattactt

SEQ ID NO: 2588 - DNA, 25 bp, Homo sapien
acgttattactttattcttctctat

SEQ ID NO: 2589 - DNA, 25 bp, Homo sapien
aaatgggagttcagtaatggcagtg

SEQ ID NO: 2590 - DNA, 25 bp, Homo sapien
gaaattacaaccttattatatgcat

SEQ ID NO: 2591 - DNA, 25 bp, Homo sapien
taattagttcttcataggtctgcag

SEQ ID NO: 2592 - DNA, 25 bp, Homo sapien
gttcttcataggtctgcagattata

SEQ ID NO: 2593 - DNA, 25 bp, Homo sapien
attatattgtgttgtagagggtcca

SEQ ID NO: 2594 - DNA, 25 bp, Homo sapien
gtagagggtccaatgttgcaaaatg

SEQ ID NO: 2595 - DNA, 25 bp, Homo sapien
aaaggttaggtgcattttatcattt

SEQ ID NO: 2596 - DNA, 25 bp, Homo sapien
gtgcattttatcattttaagggcca

SEQ ID NO: 2597 - DNA, 25 bp, Homo sapien
taagggccatgatgagataaaacat

SEQ ID NO: 2598 - DNA, 25 bp, Homo sapien
atggtaagctgttgtgctggctctt

SEQ ID NO: 2599 - DNA, 25 bp, Homo sapien
ttatgttgatcattggcagttacca

SEQ ID NO: 2600 - DNA, 25 bp, Homo sapien
ggcagttaccaagctgactatctga

SEQ ID NO: 2601 - DNA, 25 bp, Homo sapien
gcttctggatagtgggaacagcagc

SEQ ID NO: 2602 - DNA, 25 bp, Homo sapien
ggaacagcagctaccaaggtgtaaa

SEQ ID NO: 2603 - DNA, 25 bp, Homo sapien
tctgtcccctcaaacttggcttctt

SEQ ID NO: 2604 - DNA, 25 bp, Homo sapien
gcatagacctcagtattctaaacta

SEQ ID NO: 2605 - DNA, 25 bp, Homo sapien
aatgggactttagttctgtgcctct

SEQ ID NO: 2606 - DNA, 25 bp, Homo sapien
ttagttctgtgcctctgggcagaac

SEQ ID NO: 2607 - DNA, 25 bp, Homo sapien
gggcagaactgccactgggttgggt

SEQ ID NO: 2608 - DNA, 25 bp, Homo sapien
gggtcagaatgtgtagttccaggct

SEQ ID NO: 2609 - DNA, 25 bp, Homo sapien
gaatgtgtagttccaggctgcgtct

SEQ ID NO: 2610 - DNA, 25 bp, Homo sapien
aaggccggcccaagctggcctagca

SEQ ID NO: 2611 - DNA, 25 bp, Homo sapien
gaggctgaggccacttaggccagaa

SEQ ID NO: 2612 - DNA, 25 bp, Homo sapien
aggaggctgctcatataattaatgc

SEQ ID NO: 2613 - DNA, 25 bp, Homo sapien
tgccatgcaaaaaaggatccacctg

SEQ ID NO: 2614 - DNA, 25 bp, Homo sapien
aggatccacctgcagactctgaggg

SEQ ID NO: 2615 - DNA, 25 bp, Homo sapien
ctgagggcactgtcagaagtacaga

SEQ ID NO: 2616 - DNA, 25 bp, Homo sapien
gagatctcggaactttcagcagctg

SEQ ID NO: 2617 - DNA, 25 bp, Homo sapien
gcagctgagtgttgatgtactccat

SEQ ID NO: 2618 - DNA, 25 bp, Homo sapien
gaggaatctgatgaaccaactttag

SEQ ID NO: 2619 - DNA, 25 bp, Homo sapien
aactttagagaacctgcctgagtct

SEQ ID NO: 2620 - DNA, 25 bp, Homo sapien
tgagtctcagcctattccttccatg

SEQ ID NO: 2621 - DNA, 25 bp, Homo sapien
atggacctccacgaacttgaatcaa

SEQ ID NO: 2622 - DNA, 25 bp, Homo sapien
aggatgccacatctgaccttggata

SEQ ID NO: 2623 - DNA, 25 bp, Homo sapien
aaccaagaagttgacctctgagctg

SEQ ID NO: 2624 - DNA, 25 bp, Homo sapien
gaagttgacctctgagctgtcaggt

SEQ ID NO: 2625 - DNA, 25 bp, Homo sapien
tgagctgtcaggtgaccactgtgtg

SEQ ID NO: 2626 - DNA, 25 bp, Homo sapien
tgtcagtagacggtcttctccatga

SEQ ID NO: 2627 - DNA, 25 bp, Homo sapien
gacggtcttctccatgaagcgagag

SEQ ID NO: 2628 - DNA, 25 bp, Homo sapien
actggaatggccaagtgggactgct

SEQ ID NO: 2629 - DNA, 25 bp, Homo sapien
gcttcagctgaccaggttcttttaa

SEQ ID NO: 2630 - DNA, 25 bp, Homo sapien
tttaaaccgtagtcatgctttccca

SEQ ID NO: 2631 - DNA, 25 bp, Homo sapien
atgctttcccactaactcttaaatc

SEQ ID NO: 2632 - DNA, 25 bp, Homo sapien
aaatccttatgcttagaaaattgag

SEQ ID NO: 2633 - DNA, 25 bp, Homo sapien
aaaattgaggataaggctgggcaca

SEQ ID NO: 2634 - DNA, 25 bp, Homo sapien
tttggaaatagggtgtcctgcacag

SEQ ID NO: 2635 - DNA, 25 bp, Homo sapien
ctgcccatgaagctgtggtttttca

SEQ ID NO: 2636 - DNA, 25 bp, Homo sapien
ttttcagtcatggtttggaggctca

SEQ ID NO: 2637 - DNA, 25 bp, Homo sapien
tttggaggctcaatgtgtagtcaga

SEQ ID NO: 2638 - DNA, 25 bp, Homo sapien
gagaaaagagtcttggcagacactt

SEQ ID NO: 2639 - DNA, 25 bp, Homo sapien
tggcagacacttaactgagaagctg

SEQ ID NO: 2640 - DNA, 25 bp, Homo sapien
agctgagagtgtacaagcctcctaa

SEQ ID NO: 2641 - DNA, 25 bp, Homo sapien
agcctcctaaacatacaccagattg

SEQ ID NO: 2642 - DNA, 25 bp, Homo sapien
agactctagttaaccacggcaagcc

SEQ ID NO: 2643 - DNA, 25 bp, Homo sapien
taatccttaggttatttttctgtgc

SEQ ID NO: 2644 - DNA, 25 bp, Homo sapien
atttttctgtgcttagaactccccg

SEQ ID NO: 2645 - DNA, 25 bp, Homo sapien
gaagagcactaacagtgactgtttg

SEQ ID NO: 2646 - DNA, 25 bp, Homo sapien
aacagtgactgtttgaatataataa

SEQ ID NO: 2647 - DNA, 25 bp, Homo sapien
agcagagtgactaaaggcataattg

SEQ ID NO: 2648 - DNA, 25 bp, Homo sapien
ttagaacatagagtggcatggccgt

SEQ ID NO: 2649 - DNA, 25 bp, Homo sapien
agaacatagagtggcatggccgtgc

SEQ ID NO: 2650 - DNA, 25 bp, Homo sapien
catagagtggcatggccgtgctgga

SEQ ID NO: 2651 - DNA, 25 bp, Homo sapien
cgtgctggaatgacaaataactggc

SEQ ID NO: 2652 - DNA, 25 bp, Homo sapien
gaatgacaaataactggcgtgcttt

SEQ ID NO: 2653 - DNA, 25 bp, Homo sapien
tgacaaataactggcgtgctttttt

SEQ ID NO: 2654 - DNA, 25 bp, Homo sapien
atgttgcacatttttgcatgtgttc

SEQ ID NO: 2655 - DNA, 25 bp, Homo sapien
gcacatttttgcatgtgttctgata

SEQ ID NO: 2656 - DNA, 25 bp, Homo sapien
atacagatagacacacacctccata

SEQ ID NO: 2657 - DNA, 25 bp, Homo sapien
acagatagacacacacctccataca

SEQ ID NO: 2658 - DNA, 25 bp, Homo sapien
cacacctccatacacatacaaaaaa

SEQ ID NO: 2659 - DNA, 25 bp, Homo sapien
cagggatctcaggttgatttttcta

SEQ ID NO: 2660 - DNA, 25 bp, Homo sapien
ggatctcaggttgatttttctacaa

SEQ ID NO: 2661 - DNA, 25 bp, Homo sapien
ggttgatttttctacaactgaaatt

SEQ ID NO: 2662 - DNA, 25 bp, Homo sapien
tacacctttttatcctatatttcta

SEQ ID NO: 2663 - DNA, 25 bp, Homo sapien
tatatacatatactgcattaggcca

SEQ ID NO: 2664 - DNA, 25 bp, Homo sapien
catatactgcattaggccattactg

SEQ ID NO: 2665 - DNA, 25 bp, Homo sapien
gcattaggccattactgcattgcta

SEQ ID NO: 2666 - DNA, 25 bp, Homo sapien
cattaggccattactgcattgctat

SEQ ID NO: 2667 - DNA, 25 bp, Homo sapien
tttccttttacttctcagttgactg

SEQ ID NO: 2668 - DNA, 25 bp, Homo sapien
ggaagaatgtagtttcgttttatgt

SEQ ID NO: 2669 - DNA, 25 bp, Homo sapien
cgttttatgtttaatatcgctcaaa

SEQ ID NO: 2670 - DNA, 25 bp, Homo sapien
ttttcctctctgtaccttatcatgt

SEQ ID NO: 2671 - DNA, 25 bp, Homo sapien
gtaccttatcatgtaaattttgcta

SEQ ID NO: 2672 - DNA, 25 bp, Homo sapien
gcaaaaatttaaggctatttagctg

SEQ ID NO: 2673 - DNA, 25 bp, Homo sapien
caactgcctagggttgtaaaacagg

SEQ ID NO: 2674 - DNA, 25 bp, Homo sapien
atgcctaatacgtctttatatgtat

SEQ ID NO: 2675 - DNA, 25 bp, Homo sapien
gttgtgtacacgatgttttagtgct

SEQ ID NO: 2676 - DNA, 25 bp, Homo sapien
gtacacgatgttttagtgctaaaaa

SEQ ID NO: 2677 - DNA, 25 bp, Homo sapien
aaaatatgtaaaagagctctacttg

SEQ ID NO: 2678 - DNA, 25 bp, Homo sapien
tgctgtctccattaaatgctgctcg

SEQ ID NO: 2679 - DNA, 25 bp, Homo sapien
aatgctgctcgttgccaagatgaaa

SEQ ID NO: 2680 - DNA, 25 bp, Homo sapien
atgaaaaggcacaccttccaaccat

SEQ ID NO: 2681 - DNA, 25 bp, Homo sapien
caccttccaaccatgaaatcctttg

SEQ ID NO: 2682 - DNA, 25 bp, Homo sapien
gaaatcctttggtactcacaggaga

SEQ ID NO: 2683 - DNA, 25 bp, Homo sapien
acaggagagtgacccacaaaccaaa

SEQ ID NO: 2684 - DNA, 25 bp, Homo sapien
atctgttgggttctaaatggtttat

SEQ ID NO: 2685 - DNA, 25 bp, Homo sapien
gttccaaaacaagacttcccacagg

SEQ ID NO: 2686 - DNA, 25 bp, Homo sapien
gaccactaaaagcatccaggaccag

SEQ ID NO: 2687 - DNA, 25 bp, Homo sapien
ggaccagacagccatccaggaccaa

SEQ ID NO: 2688 - DNA, 25 bp, Homo sapien
aaccttccagttctgtctgtgaacg

SEQ ID NO: 2689 - DNA, 25 bp, Homo sapien
agacttgaaaactaggatcttcctc

SEQ ID NO: 2690 - DNA, 25 bp, Homo sapien
ctaggatcttcctcagatgtctgta

SEQ ID NO: 2691 - DNA, 25 bp, Homo sapien
ggatcttcctcagatgtctgtaaat

SEQ ID NO: 2692 - DNA, 25 bp, Homo sapien
atgtctgtaaataactctggtatcc

SEQ ID NO: 2693 - DNA, 25 bp, Homo sapien
aataactctggtatccaactgggtg

SEQ ID NO: 2694 - DNA, 25 bp, Homo sapien
actctggtatccaactgggtgtatt

SEQ ID NO: 2695 - DNA, 25 bp, Homo sapien
atccaactgggtgtattctagtgtg

SEQ ID NO: 2696 - DNA, 25 bp, Homo sapien
tgtactgtttcgacccaagtactgc

SEQ ID NO: 2697 - DNA, 25 bp, Homo sapien
tgtttcgacccaagtactgctgtat

SEQ ID NO: 2698 - DNA, 25 bp, Homo sapien
ttcgacccaagtactgctgtatcct

SEQ ID NO: 2699 - DNA, 25 bp, Homo sapien
ggaagcaaagtagctttgaattttc

SEQ ID NO: 2700 - DNA, 25 bp, Homo sapien
aagcacattaccctcccttgttaat

SEQ ID NO: 2701 - DNA, 25 bp, Homo sapien
ttaccctcccttgttaatcacttat

SEQ ID NO: 2702 - DNA, 25 bp, Homo sapien
ccctcccttgttaatcacttatgta

SEQ ID NO: 2703 - DNA, 25 bp, Homo sapien
aaaatgcatgttttgctgttgatct

SEQ ID NO: 2704 - DNA, 25 bp, Homo sapien
gatctgttttaactctttctacata

SEQ ID NO: 2705 - DNA, 25 bp, Homo sapien
gttaatctatagtcctttcccttat

SEQ ID NO: 2706 - DNA, 25 bp, Homo sapien
aatctatagtcctttcccttatggt

SEQ ID NO: 2707 - DNA, 25 bp, Homo sapien
atagtcctttcccttatggtgtcca

SEQ ID NO: 2708 - DNA, 25 bp, Homo sapien
ttcccttatggtgtccagctctatg

SEQ ID NO: 2709 - DNA, 25 bp, Homo sapien
ctctgcctcactccagattatgtaa

SEQ ID NO: 2710 - DNA, 25 bp, Homo sapien
gcctcactccagattatgtaaatat

SEQ ID NO: 2711 - DNA, 25 bp, Homo sapien
tcctccaagtcccattttggctggt

SEQ ID NO: 2712 - DNA, 25 bp, Homo sapien
attttggctggtggacacccaggtg

SEQ ID NO: 2713 - DNA, 25 bp, Homo sapien
caagggagggtgatggttcctggcc

SEQ ID NO: 2714 - DNA, 25 bp, Homo sapien
atcattctggtgtcagccctgagag

SEQ ID NO: 2715 - DNA, 25 bp, Homo sapien
agccctgagagggtgcctgtcacag

SEQ ID NO: 2716 - DNA, 25 bp, Homo sapien
acagcaggttccaggactgctgcct

SEQ ID NO: 2717 - DNA, 25 bp, Homo sapien
gctgcctcctgaggatggagaaact

SEQ ID NO: 2718 - DNA, 25 bp, Homo sapien
ggaggccagctgattgcagccacgt

SEQ ID NO: 2719 - DNA, 25 bp, Homo sapien
tgattgcagccacgtgtaccttcct

SEQ ID NO: 2720 - DNA, 25 bp, Homo sapien
tcttctcgtctctgtgttttgtaga

SEQ ID NO: 2721 - DNA, 25 bp, Homo sapien
tgttttgtagatgaccgcacctcga

SEQ ID NO: 2722 - DNA, 25 bp, Homo sapien
agcccttctggcttaaggacaaggt

SEQ ID NO: 2723 - DNA, 25 bp, Homo sapien
atttctgtctgcaaactgtggtagt

SEQ ID NO: 2724 - DNA, 25 bp, Homo sapien
gtattcgatttcaaggattctggga

SEQ ID NO: 2725 - DNA, 25 bp, Homo sapien
aagaacctgctattattgtccctgc

SEQ ID NO: 2726 - DNA, 25 bp, Homo sapien
tattattgtccctgctttacagctc

SEQ ID NO: 2727 - DNA, 25 bp, Homo sapien
tttacagctccagggattggcagcc

SEQ ID NO: 2728 - DNA, 25 bp, Homo sapien
tggcagcctcattcttcaaaagttg

SEQ ID NO: 2729 - DNA, 25 bp, Homo sapien
aaagttgcacacctttagggccttg

SEQ ID NO: 2730 - DNA, 25 bp, Homo sapien
ccttgggaggtacaggcaccagcaa

SEQ ID NO: 2731 - DNA, 25 bp, Homo sapien
gagatgcggcccacactggaaagac

SEQ ID NO: 2732 - DNA, 25 bp, Homo sapien
aaggagagagaaagcgcctcggcca

SEQ ID NO: 2733 - DNA, 25 bp, Homo sapien
tctaacatttggtccttaaacctgg

SEQ ID NO: 2734 - DNA, 25 bp, Homo sapien
ttttctgggtgatagaagcgtcctt

SEQ ID NO: 2735 - DNA, 25 bp, Homo sapien
tgggtgatagaagcgtcctttgttc

SEQ ID NO: 2736 - DNA, 25 bp, Homo sapien
actggtcaccaaaaagacctatggt

SEQ ID NO: 2737 - DNA, 25 bp, Homo sapien
gacctatggttggaagcgttgtgct

SEQ ID NO: 2738 - DNA, 25 bp, Homo sapien
gttggaagcgttgtgctgtcagccc

SEQ ID NO: 2739 - DNA, 25 bp, Homo sapien
ggaagcgttgtgctgtcagccccat

SEQ ID NO: 2740 - DNA, 25 bp, Homo sapien
acatccatgttccaggagagtggtg

SEQ ID NO: 2741 - DNA, 25 bp, Homo sapien
gttccaggagagtggtgcaccccaa

SEQ ID NO: 2742 - DNA, 25 bp, Homo sapien
tcttcaactggcttcatcatttgtg

SEQ ID NO: 2743 - DNA, 25 bp, Homo sapien
aactggcttcatcatttgtgtcctt

SEQ ID NO: 2744 - DNA, 25 bp, Homo sapien
ccagccaggaggacctttatttcag

SEQ ID NO: 2745 - DNA, 25 bp, Homo sapien
ccaggaggacctttatttcagtgtt

SEQ ID NO: 2746 - DNA, 25 bp, Homo sapien
caggaggacctttatttcagtgttc

SEQ ID NO: 2747 - DNA, 25 bp, Homo sapien
gaggacctttatttcagtgttcctc

SEQ ID NO: 2748 - DNA, 25 bp, Homo sapien
acgcccgtttgcaagcagtccatgg

SEQ ID NO: 2749 - DNA, 25 bp, Homo sapien
gcccgtttgcaagcagtccatgggc

SEQ ID NO: 2750 - DNA, 25 bp, Homo sapien
agccctggagagtcacgctgacacc

SEQ ID NO: 2751 - DNA, 25 bp, Homo sapien
ccctggagagtcacgctgacaccat

SEQ ID NO: 2752 - DNA, 25 bp, Homo sapien
acatggaagctctgcatatgtcagc

SEQ ID NO: 2753 - DNA, 25 bp, Homo sapien
ggaagctctgcatatgtcagccaat

SEQ ID NO: 2754 - DNA, 25 bp, Homo sapien
aagctctgcatatgtcagccaattc

SEQ ID NO: 2755 - DNA, 25 bp, Homo sapien
gagcaatagtagtttcattcagaaa

SEQ ID NO: 2756 - DNA, 25 bp, Homo sapien
gaaagacaggtttaaggccaggtgc

SEQ ID NO: 2757 - DNA, 25 bp, Homo sapien
acaaacgtggcaggcgcgtgtaatc

SEQ ID NO: 2758 - DNA, 25 bp, Homo sapien
cagaatttgacccatttatgatgta

SEQ ID NO: 2759 - DNA, 25 bp, Homo sapien
atgatatgtcttaatccatttgtct

SEQ ID NO: 2760 - DNA, 25 bp, Homo sapien
tgatatgtcttaatccatttgtctc

SEQ ID NO: 2761 - DNA, 25 bp, Homo sapien
gatatgtcttaatccatttgtctca

SEQ ID NO: 2762 - DNA, 25 bp, Homo sapien
atatgtcttaatccatttgtctcac

SEQ ID NO: 2763 - DNA, 25 bp, Homo sapien
tatgtcttaatccatttgtctcaca

SEQ ID NO: 2764 - DNA, 25 bp, Homo sapien
atgtcttaatccatttgtctcacac

SEQ ID NO: 2765 - DNA, 25 bp, Homo sapien
aatccatttgtctcacacactaatt

SEQ ID NO: 2766 - DNA, 25 bp, Homo sapien
aattcatttgcagataggccaggtc

SEQ ID NO: 2767 - DNA, 25 bp, Homo sapien
tcatttgcagataggccaggtccat

SEQ ID NO: 2768 - DNA, 25 bp, Homo sapien
ttgcagataggccaggtccatgaag

SEQ ID NO: 2769 - DNA, 25 bp, Homo sapien
cagataggccaggtccatgaagaat

SEQ ID NO: 2770 - DNA, 25 bp, Homo sapien
taaataacatggctaatactacagt

SEQ ID NO: 2771 - DNA, 25 bp, Homo sapien
acatggctaatactacagttgaaag

SEQ ID NO: 2772 - DNA, 25 bp, Homo sapien
atactacagttgaaagtttgataca

SEQ ID NO: 2773 - DNA, 25 bp, Homo sapien
aaatttgctgagtcaaaaggcactg

SEQ ID NO: 2774 - DNA, 25 bp, Homo sapien
tgctgagtcaaaaggcactgggaag

SEQ ID NO: 2775 - DNA, 25 bp, Homo sapien
gaaggaaagacctggcctcattgaa

SEQ ID NO: 2776 - DNA, 25 bp, Homo sapien
ggaaagacctggcctcattgaattt

SEQ ID NO: 2777 - DNA, 25 bp, Homo sapien
tgagatggagtgatcactggctttg

SEQ ID NO: 2778 - DNA, 25 bp, Homo sapien
agtcagacacaatagactgagctat

SEQ ID NO: 2779 - DNA, 25 bp, Homo sapien
agactgagctatgttgaaggacaat

SEQ ID NO: 2780 - DNA, 25 bp, Homo sapien
gatagcattcattgaaccctcacta

SEQ ID NO: 2781 - DNA, 25 bp, Homo sapien
attgaaccctcactatatgccaggc

SEQ ID NO: 2782 - DNA, 25 bp, Homo sapien
ctttatgtactttatgttatgcaat

SEQ ID NO: 2783 - DNA, 25 bp, Homo sapien
aacacaggtttagaggttatcaaat

SEQ ID NO: 2784 - DNA, 25 bp, Homo sapien
ggttatcaaatttgtccatgaccac

SEQ ID NO: 2785 - DNA, 25 bp, Homo sapien
tttgtccatgaccacatgaacttgt

SEQ ID NO: 2786 - DNA, 25 bp, Homo sapien
atgaacttgtaattcccagtaaata

SEQ ID NO: 2787 - DNA, 25 bp, Homo sapien
atatctgaaagtgtccaggcacggt

SEQ ID NO: 2788 - DNA, 25 bp, Homo sapien
gccacaggcagggtctgctggtttc

SEQ ID NO: 2789 - DNA, 25 bp, Homo sapien
ctggtttcggtgtcaggggcacatc

SEQ ID NO: 2790 - DNA, 25 bp, Homo sapien
gtacgaggcccggtttaaatgcagg

SEQ ID NO: 2791 - DNA, 25 bp, Homo sapien
ggcccggtttaaatgcaggaggaat

SEQ ID NO: 2792 - DNA, 25 bp, Homo sapien
cccggtttaaatgcaggaggaatct

SEQ ID NO: 2793 - DNA, 25 bp, Homo sapien
ggaatctggtgagcgagtttcactc

SEQ ID NO: 2794 - DNA, 25 bp, Homo sapien
atctggtgagcgagtttcactctga

SEQ ID NO: 2795 - DNA, 25 bp, Homo sapien
gtgagcgagtttcactctgatgcaa

SEQ ID NO: 2796 - DNA, 25 bp, Homo sapien
agcgagtttcactctgatgcaacag

SEQ ID NO: 2797 - DNA, 25 bp, Homo sapien
gaaaagccaagccaagccttggctg

SEQ ID NO: 2798 - DNA, 25 bp, Homo sapien
ttggctgtgcctggtcttggccggg

SEQ ID NO: 2799 - DNA, 25 bp, Homo sapien
gaagataaagatgcagactcgctgg

SEQ ID NO: 2800 - DNA, 25 bp, Homo sapien
gttttaccctccctggtatcacatc

SEQ ID NO: 2801 - DNA, 25 bp, Homo sapien
ttggagggagctacctaccaggtgc

SEQ ID NO: 2802 - DNA, 25 bp, Homo sapien
taccaggtgccagatgccctcgagt

SEQ ID NO: 2803 - DNA, 25 bp, Homo sapien
ccctcgagtgggaacagcagaatca

SEQ ID NO: 2804 - DNA, 25 bp, Homo sapien
cagaatcaaggcctggtgagaagct

SEQ ID NO: 2805 - DNA, 25 bp, Homo sapien
aaaagacaaggctggttacatgtct

SEQ ID NO: 2806 - DNA, 25 bp, Homo sapien
gagagaattcaacagcatgcaagat

SEQ ID NO: 2807 - DNA, 25 bp, Homo sapien
gatcgagtaatgctcttagccgaca

SEQ ID NO: 2808 - DNA, 25 bp, Homo sapien
atgctcttagccgacagctctgaag

SEQ ID NO: 2809 - DNA, 25 bp, Homo sapien
agccgacagctctgaagatgaattt

SEQ ID NO: 2810 - DNA, 25 bp, Homo sapien
acttttccgatgaggctgatactgc

SEQ ID NO: 2811 - DNA, 25 bp, Homo sapien
accacactttgaggaccactgagga

SEQ ID NO: 2812 - DNA, 25 bp, Homo sapien
tgaggaccactgaggaaagagtttc

SEQ ID NO: 2813 - DNA, 25 bp, Homo sapien
gaggaaagagtttcacaagtcagag

SEQ ID NO: 2814 - DNA, 25 bp, Homo sapien
tttctcaagttagtttatcagaagc

SEQ ID NO: 2815 - DNA, 25 bp, Homo sapien
aatgaagaccacttcatttcagttt

SEQ ID NO: 2816 - DNA, 25 bp, Homo sapien
cttcatttcagtttatgtacaaaaa

SEQ ID NO: 2817 - DNA, 25 bp, Homo sapien
cagttatgccaagtgtatgaagaca

SEQ ID NO: 2818 - DNA, 25 bp, Homo sapien
tgattttgaatccttagccccttac

SEQ ID NO: 2819 - DNA, 25 bp, Homo sapien
ttttgaatccttagccccttacaca

SEQ ID NO: 2820 - DNA, 25 bp, Homo sapien
aaatgcttattgagtgattacataa

SEQ ID NO: 2821 - DNA, 25 bp, Homo sapien
gtgtgcacctatcatatctagtctt

SEQ ID NO: 2822 - DNA, 25 bp, Homo sapien
aatggtttggtaagactttgctgtt

SEQ ID NO: 2823 - DNA, 25 bp, Homo sapien
attcgattctcatacgcagcatgca

SEQ ID NO: 2824 - DNA, 25 bp, Homo sapien
agcatgcaaccgagatcaccacgtg

SEQ ID NO: 2825 - DNA, 25 bp, Homo sapien
acgtgcacagttcaccgtaggttca

SEQ ID NO: 2826 - DNA, 25 bp, Homo sapien
gtaggttcactctcctacaagactc

SEQ ID NO: 2827 - DNA, 25 bp, Homo sapien
tacaagactccaacgctgccactga

SEQ ID NO: 2828 - DNA, 25 bp, Homo sapien
caacgctgccactgacctaacagga

SEQ ID NO: 2829 - DNA, 25 bp, Homo sapien
agctcaggcggtgatgttcgctcac

SEQ ID NO: 2830 - DNA, 25 bp, Homo sapien
aacagaccacagacggatctgctgg

SEQ ID NO: 2831 - DNA, 25 bp, Homo sapien
gggactcctgcatataaagtaagtg

SEQ ID NO: 2832 - DNA, 25 bp, Homo sapien
caagccgagatccaaatcaggaaca

SEQ ID NO: 2833 - DNA, 25 bp, Homo sapien
aatcaggaacaaactcctattcaca

SEQ ID NO: 2834 - DNA, 25 bp, Homo sapien
ggaacaaactcctattcacaattgc

SEQ ID NO: 2835 - DNA, 25 bp, Homo sapien
ttgccacaaaaacaatagaacagga

SEQ ID NO: 2836 - DNA, 25 bp, Homo sapien
ggaaaacagctaactaggaaggtga

SEQ ID NO: 2837 - DNA, 25 bp, Homo sapien
ctaactaggaaggtgaaagatctct

SEQ ID NO: 2838 - DNA, 25 bp, Homo sapien
gaaaaacattccatgatcatggata

SEQ ID NO: 2839 - DNA, 25 bp, Homo sapien
ttactgaaatggctatactgtccaa

SEQ ID NO: 2840 - DNA, 25 bp, Homo sapien
gaaatggctatactgtccaaagcaa

SEQ ID NO: 2841 - DNA, 25 bp, Homo sapien
tcctagtaaactaccattgagattt

SEQ ID NO: 2842 - DNA, 25 bp, Homo sapien
tagtaaactaccattgagatttttt

SEQ ID NO: 2843 - DNA, 25 bp, Homo sapien
gtgtaactggatcttggttcatgct

SEQ ID NO: 2844 - DNA, 25 bp, Homo sapien
ggatcttggttcatgctgagcttaa

SEQ ID NO: 2845 - DNA, 25 bp, Homo sapien
gaaagactctttctggtgaatacag

SEQ ID NO: 2846 - DNA, 25 bp, Homo sapien
ggtgaatacagatcttctgagcaat

SEQ ID NO: 2847 - DNA, 25 bp, Homo sapien
ttctgagcaattatcgactgacttt

SEQ ID NO: 2848 - DNA, 25 bp, Homo sapien
gactgactttgtcattagactgccc

SEQ ID NO: 2849 - DNA, 25 bp, Homo sapien
ttgctcccttcttcatggaatattt

SEQ ID NO: 2850 - DNA, 25 bp, Homo sapien
atagcccctatatttcaaaagatgg

SEQ ID NO: 2851 - DNA, 25 bp, Homo sapien
aaagctggattgctctgcagtgagt

SEQ ID NO: 2852 - DNA, 25 bp, Homo sapien
gtgagtgaaacgtggaaaggccttt

SEQ ID NO: 2853 - DNA, 25 bp, Homo sapien
aggcctttccccaccaagcagtagg

SEQ ID NO: 2854 - DNA, 25 bp, Homo sapien
gccgttgccctgtgttttctgtgtc

SEQ ID NO: 2855 - DNA, 25 bp, Homo sapien
ggtaacttttcagaggtcctatctc

SEQ ID NO: 2856 - DNA, 25 bp, Homo sapien
tttcagaggtcctatctccaaatac

SEQ ID NO: 2857 - DNA, 25 bp, Homo sapien
ttatctacatctcacacaggtaagg

SEQ ID NO: 2858 - DNA, 25 bp, Homo sapien
tctcacacaggtaaggttccatgat

SEQ ID NO: 2859 - DNA, 25 bp, Homo sapien
ttctgtgtgacataaaacttcctat

SEQ ID NO: 2860 - DNA, 25 bp, Homo sapien
taaaacttcctatagtcaagtcagg

SEQ ID NO: 2861 - DNA, 25 bp, Homo sapien
ctatagtcaagtcaggagtcaatta

SEQ ID NO: 2862 - DNA, 25 bp, Homo sapien
ttgtagatggctgctttgtcactgt

SEQ ID NO: 2863 - DNA, 25 bp, Homo sapien
atggctgctttgtcactgtgtctta

SEQ ID NO: 2864 - DNA, 25 bp, Homo sapien
ctgtgtcttaatatggccgttgccc

SEQ ID NO: 2865 - DNA, 25 bp, Homo sapien
gaggagtattcgaagagtacccact

SEQ ID NO: 2866 - DNA, 25 bp, Homo sapien
attcgaagagtacccactctgctga

SEQ ID NO: 2867 - DNA, 25 bp, Homo sapien
agaactgcagagacgatctgccagc

SEQ ID NO: 2868 - DNA, 25 bp, Homo sapien
tcctctgctaagagccgaacactca

SEQ ID NO: 2869 - DNA, 25 bp, Homo sapien
agccgaacactcaactggacgacct

SEQ ID NO: 2870 - DNA, 25 bp, Homo sapien
ctacagggaggagctacccagctct

SEQ ID NO: 2871 - DNA, 25 bp, Homo sapien
ggagctacccagctctctgagctgt

SEQ ID NO: 2872 - DNA, 25 bp, Homo sapien
ataaaactcttcttgtggccggttg

SEQ ID NO: 2873 - DNA, 25 bp, Homo sapien
aactcttcttgtggccggttgcgag

SEQ ID NO: 2874 - DNA, 25 bp, Homo sapien
atatatacagctgcaatcccagcca

SEQ ID NO: 2875 - DNA, 25 bp, Homo sapien
gagatacaggtactgcactccaggc

SEQ ID NO: 2876 - DNA, 25 bp, Homo sapien
tactatatattgtactgatgccaaa

SEQ ID NO: 2877 - DNA, 25 bp, Homo sapien
atattgtactgatgccaaaagtcat

SEQ ID NO: 2878 - DNA, 25 bp, Homo sapien
tgccaaaagtcatgttttcatccac

SEQ ID NO: 2879 - DNA, 25 bp, Homo sapien
atgttttcatccacttagtgaaaaa

SEQ ID NO: 2880 - DNA, 25 bp, Homo sapien
tttgtatttataagccccaaatgca

SEQ ID NO: 2881 - DNA, 25 bp, Homo sapien
tataagccccaaatgcatcaaatgc

SEQ ID NO: 2882 - DNA, 25 bp, Homo sapien
gccccaaatgcatcaaatgcagtag

SEQ ID NO: 2883 - DNA, 25 bp, Homo sapien
aacaatgtaatacagcttggtacct

SEQ ID NO: 2884 - DNA, 25 bp, Homo sapien
atatgtgcattttctgtattgttat

SEQ ID NO: 2885 - DNA, 25 bp, Homo sapien
gactttttagagtctatgccaaaat

SEQ ID NO: 2886 - DNA, 25 bp, Homo sapien
gtctatgccaaaatatatggctgta

SEQ ID NO: 2887 - DNA, 25 bp, Homo sapien
acgggttgactccaatctcctgttt

SEQ ID NO: 2888 - DNA, 25 bp, Homo sapien
ttcagatgatgctggagcctctctt

SEQ ID NO: 2889 - DNA, 25 bp, Homo sapien
gagcctctcttctgagacgggcatg

SEQ ID NO: 2890 - DNA, 25 bp, Homo sapien
gtgttatgtggttaggaagtccttc

SEQ ID NO: 2891 - DNA, 25 bp, Homo sapien
agtccttccaaaagtcctgttactg

SEQ ID NO: 2892 - DNA, 25 bp, Homo sapien
agtcctgttactggatagttctcat

SEQ ID NO: 2893 - DNA, 25 bp, Homo sapien
actggatagttctcatacttgaccc

SEQ ID NO: 2894 - DNA, 25 bp, Homo sapien
ttatactcatggtctttgtcaatta

SEQ ID NO: 2895 - DNA, 25 bp, Homo sapien
aacatgcaagttggaatgggctgac

SEQ ID NO: 2896 - DNA, 25 bp, Homo sapien
aatgggctgacagtggctgacctcg

SEQ ID NO: 2897 - DNA, 25 bp, Homo sapien
tgacctcgtgttcccgtggtgagtt

SEQ ID NO: 2898 - DNA, 25 bp, Homo sapien
gttggtaaggttgatatattcaaga

SEQ ID NO: 2899 - DNA, 25 bp, Homo sapien
taaaaattatcttcgtactaacact

SEQ ID NO: 2900 - DNA, 25 bp, Homo sapien
attatcttcgtactaacactaaccg

SEQ ID NO: 2901 - DNA, 25 bp, Homo sapien
tcttgaaagacagaaccgtgatatt

SEQ ID NO: 2902 - DNA, 25 bp, Homo sapien
gacagaaccgtgatattcaacgtaa

SEQ ID NO: 2903 - DNA, 25 bp, Homo sapien
ccgtgatattcaacgtaatggcata

SEQ ID NO: 2904 - DNA, 25 bp, Homo sapien
gatattcaacgtaatggcataatgt

SEQ ID NO: 2905 - DNA, 25 bp, Homo sapien
caacgtaatggcataatgtttctgg

SEQ ID NO: 2906 - DNA, 25 bp, Homo sapien
aatggcataatgtttctgggtataa

SEQ ID NO: 2907 - DNA, 25 bp, Homo sapien
taatgtttctgggtataaaaagtct

SEQ ID NO: 2908 - DNA, 25 bp, Homo sapien
taaaaagtcttaatataggtcaggc

SEQ ID NO: 2909 - DNA, 25 bp, Homo sapien
agcaggccgcacagcagcttgctgt

SEQ ID NO: 2910 - DNA, 25 bp, Homo sapien
cagcttgctgtaggagcggttctgc

SEQ ID NO: 2911 - DNA, 25 bp, Homo sapien
gccgatcttgccgatgctgtgcagg

SEQ ID NO: 2912 - DNA, 25 bp, Homo sapien
ttgccgatgctgtgcaggctgcaga

SEQ ID NO: 2913 - DNA, 25 bp, Homo sapien
ctggagccgccgaaggccatgagct

SEQ ID NO: 2914 - DNA, 25 bp, Homo sapien
aaggccatgagctggtccgggacca

SEQ ID NO: 2915 - DNA, 25 bp, Homo sapien
ggaccacgtgcaccgcgatgtactg

SEQ ID NO: 2916 - DNA, 25 bp, Homo sapien
gagaggaacccgtccggcacggagg

SEQ ID NO: 2917 - DNA, 25 bp, Homo sapien
gggcacgttggtgtttacgatgaac

SEQ ID NO: 2918 - DNA, 25 bp, Homo sapien
tacgatgaacatcggcatgatggca

SEQ ID NO: 2919 - DNA, 25 bp, Homo sapien
catcggcatgatggcagaaggacca

SEQ ID NO: 2920 - DNA, 25 bp, Homo sapien
gttagcactgcctctaaggtctcct

SEQ ID NO: 2921 - DNA, 25 bp, Homo sapien
tgcctctaaggtctcctgcaactca

SEQ ID NO: 2922 - DNA, 25 bp, Homo sapien
ccctcttactccatggtattcaact

SEQ ID NO: 2923 - DNA, 25 bp, Homo sapien
tactccatggtattcaacttctaaa

SEQ ID NO: 2924 - DNA, 25 bp, Homo sapien
ggtattcaacttctaaactaagagg

SEQ ID NO: 2925 - DNA, 25 bp, Homo sapien
ggaaagcccgagctagaggtcctat

SEQ ID NO: 2926 - DNA, 25 bp, Homo sapien
aagcccgagctagaggtcctatgca

SEQ ID NO: 2927 - DNA, 25 bp, Homo sapien
ccgagctagaggtcctatgcatcaa

SEQ ID NO: 2928 - DNA, 25 bp, Homo sapien
gctagaggtcctatgcatcaatcag

SEQ ID NO: 2929 - DNA, 25 bp, Homo sapien
gaggtcctatgcatcaatcagggaa

SEQ ID NO: 2930 - DNA, 25 bp, Homo sapien
gtcctatgcatcaatcagggaagag

SEQ ID NO: 2931 - DNA, 25 bp, Homo sapien
aatctggacccgaatccacccattg

SEQ ID NO: 2932 - DNA, 25 bp, Homo sapien
gctgccgctggagagaatctctgag

SEQ ID NO: 2933 - DNA, 25 bp, Homo sapien
tgcacggaagagacgcctcctcggg

SEQ ID NO: 2934 - DNA, 25 bp, Homo sapien
gcctcctcgggaaatttgtgcacag

SEQ ID NO: 2935 - DNA, 25 bp, Homo sapien
agtgtggattagattcttcctcaca

SEQ ID NO: 2936 - DNA, 25 bp, Homo sapien
agccctgccaagaacttgatctcag

SEQ ID NO: 2937 - DNA, 25 bp, Homo sapien
gcattttgttttgtaagtcagccat

SEQ ID NO: 2938 - DNA, 25 bp, Homo sapien
gtcagccatatggtttgtggcactt

SEQ ID NO: 2939 - DNA, 25 bp, Homo sapien
ggcagccctaggagatgaagacaat

SEQ ID NO: 2940 - DNA, 25 bp, Homo sapien
acaatatgcaacatggtatgtccat

SEQ ID NO: 2941 - DNA, 25 bp, Homo sapien
ccataaatgtgttctttggcctgaa

SEQ ID NO: 2942 - DNA, 25 bp, Homo sapien
cagcaacaacatctgccacaagtgt

SEQ ID NO: 2943 - DNA, 25 bp, Homo sapien
cacaagtgttcccttcgctgcaaca

SEQ ID NO: 2944 - DNA, 25 bp, Homo sapien
acagccaaccagatacccataatat

SEQ ID NO: 2945 - DNA, 25 bp, Homo sapien
atatctgccgaacatctgactagcc

SEQ ID NO: 2946 - DNA, 25 bp, Homo sapien
gactagccacaagtatgttacccag

SEQ ID NO: 2947 - DNA, 25 bp, Homo sapien
gtatgtcgagagtaccaacgtggca

SEQ ID NO: 2948 - DNA, 25 bp, Homo sapien
aacgtggcaattgcaaccgaggaga

SEQ ID NO: 2949 - DNA, 25 bp, Homo sapien
ctgctgacagcacaatgattgacac

SEQ ID NO: 2950 - DNA, 25 bp, Homo sapien
cagtcactgtgtgtatggattacat

SEQ ID NO: 2951 - DNA, 25 bp, Homo sapien
tgaaaaaaccaacggtgccaccgca

SEQ ID NO: 2952 - DNA, 25 bp, Homo sapien
gccaccgcagtctttaacactggta

SEQ ID NO: 2953 - DNA, 25 bp, Homo sapien
caggactttaacagggcttgggctt

SEQ ID NO: 2954 - DNA, 25 bp, Homo sapien
gagattctgttaacccgcaggactt

SEQ ID NO: 2955 - DNA, 25 bp, Homo sapien
ccgcaggacttcattaggcacacaa

SEQ ID NO: 2956 - DNA, 25 bp, Homo sapien
ggcacacaagattcaccttaatttc

SEQ ID NO: 2957 - DNA, 25 bp, Homo sapien
ggctaattaacaacccagtacagga

SEQ ID NO: 2958 - DNA, 25 bp, Homo sapien
gtacaggacatatccacaagggtcg

SEQ ID NO: 2959 - DNA, 25 bp, Homo sapien
acaagggtcggtaaatggcatgcta

SEQ ID NO: 2960 - DNA, 25 bp, Homo sapien
cttggtttctcttgtggccagatct

SEQ ID NO: 2961 - DNA, 25 bp, Homo sapien
tcttgtggccagatctttcagttgc

SEQ ID NO: 2962 - DNA, 25 bp, Homo sapien
tttcagttgccccttttccataaca

SEQ ID NO: 2963 - DNA, 25 bp, Homo sapien
ggtctggaaataccttttcgaacag

SEQ ID NO: 2964 - DNA, 25 bp, Homo sapien
ttactagccatctgcatccttttga

SEQ ID NO: 2965 - DNA, 25 bp, Homo sapien
tctctccatttattatctacactgc

SEQ ID NO: 2966 - DNA, 25 bp, Homo sapien
tacactgcaggtagggccatacgta

SEQ ID NO: 2967 - DNA, 25 bp, Homo sapien
taaaccttaccatatcatcttcctt

SEQ ID NO: 2968 - DNA, 25 bp, Homo sapien
atttaatcctttacatgactggctg

SEQ ID NO: 2969 - DNA, 25 bp, Homo sapien
tgactggctgtgctcagacctagac

SEQ ID NO: 2970 - DNA, 25 bp, Homo sapien
tagactgcctcacaagctcatccaa

SEQ ID NO: 2971 - DNA, 25 bp, Homo sapien
ttttttcagttcctcacacgtgctg

SEQ ID NO: 2972 - DNA, 25 bp, Homo sapien
tgtgctgttcccattgcctgaaata

SEQ ID NO: 2973 - DNA, 25 bp, Homo sapien
cattgcctgaaatactttccctcta

SEQ ID NO: 2974 - DNA, 25 bp, Homo sapien
attctctctcaaatgtacccacttt

SEQ ID NO: 2975 - DNA, 25 bp, Homo sapien
ggaggtgatgtggaattctcccagc

SEQ ID NO: 2976 - DNA, 25 bp, Homo sapien
ccagctgttccgagagcaaacgact

SEQ ID NO: 2977 - DNA, 25 bp, Homo sapien
atttgattaacacttcaggagcagt

SEQ ID NO: 2978 - DNA, 25 bp, Homo sapien
gtacagaaagcaaggcaccaccacc

SEQ ID NO: 2979 - DNA, 25 bp, Homo sapien
cccctgaatggagcctgggtcacag

SEQ ID NO: 2980 - DNA, 25 bp, Homo sapien
agcagatttggacttggaggaccct

SEQ ID NO: 2981 - DNA, 25 bp, Homo sapien
acaaatatctcccatgaaattgccc

SEQ ID NO: 2982 - DNA, 25 bp, Homo sapien
gggcctccaaaacagatctgagcat

SEQ ID NO: 2983 - DNA, 25 bp, Homo sapien
ggagcaagaactgtgtctcacctgc

SEQ ID NO: 2984 - DNA, 25 bp, Homo sapien
gaaattgccccgagtgtccaatggc

SEQ ID NO: 2985 - DNA, 25 bp, Homo sapien
gtccaatggctgttgctatgaggtc

SEQ ID NO: 2986 - DNA, 25 bp, Homo sapien
ttgccgaagagactgctcccgacct

SEQ ID NO: 2987 - DNA, 25 bp, Homo sapien
tctcatgtcatcctgcatccagaga

SEQ ID NO: 2988 - DNA, 25 bp, Homo sapien
gtcatcctgcatccagagaacggca

SEQ ID NO: 2989 - DNA, 25 bp, Homo sapien
gcatccagagaacggcagcatatca

SEQ ID NO: 2990 - DNA, 25 bp, Homo sapien
gcagcatatcaagccgttaaccctg

SEQ ID NO: 2991 - DNA, 25 bp, Homo sapien
aagccgttaaccctgattcactcgg

SEQ ID NO: 2992 - DNA, 25 bp, Homo sapien
attcactcggttcccttgaaaccag

SEQ ID NO: 2993 - DNA, 25 bp, Homo sapien
tgaaaccaggcctcagttaaccatg

SEQ ID NO: 2994 - DNA, 25 bp, Homo sapien
aggcctcagttaaccatgaccacag

SEQ ID NO: 2995 - DNA, 25 bp, Homo sapien
gttaaccatgaccacagctacaggc

SEQ ID NO: 2996 - DNA, 25 bp, Homo sapien
agctacaggcaaaccgctgctgttg

SEQ ID NO: 2997 - DNA, 25 bp, Homo sapien
gggccattctttatagtttgactct

SEQ ID NO: 2998 - DNA, 25 bp, Homo sapien
attctttatagtttgactctggaga

SEQ ID NO: 2999 - DNA, 25 bp, Homo sapien
gggtgcacatcctcaggagctgcct

SEQ ID NO: 3000 - DNA, 25 bp, Homo sapien
aggagctgcctacctccagatattg

SEQ ID NO: 3001 - DNA, 25 bp, Homo sapien
gctgcctacctccagatattgtaag

SEQ ID NO: 3002 - DNA, 25 bp, Homo sapien
acctccagatattgtaagtccatgc

SEQ ID NO: 3003 - DNA, 25 bp, Homo sapien
agatattgtaagtccatgcagaaga

SEQ ID NO: 3004 - DNA, 25 bp, Homo sapien
gtatgtgacattttcatgtgggcac

SEQ ID NO: 3005 - DNA, 25 bp, Homo sapien
gtgacattttcatgtgggcacattt

SEQ ID NO: 3006 - DNA, 25 bp, Homo sapien
gtgggcacattttgatactacttta

SEQ ID NO: 3007 - DNA, 25 bp, Homo sapien
gtgatagtagggatggtcttgctct

SEQ ID NO: 3008 - DNA, 25 bp, Homo sapien
tggtcaccagccactcgaaggaact

SEQ ID NO: 3009 - DNA, 25 bp, Homo sapien
cgaaggaacttcagatgtgagagca

SEQ ID NO: 3010 - DNA, 25 bp, Homo sapien
agcagagggccgtgttcagacagaa

SEQ ID NO: 3011 - DNA, 25 bp, Homo sapien
gttcagacagaacgccaagcatccg

SEQ ID NO: 3012 - DNA, 25 bp, Homo sapien
caagcatccggcacgccaggaagcg

SEQ ID NO: 3013 - DNA, 25 bp, Homo sapien
ggaaggccgcgtggtgtacattcaa

SEQ ID NO: 3014 - DNA, 25 bp, Homo sapien
gtacattcaaaatctctccagcgac

SEQ ID NO: 3015 - DNA, 25 bp, Homo sapien
aaaatctctccagcgacatgagctc

SEQ ID NO: 3016 - DNA, 25 bp, Homo sapien
tccagcgacatgagctcccgagagc

SEQ ID NO: 3017 - DNA, 25 bp, Homo sapien
ctctttgacaaagggcgctgccctg

SEQ ID NO: 3018 - DNA, 25 bp, Homo sapien
acaaagggcgctgccctgaggaagc

SEQ ID NO: 3019 - DNA, 25 bp, Homo sapien
agtggtccagacacaggtgatgtga

SEQ ID NO: 3020 - DNA, 25 bp, Homo sapien
agagcccagtgtgaatatttattga

SEQ ID NO: 3021 - DNA, 25 bp, Homo sapien
aattttagtcaggtctgtggcacta

SEQ ID NO: 3022 - DNA, 25 bp, Homo sapien
gtctgtggcactaaggaaatctgtc

SEQ ID NO: 3023 - DNA, 25 bp, Homo sapien
aggaccctagccacggagttagatt

SEQ ID NO: 3024 - DNA, 25 bp, Homo sapien
gaagtaaaactggactttctgagca

SEQ ID NO: 3025 - DNA, 25 bp, Homo sapien
gctgacagcggcaaagcgaggcctc

SEQ ID NO: 3026 - DNA, 25 bp, Homo sapien
aagcgaggcctcaggtcatttctta

SEQ ID NO: 3027 - DNA, 25 bp, Homo sapien
ggtcatttcttaccagtttaggctt

SEQ ID NO: 3028 - DNA, 25 bp, Homo sapien
taccagtttaggcttatgggaccaa

SEQ ID NO: 3029 - DNA, 25 bp, Homo sapien
tatgggaccaaagcagaaattcaag

SEQ ID NO: 3030 - DNA, 25 bp, Homo sapien
tggacctatctttcagagccataat

SEQ ID NO: 3031 - DNA, 25 bp, Homo sapien
gacagtccctgagtcttggatgaac

SEQ ID NO: 3032 - DNA, 25 bp, Homo sapien
acaggactcacagtgtctacaccgg

SEQ ID NO: 3033 - DNA, 25 bp, Homo sapien
tgtctacaccggacagtttctgttt

SEQ ID NO: 3034 - DNA, 25 bp, Homo sapien
agtttctgtttgcacgacgttgagt

SEQ ID NO: 3035 - DNA, 25 bp, Homo sapien
gaagttaccctttgggattactgat

SEQ ID NO: 3036 - DNA, 25 bp, Homo sapien
gctgttctgagagctgctgataata

SEQ ID NO: 3037 - DNA, 25 bp, Homo sapien
ggatccaaacccacaggcttgagct

SEQ ID NO: 3038 - DNA, 25 bp, Homo sapien
gaaattctggtttagctcaacttga

SEQ ID NO: 3039 - DNA, 25 bp, Homo sapien
gctcaacttgactactatggatgat

SEQ ID NO: 3040 - DNA, 25 bp, Homo sapien
tagagcttgtttgctggcacaggaa

SEQ ID NO: 3041 - DNA, 25 bp, Homo sapien
acatggatgatatcaccccatttta

SEQ ID NO: 3042 - DNA, 25 bp, Homo sapien
atgtgagctttgtgaaatctgactg

SEQ ID NO: 3043 - DNA, 25 bp, Homo sapien
atctgactgtaaccttcataacata

SEQ ID NO: 3044 - DNA, 25 bp, Homo sapien
gtaaccttcataacataatcaaata

SEQ ID NO: 3045 - DNA, 25 bp, Homo sapien
gtgaacaactattctttcctctggc

SEQ ID NO: 3046 - DNA, 25 bp, Homo sapien
aactattctttcctctggcaatgaa

SEQ ID NO: 3047 - DNA, 25 bp, Homo sapien
cctctggcaatgaatatttgctggt

SEQ ID NO: 3048 - DNA, 25 bp, Homo sapien
tttgctggtatttttccattttata

SEQ ID NO: 3049 - DNA, 25 bp, Homo sapien
ctcagtgaacatcagttttatcaaa

SEQ ID NO: 3050 - DNA, 25 bp, Homo sapien
taacgttaatcacttacctaccagg

SEQ ID NO: 3051 - DNA, 25 bp, Homo sapien
ttaatcacttacctaccaggactca

SEQ ID NO: 3052 - DNA, 25 bp, Homo sapien
cacactggcaaagcgtacgtattct

SEQ ID NO: 3053 - DNA, 25 bp, Homo sapien
gcgtacgtattctgggatcatctct

SEQ ID NO: 3054 - DNA, 25 bp, Homo sapien
acgtattctgggatcatctctttgt

SEQ ID NO: 3055 - DNA, 25 bp, Homo sapien
gggatcatctctttgtttaggtgtg

SEQ ID NO: 3056 - DNA, 25 bp, Homo sapien
ttaggtgtgaaatcttagtgttgta

SEQ ID NO: 3057 - DNA, 25 bp, Homo sapien
agtgttgtaaaggtagtgctgcttc

SEQ ID NO: 3058 - DNA, 25 bp, Homo sapien
taaaggtagtgctgcttcacctgct

SEQ ID NO: 3059 - DNA, 25 bp, Homo sapien
tagtgctgcttcacctgcttttgct

SEQ ID NO: 3060 - DNA, 25 bp, Homo sapien
agggccactctggtttgagctttct

SEQ ID NO: 3061 - DNA, 25 bp, Homo sapien
tggtttgagctttctgccagaaatg

SEQ ID NO: 3062 - DNA, 25 bp, Homo sapien
tctgccagaaatgagatttgggaat

SEQ ID NO: 3063 - DNA, 25 bp, Homo sapien
aggaagatcttgcagtctcccatct

SEQ ID NO: 3064 - DNA, 25 bp, Homo sapien
atctcagcagcctgtcacatcaagg

SEQ ID NO: 3065 - DNA, 25 bp, Homo sapien
gcctgtcacatcaaggtcaagcaga

SEQ ID NO: 3066 - DNA, 25 bp, Homo sapien
gaagaggcaagactcaaacccacct

SEQ ID NO: 3067 - DNA, 25 bp, Homo sapien
tggccaacaccctgcctggatgtgg

SEQ ID NO: 3068 - DNA, 25 bp, Homo sapien
ctggatgtggcccagctcctcacga

SEQ ID NO: 3069 - DNA, 25 bp, Homo sapien
ctccccgtggcctaggaatctaaga

SEQ ID NO: 3070 - DNA, 25 bp, Homo sapien
atgatcaaggtcaaccaggtgcagt

SEQ ID NO: 3071 - DNA, 25 bp, Homo sapien
gtatataaatgatctgggcatggtg

SEQ ID NO: 3072 - DNA, 25 bp, Homo sapien
gctcctcagggcttaggcgagatcg

SEQ ID NO: 3073 - DNA, 25 bp, Homo sapien
gcttaggcgagatcgcttgatccca

SEQ ID NO: 3074 - DNA, 25 bp, Homo sapien
gggatgtggcttgagctgcagtcac

SEQ ID NO: 3075 - DNA, 25 bp, Homo sapien
acaggccttggctggaccagggatg

SEQ ID NO: 3076 - DNA, 25 bp, Homo sapien
cttggctggaccagggatggccccc

SEQ ID NO: 3077 - DNA, 25 bp, Homo sapien
aggagggcccactgaccctgcagct

SEQ ID NO: 3078 - DNA, 25 bp, Homo sapien
tccagccttctccatacttcaacaa

SEQ ID NO: 3079 - DNA, 25 bp, Homo sapien
caaagaatgagttgtggcaatgagg

SEQ ID NO: 3080 - DNA, 25 bp, Homo sapien
accctctcatagtgttttatactca

SEQ ID NO: 3081 - DNA, 25 bp, Homo sapien
cctctcatagtgttttatactcagt

SEQ ID NO: 3082 - DNA, 25 bp, Homo sapien
aggcaggcagcctggcgctaggccc

SEQ ID NO: 3083 - DNA, 25 bp, Homo sapien
cccagtagttgaaaatcaattcata

SEQ ID NO: 3084 - DNA, 25 bp, Homo sapien
gttgaaaatcaattcataacttaga

SEQ ID NO: 3085 - DNA, 25 bp, Homo sapien
aggagtgggaatctcagccacactc

SEQ ID NO: 3086 - DNA, 25 bp, Homo sapien
gcaagatgcacacattctagactgt

SEQ ID NO: 3087 - DNA, 25 bp, Homo sapien
aacaagcaacttctcatcattaaat

SEQ ID NO: 3088 - DNA, 25 bp, Homo sapien
atagcctaatttactctgcttaagc

SEQ ID NO: 3089 - DNA, 25 bp, Homo sapien
gagaactaatctaccgtgtccacag

SEQ ID NO: 3090 - DNA, 25 bp, Homo sapien
taccgtgtccacagaccagtgaatt

SEQ ID NO: 3091 - DNA, 25 bp, Homo sapien
acgtctatggtctaaggcctgcaga

SEQ ID NO: 3092 - DNA, 25 bp, Homo sapien
tttgctcgacagatgaacagtctac

SEQ ID NO: 3093 - DNA, 25 bp, Homo sapien
catgacattcaggagagccaggcac

SEQ ID NO: 3094 - DNA, 25 bp, Homo sapien
gagccaggcaccagaagacccagag

SEQ ID NO: 3095 - DNA, 25 bp, Homo sapien
gacccagagggccagagatcattaa

SEQ ID NO: 3096 - DNA, 25 bp, Homo sapien
aaatctctacgctaaggtggatagg

SEQ ID NO: 3097 - DNA, 25 bp, Homo sapien
tctacgctaaggtggataggactcc

SEQ ID NO: 3098 - DNA, 25 bp, Homo sapien
gctaaggtggataggactccatagt

SEQ ID NO: 3099 - DNA, 25 bp, Homo sapien
cacagcagagtgcatgagccctgga

SEQ ID NO: 3100 - DNA, 25 bp, Homo sapien
agctgtgatcgcacctaggcggcag

SEQ ID NO: 3101 - DNA, 25 bp, Homo sapien
tgatcgcacctaggcggcagtgaga

SEQ ID NO: 3102 - DNA, 25 bp, Homo sapien
acccatgcatgtgagaccagcagtt

SEQ ID NO: 3103 - DNA, 25 bp, Homo sapien
atgcatgtgagaccagcagttccct

SEQ ID NO: 3104 - DNA, 25 bp, Homo sapien
atgtgagaccagcagttccctcttc

SEQ ID NO: 3105 - DNA, 25 bp, Homo sapien
gtgattctctggaagataaatctct

SEQ ID NO: 3106 - DNA, 25 bp, Homo sapien
agataaatctctacgctaaggtgga

SEQ ID NO: 3107 - DNA, 25 bp, Homo sapien
aggtattccgtggtccatggaggct

SEQ ID NO: 3108 - DNA, 25 bp, Homo sapien
catggaggctggtccacttgacaaa

SEQ ID NO: 3109 - DNA, 25 bp, Homo sapien
gctggtccacttgacaaagcttcca

SEQ ID NO: 3110 - DNA, 25 bp, Homo sapien
caaagcttccaaggtcttgtggctt

SEQ ID NO: 3111 - DNA, 25 bp, Homo sapien
aggtcttgtggctttgagtttcttt

SEQ ID NO: 3112 - DNA, 25 bp, Homo sapien
gagtttctttgaccagctgagtttc

SEQ ID NO: 3113 - DNA, 25 bp, Homo sapien
accatccaaggcttccgtaaagctg

SEQ ID NO: 3114 - DNA, 25 bp, Homo sapien
ttccgtaaagctgctagcccagctg

SEQ ID NO: 3115 - DNA, 25 bp, Homo sapien
ctaccatctcggtgtccagactgca

SEQ ID NO: 3116 - DNA, 25 bp, Homo sapien
ggtgtccagactgcacaacctggtg

SEQ ID NO: 3117 - DNA, 25 bp, Homo sapien
ctggtgaaacacttcttggactctt

SEQ ID NO: 3118 - DNA, 25 bp, Homo sapien
ctctggctcaactctgacgctggtg

SEQ ID NO: 3119 - DNA, 25 bp, Homo sapien
ctggctcaactctgacgctggtgct

SEQ ID NO: 3120 - DNA, 25 bp, Homo sapien
tgacgctggtgctcccacgagtggc

SEQ ID NO: 3121 - DNA, 25 bp, Homo sapien
tgtggcatggcacgctgtgttctcc

SEQ ID NO: 3122 - DNA, 25 bp, Homo sapien
tggcacgctgtgttctccccaggga

SEQ ID NO: 3123 - DNA, 25 bp, Homo sapien
cacgctgtgttctccccagggaact

SEQ ID NO: 3124 - DNA, 25 bp, Homo sapien
ggtgaccaaaccagttaagactgat

SEQ ID NO: 3125 - DNA, 25 bp, Homo sapien
gagattcaagatccagctcacttcg

SEQ ID NO: 3126 - DNA, 25 bp, Homo sapien
agctcacttcgcctttgaagaacct

SEQ ID NO: 3127 - DNA, 25 bp, Homo sapien
ttcgcctttgaagaacctccaactt

SEQ ID NO: 3128 - DNA, 25 bp, Homo sapien
tgccatgacagtttataatcaccat

SEQ ID NO: 3129 - DNA, 25 bp, Homo sapien
catgcagagtgagaaggctgagctc

SEQ ID NO: 3130 - DNA, 25 bp, Homo sapien
ggctgagctctggaacaacgtattt

SEQ ID NO: 3131 - DNA, 25 bp, Homo sapien
aacgtatttgtgtcctctgtcaaca

SEQ ID NO: 3132 - DNA, 25 bp, Homo sapien
cagttgaaccaaattctgcttttct

SEQ ID NO: 3133 - DNA, 25 bp, Homo sapien
aatgtatcttgaacagcttccatag

SEQ ID NO: 3134 - DNA, 25 bp, Homo sapien
ttgaacagcttccatagtccttttg

SEQ ID NO: 3135 - DNA, 25 bp, Homo sapien
cttccatagtccttttgtttccaga

SEQ ID NO: 3136 - DNA, 25 bp, Homo sapien
tttgtttccagagcactgagaccca

SEQ ID NO: 3137 - DNA, 25 bp, Homo sapien
cactgagacccaacatgtgacctgg

SEQ ID NO: 3138 - DNA, 25 bp, Homo sapien
tttgagtagcacttaacaggactat

SEQ ID NO: 3139 - DNA, 25 bp, Homo sapien
cgtagtggcaacaaaacgttctttg

SEQ ID NO: 3140 - DNA, 25 bp, Homo sapien
agcccgaggtgggtcccacccgcat

SEQ ID NO: 3141 - DNA, 25 bp, Homo sapien
ccagccctggagaagtagctctggc

SEQ ID NO: 3142 - DNA, 25 bp, Homo sapien
aagtagctctggcttgtcttctttt

SEQ ID NO: 3143 - DNA, 25 bp, Homo sapien
agtagctctggcttgtcttcttttt

SEQ ID NO: 3144 - DNA, 25 bp, Homo sapien
gtagctctggcttgtcttctttttc

SEQ ID NO: 3145 - DNA, 25 bp, Homo sapien
tagctctggcttgtcttctttttca

SEQ ID NO: 3146 - DNA, 25 bp, Homo sapien
agctctggcttgtcttctttttcat

SEQ ID NO: 3147 - DNA, 25 bp, Homo sapien
gctctggcttgtcttctttttcatt

SEQ ID NO: 3148 - DNA, 25 bp, Homo sapien
ataatttatgtatcgactaagaaat

SEQ ID NO: 3149 - DNA, 25 bp, Homo sapien
gaaataataaggtacattcagatgt

SEQ ID NO: 3150 - DNA, 25 bp, Homo sapien
cgggagcccgagtgcgggcggtggc

SEQ ID NO: 3151 - DNA, 25 bp, Homo sapien
tacctctacgcgcagctggacgggc

SEQ ID NO: 3152 - DNA, 25 bp, Homo sapien
aacaccagcagtactgccccggcag

SEQ ID NO: 3153 - DNA, 25 bp, Homo sapien
ggcagctggtgcttcctccgcatgc

SEQ ID NO: 3154 - DNA, 25 bp, Homo sapien
atcttcctctgcaacggctcggtca

SEQ ID NO: 3155 - DNA, 25 bp, Homo sapien
ctgccgcatgtaccgccagcagaag

SEQ ID NO: 3156 - DNA, 25 bp, Homo sapien
gcatgtaccgccagcagaagcgcca

SEQ ID NO: 3157 - DNA, 25 bp, Homo sapien
agaagcgccaccagggctctctggg

SEQ ID NO: 3158 - DNA, 25 bp, Homo sapien
ggccgcgcaccggagaggacgaggt

SEQ ID NO: 3159 - DNA, 25 bp, Homo sapien
tgctggccctcatgacagtggtcat

SEQ ID NO: 3160 - DNA, 25 bp, Homo sapien
tgacagtggtcatggccgtgtgctc

SEQ ID NO: 3161 - DNA, 25 bp, Homo sapien
gtggtcatggccgtgtgctccctgc

SEQ ID NO: 3162 - DNA, 25 bp, Homo sapien
gggtagtgaaagactccttaagcca

SEQ ID NO: 3163 - DNA, 25 bp, Homo sapien
gtagtgaaagactccttaagccaca

SEQ ID NO: 3164 - DNA, 25 bp, Homo sapien
gaaagactccttaagccacaaaaag

SEQ ID NO: 3165 - DNA, 25 bp, Homo sapien
aaagaaatgatgaacatacttgacc

SEQ ID NO: 3166 - DNA, 25 bp, Homo sapien
taaatccataaaccttaagaaagtg

SEQ ID NO: 3167 - DNA, 25 bp, Homo sapien
gtgaaatctaaactacaaactggga

SEQ ID NO: 3168 - DNA, 25 bp, Homo sapien
aatctaaactacaaactgggagaag

SEQ ID NO: 3169 - DNA, 25 bp, Homo sapien
gtctcaagactacatgaagaactct

SEQ ID NO: 3170 - DNA, 25 bp, Homo sapien
gactacatgaagaactctgataaat

SEQ ID NO: 3171 - DNA, 25 bp, Homo sapien
atcaatgagaaaacaacctaatagg

SEQ ID NO: 3172 - DNA, 25 bp, Homo sapien
aaaaaacatgcataggcatttcatg

SEQ ID NO: 3173 - DNA, 25 bp, Homo sapien
gatgccctctgctgatgaaggtgtt

SEQ ID NO: 3174 - DNA, 25 bp, Homo sapien
tggatgtctatttcattccccattc

SEQ ID NO: 3175 - DNA, 25 bp, Homo sapien
ttccccattccaaataggtgccagg

SEQ ID NO: 3176 - DNA, 25 bp, Homo sapien
gacacagattctccaacacacatat

SEQ ID NO: 3177 - DNA, 25 bp, Homo sapien
acacacatatcaggctccgggaagt

SEQ ID NO: 3178 - DNA, 25 bp, Homo sapien
gaagtttccgaagaggtatccattg

SEQ ID NO: 3179 - DNA, 25 bp, Homo sapien
cagagtgctgctcatatttacagga

SEQ ID NO: 3180 - DNA, 25 bp, Homo sapien
atttacaggaggctcagtcaccttc

SEQ ID NO: 3181 - DNA, 25 bp, Homo sapien
gtcataatccttcactggcatatct

SEQ ID NO: 3182 - DNA, 25 bp, Homo sapien
gtgctccttggaactagaaaccctg

SEQ ID NO: 3183 - DNA, 25 bp, Homo sapien
gaaaccctgtcttgttcatcttaac

SEQ ID NO: 3184 - DNA, 25 bp, Homo sapien
ggtgacaagaaattgccctgatcaa

SEQ ID NO: 3185 - DNA, 25 bp, Homo sapien
gaaattgccctgatcaaactgccac

SEQ ID NO: 3186 - DNA, 25 bp, Homo sapien
tgccctgatcaaactgccacagtga

SEQ ID NO: 3187 - DNA, 25 bp, Homo sapien
aaactgccacagtgacacaccatga

SEQ ID NO: 3188 - DNA, 25 bp, Homo sapien
tgccacagtgacacaccatgaaaaa

SEQ ID NO: 3189 - DNA, 25 bp, Homo sapien
tggcaatggcttcatacccaggtca

SEQ ID NO: 3190 - DNA, 25 bp, Homo sapien
aatggcttcatacccaggtcacagg

SEQ ID NO: 3191 - DNA, 25 bp, Homo sapien
ttcatacccaggtcacaggtgcaaa

SEQ ID NO: 3192 - DNA, 25 bp, Homo sapien
tacccaggtcacaggtgcaaatttg

SEQ ID NO: 3193 - DNA, 25 bp, Homo sapien
gtcacaggtgcaaatttggtgcagc

SEQ ID NO: 3194 - DNA, 25 bp, Homo sapien
atttggtgcagcaaagcagcattaa

SEQ ID NO: 3195 - DNA, 25 bp, Homo sapien
gtttggcctgctcattgcattcccc

SEQ ID NO: 3196 - DNA, 25 bp, Homo sapien
gatgtctgctcatgggagaatggca

SEQ ID NO: 3197 - DNA, 25 bp, Homo sapien
ggagaatggcagagggatccccaac

SEQ ID NO: 3198 - DNA, 25 bp, Homo sapien
tggcagagggatccccaacagtcat

SEQ ID NO: 3199 - DNA, 25 bp, Homo sapien
caacagtcattcctgatactcctct

SEQ ID NO: 3200 - DNA, 25 bp, Homo sapien
tctccctgtatcatgtcagcacata

SEQ ID NO: 3201 - DNA, 25 bp, Homo sapien
gcacatagtaggtgtggcctatgta

SEQ ID NO: 3202 - DNA, 25 bp, Homo sapien
tggcctatgtatggcagattcattt

SEQ ID NO: 3203 - DNA, 25 bp, Homo sapien
tgtatggcagattcatttctgcccc

SEQ ID NO: 3204 - DNA, 25 bp, Homo sapien
atctggttatttaagagtctaagac

SEQ ID NO: 3205 - DNA, 25 bp, Homo sapien
tccccatcaccttatgtcatgatct

SEQ ID NO: 3206 - DNA, 25 bp, Homo sapien
gtattagattactcacctatcatat

SEQ ID NO: 3207 - DNA, 25 bp, Homo sapien
ttactcacctatcatatcatttctg

SEQ ID NO: 3208 - DNA, 25 bp, Homo sapien
tatcatatcatttctgatgctgagt

SEQ ID NO: 3209 - DNA, 25 bp, Homo sapien
tctgatgctgagtatgctaattata

SEQ ID NO: 3210 - DNA, 25 bp, Homo sapien
ataagtgatcattttttccgtataa

SEQ ID NO: 3211 - DNA, 25 bp, Homo sapien
tcattttttccgtataaatttgcct

SEQ ID NO: 3212 - DNA, 25 bp, Homo sapien
aaactaggcagaattttatggagaa

SEQ ID NO: 3213 - DNA, 25 bp, Homo sapien
gaaagctgaggctctagaacactta

SEQ ID NO: 3214 - DNA, 25 bp, Homo sapien
gaggctctagaacacttaatttaag

SEQ ID NO: 3215 - DNA, 25 bp, Homo sapien
agtgcatgaacacagcttactgcag

SEQ ID NO: 3216 - DNA, 25 bp, Homo sapien
gtggctgggaccacaagtttgcacc

SEQ ID NO: 3217 - DNA, 25 bp, Homo sapien
tacccctggtaacccatttatggag

SEQ ID NO: 3218 - DNA, 25 bp, Homo sapien
aacccatttatggaggctgccacag

SEQ ID NO: 3219 - DNA, 25 bp, Homo sapien
ggaggctgccacagaaatgctagtt

SEQ ID NO: 3220 - DNA, 25 bp, Homo sapien
gctgccacagaaatgctagttggaa

SEQ ID NO: 3221 - DNA, 25 bp, Homo sapien
ttggaaattttcctccttcagtcta

SEQ ID NO: 3222 - DNA, 25 bp, Homo sapien
aaattttcctccttcagtctatcat

SEQ ID NO: 3223 - DNA, 25 bp, Homo sapien
ttcctccttcagtctatcatgaatt

SEQ ID NO: 3224 - DNA, 25 bp, Homo sapien
cttttgagatgaagtcgcccgggct

SEQ ID NO: 3225 - DNA, 25 bp, Homo sapien
tttgagatgaagtcgcccgggctgc

SEQ ID NO: 3226 - DNA, 25 bp, Homo sapien
actgcactcggctgtaccgtgatta

SEQ ID NO: 3227 - DNA, 25 bp, Homo sapien
gcactcggctgtaccgtgattatta

SEQ ID NO: 3228 - DNA, 25 bp, Homo sapien
gcccggcctcagagtagttcttaaa

SEQ ID NO: 3229 - DNA, 25 bp, Homo sapien
aaatggtaatctagagacaactctt

SEQ ID NO: 3230 - DNA, 25 bp, Homo sapien
gagacaactcttttaggccatcttg

SEQ ID NO: 3231 - DNA, 25 bp, Homo sapien
aggccatcttgctttttctaataat

SEQ ID NO: 3232 - DNA, 25 bp, Homo sapien
aattgatgtgtagatgttcctttta

SEQ ID NO: 3233 - DNA, 25 bp, Homo sapien
gttccttttatattctgtttactca

SEQ ID NO: 3234 - DNA, 25 bp, Homo sapien
ttctgtttactcattgttgacgatt

SEQ ID NO: 3235 - DNA, 25 bp, Homo sapien
ctcattgttgacgattataggttgc

SEQ ID NO: 3236 - DNA, 25 bp, Homo sapien
attataggttgcaatacctgctccc

SEQ ID NO: 3237 - DNA, 25 bp, Homo sapien
ataagaaattccaagtccaagcatg

SEQ ID NO: 3238 - DNA, 25 bp, Homo sapien
attccaagtccaagcatggtggcta

SEQ ID NO: 3239 - DNA, 25 bp, Homo sapien
atgagacaactggaagagtatcagg

SEQ ID NO: 3240 - DNA, 25 bp, Homo sapien
gagtatcaggggatcttgctggcaa

SEQ ID NO: 3241 - DNA, 25 bp, Homo sapien
cttgctggcaaggtgagttagttac

SEQ ID NO: 3242 - DNA, 25 bp, Homo sapien
ggcaaggtgagttagttactttctc

SEQ ID NO: 3243 - DNA, 25 bp, Homo sapien
ttagttactttctccaattctccct

SEQ ID NO: 3244 - DNA, 25 bp, Homo sapien
ttctccaattctccctccttttaag

SEQ ID NO: 3245 - DNA, 25 bp, Homo sapien
tttcaaaaaagacttatttctctat

SEQ ID NO: 3246 - DNA, 25 bp, Homo sapien
tttctctatcaatccagttttcaaa

SEQ ID NO: 3247 - DNA, 25 bp, Homo sapien
tctctatcaatccagttttcaaaac

SEQ ID NO: 3248 - DNA, 25 bp, Homo sapien
gtaagcatttaagatttgcatgggc

SEQ ID NO: 3249 - DNA, 25 bp, Homo sapien
atttgcatgggctggccgggcacag

SEQ ID NO: 3250 - DNA, 25 bp, Homo sapien
tgatagtctgcaaatcatccaggtg

SEQ ID NO: 3251 - DNA, 25 bp, Homo sapien
tagtctgcaaatcatccaggtgaat

SEQ ID NO: 3252 - DNA, 25 bp, Homo sapien
gttattttttggtggttaatgtgat

SEQ ID NO: 3253 - DNA, 25 bp, Homo sapien
gtggttaatgtgataatattgtctt

SEQ ID NO: 3254 - DNA, 25 bp, Homo sapien
taaaaccacaaatgaatttcaggag

SEQ ID NO: 3255 - DNA, 25 bp, Homo sapien
atgaatttcaggagacgaaaccaga

SEQ ID NO: 3256 - DNA, 25 bp, Homo sapien
gggaataatatttacgtggctcaca

SEQ ID NO: 3257 - DNA, 25 bp, Homo sapien
gaataatatttacgtggctcacaaa

SEQ ID NO: 3258 - DNA, 25 bp, Homo sapien
taatatttacgtggctcacaaagac

SEQ ID NO: 3259 - DNA, 25 bp, Homo sapien
ggctcacaaagaccagcaatggatc

SEQ ID NO: 3260 - DNA, 25 bp, Homo sapien
acaaagaccagcaatggatcacttg

SEQ ID NO: 3261 - DNA, 25 bp, Homo sapien
tttataatcagcttgtcaaagttct

SEQ ID NO: 3262 - DNA, 25 bp, Homo sapien
aatcagcttgtcaaagttctgtgaa

SEQ ID NO: 3263 - DNA, 25 bp, Homo sapien
atcagcttgtcaaagttctgtgaac

SEQ ID NO: 3264 - DNA, 25 bp, Homo sapien
agttctgtgaacaaaatgtctgttg

SEQ ID NO: 3265 - DNA, 25 bp, Homo sapien
gggaaattaacatctttagaatata

SEQ ID NO: 3266 - DNA, 25 bp, Homo sapien
ataagttcttcccatctgtggacat

SEQ ID NO: 3267 - DNA, 25 bp, Homo sapien
taagttcttcccatctgtggacatg

SEQ ID NO: 3268 - DNA, 25 bp, Homo sapien
aagttcttcccatctgtggacatgg

SEQ ID NO: 3269 - DNA, 25 bp, Homo sapien
agttcttcccatctgtggacatggt

SEQ ID NO: 3270 - DNA, 25 bp, Homo sapien
gttcttcccatctgtggacatggtg

SEQ ID NO: 3271 - DNA, 25 bp, Homo sapien
ttcttcccatctgtggacatggtgt

SEQ ID NO: 3272 - DNA, 25 bp, Homo sapien
gagggcttctgattggttgagctta

SEQ ID NO: 3273 - DNA, 25 bp, Homo sapien
tgttttcagctttcacaggaggtga

SEQ ID NO: 3274 - DNA, 25 bp, Homo sapien
ggtgaactctgccaagacctgtgca

SEQ ID NO: 3275 - DNA, 25 bp, Homo sapien
gacctgtgcagtgaggaagtcccca

SEQ ID NO: 3276 - DNA, 25 bp, Homo sapien
aaggaggtcagatgccagactggca

SEQ ID NO: 3277 - DNA, 25 bp, Homo sapien
aagtttgccagcttgtgggattgtc

SEQ ID NO: 3278 - DNA, 25 bp, Homo sapien
atctgcatttaaaccagcaccctgg

SEQ ID NO: 3279 - DNA, 25 bp, Homo sapien
tggaaattcccatgcaggtgctgcc

SEQ ID NO: 3280 - DNA, 25 bp, Homo sapien
aggtgctgcctgaaccacatttgca

SEQ ID NO: 3281 - DNA, 25 bp, Homo sapien
atttgcatccattgcttgaactggt

SEQ ID NO: 3282 - DNA, 25 bp, Homo sapien
accccgtctcactagaaatgcaaaa

SEQ ID NO: 3283 - DNA, 25 bp, Homo sapien
ctgacagaacatcagaagtatatct

SEQ ID NO: 3284 - DNA, 25 bp, Homo sapien
atgaagaattacagcaagacatgca

SEQ ID NO: 3285 - DNA, 25 bp, Homo sapien
aagtttaagaatgaggtcaacacat

SEQ ID NO: 3286 - DNA, 25 bp, Homo sapien
gaggtcaacacattagaagaagagt

SEQ ID NO: 3287 - DNA, 25 bp, Homo sapien
aatgttcaacttcataaagaggttg

SEQ ID NO: 3288 - DNA, 25 bp, Homo sapien
gaagcacagaagtaatagcacagaa

SEQ ID NO: 3289 - DNA, 25 bp, Homo sapien
cacagaattatcaggaaccctaact

SEQ ID NO: 3290 - DNA, 25 bp, Homo sapien
atgatggactaaatcagcagattcc

SEQ ID NO: 3291 - DNA, 25 bp, Homo sapien
aatcagcagattcctaggaaggaaa

SEQ ID NO: 3292 - DNA, 25 bp, Homo sapien
gcctatagcagcgtttaacaggaga

SEQ ID NO: 3293 - DNA, 25 bp, Homo sapien
tagcagcgtttaacaggagacaatt

SEQ ID NO: 3294 - DNA, 25 bp, Homo sapien
taaagctgtctttctcaatggcaaa

SEQ ID NO: 3295 - DNA, 25 bp, Homo sapien
aagggcatactgctgttattgtcag

SEQ ID NO: 3296 - DNA, 25 bp, Homo sapien
ggatcagcgtaaagtaaaccaacat

SEQ ID NO: 3297 - DNA, 25 bp, Homo sapien
agagacagcccctggtttacaaaca

SEQ ID NO: 3298 - DNA, 25 bp, Homo sapien
tacaaacacctgacttaagcatcgt

SEQ ID NO: 3299 - DNA, 25 bp, Homo sapien
ttaagcatcgtccatcctacaggta

SEQ ID NO: 3300 - DNA, 25 bp, Homo sapien
ggtaaattcctcattcttactgctg

SEQ ID NO: 3301 - DNA, 25 bp, Homo sapien
tcttactgctgtgagaacaattgtt

SEQ ID NO: 3302 - DNA, 25 bp, Homo sapien
tgttaggagccaaaaacttcagagc

SEQ ID NO: 3303 - DNA, 25 bp, Homo sapien
acttcagagctttcaaagaactgta

SEQ ID NO: 3304 - DNA, 25 bp, Homo sapien
aaagccagtgttaacggagcaagaa

SEQ ID NO: 3305 - DNA, 25 bp, Homo sapien
tgcccaactggctggccgcagtggc

SEQ ID NO: 3306 - DNA, 25 bp, Homo sapien
gccgcagtggctcaggcgggtaatc

SEQ ID NO: 3307 - DNA, 25 bp, Homo sapien
tagtgaggccccacctctacctaga

SEQ ID NO: 3308 - DNA, 25 bp, Homo sapien
agtgaggccccacctctacctagaa

SEQ ID NO: 3309 - DNA, 25 bp, Homo sapien
gtgaggccccacctctacctagaat

SEQ ID NO: 3310 - DNA, 25 bp, Homo sapien
tgaggccccacctctacctagaata

SEQ ID NO: 3311 - DNA, 25 bp, Homo sapien
ccacctctacctagaatacaaaaat

SEQ ID NO: 3312 - DNA, 25 bp, Homo sapien
aatcagctggttgtggtgttaccct

SEQ ID NO: 3313 - DNA, 25 bp, Homo sapien
ggttgtggtgttaccctcctgtggt

SEQ ID NO: 3314 - DNA, 25 bp, Homo sapien
aagatctcaaatcagtcacctaact

SEQ ID NO: 3315 - DNA, 25 bp, Homo sapien
gaactaaacccaagctagcagaata

SEQ ID NO: 3316 - DNA, 25 bp, Homo sapien
ggaaattcatccagcttggagactt

SEQ ID NO: 3317 - DNA, 25 bp, Homo sapien
cttccaatcccttcattgtgcagaa

SEQ ID NO: 3318 - DNA, 25 bp, Homo sapien
gtgcagaaggttgctaatgctctca

SEQ ID NO: 3319 - DNA, 25 bp, Homo sapien
aatgctctcaggagaagcccttcac

SEQ ID NO: 3320 - DNA, 25 bp, Homo sapien
gaatacttccacatagagtcctctc

SEQ ID NO: 3321 - DNA, 25 bp, Homo sapien
gagtcctctccattgagactaagga

SEQ ID NO: 3322 - DNA, 25 bp, Homo sapien
atgtcatgtagccacagcagccttt

SEQ ID NO: 3323 - DNA, 25 bp, Homo sapien
cagcagcctttgcagctgttgaagg

SEQ ID NO: 3324 - DNA, 25 bp, Homo sapien
gaaccaagactcatatccagttata

SEQ ID NO: 3325 - DNA, 25 bp, Homo sapien
tgggacacacactcatcaggcttag

SEQ ID NO: 3326 - DNA, 25 bp, Homo sapien
gagggaaccatactcagccctaggg

SEQ ID NO: 3327 - DNA, 25 bp, Homo sapien
agtatcttctctcttacctatttga

SEQ ID NO: 3328 - DNA, 25 bp, Homo sapien
ctatttgagcccctctagctacagt

SEQ ID NO: 3329 - DNA, 25 bp, Homo sapien
ccctctagctacagtctggcttaaa

SEQ ID NO: 3330 - DNA, 25 bp, Homo sapien
gcccagatctcctcttaagcggaaa

SEQ ID NO: 3331 - DNA, 25 bp, Homo sapien
gggcagctgcaaagcgttctcccta

SEQ ID NO: 3332 - DNA, 25 bp, Homo sapien
aagcgttctccctaggacagatgga

SEQ ID NO: 3333 - DNA, 25 bp, Homo sapien
cctaggacagatggagcctcccttt

SEQ ID NO: 3334 - DNA, 25 bp, Homo sapien
tttcctcatctactctgtgggtggt

SEQ ID NO: 3335 - DNA, 25 bp, Homo sapien
actctgtgggtggtttcagggccca

SEQ ID NO: 3336 - DNA, 25 bp, Homo sapien
cagggcccacgagtcaacatgagga

SEQ ID NO: 3337 - DNA, 25 bp, Homo sapien
gctgggctggctgattcacagtgac

SEQ ID NO: 3338 - DNA, 25 bp, Homo sapien
gggccagcactattccatgcttaga

SEQ ID NO: 3339 - DNA, 25 bp, Homo sapien
ggccagcactattccatgcttagag

SEQ ID NO: 3340 - DNA, 25 bp, Homo sapien
gcactattccatgcttagaggctcc

SEQ ID NO: 3341 - DNA, 25 bp, Homo sapien
atgcttagaggctccatcaatacct

SEQ ID NO: 3342 - DNA, 25 bp, Homo sapien
gcttagaggctccatcaatacctgt

SEQ ID NO: 3343 - DNA, 25 bp, Homo sapien
ttagaggctccatcaatacctgtta

SEQ ID NO: 3344 - DNA, 25 bp, Homo sapien
agaggctccatcaatacctgttatg

SEQ ID NO: 3345 - DNA, 25 bp, Homo sapien
gaggctccatcaatacctgttatgg

SEQ ID NO: 3346 - DNA, 25 bp, Homo sapien
atacctgttatggactaaatggcac

SEQ ID NO: 3347 - DNA, 25 bp, Homo sapien
cctgttatggactaaatggcacggt

SEQ ID NO: 3348 - DNA, 25 bp, Homo sapien
tatggactaaatggcacggtggctc

SEQ ID NO: 3349 - DNA, 25 bp, Homo sapien
ttatggagtcagtggctagattgat

SEQ ID NO: 3350 - DNA, 25 bp, Homo sapien
ggctagattgattgatcctccagaa

SEQ ID NO: 3351 - DNA, 25 bp, Homo sapien
gatcctccagaattagacactcaca

SEQ ID NO: 3352 - DNA, 25 bp, Homo sapien
attagacactcacatgttaacacca

SEQ ID NO: 3353 - DNA, 25 bp, Homo sapien
ccatgcccatggagcttctcaagga

SEQ ID NO: 3354 - DNA, 25 bp, Homo sapien
aaggaagctgtcactcatctgatca

SEQ ID NO: 3355 - DNA, 25 bp, Homo sapien
actcatctgatcacagccattcaca

SEQ ID NO: 3356 - DNA, 25 bp, Homo sapien
atggacacagtgaccatgggcatgg

SEQ ID NO: 3357 - DNA, 25 bp, Homo sapien
ttggcagcattggtgtgatcgtatc

SEQ ID NO: 3358 - DNA, 25 bp, Homo sapien
gatcgtatccacagttcttatagag

SEQ ID NO: 3359 - DNA, 25 bp, Homo sapien
gatggttcatcgctgacccactctg

SEQ ID NO: 3360 - DNA, 25 bp, Homo sapien
gttggtcatgcaattcaaatattaa

SEQ ID NO: 3361 - DNA, 25 bp, Homo sapien
gaatcttgtaatgcatctggtttaa

SEQ ID NO: 3362 - DNA, 25 bp, Homo sapien
gcatctggtttaatacctgtcattt

SEQ ID NO: 3363 - DNA, 25 bp, Homo sapien
ggtttaatacctgtcattttgtaga

SEQ ID NO: 3364 - DNA, 25 bp, Homo sapien
ttcccaaggtcatacacctaatcag

SEQ ID NO: 3365 - DNA, 25 bp, Homo sapien
ggtcatacacctaatcagtggtata

SEQ ID NO: 3366 - DNA, 25 bp, Homo sapien
tgtgttctgactttgttgattcaaa

SEQ ID NO: 3367 - DNA, 25 bp, Homo sapien
atttgctatgtgttgttcttacatc

SEQ ID NO: 3368 - DNA, 25 bp, Homo sapien
cattgattcatgtaagtagacttgt

SEQ ID NO: 3369 - DNA, 25 bp, Homo sapien
gacttgtgtgacagctaattcttaa

SEQ ID NO: 3370 - DNA, 25 bp, Homo sapien
gaagatgttagacttcttttgatat

SEQ ID NO: 3371 - DNA, 25 bp, Homo sapien
gtgattcagatgcacagccaggttt

SEQ ID NO: 3372 - DNA, 25 bp, Homo sapien
gatgcacagccaggtttggaaattt

SEQ ID NO: 3373 - DNA, 25 bp, Homo sapien
accttggaagagagtcacattgcct

SEQ ID NO: 3374 - DNA, 25 bp, Homo sapien
gtgagtatcaaagaagacgctgcag

SEQ ID NO: 3375 - DNA, 25 bp, Homo sapien
gacgctgcaggtaaagtctttaggg

SEQ ID NO: 3376 - DNA, 25 bp, Homo sapien
ggtaaagtctttagggccagccagg

SEQ ID NO: 3377 - DNA, 25 bp, Homo sapien
tctttagggccagccaggcgtagtg

SEQ ID NO: 3378 - DNA, 25 bp, Homo sapien
ggacacattcccaaacctaactagg

SEQ ID NO: 3379 - DNA, 25 bp, Homo sapien
ttttttattcatcctagaccttcat

SEQ ID NO: 3380 - DNA, 25 bp, Homo sapien
ttcatcctagaccttcataagtcag

SEQ ID NO: 3381 - DNA, 25 bp, Homo sapien
gaccttcataagtcagaatcatctg

SEQ ID NO: 3382 - DNA, 25 bp, Homo sapien
aagaaattagtaagcagcaccccaa

SEQ ID NO: 3383 - DNA, 25 bp, Homo sapien
accccaaagcaattacacccagaag

SEQ ID NO: 3384 - DNA, 25 bp, Homo sapien
gaagattacctttgactcttgtccc

SEQ ID NO: 3385 - DNA, 25 bp, Homo sapien
ggtttctataatccaggaacttgtt

SEQ ID NO: 3386 - DNA, 25 bp, Homo sapien
gaagcctctcttaaaacgtgtgact

SEQ ID NO: 3387 - DNA, 25 bp, Homo sapien
acgtgtgacttttttagcccatatg

SEQ ID NO: 3388 - DNA, 25 bp, Homo sapien
gacaacactactctgggttcagtat

SEQ ID NO: 3389 - DNA, 25 bp, Homo sapien
tcagtatttcctggcacagcacttt

SEQ ID NO: 3390 - DNA, 25 bp, Homo sapien
gcactttgataaacttggacagtat

SEQ ID NO: 3391 - DNA, 25 bp, Homo sapien
gacagtattctttggctttggatta

SEQ ID NO: 3392 - DNA, 25 bp, Homo sapien
gcaattgctagtactccaactctaa

SEQ ID NO: 3393 - DNA, 25 bp, Homo sapien
gggtgaattgtttagggtgacacaa

SEQ ID NO: 3394 - DNA, 25 bp, Homo sapien
tagggtgacacaaacaatattgcag

SEQ ID NO: 3395 - DNA, 25 bp, Homo sapien
aatattgcagtctcgagtctgtcct

SEQ ID NO: 3396 - DNA, 25 bp, Homo sapien
tgcagtctcgagtctgtccttgaac

SEQ ID NO: 3397 - DNA, 25 bp, Homo sapien
tcgagtctgtccttgaaccttgttt

SEQ ID NO: 3398 - DNA, 25 bp, Homo sapien
tttcttaatcctataatggggccaa

SEQ ID NO: 3399 - DNA, 25 bp, Homo sapien
gggccaatatcctagagcgctgctg

SEQ ID NO: 3400 - DNA, 25 bp, Homo sapien
gccaatatcctagagcgctgctgta

SEQ ID NO: 3401 - DNA, 25 bp, Homo sapien
tatcctagagcgctgctgtaagaat

SEQ ID NO: 3402 - DNA, 25 bp, Homo sapien
tagagcgctgctgtaagaataaaat

SEQ ID NO: 3403 - DNA, 25 bp, Homo sapien
gcacttagtgtaatacctggcacat

SEQ ID NO: 3404 - DNA, 25 bp, Homo sapien
actaggactgttgaattaggaaatc

SEQ ID NO: 3405 - DNA, 25 bp, Homo sapien
ggaaatcatatctattatctgctaa

SEQ ID NO: 3406 - DNA, 25 bp, Homo sapien
attatctgctaattgctggagactt

SEQ ID NO: 3407 - DNA, 25 bp, Homo sapien
ggtttgaatatgtcacaaggtcttt

SEQ ID NO: 3408 - DNA, 25 bp, Homo sapien
gttctctattctgtagtgctgtaca

SEQ ID NO: 3409 - DNA, 25 bp, Homo sapien
attctgtagtgctgtacatttttgt

SEQ ID NO: 3410 - DNA, 25 bp, Homo sapien
aatgtgttgcatgtactccagtgtt

SEQ ID NO: 3411 - DNA, 25 bp, Homo sapien
gttgcatgtactccagtgtttgtgt

SEQ ID NO: 3412 - DNA, 25 bp, Homo sapien
gcatgtactccagtgtttgtgtatt

SEQ ID NO: 3413 - DNA, 25 bp, Homo sapien
tccagtgtttgtgtatttataatct

SEQ ID NO: 3414 - DNA, 25 bp, Homo sapien
taatcttatttgcatcatgatgatg

SEQ ID NO: 3415 - DNA, 25 bp, Homo sapien
gatttatgtcattttagttcacaca

SEQ ID NO: 3416 - DNA, 25 bp, Homo sapien
tagttcacacaactctgtctgccag

SEQ ID NO: 3417 - DNA, 25 bp, Homo sapien
tgtctgccagcatcattaacttacc

SEQ ID NO: 3418 - DNA, 25 bp, Homo sapien
agcatcattaacttacctaacttgt

SEQ ID NO: 3419 - DNA, 25 bp, Homo sapien
caaaaatgctaacagcaccactgag

SEQ ID NO: 3420 - DNA, 25 bp, Homo sapien
gcaccactgagaccttgctagtcta

SEQ ID NO: 3421 - DNA, 25 bp, Homo sapien
gaccttgctagtctaagtgtgcttt

SEQ ID NO: 3422 - DNA, 25 bp, Homo sapien
tctaagtgtgctttggagaccattg

SEQ ID NO: 3423 - DNA, 25 bp, Homo sapien
gaccattggcatcagcaccatttag

SEQ ID NO: 3424 - DNA, 25 bp, Homo sapien
cagcaccatttaggcacttgttaga

SEQ ID NO: 3425 - DNA, 25 bp, Homo sapien
tagaatgtagagtctccgggccagg

SEQ ID NO: 3426 - DNA, 25 bp, Homo sapien
atcctgtctgaaaggtttggagcag

SEQ ID NO: 3427 - DNA, 25 bp, Homo sapien
aaaggtttggagcagcttgttgaaa

SEQ ID NO: 3428 - DNA, 25 bp, Homo sapien
gattctgtgttttaagttgtggcta

SEQ ID NO: 3429 - DNA, 25 bp, Homo sapien
ggctaaggtagaatcatccatgatg

SEQ ID NO: 3430 - DNA, 25 bp, Homo sapien
tcctggacttaaacatctgtatctg

SEQ ID NO: 3431 - DNA, 25 bp, Homo sapien
catctgtatctgacgtgtgggtaat

SEQ ID NO: 3432 - DNA, 25 bp, Homo sapien
gtgtgggtaattatattgctatcct

SEQ ID NO: 3433 - DNA, 25 bp, Homo sapien
atattgctatcctacacctttgacc

SEQ ID NO: 3434 - DNA, 25 bp, Homo sapien
tgagagagtctgcaacacaaggaaa

SEQ ID NO: 3435 - DNA, 25 bp, Homo sapien
acaaggaaaacatagagccatcatt

SEQ ID NO: 3436 - DNA, 25 bp, Homo sapien
catagagccatcatttagtaaatca

SEQ ID NO: 3437 - DNA, 25 bp, Homo sapien
gaaaggccagagatatgcaacagct

SEQ ID NO: 3438 - DNA, 25 bp, Homo sapien
gagatatgcaacagcttttcaaaga

SEQ ID NO: 3439 - DNA, 25 bp, Homo sapien
ggaacaagatgtcctggttaaatct

SEQ ID NO: 3440 - DNA, 25 bp, Homo sapien
tgtcctggttaaatctagggtgacc

SEQ ID NO: 3441 - DNA, 25 bp, Homo sapien
taacctgttatgacagactgtgccc

SEQ ID NO: 3442 - DNA, 25 bp, Homo sapien
gactgtgcccttatccagaatgaag

SEQ ID NO: 3443 - DNA, 25 bp, Homo sapien
tgaagtagactgtgtcatttccaaa

SEQ ID NO: 3444 - DNA, 25 bp, Homo sapien
gttgtagcaatggatctgccatctc

SEQ ID NO: 3445 - DNA, 25 bp, Homo sapien
gatctgccatctctgacagggatga

SEQ ID NO: 3446 - DNA, 25 bp, Homo sapien
caagggaaagatccatgcccaattt

SEQ ID NO: 3447 - DNA, 25 bp, Homo sapien
gatccatgcccaattttatcttcct

SEQ ID NO: 3448 - DNA, 25 bp, Homo sapien
aaactgacacaagcccatgtaccag

SEQ ID NO: 3449 - DNA, 25 bp, Homo sapien
cagcagccaattggatctttttttt

SEQ ID NO: 3450 - DNA, 25 bp, Homo sapien
aggcgtgaaccaccaattggatctt

SEQ ID NO: 3451 - DNA, 25 bp, Homo sapien
attggatctttactggacccctaca

SEQ ID NO: 3452 - DNA, 25 bp, Homo sapien
tactggacccctacagggcactgag

SEQ ID NO: 3453 - DNA, 25 bp, Homo sapien
cactgagctagggaatgttggagat

SEQ ID NO: 3454 - DNA, 25 bp, Homo sapien
tgaatcagatagcagcccaaccctg

SEQ ID NO: 3455 - DNA, 25 bp, Homo sapien
agcccaaccctgagatacaactgag

SEQ ID NO: 3456 - DNA, 25 bp, Homo sapien
aaccctgagatacaactgagctaca

SEQ ID NO: 3457 - DNA, 25 bp, Homo sapien
ctgagctacaggcaagaggatacta

SEQ ID NO: 3458 - DNA, 25 bp, Homo sapien
gcaagaggatactaccgggcgcagt

SEQ ID NO: 3459 - DNA, 25 bp, Homo sapien
gtcgcaagttctatttgtgcctcgt

SEQ ID NO: 3460 - DNA, 25 bp, Homo sapien
cgcaagttctatttgtgcctcgttg

SEQ ID NO: 3461 - DNA, 25 bp, Homo sapien
gcaagttctatttgtgcctcgttgt

SEQ ID NO: 3462 - DNA, 25 bp, Homo sapien
caagttctatttgtgcctcgttgtc

SEQ ID NO: 3463 - DNA, 25 bp, Homo sapien
aagttctatttgtgcctcgttgtct

SEQ ID NO: 3464 - DNA, 25 bp, Homo sapien
agttctatttgtgcctcgttgtctg

SEQ ID NO: 3465 - DNA, 25 bp, Homo sapien
ttctatttgtgcctcgttgtctgcc

SEQ ID NO: 3466 - DNA, 25 bp, Homo sapien
tatttgtgcctcgttgtctgcctcc

SEQ ID NO: 3467 - DNA, 25 bp, Homo sapien
tgtgcctcgttgtctgcctcctggg

SEQ ID NO: 3468 - DNA, 25 bp, Homo sapien
gcaggaccaagtagagataattgaa

SEQ ID NO: 3469 - DNA, 25 bp, Homo sapien
tttgctcagtatcactctccctcct

SEQ ID NO: 3470 - DNA, 25 bp, Homo sapien
ggcctctgcaacatgaggttatggg

SEQ ID NO: 3471 - DNA, 25 bp, Homo sapien
acatcatgatccctactggcagaaa

SEQ ID NO: 3472 - DNA, 25 bp, Homo sapien
gcagaaagagcagagccccagagtg

SEQ ID NO: 3473 - DNA, 25 bp, Homo sapien
gggtcagtgtcttttctgagatatt

SEQ ID NO: 3474 - DNA, 25 bp, Homo sapien
ttttctgagatattcctcggaacca

SEQ ID NO: 3475 - DNA, 25 bp, Homo sapien
tattcctcggaaccacatttaaatt

SEQ ID NO: 3476 - DNA, 25 bp, Homo sapien
aattctttttcatattgtttgcata

SEQ ID NO: 3477 - DNA, 25 bp, Homo sapien
ataataattgccttctagtgcctac

SEQ ID NO: 3478 - DNA, 25 bp, Homo sapien
tatggatttaacacagcctctggca

SEQ ID NO: 3479 - DNA, 25 bp, Homo sapien
acagcctctggcacaagtctaaatg

SEQ ID NO: 3480 - DNA, 25 bp, Homo sapien
gaaggctcagttccttgatttaggt

SEQ ID NO: 3481 - DNA, 25 bp, Homo sapien
gaggtgttgcccgttttgaccatgg

SEQ ID NO: 3482 - DNA, 25 bp, Homo sapien
gttgcccgttttgaccatggtgtaa

SEQ ID NO: 3483 - DNA, 25 bp, Homo sapien
accatggtgtaattgctgttgtcta

SEQ ID NO: 3484 - DNA, 25 bp, Homo sapien
ggtgtaattgctgttgtctaatcca

SEQ ID NO: 3485 - DNA, 25 bp, Homo sapien
gctgttgtctaatccaaagagtaac

SEQ ID NO: 3486 - DNA, 25 bp, Homo sapien
gagtaacactgagctcatattttga

SEQ ID NO: 3487 - DNA, 25 bp, Homo sapien
attacctgcaactttgaaaggtctg

SEQ ID NO: 3488 - DNA, 25 bp, Homo sapien
gcaactttgaaaggtctgtctgcat

SEQ ID NO: 3489 - DNA, 25 bp, Homo sapien
aaaggtctgtctgcatttagatggt

SEQ ID NO: 3490 - DNA, 25 bp, Homo sapien
gtctgcatttagatggtaacgctca

SEQ ID NO: 3491 - DNA, 25 bp, Homo sapien
gatggtaacgctcattataaatatt

SEQ ID NO: 3492 - DNA, 25 bp, Homo sapien
gccaggacctatttttattgtagac

SEQ ID NO: 3493 - DNA, 25 bp, Homo sapien
gaaagctagtactattcctgcaaaa

SEQ ID NO: 3494 - DNA, 25 bp, Homo sapien
aaatgccaaagccaagatgcgatga

SEQ ID NO: 3495 - DNA, 25 bp, Homo sapien
ctacagatttgttgatggaagggcc

SEQ ID NO: 3496 - DNA, 25 bp, Homo sapien
ggtcctgcttttgtatggcaaagtc

SEQ ID NO: 3497 - DNA, 25 bp, Homo sapien
gcaagtattcttttctacactgttc

SEQ ID NO: 3498 - DNA, 25 bp, Homo sapien
ggaattccctttgcaaagaccatgt

SEQ ID NO: 3499 - DNA, 25 bp, Homo sapien
ccctttgcaaagaccatgtatccca

SEQ ID NO: 3500 - DNA, 25 bp, Homo sapien
catgtatcccaattcttgcctagat

SEQ ID NO: 3501 - DNA, 25 bp, Homo sapien
cccaattcttgcctagattatgagc

SEQ ID NO: 3502 - DNA, 25 bp, Homo sapien
atagtaaatatagccagttgccctg

SEQ ID NO: 3503 - DNA, 25 bp, Homo sapien
aaagccgggcttattgctttcggca

SEQ ID NO: 3504 - DNA, 25 bp, Homo sapien
cgggcttattgctttcggcagtaag

SEQ ID NO: 3505 - DNA, 25 bp, Homo sapien
gggtttgtttgatggtgctatcaga

SEQ ID NO: 3506 - DNA, 25 bp, Homo sapien
aaaggcaaggccagattactgaaaa

SEQ ID NO: 3507 - DNA, 25 bp, Homo sapien
actgaaaatttgcagcttggtttaa

SEQ ID NO: 3508 - DNA, 25 bp, Homo sapien
aagtccgtttttgacagggcttgat

SEQ ID NO: 3509 - DNA, 25 bp, Homo sapien
acagggcttgataaggattgggtta

SEQ ID NO: 3510 - DNA, 25 bp, Homo sapien
gggcataaactgttggtgcttccta

SEQ ID NO: 3511 - DNA, 25 bp, Homo sapien
gtgcttcctattgaagtgttaacgg

SEQ ID NO: 3512 - DNA, 25 bp, Homo sapien
ggtcttttgggaagtttccataatg

SEQ ID NO: 3513 - DNA, 25 bp, Homo sapien
gaagtttccataatgagcaattcat

SEQ ID NO: 3514 - DNA, 25 bp, Homo sapien
aaagcggatgtttaacttcacccat

SEQ ID NO: 3515 - DNA, 25 bp, Homo sapien
gcggatgtttaacttcacccattat

SEQ ID NO: 3516 - DNA, 25 bp, Homo sapien
ggatgtttaacttcacccattattt

SEQ ID NO: 3517 - DNA, 25 bp, Homo sapien
cccctttttcaatacatgggatggg

SEQ ID NO: 3518 - DNA, 25 bp, Homo sapien
gctcctcagtgtgagctctagcttt

SEQ ID NO: 3519 - DNA, 25 bp, Homo sapien
tcagtgtgagctctagctttgcctt

SEQ ID NO: 3520 - DNA, 25 bp, Homo sapien
tgtgagctctagctttgcctttgac

SEQ ID NO: 3521 - DNA, 25 bp, Homo sapien
gagctctagctttgcctttgactgt

SEQ ID NO: 3522 - DNA, 25 bp, Homo sapien
tctagctttgcctttgactgttttt

SEQ ID NO: 3523 - DNA, 25 bp, Homo sapien
agctttgcctttgactgtttttgtt

SEQ ID NO: 3524 - DNA, 25 bp, Homo sapien
attacacatgtggaatattttagaa

SEQ ID NO: 3525 - DNA, 25 bp, Homo sapien
gagggaaatggaaatacttcaagaa

SEQ ID NO: 3526 - DNA, 25 bp, Homo sapien
tcttcagaagtaaaggtattgcatc

SEQ ID NO: 3527 - DNA, 25 bp, Homo sapien
aagtaaaggtattgcatctttgaaa

SEQ ID NO: 3528 - DNA, 25 bp, Homo sapien
tgcccagaaaacaagagcttctaga

SEQ ID NO: 3529 - DNA, 25 bp, Homo sapien
tattaaattcttagagggttggaag

SEQ ID NO: 3530 - DNA, 25 bp, Homo sapien
cacttgcatgcacgttcaacatatg

SEQ ID NO: 3531 - DNA, 25 bp, Homo sapien
ttgcatgcacgttcaacatatgaaa

SEQ ID NO: 3532 - DNA, 25 bp, Homo sapien
gcagggcatgttggtatgcacccgt

SEQ ID NO: 3533 - DNA, 25 bp, Homo sapien
agggcatgttggtatgcacccgtaa

SEQ ID NO: 3534 - DNA, 25 bp, Homo sapien
cccgtaatcccagcaaatcgcttga

SEQ ID NO: 3535 - DNA, 25 bp, Homo sapien
ccgaggtggcgctactgtgctccag

SEQ ID NO: 3536 - DNA, 25 bp, Homo sapien
taaatttgtttgctcactcctttct

SEQ ID NO: 3537 - DNA, 25 bp, Homo sapien
aatttgtttgctcactcctttctta

SEQ ID NO: 3538 - DNA, 25 bp, Homo sapien
ttgtttgctcactcctttcttaaag

SEQ ID NO: 3539 - DNA, 25 bp, Homo sapien
gtttgctcactcctttcttaaagca

SEQ ID NO: 3540 - DNA, 25 bp, Homo sapien
gctcactcctttcttaaagcaacag

SEQ ID NO: 3541 - DNA, 25 bp, Homo sapien
ctttcttaaagcaacagccgatcat

SEQ ID NO: 3542 - DNA, 25 bp, Homo sapien
aaagcaacagccgatcattcgtgga

SEQ ID NO: 3543 - DNA, 25 bp, Homo sapien
gcaacagccgatcattcgtggaata

SEQ ID NO: 3544 - DNA, 25 bp, Homo sapien
acagccgatcattcgtggaatattt

SEQ ID NO: 3545 - DNA, 25 bp, Homo sapien
cgtggaatatttggaatctcattat

SEQ ID NO: 3546 - DNA, 25 bp, Homo sapien
tattcttttaatggatagttctttc

SEQ ID NO: 3547 - DNA, 25 bp, Homo sapien
gagaagccactttattccctgtgga

SEQ ID NO: 3548 - DNA, 25 bp, Homo sapien
gaggatgctaggatgttgctgctcc

SEQ ID NO: 3549 - DNA, 25 bp, Homo sapien
ggatgttgctgctccggcagacaga

SEQ ID NO: 3550 - DNA, 25 bp, Homo sapien
gcagacagaggcctttcgcttgagt

SEQ ID NO: 3551 - DNA, 25 bp, Homo sapien
tttcgcttgagtcatcagccaacag

SEQ ID NO: 3552 - DNA, 25 bp, Homo sapien
tagaaacccatacacaaagttgagt

SEQ ID NO: 3553 - DNA, 25 bp, Homo sapien
atttttaaaacacccacctgcatgt

SEQ ID NO: 3554 - DNA, 25 bp, Homo sapien
aacacccacctgcatgtaatacaca

SEQ ID NO: 3555 - DNA, 25 bp, Homo sapien
ccatcccagaggctcaaccaaataa

SEQ ID NO: 3556 - DNA, 25 bp, Homo sapien
ggctgggtccttttaagcactggta

SEQ ID NO: 3557 - DNA, 25 bp, Homo sapien
agcactggtaatttctacctgtaat

SEQ ID NO: 3558 - DNA, 25 bp, Homo sapien
tcaccacttgtatcattggctggca

SEQ ID NO: 3559 - DNA, 25 bp, Homo sapien
accacttgtatcattggctggcaat

SEQ ID NO: 3560 - DNA, 25 bp, Homo sapien
acttgtatcattggctggcaatacc

SEQ ID NO: 3561 - DNA, 25 bp, Homo sapien
gtatcattggctggcaatacctggt

SEQ ID NO: 3562 - DNA, 25 bp, Homo sapien
atcattggctggcaatacctggttt

SEQ ID NO: 3563 - DNA, 25 bp, Homo sapien
attggctggcaatacctggtttgtc

SEQ ID NO: 3564 - DNA, 25 bp, Homo sapien
ggctggcaatacctggtttgtcata

SEQ ID NO: 3565 - DNA, 25 bp, Homo sapien
ggcaatacctggtttgtcatagttt

SEQ ID NO: 3566 - DNA, 25 bp, Homo sapien
caatacctggtttgtcatagtttca

SEQ ID NO: 3567 - DNA, 25 bp, Homo sapien
gtttcacattaccttaaacagatgc

SEQ ID NO: 3568 - DNA, 25 bp, Homo sapien
acattaccttaaacagatgcccaga

SEQ ID NO: 3569 - DNA, 25 bp, Homo sapien
gtttttgaaacctgactatacttgg

SEQ ID NO: 3570 - DNA, 25 bp, Homo sapien
gaaacctgactatacttggagtctt

SEQ ID NO: 3571 - DNA, 25 bp, Homo sapien
actatacttggagtcttgggaacac

SEQ ID NO: 3572 - DNA, 25 bp, Homo sapien
acttggagtcttgggaacacatctt

SEQ ID NO: 3573 - DNA, 25 bp, Homo sapien
gagtcttgggaacacatcttacagt

SEQ ID NO: 3574 - DNA, 25 bp, Homo sapien
acatcttacagtgtttcctcacact

SEQ ID NO: 3575 - DNA, 25 bp, Homo sapien
cagtgtttcctcacactgtgagata

SEQ ID NO: 3576 - DNA, 25 bp, Homo sapien
cactgtgagataaaatggctacttt

SEQ ID NO: 3577 - DNA, 25 bp, Homo sapien
taaggtgaggctttgtttattccta

SEQ ID NO: 3578 - DNA, 25 bp, Homo sapien
gaaaaatgtgagtcccagcactttg

SEQ ID NO: 3579 - DNA, 25 bp, Homo sapien
agccgagatcagatcacgacactgc

SEQ ID NO: 3580 - DNA, 25 bp, Homo sapien
acttcccagaagttgagaggcctga

SEQ ID NO: 3581 - DNA, 25 bp, Homo sapien
taaaaaccgatttcaaatcctgcct

SEQ ID NO: 3582 - DNA, 25 bp, Homo sapien
ggaacctgctcaggaggtcctggaa

SEQ ID NO: 3583 - DNA, 25 bp, Homo sapien
ctctcatcgcctgtctttattaaat

SEQ ID NO: 3584 - DNA, 25 bp, Homo sapien
ataaagccctaaagccctagactgt

SEQ ID NO: 3585 - DNA, 25 bp, Homo sapien
aagccctagactgtggtgctcgaaa

SEQ ID NO: 3586 - DNA, 25 bp, Homo sapien
gactgtggtgctcgaaactttttaa

SEQ ID NO: 3587 - DNA, 25 bp, Homo sapien
taagggatgcctgactcctcaagaa

SEQ ID NO: 3588 - DNA, 25 bp, Homo sapien
actcctcaagaagtctgtaccattt

SEQ ID NO: 3589 - DNA, 25 bp, Homo sapien
accatttgaatgagctctagttgaa

SEQ ID NO: 3590 - DNA, 25 bp, Homo sapien
tggattcaagcacccacctaccttg

SEQ ID NO: 3591 - DNA, 25 bp, Homo sapien
cgcaccgtggctggagtcctgagca

SEQ ID NO: 3592 - DNA, 25 bp, Homo sapien
ctggcactggttgggtacctgatac

SEQ ID NO: 3593 - DNA, 25 bp, Homo sapien
acgggactggcgatggcttctgcta

SEQ ID NO: 3594 - DNA, 25 bp, Homo sapien
tctgaacagagctgcgtccactttc

SEQ ID NO: 3595 - DNA, 25 bp, Homo sapien
tggcctttggatatctgtccgacag

SEQ ID NO: 3596 - DNA, 25 bp, Homo sapien
tatctgtccgacaggtttgggcggc

SEQ ID NO: 3597 - DNA, 25 bp, Homo sapien
ggcgtctgctgctggtagcctacgt

SEQ ID NO: 3598 - DNA, 25 bp, Homo sapien
gtagcctacgtgagtaccctggtgc

SEQ ID NO: 3599 - DNA, 25 bp, Homo sapien
gcagcctccgtcagctatgtaatgt

SEQ ID NO: 3600 - DNA, 25 bp, Homo sapien
ctggctggttttaccatcatcgtga

SEQ ID NO: 3601 - DNA, 25 bp, Homo sapien
tcatcgtgatgccactggagctgga

SEQ ID NO: 3602 - DNA, 25 bp, Homo sapien
tgctctttctccaagtaccaacata

SEQ ID NO: 3603 - DNA, 25 bp, Homo sapien
gtaccaacataaatggctcccttta

SEQ ID NO: 3604 - DNA, 25 bp, Homo sapien
taaatggctccctttatctcaagtc

SEQ ID NO: 3605 - DNA, 25 bp, Homo sapien
gctccctttatctcaagtctttact

SEQ ID NO: 3606 - DNA, 25 bp, Homo sapien
agtctttactcaactatcaccttca

SEQ ID NO: 3607 - DNA, 25 bp, Homo sapien
tatcaccttcatgaagacttccctg

SEQ ID NO: 3608 - DNA, 25 bp, Homo sapien
tcatgaagacttccctggctaccct

SEQ ID NO: 3609 - DNA, 25 bp, Homo sapien
tggctacccttcctaaaactgcagc

SEQ ID NO: 3610 - DNA, 25 bp, Homo sapien
aaaactgcagccctaatcgcacttt

SEQ ID NO: 3611 - DNA, 25 bp, Homo sapien
aatcgcactttgatacttcctatcc

SEQ ID NO: 3612 - DNA, 25 bp, Homo sapien
aattgtcttctagctaggcacggtg

SEQ ID NO: 3613 - DNA, 25 bp, Homo sapien
ccatgcatacttttcactacactga

SEQ ID NO: 3614 - DNA, 25 bp, Homo sapien
actgatcttaactacctgaaactga

SEQ ID NO: 3615 - DNA, 25 bp, Homo sapien
gaggtcaatttagtagcacagcaac

SEQ ID NO: 3616 - DNA, 25 bp, Homo sapien
atacaacacactgtcatggtacaaa

SEQ ID NO: 3617 - DNA, 25 bp, Homo sapien
gatcaactcagcttagacggtttat

SEQ ID NO: 3618 - DNA, 25 bp, Homo sapien
gccagaggttggcttattctttttt

SEQ ID NO: 3619 - DNA, 25 bp, Homo sapien
aacaacatgtaggtgtccccttact

SEQ ID NO: 3620 - DNA, 25 bp, Homo sapien
tgtaggtgtccccttactcaagaaa

SEQ ID NO: 3621 - DNA, 25 bp, Homo sapien
gaatatggatctgtcaacctgagga

SEQ ID NO: 3622 - DNA, 25 bp, Homo sapien
aaatatggatctgtcaacctgagga

SEQ ID NO: 3623 - DNA, 25 bp, Homo sapien
aagaggcatggcctaattcctctcc

SEQ ID NO: 3624 - DNA, 25 bp, Homo sapien
ttctctgtgttcattgcttattaat

SEQ ID NO: 3625 - DNA, 25 bp, Homo sapien
ttcagcaaagattaattgagctcct

SEQ ID NO: 3626 - DNA, 25 bp, Homo sapien
gaaagaatactaacaaaacctgcaa

SEQ ID NO: 3627 - DNA, 25 bp, Homo sapien
gaatactaacaaaacctgcaaagtg

SEQ ID NO: 3628 - DNA, 25 bp, Homo sapien
tactaacaaaacctgcaaagtggta

SEQ ID NO: 3629 - DNA, 25 bp, Homo sapien
taacaaaacctgcaaagtggtattt

SEQ ID NO: 3630 - DNA, 25 bp, Homo sapien
aaaagcaagaagcacttgccagatt

SEQ ID NO: 3631 - DNA, 25 bp, Homo sapien
caagaagcacttgccagatttaact

SEQ ID NO: 3632 - DNA, 25 bp, Homo sapien
agaagcacttgccagatttaactat

SEQ ID NO: 3633 - DNA, 25 bp, Homo sapien
gaagcacttgccagatttaactata

SEQ ID NO: 3634 - DNA, 25 bp, Homo sapien
aagcacttgccagatttaactataa

SEQ ID NO: 3635 - DNA, 25 bp, Homo sapien
gcctgtgttgactacttcctggagg

SEQ ID NO: 3636 - DNA, 25 bp, Homo sapien
ttgccttctctctgctgatatagct

SEQ ID NO: 3637 - DNA, 25 bp, Homo sapien
tggcccagtggaagctcgtgcctga

SEQ ID NO: 3638 - DNA, 25 bp, Homo sapien
gaagctcgtgcctgaggaacatgga

SEQ ID NO: 3639 - DNA, 25 bp, Homo sapien
aacatggaggccacgctaatggtga

SEQ ID NO: 3640 - DNA, 25 bp, Homo sapien
gaggccacgctaatggtgagttagt

SEQ ID NO: 3641 - DNA, 25 bp, Homo sapien
aatggtgagttagtgctgtggtaca

SEQ ID NO: 3642 - DNA, 25 bp, Homo sapien
agtgctgtggtacagaagcagccaa

SEQ ID NO: 3643 - DNA, 25 bp, Homo sapien
gaagcagccaacctgtgcctactca

SEQ ID NO: 3644 - DNA, 25 bp, Homo sapien
atgtccccagttcctagacttaagg

SEQ ID NO: 3645 - DNA, 25 bp, Homo sapien
gaaaggaggatctcagggaagtcta

SEQ ID NO: 3646 - DNA, 25 bp, Homo sapien
gaccatggagaattcaaagaccagc

SEQ ID NO: 3647 - DNA, 25 bp, Homo sapien
aagaccagcaacaggcttcaaaagc

SEQ ID NO: 3648 - DNA, 25 bp, Homo sapien
aaagccttctatgaatagggcatgt

SEQ ID NO: 3649 - DNA, 25 bp, Homo sapien
aattagtgaacaccatgcctctctc

SEQ ID NO: 3650 - DNA, 25 bp, Homo sapien
ccatgcctctctcttgtactaaaga

SEQ ID NO: 3651 - DNA, 25 bp, Homo sapien
gccgcagggaagacaaagctcagtt

SEQ ID NO: 3652 - DNA, 25 bp, Homo sapien
tcagttgtattcaacaaaggccact

SEQ ID NO: 3653 - DNA, 25 bp, Homo sapien
aaaggccactcaggtagcaccataa

SEQ ID NO: 3654 - DNA, 25 bp, Homo sapien
aagagctgtaacacggacacgggag

SEQ ID NO: 3655 - DNA, 25 bp, Homo sapien
gacacgggagtagtggaatcagtca

SEQ ID NO: 3656 - DNA, 25 bp, Homo sapien
gaatcagtcaagagggaatttcaaa

SEQ ID NO: 3657 - DNA, 25 bp, Homo sapien
aaaggatgcatttcaagctctccca

SEQ ID NO: 3658 - DNA, 25 bp, Homo sapien
tctcccaagaactcttgcagtgctc

SEQ ID NO: 3659 - DNA, 25 bp, Homo sapien
aagaactcttgcagtgctccatccc

SEQ ID NO: 3660 - DNA, 25 bp, Homo sapien
tccatccctgtgtcctcagaaatgg

SEQ ID NO: 3661 - DNA, 25 bp, Homo sapien
tgtcctcagaaatggccctgagtct

SEQ ID NO: 3662 - DNA, 25 bp, Homo sapien
ctgagtctcagcagctcaaaaagac

SEQ ID NO: 3663 - DNA, 25 bp, Homo sapien
agcagctcaaaaagactccagttgg

SEQ ID NO: 3664 - DNA, 25 bp, Homo sapien
gaattagatgtggtcctcacaggga

SEQ ID NO: 3665 - DNA, 25 bp, Homo sapien
gtggtcctcacagggaatatttgcc

SEQ ID NO: 3666 - DNA, 25 bp, Homo sapien
acagggaatatttgcccctggccgc

SEQ ID NO: 3667 - DNA, 25 bp, Homo sapien
cctggccgcagatacaaaggatgca

SEQ ID NO: 3668 - DNA, 25 bp, Homo sapien
tgaacaatcaggtataatagtcccc

SEQ ID NO: 3669 - DNA, 25 bp, Homo sapien
caggtataatagtccccctttatct

SEQ ID NO: 3670 - DNA, 25 bp, Homo sapien
aagattatatcccaagactcccagt

SEQ ID NO: 3671 - DNA, 25 bp, Homo sapien
attatatcccaagactcccagtgag

SEQ ID NO: 3672 - DNA, 25 bp, Homo sapien
atatcccaagactcccagtgagtgt

SEQ ID NO: 3673 - DNA, 25 bp, Homo sapien
gactcccagtgagtgtctgaaacca

SEQ ID NO: 3674 - DNA, 25 bp, Homo sapien
gtatatacactatccatatgtgcta

SEQ ID NO: 3675 - DNA, 25 bp, Homo sapien
tatgtgctatatgtactatatgtcc

SEQ ID NO: 3676 - DNA, 25 bp, Homo sapien
atgtactatatgtcctctatatatt

SEQ ID NO: 3677 - DNA, 25 bp, Homo sapien
tgatgtttaattaagcactgcaaga

SEQ ID NO: 3678 - DNA, 25 bp, Homo sapien
agcactgcaagaaactgacagcaat

SEQ ID NO: 3679 - DNA, 25 bp, Homo sapien
taaatcccaggtacgaatccaagtt

SEQ ID NO: 3680 - DNA, 25 bp, Homo sapien
gatcatggcatgcttatcctttttg

SEQ ID NO: 3681 - DNA, 25 bp, Homo sapien
tttttgttttcaccaaccctgagag

SEQ ID NO: 3682 - DNA, 25 bp, Homo sapien
accctgagaggtagtctacattcca

SEQ ID NO: 3683 - DNA, 25 bp, Homo sapien
tagaagggctgcattctatgaggca

SEQ ID NO: 3684 - DNA, 25 bp, Homo sapien
cagagcttttcattgcaatttccat

SEQ ID NO: 3685 - DNA, 25 bp, Homo sapien
tgcaatttccatgactgttatttat

SEQ ID NO: 3686 - DNA, 25 bp, Homo sapien
tctaaggatcactctgagccacagt

SEQ ID NO: 3687 - DNA, 25 bp, Homo sapien
actgcaatggctcctatagctgctg

SEQ ID NO: 3688 - DNA, 25 bp, Homo sapien
aatcaagtcagccttactatcttaa

SEQ ID NO: 3689 - DNA, 25 bp, Homo sapien
aagggcagctaaacgccatggcaaa

SEQ ID NO: 3690 - DNA, 25 bp, Homo sapien
ctcctgaggaaatctcagctgcaca

SEQ ID NO: 3691 - DNA, 25 bp, Homo sapien
tcctgaggaaatctcagctgcacaa

SEQ ID NO: 3692 - DNA, 25 bp, Homo sapien
tcagctgcacaacctctactacgcc

SEQ ID NO: 3693 - DNA, 25 bp, Homo sapien
cacctgaccaatcagagagctcact

SEQ ID NO: 3694 - DNA, 25 bp, Homo sapien
acctgaccaatcagagagctcacta

SEQ ID NO: 3695 - DNA, 25 bp, Homo sapien
cctgaccaatcagagagctcactaa

SEQ ID NO: 3696 - DNA, 25 bp, Homo sapien
ctgaccaatcagagagctcactaaa

SEQ ID NO: 3697 - DNA, 25 bp, Homo sapien
gggatataaacccaagtcttcgagc

SEQ ID NO: 3698 - DNA, 25 bp, Homo sapien
atataaacccaagtcttcgagccgg

SEQ ID NO: 3699 - DNA, 25 bp, Homo sapien
tataaacccaagtcttcgagccggc

SEQ ID NO: 3700 - DNA, 25 bp, Homo sapien
aacccaagtcttcgagccggcaacg

SEQ ID NO: 3701 - DNA, 25 bp, Homo sapien
gaagccacacagaaacttgaacagg

SEQ ID NO: 3702 - DNA, 25 bp, Homo sapien
acaacagcaatttggttctcagcat

SEQ ID NO: 3703 - DNA, 25 bp, Homo sapien
gtgcagtctggttcagatacaccaa

SEQ ID NO: 3704 - DNA, 25 bp, Homo sapien
gttcagatacaccaagtagtgggat

SEQ ID NO: 3705 - DNA, 25 bp, Homo sapien
gatacagagtcccttgacacctcag

SEQ ID NO: 3706 - DNA, 25 bp, Homo sapien
ggcaatggaaatatgtctcctgcac

SEQ ID NO: 3707 - DNA, 25 bp, Homo sapien
tctcctgcacagtcattccataaag

SEQ ID NO: 3708 - DNA, 25 bp, Homo sapien
tacccctacgtctacatcttcagat

SEQ ID NO: 3709 - DNA, 25 bp, Homo sapien
tgtttgtaaagccacaagctccacc

SEQ ID NO: 3710 - DNA, 25 bp, Homo sapien
tgcaaaaatggttggtacccctcga

SEQ ID NO: 3711 - DNA, 25 bp, Homo sapien
cagtggaaaactgtacacctttatc

SEQ ID NO: 3712 - DNA, 25 bp, Homo sapien
tgaaactgccctgtatgatgccgag

SEQ ID NO: 3713 - DNA, 25 bp, Homo sapien
tgccctgtatgatgccgaggactgg

SEQ ID NO: 3714 - DNA, 25 bp, Homo sapien
ttgcacgacggtgaaactgccctgt

SEQ ID NO: 3715 - DNA, 25 bp, Homo sapien
aaactgccctgtacgatgctgtcat

SEQ ID NO: 3716 - DNA, 25 bp, Homo sapien
atgctgtcatggtgggcgcatctca

SEQ ID NO: 3717 - DNA, 25 bp, Homo sapien
gcatctcattctgcgtttgcttcaa

SEQ ID NO: 3718 - DNA, 25 bp, Homo sapien
gtttgcttcaactcacaggatgtac

SEQ ID NO: 3719 - DNA, 25 bp, Homo sapien
aggatgtacgagagtgaaccgcaat

SEQ ID NO: 3720 - DNA, 25 bp, Homo sapien
gaaccgcaatgtaaactgcagaccg

SEQ ID NO: 3721 - DNA, 25 bp, Homo sapien
gggtggcaacgtgtgtcagcacact

SEQ ID NO: 3722 - DNA, 25 bp, Homo sapien
gtgtgtcagcacactggctctgaga

SEQ ID NO: 3723 - DNA, 25 bp, Homo sapien
tcaaagaacacttcagttcagaagt

SEQ ID NO: 3724 - DNA, 25 bp, Homo sapien
ttcagttcagaagtgacgatttcaa

SEQ ID NO: 3725 - DNA, 25 bp, Homo sapien
gaagtgacgatttcaaatcttctga

SEQ ID NO: 3726 - DNA, 25 bp, Homo sapien
tcaaatcttctgaatctctttcaaa

SEQ ID NO: 3727 - DNA, 25 bp, Homo sapien
ctctttcaaagagcagaactttcaa

SEQ ID NO: 3728 - DNA, 25 bp, Homo sapien
gaatggagaatggtacgaggtactt

SEQ ID NO: 3729 - DNA, 25 bp, Homo sapien
tacgaggtacttaagatagccgctg

SEQ ID NO: 3730 - DNA, 25 bp, Homo sapien
aggtacttaagatagccgctgacat

SEQ ID NO: 3731 - DNA, 25 bp, Homo sapien
gatagccgctgacatattaattaaa

SEQ ID NO: 3732 - DNA, 25 bp, Homo sapien
acaaagccaggaaaactaatcggtg

SEQ ID NO: 3733 - DNA, 25 bp, Homo sapien
aagtaacgtttcatgtgatcctgtc

SEQ ID NO: 3734 - DNA, 25 bp, Homo sapien
gagaggattcaggagcagcacaaga

SEQ ID NO: 3735 - DNA, 25 bp, Homo sapien
gattcaggagcagcacaagagcctt

SEQ ID NO: 3736 - DNA, 25 bp, Homo sapien
ggagcagcacaagagccttcagcag

SEQ ID NO: 3737 - DNA, 25 bp, Homo sapien
tggccaagccacagagcgtcttcga

SEQ ID NO: 3738 - DNA, 25 bp, Homo sapien
aagccacagagcgtcttcgaggagc

SEQ ID NO: 3739 - DNA, 25 bp, Homo sapien
acagagcgtcttcgaggagccaaac

SEQ ID NO: 3740 - DNA, 25 bp, Homo sapien
agcgtcttcgaggagccaaacaatg

SEQ ID NO: 3741 - DNA, 25 bp, Homo sapien
cttcctgcctctgacttttaaaggt

SEQ ID NO: 3742 - DNA, 25 bp, Homo sapien
tgggctcctctcaggtctggacatc

SEQ ID NO: 3743 - DNA, 25 bp, Homo sapien
ggctcctctcaggtctggacatcat

SEQ ID NO: 3744 - DNA, 25 bp, Homo sapien
agctagaggcatggagcccccaatc

SEQ ID NO: 3745 - DNA, 25 bp, Homo sapien
tccctcaggtaacatttttgttaca

SEQ ID NO: 3746 - DNA, 25 bp, Homo sapien
tcttctgaaaaaattgccttataaa

SEQ ID NO: 3747 - DNA, 25 bp, Homo sapien
aaattgccttataaatcctgtgaac

SEQ ID NO: 3748 - DNA, 25 bp, Homo sapien
attgccttataaatcctgtgaacta

SEQ ID NO: 3749 - DNA, 25 bp, Homo sapien
gccttataaatcctgtgaactactg

SEQ ID NO: 3750 - DNA, 25 bp, Homo sapien
tataaatcctgtgaactactgaatt

SEQ ID NO: 3751 - DNA, 25 bp, Homo sapien
aatcctgtgaactactgaatttaaa

SEQ ID NO: 3752 - DNA, 25 bp, Homo sapien
ctgtgaactactgaatttaaattgg

SEQ ID NO: 3753 - DNA, 25 bp, Homo sapien
atgtcatttggagaggtttgtaaat

SEQ ID NO: 3754 - DNA, 25 bp, Homo sapien
gaaatatgaatgtttagtctgaaaa

SEQ ID NO: 3755 - DNA, 25 bp, Homo sapien
gtttagtctgaaaatagcagatttt

SEQ ID NO: 3756 - DNA, 25 bp, Homo sapien
ttcacatttccacgatacactcggc

SEQ ID NO: 3757 - DNA, 25 bp, Homo sapien
tcggccagtcagacgatctcattca

SEQ ID NO: 3758 - DNA, 25 bp, Homo sapien
tgactaccatcatattctccatcat

SEQ ID NO: 3759 - DNA, 25 bp, Homo sapien
acagccagcgctactctcgggagga

SEQ ID NO: 3760 - DNA, 25 bp, Homo sapien
gagctgaaagatgccggcgtcgcca

SEQ ID NO: 3761 - DNA, 25 bp, Homo sapien
atgggtgatggcctgcacaatttca

SEQ ID NO: 3762 - DNA, 25 bp, Homo sapien
acaatttcagcgatggcctagcaat

SEQ ID NO: 3763 - DNA, 25 bp, Homo sapien
ctgtgttctgtcatgagttgcctca

SEQ ID NO: 3764 - DNA, 25 bp, Homo sapien
taggtgactttgctgttctactaaa

SEQ ID NO: 3765 - DNA, 25 bp, Homo sapien
atgaccgttaagcaggctgtccttt

SEQ ID NO: 3766 - DNA, 25 bp, Homo sapien
agccatgctggcgtatcttggaatg

SEQ ID NO: 3767 - DNA, 25 bp, Homo sapien
tgtctctagtgataaaacggaaaga

SEQ ID NO: 3768 - DNA, 25 bp, Homo sapien
acaactgtaactagagcaaacctct

SEQ ID NO: 3769 - DNA, 25 bp, Homo sapien
gcaaacctctttgccaatttaactg

SEQ ID NO: 3770 - DNA, 25 bp, Homo sapien
gccaatttaactggcatactaaaat

SEQ ID NO: 3771 - DNA, 25 bp, Homo sapien
tttcctttgagattagtaactgtac

SEQ ID NO: 3772 - DNA, 25 bp, Homo sapien
gattagtaactgtaccatccatata

SEQ ID NO: 3773 - DNA, 25 bp, Homo sapien
gtaccatccatatacaaaacactat

SEQ ID NO: 3774 - DNA, 25 bp, Homo sapien
acaaaacactatattgctttgctga

SEQ ID NO: 3775 - DNA, 25 bp, Homo sapien
gctttgctgaaacctgaaagtgagc

SEQ ID NO: 3776 - DNA, 25 bp, Homo sapien
gaaacctgaaagtgagcaaactgat

SEQ ID NO: 3777 - DNA, 25 bp, Homo sapien
aaatgcatataacaggccgggcgta

SEQ ID NO: 3778 - DNA, 25 bp, Homo sapien
ggaagtgccgaggttcaagactgca

SEQ ID NO: 3779 - DNA, 25 bp, Homo sapien
ccgaggttcaagactgcagcgagcc

SEQ ID NO: 3780 - DNA, 25 bp, Homo sapien
aagactgcagcgagcctggtgacca

SEQ ID NO: 3781 - DNA, 25 bp, Homo sapien
ctgcagcgagcctggtgaccataaa

SEQ ID NO: 3782 - DNA, 25 bp, Homo sapien
agcctggtgaccataaagttctcag

SEQ ID NO: 3783 - DNA, 25 bp, Homo sapien
gggctctgtacatcgtaggagccat

SEQ ID NO: 3784 - DNA, 25 bp, Homo sapien
gtacatcgtaggagccattcacaag

SEQ ID NO: 3785 - DNA, 25 bp, Homo sapien
atcgtaggagccattcacaagcaga

SEQ ID NO: 3786 - DNA, 25 bp, Homo sapien
ggagccattcacaagcagaatccaa

SEQ ID NO: 3787 - DNA, 25 bp, Homo sapien
agcagaatccaacaatggccgtaca

SEQ ID NO: 3788 - DNA, 25 bp, Homo sapien
acaatggccgtacacagacttcaag

SEQ ID NO: 3789 - DNA, 25 bp, Homo sapien
aggatgccggcggtcccagagccag

SEQ ID NO: 3790 - DNA, 25 bp, Homo sapien
agaggcccatggaaacaccatccag

SEQ ID NO: 3791 - DNA, 25 bp, Homo sapien
tggaaacaccatccaggacgcacct

SEQ ID NO: 3792 - DNA, 25 bp, Homo sapien
gggccggaagttgcttgagttcata

SEQ ID NO: 3793 - DNA, 25 bp, Homo sapien
gagttcataaaacatgtctgttatc

SEQ ID NO: 3794 - DNA, 25 bp, Homo sapien
tgtctgttatcacagacatcagagc

SEQ ID NO: 3795 - DNA, 25 bp, Homo sapien
agccacaggccgtgcgctccagggt

SEQ ID NO: 3796 - DNA, 25 bp, Homo sapien
ctccagggtggttttgccaagtgct

SEQ ID NO: 3797 - DNA, 25 bp, Homo sapien
ttgccaagtgctgcagaggccaggt

SEQ ID NO: 3798 - DNA, 25 bp, Homo sapien
atgcctctcaggcttccggcatgga

SEQ ID NO: 3799 - DNA, 25 bp, Homo sapien
ttccggcatggaccgtggagatggc

SEQ ID NO: 3800 - DNA, 25 bp, Homo sapien
gatatgtctcatggtgttcctaagc

SEQ ID NO: 3801 - DNA, 25 bp, Homo sapien
tgttcctaagcccattattttaata

SEQ ID NO: 3802 - DNA, 25 bp, Homo sapien
gtacaaatacagtagccattgccta

SEQ ID NO: 3803 - DNA, 25 bp, Homo sapien
aagggcatggtaaccagagtttcaa

SEQ ID NO: 3804 - DNA, 25 bp, Homo sapien
gagtttcaaacctcttagataaaag

SEQ ID NO: 3805 - DNA, 25 bp, Homo sapien
aaggatctggatcgctctactggca

SEQ ID NO: 3806 - DNA, 25 bp, Homo sapien
tcgctctactggcaagctgcttaca

SEQ ID NO: 3807 - DNA, 25 bp, Homo sapien
gctgcttacaccagcataagtgcta

SEQ ID NO: 3808 - DNA, 25 bp, Homo sapien
gagggatgatgatctgttatggcca

SEQ ID NO: 3809 - DNA, 25 bp, Homo sapien
gttatggccaggaaatcaactacag

SEQ ID NO: 3810 - DNA, 25 bp, Homo sapien
gcattgggactatagtttgtcttct

SEQ ID NO: 3811 - DNA, 25 bp, Homo sapien
aattatcttaattaggactcctaga

SEQ ID NO: 3812 - DNA, 25 bp, Homo sapien
ggactcctagaaattgtgaaacatc

SEQ ID NO: 3813 - DNA, 25 bp, Homo sapien
ggatacaccatctaattatcattat

SEQ ID NO: 3814 - DNA, 25 bp, Homo sapien
tactgtaaccagaatctttgatttt

SEQ ID NO: 3815 - DNA, 25 bp, Homo sapien
tgctttatgtggataatctacgcaa

SEQ ID NO: 3816 - DNA, 25 bp, Homo sapien
ggataatctacgcaaaagacatttt

SEQ ID NO: 3817 - DNA, 25 bp, Homo sapien
agagtaaacatccaccctaaattat

SEQ ID NO: 3818 - DNA, 25 bp, Homo sapien
aacatccaccctaaattatattctg

SEQ ID NO: 3819 - DNA, 25 bp, Homo sapien
cactataaaaacaatctgggctggg

SEQ ID NO: 3820 - DNA, 25 bp, Homo sapien
ggaggccgaagctcgtggactacct

SEQ ID NO: 3821 - DNA, 25 bp, Homo sapien
cgaagctcgtggactacctgaggtc

SEQ ID NO: 3822 - DNA, 25 bp, Homo sapien
tggatcatggaggtgaacccctcat

SEQ ID NO: 3823 - DNA, 25 bp, Homo sapien
gatcatggaggtgaacccctcatga

SEQ ID NO: 3824 - DNA, 25 bp, Homo sapien
tcatggaggtgaacccctcatgaat

SEQ ID NO: 3825 - DNA, 25 bp, Homo sapien
ggaggtgaacccctcatgaatggct

SEQ ID NO: 3826 - DNA, 25 bp, Homo sapien
ccagcatggcgataccctacttcta

SEQ ID NO: 3827 - DNA, 25 bp, Homo sapien
agcatggcgataccctacttctact

SEQ ID NO: 3828 - DNA, 25 bp, Homo sapien
atggcgataccctacttctactgaa

SEQ ID NO: 3829 - DNA, 25 bp, Homo sapien
tggcgataccctacttctactgaac

SEQ ID NO: 3830 - DNA, 25 bp, Homo sapien
gcgataccctacttctactgaacat

SEQ ID NO: 3831 - DNA, 25 bp, Homo sapien
gataccctacttctactgaacatac

SEQ ID NO: 3832 - DNA, 25 bp, Homo sapien
ataccctacttctactgaacataca

SEQ ID NO: 3833 - DNA, 25 bp, Homo sapien
agggtctcaaatgaactctgagtta

SEQ ID NO: 3834 - DNA, 25 bp, Homo sapien
gaactctgagttaccatctttggac

SEQ ID NO: 3835 - DNA, 25 bp, Homo sapien
tactatgtcactttaattggatgaa

SEQ ID NO: 3836 - DNA, 25 bp, Homo sapien
atgtgagtcctgcttaatttggaaa

SEQ ID NO: 3837 - DNA, 25 bp, Homo sapien
aaaattttgcaactctgcctacaag

SEQ ID NO: 3838 - DNA, 25 bp, Homo sapien
ttttgcaactctgcctacaaggtac

SEQ ID NO: 3839 - DNA, 25 bp, Homo sapien
ggtacagtaattggctaggttcttt

SEQ ID NO: 3840 - DNA, 25 bp, Homo sapien
gaagagcagtgttgactagagttaa

SEQ ID NO: 3841 - DNA, 25 bp, Homo sapien
atgatgtgctttactgtagaaacag

SEQ ID NO: 3842 - DNA, 25 bp, Homo sapien
ttttatgctgctctactttattgca

SEQ ID NO: 3843 - DNA, 25 bp, Homo sapien
tgctgctctactttattgcaaaacg

SEQ ID NO: 3844 - DNA, 25 bp, Homo sapien
aaaggagcagcacttcaggaggtta

SEQ ID NO: 3845 - DNA, 25 bp, Homo sapien
caggaggttacatcttttacacctt

SEQ ID NO: 3846 - DNA, 25 bp, Homo sapien
caactccatctgtgcagcaaacaac

SEQ ID NO: 3847 - DNA, 25 bp, Homo sapien
cctcccagtatgacacatattgctt

SEQ ID NO: 3848 - DNA, 25 bp, Homo sapien
agacctgcccaatgcctttgatgga

SEQ ID NO: 3849 - DNA, 25 bp, Homo sapien
aatgcctttgatggaccaattacca

SEQ ID NO: 3850 - DNA, 25 bp, Homo sapien
tattgttaaccgtgatggcacccgc

SEQ ID NO: 3851 - DNA, 25 bp, Homo sapien
tggcacccgctatgtccagaaagga

SEQ ID NO: 3852 - DNA, 25 bp, Homo sapien
tacagaacgaatcctgaagacatct

SEQ ID NO: 3853 - DNA, 25 bp, Homo sapien
agcaaccctactgatgatgacgtga

SEQ ID NO: 3854 - DNA, 25 bp, Homo sapien
atgatgacgtgagcagcggctcctc

SEQ ID NO: 3855 - DNA, 25 bp, Homo sapien
gttgcctatgtgcttcaagattggt

SEQ ID NO: 3856 - DNA, 25 bp, Homo sapien
ggtggctttcatactgggcaaacaa

SEQ ID NO: 3857 - DNA, 25 bp, Homo sapien
gagaagctagatcttaactggtact

SEQ ID NO: 3858 - DNA, 25 bp, Homo sapien
attcaggtttaactgtagctaccgt

SEQ ID NO: 3859 - DNA, 25 bp, Homo sapien
gtagctaccgttctttttggcatag

SEQ ID NO: 3860 - DNA, 25 bp, Homo sapien
gatctctattggtattctacgtcct

SEQ ID NO: 3861 - DNA, 25 bp, Homo sapien
attctacgtccttgttaactcttca

SEQ ID NO: 3862 - DNA, 25 bp, Homo sapien
gtcaattctgaaagctccggtatta

SEQ ID NO: 3863 - DNA, 25 bp, Homo sapien
agctccggtattattctttgataga

SEQ ID NO: 3864 - DNA, 25 bp, Homo sapien
tggatgatttgctgccgctgacgtt

SEQ ID NO: 3865 - DNA, 25 bp, Homo sapien
gctgccgctgacgtttttagatttc

SEQ ID NO: 3866 - DNA, 25 bp, Homo sapien
gagagcctactgtatgccagatact

SEQ ID NO: 3867 - DNA, 25 bp, Homo sapien
ttacactgtgtgtaccctttagcac

SEQ ID NO: 3868 - DNA, 25 bp, Homo sapien
tgtgtaccctttagcactgtttggg

SEQ ID NO: 3869 - DNA, 25 bp, Homo sapien
agagagggactgttctggtctcctt

SEQ ID NO: 3870 - DNA, 25 bp, Homo sapien
tctccttggaaggtatgtgcctata

SEQ ID NO: 3871 - DNA, 25 bp, Homo sapien
gcatgagtaagatatcacatctcct

SEQ ID NO: 3872 - DNA, 25 bp, Homo sapien
tcctaactccgtaacaaccaagcaa

SEQ ID NO: 3873 - DNA, 25 bp, Homo sapien
tatatcaccttttttataggagcgg

SEQ ID NO: 3874 - DNA, 25 bp, Homo sapien
gagcggatatatattccagcagcat

SEQ ID NO: 3875 - DNA, 25 bp, Homo sapien
agtattttagccctctttgcaattg

SEQ ID NO: 3876 - DNA, 25 bp, Homo sapien
ctttgcaattgcagtcttcattcat

SEQ ID NO: 3877 - DNA, 25 bp, Homo sapien
cactcaataacacttcgcactgatt

SEQ ID NO: 3878 - DNA, 25 bp, Homo sapien
taacacttcgcactgattctccaag

SEQ ID NO: 3879 - DNA, 25 bp, Homo sapien
ttcttctggtacacccaggcaagaa

SEQ ID NO: 3880 - DNA, 25 bp, Homo sapien
agccctctgtccttttgataactag

SEQ ID NO: 3881 - DNA, 25 bp, Homo sapien
gataactagagggtctcattgacct

SEQ ID NO: 3882 - DNA, 25 bp, Homo sapien
ttgacctggttaacacaagctgcct

SEQ ID NO: 3883 - DNA, 25 bp, Homo sapien
acacaagctgcctacagacggcaaa

SEQ ID NO: 3884 - DNA, 25 bp, Homo sapien
agcagggcactgaagaatcaagcca

SEQ ID NO: 3885 - DNA, 25 bp, Homo sapien
gcatgccggcggaagagcacaccca

SEQ ID NO: 3886 - DNA, 25 bp, Homo sapien
cagtcggaggagagctaggccacta

SEQ ID NO: 3887 - DNA, 25 bp, Homo sapien
actaagcagctcaactccaggagaa

SEQ ID NO: 3888 - DNA, 25 bp, Homo sapien
tgcccacatcttcacggttcttaag

SEQ ID NO: 3889 - DNA, 25 bp, Homo sapien
cacatcttcacggttcttaagttgt

SEQ ID NO: 3890 - DNA, 25 bp, Homo sapien
cacggttcttaagttgttgctctaa

SEQ ID NO: 3891 - DNA, 25 bp, Homo sapien
ttcttaagttgttgctctaacgcca

SEQ ID NO: 3892 - DNA, 25 bp, Homo sapien
taaccactctacttaaaaacagcac

SEQ ID NO: 3893 - DNA, 25 bp, Homo sapien
aaacacaaatgagggaggtactggc

SEQ ID NO: 3894 - DNA, 25 bp, Homo sapien
acacaaatgagggaggtactggctt

SEQ ID NO: 3895 - DNA, 25 bp, Homo sapien
cacaaatgagggaggtactggcttc

SEQ ID NO: 3896 - DNA, 25 bp, Homo sapien
acaaatgagggaggtactggcttct

SEQ ID NO: 3897 - DNA, 25 bp, Homo sapien
caaatgagggaggtactggcttctg

SEQ ID NO: 3898 - DNA, 25 bp, Homo sapien
aaatgagggaggtactggcttctgc

SEQ ID NO: 3899 - DNA, 25 bp, Homo sapien
cacgggtgagcattcagggtgcttt

SEQ ID NO: 3900 - DNA, 25 bp, Homo sapien
gtgctttggtggcttcacccactta

SEQ ID NO: 3901 - DNA, 25 bp, Homo sapien
ttcacccacttagcaccttgttaag

SEQ ID NO: 3902 - DNA, 25 bp, Homo sapien
acccacttagcaccttgttaagaca

SEQ ID NO: 3903 - DNA, 25 bp, Homo sapien
ggagccccttatggacactgttgag

SEQ ID NO: 3904 - DNA, 25 bp, Homo sapien
gataagccctttgtttcatcaaaat

SEQ ID NO: 3905 - DNA, 25 bp, Homo sapien
tgtttcatcaaaatctactccctgg

SEQ ID NO: 3906 - DNA, 25 bp, Homo sapien
tttcatcaaaatctactccctgggt

SEQ ID NO: 3907 - DNA, 25 bp, Homo sapien
atcaaaatctactccctgggtctga

SEQ ID NO: 3908 - DNA, 25 bp, Homo sapien
aaatctactccctgggtctgactta

SEQ ID NO: 3909 - DNA, 25 bp, Homo sapien
tctactccctgggtctgacttagtt

SEQ ID NO: 3910 - DNA, 25 bp, Homo sapien
gtgagtgaacgtgaaggcctgcagc

SEQ ID NO: 3911 - DNA, 25 bp, Homo sapien
gtacactaccatagatttttatcaa

SEQ ID NO: 3912 - DNA, 25 bp, Homo sapien
aaataaattaacctcagctcactgt

SEQ ID NO: 3913 - DNA, 25 bp, Homo sapien
cacacacattagtgcaggcctgcat

SEQ ID NO: 3914 - DNA, 25 bp, Homo sapien
gtgcaggcctgcatagcatcaggat

SEQ ID NO: 3915 - DNA, 25 bp, Homo sapien
tagcatcaggatcatcagtatcact

SEQ ID NO: 3916 - DNA, 25 bp, Homo sapien
gtcccactgaaaggtcttcagcggg

SEQ ID NO: 3917 - DNA, 25 bp, Homo sapien
ggtcttcagcgggaatatcatgcat

SEQ ID NO: 3918 - DNA, 25 bp, Homo sapien
gcgggaatatcatgcatggagctgt

SEQ ID NO: 3919 - DNA, 25 bp, Homo sapien
tcctgaaggacctggttgagcctgt

SEQ ID NO: 3920 - DNA, 25 bp, Homo sapien
acctggttgagcctgttttacagtt

SEQ ID NO: 3921 - DNA, 25 bp, Homo sapien
tcgaagtaccccacgactaaacgct

SEQ ID NO: 3922 - DNA, 25 bp, Homo sapien
agtaccccacgactaaacgctaatg

SEQ ID NO: 3923 - DNA, 25 bp, Homo sapien
gtaccccacgactaaacgctaatga

SEQ ID NO: 3924 - DNA, 25 bp, Homo sapien
taccccacgactaaacgctaatgaa

SEQ ID NO: 3925 - DNA, 25 bp, Homo sapien
cacgactaaacgctaatgaaactag

SEQ ID NO: 3926 - DNA, 25 bp, Homo sapien
taaacgctaatgaaactagaggagg

SEQ ID NO: 3927 - DNA, 25 bp, Homo sapien
tagaggaggcacagcttcagctccg

SEQ ID NO: 3928 - DNA, 25 bp, Homo sapien
aggaggcacagcttcagctccgtgc

SEQ ID NO: 3929 - DNA, 25 bp, Homo sapien
gaggcacagcttcagctccgtgcag

SEQ ID NO: 3930 - DNA, 25 bp, Homo sapien
aataatttccaaagtaagacactgg

SEQ ID NO: 3931 - DNA, 25 bp, Homo sapien
aggaagctggaaactcatctgcctt

SEQ ID NO: 3932 - DNA, 25 bp, Homo sapien
ttctgtaacaactcttctctcaagg

SEQ ID NO: 3933 - DNA, 25 bp, Homo sapien
gcagtagcaacttatacggtttctt

SEQ ID NO: 3934 - DNA, 25 bp, Homo sapien
gcagaggagctcacaacttttgctt

SEQ ID NO: 3935 - DNA, 25 bp, Homo sapien
aaaagccaagcactacaggatgtaa

SEQ ID NO: 3936 - DNA, 25 bp, Homo sapien
gagtcaccgtgacttccctgtcaag

SEQ ID NO: 3937 - DNA, 25 bp, Homo sapien
tgtcaagctgccagcagttccctag

SEQ ID NO: 3938 - DNA, 25 bp, Homo sapien
gccagcagttccctaggttggaaaa

SEQ ID NO: 3939 - DNA, 25 bp, Homo sapien
ggaaaatgggcatggtcataaccta

SEQ ID NO: 3940 - DNA, 25 bp, Homo sapien
ggtcataacctaaccacttctgaat

SEQ ID NO: 3941 - DNA, 25 bp, Homo sapien
aataggtttcagaatgaccatgttc

SEQ ID NO: 3942 - DNA, 25 bp, Homo sapien
tgagccctgatatcatgtcactgca

SEQ ID NO: 3943 - DNA, 25 bp, Homo sapien
gcgtgaagaggaatatttcgttgat

SEQ ID NO: 3944 - DNA, 25 bp, Homo sapien
tcgttgataatgaaagtgagcagct

SEQ ID NO: 3945 - DNA, 25 bp, Homo sapien
gataatgaaagtgagcagctaggga

SEQ ID NO: 3946 - DNA, 25 bp, Homo sapien
ggaaatcaagaacacacttaaagtt

SEQ ID NO: 3947 - DNA, 25 bp, Homo sapien
gtttgtcagaagaaggaactttatt

SEQ ID NO: 3948 - DNA, 25 bp, Homo sapien
agatgatgtcatttcagttattgat

SEQ ID NO: 3949 - DNA, 25 bp, Homo sapien
gtcatttcagttattgattgtctaa

SEQ ID NO: 3950 - DNA, 25 bp, Homo sapien
attgattgtctaacttcagtaggtt

SEQ ID NO: 3951 - DNA, 25 bp, Homo sapien
gattgtctaacttcagtaggtttaa

SEQ ID NO: 3952 - DNA, 25 bp, Homo sapien
gtctaacttcagtaggtttaagagt

SEQ ID NO: 3953 - DNA, 25 bp, Homo sapien
taagagttacttgagggctgggcac

SEQ ID NO: 3954 - DNA, 25 bp, Homo sapien
atgacttgaccagacagataaggat

SEQ ID NO: 3955 - DNA, 25 bp, Homo sapien
gggaggcctcattacatcagtgttg

SEQ ID NO: 3956 - DNA, 25 bp, Homo sapien
ggaggcctcattacatcagtgttgt

SEQ ID NO: 3957 - DNA, 25 bp, Homo sapien
ggcctcattacatcagtgttgtttt

SEQ ID NO: 3958 - DNA, 25 bp, Homo sapien
cgcccggcctatatgactttatatt

SEQ ID NO: 3959 - DNA, 25 bp, Homo sapien
gcccggcctatatgactttatattt

SEQ ID NO: 3960 - DNA, 25 bp, Homo sapien
ccggcctatatgactttatatttac

SEQ ID NO: 3961 - DNA, 25 bp, Homo sapien
ttacctgctcccttcaccaggagat

SEQ ID NO: 3962 - DNA, 25 bp, Homo sapien
tcatgggctgtgatgctgggttttc

SEQ ID NO: 3963 - DNA, 25 bp, Homo sapien
gggctgtgatgctgggttttcttaa

SEQ ID NO: 3964 - DNA, 25 bp, Homo sapien
ccccttgccctatcaaagagaatag

SEQ ID NO: 3965 - DNA, 25 bp, Homo sapien
aaaggagaccccctcactcagtcgg

SEQ ID NO: 3966 - DNA, 25 bp, Homo sapien
tcactcagtcggagccatgctggct

SEQ ID NO: 3967 - DNA, 25 bp, Homo sapien
gctccttccctcaggatttgcggag

SEQ ID NO: 3968 - DNA, 25 bp, Homo sapien
ccttccctcaggatttgcggagcct

SEQ ID NO: 3969 - DNA, 25 bp, Homo sapien
ttccctcaggatttgcggagcctgt

SEQ ID NO: 3970 - DNA, 25 bp, Homo sapien
ccctcaggatttgcggagcctgtaa

SEQ ID NO: 3971 - DNA, 25 bp, Homo sapien
aggatttgcggagcctgtaataatt

SEQ ID NO: 3972 - DNA, 25 bp, Homo sapien
gatttgcggagcctgtaataattga

SEQ ID NO: 3973 - DNA, 25 bp, Homo sapien
atttgcggagcctgtaataattgag

SEQ ID NO: 3974 - DNA, 25 bp, Homo sapien
ttgcggagcctgtaataattgaggg

SEQ ID NO: 3975 - DNA, 25 bp, Homo sapien
cggagcctgtaataattgagggaca

SEQ ID NO: 3976 - DNA, 25 bp, Homo sapien
gagatgaagccgctacttgagcaat

SEQ ID NO: 3977 - DNA, 25 bp, Homo sapien
cttgagcaattactaaaggctgcca

SEQ ID NO: 3978 - DNA, 25 bp, Homo sapien
ggctgccaaggacactaaagacaat

SEQ ID NO: 3979 - DNA, 25 bp, Homo sapien
agacaattattgcatcatttcttcc

SEQ ID NO: 3980 - DNA, 25 bp, Homo sapien
aaaagaatcgtgtcagaactctttt

SEQ ID NO: 3981 - DNA, 25 bp, Homo sapien
gagttggcacttcattgtctcttca

SEQ ID NO: 3982 - DNA, 25 bp, Homo sapien
tagatttcagttcacctctgtggat

SEQ ID NO: 3983 - DNA, 25 bp, Homo sapien
tttcagttcacctctgtggatctgt

SEQ ID NO: 3984 - DNA, 25 bp, Homo sapien
tcaaaaacgtagaaagcacgggcat

SEQ ID NO: 3985 - DNA, 25 bp, Homo sapien
gaggtggcaacaacctacaggtgtt

SEQ ID NO: 3986 - DNA, 25 bp, Homo sapien
caacctacaggtgttaggagctgga

SEQ ID NO: 3987 - DNA, 25 bp, Homo sapien
ttgcctgtggtcatcgataacttcc

SEQ ID NO: 3988 - DNA, 25 bp, Homo sapien
atggcagaagcaaaaccctgggttc

SEQ ID NO: 3989 - DNA, 25 bp, Homo sapien
ggcagaagcaaaaccctgggttcca

SEQ ID NO: 3990 - DNA, 25 bp, Homo sapien
tgtgtgtctggctagtccctgggaa

SEQ ID NO: 3991 - DNA, 25 bp, Homo sapien
tgtctggctagtccctgggaacaca

SEQ ID NO: 3992 - DNA, 25 bp, Homo sapien
acacagcaccccatgtcgtgatgat

SEQ ID NO: 3993 - DNA, 25 bp, Homo sapien
catgtcgtgatgatgtggcctacat

SEQ ID NO: 3994 - DNA, 25 bp, Homo sapien
gatgatgtggcctacatgtacccta

SEQ ID NO: 3995 - DNA, 25 bp, Homo sapien
ggcctacatgtaccctaccaggagg

SEQ ID NO: 3996 - DNA, 25 bp, Homo sapien
gacattttggaccagggagccctac

SEQ ID NO: 3997 - DNA, 25 bp, Homo sapien
gagccctacagcgtctcttcaaaaa

SEQ ID NO: 3998 - DNA, 25 bp, Homo sapien
agggaagatgttatcagctctgatc

SEQ ID NO: 3999 - DNA, 25 bp, Homo sapien
ctctgatcatcctaactcagggatt

SEQ ID NO: 4000 - DNA, 25 bp, Homo sapien
ctcagggattaacgatttaggctat

SEQ ID NO: 4001 - DNA, 25 bp, Homo sapien
gcagccacctggaacaaatctatat

SEQ ID NO: 4002 - DNA, 25 bp, Homo sapien
atgccacctaattggtacttagtgc

SEQ ID NO: 4003 - DNA, 25 bp, Homo sapien
ggtacttagtgcaatgctaatcaca

SEQ ID NO: 4004 - DNA, 25 bp, Homo sapien
atgtttgtttggtcaggactaaatt

SEQ ID NO: 4005 - DNA, 25 bp, Homo sapien
gaaagtctaatgctatctgtacgta

SEQ ID NO: 4006 - DNA, 25 bp, Homo sapien
gtctaatgctatctgtacgtaattt

SEQ ID NO: 4007 - DNA, 25 bp, Homo sapien
attataatggttggtcactctcagg

SEQ ID NO: 4008 - DNA, 25 bp, Homo sapien
aatggttggtcactctcagggaaga

SEQ ID NO: 4009 - DNA, 25 bp, Homo sapien
tgaccactttgctgactgtattgaa

SEQ ID NO: 4010 - DNA, 25 bp, Homo sapien
ttgaaaaaaccctcaccttactctg

SEQ ID NO: 4011 - DNA, 25 bp, Homo sapien
gaagcatggcaacagtacaatattg

SEQ ID NO: 4012 - DNA, 25 bp, Homo sapien
cagtacaatattgccgatgctttgg

SEQ ID NO: 4013 - DNA, 25 bp, Homo sapien
attgccgatgctttggtagtgataa

SEQ ID NO: 4014 - DNA, 25 bp, Homo sapien
gggtgatataaaatcagccactctt

SEQ ID NO: 4015 - DNA, 25 bp, Homo sapien
agccactcttaagcttgctggaaac

SEQ ID NO: 4016 - DNA, 25 bp, Homo sapien
ttaagcttgctggaaactgtgggag

SEQ ID NO: 4017 - DNA, 25 bp, Homo sapien
atatttccctagagctaatgaagaa

SEQ ID NO: 4018 - DNA, 25 bp, Homo sapien
tagtgtctgcaaaacaggtgggttt

SEQ ID NO: 4019 - DNA, 25 bp, Homo sapien
aattaatgagctactcaagtttctg

SEQ ID NO: 4020 - DNA, 25 bp, Homo sapien
gtgatggtcacatctactctttcca

SEQ ID NO: 4021 - DNA, 25 bp, Homo sapien
aagataaagccgacctacagatttc

SEQ ID NO: 4022 - DNA, 25 bp, Homo sapien
acagatttcggtgcttgaatgtcat

SEQ ID NO: 4023 - DNA, 25 bp, Homo sapien
cattttgtggttgggattctgggct

SEQ ID NO: 4024 - DNA, 25 bp, Homo sapien
tgtgcagctgaatgtctgtctgtca

SEQ ID NO: 4025 - DNA, 25 bp, Homo sapien
atgtctgtctgtcacgaatctacct

SEQ ID NO: 4026 - DNA, 25 bp, Homo sapien
acgaatctaccttgctgctcatttt

SEQ ID NO: 4027 - DNA, 25 bp, Homo sapien
agttgttgctggagtcctgtcaggc

SEQ ID NO: 4028 - DNA, 25 bp, Homo sapien
cacagcatctataatgccagcctca

SEQ ID NO: 4029 - DNA, 25 bp, Homo sapien
aatgccagcctcaagaaatattttc

SEQ ID NO: 4030 - DNA, 25 bp, Homo sapien
gttcagcttcgccatcggattttat

SEQ ID NO: 4031 - DNA, 25 bp, Homo sapien
ggtggtggaggccagtagtcccaac

SEQ ID NO: 4032 - DNA, 25 bp, Homo sapien
attgccaggttgtttagcattctga

SEQ ID NO: 4033 - DNA, 25 bp, Homo sapien
tgccaggttgtttagcattctgatc

SEQ ID NO: 4034 - DNA, 25 bp, Homo sapien
ccaggttgtttagcattctgatcaa

SEQ ID NO: 4035 - DNA, 25 bp, Homo sapien
aggttgtttagcattctgatcaaca

SEQ ID NO: 4036 - DNA, 25 bp, Homo sapien
tgtttagcattctgatcaacaatgg

SEQ ID NO: 4037 - DNA, 25 bp, Homo sapien
tcagccatattgatgaggttctctt

SEQ ID NO: 4038 - DNA, 25 bp, Homo sapien
cagccatattgatgaggttctcttt

SEQ ID NO: 4039 - DNA, 25 bp, Homo sapien
gccatattgatgaggttctcttttt

SEQ ID NO: 4040 - DNA, 25 bp, Homo sapien
tattgatgaggttctctttttaata

SEQ ID NO: 4041 - DNA, 25 bp, Homo sapien
atatttgctaattttgtgagcaaac

SEQ ID NO: 4042 - DNA, 25 bp, Homo sapien
ggaggactccagtaagtatagtcac

SEQ ID NO: 4043 - DNA, 25 bp, Homo sapien
actccagtaagtatagtcactctag

SEQ ID NO: 4044 - DNA, 25 bp, Homo sapien
gtaagtatagtcactctagctcacc

SEQ ID NO: 4045 - DNA, 25 bp, Homo sapien
taagtatagtcactctagctcaccc

SEQ ID NO: 4046 - DNA, 25 bp, Homo sapien
agtatagtcactctagctcacccca

SEQ ID NO: 4047 - DNA, 25 bp, Homo sapien
tagtcactctagctcaccccaggag

SEQ ID NO: 4048 - DNA, 25 bp, Homo sapien
tcactctagctcaccccaggagaag

SEQ ID NO: 4049 - DNA, 25 bp, Homo sapien
tctagctcaccccaggagaagcctg

SEQ ID NO: 4050 - DNA, 25 bp, Homo sapien
ctagctcaccccaggagaagcctgt

SEQ ID NO: 4051 - DNA, 25 bp, Homo sapien
agaagcctgttgcagagtatgatcg

SEQ ID NO: 4052 - DNA, 25 bp, Homo sapien
aagcctgttgcagagtatgatcggt

SEQ ID NO: 4053 - DNA, 25 bp, Homo sapien
ttctgcaaatgttcccagcctccgt

SEQ ID NO: 4054 - DNA, 25 bp, Homo sapien
cagcctccgtgcaagtattcttaac

SEQ ID NO: 4055 - DNA, 25 bp, Homo sapien
gtattcttaactctttacgcctaat

SEQ ID NO: 4056 - DNA, 25 bp, Homo sapien
tttacgcctaatgaacaagcacagt

SEQ ID NO: 4057 - DNA, 25 bp, Homo sapien
gcacagtttttcaatggtgaagaaa

SEQ ID NO: 4058 - DNA, 25 bp, Homo sapien
ggctgtagcaacgtctgtcaggccc

SEQ ID NO: 4059 - DNA, 25 bp, Homo sapien
ttgtgtttcatctcctgcgcgcgta

SEQ ID NO: 4060 - DNA, 25 bp, Homo sapien
tcctgcgcgcgtagagcaaatgcta

SEQ ID NO: 4061 - DNA, 25 bp, Homo sapien
gcaaatgctagagcgatttcagctg

SEQ ID NO: 4062 - DNA, 25 bp, Homo sapien
gctagagcgatttcagctgatagaa

SEQ ID NO: 4063 - DNA, 25 bp, Homo sapien
gatatcgtgggttcttatttaatta

SEQ ID NO: 4064 - DNA, 25 bp, Homo sapien
agtttgtgggccttacaaatcaggc

SEQ ID NO: 4065 - DNA, 25 bp, Homo sapien
tacaaatcaggccactggcccattg

SEQ ID NO: 4066 - DNA, 25 bp, Homo sapien
ctggcccattgcttgtagttagttg

SEQ ID NO: 4067 - DNA, 25 bp, Homo sapien
gcttgtagttagttgatccatgtca

SEQ ID NO: 4068 - DNA, 25 bp, Homo sapien
agttgatccatgtcatgcaccctaa

SEQ ID NO: 4069 - DNA, 25 bp, Homo sapien
gatccatgtcatgcaccctaaaaat

SEQ ID NO: 4070 - DNA, 25 bp, Homo sapien
tctgtcactgtgagtggcttcagta

SEQ ID NO: 4071 - DNA, 25 bp, Homo sapien
gagtggcttcagtaggattttgaga

SEQ ID NO: 4072 - DNA, 25 bp, Homo sapien
ataagtttatattcttgctaggtaa

SEQ ID NO: 4073 - DNA, 25 bp, Homo sapien
ttttaccctccatttgtgtttattg

SEQ ID NO: 4074 - DNA, 25 bp, Homo sapien
ttaccctccatttgtgtttattgca

SEQ ID NO: 4075 - DNA, 25 bp, Homo sapien
aggttctgcccgtttgctgagagga

SEQ ID NO: 4076 - DNA, 25 bp, Homo sapien
gtttgctgagaggacgcgtctagtc

SEQ ID NO: 4077 - DNA, 25 bp, Homo sapien
gacgcgtctagtcctgaaggccaag

SEQ ID NO: 4078 - DNA, 25 bp, Homo sapien
agggaatcaggcatgaagtcatcaa

SEQ ID NO: 4079 - DNA, 25 bp, Homo sapien
aataagcctgagtggttctttaaga

SEQ ID NO: 4080 - DNA, 25 bp, Homo sapien
aaaaatccctttggtctggtgccag

SEQ ID NO: 4081 - DNA, 25 bp, Homo sapien
agggtcagctgatctacgagtctgc

SEQ ID NO: 4082 - DNA, 25 bp, Homo sapien
acgagtctgccatcacctgtgagta

SEQ ID NO: 4083 - DNA, 25 bp, Homo sapien
tgagtacctggatgaagcataccca

SEQ ID NO: 4084 - DNA, 25 bp, Homo sapien
gaagaagctgttgccggatgacccc

SEQ ID NO: 4085 - DNA, 25 bp, Homo sapien
gaaagcttgccagaagatgatctta

SEQ ID NO: 4086 - DNA, 25 bp, Homo sapien
aggccatggccagctggaccctgag

SEQ ID NO: 4087 - DNA, 25 bp, Homo sapien
gcccgctcctgcttggtgagagagt

SEQ ID NO: 4088 - DNA, 25 bp, Homo sapien
cgctcctgcttggtgagagagtcag

SEQ ID NO: 4089 - DNA, 25 bp, Homo sapien
gctcctgcttggtgagagagtcagc

SEQ ID NO: 4090 - DNA, 25 bp, Homo sapien
tcctgcttggtgagagagtcagcac

SEQ ID NO: 4091 - DNA, 25 bp, Homo sapien
cttggtgagagagtcagcacgcagt

SEQ ID NO: 4092 - DNA, 25 bp, Homo sapien
gagagtcagcacgcagtggcctgca

SEQ ID NO: 4093 - DNA, 25 bp, Homo sapien
gaaaaacgttgacctcttggcgaga

SEQ ID NO: 4094 - DNA, 25 bp, Homo sapien
tgacctcttggcgagaatgcaaaga

SEQ ID NO: 4095 - DNA, 25 bp, Homo sapien
tgttggtgaactgtcacccctacaa

SEQ ID NO: 4096 - DNA, 25 bp, Homo sapien
cctggaatcacgtgtcatttcaacc

SEQ ID NO: 4097 - DNA, 25 bp, Homo sapien
ctgcacctggcccataaattgtcat

SEQ ID NO: 4098 - DNA, 25 bp, Homo sapien
gcacctggcccataaattgtcatac

SEQ ID NO: 4099 - DNA, 25 bp, Homo sapien
cctggcccataaattgtcatacttt

SEQ ID NO: 4100 - DNA, 25 bp, Homo sapien
tacttttaaagagcctattacacaa

SEQ ID NO: 4101 - DNA, 25 bp, Homo sapien
gagcctattacacaaagtatcatca

SEQ ID NO: 4102 - DNA, 25 bp, Homo sapien
aagtatcatcagaatcatcccaaga

SEQ ID NO: 4103 - DNA, 25 bp, Homo sapien
gaatcatcccaagactcatttcctg

SEQ ID NO: 4104 - DNA, 25 bp, Homo sapien
tcatcccaagactcatttcctgatt

SEQ ID NO: 4105 - DNA, 25 bp, Homo sapien
ccaagactcatttcctgattcctaa

SEQ ID NO: 4106 - DNA, 25 bp, Homo sapien
gactcatttcctgattcctaattat

SEQ ID NO: 4107 - DNA, 25 bp, Homo sapien
aaattttgcttttaggcgaggcatg

SEQ ID NO: 4108 - DNA, 25 bp, Homo sapien
gagaacacccgcaagtaattgtgca

SEQ ID NO: 4109 - DNA, 25 bp, Homo sapien
gcaagtaattgtgcagcttcctctc

SEQ ID NO: 4110 - DNA, 25 bp, Homo sapien
aagtaattgtgcagcttcctctcat

SEQ ID NO: 4111 - DNA, 25 bp, Homo sapien
taattgtgcagcttcctctcattcc

SEQ ID NO: 4112 - DNA, 25 bp, Homo sapien
tcattccctgctacttgtctcatgt

SEQ ID NO: 4113 - DNA, 25 bp, Homo sapien
tgctacttgtctcatgtcctggcaa

SEQ ID NO: 4114 - DNA, 25 bp, Homo sapien
tacttgtctcatgtcctggcaacag

SEQ ID NO: 4115 - DNA, 25 bp, Homo sapien
tcctgtgtcagatccctgtttgccc

SEQ ID NO: 4116 - DNA, 25 bp, Homo sapien
gtcagatccctgtttgcccttctgg

SEQ ID NO: 4117 - DNA, 25 bp, Homo sapien
cctcttctgggcatcagcaaaggaa

SEQ ID NO: 4118 - DNA, 25 bp, Homo sapien
aaggaagttcttgggcctggtgtgg

SEQ ID NO: 4119 - DNA, 25 bp, Homo sapien
gtgaccgagagaacctcagattctt

SEQ ID NO: 4120 - DNA, 25 bp, Homo sapien
cgagagaacctcagattcttcattg

SEQ ID NO: 4121 - DNA, 25 bp, Homo sapien
catgatttcagtcatagcaagcttt

SEQ ID NO: 4122 - DNA, 25 bp, Homo sapien
tccttttcctatccttataggcctg

SEQ ID NO: 4123 - DNA, 25 bp, Homo sapien
atccttataggcctgtcccttgcct

SEQ ID NO: 4124 - DNA, 25 bp, Homo sapien
ttgcctctgccctggattggttggc

SEQ ID NO: 4125 - DNA, 25 bp, Homo sapien
ctgccctggattggttggcaaacta

SEQ ID NO: 4126 - DNA, 25 bp, Homo sapien
ggacttgatgtacataactcctgtc

SEQ ID NO: 4127 - DNA, 25 bp, Homo sapien
ttgatgtacataactcctgtccctt

SEQ ID NO: 4128 - DNA, 25 bp, Homo sapien
atgtacataactcctgtcccttttc

SEQ ID NO: 4129 - DNA, 25 bp, Homo sapien
tttctttgcctctgcagtctcattt

SEQ ID NO: 4130 - DNA, 25 bp, Homo sapien
atttgtatgctttcataagtacttc

SEQ ID NO: 4131 - DNA, 25 bp, Homo sapien
taggagagaaaaccctacgaacaga

SEQ ID NO: 4132 - DNA, 25 bp, Homo sapien
tagccatgttttgtgaattccaggt

SEQ ID NO: 4133 - DNA, 25 bp, Homo sapien
tgttttgtgaattccaggtgccatc

SEQ ID NO: 4134 - DNA, 25 bp, Homo sapien
gccatcttcaaaaacacccttggat

SEQ ID NO: 4135 - DNA, 25 bp, Homo sapien
aacacccttggattctagccaatca

SEQ ID NO: 4136 - DNA, 25 bp, Homo sapien
aaaatggcagagacggccacctgag

SEQ ID NO: 4137 - DNA, 25 bp, Homo sapien
gacggccacctgagaccaattagaa

SEQ ID NO: 4138 - DNA, 25 bp, Homo sapien
gaccaattagaatatccacaccagt

SEQ ID NO: 4139 - DNA, 25 bp, Homo sapien
tgatttcatgatgtattgttccata

SEQ ID NO: 4140 - DNA, 25 bp, Homo sapien
aacaggacaaaagtcatgattcgta

SEQ ID NO: 4141 - DNA, 25 bp, Homo sapien
gggcctgctaatctgaggccgatcc

SEQ ID NO: 4142 - DNA, 25 bp, Homo sapien
ctgctaatctgaggccgatccggga

SEQ ID NO: 4143 - DNA, 25 bp, Homo sapien
taatctgaggccgatccgggaccgg

SEQ ID NO: 4144 - DNA, 25 bp, Homo sapien
gccttcaatttacgttctttacact

SEQ ID NO: 4145 - DNA, 25 bp, Homo sapien
tcaatttacgttctttacactacgg

SEQ ID NO: 4146 - DNA, 25 bp, Homo sapien
cacgtcccgacaacttgttccctga

SEQ ID NO: 4147 - DNA, 25 bp, Homo sapien
gggcgctctgagattaaagagtttt

SEQ ID NO: 4148 - DNA, 25 bp, Homo sapien
gattaaagagttttacctctgagat

SEQ ID NO: 4149 - DNA, 25 bp, Homo sapien
aacaccagcgacttccagaagctga

SEQ ID NO: 4150 - DNA, 25 bp, Homo sapien
tccagaagctgaagcggaaatattg

SEQ ID NO: 4151 - DNA, 25 bp, Homo sapien
aagcggaaatattgaagtccaggga

SEQ ID NO: 4152 - DNA, 25 bp, Homo sapien
attttcaaataccaagctagcctcg

SEQ ID NO: 4153 - DNA, 25 bp, Homo sapien
aagctagcctcgtacacctaaacga

SEQ ID NO: 4154 - DNA, 25 bp, Homo sapien
gtacacctaaacgaagtcccacttg

SEQ ID NO: 4155 - DNA, 25 bp, Homo sapien
agtcccacttggtcacggcataata

SEQ ID NO: 4156 - DNA, 25 bp, Homo sapien
tggtcacggcataatattctctgtt

SEQ ID NO: 4157 - DNA, 25 bp, Homo sapien
tagaaagtggcctggacgcgtctgt

SEQ ID NO: 4158 - DNA, 25 bp, Homo sapien
gtgggtctctttcgagttcctctgt

SEQ ID NO: 4159 - DNA, 25 bp, Homo sapien
agccatgtctgtctgacgtaggagc

SEQ ID NO: 4160 - DNA, 25 bp, Homo sapien
gtctgtctgacgtaggagccgtata

SEQ ID NO: 4161 - DNA, 25 bp, Homo sapien
acagccatgagtggtggtgcgcacc

SEQ ID NO: 4162 - DNA, 25 bp, Homo sapien
gttacagctacttggcacgttgagg

SEQ ID NO: 4163 - DNA, 25 bp, Homo sapien
gggcaccatcattattccatacaac

SEQ ID NO: 4164 - DNA, 25 bp, Homo sapien
ttccatacaaccttagggtcatttt

SEQ ID NO: 4165 - DNA, 25 bp, Homo sapien
gaactttctcaatagggtttcaaga

SEQ ID NO: 4166 - DNA, 25 bp, Homo sapien
gattttgaaaagtgtcttccaattc

SEQ ID NO: 4167 - DNA, 25 bp, Homo sapien
gtcttccaattctgatctccgtaga

SEQ ID NO: 4168 - DNA, 25 bp, Homo sapien
atctccgtagatcctgttatgggaa

SEQ ID NO: 4169 - DNA, 25 bp, Homo sapien
taaagatgaaattccctactttctt

SEQ ID NO: 4170 - DNA, 25 bp, Homo sapien
agatggcgattctgacctgtgtgtc

SEQ ID NO: 4171 - DNA, 25 bp, Homo sapien
gacctgtgtgtctcatgtcacctaa

SEQ ID NO: 4172 - DNA, 25 bp, Homo sapien
tctcatgtcacctaacacctatggg

SEQ ID NO: 4173 - DNA, 25 bp, Homo sapien
gggtggcatgaaacttgagctttaa

SEQ ID NO: 4174 - DNA, 25 bp, Homo sapien
gaaaactggtgtgggcagatctgtt

SEQ ID NO: 4175 - DNA, 25 bp, Homo sapien
tgggcagatctgttggttgaaataa

SEQ ID NO: 4176 - DNA, 25 bp, Homo sapien
ctactgtttcaaatactgaaggcag

SEQ ID NO: 4177 - DNA, 25 bp, Homo sapien
agaggcggctagagcatcacctctt

SEQ ID NO: 4178 - DNA, 25 bp, Homo sapien
atcacctcttcacgcaagtgtcttg

SEQ ID NO: 4179 - DNA, 25 bp, Homo sapien
aagtgtcttgaaactcagcttgaag

SEQ ID NO: 4180 - DNA, 25 bp, Homo sapien
agggagtcagcccatcgggattaaa

SEQ ID NO: 4181 - DNA, 25 bp, Homo sapien
gtgacaacacacactcggcttcagt

SEQ ID NO: 4182 - DNA, 25 bp, Homo sapien
acactcggcttcagttcttaggaga

SEQ ID NO: 4183 - DNA, 25 bp, Homo sapien
gagactctgttgagattcactggtt

SEQ ID NO: 4184 - DNA, 25 bp, Homo sapien
gttgagattcactggtttacttaaa

SEQ ID NO: 4185 - DNA, 25 bp, Homo sapien
gtatattaaccctaaaacctagatg

SEQ ID NO: 4186 - DNA, 25 bp, Homo sapien
aacctagatgttgtccacctgatgc

SEQ ID NO: 4187 - DNA, 25 bp, Homo sapien
agatgttgtccacctgatgccaaat

SEQ ID NO: 4188 - DNA, 25 bp, Homo sapien
tgtccacctgatgccaaatttctta

SEQ ID NO: 4189 - DNA, 25 bp, Homo sapien
ccacctgatgccaaatttcttaatt

SEQ ID NO: 4190 - DNA, 25 bp, Homo sapien
gtctttttcaggagtgtagaaatct

SEQ ID NO: 4191 - DNA, 25 bp, Homo sapien
gaaatctatgtattggtggttgtca

SEQ ID NO: 4192 - DNA, 25 bp, Homo sapien
ttatccatgtcttgtctgtacatat

SEQ ID NO: 4193 - DNA, 25 bp, Homo sapien
gtcttgtctgtacatatgaccatgt

SEQ ID NO: 4194 - DNA, 25 bp, Homo sapien
gtacatatgaccatgtttcttgaca

SEQ ID NO: 4195 - DNA, 25 bp, Homo sapien
gaaataccagtcagtgttcctatgt

SEQ ID NO: 4196 - DNA, 25 bp, Homo sapien
gaactttgttctaagaacctcggct

SEQ ID NO: 4197 - DNA, 25 bp, Homo sapien
gaacctcggctagtgtttacatgta

SEQ ID NO: 4198 - DNA, 25 bp, Homo sapien
ggtcgttttttattcatctattcaa

SEQ ID NO: 4199 - DNA, 25 bp, Homo sapien
gaacacctataatgagctggacact

SEQ ID NO: 4200 - DNA, 25 bp, Homo sapien
gctggacactctatgggccttgcaa

SEQ ID NO: 4201 - DNA, 25 bp, Homo sapien
gggccttgcaatttagacatgaata

SEQ ID NO: 4202 - DNA, 25 bp, Homo sapien
gagttctcaggtaccttacattcta

SEQ ID NO: 4203 - DNA, 25 bp, Homo sapien
gaaggagaactttgacctctaacca

SEQ ID NO: 4204 - DNA, 25 bp, Homo sapien
tttgacctctaaccaagacctgttt

SEQ ID NO: 4205 - DNA, 25 bp, Homo sapien
tttttaaactgcactcacggtcatc

SEQ ID NO: 4206 - DNA, 25 bp, Homo sapien
attcaaaccttgagtccgggcatgg

SEQ ID NO: 4207 - DNA, 25 bp, Homo sapien
tgggattacactatgcctggcccct

SEQ ID NO: 4208 - DNA, 25 bp, Homo sapien
tggcccctccaacagatttgaccga

SEQ ID NO: 4209 - DNA, 25 bp, Homo sapien
ccctccaacagatttgaccgagtgt

SEQ ID NO: 4210 - DNA, 25 bp, Homo sapien
agatttgaccgagtgtgtaccttgt

SEQ ID NO: 4211 - DNA, 25 bp, Homo sapien
atttgaccgagtgtgtaccttgtgc

SEQ ID NO: 4212 - DNA, 25 bp, Homo sapien
actgttctgggcacttggggtatag

SEQ ID NO: 4213 - DNA, 25 bp, Homo sapien
caagggcttacattctagcagggag

SEQ ID NO: 4214 - DNA, 25 bp, Homo sapien
gggcttacattctagcagggagaaa

SEQ ID NO: 4215 - DNA, 25 bp, Homo sapien
tctagcagggagaaacaggcaagca

SEQ ID NO: 4216 - DNA, 25 bp, Homo sapien
gaaacaggcaagcaagaacacaagt

SEQ ID NO: 4217 - DNA, 25 bp, Homo sapien
caagtgaaattatctaacaggttaa

SEQ ID NO: 4218 - DNA, 25 bp, Homo sapien
ccccatctttggtgtcagatccaaa

SEQ ID NO: 4219 - DNA, 25 bp, Homo sapien
tccagtgttgggaagcttttgccat

SEQ ID NO: 4220 - DNA, 25 bp, Homo sapien
atttttgtcgatagtgttaggtaag

SEQ ID NO: 4221 - DNA, 25 bp, Homo sapien
taggtaagagtccaactttattctc

SEQ ID NO: 4222 - DNA, 25 bp, Homo sapien
gtccaactttattctcttacatgtg

SEQ ID NO: 4223 - DNA, 25 bp, Homo sapien
attctcttacatgtggatatccgtt

SEQ ID NO: 4224 - DNA, 25 bp, Homo sapien
ggatatccgttttttccagcactat

SEQ ID NO: 4225 - DNA, 25 bp, Homo sapien
tatccgttttttccagcactatttg

SEQ ID NO: 4226 - DNA, 25 bp, Homo sapien
cttgtcaaaaatcaggctggagtgc

SEQ ID NO: 4227 - DNA, 25 bp, Homo sapien
ggcctgatcaagtttaagactgcat

SEQ ID NO: 4228 - DNA, 25 bp, Homo sapien
tttaagactgcattgcaccacagca

SEQ ID NO: 4229 - DNA, 25 bp, Homo sapien
cccaagatcaccaggtgagcagctg

SEQ ID NO: 4230 - DNA, 25 bp, Homo sapien
tccctcgggtgtccagcaagcactg

SEQ ID NO: 4231 - DNA, 25 bp, Homo sapien
ccccttagggctggctttgagatag

SEQ ID NO: 4232 - DNA, 25 bp, Homo sapien
gggctggctttgagatagatcctga

SEQ ID NO: 4233 - DNA, 25 bp, Homo sapien
atagatcctgatgtcagcctgtttc

SEQ ID NO: 4234 - DNA, 25 bp, Homo sapien
aatggaggctttgatcgcttgccca

SEQ ID NO: 4235 - DNA, 25 bp, Homo sapien
agggccacgtccagtgagtggtaca

SEQ ID NO: 4236 - DNA, 25 bp, Homo sapien
gtggtacagcttggactcaaaccca

SEQ ID NO: 4237 - DNA, 25 bp, Homo sapien
aagtctgtgtgactccaacatgtca

SEQ ID NO: 4238 - DNA, 25 bp, Homo sapien
aacatgtcacacttcctcacgtgaa

SEQ ID NO: 4239 - DNA, 25 bp, Homo sapien
cttcctcacgtgaaaagcctcatat

SEQ ID NO: 4240 - DNA, 25 bp, Homo sapien
agcccttggcttgcaagctgttcat

SEQ ID NO: 4241 - DNA, 25 bp, Homo sapien
agggtgaaatcagcctttctaagaa

SEQ ID NO: 4242 - DNA, 25 bp, Homo sapien
agcctttctaagaatctgattcatc

SEQ ID NO: 4243 - DNA, 25 bp, Homo sapien
catctcattattgccagcattatta

SEQ ID NO: 4244 - DNA, 25 bp, Homo sapien
attgccagcattattagatgttaga

SEQ ID NO: 4245 - DNA, 25 bp, Homo sapien
ttcaaccttttctacctggcacgtt

SEQ ID NO: 4246 - DNA, 25 bp, Homo sapien
tttctacctggcacgttatctgaac

SEQ ID NO: 4247 - DNA, 25 bp, Homo sapien
acctggcacgttatctgaactaaaa

SEQ ID NO: 4248 - DNA, 25 bp, Homo sapien
agagaagaagcagcccttcaaaaat

SEQ ID NO: 4249 - DNA, 25 bp, Homo sapien
agaagcagcccttcaaaaatagatt

SEQ ID NO: 4250 - DNA, 25 bp, Homo sapien
tatggcttcccaaaaagtctctttt

SEQ ID NO: 4251 - DNA, 25 bp, Homo sapien
gggattcagtgccaatgcatcaaca

SEQ ID NO: 4252 - DNA, 25 bp, Homo sapien
tcctgttttcgtgttccccacggag

SEQ ID NO: 4253 - DNA, 25 bp, Homo sapien
ttccccacggagctcatattttatg

SEQ ID NO: 4254 - DNA, 25 bp, Homo sapien
ttttatgcagatgatcagtcaacac

SEQ ID NO: 4255 - DNA, 25 bp, Homo sapien
gtgttgacactgtacaatccctatg

SEQ ID NO: 4256 - DNA, 25 bp, Homo sapien
aatccctatgagtttgccttaaagt

SEQ ID NO: 4257 - DNA, 25 bp, Homo sapien
agttttgtgtactactccaaataag

SEQ ID NO: 4258 - DNA, 25 bp, Homo sapien
aagtatgttgtcgttgatgctgcag

SEQ ID NO: 4259 - DNA, 25 bp, Homo sapien
atgttgtcgttgatgctgcaggtgc

SEQ ID NO: 4260 - DNA, 25 bp, Homo sapien
gcaggtgcagtaaagcctcagtgtt

SEQ ID NO: 4261 - DNA, 25 bp, Homo sapien
taaagcctcagtgttgtgtggatat

SEQ ID NO: 4262 - DNA, 25 bp, Homo sapien
tagcctatctcatccttatcatgca

SEQ ID NO: 4263 - DNA, 25 bp, Homo sapien
atccttatcatgcagcctcctacaa

SEQ ID NO: 4264 - DNA, 25 bp, Homo sapien
tcctacaagggcaggcactcctggg

SEQ ID NO: 4265 - DNA, 25 bp, Homo sapien
gagctggctgggagcacctctgtgg

SEQ ID NO: 4266 - DNA, 25 bp, Homo sapien
atctgacccctgtgccagggtctgg

SEQ ID NO: 4267 - DNA, 25 bp, Homo sapien
tgtgccagggtctgggccagcccct

SEQ ID NO: 4268 - DNA, 25 bp, Homo sapien
ttggtcttgctaggcccaggactga

SEQ ID NO: 4269 - DNA, 25 bp, Homo sapien
aggcccaggactgattgtgtctgat

SEQ ID NO: 4270 - DNA, 25 bp, Homo sapien
gatggcatcagcctggcctcgtggg

SEQ ID NO: 4271 - DNA, 25 bp, Homo sapien
agcaggacccagacaactgcctggg

SEQ ID NO: 4272 - DNA, 25 bp, Homo sapien
ttttcttcattttgacagagacaca

SEQ ID NO: 4273 - DNA, 25 bp, Homo sapien
ttcctggatgactcctttcgcaagt

SEQ ID NO: 4274 - DNA, 25 bp, Homo sapien
gactcctttcgcaagtgggctagaa

SEQ ID NO: 4275 - DNA, 25 bp, Homo sapien
agaatccgggagttcgtgccgcctt

SEQ ID NO: 4276 - DNA, 25 bp, Homo sapien
agacaatctgatcaaagccatcttg

SEQ ID NO: 4277 - DNA, 25 bp, Homo sapien
aaagccatcttgtcagtcaccaaag

SEQ ID NO: 4278 - DNA, 25 bp, Homo sapien
gtcagtcaccaaagagtaccgcctg

SEQ ID NO: 4279 - DNA, 25 bp, Homo sapien
ccgctgcatcatcgtgggcaatgga

SEQ ID NO: 4280 - DNA, 25 bp, Homo sapien
gcaatggaggcgttcttgccaacaa

SEQ ID NO: 4281 - DNA, 25 bp, Homo sapien
aaagctcgcgtcatcactgatctaa

SEQ ID NO: 4282 - DNA, 25 bp, Homo sapien
tattctgcgtggaagctacacttac

SEQ ID NO: 4283 - DNA, 25 bp, Homo sapien
gaagctacacttactccagtgggag

SEQ ID NO: 4284 - DNA, 25 bp, Homo sapien
gttctctgtgctaggtcagcctcaa

SEQ ID NO: 4285 - DNA, 25 bp, Homo sapien
taggtcagcctcaagtctctcggag

SEQ ID NO: 4286 - DNA, 25 bp, Homo sapien
gtctctcggaggttttcgttacact

SEQ ID NO: 4287 - DNA, 25 bp, Homo sapien
aggttttcgttacactcaggctggt

SEQ ID NO: 4288 - DNA, 25 bp, Homo sapien
gttacactcaggctggttaacccag

SEQ ID NO: 4289 - DNA, 25 bp, Homo sapien
ctgcctggcagaggcgtttgatgtt

SEQ ID NO: 4290 - DNA, 25 bp, Homo sapien
aggatggaatctgtgacctcccaga

SEQ ID NO: 4291 - DNA, 25 bp, Homo sapien
gaatctgtgacctcccagatgcttt

SEQ ID NO: 4292 - DNA, 25 bp, Homo sapien
tgcttccaccacaggcctgggtcag

SEQ ID NO: 4293 - DNA, 25 bp, Homo sapien
aggtacttcgtgacccactctgaaa

SEQ ID NO: 4294 - DNA, 25 bp, Homo sapien
ttcgtgacccactctgaaaagaaaa

SEQ ID NO: 4295 - DNA, 25 bp, Homo sapien
agacgaacaggtactgtcgctgtga

SEQ ID NO: 4296 - DNA, 25 bp, Homo sapien
aggtactgtcgctgtgaggtgacat

SEQ ID NO: 4297 - DNA, 25 bp, Homo sapien
gaggtgacatggtgtccgctcctgt

SEQ ID NO: 4298 - DNA, 25 bp, Homo sapien
cctgtctcagaccatgtaaccttgg

SEQ ID NO: 4299 - DNA, 25 bp, Homo sapien
gaccatgtaaccttgggcagatcaa

SEQ ID NO: 4300 - DNA, 25 bp, Homo sapien
ggcagatcaagtctaagggtcctga

SEQ ID NO: 4301 - DNA, 25 bp, Homo sapien
taagggtcctgactttccccatctg

SEQ ID NO: 4302 - DNA, 25 bp, Homo sapien
gaaatgcttcttaggtctcttccag

SEQ ID NO: 4303 - DNA, 25 bp, Homo sapien
tgacttttagaaccctagttggcac

SEQ ID NO: 4304 - DNA, 25 bp, Homo sapien
aatggcgtagccctaagccatagaa

SEQ ID NO: 4305 - DNA, 25 bp, Homo sapien
tagaaacacatcatgcaggccgggc

SEQ ID NO: 4306 - DNA, 25 bp, Homo sapien
cacagtgcagaggtggtgcccaact

SEQ ID NO: 4307 - DNA, 25 bp, Homo sapien
agtgcagaggtggtgcccaactcag

SEQ ID NO: 4308 - DNA, 25 bp, Homo sapien
tgcagaggtggtgcccaactcagag

SEQ ID NO: 4309 - DNA, 25 bp, Homo sapien
aggtggtgcccaactcagaggacca

SEQ ID NO: 4310 - DNA, 25 bp, Homo sapien
ggtgcccaactcagaggaccaggga

SEQ ID NO: 4311 - DNA, 25 bp, Homo sapien
ccaactcagaggaccagggaccggg

SEQ ID NO: 4312 - DNA, 25 bp, Homo sapien
ttccagctcagtgaagcaagccctc

SEQ ID NO: 4313 - DNA, 25 bp, Homo sapien
agtgaagcaagccctccccagagct

SEQ ID NO: 4314 - DNA, 25 bp, Homo sapien
gatagcgggtaccttccctggatgg

SEQ ID NO: 4315 - DNA, 25 bp, Homo sapien
ccccagaatgcctggcgctctgcag

SEQ ID NO: 4316 - DNA, 25 bp, Homo sapien
cgctctgcagagcacagtctgagct

SEQ ID NO: 4317 - DNA, 25 bp, Homo sapien
tccatccacctttcttgtggttctc

SEQ ID NO: 4318 - DNA, 25 bp, Homo sapien
gaccatttctctctacagcagtagt

SEQ ID NO: 4319 - DNA, 25 bp, Homo sapien
ccatttctctctacagcagtagttt

SEQ ID NO: 4320 - DNA, 25 bp, Homo sapien
atttctctctacagcagtagtttcc

SEQ ID NO: 4321 - DNA, 25 bp, Homo sapien
ttctctctacagcagtagtttccaa

SEQ ID NO: 4322 - DNA, 25 bp, Homo sapien
tctctacagcagtagtttccaatag

SEQ ID NO: 4323 - DNA, 25 bp, Homo sapien
ctacagcagtagtttccaatagaaa

SEQ ID NO: 4324 - DNA, 25 bp, Homo sapien
agcagtagtttccaatagaaataca

SEQ ID NO: 4325 - DNA, 25 bp, Homo sapien
aatgccagacacatacgtcatttta

SEQ ID NO: 4326 - DNA, 25 bp, Homo sapien
tgccagacacatacgtcattttaga

SEQ ID NO: 4327 - DNA, 25 bp, Homo sapien
cacatacgtcattttagattttcta

SEQ ID NO: 4328 - DNA, 25 bp, Homo sapien
gtgatctcatggatcaattatgaga

SEQ ID NO: 4329 - DNA, 25 bp, Homo sapien
agagcacatggcaaagctgatggaa

SEQ ID NO: 4330 - DNA, 25 bp, Homo sapien
aagctgatggaacatgtccgacttc

SEQ ID NO: 4331 - DNA, 25 bp, Homo sapien
tgatggaacatgtccgacttcctct

SEQ ID NO: 4332 - DNA, 25 bp, Homo sapien
gacttcctctcttacctagggacta

SEQ ID NO: 4333 - DNA, 25 bp, Homo sapien
ctctcttacctagggactacctagt

SEQ ID NO: 4334 - DNA, 25 bp, Homo sapien
gactacctagtccaaacggttgaag

SEQ ID NO: 4335 - DNA, 25 bp, Homo sapien
gaggccatgaaataccatctcctcc

SEQ ID NO: 4336 - DNA, 25 bp, Homo sapien
gaaataccatctcctccctctggat

SEQ ID NO: 4337 - DNA, 25 bp, Homo sapien
ctctggatcagagactattgattaa

SEQ ID NO: 4338 - DNA, 25 bp, Homo sapien
ggaccaagcccaggactccagtcag

SEQ ID NO: 4339 - DNA, 25 bp, Homo sapien
accagtctcaacacatcaccatcac

SEQ ID NO: 4340 - DNA, 25 bp, Homo sapien
agcagcagcatcacggaaactctgg

SEQ ID NO: 4341 - DNA, 25 bp, Homo sapien
gcagcagcatcacggaaactctggg

SEQ ID NO: 4342 - DNA, 25 bp, Homo sapien
agcagcatcacggaaactctgggcc

SEQ ID NO: 4343 - DNA, 25 bp, Homo sapien
gcagcatcacggaaactctgggccc

SEQ ID NO: 4344 - DNA, 25 bp, Homo sapien
tggagggcggtagctcccaccacgc

SEQ ID NO: 4345 - DNA, 25 bp, Homo sapien
accacgcacacccttacgccatgtc

SEQ ID NO: 4346 - DNA, 25 bp, Homo sapien
gtctctgaggccctacccaccaggg

SEQ ID NO: 4347 - DNA, 25 bp, Homo sapien
tatggccgcctcttagccaacagca

SEQ ID NO: 4348 - DNA, 25 bp, Homo sapien
tggccgcctcttagccaacagcaat

SEQ ID NO: 4349 - DNA, 25 bp, Homo sapien
tcttagccaacagcaatgcccatcc

SEQ ID NO: 4350 - DNA, 25 bp, Homo sapien
ctcatccccaaggagtcttggactg

SEQ ID NO: 4351 - DNA, 25 bp, Homo sapien
ggagtcttggactgcaggtccagct

SEQ ID NO: 4352 - DNA, 25 bp, Homo sapien
gactgcaggtccagctctgcagagg

SEQ ID NO: 4353 - DNA, 25 bp, Homo sapien
agggcccatactcgtctgctcatct

SEQ ID NO: 4354 - DNA, 25 bp, Homo sapien
cagtctctgtgtttatggaacacca

SEQ ID NO: 4355 - DNA, 25 bp, Homo sapien
tgagtgaggcctgcttcccaaatca

SEQ ID NO: 4356 - DNA, 25 bp, Homo sapien
gcttcccaaatcaggcacattctta

SEQ ID NO: 4357 - DNA, 25 bp, Homo sapien
atcaggcacattcttatgagactaa

SEQ ID NO: 4358 - DNA, 25 bp, Homo sapien
gagactaagatttgtccctgctcat

SEQ ID NO: 4359 - DNA, 25 bp, Homo sapien
gatttgtccctgctcatggacatta

SEQ ID NO: 4360 - DNA, 25 bp, Homo sapien
gacagcaggattaagcggaatcaca

SEQ ID NO: 4361 - DNA, 25 bp, Homo sapien
taacttccaaggtcccaccaacagt

SEQ ID NO: 4362 - DNA, 25 bp, Homo sapien
caaggtcccaccaacagttcagaaa

SEQ ID NO: 4363 - DNA, 25 bp, Homo sapien
caccaacagttcagaaacctaccac

SEQ ID NO: 4364 - DNA, 25 bp, Homo sapien
gcaacacggagtacacctgtttcca

SEQ ID NO: 4365 - DNA, 25 bp, Homo sapien
aacacggagtacacctgtttccagg

SEQ ID NO: 4366 - DNA, 25 bp, Homo sapien
acctgtttccaggacaaccaagcat

SEQ ID NO: 4367 - DNA, 25 bp, Homo sapien
agcattttcatgaaacaaccccaaa

SEQ ID NO: 4368 - DNA, 25 bp, Homo sapien
gtggaaccacttcaggtactacccg

SEQ ID NO: 4369 - DNA, 25 bp, Homo sapien
tggaaccacttcaggtactacccgt

SEQ ID NO: 4370 - DNA, 25 bp, Homo sapien
acttcaggtactacccgtcttctat

SEQ ID NO: 4371 - DNA, 25 bp, Homo sapien
caggtactacccgtcttctatctgg

SEQ ID NO: 4372 - DNA, 25 bp, Homo sapien
cacaaaggcagtttgctggagttta

SEQ ID NO: 4373 - DNA, 25 bp, Homo sapien
gcttttctggtacaaggttatggtt

SEQ ID NO: 4374 - DNA, 25 bp, Homo sapien
aaacagcacagagaggacagtccat

SEQ ID NO: 4375 - DNA, 25 bp, Homo sapien
ggacagtccatcacggtgagacttg

SEQ ID NO: 4376 - DNA, 25 bp, Homo sapien
aaaggcacacagagagctagtcgtc

SEQ ID NO: 4377 - DNA, 25 bp, Homo sapien
gagctagtcgtctctgttctggcct

SEQ ID NO: 4378 - DNA, 25 bp, Homo sapien
gttctggcctcgaacagtaatgatt

SEQ ID NO: 4379 - DNA, 25 bp, Homo sapien
gattatggtctgatgattgccctgt

SEQ ID NO: 4380 - DNA, 25 bp, Homo sapien
ggtctgatgattgccctgtgtatac

SEQ ID NO: 4381 - DNA, 25 bp, Homo sapien
tgtgtatacataactgctctcagag

SEQ ID NO: 4382 - DNA, 25 bp, Homo sapien
atttgaatcacctttcttcaaaagg

SEQ ID NO: 4383 - DNA, 25 bp, Homo sapien
tacagctacttggtaattaaacaaa

SEQ ID NO: 4384 - DNA, 25 bp, Homo sapien
tgttaactaattagcttttggcctt

SEQ ID NO: 4385 - DNA, 25 bp, Homo sapien
taattagcttttggcctttgataga

SEQ ID NO: 4386 - DNA, 25 bp, Homo sapien
aattttagaattggtcttgactact

SEQ ID NO: 4387 - DNA, 25 bp, Homo sapien
ggtcttgactactaaactattgcta

SEQ ID NO: 4388 - DNA, 25 bp, Homo sapien
tgactactaaactattgctaaaatt

SEQ ID NO: 4389 - DNA, 25 bp, Homo sapien
ggctaaaagtttttgtctcatctgc

SEQ ID NO: 4390 - DNA, 25 bp, Homo sapien
ttcagtttactagtagctttaatta

SEQ ID NO: 4391 - DNA, 25 bp, Homo sapien
taaagctgagccttttacagctact

SEQ ID NO: 4392 - DNA, 25 bp, Homo sapien
ctgagccttttacagctacttggta

SEQ ID NO: 4393 - DNA, 25 bp, Homo sapien
gagccttttacagctacttggtaat

SEQ ID NO: 4394 - DNA, 25 bp, Homo sapien
ggacttttcactactgatgtggcca

SEQ ID NO: 4395 - DNA, 25 bp, Homo sapien
tactgatgtggccaggactaccaac

SEQ ID NO: 4396 - DNA, 25 bp, Homo sapien
aggactaccaacacagtctggctta

SEQ ID NO: 4397 - DNA, 25 bp, Homo sapien
aacacagtctggcttagcaggtaga

SEQ ID NO: 4398 - DNA, 25 bp, Homo sapien
ctggcttagcaggtagaacttagtg

SEQ ID NO: 4399 - DNA, 25 bp, Homo sapien
gaacttagtgagcattcctgtctct

SEQ ID NO: 4400 - DNA, 25 bp, Homo sapien
ttctgtttgttcctctccagcaact

SEQ ID NO: 4401 - DNA, 25 bp, Homo sapien
ccagcaacttctttgtccagtggaa

SEQ ID NO: 4402 - DNA, 25 bp, Homo sapien
gtcttcatatcagctcttaatgtat

SEQ ID NO: 4403 - DNA, 25 bp, Homo sapien
ttttatcaattgtgtctttttcttt

SEQ ID NO: 4404 - DNA, 25 bp, Homo sapien
ggctttgtgtggacttttcactact

SEQ ID NO: 4405 - DNA, 25 bp, Homo sapien
tgtgaatagcacatgccttccatct

SEQ ID NO: 4406 - DNA, 25 bp, Homo sapien
acatgccttccatcttcagacaaac

SEQ ID NO: 4407 - DNA, 25 bp, Homo sapien
ttcagacaaacactgaggcctggac

SEQ ID NO: 4408 - DNA, 25 bp, Homo sapien
acctgcattaggtagatagaatcta

SEQ ID NO: 4409 - DNA, 25 bp, Homo sapien
tgtcttagcagcacggaagccacgc

SEQ ID NO: 4410 - DNA, 25 bp, Homo sapien
gaatgagggctcagtcagaactaca

SEQ ID NO: 4411 - DNA, 25 bp, Homo sapien
gggctcagtcagaactacaactaca

SEQ ID NO: 4412 - DNA, 25 bp, Homo sapien
tgtctgctcagatttttgggttaag

SEQ ID NO: 4413 - DNA, 25 bp, Homo sapien
gggttaaggttcatgccagctacat

SEQ ID NO: 4414 - DNA, 25 bp, Homo sapien
aaggttcatgccagctacattcttt

SEQ ID NO: 4415 - DNA, 25 bp, Homo sapien
atgccagctacattctttgcataat

SEQ ID NO: 4416 - DNA, 25 bp, Homo sapien
gatgagtcatggctggacgacccct

SEQ ID NO: 4417 - DNA, 25 bp, Homo sapien
tccgcataggagatcagctggttct

SEQ ID NO: 4418 - DNA, 25 bp, Homo sapien
gagacctacattcctagtgagcaag

SEQ ID NO: 4419 - DNA, 25 bp, Homo sapien
aaattcttgaatttgcccgggagat

SEQ ID NO: 4420 - DNA, 25 bp, Homo sapien
ggagattggtattgatcccatcaag

SEQ ID NO: 4421 - DNA, 25 bp, Homo sapien
gagtggaaaccatgccaggacatca

SEQ ID NO: 4422 - DNA, 25 bp, Homo sapien
atttactatttcaacttcgccaacg

SEQ ID NO: 4423 - DNA, 25 bp, Homo sapien
aacgggcagtctatgtgggaccatc

SEQ ID NO: 4424 - DNA, 25 bp, Homo sapien
tgggaccatccatgtgacgaacact

SEQ ID NO: 4425 - DNA, 25 bp, Homo sapien
acactatcggagcttggtgatccaa

SEQ ID NO: 4426 - DNA, 25 bp, Homo sapien
gagcgggcaaagctgtcaacttctg

SEQ ID NO: 4427 - DNA, 25 bp, Homo sapien
atggagagctgcctgttattctgag

SEQ ID NO: 4428 - DNA, 25 bp, Homo sapien
agagctgcctgttattctgagccaa

SEQ ID NO: 4429 - DNA, 25 bp, Homo sapien
gttattctgagccaacttctggcaa

SEQ ID NO: 4430 - DNA, 25 bp, Homo sapien
acttctggcaagatgctgggtgaat

SEQ ID NO: 4431 - DNA, 25 bp, Homo sapien
agaatgccagcaaacaaaccacaca

SEQ ID NO: 4432 - DNA, 25 bp, Homo sapien
tacgatgactcagggccacccatga

SEQ ID NO: 4433 - DNA, 25 bp, Homo sapien
ggccacccatgagtgggacattcgt

SEQ ID NO: 4434 - DNA, 25 bp, Homo sapien
gcagcagttgtaatggccagccacg

SEQ ID NO: 4435 - DNA, 25 bp, Homo sapien
gggaccagttccgtgcctggccttt

SEQ ID NO: 4436 - DNA, 25 bp, Homo sapien
gtgaggatacgaacaacataagatt

SEQ ID NO: 4437 - DNA, 25 bp, Homo sapien
taatgatcgttgtcaaaaccagtcc

SEQ ID NO: 4438 - DNA, 25 bp, Homo sapien
gactttcacgtcaccaggaatgggc

SEQ ID NO: 4439 - DNA, 25 bp, Homo sapien
ccaggaatgggcaaagtctagattt

SEQ ID NO: 4440 - DNA, 25 bp, Homo sapien
gcaggaaggatttagctaaagccat

SEQ ID NO: 4441 - DNA, 25 bp, Homo sapien
agccataaagctggaagagggtttg

SEQ ID NO: 4442 - DNA, 25 bp, Homo sapien
gggaacggctttgaagttacatttg

SEQ ID NO: 4443 - DNA, 25 bp, Homo sapien
agttacatttgttttgcaagttctt

SEQ ID NO: 4444 - DNA, 25 bp, Homo sapien
gcaagttctttgtttttattaatgt

SEQ ID NO: 4445 - DNA, 25 bp, Homo sapien
gtttgcatgttatttgggtagctgt

SEQ ID NO: 4446 - DNA, 25 bp, Homo sapien
tcagtcctactactgcccctagata

SEQ ID NO: 4447 - DNA, 25 bp, Homo sapien
ccctagatacacaatcacctcaagt

SEQ ID NO: 4448 - DNA, 25 bp, Homo sapien
aatcacctcaagtgactttcacgtc

SEQ ID NO: 4449 - DNA, 25 bp, Homo sapien
ctgaaaactccttctggccgggcat

SEQ ID NO: 4450 - DNA, 25 bp, Homo sapien
tgaaaactccttctggccgggcatg

SEQ ID NO: 4451 - DNA, 25 bp, Homo sapien
aaaactccttctggccgggcatggg

SEQ ID NO: 4452 - DNA, 25 bp, Homo sapien
cagcactggcaggctgaggccagtg

SEQ ID NO: 4453 - DNA, 25 bp, Homo sapien
ctgggtggtagtggcacgcgactgt

SEQ ID NO: 4454 - DNA, 25 bp, Homo sapien
attccttcttcggtcgggcacggtg

SEQ ID NO: 4455 - DNA, 25 bp, Homo sapien
ttccttcttcggtcgggcacggtgg

SEQ ID NO: 4456 - DNA, 25 bp, Homo sapien
cttcttcggtcgggcacggtggctc

SEQ ID NO: 4457 - DNA, 25 bp, Homo sapien
tagcgctttgagtggccaaggtggt

SEQ ID NO: 4458 - DNA, 25 bp, Homo sapien
agcgctttgagtggccaaggtggtt

SEQ ID NO: 4459 - DNA, 25 bp, Homo sapien
cgctttgagtggccaaggtggttgg

SEQ ID NO: 4460 - DNA, 25 bp, Homo sapien
aggttatatacctctacccatcttt

SEQ ID NO: 4461 - DNA, 25 bp, Homo sapien
ctacccatcttttctaagctttctt

SEQ ID NO: 4462 - DNA, 25 bp, Homo sapien
ttctttgcaaatctagtcccatcag

SEQ ID NO: 4463 - DNA, 25 bp, Homo sapien
aaatctagtcccatcagattctccc

SEQ ID NO: 4464 - DNA, 25 bp, Homo sapien
agattctccctgtgtaacaaccaac

SEQ ID NO: 4465 - DNA, 25 bp, Homo sapien
gtgtaacaaccaacttctttagatt

SEQ ID NO: 4466 - DNA, 25 bp, Homo sapien
tattgcatagtcaaaatgtcatgtt

SEQ ID NO: 4467 - DNA, 25 bp, Homo sapien
atcttctgtggcctgtgaatcactg

SEQ ID NO: 4468 - DNA, 25 bp, Homo sapien
tgaatcactgctctctataaccatg

SEQ ID NO: 4469 - DNA, 25 bp, Homo sapien
tgctctctataaccatgggaccact

SEQ ID NO: 4470 - DNA, 25 bp, Homo sapien
aaaaatctggaagcaggctgggtgc

SEQ ID NO: 4471 - DNA, 25 bp, Homo sapien
agaacccacagtgctgtccatagag

SEQ ID NO: 4472 - DNA, 25 bp, Homo sapien
gaacaagcaacgaagatcatggcta

SEQ ID NO: 4473 - DNA, 25 bp, Homo sapien
gagatccttaaaatgccgattccta

SEQ ID NO: 4474 - DNA, 25 bp, Homo sapien
gccgattcctaatctcttgctgaaa

SEQ ID NO: 4475 - DNA, 25 bp, Homo sapien
tgctgaaaactactgacttttagat

SEQ ID NO: 4476 - DNA, 25 bp, Homo sapien
tttagatattttcccgcttgccact

SEQ ID NO: 4477 - DNA, 25 bp, Homo sapien
gcttgccactctgtaatccagaata

SEQ ID NO: 4478 - DNA, 25 bp, Homo sapien
aactcgagtttacttttcactggtg

SEQ ID NO: 4479 - DNA, 25 bp, Homo sapien
acttttcactggtgtttgcatgtgt

SEQ ID NO: 4480 - DNA, 25 bp, Homo sapien
ttatgttcttgtggcaggaaactgt

SEQ ID NO: 4481 - DNA, 25 bp, Homo sapien
gaaactgtgggatctgcagcatgga

SEQ ID NO: 4482 - DNA, 25 bp, Homo sapien
ccccaggcaagcaggaaacaatgca

SEQ ID NO: 4483 - DNA, 25 bp, Homo sapien
gggtcaaggcactggcctaaggtcc

SEQ ID NO: 4484 - DNA, 25 bp, Homo sapien
ctgggaggtgcaatcaggtctgcct

SEQ ID NO: 4485 - DNA, 25 bp, Homo sapien
tgcaatcaggtctgcctggcacaga

SEQ ID NO: 4486 - DNA, 25 bp, Homo sapien
tcctgaccacgatgccaaactggtt

SEQ ID NO: 4487 - DNA, 25 bp, Homo sapien
aaactggttattattgtcaccacaa

SEQ ID NO: 4488 - DNA, 25 bp, Homo sapien
attgtggagggctgttctccaggca

SEQ ID NO: 4489 - DNA, 25 bp, Homo sapien
ggctgttctccaggcaggcaggtct

SEQ ID NO: 4490 - DNA, 25 bp, Homo sapien
agtgcccacaatgaggcagggtcct

SEQ ID NO: 4491 - DNA, 25 bp, Homo sapien
tgaggcagggtcctgtcccaaacag

SEQ ID NO: 4492 - DNA, 25 bp, Homo sapien
tccatccaatgctgggtggcgggca

SEQ ID NO: 4493 - DNA, 25 bp, Homo sapien
ttttttgtccaaacgttgtgatttg

SEQ ID NO: 4494 - DNA, 25 bp, Homo sapien
ccaaacgttgtgatttgaagtgaca

SEQ ID NO: 4495 - DNA, 25 bp, Homo sapien
agtttgggtcctattctctttgaat

SEQ ID NO: 4496 - DNA, 25 bp, Homo sapien
ttctctttgaatgtttggcccttat

SEQ ID NO: 4497 - DNA, 25 bp, Homo sapien
gaatgtttggcccttatatttatat

SEQ ID NO: 4498 - DNA, 25 bp, Homo sapien
gtgtaccactggatcatgataaata

SEQ ID NO: 4499 - DNA, 25 bp, Homo sapien
tagagtattagtttttgtcttccct

SEQ ID NO: 4500 - DNA, 25 bp, Homo sapien
ttttgtcttccctttcgtcagtgaa

SEQ ID NO: 4501 - DNA, 25 bp, Homo sapien
gtcttccctttcgtcagtgaagaag

SEQ ID NO: 4502 - DNA, 25 bp, Homo sapien
tttcttctgaaagttagaggagaca

SEQ ID NO: 4503 - DNA, 25 bp, Homo sapien
ttagcaggcatatttttcagatttt

SEQ ID NO: 4504 - DNA, 25 bp, Homo sapien
gtggattattccagcaaatacggct

SEQ ID NO: 4505 - DNA, 25 bp, Homo sapien
gcaaatacggctttggctaccagct

SEQ ID NO: 4506 - DNA, 25 bp, Homo sapien
atacggctttggctaccagctcttg

SEQ ID NO: 4507 - DNA, 25 bp, Homo sapien
ctttggctaccagctcttggacggg

SEQ ID NO: 4508 - DNA, 25 bp, Homo sapien
gggcgcacgggacggcacccacatg

SEQ ID NO: 4509 - DNA, 25 bp, Homo sapien
ctgctgttcagcaatgggatggtgc

SEQ ID NO: 4510 - DNA, 25 bp, Homo sapien
tgagcttcagtggagtcccggccca

SEQ ID NO: 4511 - DNA, 25 bp, Homo sapien
tcccggcccaactggtgctgagtgg

SEQ ID NO: 4512 - DNA, 25 bp, Homo sapien
ggtgagggtttgcagctcaccctct

SEQ ID NO: 4513 - DNA, 25 bp, Homo sapien
agggtttgcagctcaccctctggga

SEQ ID NO: 4514 - DNA, 25 bp, Homo sapien
acgccctccgcatgctgcagagtat

SEQ ID NO: 4515 - DNA, 25 bp, Homo sapien
gcagtccagcaacctcgatgacaga

SEQ ID NO: 4516 - DNA, 25 bp, Homo sapien
cagacaacccaatcgaaaaatggat

SEQ ID NO: 4517 - DNA, 25 bp, Homo sapien
aaatccagatagtcaacaaacatgt

SEQ ID NO: 4518 - DNA, 25 bp, Homo sapien
caaacatgtaaggtgcgcaagcgca

SEQ ID NO: 4519 - DNA, 25 bp, Homo sapien
gtgcgcaagcgcattacgaatcggg

SEQ ID NO: 4520 - DNA, 25 bp, Homo sapien
gggaaatgcattaaaaccacgatta

SEQ ID NO: 4521 - DNA, 25 bp, Homo sapien
aaccacgattagtttcaattgattg

SEQ ID NO: 4522 - DNA, 25 bp, Homo sapien
ggtttttaaaccacactcactagat

SEQ ID NO: 4523 - DNA, 25 bp, Homo sapien
aaaccacactcactagattggcaaa

SEQ ID NO: 4524 - DNA, 25 bp, Homo sapien
ggcagattatttgacctcctgactc

SEQ ID NO: 4525 - DNA, 25 bp, Homo sapien
cctgactcccgacttgaggtcagga

SEQ ID NO: 4526 - DNA, 25 bp, Homo sapien
cacaaatctattcatctatccactc

SEQ ID NO: 4527 - DNA, 25 bp, Homo sapien
ctattcatctatccactcctttatt

SEQ ID NO: 4528 - DNA, 25 bp, Homo sapien
tccactcctttatttatctatccac

SEQ ID NO: 4529 - DNA, 25 bp, Homo sapien
ttatttatctatccacctcttattt

SEQ ID NO: 4530 - DNA, 25 bp, Homo sapien
agacatctgtatacttatctttaaa

SEQ ID NO: 4531 - DNA, 25 bp, Homo sapien
gtacatcattaactggtgttaagta

SEQ ID NO: 4532 - DNA, 25 bp, Homo sapien
ctttatagcttttcctcttggtgga

SEQ ID NO: 4533 - DNA, 25 bp, Homo sapien
tcctcttggtggaaagtttacatac

SEQ ID NO: 4534 - DNA, 25 bp, Homo sapien
gtacatgttcactgggttttgacaa

SEQ ID NO: 4535 - DNA, 25 bp, Homo sapien
ggttttgacaagtacatgcatcagc

SEQ ID NO: 4536 - DNA, 25 bp, Homo sapien
caagatagagaatgtgcccgggcgt

SEQ ID NO: 4537 - DNA, 25 bp, Homo sapien
gtgcttggttggaacgattaaagga

SEQ ID NO: 4538 - DNA, 25 bp, Homo sapien
ggagaataacagtttagcacgatta

SEQ ID NO: 4539 - DNA, 25 bp, Homo sapien
cacagttgttcaaagagatggcttt

SEQ ID NO: 4540 - DNA, 25 bp, Homo sapien
tgaattccagcttacatggcgtctt

SEQ ID NO: 4541 - DNA, 25 bp, Homo sapien
gcttacatggcgtcttcaacaaaaa

SEQ ID NO: 4542 - DNA, 25 bp, Homo sapien
tccctgtgtgagcagaggtaaacaa

SEQ ID NO: 4543 - DNA, 25 bp, Homo sapien
aacaatgaaaactcaccaaccagga

SEQ ID NO: 4544 - DNA, 25 bp, Homo sapien
agaaattcacctaggactggcgcag

SEQ ID NO: 4545 - DNA, 25 bp, Homo sapien
aggtatacaccatgagcctggaaat

SEQ ID NO: 4546 - DNA, 25 bp, Homo sapien
caccatgagcctggaaatgatttaa

SEQ ID NO: 4547 - DNA, 25 bp, Homo sapien
tttgcgagttggaaaccagtctgac

SEQ ID NO: 4548 - DNA, 25 bp, Homo sapien
gagcatcattgggacagttggtaaa

SEQ ID NO: 4549 - DNA, 25 bp, Homo sapien
gcatcattgggacagttggtaaaat

SEQ ID NO: 4550 - DNA, 25 bp, Homo sapien
atgtgaatattgtctgaagagtata

SEQ ID NO: 4551 - DNA, 25 bp, Homo sapien
aatttcctggtcttgaggattgtac

SEQ ID NO: 4552 - DNA, 25 bp, Homo sapien
ggtcttgaggattgtactgtggtta

SEQ ID NO: 4553 - DNA, 25 bp, Homo sapien
gataaagagcattatgtcggcgact

SEQ ID NO: 4554 - DNA, 25 bp, Homo sapien
aaagagcattatgtcggcgacttat

SEQ ID NO: 4555 - DNA, 25 bp, Homo sapien
ttatgtcggcgacttattatcaaat

SEQ ID NO: 4556 - DNA, 25 bp, Homo sapien
gagagatataaaaccaatgcacctg

SEQ ID NO: 4557 - DNA, 25 bp, Homo sapien
tataaaaccaatgcacctgggtgcg

SEQ ID NO: 4558 - DNA, 25 bp, Homo sapien
aaaaccaatgcacctgggtgcggtg

SEQ ID NO: 4559 - DNA, 25 bp, Homo sapien
gtgaccaaccatcttagtttgcctg

SEQ ID NO: 4560 - DNA, 25 bp, Homo sapien
atcttagtttgcctgggaatctcca

SEQ ID NO: 4561 - DNA, 25 bp, Homo sapien
tgggaatctccaggttttagtccta

SEQ ID NO: 4562 - DNA, 25 bp, Homo sapien
aaaatctcaacatctcaggtcacac

SEQ ID NO: 4563 - DNA, 25 bp, Homo sapien
caggtcacaccttagtcttggataa

SEQ ID NO: 4564 - DNA, 25 bp, Homo sapien
taaaccaagatggtgggcggttcta

SEQ ID NO: 4565 - DNA, 25 bp, Homo sapien
aataggtttatggtgctgttacaat

SEQ ID NO: 4566 - DNA, 25 bp, Homo sapien
attttagttgagttgcagctttgca

SEQ ID NO: 4567 - DNA, 25 bp, Homo sapien
taaagggtcctgtttccacttgtag

SEQ ID NO: 4568 - DNA, 25 bp, Homo sapien
gttgttgcagagatgttgacagtca

SEQ ID NO: 4569 - DNA, 25 bp, Homo sapien
acagtcattgtattggtccattttc

SEQ ID NO: 4570 - DNA, 25 bp, Homo sapien
tgccttctttcacgtatgtacccag

SEQ ID NO: 4571 - DNA, 25 bp, Homo sapien
acgtatgtacccagaaccctcaaga

SEQ ID NO: 4572 - DNA, 25 bp, Homo sapien
acagtcagtgggaccgcaaagacct

SEQ ID NO: 4573 - DNA, 25 bp, Homo sapien
tgggcctctgctttgataactgcgt

SEQ ID NO: 4574 - DNA, 25 bp, Homo sapien
ctctgctttgataactgcgtgacat

SEQ ID NO: 4575 - DNA, 25 bp, Homo sapien
gataactgcgtgacatactttcttc

SEQ ID NO: 4576 - DNA, 25 bp, Homo sapien
gtgacatactttcttcagtgcctca

SEQ ID NO: 4577 - DNA, 25 bp, Homo sapien
gtgcctcaggacagaaaaacttgag

SEQ ID NO: 4578 - DNA, 25 bp, Homo sapien
gaattcaatctattctctagcaact

SEQ ID NO: 4579 - DNA, 25 bp, Homo sapien
gatctaagaactagagtcaccctaa

SEQ ID NO: 4580 - DNA, 25 bp, Homo sapien
gagtcaccctaaatcctggagaata

SEQ ID NO: 4581 - DNA, 25 bp, Homo sapien
gtgggaacattccagaccacctagg

SEQ ID NO: 4582 - DNA, 25 bp, Homo sapien
gctgactgtaaaaaacatctgacct

SEQ ID NO: 4583 - DNA, 25 bp, Homo sapien
ctcaggttctgctgcaccaagtgat

SEQ ID NO: 4584 - DNA, 25 bp, Homo sapien
catctgcctttctccacttataaag

SEQ ID NO: 4585 - DNA, 25 bp, Homo sapien
gttgggcatttttccagatgtggtt

SEQ ID NO: 4586 - DNA, 25 bp, Homo sapien
gcatttttccagatgtggtttcagt

SEQ ID NO: 4587 - DNA, 25 bp, Homo sapien
gtggtttcagtgtctcgcttgctac

SEQ ID NO: 4588 - DNA, 25 bp, Homo sapien
cttgctacctggtcccctgtgctgg

SEQ ID NO: 4589 - DNA, 25 bp, Homo sapien
gctgtgacgcacctggcagtccttg

SEQ ID NO: 4590 - DNA, 25 bp, Homo sapien
ggcagtccttgctctaggatggatt

SEQ ID NO: 4591 - DNA, 25 bp, Homo sapien
cttgctctaggatggattcgggccg

SEQ ID NO: 4592 - DNA, 25 bp, Homo sapien
acccagactgattaactggctcatg

SEQ ID NO: 4593 - DNA, 25 bp, Homo sapien
cagactgattaactggctcatgtga

SEQ ID NO: 4594 - DNA, 25 bp, Homo sapien
agactgattaactggctcatgtgat

SEQ ID NO: 4595 - DNA, 25 bp, Homo sapien
gactgattaactggctcatgtgatc

SEQ ID NO: 4596 - DNA, 25 bp, Homo sapien
ctgattaactggctcatgtgatctt

SEQ ID NO: 4597 - DNA, 25 bp, Homo sapien
gattaactggctcatgtgatcttgt

SEQ ID NO: 4598 - DNA, 25 bp, Homo sapien
taactggctcatgtgatcttgtggt

SEQ ID NO: 4599 - DNA, 25 bp, Homo sapien
ccacccaggaacttaatcagcacaa

SEQ ID NO: 4600 - DNA, 25 bp, Homo sapien
aggagacagcttcaactccctatga

SEQ ID NO: 4601 - DNA, 25 bp, Homo sapien
tccttaaaaagtctgctccccaaat

SEQ ID NO: 4602 - DNA, 25 bp, Homo sapien
aaatgctcgggtagactgatttggg

SEQ ID NO: 4603 - DNA, 25 bp, Homo sapien
aacctgaagtctatcatgaggctgg

SEQ ID NO: 4604 - DNA, 25 bp, Homo sapien
tgaagtctatcatgaggctggtcct

SEQ ID NO: 4605 - DNA, 25 bp, Homo sapien
ctgctgctctggccgatgtgtgtca

SEQ ID NO: 4606 - DNA, 25 bp, Homo sapien
gacatgtcccgatcaggacgggatg

SEQ ID NO: 4607 - DNA, 25 bp, Homo sapien
gatcaggacgggatgtctttcgata

SEQ ID NO: 4608 - DNA, 25 bp, Homo sapien
ggacgggatgtctttcgatatagac

SEQ ID NO: 4609 - DNA, 25 bp, Homo sapien
tcgatatagacagaggaacagcagc

SEQ ID NO: 4610 - DNA, 25 bp, Homo sapien
gagtgtgcgggccctagtgcagcag

SEQ ID NO: 4611 - DNA, 25 bp, Homo sapien
gaagggcaacaaaggtccccgtctg

SEQ ID NO: 4612 - DNA, 25 bp, Homo sapien
ggcaacaaaggtccccgtctgaatc

SEQ ID NO: 4613 - DNA, 25 bp, Homo sapien
aaaggtccccgtctgaatccagctg

SEQ ID NO: 4614 - DNA, 25 bp, Homo sapien
tttttatatgcagtcaacagatcac

SEQ ID NO: 4615 - DNA, 25 bp, Homo sapien
ttatatgcagtcaacagatcacatg

SEQ ID NO: 4616 - DNA, 25 bp, Homo sapien
tatgcagtcaacagatcacatgtgt

SEQ ID NO: 4617 - DNA, 25 bp, Homo sapien
tgcagtcaacagatcacatgtgtat

SEQ ID NO: 4618 - DNA, 25 bp, Homo sapien
gtcaacagatcacatgtgtatgtct

SEQ ID NO: 4619 - DNA, 25 bp, Homo sapien
aacagatcacatgtgtatgtctctt

SEQ ID NO: 4620 - DNA, 25 bp, Homo sapien
cagatcacatgtgtatgtctcttat

SEQ ID NO: 4621 - DNA, 25 bp, Homo sapien
gatcacatgtgtatgtctcttatgt

SEQ ID NO: 4622 - DNA, 25 bp, Homo sapien
cacatgtgtatgtctcttatgtgtt

SEQ ID NO: 4623 - DNA, 25 bp, Homo sapien
gtctcttatgtgttcctgtgtggga

SEQ ID NO: 4624 - DNA, 25 bp, Homo sapien
gtgttcctgtgtgggaatagcttga

SEQ ID NO: 4625 - DNA, 25 bp, Homo sapien
atgcagggcactgtcgtgagcacac

SEQ ID NO: 4626 - DNA, 25 bp, Homo sapien
cagggtcaccaggtgagcaaggctg

SEQ ID NO: 4627 - DNA, 25 bp, Homo sapien
gggaacaatggaggcggagccccgc

SEQ ID NO: 4628 - DNA, 25 bp, Homo sapien
ctgcccccagtgtccaggctgtggt

SEQ ID NO: 4629 - DNA, 25 bp, Homo sapien
tgttcaggggtctccttcagggaag

SEQ ID NO: 4630 - DNA, 25 bp, Homo sapien
aaggagaccaagctgggagtctggg

SEQ ID NO: 4631 - DNA, 25 bp, Homo sapien
gacagcaggtgaagagtgagccaca

SEQ ID NO: 4632 - DNA, 25 bp, Homo sapien
cagcaggtgaagagtgagccacaat

SEQ ID NO: 4633 - DNA, 25 bp, Homo sapien
atgaaaggaaactacaggcctgggc

SEQ ID NO: 4634 - DNA, 25 bp, Homo sapien
aaggaaactacaggcctgggcgcag

SEQ ID NO: 4635 - DNA, 25 bp, Homo sapien
aactacaggcctgggcgcagtggct

SEQ ID NO: 4636 - DNA, 25 bp, Homo sapien
gaagaaatgtggtcgtttgaggaac

SEQ ID NO: 4637 - DNA, 25 bp, Homo sapien
ggaacttcgagatcagcgtggccac

SEQ ID NO: 4638 - DNA, 25 bp, Homo sapien
tcgagatcagcgtggccactgatgt

SEQ ID NO: 4639 - DNA, 25 bp, Homo sapien
actgatgtgctgcagtgtagcaaag

SEQ ID NO: 4640 - DNA, 25 bp, Homo sapien
gaattcagctcacgggctctggaat

SEQ ID NO: 4641 - DNA, 25 bp, Homo sapien
gaatcagagtttcaagttggaatcc

SEQ ID NO: 4642 - DNA, 25 bp, Homo sapien
agttggaatcctgacttcctagctg

SEQ ID NO: 4643 - DNA, 25 bp, Homo sapien
ctgacttcctagctgtatcggttaa

SEQ ID NO: 4644 - DNA, 25 bp, Homo sapien
tcctagctgtatcggttaagaattt

SEQ ID NO: 4645 - DNA, 25 bp, Homo sapien
gaacagaaagcctaccttactgagg

SEQ ID NO: 4646 - DNA, 25 bp, Homo sapien
aagcctaccttactgaggttcatat

SEQ ID NO: 4647 - DNA, 25 bp, Homo sapien
gccacatgaagtacgtcatcccaac

SEQ ID NO: 4648 - DNA, 25 bp, Homo sapien
atgaagtacgtcatcccaacagatt

SEQ ID NO: 4649 - DNA, 25 bp, Homo sapien
atcccaacagattcctgggcaagga

SEQ ID NO: 4650 - DNA, 25 bp, Homo sapien
cttccatctggcctgggcttagcat

SEQ ID NO: 4651 - DNA, 25 bp, Homo sapien
tctggcctgggcttagcatctgagg

SEQ ID NO: 4652 - DNA, 25 bp, Homo sapien
agaaccttgccagggagtctgaggt

SEQ ID NO: 4653 - DNA, 25 bp, Homo sapien
ggatgatggagtcctgttaccaaat

SEQ ID NO: 4654 - DNA, 25 bp, Homo sapien
gagtcctgttaccaaatagacccag

SEQ ID NO: 4655 - DNA, 25 bp, Homo sapien
gacccagaaagtagggctgcccact

SEQ ID NO: 4656 - DNA, 25 bp, Homo sapien
cactccttctcagggatcagcaagt

SEQ ID NO: 4657 - DNA, 25 bp, Homo sapien
gatcagcaagtggaatgtgcttttc

SEQ ID NO: 4658 - DNA, 25 bp, Homo sapien
atactccactcttcctatcttttca

SEQ ID NO: 4659 - DNA, 25 bp, Homo sapien
tatcttttcattgggaccttctgct

SEQ ID NO: 4660 - DNA, 25 bp, Homo sapien
gatgaagaactccagtttcccaaag

SEQ ID NO: 4661 - DNA, 25 bp, Homo sapien
ggactgcaagaagttcatttcggaa

SEQ ID NO: 4662 - DNA, 25 bp, Homo sapien
aaatcatcagttcaagccggcgcag

SEQ ID NO: 4663 - DNA, 25 bp, Homo sapien
gtgttggccaacaaaagggcccgat

SEQ ID NO: 4664 - DNA, 25 bp, Homo sapien
aaaacgcagtctttctacatgtcct

SEQ ID NO: 4665 - DNA, 25 bp, Homo sapien
atcagtgagatctgagcctcgtgcc

SEQ ID NO: 4666 - DNA, 25 bp, Homo sapien
tgcttttgtgctacgagtcagcgtc

SEQ ID NO: 4667 - DNA, 25 bp, Homo sapien
agtcagcgtccgtgcgcgaggacac

SEQ ID NO: 4668 - DNA, 25 bp, Homo sapien
tgcattagatcagatttttgccgca

SEQ ID NO: 4669 - DNA, 25 bp, Homo sapien
ttcttttgtaattggagctttggtt

SEQ ID NO: 4670 - DNA, 25 bp, Homo sapien
ttcagtttctttgatacatatccag

SEQ ID NO: 4671 - DNA, 25 bp, Homo sapien
ttctttgatacatatccaggactgt

SEQ ID NO: 4672 - DNA, 25 bp, Homo sapien
acatatccaggactgtaaaatatct

SEQ ID NO: 4673 - DNA, 25 bp, Homo sapien
acagtgaggcaggacttatttccca

SEQ ID NO: 4674 - DNA, 25 bp, Homo sapien
gaggcaggacttatttcccagtctc

SEQ ID NO: 4675 - DNA, 25 bp, Homo sapien
gcaggacttatttcccagtctcaat

SEQ ID NO: 4676 - DNA, 25 bp, Homo sapien
ggacttatttcccagtctcaattga

SEQ ID NO: 4677 - DNA, 25 bp, Homo sapien
acttatttcccagtctcaattgata

SEQ ID NO: 4678 - DNA, 25 bp, Homo sapien
tatttcccagtctcaattgataaag

SEQ ID NO: 4679 - DNA, 25 bp, Homo sapien
tcccagtctcaattgataaagtgaa

SEQ ID NO: 4680 - DNA, 25 bp, Homo sapien
actgagagaagcgatggagctgcat

SEQ ID NO: 4681 - DNA, 25 bp, Homo sapien
gagctgcatgcagggaaactttgtt

SEQ ID NO: 4682 - DNA, 25 bp, Homo sapien
gcatgcagggaaactttgttgacag

SEQ ID NO: 4683 - DNA, 25 bp, Homo sapien
gcagggaaactttgttgacagcggt

SEQ ID NO: 4684 - DNA, 25 bp, Homo sapien
ggaaactttgttgacagcggtgtct

SEQ ID NO: 4685 - DNA, 25 bp, Homo sapien
aactttgttgacagcggtgtctgga

SEQ ID NO: 4686 - DNA, 25 bp, Homo sapien
atggaccagcagagggcactctcac

SEQ ID NO: 4687 - DNA, 25 bp, Homo sapien
agcagagggcactctcacccacggg

SEQ ID NO: 4688 - DNA, 25 bp, Homo sapien
agaagacgccgctacacaatggagt

SEQ ID NO: 4689 - DNA, 25 bp, Homo sapien
gacgccgctacacaatggagtctcg

SEQ ID NO: 4690 - DNA, 25 bp, Homo sapien
taaagtttgtaaacgtaccaatcag

SEQ ID NO: 4691 - DNA, 25 bp, Homo sapien
acccagtgtccaagcagggcgggaa

SEQ ID NO: 4692 - DNA, 25 bp, Homo sapien
agtggacaggtccagaaccacagag

SEQ ID NO: 4693 - DNA, 25 bp, Homo sapien
ccacagagggtgatgaacagatgca

SEQ ID NO: 4694 - DNA, 25 bp, Homo sapien
gcagaagtatcaatcctgaggctaa

SEQ ID NO: 4695 - DNA, 25 bp, Homo sapien
ctgaggctaaagagtaattgggcaa

SEQ ID NO: 4696 - DNA, 25 bp, Homo sapien
agttttggtgagacactcccattgc

SEQ ID NO: 4697 - DNA, 25 bp, Homo sapien
gataaggaatgttttctcttgaaag

SEQ ID NO: 4698 - DNA, 25 bp, Homo sapien
aaaattggtggaaagcggtggctca

SEQ ID NO: 4699 - DNA, 25 bp, Homo sapien
tgggcaacacctcccagtacttggg

SEQ ID NO: 4700 - DNA, 25 bp, Homo sapien
gagccgagactatgtcactgaactc

SEQ ID NO: 4701 - DNA, 25 bp, Homo sapien
agtttacttccagcctggcaaggag

SEQ ID NO: 4702 - DNA, 25 bp, Homo sapien
gataatgctttgcagatgacttcaa

SEQ ID NO: 4703 - DNA, 25 bp, Homo sapien
catccttcatagacgtacgtatgct

SEQ ID NO: 4704 - DNA, 25 bp, Homo sapien
atagacgtacgtatgctggcctggg

SEQ ID NO: 4705 - DNA, 25 bp, Homo sapien
acgtacgtatgctggcctgggttgt

SEQ ID NO: 4706 - DNA, 25 bp, Homo sapien
tatgcagatgtgtttccttcacatg

SEQ ID NO: 4707 - DNA, 25 bp, Homo sapien
atgtgtttccttcacatgtgaccac

SEQ ID NO: 4708 - DNA, 25 bp, Homo sapien
atgtgaccacagacttgattagctt

SEQ ID NO: 4709 - DNA, 25 bp, Homo sapien
gacttgattagcttgttttcacaat

SEQ ID NO: 4710 - DNA, 25 bp, Homo sapien
gaaagaattgacatgtttccagaaa

SEQ ID NO: 4711 - DNA, 25 bp, Homo sapien
ttttgttagcagaattacttgctta

SEQ ID NO: 4712 - DNA, 25 bp, Homo sapien
aaaaagtggcaaggcacgatggctc

SEQ ID NO: 4713 - DNA, 25 bp, Homo sapien
gaaaatatagcatacagggtcagaa

SEQ ID NO: 4714 - DNA, 25 bp, Homo sapien
tagcatacagggtcagaaagatttg

SEQ ID NO: 4715 - DNA, 25 bp, Homo sapien
gatttgagaatatgacgagatggtt

SEQ ID NO: 4716 - DNA, 25 bp, Homo sapien
tatgacgagatggttttagaaggca

SEQ ID NO: 4717 - DNA, 25 bp, Homo sapien
acgagatggttttagaaggcaggat

SEQ ID NO: 4718 - DNA, 25 bp, Homo sapien
ggatatgaagcaggcttcccatgtg

SEQ ID NO: 4719 - DNA, 25 bp, Homo sapien
ttcccatgtgaccattctcacttct

SEQ ID NO: 4720 - DNA, 25 bp, Homo sapien
tattctgaagtctaacactctgctt

SEQ ID NO: 4721 - DNA, 25 bp, Homo sapien
tctcttcattgattcttctagtggc

SEQ ID NO: 4722 - DNA, 25 bp, Homo sapien
tgtgggaactgagctttcatctcct

SEQ ID NO: 4723 - DNA, 25 bp, Homo sapien
tttgagggcaccatggaatccgatt

SEQ ID NO: 4724 - DNA, 25 bp, Homo sapien
aacaatttacaacagtaagcacctg

SEQ ID NO: 4725 - DNA, 25 bp, Homo sapien
agtaagcacctgtacacaagcccca

SEQ ID NO: 4726 - DNA, 25 bp, Homo sapien
gtaagcacctgtacacaagccccat

SEQ ID NO: 4727 - DNA, 25 bp, Homo sapien
catctccagtcctgtttctagggct

SEQ ID NO: 4728 - DNA, 25 bp, Homo sapien
tgtttctagggcttccaatttaaca

SEQ ID NO: 4729 - DNA, 25 bp, Homo sapien
ttctagggcttccaatttaacacac

SEQ ID NO: 4730 - DNA, 25 bp, Homo sapien
gggcttccaatttaacacacctaga

SEQ ID NO: 4731 - DNA, 25 bp, Homo sapien
ggcttccaatttaacacacctagag

SEQ ID NO: 4732 - DNA, 25 bp, Homo sapien
tccaatttaacacacctagaggctg

SEQ ID NO: 4733 - DNA, 25 bp, Homo sapien
aatttaacacacctagaggctgggc

SEQ ID NO: 4734 - DNA, 25 bp, Homo sapien
ttaacacacctagaggctgggcata

SEQ ID NO: 4735 - DNA, 25 bp, Homo sapien
cagtggttactatccaaactggttc

SEQ ID NO: 4736 - DNA, 25 bp, Homo sapien
agcacccagggcactgatttatagt

SEQ ID NO: 4737 - DNA, 25 bp, Homo sapien
gggcactgatttatagtacaagcaa

SEQ ID NO: 4738 - DNA, 25 bp, Homo sapien
ttatagtacaagcaacaaacactcc

SEQ ID NO: 4739 - DNA, 25 bp, Homo sapien
aaagctgccctgacactgtcaggtg

SEQ ID NO: 4740 - DNA, 25 bp, Homo sapien
ctgacactgtcaggtgtgcagcctg

SEQ ID NO: 4741 - DNA, 25 bp, Homo sapien
gaggctgagtattactgcctgctct

SEQ ID NO: 4742 - DNA, 25 bp, Homo sapien
ctgagtattactgcctgctctacta

SEQ ID NO: 4743 - DNA, 25 bp, Homo sapien
ggagcaaccgtaggagaagcacagt

SEQ ID NO: 4744 - DNA, 25 bp, Homo sapien
ggagaagcacagttgggcccttacc

SEQ ID NO: 4745 - DNA, 25 bp, Homo sapien
agaagcacagttgggcccttaccag

SEQ ID NO: 4746 - DNA, 25 bp, Homo sapien
ggattagtagctttagttttcatca

SEQ ID NO: 4747 - DNA, 25 bp, Homo sapien
gaagctatatatcgagtcagacaat

SEQ ID NO: 4748 - DNA, 25 bp, Homo sapien
cgagtcagacaatacttcctgataa

SEQ ID NO: 4749 - DNA, 25 bp, Homo sapien
tcaagtctctgccagattcaagtgg

SEQ ID NO: 4750 - DNA, 25 bp, Homo sapien
gattcaagtggccacacagctcaca

SEQ ID NO: 4751 - DNA, 25 bp, Homo sapien
acagctcacaagcagccacagtgaa

SEQ ID NO: 4752 - DNA, 25 bp, Homo sapien
acatataaacacagtgccttttcaa

SEQ ID NO: 4753 - DNA, 25 bp, Homo sapien
attttagttgcctagagcttcccag

SEQ ID NO: 4754 - DNA, 25 bp, Homo sapien
aaggcagcccgcctcttattttctc

SEQ ID NO: 4755 - DNA, 25 bp, Homo sapien
ctttccctgaagatctaaggatata

SEQ ID NO: 4756 - DNA, 25 bp, Homo sapien
gatctaaggatataaccagcttcat

SEQ ID NO: 4757 - DNA, 25 bp, Homo sapien
atataagcgtgaactcatttgttgt

SEQ ID NO: 4758 - DNA, 25 bp, Homo sapien
agcgtgaactcatttgttgttcttt

SEQ ID NO: 4759 - DNA, 25 bp, Homo sapien
gttgttcttttaccgtagacacatt

SEQ ID NO: 4760 - DNA, 25 bp, Homo sapien
gtagacacattttctacctctgccc

SEQ ID NO: 4761 - DNA, 25 bp, Homo sapien
tacctctgccccagtagcagtagac

SEQ ID NO: 4762 - DNA, 25 bp, Homo sapien
gccccagtagcagtagacacatcaa

SEQ ID NO: 4763 - DNA, 25 bp, Homo sapien
gtagcagtagacacatcaagcacct

SEQ ID NO: 4764 - DNA, 25 bp, Homo sapien
gtagacacatcaagcacctagaaag

SEQ ID NO: 4765 - DNA, 25 bp, Homo sapien
aagcacctagaaagtggtctctaat

SEQ ID NO: 4766 - DNA, 25 bp, Homo sapien
gaaagtggtctctaatacatgaaaa

SEQ ID NO: 4767 - DNA, 25 bp, Homo sapien
aattcatagtgatggtttcaaagcc

SEQ ID NO: 4768 - DNA, 25 bp, Homo sapien
ttattcttttagttaaggctggttg

SEQ ID NO: 4769 - DNA, 25 bp, Homo sapien
attcttttagttaaggctggttgat

SEQ ID NO: 4770 - DNA, 25 bp, Homo sapien
tttagttaaggctggttgatattac

SEQ ID NO: 4771 - DNA, 25 bp, Homo sapien
gttaaggctggttgatattaccttg

SEQ ID NO: 4772 - DNA, 25 bp, Homo sapien
aaggctggttgatattaccttgtgt

SEQ ID NO: 4773 - DNA, 25 bp, Homo sapien
ggctggttgatattaccttgtgtgt

SEQ ID NO: 4774 - DNA, 25 bp, Homo sapien
gctggttgatattaccttgtgtgta

SEQ ID NO: 4775 - DNA, 25 bp, Homo sapien
ggttgatattaccttgtgtgtatat

SEQ ID NO: 4776 - DNA, 25 bp, Homo sapien
tgatattaccttgtgtgtatatacc

SEQ ID NO: 4777 - DNA, 25 bp, Homo sapien
acatgttgtttatccattgttgttg

SEQ ID NO: 4778 - DNA, 25 bp, Homo sapien
atgttgtttatccattgttgttgat

SEQ ID NO: 4779 - DNA, 25 bp, Homo sapien
agattatccctttatcacttagaga

SEQ ID NO: 4780 - DNA, 25 bp, Homo sapien
gaacacaattttcgtgccctttttg

SEQ ID NO: 4781 - DNA, 25 bp, Homo sapien
tcgtgccctttttgattattttgtt

SEQ ID NO: 4782 - DNA, 25 bp, Homo sapien
tccctattatttcactataccttaa

SEQ ID NO: 4783 - DNA, 25 bp, Homo sapien
gattgttcagatttagtcagcttct

SEQ ID NO: 4784 - DNA, 25 bp, Homo sapien
gtcagcttctactttgtctagggtc

SEQ ID NO: 4785 - DNA, 25 bp, Homo sapien
gccagaactcaagtacattttccat

SEQ ID NO: 4786 - DNA, 25 bp, Homo sapien
agtacattttccatgtgagatctga

SEQ ID NO: 4787 - DNA, 25 bp, Homo sapien
gaactatcacctctgtagacttaag

SEQ ID NO: 4788 - DNA, 25 bp, Homo sapien
gatttttgtactaactgtatctttg

SEQ ID NO: 4789 - DNA, 25 bp, Homo sapien
atctttgttttcctagggtgataca

SEQ ID NO: 4790 - DNA, 25 bp, Homo sapien
gaaactcacgagacagcgactcaag

SEQ ID NO: 4791 - DNA, 25 bp, Homo sapien
gcgactcaaggtctctttttcctaa

SEQ ID NO: 4792 - DNA, 25 bp, Homo sapien
agaaaattgttctcagatgtcactc

SEQ ID NO: 4793 - DNA, 25 bp, Homo sapien
atgtcactcagtgtagcctactcaa

SEQ ID NO: 4794 - DNA, 25 bp, Homo sapien
gcctactcaaaagaacctacatgga

SEQ ID NO: 4795 - DNA, 25 bp, Homo sapien
ggaggagaaagcaacacactctttt

SEQ ID NO: 4796 - DNA, 25 bp, Homo sapien
ccatggactgggaggatttgaatct

SEQ ID NO: 4797 - DNA, 25 bp, Homo sapien
tgaatcttggatccgaggacatcgt

SEQ ID NO: 4798 - DNA, 25 bp, Homo sapien
ggacatcgtagaaatcctggttgtt

SEQ ID NO: 4799 - DNA, 25 bp, Homo sapien
atcctggttgtttactagctgtgtg

SEQ ID NO: 4800 - DNA, 25 bp, Homo sapien
ctatgtccccacctataaagtagga

SEQ ID NO: 4801 - DNA, 25 bp, Homo sapien
aaccaagaagcttaggtgtgttgaa

SEQ ID NO: 4802 - DNA, 25 bp, Homo sapien
tgttgaagacaacattcagcactga

SEQ ID NO: 4803 - DNA, 25 bp, Homo sapien
cattcagcactgatctgtggtgtgc

SEQ ID NO: 4804 - DNA, 25 bp, Homo sapien
tgtggtgtgctgtagtggccaatct

SEQ ID NO: 4805 - DNA, 25 bp, Homo sapien
gactagcctgtgaattacactctga

SEQ ID NO: 4806 - DNA, 25 bp, Homo sapien
gaattacactctgaagcaaatgcca

SEQ ID NO: 4807 - DNA, 25 bp, Homo sapien
atgccaagagttgccaattttgcca

SEQ ID NO: 4808 - DNA, 25 bp, Homo sapien
tttgcttggctctttaccttggatt

SEQ ID NO: 4809 - DNA, 25 bp, Homo sapien
ggctctttaccttggatttcataga

SEQ ID NO: 4810 - DNA, 25 bp, Homo sapien
ggtacctgggctaaaataatcagca

SEQ ID NO: 4811 - DNA, 25 bp, Homo sapien
aagttatcaaaaactacaggccagg

SEQ ID NO: 4812 - DNA, 25 bp, Homo sapien
ggctgcagggaggtctgacttagct

SEQ ID NO: 4813 - DNA, 25 bp, Homo sapien
ttagctggggaaagtgccatccctg

SEQ ID NO: 4814 - DNA, 25 bp, Homo sapien
atccctgccattgctagtgacaagc

SEQ ID NO: 4815 - DNA, 25 bp, Homo sapien
attgctagtgacaagctcgggctgc

SEQ ID NO: 4816 - DNA, 25 bp, Homo sapien
ctagtgacaagctcgggctgctgtg

SEQ ID NO: 4817 - DNA, 25 bp, Homo sapien
cagcacagattcaacactcactgcg

SEQ ID NO: 4818 - DNA, 25 bp, Homo sapien
gtgccagctgttgcacactcacctc

SEQ ID NO: 4819 - DNA, 25 bp, Homo sapien
aactcacaggaagcaaggctgggaa

SEQ ID NO: 4820 - DNA, 25 bp, Homo sapien
ccacacagatgctgcgagttgggat

SEQ ID NO: 4821 - DNA, 25 bp, Homo sapien
cacagatgctgcgagttgggattat

SEQ ID NO: 4822 - DNA, 25 bp, Homo sapien
gatgctgcgagttgggattatgatc

SEQ ID NO: 4823 - DNA, 25 bp, Homo sapien
gtggtttaaataacagtgcaatttc

SEQ ID NO: 4824 - DNA, 25 bp, Homo sapien
aaatttataactttcttttgatcat

SEQ ID NO: 4825 - DNA, 25 bp, Homo sapien
cttttgatcatcatgtacagaggtg

SEQ ID NO: 4826 - DNA, 25 bp, Homo sapien
gatcatcatgtacagaggtgttttt

SEQ ID NO: 4827 - DNA, 25 bp, Homo sapien
tttttctttaggcttctcatgcata

SEQ ID NO: 4828 - DNA, 25 bp, Homo sapien
tttctttaggcttctcatgcatatg

SEQ ID NO: 4829 - DNA, 25 bp, Homo sapien
tctttaggcttctcatgcatatgaa

SEQ ID NO: 4830 - DNA, 25 bp, Homo sapien
gcatatgaatattttaagcacgaat

SEQ ID NO: 4831 - DNA, 25 bp, Homo sapien
tattttaagcacgaatggactacta

SEQ ID NO: 4832 - DNA, 25 bp, Homo sapien
gcacgaatggactactaaatatctg

SEQ ID NO: 4833 - DNA, 25 bp, Homo sapien
aatggactactaaatatctgagttt

SEQ ID NO: 4834 - DNA, 25 bp, Homo sapien
gctcaataaatgcttcgaggctgat

SEQ ID NO: 4835 - DNA, 25 bp, Homo sapien
ctcaataaatgcttcgaggctgatg

SEQ ID NO: 4836 - DNA, 25 bp, Homo sapien
tcaataaatgcttcgaggctgatga

SEQ ID NO: 4837 - DNA, 25 bp, Homo sapien
ttcgaggctgatgaggctgctggct

SEQ ID NO: 4838 - DNA, 25 bp, Homo sapien
aagtctccatctgagactcccaaat

SEQ ID NO: 4839 - DNA, 25 bp, Homo sapien
agtctccatctgagactcccaaatt

SEQ ID NO: 4840 - DNA, 25 bp, Homo sapien
gtctccatctgagactcccaaattg

SEQ ID NO: 4841 - DNA, 25 bp, Homo sapien
tctccatctgagactcccaaattgc

SEQ ID NO: 4842 - DNA, 25 bp, Homo sapien
ctccatctgagactcccaaattgct

SEQ ID NO: 4843 - DNA, 25 bp, Homo sapien
tccatctgagactcccaaattgctc

SEQ ID NO: 4844 - DNA, 25 bp, Homo sapien
tctgagactcccaaattgctcccca

SEQ ID NO: 4845 - DNA, 25 bp, Homo sapien
aataatctaagttcctgattcaagc

SEQ ID NO: 4846 - DNA, 25 bp, Homo sapien
atctaagttcctgattcaagcaact

SEQ ID NO: 4847 - DNA, 25 bp, Homo sapien
gttcctgattcaagcaactagaaaa

SEQ ID NO: 4848 - DNA, 25 bp, Homo sapien
tgaaaccaaaggactggacgcaatg

SEQ ID NO: 4849 - DNA, 25 bp, Homo sapien
accaaaggactggacgcaatggctt

SEQ ID NO: 4850 - DNA, 25 bp, Homo sapien
caaaggactggacgcaatggcttat

SEQ ID NO: 4851 - DNA, 25 bp, Homo sapien
aggactggacgcaatggcttatgcc

SEQ ID NO: 4852 - DNA, 25 bp, Homo sapien
accagcccagacaactagtgggacc

SEQ ID NO: 4853 - DNA, 25 bp, Homo sapien
gcccagacaactagtgggaccctat

SEQ ID NO: 4854 - DNA, 25 bp, Homo sapien
aagagaaatcactgaggccgagcgt

SEQ ID NO: 4855 - DNA, 25 bp, Homo sapien
agaaatcactgaggccgagcgtggt

SEQ ID NO: 4856 - DNA, 25 bp, Homo sapien
ttcgcgtgccgaattgtaaaaagtg

SEQ ID NO: 4857 - DNA, 25 bp, Homo sapien
aaagtgcacgttaatgcgagcctgt

SEQ ID NO: 4858 - DNA, 25 bp, Homo sapien
gtgacatgaatctcagccatgctgg

SEQ ID NO: 4859 - DNA, 25 bp, Homo sapien
gagaaaccttttgtgcctaattagc

SEQ ID NO: 4860 - DNA, 25 bp, Homo sapien
ttagcacgcagaacagaacacaggg

SEQ ID NO: 4861 - DNA, 25 bp, Homo sapien
aacacagggttcgatttatggactt

SEQ ID NO: 4862 - DNA, 25 bp, Homo sapien
gaatttcagtgggagactgtggcaa

SEQ ID NO: 4863 - DNA, 25 bp, Homo sapien
ggcaaatgacacagtgttgacactg

SEQ ID NO: 4864 - DNA, 25 bp, Homo sapien
ttgactacatgttggtctagacccc

SEQ ID NO: 4865 - DNA, 25 bp, Homo sapien
tggtctagaccccagttgaaattaa

SEQ ID NO: 4866 - DNA, 25 bp, Homo sapien
ttcttcctttttgagcaggatggga

SEQ ID NO: 4867 - DNA, 25 bp, Homo sapien
atgggctgaaatggaaaacgtgtat

SEQ ID NO: 4868 - DNA, 25 bp, Homo sapien
ggctgaaatggaaaacgtgtataaa

SEQ ID NO: 4869 - DNA, 25 bp, Homo sapien
ctagacgattggagtgtgaaagtga

SEQ ID NO: 4870 - DNA, 25 bp, Homo sapien
tgaggaggcagaaatgcgctttgat

SEQ ID NO: 4871 - DNA, 25 bp, Homo sapien
agaaatgcgctttgatgggagctca

SEQ ID NO: 4872 - DNA, 25 bp, Homo sapien
gatgggagctcagacagtaaaaatt

SEQ ID NO: 4873 - DNA, 25 bp, Homo sapien
gagctcagacagtaaaaattaacac

SEQ ID NO: 4874 - DNA, 25 bp, Homo sapien
agatgagcacggaagagaacgttgt

SEQ ID NO: 4875 - DNA, 25 bp, Homo sapien
ttgtgggtggcgaaggtacaaaata

SEQ ID NO: 4876 - DNA, 25 bp, Homo sapien
gggtggcgaaggtacaaaatagcat

SEQ ID NO: 4877 - DNA, 25 bp, Homo sapien
taaacacctgtgtaaggaaagacct

SEQ ID NO: 4878 - DNA, 25 bp, Homo sapien
tcctactgcctcatccttcggagta

SEQ ID NO: 4879 - DNA, 25 bp, Homo sapien
gctaggctggtctctgtccgtcctc

SEQ ID NO: 4880 - DNA, 25 bp, Homo sapien
taggctggtctctgtccgtcctctg

SEQ ID NO: 4881 - DNA, 25 bp, Homo sapien
ggctggtctctgtccgtcctctgag

SEQ ID NO: 4882 - DNA, 25 bp, Homo sapien
tctctgtccgtcctctgagctcaag

SEQ ID NO: 4883 - DNA, 25 bp, Homo sapien
gtccgtcctctgagctcaagctaag

SEQ ID NO: 4884 - DNA, 25 bp, Homo sapien
atcatatcccagtgacctgcacata

SEQ ID NO: 4885 - DNA, 25 bp, Homo sapien
atcccagtgacctgcacatatacat

SEQ ID NO: 4886 - DNA, 25 bp, Homo sapien
gcaccattgtgatatgttactgccc

SEQ ID NO: 4887 - DNA, 25 bp, Homo sapien
tgcccgcaaaacattgctccaaact

SEQ ID NO: 4888 - DNA, 25 bp, Homo sapien
ccgcaaaacattgctccaaactcca

SEQ ID NO: 4889 - DNA, 25 bp, Homo sapien
aaaaaatgtctcctactgatccctg

SEQ ID NO: 4890 - DNA, 25 bp, Homo sapien
gtctcctactgatccctgacaaggg

SEQ ID NO: 4891 - DNA, 25 bp, Homo sapien
gggaattcaaattcttccagagatg

SEQ ID NO: 4892 - DNA, 25 bp, Homo sapien
gagatgaggagcttgctgttgcaca

SEQ ID NO: 4893 - DNA, 25 bp, Homo sapien
gcacagggtaccttggttcaattaa

SEQ ID NO: 4894 - DNA, 25 bp, Homo sapien
taaaaggacagttagggcctacagg

SEQ ID NO: 4895 - DNA, 25 bp, Homo sapien
gggcctacagggaaacccttgtgag

SEQ ID NO: 4896 - DNA, 25 bp, Homo sapien
atagttgttctgtatcttagtgctg

SEQ ID NO: 4897 - DNA, 25 bp, Homo sapien
atcttagtgctggtggtatttatgc

SEQ ID NO: 4898 - DNA, 25 bp, Homo sapien
tgcagttgtatgctttggtgaaaac

SEQ ID NO: 4899 - DNA, 25 bp, Homo sapien
gggtgagttctcttgaatgttaatt

SEQ ID NO: 4900 - DNA, 25 bp, Homo sapien
acttaggtaggtcctgccgcgttga

SEQ ID NO: 4901 - DNA, 25 bp, Homo sapien
taggtaggtcctgccgcgttgacca

SEQ ID NO: 4902 - DNA, 25 bp, Homo sapien
gcgttgaccactggcgtctcgctgg

SEQ ID NO: 4903 - DNA, 25 bp, Homo sapien
ctggcgtctcgctggtggtcttcga

SEQ ID NO: 4904 - DNA, 25 bp, Homo sapien
ttcgagaccggcgttggttgaaaat

SEQ ID NO: 4905 - DNA, 25 bp, Homo sapien
gagaccggcgttggttgaaaatcgc

SEQ ID NO: 4906 - DNA, 25 bp, Homo sapien
ggtgcggtcgctcgcgaggtctggc

SEQ ID NO: 4907 - DNA, 25 bp, Homo sapien
tgcagacccctaaccttgttctttc

SEQ ID NO: 4908 - DNA, 25 bp, Homo sapien
gttctttctccgcaggacactggtc

SEQ ID NO: 4909 - DNA, 25 bp, Homo sapien
tgcgctctcctcttcacttaggtag

SEQ ID NO: 4910 - DNA, 25 bp, Homo sapien
tcctcttcacttaggtaggtcctgc

SEQ ID NO: 4911 - DNA, 25 bp, Homo sapien
tccttggcctgtcaggctgcgccgt

SEQ ID NO: 4912 - DNA, 25 bp, Homo sapien
gcctgtgggacaagatagccgcgca

SEQ ID NO: 4913 - DNA, 25 bp, Homo sapien
tgggacaagatagccgcgcagctcc

SEQ ID NO: 4914 - DNA, 25 bp, Homo sapien
cagctgtgcagcagacgcctctgcg

SEQ ID NO: 4915 - DNA, 25 bp, Homo sapien
gcagacgcctctgcgctgaggacag

SEQ ID NO: 4916 - DNA, 25 bp, Homo sapien
tctgcgctgaggacagggacgccct

SEQ ID NO: 4917 - DNA, 25 bp, Homo sapien
ctgaggacagggacgccctgcgcca

SEQ ID NO: 4918 - DNA, 25 bp, Homo sapien
ccggcgagtgcacgctggaccacgg

SEQ ID NO: 4919 - DNA, 25 bp, Homo sapien
caagctcttctttcggcgcctctga

SEQ ID NO: 4920 - DNA, 25 bp, Homo sapien
tcaccgaagcccctaataaatgaag

SEQ ID NO: 4921 - DNA, 25 bp, Homo sapien
cccctaataaatgaagctgctggcc

SEQ ID NO: 4922 - DNA, 25 bp, Homo sapien
acgttcattccagaaccctggtcag

SEQ ID NO: 4923 - DNA, 25 bp, Homo sapien
aggtgaagtgccgtgtgctcctcac

SEQ ID NO: 4924 - DNA, 25 bp, Homo sapien
tgctcctcacattcacgcagactga

SEQ ID NO: 4925 - DNA, 25 bp, Homo sapien
gactgagactgagctgcccgaggaa

SEQ ID NO: 4926 - DNA, 25 bp, Homo sapien
gaagagtgtgaaggccccaagctgc

SEQ ID NO: 4927 - DNA, 25 bp, Homo sapien
agcatgtgatgagagcccggcctcc

SEQ ID NO: 4928 - DNA, 25 bp, Homo sapien
gtgagacgacttacgactgggagta

SEQ ID NO: 4929 - DNA, 25 bp, Homo sapien
acgactgggagtacgctgggttcac

SEQ ID NO: 4930 - DNA, 25 bp, Homo sapien
tgggttcaccccttgcacagcaaca

SEQ ID NO: 4931 - DNA, 25 bp, Homo sapien
acagcaacatgcttgggaggccatc

SEQ ID NO: 4932 - DNA, 25 bp, Homo sapien
gaggccatcaagaagccatagcagt

SEQ ID NO: 4933 - DNA, 25 bp, Homo sapien
aggtgggaatacacaagcaggtgca

SEQ ID NO: 4934 - DNA, 25 bp, Homo sapien
acaagcaggtgcatgtaagcccaaa

SEQ ID NO: 4935 - DNA, 25 bp, Homo sapien
gcaggtgcatgtaagcccaaaagct

SEQ ID NO: 4936 - DNA, 25 bp, Homo sapien
aagcccaaaagctagaaagccttat

SEQ ID NO: 4937 - DNA, 25 bp, Homo sapien
cattccagttattcacttacagatg

SEQ ID NO: 4938 - DNA, 25 bp, Homo sapien
ttatcagtttggtagttcgttattt

SEQ ID NO: 4939 - DNA, 25 bp, Homo sapien
tcagtttggtagttcgttattttag

SEQ ID NO: 4940 - DNA, 25 bp, Homo sapien
gaatttattcccataacctacaata

SEQ ID NO: 4941 - DNA, 25 bp, Homo sapien
aacctacaatagcactgagaacaga

SEQ ID NO: 4942 - DNA, 25 bp, Homo sapien
acctgagggtgcctccaaatgtata

SEQ ID NO: 4943 - DNA, 25 bp, Homo sapien
aatgtatatcatttcactcccctcc

SEQ ID NO: 4944 - DNA, 25 bp, Homo sapien
gaaagatggacgctatctcctcctg

SEQ ID NO: 4945 - DNA, 25 bp, Homo sapien
gacgctatctcctcctgggagagga

SEQ ID NO: 4946 - DNA, 25 bp, Homo sapien
gtgagagcattatgtggccacttat

SEQ ID NO: 4947 - DNA, 25 bp, Homo sapien
ggccacttatgtttgcaatctacca

SEQ ID NO: 4948 - DNA, 25 bp, Homo sapien
aatctaccatacttagccctttgag

SEQ ID NO: 4949 - DNA, 25 bp, Homo sapien
aacttgcttcaaatagggcattcag

SEQ ID NO: 4950 - DNA, 25 bp, Homo sapien
aggagaagacccttattggcatgac

SEQ ID NO: 4951 - DNA, 25 bp, Homo sapien
gtgcacattctacagcctctgtgca

SEQ ID NO: 4952 - DNA, 25 bp, Homo sapien
ctgtgcacatcagacttgttaatat

SEQ ID NO: 4953 - DNA, 25 bp, Homo sapien
agtgcaagtcacacggccaagccca

SEQ ID NO: 4954 - DNA, 25 bp, Homo sapien
cacggccaagcccagattaaggagt

SEQ ID NO: 4955 - DNA, 25 bp, Homo sapien
tatctgccggcccttggtccggtga

SEQ ID NO: 4956 - DNA, 25 bp, Homo sapien
ctgccggcccttggtccggtgagaa

SEQ ID NO: 4957 - DNA, 25 bp, Homo sapien
tacttcctggccaaccggcaaaata

SEQ ID NO: 4958 - DNA, 25 bp, Homo sapien
cttcctggccaaccggcaaaataat

SEQ ID NO: 4959 - DNA, 25 bp, Homo sapien
aatctatgctgagggatgagcggct

SEQ ID NO: 4960 - DNA, 25 bp, Homo sapien
tatgctgagggatgagcggctgctc

SEQ ID NO: 4961 - DNA, 25 bp, Homo sapien
agggatgagcggctgctcacagaag

SEQ ID NO: 4962 - DNA, 25 bp, Homo sapien
tgctcacagaagagaagcttgcaga

SEQ ID NO: 4963 - DNA, 25 bp, Homo sapien
gaagcttgcagaggagctcgggcaa

SEQ ID NO: 4964 - DNA, 25 bp, Homo sapien
ttgcagaggagctcgggcaagctga

SEQ ID NO: 4965 - DNA, 25 bp, Homo sapien
gagccggacaactcccagggacggg

SEQ ID NO: 4966 - DNA, 25 bp, Homo sapien
tagaatattccactataatgtgtct

SEQ ID NO: 4967 - DNA, 25 bp, Homo sapien
cctttatctttcttgttatatcctg

SEQ ID NO: 4968 - DNA, 25 bp, Homo sapien
ttttcttcaaatagtctctctccac

SEQ ID NO: 4969 - DNA, 25 bp, Homo sapien
tcttcaaatagtctctctccacatt

SEQ ID NO: 4970 - DNA, 25 bp, Homo sapien
ctctctccacattctatctattatt

SEQ ID NO: 4971 - DNA, 25 bp, Homo sapien
attctatctattatttccttttgta

SEQ ID NO: 4972 - DNA, 25 bp, Homo sapien
atttccttttgtaatcttagtcagt

SEQ ID NO: 4973 - DNA, 25 bp, Homo sapien
ttctgttgttctttgctcatttatt

SEQ ID NO: 4974 - DNA, 25 bp, Homo sapien
tcatttatttccactctgttttatt

SEQ ID NO: 4975 - DNA, 25 bp, Homo sapien
atttccactctgttttatttacata

SEQ ID NO: 4976 - DNA, 25 bp, Homo sapien
aattccagtatcttaatttcttaag

SEQ ID NO: 4977 - DNA, 25 bp, Homo sapien
gaagcactgggtcagttaaaaggca

SEQ ID NO: 4978 - DNA, 25 bp, Homo sapien
ggaaatgtggacaaaagccttgatt

SEQ ID NO: 4979 - DNA, 25 bp, Homo sapien
gccttgattgtggttttcagggaag

SEQ ID NO: 4980 - DNA, 25 bp, Homo sapien
gcacacaagacagggtaagcaggtt

SEQ ID NO: 4981 - DNA, 25 bp, Homo sapien
ttagctagttcggataatttcaggg

SEQ ID NO: 4982 - DNA, 25 bp, Homo sapien
gggctgttcctgattgtctagtacc

SEQ ID NO: 4983 - DNA, 25 bp, Homo sapien
attgtctagtacctggcccgggtga

SEQ ID NO: 4984 - DNA, 25 bp, Homo sapien
gcagtgtagtattggccctcagtgt

SEQ ID NO: 4985 - DNA, 25 bp, Homo sapien
gtttgcctatgaaaggagtactcaa

SEQ ID NO: 4986 - DNA, 25 bp, Homo sapien
aaaggtgagtttactatctctaatg

SEQ ID NO: 4987 - DNA, 25 bp, Homo sapien
aatgaaaaagctaatcctggcaggg

SEQ ID NO: 4988 - DNA, 25 bp, Homo sapien
atgaaatactctgacattgtgatgt

SEQ ID NO: 4989 - DNA, 25 bp, Homo sapien
actttcctaagtgacctttctctct

SEQ ID NO: 4990 - DNA, 25 bp, Homo sapien
agaaaatgctactaccaaaggtgtt

SEQ ID NO: 4991 - DNA, 25 bp, Homo sapien
tgaataagaactcccattagcaggt

SEQ ID NO: 4992 - DNA, 25 bp, Homo sapien
ccattagcaggtgggtttagcgctg

SEQ ID NO: 4993 - DNA, 25 bp, Homo sapien
ctgtttgtgaactgactgcagaaca

SEQ ID NO: 4994 - DNA, 25 bp, Homo sapien
atgaaacattcctatccatcctgag

SEQ ID NO: 4995 - DNA, 25 bp, Homo sapien
gatgattccttgagtcagcaaaact

SEQ ID NO: 4996 - DNA, 25 bp, Homo sapien
tcaatcccagtgtattttcgcaata

SEQ ID NO: 4997 - DNA, 25 bp, Homo sapien
gaattgaacaactaggtgagccttt

SEQ ID NO: 4998 - DNA, 25 bp, Homo sapien
gagccttttaatagtccgtgtctga

SEQ ID NO: 4999 - DNA, 25 bp, Homo sapien
tgaccagaggagcttgaggactgct

SEQ ID NO: 5000 - DNA, 25 bp, Homo sapien
tgctgacagcaccagctggtcgaga

SEQ ID NO: 5001 - DNA, 25 bp, Homo sapien
agctggtcgagacttgcttcatttt

SEQ ID NO: 5002 - DNA, 25 bp, Homo sapien
ttggattgtcctttgctgtttgatt

SEQ ID NO: 5003 - DNA, 25 bp, Homo sapien
aaaccatgagcaggtattacttaag

SEQ ID NO: 5004 - DNA, 25 bp, Homo sapien
gcaggtattacttaagatgacttat

SEQ ID NO: 5005 - DNA, 25 bp, Homo sapien
gctttcattgattctgttcaaccgt

SEQ ID NO: 5006 - DNA, 25 bp, Homo sapien
gattctgttcaaccgttgattggaa

SEQ ID NO: 5007 - DNA, 25 bp, Homo sapien
gaaaaagaagtcacaacggaagagg

SEQ ID NO: 5008 - DNA, 25 bp, Homo sapien
gaaggccaggacaacagctcagtaa

SEQ ID NO: 5009 - DNA, 25 bp, Homo sapien
acagctcagtaaagctgaggtgcaa

SEQ ID NO: 5010 - DNA, 25 bp, Homo sapien
ttatgtcataccgttggaattctat

SEQ ID NO: 5011 - DNA, 25 bp, Homo sapien
ggaattctatatccacaggtttcta

SEQ ID NO: 5012 - DNA, 25 bp, Homo sapien
cacaggtttctatccgtggttgttt

SEQ ID NO: 5013 - DNA, 25 bp, Homo sapien
ctatccgtggttgtttgaatctgca

SEQ ID NO: 5014 - DNA, 25 bp, Homo sapien
gcaaatctgctgtgaagctcacaga

SEQ ID NO: 5015 - DNA, 25 bp, Homo sapien
gctgactgtggttttactttgctgt

SEQ ID NO: 5016 - DNA, 25 bp, Homo sapien
tgctgttttaagcacatctgcctga

SEQ ID NO: 5017 - DNA, 25 bp, Homo sapien
gcacatctgcctgaataaaactgga

SEQ ID NO: 5018 - DNA, 25 bp, Homo sapien
ctggaaatggtgctacactgggcat

SEQ ID NO: 5019 - DNA, 25 bp, Homo sapien
ctttgaaaggcctgttgcctgagcc

SEQ ID NO: 5020 - DNA, 25 bp, Homo sapien
ggccaaggcattgcagaaaccctct

SEQ ID NO: 5021 - DNA, 25 bp, Homo sapien
ccgccgaggcgctctctgggagaag

SEQ ID NO: 5022 - DNA, 25 bp, Homo sapien
gctctctgggagaagcgggaacctc

SEQ ID NO: 5023 - DNA, 25 bp, Homo sapien
ctctctgggagaagcgggaacctcg

SEQ ID NO: 5024 - DNA, 25 bp, Homo sapien
tggactcggccggaacagggaacct

SEQ ID NO: 5025 - DNA, 25 bp, Homo sapien
gactcggccggaacagggaacctcg

SEQ ID NO: 5026 - DNA, 25 bp, Homo sapien
tcggccggaacagggaacctcgaag

SEQ ID NO: 5027 - DNA, 25 bp, Homo sapien
gccggaacagggaacctcgaagcct

SEQ ID NO: 5028 - DNA, 25 bp, Homo sapien
ggaacagggaacctcgaagcctcct

SEQ ID NO: 5029 - DNA, 25 bp, Homo sapien
aacagggaacctcgaagcctcctct

SEQ ID NO: 5030 - DNA, 25 bp, Homo sapien
aaatgaacaaatcagctgggcttgg

SEQ ID NO: 5031 - DNA, 25 bp, Homo sapien
cactggagaccaggaagtcgatgct

SEQ ID NO: 5032 - DNA, 25 bp, Homo sapien
atagaagatcttctcagcttaagca

SEQ ID NO: 5033 - DNA, 25 bp, Homo sapien
agcttaagcatcctattgccaccat

SEQ ID NO: 5034 - DNA, 25 bp, Homo sapien
ctattgccaccatgcttgggatctt

SEQ ID NO: 5035 - DNA, 25 bp, Homo sapien
gcttgggatcttgtacaggtcttat

SEQ ID NO: 5036 - DNA, 25 bp, Homo sapien
acaggtcttatttcagaggagcttt

SEQ ID NO: 5037 - DNA, 25 bp, Homo sapien
ggagctttgatagtttcagtcacaa

SEQ ID NO: 5038 - DNA, 25 bp, Homo sapien
gtaaacaagctttatgcctttgata

SEQ ID NO: 5039 - DNA, 25 bp, Homo sapien
catgggtggtgctctttcttgttaa

SEQ ID NO: 5040 - DNA, 25 bp, Homo sapien
cttgttaaaatggagctctggtttg

SEQ ID NO: 5041 - DNA, 25 bp, Homo sapien
tctgccaactactgtgcttatttct

SEQ ID NO: 5042 - DNA, 25 bp, Homo sapien
tataagcccagacgcctgggcgaga

SEQ ID NO: 5043 - DNA, 25 bp, Homo sapien
acaagacacataccatctctgcatc

SEQ ID NO: 5044 - DNA, 25 bp, Homo sapien
ccccagaagtttgcagtctggtaag

SEQ ID NO: 5045 - DNA, 25 bp, Homo sapien
gacaggcattaaataattgcacaag

SEQ ID NO: 5046 - DNA, 25 bp, Homo sapien
agttttgacatgtgccttgaagaag

SEQ ID NO: 5047 - DNA, 25 bp, Homo sapien
gggaacgtagtcctctctgatactg

SEQ ID NO: 5048 - DNA, 25 bp, Homo sapien
gtcctctctgatactgtgatactta

SEQ ID NO: 5049 - DNA, 25 bp, Homo sapien
tgatactgtgatacttaaggcaaga

SEQ ID NO: 5050 - DNA, 25 bp, Homo sapien
gagaagttaagctccaagatgggaa

SEQ ID NO: 5051 - DNA, 25 bp, Homo sapien
gggaacagagtatgccaggagaaaa

SEQ ID NO: 5052 - DNA, 25 bp, Homo sapien
gagaaaaggccagtgcagctggaat

SEQ ID NO: 5053 - DNA, 25 bp, Homo sapien
gtgcagctggaatagagagagccaa

SEQ ID NO: 5054 - DNA, 25 bp, Homo sapien
gcaaaagaaagtgcttccatgggaa

SEQ ID NO: 5055 - DNA, 25 bp, Homo sapien
aagtgcttccatgggaagactacca

SEQ ID NO: 5056 - DNA, 25 bp, Homo sapien
gcttccatgggaagactaccaggtt

SEQ ID NO: 5057 - DNA, 25 bp, Homo sapien
ccatgggaagactaccaggttagtt

SEQ ID NO: 5058 - DNA, 25 bp, Homo sapien
taccaggttagttagaatgcgaaaa

SEQ ID NO: 5059 - DNA, 25 bp, Homo sapien
ataaaggggcattctggcccttcaa

SEQ ID NO: 5060 - DNA, 25 bp, Homo sapien
ctggcccttcaaaacaatgatcttc

SEQ ID NO: 5061 - DNA, 25 bp, Homo sapien
ggcccttcaaaacaatgatcttcaa

SEQ ID NO: 5062 - DNA, 25 bp, Homo sapien
caatgatcttcaacagtaaatgcaa

SEQ ID NO: 5063 - DNA, 25 bp, Homo sapien
gatcttcaacagtaaatgcaagcac

SEQ ID NO: 5064 - DNA, 25 bp, Homo sapien
aaatgcaagcacaagaaggctccag

SEQ ID NO: 5065 - DNA, 25 bp, Homo sapien
atggacgatgacatggatcccactc

SEQ ID NO: 5066 - DNA, 25 bp, Homo sapien
tggatcccactcctgaagcttcaga

SEQ ID NO: 5067 - DNA, 25 bp, Homo sapien
gaacccagcacctcacaagggactt

SEQ ID NO: 5068 - DNA, 25 bp, Homo sapien
tcacaagggacttccggtctcctct

SEQ ID NO: 5069 - DNA, 25 bp, Homo sapien
ggtctcctctgctggtgaacagatg

SEQ ID NO: 5070 - DNA, 25 bp, Homo sapien
tcacaggtgtctctctgagcatagt

SEQ ID NO: 5071 - DNA, 25 bp, Homo sapien
ctgagcatagtcatctgagaactgt

SEQ ID NO: 5072 - DNA, 25 bp, Homo sapien
ctgagaactgttgccagaggcccca

SEQ ID NO: 5073 - DNA, 25 bp, Homo sapien
gattgaaggctgcactctcaggtca

SEQ ID NO: 5074 - DNA, 25 bp, Homo sapien
tgcactctcaggtcaagttgtacat

SEQ ID NO: 5075 - DNA, 25 bp, Homo sapien
agttgtacatggcagtccttgctca

SEQ ID NO: 5076 - DNA, 25 bp, Homo sapien
ttacaaacagttggcaaccttgccc

SEQ ID NO: 5077 - DNA, 25 bp, Homo sapien
tgctcaccaaatgggagttgcatac

SEQ ID NO: 5078 - DNA, 25 bp, Homo sapien
ggagttgcataccagtattccccag

SEQ ID NO: 5079 - DNA, 25 bp, Homo sapien
ccccagcttgtgactacagagatgt

SEQ ID NO: 5080 - DNA, 25 bp, Homo sapien
agagatgtcccagtatgtttctttc

SEQ ID NO: 5081 - DNA, 25 bp, Homo sapien
ctttctgccccgttgaagaggtgca

SEQ ID NO: 5082 - DNA, 25 bp, Homo sapien
aggctgagaaacactgatagaccaa

SEQ ID NO: 5083 - DNA, 25 bp, Homo sapien
ggaactcaccttgaacttagctttc

SEQ ID NO: 5084 - DNA, 25 bp, Homo sapien
gaaagtttgtgcacattgagggcat

SEQ ID NO: 5085 - DNA, 25 bp, Homo sapien
cacattgagggcatgggcagaatct

SEQ ID NO: 5086 - DNA, 25 bp, Homo sapien
gaaagccaatatgaggccaggtggt

SEQ ID NO: 5087 - DNA, 25 bp, Homo sapien
gcacagacgtcattaaataataaca

SEQ ID NO: 5088 - DNA, 25 bp, Homo sapien
agagtgacgggtgctgtgatacagg

SEQ ID NO: 5089 - DNA, 25 bp, Homo sapien
gcagaaatggcatgcaaatttatta

SEQ ID NO: 5090 - DNA, 25 bp, Homo sapien
aaatttattaatgcgcacacaggga

SEQ ID NO: 5091 - DNA, 25 bp, Homo sapien
tttattaatgcgcacacagggagaa

SEQ ID NO: 5092 - DNA, 25 bp, Homo sapien
gcacacagggagaaccacagaatga

SEQ ID NO: 5093 - DNA, 25 bp, Homo sapien
cagaatgattgattactccccactc

SEQ ID NO: 5094 - DNA, 25 bp, Homo sapien
gaatgattgattactccccactctg

SEQ ID NO: 5095 - DNA, 25 bp, Homo sapien
tgattactccccactctgcaatggg

SEQ ID NO: 5096 - DNA, 25 bp, Homo sapien
agaccaccctgaccagcatgaaacc

SEQ ID NO: 5097 - DNA, 25 bp, Homo sapien
aatcacttgggccagggatgctgag

SEQ ID NO: 5098 - DNA, 25 bp, Homo sapien
aagtcctttgcatgtattcactcaa

SEQ ID NO: 5099 - DNA, 25 bp, Homo sapien
catctcccatttcacagtgagggtt

SEQ ID NO: 5100 - DNA, 25 bp, Homo sapien
aaacatcaaatctaggtggtccagg

SEQ ID NO: 5101 - DNA, 25 bp, Homo sapien
caggtggtggccagaacccatcagc

SEQ ID NO: 5102 - DNA, 25 bp, Homo sapien
cctccagtttctcgctctaggaaat

SEQ ID NO: 5103 - DNA, 25 bp, Homo sapien
taggaaatactcttccctgtcaact

SEQ ID NO: 5104 - DNA, 25 bp, Homo sapien
tcctctgggctcagttgacatgtca

SEQ ID NO: 5105 - DNA, 25 bp, Homo sapien
gttgacatgtcatctccttgaggag

SEQ ID NO: 5106 - DNA, 25 bp, Homo sapien
agatgctccccgactagggtgggca

SEQ ID NO: 5107 - DNA, 25 bp, Homo sapien
ctatttgacctgtgtatcgctgcat

SEQ ID NO: 5108 - DNA, 25 bp, Homo sapien
ctggcagatagcaggcccctaataa

SEQ ID NO: 5109 - DNA, 25 bp, Homo sapien
tgcaatggctcgcgcccgtaatctt

SEQ ID NO: 5110 - DNA, 25 bp, Homo sapien
caatggctcgcgcccgtaatcttag

SEQ ID NO: 5111 - DNA, 25 bp, Homo sapien
aatggctcgcgcccgtaatcttagc

SEQ ID NO: 5112 - DNA, 25 bp, Homo sapien
atggctcgcgcccgtaatcttagca

SEQ ID NO: 5113 - DNA, 25 bp, Homo sapien
tcgcgcccgtaatcttagcactctg

SEQ ID NO: 5114 - DNA, 25 bp, Homo sapien
cgcgcccgtaatcttagcactctgg

SEQ ID NO: 5115 - DNA, 25 bp, Homo sapien
gcgcccgtaatcttagcactctggg

SEQ ID NO: 5116 - DNA, 25 bp, Homo sapien
atcaggactttaagaccagcctcgg

SEQ ID NO: 5117 - DNA, 25 bp, Homo sapien
cagcctcggcaacaacatggtgaaa

SEQ ID NO: 5118 - DNA, 25 bp, Homo sapien
tggtgaaaccatctctagcaaaaat

SEQ ID NO: 5119 - DNA, 25 bp, Homo sapien
ggtgaaaccatctctagcaaaaata

SEQ ID NO: 5120 - DNA, 25 bp, Homo sapien
gggccctgaaccatctttctagcct

SEQ ID NO: 5121 - DNA, 25 bp, Homo sapien
attttctgtacattagccaccctag

SEQ ID NO: 5122 - DNA, 25 bp, Homo sapien
acattagccaccctagccttctttg

SEQ ID NO: 5123 - DNA, 25 bp, Homo sapien
gtttctcaaatgtaacagccccctt

SEQ ID NO: 5124 - DNA, 25 bp, Homo sapien
cccacatacatactttaccttctag

SEQ ID NO: 5125 - DNA, 25 bp, Homo sapien
acatactttaccttctagttcttat

SEQ ID NO: 5126 - DNA, 25 bp, Homo sapien
gttcttatgcattcctctggtcgca

SEQ ID NO: 5127 - DNA, 25 bp, Homo sapien
tctggtcgcagcctaaatcttactt

SEQ ID NO: 5128 - DNA, 25 bp, Homo sapien
gcagcctaaatcttactttgtggtg

SEQ ID NO: 5129 - DNA, 25 bp, Homo sapien
aatcttactttgtggtggcagtata

SEQ ID NO: 5130 - DNA, 25 bp, Homo sapien
gcttggccaatatatagaaaaaccc

SEQ ID NO: 5131 - DNA, 25 bp, Homo sapien
ctgtgttgtctaggcttccaggcta

SEQ ID NO: 5132 - DNA, 25 bp, Homo sapien
tgtctaggcttccaggctagtcttg

SEQ ID NO: 5133 - DNA, 25 bp, Homo sapien
agtcttgaactattggcctcacaca

SEQ ID NO: 5134 - DNA, 25 bp, Homo sapien
tgaactattggcctcacacagtcct

SEQ ID NO: 5135 - DNA, 25 bp, Homo sapien
aatcgactgaaatatcactgctgct

SEQ ID NO: 5136 - DNA, 25 bp, Homo sapien
cgactgaaatatcactgctgctgtt

SEQ ID NO: 5137 - DNA, 25 bp, Homo sapien
atcactgctgctgttaataaaacta

SEQ ID NO: 5138 - DNA, 25 bp, Homo sapien
atgaaatgatgttcattgcttattt

SEQ ID NO: 5139 - DNA, 25 bp, Homo sapien
tttttcctctggctttagataaatt

SEQ ID NO: 5140 - DNA, 25 bp, Homo sapien
taatgcttgtaatctaagttttgtt

SEQ ID NO: 5141 - DNA, 25 bp, Homo sapien
tatttcttatagattgcgcagtctc

SEQ ID NO: 5142 - DNA, 25 bp, Homo sapien
gggaccatatggagcccacacagga

SEQ ID NO: 5143 - DNA, 25 bp, Homo sapien
ttctaaggaagcagcccatagtctt

SEQ ID NO: 5144 - DNA, 25 bp, Homo sapien
ggaagcagcccatagtcttctttct

SEQ ID NO: 5145 - DNA, 25 bp, Homo sapien
ttctttcttttcctgtgcatcttcc

SEQ ID NO: 5146 - DNA, 25 bp, Homo sapien
tgtgcatcttccactgtcagtgagg

SEQ ID NO: 5147 - DNA, 25 bp, Homo sapien
gtgaggctcctcatttatggtgaac

SEQ ID NO: 5148 - DNA, 25 bp, Homo sapien
ggctcctcatttatggtgaacccaa

SEQ ID NO: 5149 - DNA, 25 bp, Homo sapien
tatggtgaacccaactgtgtgtatc

SEQ ID NO: 5150 - DNA, 25 bp, Homo sapien
actgtgtgtatctcccaagttctca

SEQ ID NO: 5151 - DNA, 25 bp, Homo sapien
aatgttttcaggaagataggccatc

SEQ ID NO: 5152 - DNA, 25 bp, Homo sapien
gagggatgcattttaaccattaatt

SEQ ID NO: 5153 - DNA, 25 bp, Homo sapien
ggtggagcagtagtaagcctcccaa

SEQ ID NO: 5154 - DNA, 25 bp, Homo sapien
agtagtaagcctcccaaaatctaag

SEQ ID NO: 5155 - DNA, 25 bp, Homo sapien
aaaatctaaggtcccacactccagc

SEQ ID NO: 5156 - DNA, 25 bp, Homo sapien
ccacactccagcaagggtgaacctt

SEQ ID NO: 5157 - DNA, 25 bp, Homo sapien
agggtgaaccttgcaaactcaaaag

SEQ ID NO: 5158 - DNA, 25 bp, Homo sapien
caaaaggatagcagtctccaacctg

SEQ ID NO: 5159 - DNA, 25 bp, Homo sapien
agtctccaacctgctgttttataca

SEQ ID NO: 5160 - DNA, 25 bp, Homo sapien
acctgctgttttatacagtgactta

SEQ ID NO: 5161 - DNA, 25 bp, Homo sapien
gtgacttaagtggtactaaaatgct

SEQ ID NO: 5162 - DNA, 25 bp, Homo sapien
gattgtaataaattcaggtggctca

SEQ ID NO: 5163 - DNA, 25 bp, Homo sapien
agtggtacatgcatttagtcctagc

SEQ ID NO: 5164 - DNA, 25 bp, Homo sapien
gaaatgacttccaggtttctgccat

SEQ ID NO: 5165 - DNA, 25 bp, Homo sapien
gacttccaggtttctgccattagga

SEQ ID NO: 5166 - DNA, 25 bp, Homo sapien
ttctgccattaggaattgggtggtt

SEQ ID NO: 5167 - DNA, 25 bp, Homo sapien
gttatgattgagatgcctgtgagcc

SEQ ID NO: 5168 - DNA, 25 bp, Homo sapien
gattgagatgcctgtgagccacatg

SEQ ID NO: 5169 - DNA, 25 bp, Homo sapien
gcctgtgagccacatgaagctatta

SEQ ID NO: 5170 - DNA, 25 bp, Homo sapien
aaatgtgcagtgagatatatgaatc

SEQ ID NO: 5171 - DNA, 25 bp, Homo sapien
gaagacagactcaccagactataaa

SEQ ID NO: 5172 - DNA, 25 bp, Homo sapien
ggtgtattagtttcacatatgctgt

SEQ ID NO: 5173 - DNA, 25 bp, Homo sapien
gtttcacatatgctgtaacaaatta

SEQ ID NO: 5174 - DNA, 25 bp, Homo sapien
aaacaacacaaattggccaggcgcg

SEQ ID NO: 5175 - DNA, 25 bp, Homo sapien
gtgaagtcccccaaggaaactgaca

SEQ ID NO: 5176 - DNA, 25 bp, Homo sapien
gaagtcccccaaggaaactgacatt

SEQ ID NO: 5177 - DNA, 25 bp, Homo sapien
aggctggtgcaggataaaactggga

SEQ ID NO: 5178 - DNA, 25 bp, Homo sapien
gaggccagctcttaccaggccctgt

SEQ ID NO: 5179 - DNA, 25 bp, Homo sapien
aggccagctcttaccaggccctgtg

SEQ ID NO: 5180 - DNA, 25 bp, Homo sapien
aggccctgtggccaaattagtttgg

SEQ ID NO: 5181 - DNA, 25 bp, Homo sapien
gccctgtggccaaattagtttggac

SEQ ID NO: 5182 - DNA, 25 bp, Homo sapien
ggccaaattagtttggactttgtct

SEQ ID NO: 5183 - DNA, 25 bp, Homo sapien
tagtttggactttgtcttaaaggca

SEQ ID NO: 5184 - DNA, 25 bp, Homo sapien
atttgccttttaggagaattcctct

SEQ ID NO: 5185 - DNA, 25 bp, Homo sapien
ttgccttttaggagaattcctctgg

SEQ ID NO: 5186 - DNA, 25 bp, Homo sapien
ggagcacctataacaataatttctg

SEQ ID NO: 5187 - DNA, 25 bp, Homo sapien
gtgtagtactttctacagcagccaa

SEQ ID NO: 5188 - DNA, 25 bp, Homo sapien
tacagcagccaaattccaagtcttt

SEQ ID NO: 5189 - DNA, 25 bp, Homo sapien
gatcaggatttcttgtgctctggtg

SEQ ID NO: 5190 - DNA, 25 bp, Homo sapien
gtgctctggtgatggtgataattac

SEQ ID NO: 5191 - DNA, 25 bp, Homo sapien
gtgataattacgacctttccaagct

SEQ ID NO: 5192 - DNA, 25 bp, Homo sapien
gacctttccaagctatagaatctta

SEQ ID NO: 5193 - DNA, 25 bp, Homo sapien
aatcttagggcttagtggagctcac

SEQ ID NO: 5194 - DNA, 25 bp, Homo sapien
ttagtggagctcacggcattcaatt

SEQ ID NO: 5195 - DNA, 25 bp, Homo sapien
actgaggtctaaaagttacttctga

SEQ ID NO: 5196 - DNA, 25 bp, Homo sapien
gaatatcatcttatgctgtatgact

SEQ ID NO: 5197 - DNA, 25 bp, Homo sapien
ttatggtatcttaaacatgtgcttg

SEQ ID NO: 5198 - DNA, 25 bp, Homo sapien
atggtatcttaaacatgtgcttgtt

SEQ ID NO: 5199 - DNA, 25 bp, Homo sapien
ggtatcttaaacatgtgcttgtttt

SEQ ID NO: 5200 - DNA, 25 bp, Homo sapien
tcttaaacatgtgcttgtttttcta

SEQ ID NO: 5201 - DNA, 25 bp, Homo sapien
gggcatttgtcgtgaacattcattt

SEQ ID NO: 5202 - DNA, 25 bp, Homo sapien
ggcatttgtcgtgaacattcatttc

SEQ ID NO: 5203 - DNA, 25 bp, Homo sapien
gcatttgtcgtgaacattcatttca

SEQ ID NO: 5204 - DNA, 25 bp, Homo sapien
atttcaaatatgtagtatcttcaga

SEQ ID NO: 5205 - DNA, 25 bp, Homo sapien
tcaaatatgtagtatcttcagaata

SEQ ID NO: 5206 - DNA, 25 bp, Homo sapien
gtagtatcttcagaatatttgagaa

SEQ ID NO: 5207 - DNA, 25 bp, Homo sapien
aattgtatttatgttaactgcttaa

SEQ ID NO: 5208 - DNA, 25 bp, Homo sapien
gccagattggtttgacatcgtggag

SEQ ID NO: 5209 - DNA, 25 bp, Homo sapien
gtttgacatcgtggagtctgaagtc

SEQ ID NO: 5210 - DNA, 25 bp, Homo sapien
tggagtctgaagtcaagtgctgtaa

SEQ ID NO: 5211 - DNA, 25 bp, Homo sapien
gtgtgtcattgacatgtcctctttc

SEQ ID NO: 5212 - DNA, 25 bp, Homo sapien
tgtcattgacatgtcctctttcaca

SEQ ID NO: 5213 - DNA, 25 bp, Homo sapien
gtttgagataacagtaagtatttgg

SEQ ID NO: 5214 - DNA, 25 bp, Homo sapien
gataacagtaagtatttgggaacca

SEQ ID NO: 5215 - DNA, 25 bp, Homo sapien
taatagattaggaaactttacatat

SEQ ID NO: 5216 - DNA, 25 bp, Homo sapien
agattaggaaactttacatatttat

SEQ ID NO: 5217 - DNA, 25 bp, Homo sapien
gaaactttacatatttattgaatgc

SEQ ID NO: 5218 - DNA, 25 bp, Homo sapien
tttgtttttcatcttcaaaactgat

SEQ ID NO: 5219 - DNA, 25 bp, Homo sapien
agaggacattagtgcaaagactgat

SEQ ID NO: 5220 - DNA, 25 bp, Homo sapien
agactgatgaagtctgtagtttcgt

SEQ ID NO: 5221 - DNA, 25 bp, Homo sapien
aagtttgaaaaaagctgcccagatg

SEQ ID NO: 5222 - DNA, 25 bp, Homo sapien
aagctgcccagatggaaatctgctt

SEQ ID NO: 5223 - DNA, 25 bp, Homo sapien
atggaaatctgcttgcatttgtgca

SEQ ID NO: 5224 - DNA, 25 bp, Homo sapien
gagggatttttactgtactgccgtg

SEQ ID NO: 5225 - DNA, 25 bp, Homo sapien
ttttactgtactgccgtgtccccta

SEQ ID NO: 5226 - DNA, 25 bp, Homo sapien
gtgtacaatgtgatgtggccttttt

SEQ ID NO: 5227 - DNA, 25 bp, Homo sapien
gttttgagacataatcttatcaccc

SEQ ID NO: 5228 - DNA, 25 bp, Homo sapien
agtgaagtggcgcagtttaaactgc

SEQ ID NO: 5229 - DNA, 25 bp, Homo sapien
gtttaaactgcgcaggctcatcatc

SEQ ID NO: 5230 - DNA, 25 bp, Homo sapien
gtaagtggaagatggcctaattgcc

SEQ ID NO: 5231 - DNA, 25 bp, Homo sapien
ggcctaattgccaagtgtacagctt

SEQ ID NO: 5232 - DNA, 25 bp, Homo sapien
attgccaagtgtacagcttcagctc

SEQ ID NO: 5233 - DNA, 25 bp, Homo sapien
acagcttcagctcagcatataattg

SEQ ID NO: 5234 - DNA, 25 bp, Homo sapien
aattgttatggaccccagttatcca

SEQ ID NO: 5235 - DNA, 25 bp, Homo sapien
agttatccactcacctaaccgtcag

SEQ ID NO: 5236 - DNA, 25 bp, Homo sapien
tcacctaaccgtcagtgccctgtgg

SEQ ID NO: 5237 - DNA, 25 bp, Homo sapien
cagagcagcagtgaagctaagtagg

SEQ ID NO: 5238 - DNA, 25 bp, Homo sapien
gctgtgcagcagtcttggagatcat

SEQ ID NO: 5239 - DNA, 25 bp, Homo sapien
gatcatagttgacagtgccggctct

SEQ ID NO: 5240 - DNA, 25 bp, Homo sapien
catagttgacagtgccggctctggg

SEQ ID NO: 5241 - DNA, 25 bp, Homo sapien
gaaagttaccagtatcaaacacatt

SEQ ID NO: 5242 - DNA, 25 bp, Homo sapien
ttacacattatttacaatgcaccat

SEQ ID NO: 5243 - DNA, 25 bp, Homo sapien
tatttacaatgcaccattggtggtg

SEQ ID NO: 5244 - DNA, 25 bp, Homo sapien
attggtggtgagtagaattccccgt

SEQ ID NO: 5245 - DNA, 25 bp, Homo sapien
gtggtgagtagaattccccgtgtta

SEQ ID NO: 5246 - DNA, 25 bp, Homo sapien
gtgagtagaattccccgtgttaggt

SEQ ID NO: 5247 - DNA, 25 bp, Homo sapien
ggagaaaactgctctgagattggca

SEQ ID NO: 5248 - DNA, 25 bp, Homo sapien
tgctctgagattggcagtgctatgg

SEQ ID NO: 5249 - DNA, 25 bp, Homo sapien
gattggcagtgctatggaaaattac

SEQ ID NO: 5250 - DNA, 25 bp, Homo sapien
atggaaaattacaacatctgcaatt

SEQ ID NO: 5251 - DNA, 25 bp, Homo sapien
tgtgttttgtggtagaagtggttaa

SEQ ID NO: 5252 - DNA, 25 bp, Homo sapien
caagcttgttagattgtttaagatt

SEQ ID NO: 5253 - DNA, 25 bp, Homo sapien
agattttcttctatagtagtctgag

SEQ ID NO: 5254 - DNA, 25 bp, Homo sapien
tttcttctatagtagtctgagttgc

SEQ ID NO: 5255 - DNA, 25 bp, Homo sapien
ctatagtagtctgagttgcatgaac

SEQ ID NO: 5256 - DNA, 25 bp, Homo sapien
gtagtctgagttgcatgaactttat

SEQ ID NO: 5257 - DNA, 25 bp, Homo sapien
gggctcacgaccttttcagatgatt

SEQ ID NO: 5258 - DNA, 25 bp, Homo sapien
gctcacgaccttttcagatgattaa

SEQ ID NO: 5259 - DNA, 25 bp, Homo sapien
tcacgaccttttcagatgattaatg

SEQ ID NO: 5260 - DNA, 25 bp, Homo sapien
accttttcagatgattaatgttccc

SEQ ID NO: 5261 - DNA, 25 bp, Homo sapien
aaacaatacaaaagcaccattgggt

SEQ ID NO: 5262 - DNA, 25 bp, Homo sapien
caccattgggttgagcatggtggct

SEQ ID NO: 5263 - DNA, 25 bp, Homo sapien
tggttcgggccgtccttctgcctca

SEQ ID NO: 5264 - DNA, 25 bp, Homo sapien
gcccaggccaccgtgtcaggatagt

SEQ ID NO: 5265 - DNA, 25 bp, Homo sapien
caggccaccgtgtcaggatagtttt

SEQ ID NO: 5266 - DNA, 25 bp, Homo sapien
ggccaccgtgtcaggatagtttttt

SEQ ID NO: 5267 - DNA, 25 bp, Homo sapien
caccgtgtcaggatagttttttagt

SEQ ID NO: 5268 - DNA, 25 bp, Homo sapien
cggactggtcctgaattcccgggat

SEQ ID NO: 5269 - DNA, 25 bp, Homo sapien
gactggtcctgaattcccgggatca

SEQ ID NO: 5270 - DNA, 25 bp, Homo sapien
cacgcctggccaatcttataacatt

SEQ ID NO: 5271 - DNA, 25 bp, Homo sapien
cgcctggccaatcttataacattcc

SEQ ID NO: 5272 - DNA, 25 bp, Homo sapien
cattccattttatgcgttttaatcc

SEQ ID NO: 5273 - DNA, 25 bp, Homo sapien
tccattttatgcgttttaatccttt

SEQ ID NO: 5274 - DNA, 25 bp, Homo sapien
gaatatccccaaataacatgtctta

SEQ ID NO: 5275 - DNA, 25 bp, Homo sapien
ttactgtaccctgtcctagaagata

SEQ ID NO: 5276 - DNA, 25 bp, Homo sapien
atagaagatgccctgcccttagaag

SEQ ID NO: 5277 - DNA, 25 bp, Homo sapien
gatgccctgcccttagaagacaaag

SEQ ID NO: 5278 - DNA, 25 bp, Homo sapien
aagagactgtagagctatgccttct

SEQ ID NO: 5279 - DNA, 25 bp, Homo sapien
agagctatgccttctaaatcttaag

SEQ ID NO: 5280 - DNA, 25 bp, Homo sapien
ccttctaaatcttaagccactcttc

SEQ ID NO: 5281 - DNA, 25 bp, Homo sapien
gccactcttcagataatggatccct

SEQ ID NO: 5282 - DNA, 25 bp, Homo sapien
ataatggatcccttcatggtcagcc

SEQ ID NO: 5283 - DNA, 25 bp, Homo sapien
atcccttcatggtcagcccaaacat

SEQ ID NO: 5284 - DNA, 25 bp, Homo sapien
agccaatatctacatcttctcacaa

SEQ ID NO: 5285 - DNA, 25 bp, Homo sapien
gcagagcctggaaatcgggatcgcc

SEQ ID NO: 5286 - DNA, 25 bp, Homo sapien
cgggatcgccagactgtccttgaga

SEQ ID NO: 5287 - DNA, 25 bp, Homo sapien
gagacacaaccgaaggaggcacaca

SEQ ID NO: 5288 - DNA, 25 bp, Homo sapien
gaggcacacagattggcccaccaga

SEQ ID NO: 5289 - DNA, 25 bp, Homo sapien
gcgagtacacgatttaaagacacca

SEQ ID NO: 5290 - DNA, 25 bp, Homo sapien
agaaaggcgccttagtaccccacag

SEQ ID NO: 5291 - DNA, 25 bp, Homo sapien
ggatgcgtcctcaaaagcgggtact

SEQ ID NO: 5292 - DNA, 25 bp, Homo sapien
tggatgccgggcagggaaccaacca

SEQ ID NO: 5293 - DNA, 25 bp, Homo sapien
agggaaccaaccacacatgcagaag

SEQ ID NO: 5294 - DNA, 25 bp, Homo sapien
aatgcccaagttcaagataccctcc

SEQ ID NO: 5295 - DNA, 25 bp, Homo sapien
ataccctccttaggatggtcgccaa

SEQ ID NO: 5296 - DNA, 25 bp, Homo sapien
ctgtaaatgtctataggtgtctata

SEQ ID NO: 5297 - DNA, 25 bp, Homo sapien
atctatacgtgttctatattggcca

SEQ ID NO: 5298 - DNA, 25 bp, Homo sapien
ttctatattggccactagccacagt

SEQ ID NO: 5299 - DNA, 25 bp, Homo sapien
tggccactagccacagttagttgtg

SEQ ID NO: 5300 - DNA, 25 bp, Homo sapien
gttgtggagtacttgaaatgtgtct

SEQ ID NO: 5301 - DNA, 25 bp, Homo sapien
gactgaagagctgaattttctattt

SEQ ID NO: 5302 - DNA, 25 bp, Homo sapien
tgagaatttaaattgcctcatgtgg

SEQ ID NO: 5303 - DNA, 25 bp, Homo sapien
ttggacagcacagatgtatctcatt

SEQ ID NO: 5304 - DNA, 25 bp, Homo sapien
cagatgtatctcattgctactcaaa

SEQ ID NO: 5305 - DNA, 25 bp, Homo sapien
agaccaggagcattgctatcacctg

SEQ ID NO: 5306 - DNA, 25 bp, Homo sapien
tagaaatgaggactctcagccgggc

SEQ ID NO: 5307 - DNA, 25 bp, Homo sapien
acgtcttatgcatttatttagtata

SEQ ID NO: 5308 - DNA, 25 bp, Homo sapien
ttatttagtatagtgaaagccttat

SEQ ID NO: 5309 - DNA, 25 bp, Homo sapien
agtgaaagccttatatacacattta

SEQ ID NO: 5310 - DNA, 25 bp, Homo sapien
ataattagtctctggatatttggat

SEQ ID NO: 5311 - DNA, 25 bp, Homo sapien
ttagtctctggatatttggattatt

SEQ ID NO: 5312 - DNA, 25 bp, Homo sapien
tagtagtacttttttagagtgtggg

SEQ ID NO: 5313 - DNA, 25 bp, Homo sapien
gccttgctccatcacccgagctgga

SEQ ID NO: 5314 - DNA, 25 bp, Homo sapien
acccgagctggagtgtaggtagcat

SEQ ID NO: 5315 - DNA, 25 bp, Homo sapien
agtgtaggtagcatgatcatagctc

SEQ ID NO: 5316 - DNA, 25 bp, Homo sapien
ctcgctgcaaccttgaaatcctggg

SEQ ID NO: 5317 - DNA, 25 bp, Homo sapien
gggactattggtccatgccaccatg

SEQ ID NO: 5318 - DNA, 25 bp, Homo sapien
ccctgctgggctaccaggtgactgt

SEQ ID NO: 5319 - DNA, 25 bp, Homo sapien
cctgctgggctaccaggtgactgtt

SEQ ID NO: 5320 - DNA, 25 bp, Homo sapien
tcgggtcttccagctacagcagtca

SEQ ID NO: 5321 - DNA, 25 bp, Homo sapien
agctacagcagtcaggccagctcta

SEQ ID NO: 5322 - DNA, 25 bp, Homo sapien
gctacagcagtcaggccagctctac

SEQ ID NO: 5323 - DNA, 25 bp, Homo sapien
agcagtcaggccagctctacacctt

SEQ ID NO: 5324 - DNA, 25 bp, Homo sapien
agtcaggccagctctacaccttcaa

SEQ ID NO: 5325 - DNA, 25 bp, Homo sapien
gtcaggccagctctacaccttcaag

SEQ ID NO: 5326 - DNA, 25 bp, Homo sapien
tcaggccagctctacaccttcaagg

SEQ ID NO: 5327 - DNA, 25 bp, Homo sapien
ctacaccttcaaggccgagacggag

SEQ ID NO: 5328 - DNA, 25 bp, Homo sapien
aggagctgaagggccgctgggtgaa

SEQ ID NO: 5329 - DNA, 25 bp, Homo sapien
ataatagaacatcagattctgggcc

SEQ ID NO: 5330 - DNA, 25 bp, Homo sapien
atagaacatcagattctgggccagg

SEQ ID NO: 5331 - DNA, 25 bp, Homo sapien
agaacatcagattctgggccaggta

SEQ ID NO: 5332 - DNA, 25 bp, Homo sapien
gaacatcagattctgggccaggtac

SEQ ID NO: 5333 - DNA, 25 bp, Homo sapien
acatcagattctgggccaggtacga

SEQ ID NO: 5334 - DNA, 25 bp, Homo sapien
gattctgggccaggtacgatggctc

SEQ ID NO: 5335 - DNA, 25 bp, Homo sapien
attctgggccaggtacgatggctca

SEQ ID NO: 5336 - DNA, 25 bp, Homo sapien
gagccatgattgtgttactgccttc

SEQ ID NO: 5337 - DNA, 25 bp, Homo sapien
aatcagactctgaggctgcaggcgg

SEQ ID NO: 5338 - DNA, 25 bp, Homo sapien
gactctgaggctgcaggcggtggct

SEQ ID NO: 5339 - DNA, 25 bp, Homo sapien
aacttgagcaacacagtggcaccct

SEQ ID NO: 5340 - DNA, 25 bp, Homo sapien
aaagttgtttatctcatggaaacca

SEQ ID NO: 5341 - DNA, 25 bp, Homo sapien
gttgtttatctcatggaaaccacga

SEQ ID NO: 5342 - DNA, 25 bp, Homo sapien
gtttatctcatggaaaccacgagga

SEQ ID NO: 5343 - DNA, 25 bp, Homo sapien
tatctcatggaaaccacgaggaaaa

SEQ ID NO: 5344 - DNA, 25 bp, Homo sapien
tggaaaccacgaggaaaatacacaa

SEQ ID NO: 5345 - DNA, 25 bp, Homo sapien
tgagctatgattactacacccttgc

SEQ ID NO: 5346 - DNA, 25 bp, Homo sapien
gagctatgattactacacccttgca

SEQ ID NO: 5347 - DNA, 25 bp, Homo sapien
agctatgattactacacccttgcac

SEQ ID NO: 5348 - DNA, 25 bp, Homo sapien
gctatgattactacacccttgcact

SEQ ID NO: 5349 - DNA, 25 bp, Homo sapien
ctatgattactacacccttgcactc

SEQ ID NO: 5350 - DNA, 25 bp, Homo sapien
atgattactacacccttgcactcca

SEQ ID NO: 5351 - DNA, 25 bp, Homo sapien
tataagtggtgcctcgctctcgtta

SEQ ID NO: 5352 - DNA, 25 bp, Homo sapien
tcgctctcgttaactcttagacttt

SEQ ID NO: 5353 - DNA, 25 bp, Homo sapien
ctcttagactttgttccacgtttat

SEQ ID NO: 5354 - DNA, 25 bp, Homo sapien
gaccagaaagacttgcttccggact

SEQ ID NO: 5355 - DNA, 25 bp, Homo sapien
ccggactttgctttatgactctgaa

SEQ ID NO: 5356 - DNA, 25 bp, Homo sapien
attaactctagatgccggtctggtt

SEQ ID NO: 5357 - DNA, 25 bp, Homo sapien
ttcttgtgatttcttcaggcggtct

SEQ ID NO: 5358 - DNA, 25 bp, Homo sapien
tagcctccgacctggaatagatctc

SEQ ID NO: 5359 - DNA, 25 bp, Homo sapien
aatagatctctcttcacacttcact

SEQ ID NO: 5360 - DNA, 25 bp, Homo sapien
ttagagggcttactctgtgccaagc

SEQ ID NO: 5361 - DNA, 25 bp, Homo sapien
gtgccaagccctgataaaactcttt

SEQ ID NO: 5362 - DNA, 25 bp, Homo sapien
aagcaggcaatttggccagcgtggc

SEQ ID NO: 5363 - DNA, 25 bp, Homo sapien
gttctgtctgtaggtgccgactctc

SEQ ID NO: 5364 - DNA, 25 bp, Homo sapien
tctgtaggtgccgactctcagctac

SEQ ID NO: 5365 - DNA, 25 bp, Homo sapien
aggtgccgactctcagctacctagg

SEQ ID NO: 5366 - DNA, 25 bp, Homo sapien
ctaggagaagatgccaacaggtata

SEQ ID NO: 5367 - DNA, 25 bp, Homo sapien
tgccaacaggtatatatcactcact

SEQ ID NO: 5368 - DNA, 25 bp, Homo sapien
atatcactcactgagaatggttact

SEQ ID NO: 5369 - DNA, 25 bp, Homo sapien
gaatggttactatccagggcatata

SEQ ID NO: 5370 - DNA, 25 bp, Homo sapien
cagggcatatagagaattgcaaatc

SEQ ID NO: 5371 - DNA, 25 bp, Homo sapien
tactcgggaagcttagatggaagga

SEQ ID NO: 5372 - DNA, 25 bp, Homo sapien
ttagatggaaggatcaactgagccc

SEQ ID NO: 5373 - DNA, 25 bp, Homo sapien
gaacagaaagcatttgccctcatca

SEQ ID NO: 5374 - DNA, 25 bp, Homo sapien
aagcatttgccctcatcagagaaat

SEQ ID NO: 5375 - DNA, 25 bp, Homo sapien
gaaatcctggcatacttgggcttcc

SEQ ID NO: 5376 - DNA, 25 bp, Homo sapien
tgggcttcctgtggatgctactgct

SEQ ID NO: 5377 - DNA, 25 bp, Homo sapien
tgtggatgctactgctcgtggccta

SEQ ID NO: 5378 - DNA, 25 bp, Homo sapien
tgctactgctcgtggcctacgggca

SEQ ID NO: 5379 - DNA, 25 bp, Homo sapien
gggcttttcaggtgtgctcggcttc

SEQ ID NO: 5380 - DNA, 25 bp, Homo sapien
tcggcttccgagagttcttcaagtg

SEQ ID NO: 5381 - DNA, 25 bp, Homo sapien
aagtgggccaacaccaccctcgtga

SEQ ID NO: 5382 - DNA, 25 bp, Homo sapien
caccctcgtgagtaacctgtatggt

SEQ ID NO: 5383 - DNA, 25 bp, Homo sapien
cgtgagtaacctgtatggtcacccc

SEQ ID NO: 5384 - DNA, 25 bp, Homo sapien
tagaggccacggtcccggggatctc

SEQ ID NO: 5385 - DNA, 25 bp, Homo sapien
tgccgcagaggcctcggaaaagctt

SEQ ID NO: 5386 - DNA, 25 bp, Homo sapien
gcagaggcctcggaaaagcttcaag

SEQ ID NO: 5387 - DNA, 25 bp, Homo sapien
aggcctcggaaaagcttcaagtaga

SEQ ID NO: 5388 - DNA, 25 bp, Homo sapien
cttcaagtagagctggagaccagga

SEQ ID NO: 5389 - DNA, 25 bp, Homo sapien
ggagaccaggatccgtggcttggag

SEQ ID NO: 5390 - DNA, 25 bp, Homo sapien
atccgtggcttggaggaggctctcc

SEQ ID NO: 5391 - DNA, 25 bp, Homo sapien
ttggaggaggctctccggcagcggg

SEQ ID NO: 5392 - DNA, 25 bp, Homo sapien
gcagcctcggcctgcctggatgagg

SEQ ID NO: 5393 - DNA, 25 bp, Homo sapien
tgaggctcgggccagccggctgctg

SEQ ID NO: 5394 - DNA, 25 bp, Homo sapien
gctggaggttctgcgggagcagctg

SEQ ID NO: 5395 - DNA, 25 bp, Homo sapien
ccctggtagtgctgccaagttcttt

SEQ ID NO: 5396 - DNA, 25 bp, Homo sapien
tggtagtgctgccaagttctttcat

SEQ ID NO: 5397 - DNA, 25 bp, Homo sapien
gtagtgctgccaagttctttcattt

SEQ ID NO: 5398 - DNA, 25 bp, Homo sapien
gtgctgccaagttctttcatttttc

SEQ ID NO: 5399 - DNA, 25 bp, Homo sapien
gctgccaagttctttcatttttccc

SEQ ID NO: 5400 - DNA, 25 bp, Homo sapien
taccagagcgccttagagggccttt

SEQ ID NO: 5401 - DNA, 25 bp, Homo sapien
agagcgccttagagggcctttgtag

SEQ ID NO: 5402 - DNA, 25 bp, Homo sapien
ccttagagggcctttgtagggtgca

SEQ ID NO: 5403 - DNA, 25 bp, Homo sapien
gcagggagtgagtttcagcccccat

SEQ ID NO: 5404 - DNA, 25 bp, Homo sapien
catcataccctatacccctttattt

SEQ ID NO: 5405 - DNA, 25 bp, Homo sapien
cccaagctggagagctgtggtatga

SEQ ID NO: 5406 - DNA, 25 bp, Homo sapien
ggtttgtgaccataatggcatctat

SEQ ID NO: 5407 - DNA, 25 bp, Homo sapien
gcgtgaatccaactgcttggtggaa

SEQ ID NO: 5408 - DNA, 25 bp, Homo sapien
gaagcaatcaagtcagcttactgag

SEQ ID NO: 5409 - DNA, 25 bp, Homo sapien
gttcaaaagaggcacttcccggatg

SEQ ID NO: 5410 - DNA, 25 bp, Homo sapien
ttcccggatgcctatcagtccttta

SEQ ID NO: 5411 - DNA, 25 bp, Homo sapien
agtcctttactgataccacaaccaa

SEQ ID NO: 5412 - DNA, 25 bp, Homo sapien
tgataccacaaccaaagagcctgtt

SEQ ID NO: 5413 - DNA, 25 bp, Homo sapien
gagcctgttcccaacagtggcagga

SEQ ID NO: 5414 - DNA, 25 bp, Homo sapien
gagctcctggatcaagctgagtctc

SEQ ID NO: 5415 - DNA, 25 bp, Homo sapien
caagctgagtctccttgctcacatg

SEQ ID NO: 5416 - DNA, 25 bp, Homo sapien
acggaaatacattctctttgattct

SEQ ID NO: 5417 - DNA, 25 bp, Homo sapien
aattacgttgagttatttctgcttt

SEQ ID NO: 5418 - DNA, 25 bp, Homo sapien
gttatttctgctttagtactatctg

SEQ ID NO: 5419 - DNA, 25 bp, Homo sapien
aacttaagcttaacatggaaactat

SEQ ID NO: 5420 - DNA, 25 bp, Homo sapien
tggaaactatagaaacagcctaagt

SEQ ID NO: 5421 - DNA, 25 bp, Homo sapien
acagcctaagttaatggaattttgc

SEQ ID NO: 5422 - DNA, 25 bp, Homo sapien
ggaattttgcattaagatacagaat

SEQ ID NO: 5423 - DNA, 25 bp, Homo sapien
ccattattacttagctgtgtcatgt

SEQ ID NO: 5424 - DNA, 25 bp, Homo sapien
tacttagctgtgtcatgttgggcaa

SEQ ID NO: 5425 - DNA, 25 bp, Homo sapien
gtcacttaatctctgtgggtcttac

SEQ ID NO: 5426 - DNA, 25 bp, Homo sapien
tctgtgggtcttacttgcttgtatc

SEQ ID NO: 5427 - DNA, 25 bp, Homo sapien
gggtcttacttgcttgtatctataa

SEQ ID NO: 5428 - DNA, 25 bp, Homo sapien
gcagcagaataaaacctcccagcag

SEQ ID NO: 5429 - DNA, 25 bp, Homo sapien
taaaacctcccagcaggacgcagaa

SEQ ID NO: 5430 - DNA, 25 bp, Homo sapien
cagcaggacgcagaagccactaaaa

SEQ ID NO: 5431 - DNA, 25 bp, Homo sapien
atgcaatatcataggtctgggtcca

SEQ ID NO: 5432 - DNA, 25 bp, Homo sapien
ggtctgggtccagtcataaaaccaa

SEQ ID NO: 5433 - DNA, 25 bp, Homo sapien
gaaatagtatgaacatccatcccat

SEQ ID NO: 5434 - DNA, 25 bp, Homo sapien
ccatcccataccctaattatatcag

SEQ ID NO: 5435 - DNA, 25 bp, Homo sapien
tatatattactccactacttccagc

SEQ ID NO: 5436 - DNA, 25 bp, Homo sapien
actacttccagcgtggtttactggg

SEQ ID NO: 5437 - DNA, 25 bp, Homo sapien
aagagaatctctcaaatatttggat

SEQ ID NO: 5438 - DNA, 25 bp, Homo sapien
ttggataagaataagcaggcaggct

SEQ ID NO: 5439 - DNA, 25 bp, Homo sapien
tgccagctgtgtcctaggtacttca

SEQ ID NO: 5440 - DNA, 25 bp, Homo sapien
gtgtcctaggtacttcacatggtta

SEQ ID NO: 5441 - DNA, 25 bp, Homo sapien
ggttacctcatttagtcttcaggat

SEQ ID NO: 5442 - DNA, 25 bp, Homo sapien
aggtaggtgtggaaactacagctca

SEQ ID NO: 5443 - DNA, 25 bp, Homo sapien
gaggtttagtaacatgtgcaacatc

SEQ ID NO: 5444 - DNA, 25 bp, Homo sapien
acatcacagagctgggactcagatc

SEQ ID NO: 5445 - DNA, 25 bp, Homo sapien
tgggactcagatcggatgccccagc

SEQ ID NO: 5446 - DNA, 25 bp, Homo sapien
ccatcttttaaataagggtcagcca

SEQ ID NO: 5447 - DNA, 25 bp, Homo sapien
gggtcagccatttaagtttctaact

SEQ ID NO: 5448 - DNA, 25 bp, Homo sapien
gggcatttattcactcagtcaatat

SEQ ID NO: 5449 - DNA, 25 bp, Homo sapien
gtcaatatttactgaggccaggtgt

SEQ ID NO: 5450 - DNA, 25 bp, Homo sapien
agaaattccgttcctcagttggact

SEQ ID NO: 5451 - DNA, 25 bp, Homo sapien
ttcctcagttggactagctcagtgt

SEQ ID NO: 5452 - DNA, 25 bp, Homo sapien
gctcagtgtcaagtgctcagaagtc

SEQ ID NO: 5453 - DNA, 25 bp, Homo sapien
gtgaacacactgtggcaattcctca

SEQ ID NO: 5454 - DNA, 25 bp, Homo sapien
gaaaactagaaccaccgtagcatcc

SEQ ID NO: 5455 - DNA, 25 bp, Homo sapien
gtagcatcccataattccacttctg

SEQ ID NO: 5456 - DNA, 25 bp, Homo sapien
ttgtacacccacattcatagcggct

SEQ ID NO: 5457 - DNA, 25 bp, Homo sapien
ttcatagcggctctgttcacagtag

SEQ ID NO: 5458 - DNA, 25 bp, Homo sapien
gttcacagtagccagcgggtagaaa

SEQ ID NO: 5459 - DNA, 25 bp, Homo sapien
tagaaacaacccgaatgcccgcggt

SEQ ID NO: 5460 - DNA, 25 bp, Homo sapien
gaatgcccgcggtcaaatgaatgga

SEQ ID NO: 5461 - DNA, 25 bp, Homo sapien
gtaggtggaatgcaccacacgtcag

SEQ ID NO: 5462 - DNA, 25 bp, Homo sapien
aggtggaatgcaccacacgtcagct

SEQ ID NO: 5463 - DNA, 25 bp, Homo sapien
tggaatgcaccacacgtcagctcaa

SEQ ID NO: 5464 - DNA, 25 bp, Homo sapien
aatgcaccacacgtcagctcaagtt

SEQ ID NO: 5465 - DNA, 25 bp, Homo sapien
gcaccacacgtcagctcaagttata

SEQ ID NO: 5466 - DNA, 25 bp, Homo sapien
accacacgtcagctcaagttatact

SEQ ID NO: 5467 - DNA, 25 bp, Homo sapien
acacgtcagctcaagttatactcag

SEQ ID NO: 5468 - DNA, 25 bp, Homo sapien
cgtcagctcaagttatactcagaga

SEQ ID NO: 5469 - DNA, 25 bp, Homo sapien
aggaactgggaggactgcactacga

SEQ ID NO: 5470 - DNA, 25 bp, Homo sapien
actgggaggactgcactacgagttg

SEQ ID NO: 5471 - DNA, 25 bp, Homo sapien
actgcactacgagttggggctgacc

SEQ ID NO: 5472 - DNA, 25 bp, Homo sapien
catctgaagcagtcctgggcctctt

SEQ ID NO: 5473 - DNA, 25 bp, Homo sapien
tgggcctcttcacactacagatacc

SEQ ID NO: 5474 - DNA, 25 bp, Homo sapien
actacagataccaacactgccttta

SEQ ID NO: 5475 - DNA, 25 bp, Homo sapien
actgcctttactcttccattagtgt

SEQ ID NO: 5476 - DNA, 25 bp, Homo sapien
ctcttccattagtgtcctccaaaat

SEQ ID NO: 5477 - DNA, 25 bp, Homo sapien
gggtgcatggacagcaggtacacat

SEQ ID NO: 5478 - DNA, 25 bp, Homo sapien
tatttcgtccttttaagtttctgtg

SEQ ID NO: 5479 - DNA, 25 bp, Homo sapien
gtttctgtggttttgtgtacatttc

SEQ ID NO: 5480 - DNA, 25 bp, Homo sapien
acatttcttacgttagggatttcag

SEQ ID NO: 5481 - DNA, 25 bp, Homo sapien
aaagcttggagaccaggtacattca

SEQ ID NO: 5482 - DNA, 25 bp, Homo sapien
ggtacattcacaccatctaatagag

SEQ ID NO: 5483 - DNA, 25 bp, Homo sapien
aggagacatcccagaggcgccagct

SEQ ID NO: 5484 - DNA, 25 bp, Homo sapien
gagaccccagagggaccatggcaga

SEQ ID NO: 5485 - DNA, 25 bp, Homo sapien
agcaaaagaagccaatcgtctctgt

SEQ ID NO: 5486 - DNA, 25 bp, Homo sapien
aaagaagccaatcgtctctgtgaaa

SEQ ID NO: 5487 - DNA, 25 bp, Homo sapien
gccaatcgtctctgtgaaatgtcca

SEQ ID NO: 5488 - DNA, 25 bp, Homo sapien
tgaaatgtccagaagagggaactct

SEQ ID NO: 5489 - DNA, 25 bp, Homo sapien
agagaggatattattggctgccgga

SEQ ID NO: 5490 - DNA, 25 bp, Homo sapien
gaggtgatggttaaaagattcttct

SEQ ID NO: 5491 - DNA, 25 bp, Homo sapien
gttaaaagattcttctttgtggtga

SEQ ID NO: 5492 - DNA, 25 bp, Homo sapien
gtggtgatgaaattgtcttaaaatg

SEQ ID NO: 5493 - DNA, 25 bp, Homo sapien
agttgtgcaacttggtgaatatata

SEQ ID NO: 5494 - DNA, 25 bp, Homo sapien
aaaacacagcgtttatgatactgaa

SEQ ID NO: 5495 - DNA, 25 bp, Homo sapien
gtaaccaatactcgttaaactggat

SEQ ID NO: 5496 - DNA, 25 bp, Homo sapien
ggattgaattactcagccttttaat

SEQ ID NO: 5497 - DNA, 25 bp, Homo sapien
gaaatcaagaaagctgtagcaccac

SEQ ID NO: 5498 - DNA, 25 bp, Homo sapien
gtagcaccacagctttattggtctg

SEQ ID NO: 5499 - DNA, 25 bp, Homo sapien
attggtctgtactccatttctgaaa

SEQ ID NO: 5500 - DNA, 25 bp, Homo sapien
cagacaatgatgattccttagcttc

SEQ ID NO: 5501 - DNA, 25 bp, Homo sapien
ttccttagcttcatctcaagagtcc

SEQ ID NO: 5502 - DNA, 25 bp, Homo sapien
aagagtccagattatttccttctat

SEQ ID NO: 5503 - DNA, 25 bp, Homo sapien
tttccttctatactcactttcaatg

SEQ ID NO: 5504 - DNA, 25 bp, Homo sapien
gtaaacaaatgtaggctggacgccg

SEQ ID NO: 5505 - DNA, 25 bp, Homo sapien
gagtctgtatgaatatccagtttcc

SEQ ID NO: 5506 - DNA, 25 bp, Homo sapien
gtatgaatatccagtttcccaacaa

SEQ ID NO: 5507 - DNA, 25 bp, Homo sapien
gtttcccaacaaactgttatctaat

SEQ ID NO: 5508 - DNA, 25 bp, Homo sapien
aatgatagcatcctttaatgattct

SEQ ID NO: 5509 - DNA, 25 bp, Homo sapien
aatgattcttgcttgcatttattat

SEQ ID NO: 5510 - DNA, 25 bp, Homo sapien
aggatcactgtgtcgaaaatatgca

SEQ ID NO: 5511 - DNA, 25 bp, Homo sapien
ggaggcttttgcagttgtccaggca

SEQ ID NO: 5512 - DNA, 25 bp, Homo sapien
ggcttttgcagttgtccaggcaaga

SEQ ID NO: 5513 - DNA, 25 bp, Homo sapien
caggtgtgatggcaatatagtgaaa

SEQ ID NO: 5514 - DNA, 25 bp, Homo sapien
ggcatactggtgtgcccctttagtc

SEQ ID NO: 5515 - DNA, 25 bp, Homo sapien
tgtgcccctttagtcacagctgctt

SEQ ID NO: 5516 - DNA, 25 bp, Homo sapien
gaagtgtttcgttgtataatgctgg

SEQ ID NO: 5517 - DNA, 25 bp, Homo sapien
gtttcgttgtataatgctggatcat

SEQ ID NO: 5518 - DNA, 25 bp, Homo sapien
ctggatcatgtggttagctaattat

SEQ ID NO: 5519 - DNA, 25 bp, Homo sapien
ggttagctaattatgtggctcagaa

SEQ ID NO: 5520 - DNA, 25 bp, Homo sapien
gtggctcagaattagtatttctaag

SEQ ID NO: 5521 - DNA, 25 bp, Homo sapien
ttctaagcaagggaccaaccatagg

SEQ ID NO: 5522 - DNA, 25 bp, Homo sapien
caagggaccaaccatagggccaagt

SEQ ID NO: 5523 - DNA, 25 bp, Homo sapien
accatagggccaagtagtatctgtt

SEQ ID NO: 5524 - DNA, 25 bp, Homo sapien
gtagtatctgttatgtaggctttaa

SEQ ID NO: 5525 - DNA, 25 bp, Homo sapien
gaacatacgtgtgttaggaacccct

SEQ ID NO: 5526 - DNA, 25 bp, Homo sapien
tacgtgtgttaggaacccctttgat

SEQ ID NO: 5527 - DNA, 25 bp, Homo sapien
gcacccagcctaaaatgatggtttt

SEQ ID NO: 5528 - DNA, 25 bp, Homo sapien
gatggttttctgattctagcatttc

SEQ ID NO: 5529 - DNA, 25 bp, Homo sapien
ggttttctgattctagcatttcttt

SEQ ID NO: 5530 - DNA, 25 bp, Homo sapien
tttctgattctagcatttcttttat

SEQ ID NO: 5531 - DNA, 25 bp, Homo sapien
gattgctatgtaaagcacagctttt

SEQ ID NO: 5532 - DNA, 25 bp, Homo sapien
aaatattctttcaatggaatgacaa

SEQ ID NO: 5533 - DNA, 25 bp, Homo sapien
gtataatggtaacctgagcctgcat

SEQ ID NO: 5534 - DNA, 25 bp, Homo sapien
taatggtaacctgagcctgcatgtt

SEQ ID NO: 5535 - DNA, 25 bp, Homo sapien
atggtaacctgagcctgcatgttat

SEQ ID NO: 5536 - DNA, 25 bp, Homo sapien
gtaacctgagcctgcatgttattca

SEQ ID NO: 5537 - DNA, 25 bp, Homo sapien
gaaatttaatcacaggtggaatctt

SEQ ID NO: 5538 - DNA, 25 bp, Homo sapien
atggaatactgttccgccatgacaa

SEQ ID NO: 5539 - DNA, 25 bp, Homo sapien
gaggtgctgataaacggtaccacgt

SEQ ID NO: 5540 - DNA, 25 bp, Homo sapien
ggtaccacgtgcagggaccttgaaa

SEQ ID NO: 5541 - DNA, 25 bp, Homo sapien
gagaagtcagtcaccaaagaccaca

SEQ ID NO: 5542 - DNA, 25 bp, Homo sapien
accacatattacctgattccattca

SEQ ID NO: 5543 - DNA, 25 bp, Homo sapien
attccattcatctgcacggtccaga

SEQ ID NO: 5544 - DNA, 25 bp, Homo sapien
tgcacggtccagaacaagggagtct

SEQ ID NO: 5545 - DNA, 25 bp, Homo sapien
gagatagttggttagtggttgccta

SEQ ID NO: 5546 - DNA, 25 bp, Homo sapien
gtatagtatacacggttcctttttg

SEQ ID NO: 5547 - DNA, 25 bp, Homo sapien
gtacactttacatgaatcagctata

SEQ ID NO: 5548 - DNA, 25 bp, Homo sapien
gtgaactatttctccataaagctgg

SEQ ID NO: 5549 - DNA, 25 bp, Homo sapien
gaaaatgatcatagtccattacgta

SEQ ID NO: 5550 - DNA, 25 bp, Homo sapien
tagtccattacgtatgaatcatcca

SEQ ID NO: 5551 - DNA, 25 bp, Homo sapien
gaatcatccaatacttggtcggaga

SEQ ID NO: 5552 - DNA, 25 bp, Homo sapien
tacttggtcggagaggcactgcatc

SEQ ID NO: 5553 - DNA, 25 bp, Homo sapien
ggtcggagaggcactgcatctaaaa

SEQ ID NO: 5554 - DNA, 25 bp, Homo sapien
gcctgttttggtggctaatcgcaag

SEQ ID NO: 5555 - DNA, 25 bp, Homo sapien
gtggctaatcgcaagtcagttgcaa

SEQ ID NO: 5556 - DNA, 25 bp, Homo sapien
ttacaaccagagagtgtccttcagg

SEQ ID NO: 5557 - DNA, 25 bp, Homo sapien
ggcatcaggctgtttttataaagaa

SEQ ID NO: 5558 - DNA, 25 bp, Homo sapien
ttataaagaaccctgcctgagccgg

SEQ ID NO: 5559 - DNA, 25 bp, Homo sapien
aagaaccctgcctgagccgggcgcg

SEQ ID NO: 5560 - DNA, 25 bp, Homo sapien
tccacctcctgggatgcaagcaacg

SEQ ID NO: 5561 - DNA, 25 bp, Homo sapien
tgagcttgggcggtccacctgcctt

SEQ ID NO: 5562 - DNA, 25 bp, Homo sapien
cctggcctcctgtgtttaacatata

SEQ ID NO: 5563 - DNA, 25 bp, Homo sapien
ttaagcatttcctttctggcactac

SEQ ID NO: 5564 - DNA, 25 bp, Homo sapien
atgcccttgtcctagaatcagcctt

SEQ ID NO: 5565 - DNA, 25 bp, Homo sapien
ggaccagggccatttttaatctaat

SEQ ID NO: 5566 - DNA, 25 bp, Homo sapien
cagggccatttttaatctaatttga

SEQ ID NO: 5567 - DNA, 25 bp, Homo sapien
gaaaattacattctcgattgggact

SEQ ID NO: 5568 - DNA, 25 bp, Homo sapien
attctcgattgggactattaagttt

SEQ ID NO: 5569 - DNA, 25 bp, Homo sapien
acattgactaactgctgttcattgc

SEQ ID NO: 5570 - DNA, 25 bp, Homo sapien
ctgctgttcattgcatgatcatgaa

SEQ ID NO: 5571 - DNA, 25 bp, Homo sapien
ggcactccagcagctagaagctgaa

SEQ ID NO: 5572 - DNA, 25 bp, Homo sapien
caatggagactatgagggagtagcc

SEQ ID NO: 5573 - DNA, 25 bp, Homo sapien
gcgggtgtcctgtaagatacgtgaa

SEQ ID NO: 5574 - DNA, 25 bp, Homo sapien
aaggcatgtttggatttgacaagca

SEQ ID NO: 5575 - DNA, 25 bp, Homo sapien
acaagcattgctaagtggtcaagaa

SEQ ID NO: 5576 - DNA, 25 bp, Homo sapien
aagacacaggccaacttgaccattg

SEQ ID NO: 5577 - DNA, 25 bp, Homo sapien
tgaccattggatttgactgtttgat

SEQ ID NO: 5578 - DNA, 25 bp, Homo sapien
ctgtttgatgatggtcagtaacctt

SEQ ID NO: 5579 - DNA, 25 bp, Homo sapien
gatggtcagtaaccttgatgagagt

SEQ ID NO: 5580 - DNA, 25 bp, Homo sapien
ggatttgtgtgcattaaagccagac

SEQ ID NO: 5581 - DNA, 25 bp, Homo sapien
attaaagccagactgggcagggcac

SEQ ID NO: 5582 - DNA, 25 bp, Homo sapien
aaagatttacttttcatcagattaa

SEQ ID NO: 5583 - DNA, 25 bp, Homo sapien
ggaaggattttctttctaaatactg

SEQ ID NO: 5584 - DNA, 25 bp, Homo sapien
gaatttcccaagttggataccccag

SEQ ID NO: 5585 - DNA, 25 bp, Homo sapien
gtgtagacatttatccaaaatctgt

SEQ ID NO: 5586 - DNA, 25 bp, Homo sapien
aaatctgtatttactcctgacttac

SEQ ID NO: 5587 - DNA, 25 bp, Homo sapien
gtatttactcctgacttacattaca

SEQ ID NO: 5588 - DNA, 25 bp, Homo sapien
tttactcctgacttacattacaaat

SEQ ID NO: 5589 - DNA, 25 bp, Homo sapien
gacttacattacaaatacagagttt

SEQ ID NO: 5590 - DNA, 25 bp, Homo sapien
ttaaaatctactcaccatcaaactt

SEQ ID NO: 5591 - DNA, 25 bp, Homo sapien
aaatctactcaccatcaaacttttt

SEQ ID NO: 5592 - DNA, 25 bp, Homo sapien
gaacataagccaatgtcaggagttg

SEQ ID NO: 5593 - DNA, 25 bp, Homo sapien
agaagagccagtgtgataatacatt

SEQ ID NO: 5594 - DNA, 25 bp, Homo sapien
gccagtgtgataatacattgagtga

SEQ ID NO: 5595 - DNA, 25 bp, Homo sapien
gtgcatatatgagcaaaaagttatt

SEQ ID NO: 5596 - DNA, 25 bp, Homo sapien
tttcccttttctgaagtatggcagc

SEQ ID NO: 5597 - DNA, 25 bp, Homo sapien
tcccttttctgaagtatggcagcat

SEQ ID NO: 5598 - DNA, 25 bp, Homo sapien
ccttttctgaagtatggcagcatac

SEQ ID NO: 5599 - DNA, 25 bp, Homo sapien
gtatggcagcatactatatagactg

SEQ ID NO: 5600 - DNA, 25 bp, Homo sapien
ggcagcatactatatagactgtctc

SEQ ID NO: 5601 - DNA, 25 bp, Homo sapien
agcatactatatagactgtctctgc

SEQ ID NO: 5602 - DNA, 25 bp, Homo sapien
tttcccccatttaatatatcctgga

SEQ ID NO: 5603 - DNA, 25 bp, Homo sapien
atatcctggagatcattttatatca

SEQ ID NO: 5604 - DNA, 25 bp, Homo sapien
ccttaagcagttcagaatgtgtgtc

SEQ ID NO: 5605 - DNA, 25 bp, Homo sapien
aaattctttatcatcagatagccag

SEQ ID NO: 5606 - DNA, 25 bp, Homo sapien
tcatcagatagccagttagtattaa

SEQ ID NO: 5607 - DNA, 25 bp, Homo sapien
aatagttcatttgaatcagagccaa

SEQ ID NO: 5608 - DNA, 25 bp, Homo sapien
tcagagccaaataaagtctacacat

SEQ ID NO: 5609 - DNA, 25 bp, Homo sapien
gtctacacattgcagttggttgatg

SEQ ID NO: 5610 - DNA, 25 bp, Homo sapien
attgcagttggttgatgtctctata

SEQ ID NO: 5611 - DNA, 25 bp, Homo sapien
gatgtctctataggttctctcttat

SEQ ID NO: 5612 - DNA, 25 bp, Homo sapien
ggttctctcttatgctcttttttat

SEQ ID NO: 5613 - DNA, 25 bp, Homo sapien
tttaaaaagatctctgccaggcgcg

SEQ ID NO: 5614 - DNA, 25 bp, Homo sapien
aaagatctctgccaggcgcggtgac

SEQ ID NO: 5615 - DNA, 25 bp, Homo sapien
gtcattgacatgtagggtatgtttc

SEQ ID NO: 5616 - DNA, 25 bp, Homo sapien
aaaatgccaagctggcaaggtggct

SEQ ID NO: 5617 - DNA, 25 bp, Homo sapien
ttaatagtggcctttaaaatctgtg

SEQ ID NO: 5618 - DNA, 25 bp, Homo sapien
gatacagatcaatctatgttgatgg

SEQ ID NO: 5619 - DNA, 25 bp, Homo sapien
ttactttattttactctcggaggtg

SEQ ID NO: 5620 - DNA, 25 bp, Homo sapien
ctctcggaggtgtaaatttataatc

SEQ ID NO: 5621 - DNA, 25 bp, Homo sapien
gtttatttatgcctacctcactatc

SEQ ID NO: 5622 - DNA, 25 bp, Homo sapien
atttatgcctacctcactatcaaac

SEQ ID NO: 5623 - DNA, 25 bp, Homo sapien
tatgcctacctcactatcaaacttt

SEQ ID NO: 5624 - DNA, 25 bp, Homo sapien
ctacctcactatcaaactttcaact

SEQ ID NO: 5625 - DNA, 25 bp, Homo sapien
actttcaactgatagattgtgtcaa

SEQ ID NO: 5626 - DNA, 25 bp, Homo sapien
tacataggtacagtgtgggctgctg

SEQ ID NO: 5627 - DNA, 25 bp, Homo sapien
tgaggtttgggagtacgaatgaatt

SEQ ID NO: 5628 - DNA, 25 bp, Homo sapien
gtacgaatgaattagtcaccccagt

SEQ ID NO: 5629 - DNA, 25 bp, Homo sapien
gaatgaattagtcaccccagtggtg

SEQ ID NO: 5630 - DNA, 25 bp, Homo sapien
accccagtggtgagcatagtgcccg

SEQ ID NO: 5631 - DNA, 25 bp, Homo sapien
gtggtgagcatagtgcccgataagt

SEQ ID NO: 5632 - DNA, 25 bp, Homo sapien
tagtgcccgataagtggttttttca

SEQ ID NO: 5633 - DNA, 25 bp, Homo sapien
cccatttttatgaccatgtgtactc

SEQ ID NO: 5634 - DNA, 25 bp, Homo sapien
ttagaagtaagaacatgcccagcac

SEQ ID NO: 5635 - DNA, 25 bp, Homo sapien
gaagtaagaacatgcccagcacttt

SEQ ID NO: 5636 - DNA, 25 bp, Homo sapien
aacaagtgatgctgaaatatctttt

SEQ ID NO: 5637 - DNA, 25 bp, Homo sapien
tcaagttcatttgagccatttttaa

SEQ ID NO: 5638 - DNA, 25 bp, Homo sapien
caacttaggattttgtgtgccacca

SEQ ID NO: 5639 - DNA, 25 bp, Homo sapien
taggattttgtgtgccaccagcttc

SEQ ID NO: 5640 - DNA, 25 bp, Homo sapien
attttgtgtgccaccagcttccatt

SEQ ID NO: 5641 - DNA, 25 bp, Homo sapien
atctagcaagaattggtgagcccta

SEQ ID NO: 5642 - DNA, 25 bp, Homo sapien
gcaagaattggtgagccctagtaga

SEQ ID NO: 5643 - DNA, 25 bp, Homo sapien
aattggtgagccctagtagaagtta

SEQ ID NO: 5644 - DNA, 25 bp, Homo sapien
ggtgagccctagtagaagttagaaa

SEQ ID NO: 5645 - DNA, 25 bp, Homo sapien
gcatcagaatcaccttggacacttt

SEQ ID NO: 5646 - DNA, 25 bp, Homo sapien
cagaatcaccttggacactttttaa

SEQ ID NO: 5647 - DNA, 25 bp, Homo sapien
ccaggcttggtagtgggctcctgta

SEQ ID NO: 5648 - DNA, 25 bp, Homo sapien
atttacttacaaggaggctgctctt

SEQ ID NO: 5649 - DNA, 25 bp, Homo sapien
aaggaggctgctcttgttaccactt

SEQ ID NO: 5650 - DNA, 25 bp, Homo sapien
gctgctcttgttaccacttttatta

SEQ ID NO: 5651 - DNA, 25 bp, Homo sapien
tacgtatcacttattcagctctgct

SEQ ID NO: 5652 - DNA, 25 bp, Homo sapien
tctcttgtgggttgataatgtctcc

SEQ ID NO: 5653 - DNA, 25 bp, Homo sapien
gggttgataatgtctccccaaaatt

SEQ ID NO: 5654 - DNA, 25 bp, Homo sapien
aatttacatgttgaagcacctcaga

SEQ ID NO: 5655 - DNA, 25 bp, Homo sapien
aggatagaccctaattcaatatgac

SEQ ID NO: 5656 - DNA, 25 bp, Homo sapien
gcgagtagggcacaacaggcacaaa

SEQ ID NO: 5657 - DNA, 25 bp, Homo sapien
ggaaggacaactctttacaagctaa

SEQ ID NO: 5658 - DNA, 25 bp, Homo sapien
tacaagctaagaagagagggcctca

SEQ ID NO: 5659 - DNA, 25 bp, Homo sapien
gctcagcctccagaagttatgaaat

SEQ ID NO: 5660 - DNA, 25 bp, Homo sapien
gcctccagaagttatgaaatttcca

SEQ ID NO: 5661 - DNA, 25 bp, Homo sapien
gtgaaatcctaacccacttgtgttt

SEQ ID NO: 5662 - DNA, 25 bp, Homo sapien
atcacatcccgcctgttaaggaaag

SEQ ID NO: 5663 - DNA, 25 bp, Homo sapien
cacatcccgcctgttaaggaaagag

SEQ ID NO: 5664 - DNA, 25 bp, Homo sapien
tcctcggaggctgagtacaagtagc

SEQ ID NO: 5665 - DNA, 25 bp, Homo sapien
gctgagtacaagtagctccagctac

SEQ ID NO: 5666 - DNA, 25 bp, Homo sapien
gacagagttagactctgcttccaaa

SEQ ID NO: 5667 - DNA, 25 bp, Homo sapien
attagctaggcttggttgtgttcac

SEQ ID NO: 5668 - DNA, 25 bp, Homo sapien
taggcttggttgtgttcacctgtaa

SEQ ID NO: 5669 - DNA, 25 bp, Homo sapien
ggaggatcgtttgaactggtgaggt

SEQ ID NO: 5670 - DNA, 25 bp, Homo sapien
ttgagtatctgctacacctctatgg

SEQ ID NO: 5671 - DNA, 25 bp, Homo sapien
ctgctacacctctatggtatttttt

SEQ ID NO: 5672 - DNA, 25 bp, Homo sapien
ttttttcacctcatatcataccttc

SEQ ID NO: 5673 - DNA, 25 bp, Homo sapien
acttcagtgtgggacctgcaggtct

SEQ ID NO: 5674 - DNA, 25 bp, Homo sapien
gctataggtgataagccggctgttc

SEQ ID NO: 5675 - DNA, 25 bp, Homo sapien
gataagccggctgttcttcactgac

SEQ ID NO: 5676 - DNA, 25 bp, Homo sapien
ttcactgacctggtcttaccttgaa

SEQ ID NO: 5677 - DNA, 25 bp, Homo sapien
taccttgaaccctggagttctcaca

SEQ ID NO: 5678 - DNA, 25 bp, Homo sapien
ttctaagggcacattatggccattt

SEQ ID NO: 5679 - DNA, 25 bp, Homo sapien
attatggccattttccttatctccc

SEQ ID NO: 5680 - DNA, 25 bp, Homo sapien
gtgatttttcaatacagtgtggaat

SEQ ID NO: 5681 - DNA, 25 bp, Homo sapien
ctagatatcatgtacattaggtcga

SEQ ID NO: 5682 - DNA, 25 bp, Homo sapien
catgtacattaggtcgaataactct

SEQ ID NO: 5683 - DNA, 25 bp, Homo sapien
gtacattaggtcgaataactctaga

SEQ ID NO: 5684 - DNA, 25 bp, Homo sapien
gaataactctagaaatgtcgtcata

SEQ ID NO: 5685 - DNA, 25 bp, Homo sapien
gaaatgtcgtcataatcatgtcatg

SEQ ID NO: 5686 - DNA, 25 bp, Homo sapien
aatgtcgtcataatcatgtcatgcc

SEQ ID NO: 5687 - DNA, 25 bp, Homo sapien
tgtcgtcataatcatgtcatgccta

SEQ ID NO: 5688 - DNA, 25 bp, Homo sapien
gtcataatcatgtcatgcctaatga

SEQ ID NO: 5689 - DNA, 25 bp, Homo sapien
atgcctaatgatgacctactcagcc

SEQ ID NO: 5690 - DNA, 25 bp, Homo sapien
tgcctaatgatgacctactcagccc

SEQ ID NO: 5691 - DNA, 25 bp, Homo sapien
taatgatgacctactcagcccctgc

SEQ ID NO: 5692 - DNA, 25 bp, Homo sapien
aggaggactggccaccgaggcccag

SEQ ID NO: 5693 - DNA, 25 bp, Homo sapien
caggcacagggatgctgggtggcca

SEQ ID NO: 5694 - DNA, 25 bp, Homo sapien
tgctgggtggccatggccagtcctc

SEQ ID NO: 5695 - DNA, 25 bp, Homo sapien
agctctcacgccgggagaggttttt

SEQ ID NO: 5696 - DNA, 25 bp, Homo sapien
ttcgcagaacgggagcacatggatt

SEQ ID NO: 5697 - DNA, 25 bp, Homo sapien
tcgcagaacgggagcacatggattt

SEQ ID NO: 5698 - DNA, 25 bp, Homo sapien
cgcagaacgggagcacatggatttc

SEQ ID NO: 5699 - DNA, 25 bp, Homo sapien
cagaacgggagcacatggatttcca

SEQ ID NO: 5700 - DNA, 25 bp, Homo sapien
gaacgggagcacatggatttccagt

SEQ ID NO: 5701 - DNA, 25 bp, Homo sapien
aacgggagcacatggatttccagtt

SEQ ID NO: 5702 - DNA, 25 bp, Homo sapien
acgggagcacatggatttccagttc

SEQ ID NO: 5703 - DNA, 25 bp, Homo sapien
aatgaagtcccagctgccgagagca

SEQ ID NO: 5704 - DNA, 25 bp, Homo sapien
agctgccgagagcaacagatgctga

SEQ ID NO: 5705 - DNA, 25 bp, Homo sapien
agatgctgactagatgttgttgaca

SEQ ID NO: 5706 - DNA, 25 bp, Homo sapien
tgagaagccatcagctcccatcctg

SEQ ID NO: 5707 - DNA, 25 bp, Homo sapien
cgctgctgaaaaaggcctggagatc

SEQ ID NO: 5708 - DNA, 25 bp, Homo sapien
ggcctggagatcaacaaagccccaa

SEQ ID NO: 5709 - DNA, 25 bp, Homo sapien
aacaaagccccaaacacaggtgcac

SEQ ID NO: 5710 - DNA, 25 bp, Homo sapien
agacattccctcaaagactactcat

SEQ ID NO: 5711 - DNA, 25 bp, Homo sapien
caaagactactcatttccaagaggg

SEQ ID NO: 5712 - DNA, 25 bp, Homo sapien
gctgggtagagtgactcgcacctgt

SEQ ID NO: 5713 - DNA, 25 bp, Homo sapien
gcactttgggattactcccaggctg

SEQ ID NO: 5714 - DNA, 25 bp, Homo sapien
tctttttccgggaccaacagactct

SEQ ID NO: 5715 - DNA, 25 bp, Homo sapien
tctgagggcagggacaaactgaccc

SEQ ID NO: 5716 - DNA, 25 bp, Homo sapien
ggcagggacaaactgacccagccta

SEQ ID NO: 5717 - DNA, 25 bp, Homo sapien
tttccctgagggaaggtagcatctt

SEQ ID NO: 5718 - DNA, 25 bp, Homo sapien
ctgagggaaggtagcatcttgccat

SEQ ID NO: 5719 - DNA, 25 bp, Homo sapien
gggaaggtagcatcttgccattttc

SEQ ID NO: 5720 - DNA, 25 bp, Homo sapien
aaggtagcatcttgccattttcttc

SEQ ID NO: 5721 - DNA, 25 bp, Homo sapien
agctacttgggacgcctacagagac

SEQ ID NO: 5722 - DNA, 25 bp, Homo sapien
cttgggacgcctacagagactacat

SEQ ID NO: 5723 - DNA, 25 bp, Homo sapien
gggacgcctacagagactacattgt

SEQ ID NO: 5724 - DNA, 25 bp, Homo sapien
gactacattgtcagaggatgcatct

SEQ ID NO: 5725 - DNA, 25 bp, Homo sapien
ccatgatactgctggtggtgcagaa

SEQ ID NO: 5726 - DNA, 25 bp, Homo sapien
gtgcacggccgagagcaatctggaa

SEQ ID NO: 5727 - DNA, 25 bp, Homo sapien
gccgagagcaatctggaaacgatca

SEQ ID NO: 5728 - DNA, 25 bp, Homo sapien
gaaacgatcagagaggccagttgcg

SEQ ID NO: 5729 - DNA, 25 bp, Homo sapien
tcagagaggccagttgcgtaatgat

SEQ ID NO: 5730 - DNA, 25 bp, Homo sapien
cgtaatgatggagaagccgctgttt

SEQ ID NO: 5731 - DNA, 25 bp, Homo sapien
aagccgctgttttgcagccacgaaa

SEQ ID NO: 5732 - DNA, 25 bp, Homo sapien
gcagccacgaaaatcatgcctggag

SEQ ID NO: 5733 - DNA, 25 bp, Homo sapien
atgttccgggatgtgaaattattca

SEQ ID NO: 5734 - DNA, 25 bp, Homo sapien
agaagagagctaagccagcccttgg

SEQ ID NO: 5735 - DNA, 25 bp, Homo sapien
gactacaagaggaccggaggagaca

SEQ ID NO: 5736 - DNA, 25 bp, Homo sapien
gacaagcctcgtggttctgggcagt

SEQ ID NO: 5737 - DNA, 25 bp, Homo sapien
gcctcgtggttctgggcagtgccat

SEQ ID NO: 5738 - DNA, 25 bp, Homo sapien
cagtgccatggagctctgcgggaat

SEQ ID NO: 5739 - DNA, 25 bp, Homo sapien
gccatggagctctgcgggaatgact

SEQ ID NO: 5740 - DNA, 25 bp, Homo sapien
agctctgcgggaatgactcggtgta

SEQ ID NO: 5741 - DNA, 25 bp, Homo sapien
gggaatgactcggtgtacgcctacg

SEQ ID NO: 5742 - DNA, 25 bp, Homo sapien
aatgactcggtgtacgcctacgcct

SEQ ID NO: 5743 - DNA, 25 bp, Homo sapien
ctcctccgtgttccggaaggcagga

SEQ ID NO: 5744 - DNA, 25 bp, Homo sapien
ggaagcgaagatccagtacgcgatc

SEQ ID NO: 5745 - DNA, 25 bp, Homo sapien
gatccagtacgcgatcatcgggact

SEQ ID NO: 5746 - DNA, 25 bp, Homo sapien
cagtacgcgatcatcgggactggga

SEQ ID NO: 5747 - DNA, 25 bp, Homo sapien
aatgagtgaaggagttagaccaact

SEQ ID NO: 5748 - DNA, 25 bp, Homo sapien
gttagaccaactcagtgaatgaatg

SEQ ID NO: 5749 - DNA, 25 bp, Homo sapien
gctaagcccacgagaatcaatcctg

SEQ ID NO: 5750 - DNA, 25 bp, Homo sapien
tcaatcctgggacttttactgaaat

SEQ ID NO: 5751 - DNA, 25 bp, Homo sapien
cctgggacttttactgaaattctca

SEQ ID NO: 5752 - DNA, 25 bp, Homo sapien
tactgaaattctcagaaagaggcac

SEQ ID NO: 5753 - DNA, 25 bp, Homo sapien
ggtggtaggagatacctgcagctat

SEQ ID NO: 5754 - DNA, 25 bp, Homo sapien
gggggatccttttatgcccatgagg

SEQ ID NO: 5755 - DNA, 25 bp, Homo sapien
tggctgagagtgacactaacacaga

SEQ ID NO: 5756 - DNA, 25 bp, Homo sapien
gagagtgacactaacacagaatgag

SEQ ID NO: 5757 - DNA, 25 bp, Homo sapien
gaaataaacatagttgcaacaccct

SEQ ID NO: 5758 - DNA, 25 bp, Homo sapien
gggcttggttctaccatatctctac

SEQ ID NO: 5759 - DNA, 25 bp, Homo sapien
ttggttctaccatatctctactttg

SEQ ID NO: 5760 - DNA, 25 bp, Homo sapien
ggttctaccatatctctactttgtg

SEQ ID NO: 5761 - DNA, 25 bp, Homo sapien
ctaccatatctctactttgtgttta

SEQ ID NO: 5762 - DNA, 25 bp, Homo sapien
ccatatctctactttgtgtttatgt

SEQ ID NO: 5763 - DNA, 25 bp, Homo sapien
ttgtgtatgcatgtactccaaagtc

SEQ ID NO: 5764 - DNA, 25 bp, Homo sapien
gtatgcatgtactccaaagtctttc

SEQ ID NO: 5765 - DNA, 25 bp, Homo sapien
gtctttctaatgttgctttaatttc

SEQ ID NO: 5766 - DNA, 25 bp, Homo sapien
atgttgctttaatttccaaaaatgt

SEQ ID NO: 5767 - DNA, 25 bp, Homo sapien
aaagtatacattaaagtgcttattt

SEQ ID NO: 5768 - DNA, 25 bp, Homo sapien
aattcagatgttaacctcaattttt

SEQ ID NO: 5769 - DNA, 25 bp, Homo sapien
gaagaccacacctcagaaattattg

SEQ ID NO: 5770 - DNA, 25 bp, Homo sapien
gcattttctcattatgtgttgggtt

SEQ ID NO: 5771 - DNA, 25 bp, Homo sapien
tcttgatacagtgaaatctcttatt

SEQ ID NO: 5772 - DNA, 25 bp, Homo sapien
cctgccattgtatttcccatctgtt

SEQ ID NO: 5773 - DNA, 25 bp, Homo sapien
aacaatttacattgcatcgtatgca

SEQ ID NO: 5774 - DNA, 25 bp, Homo sapien
agttgtctttgtggagagggtctta

SEQ ID NO: 5775 - DNA, 25 bp, Homo sapien
gggtcttagacaaaaatcttccttg

SEQ ID NO: 5776 - DNA, 25 bp, Homo sapien
agtccaaattcttacagtatgctat

SEQ ID NO: 5777 - DNA, 25 bp, Homo sapien
tacagtatgctatttcaggatttct

SEQ ID NO: 5778 - DNA, 25 bp, Homo sapien
ttatatctcttattaacacttcccc

SEQ ID NO: 5779 - DNA, 25 bp, Homo sapien
ccccaagaagggttgtgctgttatt

SEQ ID NO: 5780 - DNA, 25 bp, Homo sapien
aagtattaggaactacacacatcaa

SEQ ID NO: 5781 - DNA, 25 bp, Homo sapien
taggaactacacacatcaatgccaa

SEQ ID NO: 5782 - DNA, 25 bp, Homo sapien
ggaactacacacatcaatgccaaaa

SEQ ID NO: 5783 - DNA, 25 bp, Homo sapien
aactacacacatcaatgccaaaatg

SEQ ID NO: 5784 - DNA, 25 bp, Homo sapien
tttgaaaagtgatcttcccatgaac

SEQ ID NO: 5785 - DNA, 25 bp, Homo sapien
gaaaagtgatcttcccatgaacata

SEQ ID NO: 5786 - DNA, 25 bp, Homo sapien
aagtgatcttcccatgaacatattt

SEQ ID NO: 5787 - DNA, 25 bp, Homo sapien
gtgatcttcccatgaacatattttc

SEQ ID NO: 5788 - DNA, 25 bp, Homo sapien
gatcttcccatgaacatattttcag

SEQ ID NO: 5789 - DNA, 25 bp, Homo sapien
gagtttcagtttaaagttgggtatg

SEQ ID NO: 5790 - DNA, 25 bp, Homo sapien
ttcagtttaaagttgggtatggtgg

SEQ ID NO: 5791 - DNA, 25 bp, Homo sapien
attgatctctctgcaaacctagaca

SEQ ID NO: 5792 - DNA, 25 bp, Homo sapien
gaaccttgggttatcatcttgtctg

SEQ ID NO: 5793 - DNA, 25 bp, Homo sapien
atcttgtctgcctccggttgttggt

SEQ ID NO: 5794 - DNA, 25 bp, Homo sapien
gattctgaatcaccttccagtaatg

SEQ ID NO: 5795 - DNA, 25 bp, Homo sapien
ggaaaacaggctttctcagtaattt

SEQ ID NO: 5796 - DNA, 25 bp, Homo sapien
tcagtaattttcaggagctctcact

SEQ ID NO: 5797 - DNA, 25 bp, Homo sapien
ggagctctcactgacaataagcttt

SEQ ID NO: 5798 - DNA, 25 bp, Homo sapien
ttccattgtaaatcactctaaaccg

SEQ ID NO: 5799 - DNA, 25 bp, Homo sapien
ttttttggcctgtaatcacattgct

SEQ ID NO: 5800 - DNA, 25 bp, Homo sapien
aatcacattgctttcttggttgaaa

SEQ ID NO: 5801 - DNA, 25 bp, Homo sapien
tagtttcattaaaccttctttgctt

SEQ ID NO: 5802 - DNA, 25 bp, Homo sapien
gaagttcagtttcttgattcaatcc

SEQ ID NO: 5803 - DNA, 25 bp, Homo sapien
gttcagtttcttgattcaatcctca

SEQ ID NO: 5804 - DNA, 25 bp, Homo sapien
cagtttcttgattcaatcctcatgt

SEQ ID NO: 5805 - DNA, 25 bp, Homo sapien
gtttcttgattcaatcctcatgtat

SEQ ID NO: 5806 - DNA, 25 bp, Homo sapien
cttgattcaatcctcatgtatatga

SEQ ID NO: 5807 - DNA, 25 bp, Homo sapien
gaatcaaatgctgaattatgcttta

SEQ ID NO: 5808 - DNA, 25 bp, Homo sapien
tcaaatgctgaattatgctttaaca

SEQ ID NO: 5809 - DNA, 25 bp, Homo sapien
gctttaacaattaaggagagctcaa

SEQ ID NO: 5810 - DNA, 25 bp, Homo sapien
gagagctcaatgttagttgtagggt

SEQ ID NO: 5811 - DNA, 25 bp, Homo sapien
caatgttagttgtagggtatgggaa

SEQ ID NO: 5812 - DNA, 25 bp, Homo sapien
gggaattgatttttgaaagactgat

SEQ ID NO: 5813 - DNA, 25 bp, Homo sapien
accttgccagacacggtgggccact

SEQ ID NO: 5814 - DNA, 25 bp, Homo sapien
ttgccagacacggtgggccactgga

SEQ ID NO: 5815 - DNA, 25 bp, Homo sapien
acggtgggccactggagttcctctg

SEQ ID NO: 5816 - DNA, 25 bp, Homo sapien
gggccactggagttcctctgtcttc

SEQ ID NO: 5817 - DNA, 25 bp, Homo sapien
tgtcttctgggactttgctctcccc

SEQ ID NO: 5818 - DNA, 25 bp, Homo sapien
ttctgggactttgctctccccaggg

SEQ ID NO: 5819 - DNA, 25 bp, Homo sapien
aactcctcaatcttggagcgccaga

SEQ ID NO: 5820 - DNA, 25 bp, Homo sapien
ttggagcgccagagctcagccgagc

SEQ ID NO: 5821 - DNA, 25 bp, Homo sapien
gagcgccagagctcagccgagctca

SEQ ID NO: 5822 - DNA, 25 bp, Homo sapien
gagctcaccggctccctagggagct

SEQ ID NO: 5823 - DNA, 25 bp, Homo sapien
gagctggggcaactgttagctcccc

SEQ ID NO: 5824 - DNA, 25 bp, Homo sapien
aaatgtcagtgttaattcaagctgg

SEQ ID NO: 5825 - DNA, 25 bp, Homo sapien
tcagtgttaattcaagctgggagct

SEQ ID NO: 5826 - DNA, 25 bp, Homo sapien
tgccttcttccattctatccgaagt

SEQ ID NO: 5827 - DNA, 25 bp, Homo sapien
tcttccattctatccgaagtctctt

SEQ ID NO: 5828 - DNA, 25 bp, Homo sapien
ccatatccattagttcaggattttt

SEQ ID NO: 5829 - DNA, 25 bp, Homo sapien
gtttcaggtttctatttaacatgta

SEQ ID NO: 5830 - DNA, 25 bp, Homo sapien
taccaaatgtaccagaaagggttat

SEQ ID NO: 5831 - DNA, 25 bp, Homo sapien
caatagttatctaaaagttggttca

SEQ ID NO: 5832 - DNA, 25 bp, Homo sapien
acaatgtagtaaggaatcattaggc

SEQ ID NO: 5833 - DNA, 25 bp, Homo sapien
aaagaattggagacgtttggctaat

SEQ ID NO: 5834 - DNA, 25 bp, Homo sapien
ggagacgtttggctaattaaacatt

SEQ ID NO: 5835 - DNA, 25 bp, Homo sapien
ccggcgagggagaggccggacctga

SEQ ID NO: 5836 - DNA, 25 bp, Homo sapien
gcgctcgcgacgaggaggatccgga

SEQ ID NO: 5837 - DNA, 25 bp, Homo sapien
tcgcgacgaggaggatccggagccg

SEQ ID NO: 5838 - DNA, 25 bp, Homo sapien
ggaggatccggagccgccggtggct

SEQ ID NO: 5839 - DNA, 25 bp, Homo sapien
ttccctcgagacccgccaagaaata

SEQ ID NO: 5840 - DNA, 25 bp, Homo sapien
ctcgagacccgccaagaaataaagg

SEQ ID NO: 5841 - DNA, 25 bp, Homo sapien
gagacccgccaagaaataaaggcga

SEQ ID NO: 5842 - DNA, 25 bp, Homo sapien
aataaaggcgatgatttccgaccaa

SEQ ID NO: 5843 - DNA, 25 bp, Homo sapien
ataaaggcgatgatttccgaccaaa

SEQ ID NO: 5844 - DNA, 25 bp, Homo sapien
taaaggcgatgatttccgaccaaaa

SEQ ID NO: 5845 - DNA, 25 bp, Homo sapien
ggtggagcggcagctgcactcgccg

SEQ ID NO: 5846 - DNA, 25 bp, Homo sapien
gaaggtaatctcctgcttgtggtca

SEQ ID NO: 5847 - DNA, 25 bp, Homo sapien
ctgcttgtggtcatatgtacttagg

SEQ ID NO: 5848 - DNA, 25 bp, Homo sapien
ggtcatatgtacttaggattctatt

SEQ ID NO: 5849 - DNA, 25 bp, Homo sapien
gacaattagtggtctctagtacaaa

SEQ ID NO: 5850 - DNA, 25 bp, Homo sapien
attaccaggtcatttccaattctca

SEQ ID NO: 5851 - DNA, 25 bp, Homo sapien
ggtcatttccaattctcaatattaa

SEQ ID NO: 5852 - DNA, 25 bp, Homo sapien
gtttatttcttactgcactatcaaa

SEQ ID NO: 5853 - DNA, 25 bp, Homo sapien
atcaaattggaaaggtcagtacagg

SEQ ID NO: 5854 - DNA, 25 bp, Homo sapien
atcacatttgattgatgtctgttac

SEQ ID NO: 5855 - DNA, 25 bp, Homo sapien
gatgtctgttacatggatttttaaa

SEQ ID NO: 5856 - DNA, 25 bp, Homo sapien
atatgtactatattctctcctaata

SEQ ID NO: 5857 - DNA, 25 bp, Homo sapien
atgctagtacttcataaaaggtcaa

SEQ ID NO: 5858 - DNA, 25 bp, Homo sapien
caaagtgaacataaccaagtggcaa

SEQ ID NO: 5859 - DNA, 25 bp, Homo sapien
gtggcaaaaatatttcgtactgatt

SEQ ID NO: 5860 - DNA, 25 bp, Homo sapien
ttcgtactgatttagtaactactat

SEQ ID NO: 5861 - DNA, 25 bp, Homo sapien
ataatctaccagtaagtctgggtaa

SEQ ID NO: 5862 - DNA, 25 bp, Homo sapien
gaactaatttaagaggaccacatac

SEQ ID NO: 5863 - DNA, 25 bp, Homo sapien
ggaccacatacgaggaaaaacataa

SEQ ID NO: 5864 - DNA, 25 bp, Homo sapien
aaaacataacctgcccaaaactatg

SEQ ID NO: 5865 - DNA, 25 bp, Homo sapien
aacctgcccaaaactatggcatagc

SEQ ID NO: 5866 - DNA, 25 bp, Homo sapien
tgatcataggaaaagaggtcccaca

SEQ ID NO: 5867 - DNA, 25 bp, Homo sapien
tcacttctttaataccggcgctttg

SEQ ID NO: 5868 - DNA, 25 bp, Homo sapien
gtcggtgttaggtttgctgtatatc

SEQ ID NO: 5869 - DNA, 25 bp, Homo sapien
gctgtatatcaggtacatgaaccca

SEQ ID NO: 5870 - DNA, 25 bp, Homo sapien
tcaggtacatgaacccaaaatttgg

SEQ ID NO: 5871 - DNA, 25 bp, Homo sapien
gggtttgataacactaacagctctg

SEQ ID NO: 5872 - DNA, 25 bp, Homo sapien
gataacactaacagctctgcacagt

SEQ ID NO: 5873 - DNA, 25 bp, Homo sapien
agctctgcacagtaaatattgtcat

SEQ ID NO: 5874 - DNA, 25 bp, Homo sapien
aatattgtcatccagtcttactaat

SEQ ID NO: 5875 - DNA, 25 bp, Homo sapien
ggtcacacatttaatcagtggcaaa

SEQ ID NO: 5876 - DNA, 25 bp, Homo sapien
aatcagtggcaaagtcagagttaaa

SEQ ID NO: 5877 - DNA, 25 bp, Homo sapien
aatacagtatttccttcgcatttag

SEQ ID NO: 5878 - DNA, 25 bp, Homo sapien
tttccttcgcatttagaatttttgt

SEQ ID NO: 5879 - DNA, 25 bp, Homo sapien
agagctgagcccatgaggatagttc

SEQ ID NO: 5880 - DNA, 25 bp, Homo sapien
gctgagcccatgaggatagttcgcc

SEQ ID NO: 5881 - DNA, 25 bp, Homo sapien
tgagcccatgaggatagttcgccag

SEQ ID NO: 5882 - DNA, 25 bp, Homo sapien
gagcccatgaggatagttcgccagc

SEQ ID NO: 5883 - DNA, 25 bp, Homo sapien
agcccatgaggatagttcgccagcc

SEQ ID NO: 5884 - DNA, 25 bp, Homo sapien
gcccatgaggatagttcgccagcca

SEQ ID NO: 5885 - DNA, 25 bp, Homo sapien
ccatgaggatagttcgccagccaac

SEQ ID NO: 5886 - DNA, 25 bp, Homo sapien
atgaggatagttcgccagccaacgc

SEQ ID NO: 5887 - DNA, 25 bp, Homo sapien
aggatagttcgccagccaacgcctc

SEQ ID NO: 5888 - DNA, 25 bp, Homo sapien
agaccctctggagagcccaccaaca

SEQ ID NO: 5889 - DNA, 25 bp, Homo sapien
ggagagcccaccaacagccccagat

SEQ ID NO: 5890 - DNA, 25 bp, Homo sapien
atcgggaaggtgtccatttggagtc

SEQ ID NO: 5891 - DNA, 25 bp, Homo sapien
ggaaggtgtccatttggagtcatcc

SEQ ID NO: 5892 - DNA, 25 bp, Homo sapien
gatgtgtgaaggctgctcaatgatt

SEQ ID NO: 5893 - DNA, 25 bp, Homo sapien
ggctgctcaatgattttgaggttta

SEQ ID NO: 5894 - DNA, 25 bp, Homo sapien
tgcccaggtggtaaggaagacagaa

SEQ ID NO: 5895 - DNA, 25 bp, Homo sapien
atgggacagctgagcccgggcaccc

SEQ ID NO: 5896 - DNA, 25 bp, Homo sapien
gcaccctcaagccttggaggcatga

SEQ ID NO: 5897 - DNA, 25 bp, Homo sapien
ctcaagccttggaggcatgaagttt

SEQ ID NO: 5898 - DNA, 25 bp, Homo sapien
tggggatctggcaaagaacacctgg

SEQ ID NO: 5899 - DNA, 25 bp, Homo sapien
gtagcagggaagacaagcacttcaa

SEQ ID NO: 5900 - DNA, 25 bp, Homo sapien
agcacttcaaagaggcagcgtcagc

SEQ ID NO: 5901 - DNA, 25 bp, Homo sapien
ggagcagtaaaccttcccctccgag

SEQ ID NO: 5902 - DNA, 25 bp, Homo sapien
atccacgtgcggctgtgcccagcat

SEQ ID NO: 5903 - DNA, 25 bp, Homo sapien
ctcagaggtaggacttctcaggaat

SEQ ID NO: 5904 - DNA, 25 bp, Homo sapien
aggacttctcaggaatcggcgggaa

SEQ ID NO: 5905 - DNA, 25 bp, Homo sapien
acttctcaggaatcggcgggaagaa

SEQ ID NO: 5906 - DNA, 25 bp, Homo sapien
aagaagcccccttgatggagtctgg

SEQ ID NO: 5907 - DNA, 25 bp, Homo sapien
gggttcaagatctgcaggtcccacc

SEQ ID NO: 5908 - DNA, 25 bp, Homo sapien
gaacacctgcacaagtgagacctgc

SEQ ID NO: 5909 - DNA, 25 bp, Homo sapien
tgcacaagtgagacctgcccgatca

SEQ ID NO: 5910 - DNA, 25 bp, Homo sapien
acaagtgagacctgcccgatcagcc

SEQ ID NO: 5911 - DNA, 25 bp, Homo sapien
cgctccatccgcaaactgggcagat

SEQ ID NO: 5912 - DNA, 25 bp, Homo sapien
cgtttaattatcattcagtttaaat

SEQ ID NO: 5913 - DNA, 25 bp, Homo sapien
agtttaaatgttggccttctgtatg

SEQ ID NO: 5914 - DNA, 25 bp, Homo sapien
ttaaatgttggccttctgtatgtag

SEQ ID NO: 5915 - DNA, 25 bp, Homo sapien
tgtagccaagaacagctcattttgt

SEQ ID NO: 5916 - DNA, 25 bp, Homo sapien
tagccaagaacagctcattttgtga

SEQ ID NO: 5917 - DNA, 25 bp, Homo sapien
gccaagaacagctcattttgtgaat

SEQ ID NO: 5918 - DNA, 25 bp, Homo sapien
gaacagctcattttgtgaatttcag

SEQ ID NO: 5919 - DNA, 25 bp, Homo sapien
cagctcattttgtgaatttcagttt

SEQ ID NO: 5920 - DNA, 25 bp, Homo sapien
tgtgaatttcagtttttaagtggct

SEQ ID NO: 5921 - DNA, 25 bp, Homo sapien
gaatttcagtttttaagtggctgct

SEQ ID NO: 5922 - DNA, 25 bp, Homo sapien
atttcagtttttaagtggctgcttt

SEQ ID NO: 5923 - DNA, 25 bp, Homo sapien
gaggagtactactttgaacagcata

SEQ ID NO: 5924 - DNA, 25 bp, Homo sapien
gaacagcatagagccaatcacattt

SEQ ID NO: 5925 - DNA, 25 bp, Homo sapien
gagccaatcacattttgcacaaggg

SEQ ID NO: 5926 - DNA, 25 bp, Homo sapien
aagggcagtcaccatgaaaggaaaa

SEQ ID NO: 5927 - DNA, 25 bp, Homo sapien
cagaggctccttaaaaatatgttca

SEQ ID NO: 5928 - DNA, 25 bp, Homo sapien
tgaaccagattcaatatcccagccc

SEQ ID NO: 5929 - DNA, 25 bp, Homo sapien
cagcccatcatcaagattcctttga

SEQ ID NO: 5930 - DNA, 25 bp, Homo sapien
aatggagccaatagacacttcacaa

SEQ ID NO: 5931 - DNA, 25 bp, Homo sapien
gggtatttcactcattttcagtcag

SEQ ID NO: 5932 - DNA, 25 bp, Homo sapien
gaacataatgttgttgcaccatata

SEQ ID NO: 5933 - DNA, 25 bp, Homo sapien
atgtttttgaattggatgttcccgg

SEQ ID NO: 5934 - DNA, 25 bp, Homo sapien
acatgcccagggttgttgaatggcc

SEQ ID NO: 5935 - DNA, 25 bp, Homo sapien
tgcccagggttgttgaatggccaat

SEQ ID NO: 5936 - DNA, 25 bp, Homo sapien
ttgaatggccaatgattactatccc

SEQ ID NO: 5937 - DNA, 25 bp, Homo sapien
tgattactatcccacagggtgagta

SEQ ID NO: 5938 - DNA, 25 bp, Homo sapien
tatcccacagggtgagtaatctctt

SEQ ID NO: 5939 - DNA, 25 bp, Homo sapien
acagggtgagtaatctcttttctcc

SEQ ID NO: 5940 - DNA, 25 bp, Homo sapien
agggtgagtaatctcttttctccct

SEQ ID NO: 5941 - DNA, 25 bp, Homo sapien
gagctggttggcagatcataaaaat

SEQ ID NO: 5942 - DNA, 25 bp, Homo sapien
cagaacgagaccctgatagtttgag

SEQ ID NO: 5943 - DNA, 25 bp, Homo sapien
aacgagaccctgatagtttgaggat

SEQ ID NO: 5944 - DNA, 25 bp, Homo sapien
agagagaccctgatggtttgaggat

SEQ ID NO: 5945 - DNA, 25 bp, Homo sapien
gaaagcttggctagtggaacccatt

SEQ ID NO: 5946 - DNA, 25 bp, Homo sapien
tggctagtggaacccattgtttaaa

SEQ ID NO: 5947 - DNA, 25 bp, Homo sapien
ctttgcttggtttgaatgtggtttt

SEQ ID NO: 5948 - DNA, 25 bp, Homo sapien
tctctcaatcttgccctggttggtt

SEQ ID NO: 5949 - DNA, 25 bp, Homo sapien
tggttggtttcatattcctcccttt

SEQ ID NO: 5950 - DNA, 25 bp, Homo sapien
tctttctttattttagtgactactc

SEQ ID NO: 5951 - DNA, 25 bp, Homo sapien
agtgactactcatttgtaacttgca

SEQ ID NO: 5952 - DNA, 25 bp, Homo sapien
gtaacttgcactttcttcaaatgag

SEQ ID NO: 5953 - DNA, 25 bp, Homo sapien
gagctacaaagctatgtttcctggt

SEQ ID NO: 5954 - DNA, 25 bp, Homo sapien
aaagctatgtttcctggtttgtcat

SEQ ID NO: 5955 - DNA, 25 bp, Homo sapien
tgtcatttggttttcttgactttcc

SEQ ID NO: 5956 - DNA, 25 bp, Homo sapien
gtgtccacaggcaggcaggacgcat

SEQ ID NO: 5957 - DNA, 25 bp, Homo sapien
caggacgcatgctgcagccctgtgg

SEQ ID NO: 5958 - DNA, 25 bp, Homo sapien
gtgggcacggtggaagccttcctct

SEQ ID NO: 5959 - DNA, 25 bp, Homo sapien
ggcagaaaatgtgtctcagatctct

SEQ ID NO: 5960 - DNA, 25 bp, Homo sapien
atgtgtctcagatctctgggaactg

SEQ ID NO: 5961 - DNA, 25 bp, Homo sapien
ccccatttcatgtttgtgatagcag

SEQ ID NO: 5962 - DNA, 25 bp, Homo sapien
gtgatagcagctcaggacagacaaa

SEQ ID NO: 5963 - DNA, 25 bp, Homo sapien
caggacagacaaacaccaagagggt

SEQ ID NO: 5964 - DNA, 25 bp, Homo sapien
aacaccaagagggtggccttgggca

SEQ ID NO: 5965 - DNA, 25 bp, Homo sapien
ggttaagcttcgcacattgagggct

SEQ ID NO: 5966 - DNA, 25 bp, Homo sapien
gcttcgcacattgagggctgggcac

SEQ ID NO: 5967 - DNA, 25 bp, Homo sapien
gccttgtgaaggagatggacccctt

SEQ ID NO: 5968 - DNA, 25 bp, Homo sapien
agagagggtacctcctggtgcatag

SEQ ID NO: 5969 - DNA, 25 bp, Homo sapien
ggtacctcctggtgcataggtagat

SEQ ID NO: 5970 - DNA, 25 bp, Homo sapien
ggctcttagaactggttcagggaag

SEQ ID NO: 5971 - DNA, 25 bp, Homo sapien
aaatatgagataaagggaccagact

SEQ ID NO: 5972 - DNA, 25 bp, Homo sapien
gataagatgatttggcaggcactgg

SEQ ID NO: 5973 - DNA, 25 bp, Homo sapien
tttggcaggcactgggaagcatttc

SEQ ID NO: 5974 - DNA, 25 bp, Homo sapien
caggggattaccactagatgatgaa

SEQ ID NO: 5975 - DNA, 25 bp, Homo sapien
gatgatgaaaaggtgctaagcaagg

SEQ ID NO: 5976 - DNA, 25 bp, Homo sapien
gtctaggtgagtgtgtagcgggctt

SEQ ID NO: 5977 - DNA, 25 bp, Homo sapien
agttaaaaagagcatggccaggcgc

SEQ ID NO: 5978 - DNA, 25 bp, Homo sapien
agaggtaagccttagcctcaccact

SEQ ID NO: 5979 - DNA, 25 bp, Homo sapien
taagccttagcctcaccactgacta

SEQ ID NO: 5980 - DNA, 25 bp, Homo sapien
gactactgactcactaaggagggat

SEQ ID NO: 5981 - DNA, 25 bp, Homo sapien
gctttacctcccttgctacaaaaag

SEQ ID NO: 5982 - DNA, 25 bp, Homo sapien
gacagatggacgaggcatactccca

SEQ ID NO: 5983 - DNA, 25 bp, Homo sapien
gaggcatactcccaccctcagagag

SEQ ID NO: 5984 - DNA, 25 bp, Homo sapien
accctcagagagcttccaagtctac

SEQ ID NO: 5985 - DNA, 25 bp, Homo sapien
caagtctacaatgagccctatccat

SEQ ID NO: 5986 - DNA, 25 bp, Homo sapien
gagccctatccattagtaggtgctt

SEQ ID NO: 5987 - DNA, 25 bp, Homo sapien
ggaataaccaaaacaaagcagcaag

SEQ ID NO: 5988 - DNA, 25 bp, Homo sapien
tagatgtaggcagcatgagtggtta

SEQ ID NO: 5989 - DNA, 25 bp, Homo sapien
aaatgtgtttgatgccactgacctg

SEQ ID NO: 5990 - DNA, 25 bp, Homo sapien
tgtttgatgccactgacctgtacag

SEQ ID NO: 5991 - DNA, 25 bp, Homo sapien
gatgccactgacctgtacagttaaa

SEQ ID NO: 5992 - DNA, 25 bp, Homo sapien
gacctgtacagttaaaaatggctac

SEQ ID NO: 5993 - DNA, 25 bp, Homo sapien
aatggctacagtgataacttccgtg

SEQ ID NO: 5994 - DNA, 25 bp, Homo sapien
cagtgataacttccgtgttgtgcaa

SEQ ID NO: 5995 - DNA, 25 bp, Homo sapien
ataacttccgtgttgtgcaaatttt

SEQ ID NO: 5996 - DNA, 25 bp, Homo sapien
aaaggtagctagagacagcaagtga

SEQ ID NO: 5997 - DNA, 25 bp, Homo sapien
aagttttgggtacagactgtggtca

SEQ ID NO: 5998 - DNA, 25 bp, Homo sapien
ggtacagactgtggtcatgtttcca

SEQ ID NO: 5999 - DNA, 25 bp, Homo sapien
gactgtggtcatgtttccacaacat

SEQ ID NO: 6000 - DNA, 25 bp, Homo sapien
ctctctggatggcttcttgcctagg

SEQ ID NO: 6001 - DNA, 25 bp, Homo sapien
gcttcttgcctagggtgactgacag

SEQ ID NO: 6002 - DNA, 25 bp, Homo sapien
gatatgcaaaggcacctgttctcct

SEQ ID NO: 6003 - DNA, 25 bp, Homo sapien
ggcacctgttctcctcatgacctaa

SEQ ID NO: 6004 - DNA, 25 bp, Homo sapien
caattcttactccacgggttcatga

SEQ ID NO: 6005 - DNA, 25 bp, Homo sapien
cacgggttcatgacagcctattctg

SEQ ID NO: 6006 - DNA, 25 bp, Homo sapien
gacagcctattctgctggagactgt

SEQ ID NO: 6007 - DNA, 25 bp, Homo sapien
tgtgtcttaaaacttcctcccctag

SEQ ID NO: 6008 - DNA, 25 bp, Homo sapien
tagtttctctcaagtacccctcgtg

SEQ ID NO: 6009 - DNA, 25 bp, Homo sapien
aagtacccctcgtgagctgtgattt

SEQ ID NO: 6010 - DNA, 25 bp, Homo sapien
tgggctttgaactcttaggccattt

SEQ ID NO: 6011 - DNA, 25 bp, Homo sapien
gtgagattgtagctcacagcagcct

SEQ ID NO: 6012 - DNA, 25 bp, Homo sapien
ggggtcaagcaatccacgttggcct

SEQ ID NO: 6013 - DNA, 25 bp, Homo sapien
tgggcctggtgcagtctcttttaaa

SEQ ID NO: 6014 - DNA, 25 bp, Homo sapien
gcctggtgcagtctcttttaaattt

SEQ ID NO: 6015 - DNA, 25 bp, Homo sapien
acatgagtttgtgaacagttagtca

SEQ ID NO: 6016 - DNA, 25 bp, Homo sapien
gaacagttagtcacaactaatctat

SEQ ID NO: 6017 - DNA, 25 bp, Homo sapien
aatctatcaaatctggaatacgtaa

SEQ ID NO: 6018 - DNA, 25 bp, Homo sapien
ttttttaatgccgattgcccaacaa

SEQ ID NO: 6019 - DNA, 25 bp, Homo sapien
ttaatgccgattgcccaacaaaaag

SEQ ID NO: 6020 - DNA, 25 bp, Homo sapien
gccgattgcccaacaaaaagattaa

SEQ ID NO: 6021 - DNA, 25 bp, Homo sapien
taaaaacaacattttgccgggtgcg

SEQ ID NO: 6022 - DNA, 25 bp, Homo sapien
ttcctgcaaggctagggtttttgtt

SEQ ID NO: 6023 - DNA, 25 bp, Homo sapien
gttaacttggcaatatccttttctc

SEQ ID NO: 6024 - DNA, 25 bp, Homo sapien
ggcaatatccttttctctgattttt

SEQ ID NO: 6025 - DNA, 25 bp, Homo sapien
gatttttaaagttaggctgagtgca

SEQ ID NO: 6026 - DNA, 25 bp, Homo sapien
aataccagcctggttaagatagtga

SEQ ID NO: 6027 - DNA, 25 bp, Homo sapien
tgagatgcttactctacaaaaataa

SEQ ID NO: 6028 - DNA, 25 bp, Homo sapien
gagctggagcttataggatctggat

SEQ ID NO: 6029 - DNA, 25 bp, Homo sapien
gaaatacaggtttgctttagtcttt

SEQ ID NO: 6030 - DNA, 25 bp, Homo sapien
atgcttcatttgatatgcaactctg

SEQ ID NO: 6031 - DNA, 25 bp, Homo sapien
gcaactctgaggctattgacacata

SEQ ID NO: 6032 - DNA, 25 bp, Homo sapien
gaggctattgacacatattttccaa

SEQ ID NO: 6033 - DNA, 25 bp, Homo sapien
aagtgaaatgctcactggaatcagg

SEQ ID NO: 6034 - DNA, 25 bp, Homo sapien
gaatcaggaatcagaaaccagttct

SEQ ID NO: 6035 - DNA, 25 bp, Homo sapien
aaaccagttctgatcacctatccct

SEQ ID NO: 6036 - DNA, 25 bp, Homo sapien
tctgccctggcatatcatggttgat

SEQ ID NO: 6037 - DNA, 25 bp, Homo sapien
gcatatcatggttgatgtacatagc

SEQ ID NO: 6038 - DNA, 25 bp, Homo sapien
gtacatagcaatgatcatcccttct

SEQ ID NO: 6039 - DNA, 25 bp, Homo sapien
agcaatgatcatcccttctgtaatc

SEQ ID NO: 6040 - DNA, 25 bp, Homo sapien
tcatcccttctgtaatcccacttga

SEQ ID NO: 6041 - DNA, 25 bp, Homo sapien
gtaatcccacttgacagtttagaag

SEQ ID NO: 6042 - DNA, 25 bp, Homo sapien
tggattgataatactcttctggctt

SEQ ID NO: 6043 - DNA, 25 bp, Homo sapien
tactcttctggcttaaaacccttct

SEQ ID NO: 6044 - DNA, 25 bp, Homo sapien
cgttggccatgttacttaatctctc

SEQ ID NO: 6045 - DNA, 25 bp, Homo sapien
atctctctaatcctattttctcatc

SEQ ID NO: 6046 - DNA, 25 bp, Homo sapien
agaatgcctaaatgcccagctaatg

SEQ ID NO: 6047 - DNA, 25 bp, Homo sapien
tcagtgacacttcccattatcttgt

SEQ ID NO: 6048 - DNA, 25 bp, Homo sapien
cccgagggctttgggcttgcagaaa

SEQ ID NO: 6049 - DNA, 25 bp, Homo sapien
agaagaggaggcagttcccttcttc

SEQ ID NO: 6050 - DNA, 25 bp, Homo sapien
ccaggatctcagttctttatcttag

SEQ ID NO: 6051 - DNA, 25 bp, Homo sapien
gattcccaagagagctcagcctagg

SEQ ID NO: 6052 - DNA, 25 bp, Homo sapien
acactgttactcagcactgtgcctt

SEQ ID NO: 6053 - DNA, 25 bp, Homo sapien
gttcctggttctccttacaaactgg

SEQ ID NO: 6054 - DNA, 25 bp, Homo sapien
tactagctctgtgacgttggccatg

SEQ ID NO: 6055 - DNA, 25 bp, Homo sapien
tgccatcccttctgaaccacatttg

SEQ ID NO: 6056 - DNA, 25 bp, Homo sapien
tgaaccacatttgtcctgggactgg

SEQ ID NO: 6057 - DNA, 25 bp, Homo sapien
ggactggaagagacaggtatcccat

SEQ ID NO: 6058 - DNA, 25 bp, Homo sapien
gacaggtatcccatttggtcttgga

SEQ ID NO: 6059 - DNA, 25 bp, Homo sapien
gtatcccatttggtcttggaacgca

SEQ ID NO: 6060 - DNA, 25 bp, Homo sapien
tttggtcttggaacgcacagatctc

SEQ ID NO: 6061 - DNA, 25 bp, Homo sapien
ttggaacgcacagatctcgtggaca

SEQ ID NO: 6062 - DNA, 25 bp, Homo sapien
tctcacagcgtgatgacgaaagtaa

SEQ ID NO: 6063 - DNA, 25 bp, Homo sapien
tgtaattccaataactcaggagact

SEQ ID NO: 6064 - DNA, 25 bp, Homo sapien
gttaaggccgtagtgtgccttgact

SEQ ID NO: 6065 - DNA, 25 bp, Homo sapien
gccgtagtgtgccttgactgtgcca

SEQ ID NO: 6066 - DNA, 25 bp, Homo sapien
cgggactgctagagccccactcatg

SEQ ID NO: 6067 - DNA, 25 bp, Homo sapien
atgagaatcacagtttccacagaga

SEQ ID NO: 6068 - DNA, 25 bp, Homo sapien
tcacagtttccacagagaagaccag

SEQ ID NO: 6069 - DNA, 25 bp, Homo sapien
agtctagcttggactgtgggttcct

SEQ ID NO: 6070 - DNA, 25 bp, Homo sapien
tgtagagtggtgaaggcctaaccga

SEQ ID NO: 6071 - DNA, 25 bp, Homo sapien
aggcctaaccgaggagaggaaacag

SEQ ID NO: 6072 - DNA, 25 bp, Homo sapien
aggagtgtaacagagtctccattcc

SEQ ID NO: 6073 - DNA, 25 bp, Homo sapien
ttctcagtgtatgaaacacagcagg

SEQ ID NO: 6074 - DNA, 25 bp, Homo sapien
ggaactatacaacccagaggtgtgt

SEQ ID NO: 6075 - DNA, 25 bp, Homo sapien
gactggcctaggcaatatggcgaaa

SEQ ID NO: 6076 - DNA, 25 bp, Homo sapien
aaagattgcgatgagcccagactgc

SEQ ID NO: 6077 - DNA, 25 bp, Homo sapien
ggtgcatgcctgagaaataataatt

SEQ ID NO: 6078 - DNA, 25 bp, Homo sapien
taattcttgccgctaatttagtcct

SEQ ID NO: 6079 - DNA, 25 bp, Homo sapien
gctaatttagtccttctgtatgtta

SEQ ID NO: 6080 - DNA, 25 bp, Homo sapien
gtatttagtctgttcctttagtaat

SEQ ID NO: 6081 - DNA, 25 bp, Homo sapien
agtaattcttctataagtcatggaa

SEQ ID NO: 6082 - DNA, 25 bp, Homo sapien
gtcatggaagacagctactgttggt

SEQ ID NO: 6083 - DNA, 25 bp, Homo sapien
gctactgttggtaactgctggaatg

SEQ ID NO: 6084 - DNA, 25 bp, Homo sapien
acagaaactctgacactgaaagtga

SEQ ID NO: 6085 - DNA, 25 bp, Homo sapien
gtgattggtcacataggcaaatgtt

SEQ ID NO: 6086 - DNA, 25 bp, Homo sapien
tagagttaacctgaagcagtggccg

SEQ ID NO: 6087 - DNA, 25 bp, Homo sapien
aagcagtggccgagtgccatgcaca

SEQ ID NO: 6088 - DNA, 25 bp, Homo sapien
ctgatgaattttgttctgtgagacc

SEQ ID NO: 6089 - DNA, 25 bp, Homo sapien
gaattttgttctgtgagacctacca

SEQ ID NO: 6090 - DNA, 25 bp, Homo sapien
tttgttctgtgagacctaccagata

SEQ ID NO: 6091 - DNA, 25 bp, Homo sapien
ctgtgagacctaccagatatttttt

SEQ ID NO: 6092 - DNA, 25 bp, Homo sapien
gatatttttttctatctgggttgga

SEQ ID NO: 6093 - DNA, 25 bp, Homo sapien
ttggaatatgagcactaaccttggt

SEQ ID NO: 6094 - DNA, 25 bp, Homo sapien
gaatatgagcactaaccttggtaag

SEQ ID NO: 6095 - DNA, 25 bp, Homo sapien
tgagcactaaccttggtaagttaaa

SEQ ID NO: 6096 - DNA, 25 bp, Homo sapien
attttgggaaaattgtacctgcaga

SEQ ID NO: 6097 - DNA, 25 bp, Homo sapien
aaattgtacctgcagaatatgatgg

SEQ ID NO: 6098 - DNA, 25 bp, Homo sapien
aatatgatggatgaaaacaacagcc

SEQ ID NO: 6099 - DNA, 25 bp, Homo sapien
gaacgtttcactgtgatcagagtct

SEQ ID NO: 6100 - DNA, 25 bp, Homo sapien
gatcagagtctgcaaaatggctgga

SEQ ID NO: 6101 - DNA, 25 bp, Homo sapien
aatggctggaggtttacgaaatggt

SEQ ID NO: 6102 - DNA, 25 bp, Homo sapien
agtaacatctcccaggtaagtggtt

SEQ ID NO: 6103 - DNA, 25 bp, Homo sapien
agtaaacttcccttgagcatctaca

SEQ ID NO: 6104 - DNA, 25 bp, Homo sapien
gagcatctacactgtaccagacatg

SEQ ID NO: 6105 - DNA, 25 bp, Homo sapien
agacatggtgctaggacccaggcca

SEQ ID NO: 6106 - DNA, 25 bp, Homo sapien
gccacaggaggaacaggacagatga

SEQ ID NO: 6107 - DNA, 25 bp, Homo sapien
atcctggtgctcacgtctgatgaag

SEQ ID NO: 6108 - DNA, 25 bp, Homo sapien
gaaggagctcttacaaacacagtga

SEQ ID NO: 6109 - DNA, 25 bp, Homo sapien
acacagtgacaggtggagacccctc

SEQ ID NO: 6110 - DNA, 25 bp, Homo sapien
gttagtttatttctcttcctagagc

SEQ ID NO: 6111 - DNA, 25 bp, Homo sapien
tctcttcctagagctggacctgagt

SEQ ID NO: 6112 - DNA, 25 bp, Homo sapien
ggacctgagtgcctgtctttttaac

SEQ ID NO: 6113 - DNA, 25 bp, Homo sapien
ctgtctttttaactgatggccatct

SEQ ID NO: 6114 - DNA, 25 bp, Homo sapien
atggccatctacatcttttgaccct

SEQ ID NO: 6115 - DNA, 25 bp, Homo sapien
tgccttcttgactgtccatttttag

SEQ ID NO: 6116 - DNA, 25 bp, Homo sapien
agctaatcaaaacccttcatgtcat

SEQ ID NO: 6117 - DNA, 25 bp, Homo sapien
tatttggtagatgcgtgaccctctt

SEQ ID NO: 6118 - DNA, 25 bp, Homo sapien
gaatatatgtctatccacgtgctcc

SEQ ID NO: 6119 - DNA, 25 bp, Homo sapien
cctccaggtaacctctggtttgaat

SEQ ID NO: 6120 - DNA, 25 bp, Homo sapien
tttgaattttatgtgccaggcgtgg

SEQ ID NO: 6121 - DNA, 25 bp, Homo sapien
attaggaatgtaccaaattgagcat

SEQ ID NO: 6122 - DNA, 25 bp, Homo sapien
gaatgtaccaaattgagcatttgct

SEQ ID NO: 6123 - DNA, 25 bp, Homo sapien
gagcatttgctattgtttgagtggc

SEQ ID NO: 6124 - DNA, 25 bp, Homo sapien
catttgctattgtttgagtggctgc

SEQ ID NO: 6125 - DNA, 25 bp, Homo sapien
tttgctattgtttgagtggctgcat

SEQ ID NO: 6126 - DNA, 25 bp, Homo sapien
tggctgcattttaacttcctgtcct

SEQ ID NO: 6127 - DNA, 25 bp, Homo sapien
gctgcattttaacttcctgtcctat

SEQ ID NO: 6128 - DNA, 25 bp, Homo sapien
ctgcattttaacttcctgtcctatg

SEQ ID NO: 6129 - DNA, 25 bp, Homo sapien
acttcctgtcctatgttaatttatt

SEQ ID NO: 6130 - DNA, 25 bp, Homo sapien
ttaatttattactgagttaggactc

SEQ ID NO: 6131 - DNA, 25 bp, Homo sapien
ctcagaaatgatgcatcacatctaa

SEQ ID NO: 6132 - DNA, 25 bp, Homo sapien
agggagtcctctctgtaatgccatg

SEQ ID NO: 6133 - DNA, 25 bp, Homo sapien
tcctctctgtaatgccatgttcaaa

SEQ ID NO: 6134 - DNA, 25 bp, Homo sapien
aaatctgtgttgcaggactctggtg

SEQ ID NO: 6135 - DNA, 25 bp, Homo sapien
agtgttaactgcaaaggccctccgt

SEQ ID NO: 6136 - DNA, 25 bp, Homo sapien
tccgtaggtcctctgtaagttccac

SEQ ID NO: 6137 - DNA, 25 bp, Homo sapien
gtaagttccaccagagtagctccag

SEQ ID NO: 6138 - DNA, 25 bp, Homo sapien
cagagtagctccagaagaggcgcat

SEQ ID NO: 6139 - DNA, 25 bp, Homo sapien
gaggcgcatgtgttagtgttactac

SEQ ID NO: 6140 - DNA, 25 bp, Homo sapien
ttagtgttactacctttcctgccat

SEQ ID NO: 6141 - DNA, 25 bp, Homo sapien
tttcctgccatagtacacgcattta

SEQ ID NO: 6142 - DNA, 25 bp, Homo sapien
aagagtcagtttattggccgggtgt

SEQ ID NO: 6143 - DNA, 25 bp, Homo sapien
ccgaccttcagaacagccatctgtg

SEQ ID NO: 6144 - DNA, 25 bp, Homo sapien
gaccttcagaacagccatctgtgcc

SEQ ID NO: 6145 - DNA, 25 bp, Homo sapien
caggccaggcacacccagctgagcc

SEQ ID NO: 6146 - DNA, 25 bp, Homo sapien
ctgtgggtcccggagaccgtctgtg

SEQ ID NO: 6147 - DNA, 25 bp, Homo sapien
agaccgtctgtggttgtggctttgt

SEQ ID NO: 6148 - DNA, 25 bp, Homo sapien
accgtctgtggttgtggctttgtcg

SEQ ID NO: 6149 - DNA, 25 bp, Homo sapien
cgtctgtggttgtggctttgtcgcc

SEQ ID NO: 6150 - DNA, 25 bp, Homo sapien
gttgtggctttgtcgccggattgca

SEQ ID NO: 6151 - DNA, 25 bp, Homo sapien
ctttgtcgccggattgcagagctga

SEQ ID NO: 6152 - DNA, 25 bp, Homo sapien
tttgtcgccggattgcagagctgaa

SEQ ID NO: 6153 - DNA, 25 bp, Homo sapien
tgcagagctgaagggagccctgtgg

SEQ ID NO: 6154 - DNA, 25 bp, Homo sapien
atatgctaagcaacaagatttacat

SEQ ID NO: 6155 - DNA, 25 bp, Homo sapien
gatttacatatagatgcctccttta

SEQ ID NO: 6156 - DNA, 25 bp, Homo sapien
catatagatgcctcctttaaaatag

SEQ ID NO: 6157 - DNA, 25 bp, Homo sapien
aatagttgtatcaaacacttagttt

SEQ ID NO: 6158 - DNA, 25 bp, Homo sapien
agcacagttcactaacatttggaaa

SEQ ID NO: 6159 - DNA, 25 bp, Homo sapien
tcactaacatttggaaaggcacttg

SEQ ID NO: 6160 - DNA, 25 bp, Homo sapien
aaggcacttggaatgggaacccaca

SEQ ID NO: 6161 - DNA, 25 bp, Homo sapien
gaagttccactttaattgactaggt

SEQ ID NO: 6162 - DNA, 25 bp, Homo sapien
tgttttactagcagtagtttccctt

SEQ ID NO: 6163 - DNA, 25 bp, Homo sapien
tactagcagtagtttccctttaaat

SEQ ID NO: 6164 - DNA, 25 bp, Homo sapien
cctttcatagcaaactaatggttta

SEQ ID NO: 6165 - DNA, 25 bp, Homo sapien
gaacactggagtcgaagtcccagcc

SEQ ID NO: 6166 - DNA, 25 bp, Homo sapien
tgtcgctctctctgaagctcagtgt

SEQ ID NO: 6167 - DNA, 25 bp, Homo sapien
ctgaagctcagtgttgtcatttgca

SEQ ID NO: 6168 - DNA, 25 bp, Homo sapien
gcatgcaacctcaccttcagaaaag

SEQ ID NO: 6169 - DNA, 25 bp, Homo sapien
aagactccatggactttgaggccag

SEQ ID NO: 6170 - DNA, 25 bp, Homo sapien
gaggccagagagttgctccggaaca

SEQ ID NO: 6171 - DNA, 25 bp, Homo sapien
tgctccggaacagggtgttggtctt

SEQ ID NO: 6172 - DNA, 25 bp, Homo sapien
gttggtcttttgttacttggtcata

SEQ ID NO: 6173 - DNA, 25 bp, Homo sapien
cttggtcataagtaggcgttttcct

SEQ ID NO: 6174 - DNA, 25 bp, Homo sapien
aggttagtgtgcattggcgttctgt

SEQ ID NO: 6175 - DNA, 25 bp, Homo sapien
attggcgttctgttgcctgcttcca

SEQ ID NO: 6176 - DNA, 25 bp, Homo sapien
gcctggccataaactttcaatgcgt

SEQ ID NO: 6177 - DNA, 25 bp, Homo sapien
ggccataaactttcaatgcgtagaa

SEQ ID NO: 6178 - DNA, 25 bp, Homo sapien
ttcaatgcgtagaaaccaaattaat

SEQ ID NO: 6179 - DNA, 25 bp, Homo sapien
aatttagaccttaaactagcagcat

SEQ ID NO: 6180 - DNA, 25 bp, Homo sapien
actagcagcatattacattcccagg

SEQ ID NO: 6181 - DNA, 25 bp, Homo sapien
tagcagcatattacattcccaggag

SEQ ID NO: 6182 - DNA, 25 bp, Homo sapien
tgagattatatttggagtcatgttc

SEQ ID NO: 6183 - DNA, 25 bp, Homo sapien
ggagtcatgttccaaatctgatata

SEQ ID NO: 6184 - DNA, 25 bp, Homo sapien
gtcatgttccaaatctgatataaaa

SEQ ID NO: 6185 - DNA, 25 bp, Homo sapien
aaaaatcagaagtccttatccaggc

SEQ ID NO: 6186 - DNA, 25 bp, Homo sapien
tcagaagtccttatccaggcatggt

SEQ ID NO: 6187 - DNA, 25 bp, Homo sapien
tggaatatggatgcgtcagatactc

SEQ ID NO: 6188 - DNA, 25 bp, Homo sapien
tatggatgcgtcagatactccatga

SEQ ID NO: 6189 - DNA, 25 bp, Homo sapien
gctttcaaaaatataatgtgcccac

SEQ ID NO: 6190 - DNA, 25 bp, Homo sapien
taatgtgcccacactgtgatggact

SEQ ID NO: 6191 - DNA, 25 bp, Homo sapien
atgtgcccacactgtgatggactga

SEQ ID NO: 6192 - DNA, 25 bp, Homo sapien
gtgcccacactgtgatggactgact

SEQ ID NO: 6193 - DNA, 25 bp, Homo sapien
gcccacactgtgatggactgactgg

SEQ ID NO: 6194 - DNA, 25 bp, Homo sapien
gggcagagctgaaaatggttaacat

SEQ ID NO: 6195 - DNA, 25 bp, Homo sapien
aatggttaacatctgtcatccagct

SEQ ID NO: 6196 - DNA, 25 bp, Homo sapien
ggttaacatctgtcatccagctttt

SEQ ID NO: 6197 - DNA, 25 bp, Homo sapien
ttttcaattctccatccccgtcttt

SEQ ID NO: 6198 - DNA, 25 bp, Homo sapien
gaacaatatgtgagtttaccaaggt

SEQ ID NO: 6199 - DNA, 25 bp, Homo sapien
atacaaggtcaatatgccaaagtca

SEQ ID NO: 6200 - DNA, 25 bp, Homo sapien
tttttatttatgatagtctccaaaa

SEQ ID NO: 6201 - DNA, 25 bp, Homo sapien
gaagaaatgaattctttcctcctaa

SEQ ID NO: 6202 - DNA, 25 bp, Homo sapien
ctaagattagaaacaaggacggcat

SEQ ID NO: 6203 - DNA, 25 bp, Homo sapien
aggacggcatgaatacccactttca

SEQ ID NO: 6204 - DNA, 25 bp, Homo sapien
atgaatacccactttcactactaac

SEQ ID NO: 6205 - DNA, 25 bp, Homo sapien
acccactttcactactaacactgaa

SEQ ID NO: 6206 - DNA, 25 bp, Homo sapien
cactgaattttgtacgaaggtccca

SEQ ID NO: 6207 - DNA, 25 bp, Homo sapien
ttttgtacgaaggtcccagtcagtt

SEQ ID NO: 6208 - DNA, 25 bp, Homo sapien
aaaggcatacatattggaaagggaa

SEQ ID NO: 6209 - DNA, 25 bp, Homo sapien
aagattcgacttcaatttctgcaga

SEQ ID NO: 6210 - DNA, 25 bp, Homo sapien
aatttctgcagaataaggtcatagc

SEQ ID NO: 6211 - DNA, 25 bp, Homo sapien
aaggtcatagcacacttagtattta

SEQ ID NO: 6212 - DNA, 25 bp, Homo sapien
acatgacagcatttacctcatgccc

SEQ ID NO: 6213 - DNA, 25 bp, Homo sapien
tgccccttagcatgaaagcatacaa

SEQ ID NO: 6214 - DNA, 25 bp, Homo sapien
tatttttgaatatcaccagcaacct

SEQ ID NO: 6215 - DNA, 25 bp, Homo sapien
cagcaacctgagaaattatttacgt

SEQ ID NO: 6216 - DNA, 25 bp, Homo sapien
tttacgttcagatacaaacaggtca

SEQ ID NO: 6217 - DNA, 25 bp, Homo sapien
atggccacaataggagccaactatt

SEQ ID NO: 6218 - DNA, 25 bp, Homo sapien
aatattaagtcccttctgaagaagc

SEQ ID NO: 6219 - DNA, 25 bp, Homo sapien
aaaatggcatttgcggctgggcacg

SEQ ID NO: 6220 - DNA, 25 bp, Homo sapien
ctcctgagtatctaggatcacagac

SEQ ID NO: 6221 - DNA, 25 bp, Homo sapien
ctgagtatctaggatcacagacgcc

SEQ ID NO: 6222 - DNA, 25 bp, Homo sapien
gagtatctaggatcacagacgcctg

SEQ ID NO: 6223 - DNA, 25 bp, Homo sapien
taacccctgagctccggtgattcac

SEQ ID NO: 6224 - DNA, 25 bp, Homo sapien
atcacaaaagacaatcatgcagtag

SEQ ID NO: 6225 - DNA, 25 bp, Homo sapien
aagacaatcatgcagtagataatta

SEQ ID NO: 6226 - DNA, 25 bp, Homo sapien
gtataatggaagcattcaaatgttt

SEQ ID NO: 6227 - DNA, 25 bp, Homo sapien
ttatttgtacagatcaagacttact

SEQ ID NO: 6228 - DNA, 25 bp, Homo sapien
gtacagatcaagacttactaatatg

SEQ ID NO: 6229 - DNA, 25 bp, Homo sapien
gatcaagacttactaatatgctaaa

SEQ ID NO: 6230 - DNA, 25 bp, Homo sapien
agacttactaatatgctaaaaagga

SEQ ID NO: 6231 - DNA, 25 bp, Homo sapien
aattagctgggtaggctacatgctg

SEQ ID NO: 6232 - DNA, 25 bp, Homo sapien
attagctgggtaggctacatgctgt

SEQ ID NO: 6233 - DNA, 25 bp, Homo sapien
ctgggtaggctacatgctgtggctc

SEQ ID NO: 6234 - DNA, 25 bp, Homo sapien
cagaatcaagtgtgctttccttatt

SEQ ID NO: 6235 - DNA, 25 bp, Homo sapien
gaatcaagtgtgctttccttattga

SEQ ID NO: 6236 - DNA, 25 bp, Homo sapien
aatcaagtgtgctttccttattgag

SEQ ID NO: 6237 - DNA, 25 bp, Homo sapien
gagtcagaaagctctattgaaaatg

SEQ ID NO: 6238 - DNA, 25 bp, Homo sapien
agaaagctctattgaaaatgaaact

SEQ ID NO: 6239 - DNA, 25 bp, Homo sapien
aatgaaacttttttggcctggtgcg

SEQ ID NO: 6240 - DNA, 25 bp, Homo sapien
atgaaacttttttggcctggtgcgg

SEQ ID NO: 6241 - DNA, 25 bp, Homo sapien
tgaaacttttttggcctggtgcggt

SEQ ID NO: 6242 - DNA, 25 bp, Homo sapien
aagatgagtgattttgcccccactg

SEQ ID NO: 6243 - DNA, 25 bp, Homo sapien
ccccactggacttttggcaatgtct

SEQ ID NO: 6244 - DNA, 25 bp, Homo sapien
ccactggacttttggcaatgtctag

SEQ ID NO: 6245 - DNA, 25 bp, Homo sapien
taccaccatctagtggactgagaag

SEQ ID NO: 6246 - DNA, 25 bp, Homo sapien
gtggactgagaagccctgacatggg

SEQ ID NO: 6247 - DNA, 25 bp, Homo sapien
aagagtgtgcatgcccaggagtcag

SEQ ID NO: 6248 - DNA, 25 bp, Homo sapien
ttcccatcacggaacatccaggata

SEQ ID NO: 6249 - DNA, 25 bp, Homo sapien
atccaggatactaatgtggacttct

SEQ ID NO: 6250 - DNA, 25 bp, Homo sapien
acttctctgcattgtgtaagaacca

SEQ ID NO: 6251 - DNA, 25 bp, Homo sapien
gtaagaaccaattcaagaccaggca

SEQ ID NO: 6252 - DNA, 25 bp, Homo sapien
accaattcaagaccaggcacggtgg

SEQ ID NO: 6253 - DNA, 25 bp, Homo sapien
tcaacctgtgattccaagacctttc

SEQ ID NO: 6254 - DNA, 25 bp, Homo sapien
gtgattccaagacctttcattatgg

SEQ ID NO: 6255 - DNA, 25 bp, Homo sapien
ttatggaaccgaaacacagctgtaa

SEQ ID NO: 6256 - DNA, 25 bp, Homo sapien
agctgtaaagttcacacctcagttt

SEQ ID NO: 6257 - DNA, 25 bp, Homo sapien
gaaagaaacaaatctcttttccaat

SEQ ID NO: 6258 - DNA, 25 bp, Homo sapien
ttccagctatttcctcaatagcttg

SEQ ID NO: 6259 - DNA, 25 bp, Homo sapien
aagatttagcattaacttctgcagg

SEQ ID NO: 6260 - DNA, 25 bp, Homo sapien
aacttctgcaggatgataccaggaa

SEQ ID NO: 6261 - DNA, 25 bp, Homo sapien
agctgagataaaccacaggccattt

SEQ ID NO: 6262 - DNA, 25 bp, Homo sapien
aaaccacaggccatttgaaggaact

SEQ ID NO: 6263 - DNA, 25 bp, Homo sapien
gatgggaatgatatgcactattaaa

SEQ ID NO: 6264 - DNA, 25 bp, Homo sapien
aattgcatagagctacagacattag

SEQ ID NO: 6265 - DNA, 25 bp, Homo sapien
acctacaatgattctagattccttt

SEQ ID NO: 6266 - DNA, 25 bp, Homo sapien
agattcctttgcaggctcctacaat

SEQ ID NO: 6267 - DNA, 25 bp, Homo sapien
tacaatcacaccctatcaaagctag

SEQ ID NO: 6268 - DNA, 25 bp, Homo sapien
caccctatcaaagctagaatgactt

SEQ ID NO: 6269 - DNA, 25 bp, Homo sapien
aatgactttaggagattgtggccaa

SEQ ID NO: 6270 - DNA, 25 bp, Homo sapien
tttaggagattgtggccaacattct

SEQ ID NO: 6271 - DNA, 25 bp, Homo sapien
tctacttttccacagagaaggaatg

SEQ ID NO: 6272 - DNA, 25 bp, Homo sapien
gagaaggaatgtttgcccaagtggc

SEQ ID NO: 6273 - DNA, 25 bp, Homo sapien
actctttaaattgtttccattactg

SEQ ID NO: 6274 - DNA, 25 bp, Homo sapien
aaattgtttccattactgattatgc

SEQ ID NO: 6275 - DNA, 25 bp, Homo sapien
ggtatattaccttcagtttccagat

SEQ ID NO: 6276 - DNA, 25 bp, Homo sapien
gtatattaccttcagtttccagatc

SEQ ID NO: 6277 - DNA, 25 bp, Homo sapien
atattaccttcagtttccagatcaa

SEQ ID NO: 6278 - DNA, 25 bp, Homo sapien
attaccttcagtttccagatcaaga

SEQ ID NO: 6279 - DNA, 25 bp, Homo sapien
ttaccttcagtttccagatcaagaa

SEQ ID NO: 6280 - DNA, 25 bp, Homo sapien
ctatgagcctgtaagtcattaaggg

SEQ ID NO: 6281 - DNA, 25 bp, Homo sapien
gggtacatcttcaaatgacatgcta

SEQ ID NO: 6282 - DNA, 25 bp, Homo sapien
gtacatcttcaaatgacatgctatc

SEQ ID NO: 6283 - DNA, 25 bp, Homo sapien
atcttcaaatgacatgctatcacta

SEQ ID NO: 6284 - DNA, 25 bp, Homo sapien
tcaaatgacatgctatcactaacca

SEQ ID NO: 6285 - DNA, 25 bp, Homo sapien
aaatgacatgctatcactaaccatg

SEQ ID NO: 6286 - DNA, 25 bp, Homo sapien
gtctgtgggcgtgctctcagcccgt

SEQ ID NO: 6287 - DNA, 25 bp, Homo sapien
agcccgtggccttatgcccgggagt

SEQ ID NO: 6288 - DNA, 25 bp, Homo sapien
atgcccgggagtacggtgccatctg

SEQ ID NO: 6289 - DNA, 25 bp, Homo sapien
ggaagcccagccgtgagcttatgca

SEQ ID NO: 6290 - DNA, 25 bp, Homo sapien
agcccagccgtgagcttatgcagac

SEQ ID NO: 6291 - DNA, 25 bp, Homo sapien
gtgagcttatgcagaccctccatgc

SEQ ID NO: 6292 - DNA, 25 bp, Homo sapien
tatgcagaccctccatgccatctta

SEQ ID NO: 6293 - DNA, 25 bp, Homo sapien
atgccatcttaaacccagggtcaga

SEQ ID NO: 6294 - DNA, 25 bp, Homo sapien
catgcttttgcttctcaccttcctt

SEQ ID NO: 6295 - DNA, 25 bp, Homo sapien
tcaccttccttccaaattaacaggt

SEQ ID NO: 6296 - DNA, 25 bp, Homo sapien
tgcgcccggacaaattaacaggttt

SEQ ID NO: 6297 - DNA, 25 bp, Homo sapien
gtgcatggacatgggctcagctttt

SEQ ID NO: 6298 - DNA, 25 bp, Homo sapien
ggctcagcttttcctgaagagcgtt

SEQ ID NO: 6299 - DNA, 25 bp, Homo sapien
agagcgttagtgtgtatgacagcaa

SEQ ID NO: 6300 - DNA, 25 bp, Homo sapien
agtgggcagccaacccagggcgtcc

SEQ ID NO: 6301 - DNA, 25 bp, Homo sapien
ggaaagcccgtgtgttcttccccat

SEQ ID NO: 6302 - DNA, 25 bp, Homo sapien
ttcttccccatttcctatagcaaat

SEQ ID NO: 6303 - DNA, 25 bp, Homo sapien
cctgaggctgaacccataagagaag

SEQ ID NO: 6304 - DNA, 25 bp, Homo sapien
aaggagatttgacaccggacaggca

SEQ ID NO: 6305 - DNA, 25 bp, Homo sapien
atttgacaccggacaggcagccagg

SEQ ID NO: 6306 - DNA, 25 bp, Homo sapien
ccaggtgtgaggttctgtgtagatc

SEQ ID NO: 6307 - DNA, 25 bp, Homo sapien
atcaagagtgtcttaggccgggcgc

SEQ ID NO: 6308 - DNA, 25 bp, Homo sapien
gcggaggctacaacgagccgaaatt

SEQ ID NO: 6309 - DNA, 25 bp, Homo sapien
ggcaaacatagccaactggtggcct

SEQ ID NO: 6310 - DNA, 25 bp, Homo sapien
catagccaactggtggcctgagcgg

SEQ ID NO: 6311 - DNA, 25 bp, Homo sapien
catggtgaggacacccttggtggct

SEQ ID NO: 6312 - DNA, 25 bp, Homo sapien
ttggtggcttgtcccacatcaagct

SEQ ID NO: 6313 - DNA, 25 bp, Homo sapien
ccacatcaagctgggaggtgacact

SEQ ID NO: 6314 - DNA, 25 bp, Homo sapien
ggtgacactgaggatgcattagtct

SEQ ID NO: 6315 - DNA, 25 bp, Homo sapien
gaggatgcattagtctgcagcgtat

SEQ ID NO: 6316 - DNA, 25 bp, Homo sapien
gcattagtctgcagcgtatgataaa

SEQ ID NO: 6317 - DNA, 25 bp, Homo sapien
gcagcgtatgataaaaacggcattt

SEQ ID NO: 6318 - DNA, 25 bp, Homo sapien
aaaaacggcatttcaggccaggcgt

SEQ ID NO: 6319 - DNA, 25 bp, Homo sapien
taaatagaatatgggctggacgcag

SEQ ID NO: 6320 - DNA, 25 bp, Homo sapien
agcactttggtaggcgacgtcgggc

SEQ ID NO: 6321 - DNA, 25 bp, Homo sapien
ctttggtaggcgacgtcgggcagat

SEQ ID NO: 6322 - DNA, 25 bp, Homo sapien
tttggtaggcgacgtcgggcagatc

SEQ ID NO: 6323 - DNA, 25 bp, Homo sapien
tggtaggcgacgtcgggcagatcat

SEQ ID NO: 6324 - DNA, 25 bp, Homo sapien
taggcgacgtcgggcagatcatgag

SEQ ID NO: 6325 - DNA, 25 bp, Homo sapien
gtgaaactctctactaaaacaacaa

SEQ ID NO: 6326 - DNA, 25 bp, Homo sapien
catggtggtgcacccgtattcctag

SEQ ID NO: 6327 - DNA, 25 bp, Homo sapien
tggtgcacccgtattcctagctact

SEQ ID NO: 6328 - DNA, 25 bp, Homo sapien
agaaagaaaaaagccagggacagtg

SEQ ID NO: 6329 - DNA, 25 bp, Homo sapien
aaagccagggacagtggcttacacc

SEQ ID NO: 6330 - DNA, 25 bp, Homo sapien
cagtgaatgatggtcagaatagaat

SEQ ID NO: 6331 - DNA, 25 bp, Homo sapien
gaatagaattcaacataacaagctc

SEQ ID NO: 6332 - DNA, 25 bp, Homo sapien
gaattcaacataacaagctcattat

SEQ ID NO: 6333 - DNA, 25 bp, Homo sapien
aaaatatttgatctcactgtgtaca

SEQ ID NO: 6334 - DNA, 25 bp, Homo sapien
gatctcactgtgtacaattctgaag

SEQ ID NO: 6335 - DNA, 25 bp, Homo sapien
tctcactgtgtacaattctgaagac

SEQ ID NO: 6336 - DNA, 25 bp, Homo sapien
gtacttcattaaatatttctagttt

SEQ ID NO: 6337 - DNA, 25 bp, Homo sapien
cattctatgaaaagatgcctgcact

SEQ ID NO: 6338 - DNA, 25 bp, Homo sapien
aaaagatgcctgcacttgtatgttc

SEQ ID NO: 6339 - DNA, 25 bp, Homo sapien
cacttgtatgttcatcacagaacta

SEQ ID NO: 6340 - DNA, 25 bp, Homo sapien
atcacagaactatttacagtagcaa

SEQ ID NO: 6341 - DNA, 25 bp, Homo sapien
tatatttgtataccagtgttcactg

SEQ ID NO: 6342 - DNA, 25 bp, Homo sapien
tcacagtagtcaaaaggtagaaaca

SEQ ID NO: 6343 - DNA, 25 bp, Homo sapien
aggaaatccttctacatactacatc

SEQ ID NO: 6344 - DNA, 25 bp, Homo sapien
gaaatccttctacatactacatcat

SEQ ID NO: 6345 - DNA, 25 bp, Homo sapien
ccttctacatactacatcatggatg

SEQ ID NO: 6346 - DNA, 25 bp, Homo sapien
tggatgaacctttcagacattaagt

SEQ ID NO: 6347 - DNA, 25 bp, Homo sapien
tgaacctttcagacattaagtaaat

SEQ ID NO: 6348 - DNA, 25 bp, Homo sapien
gacaatactatatgaatccactgat

SEQ ID NO: 6349 - DNA, 25 bp, Homo sapien
ctatatgaatccactgatgtgaggt

SEQ ID NO: 6350 - DNA, 25 bp, Homo sapien
tagaattgtcatttgattcagcaat

SEQ ID NO: 6351 - DNA, 25 bp, Homo sapien
gcaattgcatttctgggtatataca

SEQ ID NO: 6352 - DNA, 25 bp, Homo sapien
tctagtggggcagatgtttctcaat

SEQ ID NO: 6353 - DNA, 25 bp, Homo sapien
ttctcaatggagaatgctcacagcg

SEQ ID NO: 6354 - DNA, 25 bp, Homo sapien
tcaatggagaatgctcacagcggcc

SEQ ID NO: 6355 - DNA, 25 bp, Homo sapien
gagaatgctcacagcggcctgcaga

SEQ ID NO: 6356 - DNA, 25 bp, Homo sapien
agaatgctcacagcggcctgcagag

SEQ ID NO: 6357 - DNA, 25 bp, Homo sapien
gctcctggggttgggatttacacag

SEQ ID NO: 6358 - DNA, 25 bp, Homo sapien
tctgggaaggtgcttaaagcccggc

SEQ ID NO: 6359 - DNA, 25 bp, Homo sapien
cacacccctgtttagggacacccag

SEQ ID NO: 6360 - DNA, 25 bp, Homo sapien
acccagatagggtgtctcctgcagg

SEQ ID NO: 6361 - DNA, 25 bp, Homo sapien
cagatagggtgtctcctgcaggaaa

SEQ ID NO: 6362 - DNA, 25 bp, Homo sapien
tcacttgaactagaaggcaaaggtt

SEQ ID NO: 6363 - DNA, 25 bp, Homo sapien
acgcttctgcttgctgattttatat

SEQ ID NO: 6364 - DNA, 25 bp, Homo sapien
atactaactaagtcatctgagtcta

SEQ ID NO: 6365 - DNA, 25 bp, Homo sapien
aagaactttatccagggcctctact

SEQ ID NO: 6366 - DNA, 25 bp, Homo sapien
ctctactttcccagaccaagttgat

SEQ ID NO: 6367 - DNA, 25 bp, Homo sapien
gaaagagagtctggtgtttcaacca

SEQ ID NO: 6368 - DNA, 25 bp, Homo sapien
gagttcaggacccacgaatgtgcag

SEQ ID NO: 6369 - DNA, 25 bp, Homo sapien
acccacgaatgtgcagcttctatac

SEQ ID NO: 6370 - DNA, 25 bp, Homo sapien
agtgaacatttcaacgactcccaca

SEQ ID NO: 6371 - DNA, 25 bp, Homo sapien
agccagggttcccatgtcttcaggt

SEQ ID NO: 6372 - DNA, 25 bp, Homo sapien
catgtcttcaggtcctgctgagaaa

SEQ ID NO: 6373 - DNA, 25 bp, Homo sapien
gaaacaactaacaatcctgccagca

SEQ ID NO: 6374 - DNA, 25 bp, Homo sapien
gaaactgacatttgtgcccattgga

SEQ ID NO: 6375 - DNA, 25 bp, Homo sapien
aatttggtatcttccgtagcgtcag

SEQ ID NO: 6376 - DNA, 25 bp, Homo sapien
gcgtcaggcacatgaaactctccag

SEQ ID NO: 6377 - DNA, 25 bp, Homo sapien
agtgcccatgacttttgacagtgac

SEQ ID NO: 6378 - DNA, 25 bp, Homo sapien
tgacagtgacttcagagcacatctg

SEQ ID NO: 6379 - DNA, 25 bp, Homo sapien
acatctgggagacccatgtggccca

SEQ ID NO: 6380 - DNA, 25 bp, Homo sapien
gctcagcttcactcacagcaggatt

SEQ ID NO: 6381 - DNA, 25 bp, Homo sapien
cagcaggattcctagtgccaagaac

SEQ ID NO: 6382 - DNA, 25 bp, Homo sapien
tagtgccaagaacaccataggtgca

SEQ ID NO: 6383 - DNA, 25 bp, Homo sapien
aggacttgatcctagctgcaaacta

SEQ ID NO: 6384 - DNA, 25 bp, Homo sapien
agctgcaaactaagagacctcatta

SEQ ID NO: 6385 - DNA, 25 bp, Homo sapien
caaaactcagatgcttaatttcttt

SEQ ID NO: 6386 - DNA, 25 bp, Homo sapien
ttttgccagttgaagtattgtcagg

SEQ ID NO: 6387 - DNA, 25 bp, Homo sapien
gacatcagaatcatagcagacacat

SEQ ID NO: 6388 - DNA, 25 bp, Homo sapien
atagcagacacatattttctttctt

SEQ ID NO: 6389 - DNA, 25 bp, Homo sapien
ctttcttttccaagactgagaagca

SEQ ID NO: 6390 - DNA, 25 bp, Homo sapien
gagaagcagttttagtagaacacca

SEQ ID NO: 6391 - DNA, 25 bp, Homo sapien
ttagtagaacaccaattcaaactgt

SEQ ID NO: 6392 - DNA, 25 bp, Homo sapien
tgacgtgggtggttcacttcaggcc

SEQ ID NO: 6393 - DNA, 25 bp, Homo sapien
tggttcacttcaggccggcagttcg

SEQ ID NO: 6394 - DNA, 25 bp, Homo sapien
gcctggctagcatggatatatgggt

SEQ ID NO: 6395 - DNA, 25 bp, Homo sapien
atgggtgtatatcaccgtgcctggc

SEQ ID NO: 6396 - DNA, 25 bp, Homo sapien
tggaatggaattcctcggcctgcta

SEQ ID NO: 6397 - DNA, 25 bp, Homo sapien
ttcctcggcctgctattacaagaaa

SEQ ID NO: 6398 - DNA, 25 bp, Homo sapien
attttgtcaagtatggcagactttc

SEQ ID NO: 6399 - DNA, 25 bp, Homo sapien
gtatggcagactttcattgtaaaat

SEQ ID NO: 6400 - DNA, 25 bp, Homo sapien
gtacattatttttcggcaaatcttc

SEQ ID NO: 6401 - DNA, 25 bp, Homo sapien
ttttcggcaaatcttcacaaataca

SEQ ID NO: 6402 - DNA, 25 bp, Homo sapien
gctgaggagggctttaggatcaata

SEQ ID NO: 6403 - DNA, 25 bp, Homo sapien
ttacagttgttttaggagcctttca

SEQ ID NO: 6404 - DNA, 25 bp, Homo sapien
gtttacccaagtatttaggtgtgct

SEQ ID NO: 6405 - DNA, 25 bp, Homo sapien
atttaggtgtgctaactgactcagc

SEQ ID NO: 6406 - DNA, 25 bp, Homo sapien
gtgtgctaactgactcagcagcaat

SEQ ID NO: 6407 - DNA, 25 bp, Homo sapien
gaggaagcattcagttgtcccactt

SEQ ID NO: 6408 - DNA, 25 bp, Homo sapien
tgtcccacttcctttcaaacaggaa

SEQ ID NO: 6409 - DNA, 25 bp, Homo sapien
gtcccacttcctttcaaacaggaag

SEQ ID NO: 6410 - DNA, 25 bp, Homo sapien
cccacttcctttcaaacaggaagag

SEQ ID NO: 6411 - DNA, 25 bp, Homo sapien
acaggaagagacactagagagaaac

SEQ ID NO: 6412 - DNA, 25 bp, Homo sapien
cctctgagataactgactgttgaat

SEQ ID NO: 6413 - DNA, 25 bp, Homo sapien
ctctgagataactgactgttgaatt

SEQ ID NO: 6414 - DNA, 25 bp, Homo sapien
ctgagataactgactgttgaattaa

SEQ ID NO: 6415 - DNA, 25 bp, Homo sapien
gataactgactgttgaattaagaag

SEQ ID NO: 6416 - DNA, 25 bp, Homo sapien
gttgaattaagaagagaggcctggc

SEQ ID NO: 6417 - DNA, 25 bp, Homo sapien
attaagaagagaggcctggccggac

SEQ ID NO: 6418 - DNA, 25 bp, Homo sapien
ctctgggtgccaggaacgcaaatat

SEQ ID NO: 6419 - DNA, 25 bp, Homo sapien
atgagagctctcttgccattatgga

SEQ ID NO: 6420 - DNA, 25 bp, Homo sapien
gagactgtgacttggcatgttccct

SEQ ID NO: 6421 - DNA, 25 bp, Homo sapien
atgttccctttagatggtgcctgga

SEQ ID NO: 6422 - DNA, 25 bp, Homo sapien
taaatgagccctcttgggctgtgca

SEQ ID NO: 6423 - DNA, 25 bp, Homo sapien
gggctgtgcacaacccagaaatttc

SEQ ID NO: 6424 - DNA, 25 bp, Homo sapien
aatttcgaggtgtgccagtgtgtct

SEQ ID NO: 6425 - DNA, 25 bp, Homo sapien
cagtgtgtctgtctagtatcattgt

SEQ ID NO: 6426 - DNA, 25 bp, Homo sapien
attgtttctgacatctctgtagctc

SEQ ID NO: 6427 - DNA, 25 bp, Homo sapien
atctctgtagctctgagtcttctta

SEQ ID NO: 6428 - DNA, 25 bp, Homo sapien
gtcttcttagaaggagcactttaaa

SEQ ID NO: 6429 - DNA, 25 bp, Homo sapien
caccctgagttggatcctctgtgcg

SEQ ID NO: 6430 - DNA, 25 bp, Homo sapien
tgagttggatcctctgtgcgccacc

SEQ ID NO: 6431 - DNA, 25 bp, Homo sapien
ctctgtgcgccacccctgagttgga

SEQ ID NO: 6432 - DNA, 25 bp, Homo sapien
tgcgctgcccggctatggttgccta

SEQ ID NO: 6433 - DNA, 25 bp, Homo sapien
ccggctatggttgcctactgcatga

SEQ ID NO: 6434 - DNA, 25 bp, Homo sapien
tatggttgcctactgcatgaccacg

SEQ ID NO: 6435 - DNA, 25 bp, Homo sapien
ggttgcctactgcatgaccacgcgc

SEQ ID NO: 6436 - DNA, 25 bp, Homo sapien
ccgctgcttcgagactgtgtatgat

SEQ ID NO: 6437 - DNA, 25 bp, Homo sapien
agactgtgtatgatggctactccaa

SEQ ID NO: 6438 - DNA, 25 bp, Homo sapien
gtatgatggctactccaagcacgcg

SEQ ID NO: 6439 - DNA, 25 bp, Homo sapien
gatggctactccaagcacgcgtcca

SEQ ID NO: 6440 - DNA, 25 bp, Homo sapien
catgatcagatgtgatggagctcag

SEQ ID NO: 6441 - DNA, 25 bp, Homo sapien
gctttccctcccttagctaggatgt

SEQ ID NO: 6442 - DNA, 25 bp, Homo sapien
ataaaggatgacacccaagcctcag

SEQ ID NO: 6443 - DNA, 25 bp, Homo sapien
ggtcatcatagcactgatgctgggc

SEQ ID NO: 6444 - DNA, 25 bp, Homo sapien
atcatagcactgatgctgggccaac

SEQ ID NO: 6445 - DNA, 25 bp, Homo sapien
ggatactcagaataccaatcaaggt

SEQ ID NO: 6446 - DNA, 25 bp, Homo sapien
tcaaggtaacagatgcctttatttt

SEQ ID NO: 6447 - DNA, 25 bp, Homo sapien
gttgagagatacactgagctccctc

SEQ ID NO: 6448 - DNA, 25 bp, Homo sapien
tccctcaaagaattctatttacggt

SEQ ID NO: 6449 - DNA, 25 bp, Homo sapien
attctatttacggtacaaagcagcg

SEQ ID NO: 6450 - DNA, 25 bp, Homo sapien
atgccctgctggattcccactattt

SEQ ID NO: 6451 - DNA, 25 bp, Homo sapien
tcttaattcagataggtgtgattca

SEQ ID NO: 6452 - DNA, 25 bp, Homo sapien
cagataggtgtgattcaaatgtcaa

SEQ ID NO: 6453 - DNA, 25 bp, Homo sapien
gattcaaatgtcaaatcacctacta

SEQ ID NO: 6454 - DNA, 25 bp, Homo sapien
aatgtcaaatcacctactattgtag

SEQ ID NO: 6455 - DNA, 25 bp, Homo sapien
tactattgtaggttttcctaagcgt

SEQ ID NO: 6456 - DNA, 25 bp, Homo sapien
gtaaaaaccccaacatattggaatg

SEQ ID NO: 6457 - DNA, 25 bp, Homo sapien
gctgtattctgaaatcttttattta

SEQ ID NO: 6458 - DNA, 25 bp, Homo sapien
taaccattttcccactttatcgtga

SEQ ID NO: 6459 - DNA, 25 bp, Homo sapien
ccattttcccactttatcgtgaaat

SEQ ID NO: 6460 - DNA, 25 bp, Homo sapien
attttcccactttatcgtgaaatat

SEQ ID NO: 6461 - DNA, 25 bp, Homo sapien
tcccactttatcgtgaaatatttta

SEQ ID NO: 6462 - DNA, 25 bp, Homo sapien
aaagtaattataggccagtcaaggt

SEQ ID NO: 6463 - DNA, 25 bp, Homo sapien
ttataggccagtcaaggtggctcac

SEQ ID NO: 6464 - DNA, 25 bp, Homo sapien
agcatggacagcatggcgaaatcct

SEQ ID NO: 6465 - DNA, 25 bp, Homo sapien
gcctgtgaggtcgagactacaccga

SEQ ID NO: 6466 - DNA, 25 bp, Homo sapien
gagactacaccgagattgcactgag

SEQ ID NO: 6467 - DNA, 25 bp, Homo sapien
gctccggccttggtcaacagggtga

SEQ ID NO: 6468 - DNA, 25 bp, Homo sapien
aatcccaccatccaaagataatcac

SEQ ID NO: 6469 - DNA, 25 bp, Homo sapien
tagtattgtgatgtattccctccat

SEQ ID NO: 6470 - DNA, 25 bp, Homo sapien
tccctccatctgtattccacaaaaa

SEQ ID NO: 6471 - DNA, 25 bp, Homo sapien
ttgtgtatagtttcacatctccctt

SEQ ID NO: 6472 - DNA, 25 bp, Homo sapien
aattgtgctttatgagaaggaggga

SEQ ID NO: 6473 - DNA, 25 bp, Homo sapien
gtagaagggagttgctacccttagt

SEQ ID NO: 6474 - DNA, 25 bp, Homo sapien
tacccttagtagtgtgaccagtcag

SEQ ID NO: 6475 - DNA, 25 bp, Homo sapien
agtcagacaactggtggccccatag

SEQ ID NO: 6476 - DNA, 25 bp, Homo sapien
actggtggccccatagtccaggcag

SEQ ID NO: 6477 - DNA, 25 bp, Homo sapien
agggaccaagattcctgagtcaagg

SEQ ID NO: 6478 - DNA, 25 bp, Homo sapien
ggcctgaggtctgaggtacccctga

SEQ ID NO: 6479 - DNA, 25 bp, Homo sapien
gaggtctgaggtacccctgagccat

SEQ ID NO: 6480 - DNA, 25 bp, Homo sapien
gatgcttcttgaaacctagcactct

SEQ ID NO: 6481 - DNA, 25 bp, Homo sapien
tagcactctcctggtttatgtgtcc

SEQ ID NO: 6482 - DNA, 25 bp, Homo sapien
tttatgtgtccccaccagacagaca

SEQ ID NO: 6483 - DNA, 25 bp, Homo sapien
acataagtcttgtctcttctgtcca

SEQ ID NO: 6484 - DNA, 25 bp, Homo sapien
gaggcaggcgctctttgacttatca

SEQ ID NO: 6485 - DNA, 25 bp, Homo sapien
aggcaggcgctctttgacttatcaa

SEQ ID NO: 6486 - DNA, 25 bp, Homo sapien
ggcaggcgctctttgacttatcaag

SEQ ID NO: 6487 - DNA, 25 bp, Homo sapien
gcaggcgctctttgacttatcaagc

SEQ ID NO: 6488 - DNA, 25 bp, Homo sapien
caggcgctctttgacttatcaagct

SEQ ID NO: 6489 - DNA, 25 bp, Homo sapien
aggcgctctttgacttatcaagctg

SEQ ID NO: 6490 - DNA, 25 bp, Homo sapien
ggcgctctttgacttatcaagctgc

SEQ ID NO: 6491 - DNA, 25 bp, Homo sapien
aggccatggccagctggaccctgag

SEQ ID NO: 6492 - DNA, 25 bp, Homo sapien
gatgataattccattcgattctatg

SEQ ID NO: 6493 - DNA, 25 bp, Homo sapien
cgattctatgcgatgattccattcc

SEQ ID NO: 6494 - DNA, 25 bp, Homo sapien
gaagatgattccattcgagaccatt

SEQ ID NO: 6495 - DNA, 25 bp, Homo sapien
agatgattccattcgagaccattcg

SEQ ID NO: 6496 - DNA, 25 bp, Homo sapien
attccatttgatgacaattccattc

SEQ ID NO: 6497 - DNA, 25 bp, Homo sapien
aattccattcaataccaattgatga

SEQ ID NO: 6498 - DNA, 25 bp, Homo sapien
cattcaataccaattgatgatggtt

SEQ ID NO: 6499 - DNA, 25 bp, Homo sapien
gatgatggttatttttgattccatt

SEQ ID NO: 6500 - DNA, 25 bp, Homo sapien
tgattctattcgattgcattcgata

SEQ ID NO: 6501 - DNA, 25 bp, Homo sapien
gattgcattcgataattccatttga

SEQ ID NO: 6502 - DNA, 25 bp, Homo sapien
ttcgataattccatttgattgcatt

SEQ ID NO: 6503 - DNA, 25 bp, Homo sapien
aaacggatcaaagtgctccacccgg

SEQ ID NO: 6504 - DNA, 25 bp, Homo sapien
tccacccggccctgatgtatagcaa

SEQ ID NO: 6505 - DNA, 25 bp, Homo sapien
taaacattggcttttaccattgccc

SEQ ID NO: 6506 - DNA, 25 bp, Homo sapien
taccattgccctttgcaagggtctg

SEQ ID NO: 6507 - DNA, 25 bp, Homo sapien
aagggtctgcccaatcaggtgacaa

SEQ ID NO: 6508 - DNA, 25 bp, Homo sapien
tgcccaatcaggtgacaactgctca

SEQ ID NO: 6509 - DNA, 25 bp, Homo sapien
aactgctcactttccaaagtgcacc

SEQ ID NO: 6510 - DNA, 25 bp, Homo sapien
actttccaaagtgcaccaggtagca

SEQ ID NO: 6511 - DNA, 25 bp, Homo sapien
gtgcaccaggtagcaacctggccaa

SEQ ID NO: 6512 - DNA, 25 bp, Homo sapien
tggccaagaaagacccaatgtcgag

SEQ ID NO: 6513 - DNA, 25 bp, Homo sapien
aagacccaatgtcgagtgaacataa

SEQ ID NO: 6514 - DNA, 25 bp, Homo sapien
ggaggaagacgagcgccctggccgt

SEQ ID NO: 6515 - DNA, 25 bp, Homo sapien
gccgagccctacgaggacttctgga

SEQ ID NO: 6516 - DNA, 25 bp, Homo sapien
agccctacgaggacttctggatctg

SEQ ID NO: 6517 - DNA, 25 bp, Homo sapien
tacgaggacttctggatctgggtgt

SEQ ID NO: 6518 - DNA, 25 bp, Homo sapien
gacttctggatctgggtgtccatga

SEQ ID NO: 6519 - DNA, 25 bp, Homo sapien
atctgggtgtccatgaccgtgtgcg

SEQ ID NO: 6520 - DNA, 25 bp, Homo sapien
gtgtccatgaccgtgtgcgtcttct

SEQ ID NO: 6521 - DNA, 25 bp, Homo sapien
ccatgaccgtgtgcgtcttctggct

SEQ ID NO: 6522 - DNA, 25 bp, Homo sapien
gctgatgtgcatgtgtcggctgaac

SEQ ID NO: 6523 - DNA, 25 bp, Homo sapien
gatgtgcatgtgtcggctgaacccc

SEQ ID NO: 6524 - DNA, 25 bp, Homo sapien
tgtgtcggctgaaccccgggatcta

SEQ ID NO: 6525 - DNA, 25 bp, Homo sapien
gtaggcaaggcgtctccacagtgga

SEQ ID NO: 6526 - DNA, 25 bp, Homo sapien
aaggctggcaccatcaccgagaggt

SEQ ID NO: 6527 - DNA, 25 bp, Homo sapien
ggcagatgtgacagggcgcttcacc

SEQ ID NO: 6528 - DNA, 25 bp, Homo sapien
tgacagggcgcttcaccactgggct

SEQ ID NO: 6529 - DNA, 25 bp, Homo sapien
aaaacactggcagaccgggcgcagt

SEQ ID NO: 6530 - DNA, 25 bp, Homo sapien
gacactctacagaaaaaccgacagc

SEQ ID NO: 6531 - DNA, 25 bp, Homo sapien
acactctacagaaaaaccgacagcc

SEQ ID NO: 6532 - DNA, 25 bp, Homo sapien
ccagtcctcaaacccacgaagtggg

SEQ ID NO: 6533 - DNA, 25 bp, Homo sapien
agtcctcaaacccacgaagtgggct

SEQ ID NO: 6534 - DNA, 25 bp, Homo sapien
gtcctcaaacccacgaagtgggctg

SEQ ID NO: 6535 - DNA, 25 bp, Homo sapien
tcaaacccacgaagtgggctgggcg

SEQ ID NO: 6536 - DNA, 25 bp, Homo sapien
gaaaagcgactttataggccagaaa

SEQ ID NO: 6537 - DNA, 25 bp, Homo sapien
taggccagaaagtaagacaagtctt

SEQ ID NO: 6538 - DNA, 25 bp, Homo sapien
gacaagtcttaacacataaggagct

SEQ ID NO: 6539 - DNA, 25 bp, Homo sapien
cataaggagctaatgcaagttttaa

SEQ ID NO: 6540 - DNA, 25 bp, Homo sapien
gcaagttttaaagtagtgccattaa

SEQ ID NO: 6541 - DNA, 25 bp, Homo sapien
aagtaccatgggattcagaagggaa

SEQ ID NO: 6542 - DNA, 25 bp, Homo sapien
gaagttaagctctgtctttctagat

SEQ ID NO: 6543 - DNA, 25 bp, Homo sapien
aagctctgtctttctagatagtgga

SEQ ID NO: 6544 - DNA, 25 bp, Homo sapien
gtctttctagatagtggacagttag

SEQ ID NO: 6545 - DNA, 25 bp, Homo sapien
tggacagttaggattagatcacaca

SEQ ID NO: 6546 - DNA, 25 bp, Homo sapien
gttaggattagatcacacaggtgtt

SEQ ID NO: 6547 - DNA, 25 bp, Homo sapien
gccccgtcctggataggcctgtcag

SEQ ID NO: 6548 - DNA, 25 bp, Homo sapien
tgttctgctctggtttttaccctca

SEQ ID NO: 6549 - DNA, 25 bp, Homo sapien
tttaccctcagtccgttttgcctat

SEQ ID NO: 6550 - DNA, 25 bp, Homo sapien
cctcagtccgttttgcctattctag

SEQ ID NO: 6551 - DNA, 25 bp, Homo sapien
gtaaatggagtcatgcagtctgtac

SEQ ID NO: 6552 - DNA, 25 bp, Homo sapien
gcagtctgtactctcgcaaaagtct

SEQ ID NO: 6553 - DNA, 25 bp, Homo sapien
gcaaaagtcttcttccactcagtgc

SEQ ID NO: 6554 - DNA, 25 bp, Homo sapien
cactcagtgccacgactgtgaggtt

SEQ ID NO: 6555 - DNA, 25 bp, Homo sapien
gccacgactgtgaggttcatccatg

SEQ ID NO: 6556 - DNA, 25 bp, Homo sapien
aggttcatccatgtctctgcatcat

SEQ ID NO: 6557 - DNA, 25 bp, Homo sapien
atccatgtctctgcatcatttctgc

SEQ ID NO: 6558 - DNA, 25 bp, Homo sapien
gaaagatgagttcatctgccgtgca

SEQ ID NO: 6559 - DNA, 25 bp, Homo sapien
agatgagttcatctgccgtgcagtc

SEQ ID NO: 6560 - DNA, 25 bp, Homo sapien
gatgagttcatctgccgtgcagtcc

SEQ ID NO: 6561 - DNA, 25 bp, Homo sapien
cggatagggtgctctgccactccgg

SEQ ID NO: 6562 - DNA, 25 bp, Homo sapien
atagggtgctctgccactccggaca

SEQ ID NO: 6563 - DNA, 25 bp, Homo sapien
actccggacagcagcagggactgcc

SEQ ID NO: 6564 - DNA, 25 bp, Homo sapien
acagcagcagggactgccgagagca

SEQ ID NO: 6565 - DNA, 25 bp, Homo sapien
cagggactgccgagagcagcaggag

SEQ ID NO: 6566 - DNA, 25 bp, Homo sapien
tggagccgggagggctgactggcca

SEQ ID NO: 6567 - DNA, 25 bp, Homo sapien
tgcagtggctgcacaacgaggtgca

SEQ ID NO: 6568 - DNA, 25 bp, Homo sapien
tgcacaacgaggtgcagctcccgga

SEQ ID NO: 6569 - DNA, 25 bp, Homo sapien
gaatgctgaagttggccttcctttg

SEQ ID NO: 6570 - DNA, 25 bp, Homo sapien
tgctcatctgtgcagtgcggtcgca

SEQ ID NO: 6571 - DNA, 25 bp, Homo sapien
agtgcggtcgcagtgccctctcggt

SEQ ID NO: 6572 - DNA, 25 bp, Homo sapien
gtccacagctcttcttagtttcttg

SEQ ID NO: 6573 - DNA, 25 bp, Homo sapien
tagtttcttggcctttttcagccat

SEQ ID NO: 6574 - DNA, 25 bp, Homo sapien
tcagccatggatgagagcattaaca

SEQ ID NO: 6575 - DNA, 25 bp, Homo sapien
gagcattaacatctgggcctaattt

SEQ ID NO: 6576 - DNA, 25 bp, Homo sapien
gcctaatttggccacaggtacctga

SEQ ID NO: 6577 - DNA, 25 bp, Homo sapien
tgaaaagacccctggctaccagctt

SEQ ID NO: 6578 - DNA, 25 bp, Homo sapien
aaagaaatctacatggccaaggcca

SEQ ID NO: 6579 - DNA, 25 bp, Homo sapien
tagccaggtgtgttgatgcagccct

SEQ ID NO: 6580 - DNA, 25 bp, Homo sapien
cagtcctttcagcttaacttactct

SEQ ID NO: 6581 - DNA, 25 bp, Homo sapien
cttaacttactctttcatccgatgt

SEQ ID NO: 6582 - DNA, 25 bp, Homo sapien
tgttccgtgccaaactctgtcctag

SEQ ID NO: 6583 - DNA, 25 bp, Homo sapien
aactctgtcctaggcagggagcgta

SEQ ID NO: 6584 - DNA, 25 bp, Homo sapien
gtgcaaaaatctcttcccgatctag

SEQ ID NO: 6585 - DNA, 25 bp, Homo sapien
ttcccgatctaggagaactctcacg

SEQ ID NO: 6586 - DNA, 25 bp, Homo sapien
gaactctcacgttcttgggtgaaat

SEQ ID NO: 6587 - DNA, 25 bp, Homo sapien
ttgggtgaaatcaccgcctgcagtt

SEQ ID NO: 6588 - DNA, 25 bp, Homo sapien
tcaccgcctgcagttcggtagaaga

SEQ ID NO: 6589 - DNA, 25 bp, Homo sapien
gagccgagttgctctgttagaagga

SEQ ID NO: 6590 - DNA, 25 bp, Homo sapien
caacacggaaaaatcatgtctctac

SEQ ID NO: 6591 - DNA, 25 bp, Homo sapien
attcagctgttactcctcctttaga

SEQ ID NO: 6592 - DNA, 25 bp, Homo sapien
actcctcctttagagatcacgtgag

SEQ ID NO: 6593 - DNA, 25 bp, Homo sapien
tcgagaacatgggagaacgcacagt

SEQ ID NO: 6594 - DNA, 25 bp, Homo sapien
gaatagtcatcatgggcagaaaacc

SEQ ID NO: 6595 - DNA, 25 bp, Homo sapien
ggcagaaaacccatgcatgtaaagt

SEQ ID NO: 6596 - DNA, 25 bp, Homo sapien
gacctttatgtattactcctacctt

SEQ ID NO: 6597 - DNA, 25 bp, Homo sapien
tatgtattactcctaccttacacgg

SEQ ID NO: 6598 - DNA, 25 bp, Homo sapien
tactcctaccttacacggcacgtaa

SEQ ID NO: 6599 - DNA, 25 bp, Homo sapien
acacggcacgtaagaactcacacag

SEQ ID NO: 6600 - DNA, 25 bp, Homo sapien
agctgtccctcgtactttcgagaac

SEQ ID NO: 6601 - DNA, 25 bp, Homo sapien
gtactttcgagaacatgtcagaaca

SEQ ID NO: 6602 - DNA, 25 bp, Homo sapien
catgtcagcagtgtttggtcgtcca

SEQ ID NO: 6603 - DNA, 25 bp, Homo sapien
tttggtcgtccacatgcttgtcagc

SEQ ID NO: 6604 - DNA, 25 bp, Homo sapien
ggatgcttgacacctctgacagcat

SEQ ID NO: 6605 - DNA, 25 bp, Homo sapien
tttcctgtcatcttagggcagcttc

SEQ ID NO: 6606 - DNA, 25 bp, Homo sapien
ttagggcagcttcaggaaaccgaaa

SEQ ID NO: 6607 - DNA, 25 bp, Homo sapien
tcaggaaaccgaaaaacaggcttgt

SEQ ID NO: 6608 - DNA, 25 bp, Homo sapien
ttccattaacccctttatccacaag

SEQ ID NO: 6609 - DNA, 25 bp, Homo sapien
acccctttatccacaagttcagtat

SEQ ID NO: 6610 - DNA, 25 bp, Homo sapien
gttcagtatcagcatgagccctggg

SEQ ID NO: 6611 - DNA, 25 bp, Homo sapien
ttccagaggaacctgttctacggcc

SEQ ID NO: 6612 - DNA, 25 bp, Homo sapien
ggaacctgttctacggccagaagaa

SEQ ID NO: 6613 - DNA, 25 bp, Homo sapien
tgtccaaaatcacaccagcatattt

SEQ ID NO: 6614 - DNA, 25 bp, Homo sapien
aaatcacaccagcatatttggaagt

SEQ ID NO: 6615 - DNA, 25 bp, Homo sapien
caggagttagttcatacttagttga

SEQ ID NO: 6616 - DNA, 25 bp, Homo sapien
aaatttcgtgatcagaatgcctatt

SEQ ID NO: 6617 - DNA, 25 bp, Homo sapien
gaatgcctatttcagttggatatga

SEQ ID NO: 6618 - DNA, 25 bp, Homo sapien
gatcagatggtagtatgtgtaccca

SEQ ID NO: 6619 - DNA, 25 bp, Homo sapien
gtagtatgtgtacccattgatgcca

SEQ ID NO: 6620 - DNA, 25 bp, Homo sapien
gtgtacccattgatgccatacaaat

SEQ ID NO: 6621 - DNA, 25 bp, Homo sapien
acaaattttgtaggaagctggtaga

SEQ ID NO: 6622 - DNA, 25 bp, Homo sapien
gaagctggtagagaatttggtttta

SEQ ID NO: 6623 - DNA, 25 bp, Homo sapien
aaagaggtctgtgttggccgggcac

SEQ ID NO: 6624 - DNA, 25 bp, Homo sapien
gtaaagcaaccaattgaatcagtaa

SEQ ID NO: 6625 - DNA, 25 bp, Homo sapien
agcaatcaataagaatcccctattc

SEQ ID NO: 6626 - DNA, 25 bp, Homo sapien
gaatcccctattctgagcatggaat

SEQ ID NO: 6627 - DNA, 25 bp, Homo sapien
atggaatggaggctacagtaatgat

SEQ ID NO: 6628 - DNA, 25 bp, Homo sapien
agataaagtccctagtcaaagagag

SEQ ID NO: 6629 - DNA, 25 bp, Homo sapien
agagaggtccacaagatagcaggaa

SEQ ID NO: 6630 - DNA, 25 bp, Homo sapien
tacaccaatagttcaatagttacag

SEQ ID NO: 6631 - DNA, 25 bp, Homo sapien
atagttacagtaccttgtggcaagt

SEQ ID NO: 6632 - DNA, 25 bp, Homo sapien
accttgtggcaagtgttacagcaaa

SEQ ID NO: 6633 - DNA, 25 bp, Homo sapien
aaagctgttcatatcctggtatttg

SEQ ID NO: 6634 - DNA, 25 bp, Homo sapien
ctggtatttgggtagcattaaggaa

SEQ ID NO: 6635 - DNA, 25 bp, Homo sapien
gggtccattctgttctacctagaga

SEQ ID NO: 6636 - DNA, 25 bp, Homo sapien
ctaggtaaggccaggtctctgagca

SEQ ID NO: 6637 - DNA, 25 bp, Homo sapien
gatttgagcatgacttcttccctta

SEQ ID NO: 6638 - DNA, 25 bp, Homo sapien
gcttttccaggttgtgatagccctt

SEQ ID NO: 6639 - DNA, 25 bp, Homo sapien
agcagtgttgatgttgtgagcctaa

SEQ ID NO: 6640 - DNA, 25 bp, Homo sapien
gagcctaaatggcatctgaatattt

SEQ ID NO: 6641 - DNA, 25 bp, Homo sapien
ctgaatatttactcacctatggtgg

SEQ ID NO: 6642 - DNA, 25 bp, Homo sapien
cacctatggtggataacttcttgac

SEQ ID NO: 6643 - DNA, 25 bp, Homo sapien
gggccactttaactccaaggccttg

SEQ ID NO: 6644 - DNA, 25 bp, Homo sapien
ttgctctgtcttatataggcccttt

SEQ ID NO: 6645 - DNA, 25 bp, Homo sapien
ggcccttttttgatgtgtggtttct

SEQ ID NO: 6646 - DNA, 25 bp, Homo sapien
atcaactccttgatttaccatgtgg

SEQ ID NO: 6647 - DNA, 25 bp, Homo sapien
cattgatagactgggtactgtggct

SEQ ID NO: 6648 - DNA, 25 bp, Homo sapien
taaggatcctacttgaaacacaggg

SEQ ID NO: 6649 - DNA, 25 bp, Homo sapien
agtcacgtacttaaggccacacagg

SEQ ID NO: 6650 - DNA, 25 bp, Homo sapien
gagtctaatcactgcactgttgctt

SEQ ID NO: 6651 - DNA, 25 bp, Homo sapien
actgcactgttgcttgtggaatcta

SEQ ID NO: 6652 - DNA, 25 bp, Homo sapien
gtggaatctagcatgtttctcacag

SEQ ID NO: 6653 - DNA, 25 bp, Homo sapien
tgtttctcacagtttgggccctatt

SEQ ID NO: 6654 - DNA, 25 bp, Homo sapien
gggccctatttgtgtctttgtgtat

SEQ ID NO: 6655 - DNA, 25 bp, Homo sapien
gtctttgtgtatgcaattttgccaa

SEQ ID NO: 6656 - DNA, 25 bp, Homo sapien
aaattgcacctgttcaaacatatga

SEQ ID NO: 6657 - DNA, 25 bp, Homo sapien
gacggaattgaagttggaagccact

SEQ ID NO: 6658 - DNA, 25 bp, Homo sapien
aagttggaagccacttttaggctat

SEQ ID NO: 6659 - DNA, 25 bp, Homo sapien
tgacttggaccataaaagcggcttt

SEQ ID NO: 6660 - DNA, 25 bp, Homo sapien
acttggaccataaaagcggctttga

SEQ ID NO: 6661 - DNA, 25 bp, Homo sapien
tggaccataaaagcggctttgaaac

SEQ ID NO: 6662 - DNA, 25 bp, Homo sapien
aatacacgggaaattaaagatgcag

SEQ ID NO: 6663 - DNA, 25 bp, Homo sapien
gatgcagtttgaaaggtgcatccac

SEQ ID NO: 6664 - DNA, 25 bp, Homo sapien
ggattcaatgactgatgggatgaga

SEQ ID NO: 6665 - DNA, 25 bp, Homo sapien
atgatcattgtggaccactgtgaag

SEQ ID NO: 6666 - DNA, 25 bp, Homo sapien
gatcattgtggaccactgtgaagat

SEQ ID NO: 6667 - DNA, 25 bp, Homo sapien
taatgcattgttgagaagacggaat

SEQ ID NO: 6668 - DNA, 25 bp, Homo sapien
gcatggcagcttgggcaggatcacc

SEQ ID NO: 6669 - DNA, 25 bp, Homo sapien
cttgggcaggatcaccacagatcaa

SEQ ID NO: 6670 - DNA, 25 bp, Homo sapien
agctttccaaggcatgggccacaga

SEQ ID NO: 6671 - DNA, 25 bp, Homo sapien
atgtggtggctacatctttctgttt

SEQ ID NO: 6672 - DNA, 25 bp, Homo sapien
ttttttggtgacctggtgcctagag

SEQ ID NO: 6673 - DNA, 25 bp, Homo sapien
tggtgcctagagtttgcttcagtgt

SEQ ID NO: 6674 - DNA, 25 bp, Homo sapien
tgcttcagtgtcagggaaaacccgt

SEQ ID NO: 6675 - DNA, 25 bp, Homo sapien
tgtcagggaaaacccgtcgcttcag

SEQ ID NO: 6676 - DNA, 25 bp, Homo sapien
gtcgcttcaggctctagatgttcaa

SEQ ID NO: 6677 - DNA, 25 bp, Homo sapien
ttaagaaatttggacaggtgctgtg

SEQ ID NO: 6678 - DNA, 25 bp, Homo sapien
ctggccgatgcggtgaagccctgtc

SEQ ID NO: 6679 - DNA, 25 bp, Homo sapien
ttaagttcctaagcagcccagttag

SEQ ID NO: 6680 - DNA, 25 bp, Homo sapien
gcagcccagttagttgttcaataca

SEQ ID NO: 6681 - DNA, 25 bp, Homo sapien
aaacttcatgaagatggcctaagaa

SEQ ID NO: 6682 - DNA, 25 bp, Homo sapien
aaatggagagacttgctatggctaa

SEQ ID NO: 6683 - DNA, 25 bp, Homo sapien
gagacttgctatggctaaggtacat

SEQ ID NO: 6684 - DNA, 25 bp, Homo sapien
aagcaaggttcagctgccagtcatt

SEQ ID NO: 6685 - DNA, 25 bp, Homo sapien
gtcattggctgggtttactctcctc

SEQ ID NO: 6686 - DNA, 25 bp, Homo sapien
tccagtctgttatctcccaactcta

SEQ ID NO: 6687 - DNA, 25 bp, Homo sapien
caactctatccaagcaccattttat

SEQ ID NO: 6688 - DNA, 25 bp, Homo sapien
caagcaccattttatacctttaaga

SEQ ID NO: 6689 - DNA, 25 bp, Homo sapien
ctttaagaatgtgtgggccggacgt

SEQ ID NO: 6690 - DNA, 25 bp, Homo sapien
atgtatgaaccttgtatgaatcttc

SEQ ID NO: 6691 - DNA, 25 bp, Homo sapien
tgaaccttgtatgaatcttcattca

SEQ ID NO: 6692 - DNA, 25 bp, Homo sapien
ccttgtatgaatcttcattcaaaca

SEQ ID NO: 6693 - DNA, 25 bp, Homo sapien
gaactaggcacatattctaaatgat

SEQ ID NO: 6694 - DNA, 25 bp, Homo sapien
aaatccagaatgtggaagattctac

SEQ ID NO: 6695 - DNA, 25 bp, Homo sapien
gtggaagattctacaggacatacaa

SEQ ID NO: 6696 - DNA, 25 bp, Homo sapien
gattctacaggacatacaacccagt

SEQ ID NO: 6697 - DNA, 25 bp, Homo sapien
tctacaggacatacaacccagtttc

SEQ ID NO: 6698 - DNA, 25 bp, Homo sapien
tttaagagttatgtcggccaggcgt

SEQ ID NO: 6699 - DNA, 25 bp, Homo sapien
ttaagagttatgtcggccaggcgtg

SEQ ID NO: 6700 - DNA, 25 bp, Homo sapien
gttcgaacctagcttggccatcatg

SEQ ID NO: 6701 - DNA, 25 bp, Homo sapien
atctttcagcttctgcgcgcacaga

SEQ ID NO: 6702 - DNA, 25 bp, Homo sapien
tccttttctaatttccagtcgaaag

SEQ ID NO: 6703 - DNA, 25 bp, Homo sapien
tttccagtcgaaagatcactcctca

SEQ ID NO: 6704 - DNA, 25 bp, Homo sapien
aaagatcactcctcagggaagccag

SEQ ID NO: 6705 - DNA, 25 bp, Homo sapien
ggcctttccttgtacaggttctatg

SEQ ID NO: 6706 - DNA, 25 bp, Homo sapien
ttctatgtagtcgtcaggcgggcag

SEQ ID NO: 6707 - DNA, 25 bp, Homo sapien
gcgggcaggtcctagcgtcagactc

SEQ ID NO: 6708 - DNA, 25 bp, Homo sapien
ctagcgtcagactccattatgtact

SEQ ID NO: 6709 - DNA, 25 bp, Homo sapien
gactccattatgtactgactgtgtg

SEQ ID NO: 6710 - DNA, 25 bp, Homo sapien
tgactgtgtgtccttagccaagcta

SEQ ID NO: 6711 - DNA, 25 bp, Homo sapien
aataagagtactgaccaggcgcggt

SEQ ID NO: 6712 - DNA, 25 bp, Homo sapien
aaccgcagccaggagttgcatagat

SEQ ID NO: 6713 - DNA, 25 bp, Homo sapien
tgcatagatacctgaacacccgtgt

SEQ ID NO: 6714 - DNA, 25 bp, Homo sapien
atagcagcatgagtcacggtggcca

SEQ ID NO: 6715 - DNA, 25 bp, Homo sapien
aggtggaagcaaccctaatgcccat

SEQ ID NO: 6716 - DNA, 25 bp, Homo sapien
aaccctaatgcccatcagtggatga

SEQ ID NO: 6717 - DNA, 25 bp, Homo sapien
gaaattctcatacatcctacagcgt

SEQ ID NO: 6718 - DNA, 25 bp, Homo sapien
tcctacagcgtggatggacttagaa

SEQ ID NO: 6719 - DNA, 25 bp, Homo sapien
gacagacactgtatgatcctacttg

SEQ ID NO: 6720 - DNA, 25 bp, Homo sapien
gatcctacttgtatgaagtacttag

SEQ ID NO: 6721 - DNA, 25 bp, Homo sapien
atattctaattcagctgggtttggt

SEQ ID NO: 6722 - DNA, 25 bp, Homo sapien
tagtcaatgatggtggcctgtgtct

SEQ ID NO: 6723 - DNA, 25 bp, Homo sapien
gaatgtgtgcttctttggaatgagt

SEQ ID NO: 6724 - DNA, 25 bp, Homo sapien
gaacatttctaccttctgaatttat

SEQ ID NO: 6725 - DNA, 25 bp, Homo sapien
atttatttcttcgaatgcccaccca

SEQ ID NO: 6726 - DNA, 25 bp, Homo sapien
atgcccacccacctcaagaaataaa

SEQ ID NO: 6727 - DNA, 25 bp, Homo sapien
gaagcagagatcaggagagctagaa

SEQ ID NO: 6728 - DNA, 25 bp, Homo sapien
gaatcttagaattaacctttcaaat

SEQ ID NO: 6729 - DNA, 25 bp, Homo sapien
ttcaaatactatcattttgcagatg

SEQ ID NO: 6730 - DNA, 25 bp, Homo sapien
gatgagcaaacggaggtctagagca

SEQ ID NO: 6731 - DNA, 25 bp, Homo sapien
gtgagaagtgatatgaccaaataca

SEQ ID NO: 6732 - DNA, 25 bp, Homo sapien
gaccaaatacatactgccagttaag

SEQ ID NO: 6733 - DNA, 25 bp, Homo sapien
taaagaaatggcagctaggccggga

SEQ ID NO: 6734 - DNA, 25 bp, Homo sapien
attacaaggtaggtgatagagcaga

SEQ ID NO: 6735 - DNA, 25 bp, Homo sapien
gcagaagagaatatgagttaggcta

SEQ ID NO: 6736 - DNA, 25 bp, Homo sapien
gttaggctaaaagtaatcacaagag

SEQ ID NO: 6737 - DNA, 25 bp, Homo sapien
ctaaaagtaatcacaagagcagggt

SEQ ID NO: 6738 - DNA, 25 bp, Homo sapien
cagggtggagtccattctacacact

SEQ ID NO: 6739 - DNA, 25 bp, Homo sapien
gggtggagtccattctacacactgt

SEQ ID NO: 6740 - DNA, 25 bp, Homo sapien
gtggagtccattctacacactgtag

SEQ ID NO: 6741 - DNA, 25 bp, Homo sapien
ggagtccattctacacactgtagaa

SEQ ID NO: 6742 - DNA, 25 bp, Homo sapien
tacacactgtagaagcttcaaaacc

SEQ ID NO: 6743 - DNA, 25 bp, Homo sapien
ttcaaaaccaagcagagaacctggc

SEQ ID NO: 6744 - DNA, 25 bp, Homo sapien
ggtgtacaataaaaactgacttaag

SEQ ID NO: 6745 - DNA, 25 bp, Homo sapien
aggcatctttaaatagcagtacact

SEQ ID NO: 6746 - DNA, 25 bp, Homo sapien
ttaaatagcagtacactccagtggt

SEQ ID NO: 6747 - DNA, 25 bp, Homo sapien
gtacactccagtggttaagcttggt

SEQ ID NO: 6748 - DNA, 25 bp, Homo sapien
gttaagcttggtttctgtgactcag

SEQ ID NO: 6749 - DNA, 25 bp, Homo sapien
gcttggtttctgtgactcagttacc

SEQ ID NO: 6750 - DNA, 25 bp, Homo sapien
tggtttctgtgactcagttacctct

SEQ ID NO: 6751 - DNA, 25 bp, Homo sapien
tctgtgactcagttacctcttttga

SEQ ID NO: 6752 - DNA, 25 bp, Homo sapien
gtgactcagttacctcttttgaaaa

SEQ ID NO: 6753 - DNA, 25 bp, Homo sapien
agggcagctagttccatgtttattc

SEQ ID NO: 6754 - DNA, 25 bp, Homo sapien
gctagttccatgtttattctgggtt

SEQ ID NO: 6755 - DNA, 25 bp, Homo sapien
acactgtcatcaggcatctttaaat

SEQ ID NO: 6756 - DNA, 25 bp, Homo sapien
gtaaaaattgagaaggcaagcgcaa

SEQ ID NO: 6757 - DNA, 25 bp, Homo sapien
gcaagcgcaaagataaaggtggtta

SEQ ID NO: 6758 - DNA, 25 bp, Homo sapien
ggtggttatatgtttgtcaatccct

SEQ ID NO: 6759 - DNA, 25 bp, Homo sapien
gtcaatcccttttctggattgttct

SEQ ID NO: 6760 - DNA, 25 bp, Homo sapien
ggattgttctaattttctctagagt

SEQ ID NO: 6761 - DNA, 25 bp, Homo sapien
tttaacattctccttcaatacatga

SEQ ID NO: 6762 - DNA, 25 bp, Homo sapien
aattttgggaacagaatagcatgcc

SEQ ID NO: 6763 - DNA, 25 bp, Homo sapien
gaatagcatgccaagctttcattaa

SEQ ID NO: 6764 - DNA, 25 bp, Homo sapien
gccaagctttcattaatttgagtgt

SEQ ID NO: 6765 - DNA, 25 bp, Homo sapien
tgagtgtgggacacactctaggcat

SEQ ID NO: 6766 - DNA, 25 bp, Homo sapien
atttattactactttgggccaggtg

SEQ ID NO: 6767 - DNA, 25 bp, Homo sapien
acttggtggaccgacgaggctcaaa

SEQ ID NO: 6768 - DNA, 25 bp, Homo sapien
aaaaaaccgtgctgctaatcctgct

SEQ ID NO: 6769 - DNA, 25 bp, Homo sapien
gctaatcctgctattgccattacat

SEQ ID NO: 6770 - DNA, 25 bp, Homo sapien
ggaactgtaaacaaccatcaggact

SEQ ID NO: 6771 - DNA, 25 bp, Homo sapien
atcaggacttcgagatgatgccatt

SEQ ID NO: 6772 - DNA, 25 bp, Homo sapien
aattcgcaattgctgtttgagggca

SEQ ID NO: 6773 - DNA, 25 bp, Homo sapien
ggatctgggaactacttatcagtct

SEQ ID NO: 6774 - DNA, 25 bp, Homo sapien
ggctcaaaggaaccatatcctgatt

SEQ ID NO: 6775 - DNA, 25 bp, Homo sapien
atatcctgatttcattgctcgcctt

SEQ ID NO: 6776 - DNA, 25 bp, Homo sapien
ttcattgctcgccttcaagacgcag

SEQ ID NO: 6777 - DNA, 25 bp, Homo sapien
aaggctctcactgatgaaagtgcca

SEQ ID NO: 6778 - DNA, 25 bp, Homo sapien
tgagttcatctcaggcagtcccctc

SEQ ID NO: 6779 - DNA, 25 bp, Homo sapien
gtttaacaaccccagaggacagcag

SEQ ID NO: 6780 - DNA, 25 bp, Homo sapien
ggacagcaggtagcttttcttcagt

SEQ ID NO: 6781 - DNA, 25 bp, Homo sapien
gcttttcttcagtagttccagcaaa

SEQ ID NO: 6782 - DNA, 25 bp, Homo sapien
agcaaacgtcccaaagctcacactg

SEQ ID NO: 6783 - DNA, 25 bp, Homo sapien
tcccaaagctcacactggaccagtg

SEQ ID NO: 6784 - DNA, 25 bp, Homo sapien
cagtgagggtcacgtgcttatctct

SEQ ID NO: 6785 - DNA, 25 bp, Homo sapien
gatactaaagtatgcattctcggcc

SEQ ID NO: 6786 - DNA, 25 bp, Homo sapien
aaagtatgcattctcggccaggcgc

SEQ ID NO: 6787 - DNA, 25 bp, Homo sapien
agtgttgccagggattcttctcatc

SEQ ID NO: 6788 - DNA, 25 bp, Homo sapien
tcttctcatctctgggcattgcttc

SEQ ID NO: 6789 - DNA, 25 bp, Homo sapien
gctcaactgggccaggaatggctaa

SEQ ID NO: 6790 - DNA, 25 bp, Homo sapien
tcaactgggccaggaatggctaaga

SEQ ID NO: 6791 - DNA, 25 bp, Homo sapien
caggaatggctaagaggctcactca

SEQ ID NO: 6792 - DNA, 25 bp, Homo sapien
ggaatggctaagaggctcactcaca

SEQ ID NO: 6793 - DNA, 25 bp, Homo sapien
gaatggctaagaggctcactcacag

SEQ ID NO: 6794 - DNA, 25 bp, Homo sapien
acttccaggcctgggaactgcattt

SEQ ID NO: 6795 - DNA, 25 bp, Homo sapien
aggcctgggaactgcatttttaaga

SEQ ID NO: 6796 - DNA, 25 bp, Homo sapien
gcctgggaactgcatttttaagaga

SEQ ID NO: 6797 - DNA, 25 bp, Homo sapien
ctgggaactgcatttttaagagaca

SEQ ID NO: 6798 - DNA, 25 bp, Homo sapien
agataggactacaggttacagatat

SEQ ID NO: 6799 - DNA, 25 bp, Homo sapien
aggactacaggttacagatatatgc

SEQ ID NO: 6800 - DNA, 25 bp, Homo sapien
ggaccagactaccaaggattagtcg

SEQ ID NO: 6801 - DNA, 25 bp, Homo sapien
attagtcgggacattttggctggaa

SEQ ID NO: 6802 - DNA, 25 bp, Homo sapien
attttggctggaaatgagaacccca

SEQ ID NO: 6803 - DNA, 25 bp, Homo sapien
agaaccccactcagactagcttagg

SEQ ID NO: 6804 - DNA, 25 bp, Homo sapien
ggagcctcagattgctcacagaatt

SEQ ID NO: 6805 - DNA, 25 bp, Homo sapien
ggctgatcctgacaacgtcccagaa

SEQ ID NO: 6806 - DNA, 25 bp, Homo sapien
tctgtttctcctagttctcagagtt

SEQ ID NO: 6807 - DNA, 25 bp, Homo sapien
tgccatgtcaggtatgtgactgagt

SEQ ID NO: 6808 - DNA, 25 bp, Homo sapien
gtgactgagtaagtctacactctta

SEQ ID NO: 6809 - DNA, 25 bp, Homo sapien
gtctacactcttaagtcggtatgaa

SEQ ID NO: 6810 - DNA, 25 bp, Homo sapien
tctcaagaaaggatcgaccgggcat

SEQ ID NO: 6811 - DNA, 25 bp, Homo sapien
agggagcgtgctttagaaaccaaca

SEQ ID NO: 6812 - DNA, 25 bp, Homo sapien
cgtgctttagaaaccaacacagcta

SEQ ID NO: 6813 - DNA, 25 bp, Homo sapien
cacagctaaagcttatgttatgtct

SEQ ID NO: 6814 - DNA, 25 bp, Homo sapien
tatgttatgtctagctgcatcactt

SEQ ID NO: 6815 - DNA, 25 bp, Homo sapien
tcacttaaccttttctaaacaatat

SEQ ID NO: 6816 - DNA, 25 bp, Homo sapien
gatattgatagcacctacctcactg

SEQ ID NO: 6817 - DNA, 25 bp, Homo sapien
cttaggacagtgtctggtaggcact

SEQ ID NO: 6818 - DNA, 25 bp, Homo sapien
gtctggtaggcactaagggcccaat

SEQ ID NO: 6819 - DNA, 25 bp, Homo sapien
agggcccaataaatgttggctgcta

SEQ ID NO: 6820 - DNA, 25 bp, Homo sapien
aatgttggctgctaatattattaaa

SEQ ID NO: 6821 - DNA, 25 bp, Homo sapien
gtagagtagaccaggtacagtggct

SEQ ID NO: 6822 - DNA, 25 bp, Homo sapien
gtgtcaccatgtgtcatttaaccta

SEQ ID NO: 6823 - DNA, 25 bp, Homo sapien
taacctattcctctgtttctgtata

SEQ ID NO: 6824 - DNA, 25 bp, Homo sapien
ggtacgaatacttcctcggtggtat

SEQ ID NO: 6825 - DNA, 25 bp, Homo sapien
atacttcctcggtggtatttcacac

SEQ ID NO: 6826 - DNA, 25 bp, Homo sapien
tggtatttcacacttctatctggaa

SEQ ID NO: 6827 - DNA, 25 bp, Homo sapien
aagcatgtaactatgcctggttgct

SEQ ID NO: 6828 - DNA, 25 bp, Homo sapien
tgcctggttgcttctgtgacattag

SEQ ID NO: 6829 - DNA, 25 bp, Homo sapien
accactgccccttatttcattagga

SEQ ID NO: 6830 - DNA, 25 bp, Homo sapien
atttcattaggagcagacacccaat

SEQ ID NO: 6831 - DNA, 25 bp, Homo sapien
gacacccaattacgaaccacacatt

SEQ ID NO: 6832 - DNA, 25 bp, Homo sapien
aatcgctgatattatatgacttcgt

SEQ ID NO: 6833 - DNA, 25 bp, Homo sapien
aatgccatatttgttgcttcaatta

SEQ ID NO: 6834 - DNA, 25 bp, Homo sapien
gtttgtggatcaagaactcccagtt

SEQ ID NO: 6835 - DNA, 25 bp, Homo sapien
tcccagttaagcctactagatgagc

SEQ ID NO: 6836 - DNA, 25 bp, Homo sapien
gcctactagatgagctgtgtgtgtt

SEQ ID NO: 6837 - DNA, 25 bp, Homo sapien
agctgtgtgtgtttgttgctctccc

SEQ ID NO: 6838 - DNA, 25 bp, Homo sapien
tgtttgttgctctcccttcaaaaaa

SEQ ID NO: 6839 - DNA, 25 bp, Homo sapien
gatacaaacccacttgtcgaaggga

SEQ ID NO: 6840 - DNA, 25 bp, Homo sapien
ggagaagagaccaacggcagacata

SEQ ID NO: 6841 - DNA, 25 bp, Homo sapien
ggcagacataagattccagacgatt

SEQ ID NO: 6842 - DNA, 25 bp, Homo sapien
gaaagagcacgcagttgacttagaa

SEQ ID NO: 6843 - DNA, 25 bp, Homo sapien
gacttagaaaagcatcccgggccgg

SEQ ID NO: 6844 - DNA, 25 bp, Homo sapien
gcattttttagtgcaaaaactcatc

SEQ ID NO: 6845 - DNA, 25 bp, Homo sapien
gcaaaaactcatcaacaatgggctt

SEQ ID NO: 6846 - DNA, 25 bp, Homo sapien
ctcatcaacaatgggcttatagtca

SEQ ID NO: 6847 - DNA, 25 bp, Homo sapien
tgggcttatagtcaaagtatttggt

SEQ ID NO: 6848 - DNA, 25 bp, Homo sapien
cattatcttcagactggtggtacca

SEQ ID NO: 6849 - DNA, 25 bp, Homo sapien
cagactggtggtaccattgagagat

SEQ ID NO: 6850 - DNA, 25 bp, Homo sapien
gttgtgcaaccatcctacagtatgt

SEQ ID NO: 6851 - DNA, 25 bp, Homo sapien
gcaaccatcctacagtatgtagtct

SEQ ID NO: 6852 - DNA, 25 bp, Homo sapien
atgtagtctttgtggctggcttcct

SEQ ID NO: 6853 - DNA, 25 bp, Homo sapien
agtctttgtggctggcttccttcac

SEQ ID NO: 6854 - DNA, 25 bp, Homo sapien
aagtttatccatgtgggccgggcgc

SEQ ID NO: 6855 - DNA, 25 bp, Homo sapien
tcttgcaaacaagtatctcccattt

SEQ ID NO: 6856 - DNA, 25 bp, Homo sapien
agtatctcccatttgactttataag

SEQ ID NO: 6857 - DNA, 25 bp, Homo sapien
gaagatgtggccctagtagcttatg

SEQ ID NO: 6858 - DNA, 25 bp, Homo sapien
agtagcttatggtagattctcggtc

SEQ ID NO: 6859 - DNA, 25 bp, Homo sapien
gattctcggtcattgaatgctctgt

SEQ ID NO: 6860 - DNA, 25 bp, Homo sapien
gtcattgaatgctctgtccagccca

SEQ ID NO: 6861 - DNA, 25 bp, Homo sapien
tccagcccaccattgtccttgggtg

SEQ ID NO: 6862 - DNA, 25 bp, Homo sapien
attgctggcatcttctttgttattg

SEQ ID NO: 6863 - DNA, 25 bp, Homo sapien
tattgtcccctacaaaatgcagtgg

SEQ ID NO: 6864 - DNA, 25 bp, Homo sapien
aatgcagtggatgctaccagacatt

SEQ ID NO: 6865 - DNA, 25 bp, Homo sapien
ttttgagactcaatccttatggaaa

SEQ ID NO: 6866 - DNA, 25 bp, Homo sapien
tgggcctctttaacatcaaaagatg

SEQ ID NO: 6867 - DNA, 25 bp, Homo sapien
ctgggaagggccttcaacgaagtag

SEQ ID NO: 6868 - DNA, 25 bp, Homo sapien
gaagggccttcaacgaagtaggaag

SEQ ID NO: 6869 - DNA, 25 bp, Homo sapien
ggccttcaacgaagtaggaagaaca

SEQ ID NO: 6870 - DNA, 25 bp, Homo sapien
aacagttgtaaaatggagactcgaa

SEQ ID NO: 6871 - DNA, 25 bp, Homo sapien
atggagactcgaagtgaaaaaggtt

SEQ ID NO: 6872 - DNA, 25 bp, Homo sapien
aggttgggagcaaggacctttggca

SEQ ID NO: 6873 - DNA, 25 bp, Homo sapien
aggacctttggcaagtgctataata

SEQ ID NO: 6874 - DNA, 25 bp, Homo sapien
gacattacattatataaggtctaag

SEQ ID NO: 6875 - DNA, 25 bp, Homo sapien
taaggtgtgttcaaggtataatact

SEQ ID NO: 6876 - DNA, 25 bp, Homo sapien
ttcaaggtataatactgtgctttgc

SEQ ID NO: 6877 - DNA, 25 bp, Homo sapien
gtcacttcactcatccatacttgaa

SEQ ID NO: 6878 - DNA, 25 bp, Homo sapien
tataatcatgtggtgctgccatcag

SEQ ID NO: 6879 - DNA, 25 bp, Homo sapien
gctgccatcagagccaaccaaatta

SEQ ID NO: 6880 - DNA, 25 bp, Homo sapien
aaccaaattagctgttcattcctga

SEQ ID NO: 6881 - DNA, 25 bp, Homo sapien
attcctgatgtgacgattgggccta

SEQ ID NO: 6882 - DNA, 25 bp, Homo sapien
gcctcagcactgttaacgttttggg

SEQ ID NO: 6883 - DNA, 25 bp, Homo sapien
tttgggacagatgattctgcgctgt

SEQ ID NO: 6884 - DNA, 25 bp, Homo sapien
agccctgtgcattctagggtttcag

SEQ ID NO: 6885 - DNA, 25 bp, Homo sapien
ttctacccactgaagccaatactag

SEQ ID NO: 6886 - DNA, 25 bp, Homo sapien
atactagctccccaagttgtgacaa

SEQ ID NO: 6887 - DNA, 25 bp, Homo sapien
aatgacttttgggttgggcgccaca

SEQ ID NO: 6888 - DNA, 25 bp, Homo sapien
tgagcattaaagacataaattcatg

SEQ ID NO: 6889 - DNA, 25 bp, Homo sapien
gaatcattaattatgctctcctgag

SEQ ID NO: 6890 - DNA, 25 bp, Homo sapien
aatcattaattatgctctcctgagc

SEQ ID NO: 6891 - DNA, 25 bp, Homo sapien
taatgtgtggtttattgatgatata

SEQ ID NO: 6892 - DNA, 25 bp, Homo sapien
agtacattgaattatacttcagtgt

SEQ ID NO: 6893 - DNA, 25 bp, Homo sapien
tgaattatacttcagtgtacaagaa

SEQ ID NO: 6894 - DNA, 25 bp, Homo sapien
gtaaatatcttcatcaaaactctgt

SEQ ID NO: 6895 - DNA, 25 bp, Homo sapien
atatcttcatcaaaactctgtgtta

SEQ ID NO: 6896 - DNA, 25 bp, Homo sapien
cttcatcaaaactctgtgttaaaaa

SEQ ID NO: 6897 - DNA, 25 bp, Homo sapien
gctggaactacaagcccgtgtcact

SEQ ID NO: 6898 - DNA, 25 bp, Homo sapien
ctggaactacaagcccgtgtcactg

SEQ ID NO: 6899 - DNA, 25 bp, Homo sapien
aaatgagctatatccgttcctccag

SEQ ID NO: 6900 - DNA, 25 bp, Homo sapien
gagctatatccgttcctccagccat

SEQ ID NO: 6901 - DNA, 25 bp, Homo sapien
cacatcctttcaggatgtatgtgtg

SEQ ID NO: 6902 - DNA, 25 bp, Homo sapien
gggtgcttacctgtgtgtagtaact

SEQ ID NO: 6903 - DNA, 25 bp, Homo sapien
gcttacctgtgtgtagtaacttcat

SEQ ID NO: 6904 - DNA, 25 bp, Homo sapien
acctgtgtgtagtaacttcatgtta

SEQ ID NO: 6905 - DNA, 25 bp, Homo sapien
gtaacttcatgttatacatatgcct

SEQ ID NO: 6906 - DNA, 25 bp, Homo sapien
tcatgttatacatatgcctttttcc

SEQ ID NO: 6907 - DNA, 25 bp, Homo sapien
tttttccctcaagggtgaccactgt

SEQ ID NO: 6908 - DNA, 25 bp, Homo sapien
ttccctcaagggtgaccactgttgt

SEQ ID NO: 6909 - DNA, 25 bp, Homo sapien
caagggtgaccactgttgttgccca

SEQ ID NO: 6910 - DNA, 25 bp, Homo sapien
tgcagtccgttcctgtactcacgca

SEQ ID NO: 6911 - DNA, 25 bp, Homo sapien
acgtggtcactctctcgcacttaga

SEQ ID NO: 6912 - DNA, 25 bp, Homo sapien
ttagactcctttgtccttatctact

SEQ ID NO: 6913 - DNA, 25 bp, Homo sapien
tttgtccttatctacttccgttgat

SEQ ID NO: 6914 - DNA, 25 bp, Homo sapien
atctacttccgttgatgtggctacc

SEQ ID NO: 6915 - DNA, 25 bp, Homo sapien
tgatgtggctacctcagtgtccttt

SEQ ID NO: 6916 - DNA, 25 bp, Homo sapien
agtgtcctttctcaaggtgtgcagt

SEQ ID NO: 6917 - DNA, 25 bp, Homo sapien
gaactttggattatagcaatctctt

SEQ ID NO: 6918 - DNA, 25 bp, Homo sapien
aatctcttatgaacaagggcacctg

SEQ ID NO: 6919 - DNA, 25 bp, Homo sapien
aagggcacctgattctcaatttcct

SEQ ID NO: 6920 - DNA, 25 bp, Homo sapien
tctcaatttcctgctgtatataaag

SEQ ID NO: 6921 - DNA, 25 bp, Homo sapien
ctaatttacccagtcttagcattgg

SEQ ID NO: 6922 - DNA, 25 bp, Homo sapien
cttagcattggaggcaggaatacat

SEQ ID NO: 6923 - DNA, 25 bp, Homo sapien
ggaatacatatgcataacacgcctg

SEQ ID NO: 6924 - DNA, 25 bp, Homo sapien
ataacacgcctgagtaagagctgag

SEQ ID NO: 6925 - DNA, 25 bp, Homo sapien
caaaagctctctacgtaacaacggg

SEQ ID NO: 6926 - DNA, 25 bp, Homo sapien
aacgggaaatagcacacgtgtgtac

SEQ ID NO: 6927 - DNA, 25 bp, Homo sapien
agcacacgtgtgtacttgcagaaac

SEQ ID NO: 6928 - DNA, 25 bp, Homo sapien
gacagacagacttgcaaatttgtgt

SEQ ID NO: 6929 - DNA, 25 bp, Homo sapien
tagaatatctctaggccttctctct

SEQ ID NO: 6930 - DNA, 25 bp, Homo sapien
gctgcacagtttgtttgctcttcaa

SEQ ID NO: 6931 - DNA, 25 bp, Homo sapien
ttcaaaaagtcaacctgaggccggg

SEQ ID NO: 6932 - DNA, 25 bp, Homo sapien
agatagctgggcacagttgttcagg

SEQ ID NO: 6933 - DNA, 25 bp, Homo sapien
tgggcacagttgttcaggcctatat

SEQ ID NO: 6934 - DNA, 25 bp, Homo sapien
gcacagttgttcaggcctatattgt

SEQ ID NO: 6935 - DNA, 25 bp, Homo sapien
agttgttcaggcctatattgtcagg

SEQ ID NO: 6936 - DNA, 25 bp, Homo sapien
tcaggcctatattgtcagggctttg

SEQ ID NO: 6937 - DNA, 25 bp, Homo sapien
cctatattgtcagggctttgggagg

SEQ ID NO: 6938 - DNA, 25 bp, Homo sapien
gaggcctcaaggatcgcttgaaggc

SEQ ID NO: 6939 - DNA, 25 bp, Homo sapien
tcaaggatcgcttgaaggcaggagt

SEQ ID NO: 6940 - DNA, 25 bp, Homo sapien
aagagaatttcttgagtctaggagt

SEQ ID NO: 6941 - DNA, 25 bp, Homo sapien
agcttgggtggcagaacgaaacctt

SEQ ID NO: 6942 - DNA, 25 bp, Homo sapien
gcagaacgaaaccttgcctcttaaa

SEQ ID NO: 6943 - DNA, 25 bp, Homo sapien
ctaatatttctgtcacacagagaaa

SEQ ID NO: 6944 - DNA, 25 bp, Homo sapien
tgataatgcagtacaaggttgatat

SEQ ID NO: 6945 - DNA, 25 bp, Homo sapien
tgcagtacaaggttgatattttaag

SEQ ID NO: 6946 - DNA, 25 bp, Homo sapien
ggtagagatttttagcttgagcatt

SEQ ID NO: 6947 - DNA, 25 bp, Homo sapien
gagatttttagcttgagcatttagc

SEQ ID NO: 6948 - DNA, 25 bp, Homo sapien
tttttagcttgagcatttagcatcc

SEQ ID NO: 6949 - DNA, 25 bp, Homo sapien
agcatttagcatccatttgttcttt

SEQ ID NO: 6950 - DNA, 25 bp, Homo sapien
gcatttagcatccatttgttctttt

SEQ ID NO: 6951 - DNA, 25 bp, Homo sapien
tttagcatccatttgttcttttaat

SEQ ID NO: 6952 - DNA, 25 bp, Homo sapien
gttcttttaatgtaaatgtcaaaca

SEQ ID NO: 6953 - DNA, 25 bp, Homo sapien
aaatttataattcactcaatagagt

SEQ ID NO: 6954 - DNA, 25 bp, Homo sapien
attacttgtctgattttctttctat

SEQ ID NO: 6955 - DNA, 25 bp, Homo sapien
gtctgattttctttctatagcatac

SEQ ID NO: 6956 - DNA, 25 bp, Homo sapien
atacattatttgtgcccacctgtta

SEQ ID NO: 6957 - DNA, 25 bp, Homo sapien
cctgttatctttggttatctttgaa

SEQ ID NO: 6958 - DNA, 25 bp, Homo sapien
ggttatctttgaacactcttttata

SEQ ID NO: 6959 - DNA, 25 bp, Homo sapien
tatatgttttatttgccgcattatg

SEQ ID NO: 6960 - DNA, 25 bp, Homo sapien
atttgccgcattatgttacttagaa

SEQ ID NO: 6961 - DNA, 25 bp, Homo sapien
gataaccttgggtatggaagcatcc

SEQ ID NO: 6962 - DNA, 25 bp, Homo sapien
agcatccaagatgtcttccagagga

SEQ ID NO: 6963 - DNA, 25 bp, Homo sapien
gtaaacttggtacaaccagacaatg

SEQ ID NO: 6964 - DNA, 25 bp, Homo sapien
aaagaaatgattcggctggacccag

SEQ ID NO: 6965 - DNA, 25 bp, Homo sapien
catgaagtgatcttttcaaggtcac

SEQ ID NO: 6966 - DNA, 25 bp, Homo sapien
gtcacacatcaggtggttagaccac

SEQ ID NO: 6967 - DNA, 25 bp, Homo sapien
aaccaaaacccagatcaactgactg

SEQ ID NO: 6968 - DNA, 25 bp, Homo sapien
caactgactgcaaacttggtgttct

SEQ ID NO: 6969 - DNA, 25 bp, Homo sapien
gttcttgaagtaagactgatccgaa

SEQ ID NO: 6970 - DNA, 25 bp, Homo sapien
gatccgaaatattcagcagtcttgc

SEQ ID NO: 6971 - DNA, 25 bp, Homo sapien
agtcttgccagcttaccagtggact

SEQ ID NO: 6972 - DNA, 25 bp, Homo sapien
gcttaccagtggactgaggacctga

SEQ ID NO: 6973 - DNA, 25 bp, Homo sapien
ggacctgagaatcaactgagtcttt

SEQ ID NO: 6974 - DNA, 25 bp, Homo sapien
atcaactgagtctttgtcctgggat

SEQ ID NO: 6975 - DNA, 25 bp, Homo sapien
gcatctctgctttaagaactaggcc

SEQ ID NO: 6976 - DNA, 25 bp, Homo sapien
gtaatatgagccacactggcagtgt

SEQ ID NO: 6977 - DNA, 25 bp, Homo sapien
atcatgcagctgttttgtgggatga

SEQ ID NO: 6978 - DNA, 25 bp, Homo sapien
atgaagaacgcccagcagtgcccag

SEQ ID NO: 6979 - DNA, 25 bp, Homo sapien
acgcccagcagtgcccaggattagg

SEQ ID NO: 6980 - DNA, 25 bp, Homo sapien
aggattaggcagtacctcctgcatc

SEQ ID NO: 6981 - DNA, 25 bp, Homo sapien
tgcatcccattcttctaccgaggag

SEQ ID NO: 6982 - DNA, 25 bp, Homo sapien
tcccattcttctaccgaggagacaa

SEQ ID NO: 6983 - DNA, 25 bp, Homo sapien
caatatctaaaagttggcactgtca

SEQ ID NO: 6984 - DNA, 25 bp, Homo sapien
taaaagttggcactgtcaacaaggc

SEQ ID NO: 6985 - DNA, 25 bp, Homo sapien
tgtcaacaaggcctacagaagcata

SEQ ID NO: 6986 - DNA, 25 bp, Homo sapien
tacagaagcataagccgccatgtca

SEQ ID NO: 6987 - DNA, 25 bp, Homo sapien
atgctgatgccctggcgagaggcac

SEQ ID NO: 6988 - DNA, 25 bp, Homo sapien
tgtggctgcgtgttcacagcttgac

SEQ ID NO: 6989 - DNA, 25 bp, Homo sapien
tgcgtgttcacagcttgacttctga

SEQ ID NO: 6990 - DNA, 25 bp, Homo sapien
tgttcacagcttgacttctgaggtt

SEQ ID NO: 6991 - DNA, 25 bp, Homo sapien
gacttctgaggtttaaaggactgtt

SEQ ID NO: 6992 - DNA, 25 bp, Homo sapien
gaggtttaaaggactgttcagatga

SEQ ID NO: 6993 - DNA, 25 bp, Homo sapien
actgttcagatgaaagcatcgagga

SEQ ID NO: 6994 - DNA, 25 bp, Homo sapien
gcaggattatgaagatggatgtaac

SEQ ID NO: 6995 - DNA, 25 bp, Homo sapien
aaattgtcacattatttaatgcctt

SEQ ID NO: 6996 - DNA, 25 bp, Homo sapien
tgatccttttaatatgaacaaacaa

SEQ ID NO: 6997 - DNA, 25 bp, Homo sapien
aacaataagaaaatcacagccgggt

SEQ ID NO: 6998 - DNA, 25 bp, Homo sapien
ttttttccagctgcaggaatgtaga

SEQ ID NO: 6999 - DNA, 25 bp, Homo sapien
agggcagccaccataagacttccag

SEQ ID NO: 7000 - DNA, 25 bp, Homo sapien
gggcagccaccataagacttccaga

SEQ ID NO: 7001 - DNA, 25 bp, Homo sapien
gcagccaccataagacttccagaga

SEQ ID NO: 7002 - DNA, 25 bp, Homo sapien
cagccaccataagacttccagagaa

SEQ ID NO: 7003 - DNA, 25 bp, Homo sapien
gccaccataagacttccagagaact

SEQ ID NO: 7004 - DNA, 25 bp, Homo sapien
accataagacttccagagaactttg

SEQ ID NO: 7005 - DNA, 25 bp, Homo sapien
cataagacttccagagaactttggt

SEQ ID NO: 7006 - DNA, 25 bp, Homo sapien
ttccttttctatcaatcccgggtct

SEQ ID NO: 7007 - DNA, 25 bp, Homo sapien
tccttttctatcaatcccgggtctt

SEQ ID NO: 7008 - DNA, 25 bp, Homo sapien
ctatagcctggaagcacaccccacc

SEQ ID NO: 7009 - DNA, 25 bp, Homo sapien
gtaccattcttgctcttatttcaca

SEQ ID NO: 7010 - DNA, 25 bp, Homo sapien
taagaaaattgtagggccgggcgca

SEQ ID NO: 7011 - DNA, 25 bp, Homo sapien
agacttcaaaattttggctctgttc

SEQ ID NO: 7012 - DNA, 25 bp, Homo sapien
tggctctgttcaaaattccctgact

SEQ ID NO: 7013 - DNA, 25 bp, Homo sapien
aattccctgactcattgggtggctt

SEQ ID NO: 7014 - DNA, 25 bp, Homo sapien
gatttaaatccactatcctgcaaga

SEQ ID NO: 7015 - DNA, 25 bp, Homo sapien
ataacactgtacttggcacttgggt

SEQ ID NO: 7016 - DNA, 25 bp, Homo sapien
gtgtcaaatcatatgccaagcactt

SEQ ID NO: 7017 - DNA, 25 bp, Homo sapien
ttacaagctgtaactctgcatcctc

SEQ ID NO: 7018 - DNA, 25 bp, Homo sapien
tgtaactctgcatcctctgggaagc

SEQ ID NO: 7019 - DNA, 25 bp, Homo sapien
tcctctgggaagcatgtaccattct

SEQ ID NO: 7020 - DNA, 25 bp, Homo sapien
ttgagaaggctgtgtatcccgatgt

SEQ ID NO: 7021 - DNA, 25 bp, Homo sapien
agaaggctgtgtatcccgatgttgt

SEQ ID NO: 7022 - DNA, 25 bp, Homo sapien
aaggctgtgtatcccgatgttgttg

SEQ ID NO: 7023 - DNA, 25 bp, Homo sapien
gctgtgtatcccgatgttgttgagg

SEQ ID NO: 7024 - DNA, 25 bp, Homo sapien
gtgtatcccgatgttgttgaggagt

SEQ ID NO: 7025 - DNA, 25 bp, Homo sapien
aattatattgctctctctgtgttta

SEQ ID NO: 7026 - DNA, 25 bp, Homo sapien
ctctgtgtttattcagttttgttag

SEQ ID NO: 7027 - DNA, 25 bp, Homo sapien
gtgtttattcagttttgttagtatt

SEQ ID NO: 7028 - DNA, 25 bp, Homo sapien
tactttatatatctgaaagcctaat

SEQ ID NO: 7029 - DNA, 25 bp, Homo sapien
ctgaaagcctaatttgagacacaca

SEQ ID NO: 7030 - DNA, 25 bp, Homo sapien
caaatttgtcatacattcacaggga

SEQ ID NO: 7031 - DNA, 25 bp, Homo sapien
gcacctggagctgatgaatggccct

SEQ ID NO: 7032 - DNA, 25 bp, Homo sapien
tgactgcccagaaaccaatccggaa

SEQ ID NO: 7033 - DNA, 25 bp, Homo sapien
gacgcagctggagagccaagcactc

SEQ ID NO: 7034 - DNA, 25 bp, Homo sapien
caagcactcttggactacagtccta

SEQ ID NO: 7035 - DNA, 25 bp, Homo sapien
tacagtcctaggctggagctgccaa

SEQ ID NO: 7036 - DNA, 25 bp, Homo sapien
tggagctgccaatacaggctctgcc

SEQ ID NO: 7037 - DNA, 25 bp, Homo sapien
tctgcccagctaatcttctctgagc

SEQ ID NO: 7038 - DNA, 25 bp, Homo sapien
gagcctgcaaatattaaacctgaca

SEQ ID NO: 7039 - DNA, 25 bp, Homo sapien
aaacaggctcacagggcagctgaaa

SEQ ID NO: 7040 - DNA, 25 bp, Homo sapien
tccaagtgcctaagtgagatccagt

SEQ ID NO: 7041 - DNA, 25 bp, Homo sapien
tcaaagtaagtgcaaggccctcctc

SEQ ID NO: 7042 - DNA, 25 bp, Homo sapien
gctgaacacaaaagcctgccactgc

SEQ ID NO: 7043 - DNA, 25 bp, Homo sapien
tgcagggccccttagcctgaagaac

SEQ ID NO: 7044 - DNA, 25 bp, Homo sapien
tagcctgaagaacccaaatattaca

SEQ ID NO: 7045 - DNA, 25 bp, Homo sapien
agaacccaaatattacagtcacagt

SEQ ID NO: 7046 - DNA, 25 bp, Homo sapien
ttacagtcacagtatgtcttcaggg

SEQ ID NO: 7047 - DNA, 25 bp, Homo sapien
tcttcagggtgtttattacctaggt

SEQ ID NO: 7048 - DNA, 25 bp, Homo sapien
ttacctaggtattataattcttgtg

SEQ ID NO: 7049 - DNA, 25 bp, Homo sapien
aattcttgtgtgatggcagtcagag

SEQ ID NO: 7050 - DNA, 25 bp, Homo sapien
cctagggaagacatttggtgctggt

SEQ ID NO: 7051 - DNA, 25 bp, Homo sapien
gaagacatttggtgctggtttcttg

SEQ ID NO: 7052 - DNA, 25 bp, Homo sapien
gtctttgggtaggacaagcatcaag

SEQ ID NO: 7053 - DNA, 25 bp, Homo sapien
gacttgggtagagacatgatgccct

SEQ ID NO: 7054 - DNA, 25 bp, Homo sapien
acatgatgccctgggagtctccctt

SEQ ID NO: 7055 - DNA, 25 bp, Homo sapien
ccaggagtcagaaccctggctgcac

SEQ ID NO: 7056 - DNA, 25 bp, Homo sapien
agaggcccgacgtgtgcctcttcgg

SEQ ID NO: 7057 - DNA, 25 bp, Homo sapien
ccgccccacagatgtgagagtgtgg

SEQ ID NO: 7058 - DNA, 25 bp, Homo sapien
ggcctccataacaattatttcagtg

SEQ ID NO: 7059 - DNA, 25 bp, Homo sapien
ataacaattatttcagtgcagagtg

SEQ ID NO: 7060 - DNA, 25 bp, Homo sapien
cagtgcagagtggttagttcaatat

SEQ ID NO: 7061 - DNA, 25 bp, Homo sapien
gcttaaaaagctgtccaggatcggt

SEQ ID NO: 7062 - DNA, 25 bp, Homo sapien
aagctgtccaggatcggtggtttac

SEQ ID NO: 7063 - DNA, 25 bp, Homo sapien
gtccaggatcggtggtttacacctg

SEQ ID NO: 7064 - DNA, 25 bp, Homo sapien
acttgtagagtgttagttctgaggc

SEQ ID NO: 7065 - DNA, 25 bp, Homo sapien
gttctgaggctaaagatcagtctct

SEQ ID NO: 7066 - DNA, 25 bp, Homo sapien
aggctaaagatcagtctctttttct

SEQ ID NO: 7067 - DNA, 25 bp, Homo sapien
agtacctaaatagcactccatctta

SEQ ID NO: 7068 - DNA, 25 bp, Homo sapien
actccatcttaattagagctatgct

SEQ ID NO: 7069 - DNA, 25 bp, Homo sapien
gagctatgctttgcttaggttgttt

SEQ ID NO: 7070 - DNA, 25 bp, Homo sapien
gctttgcttaggttgtttcataatt

SEQ ID NO: 7071 - DNA, 25 bp, Homo sapien
tctgtttttaggtggttgttgaatt

SEQ ID NO: 7072 - DNA, 25 bp, Homo sapien
ttaaaagtactgataactgcggtca

SEQ ID NO: 7073 - DNA, 25 bp, Homo sapien
gtactgataactgcggtcaggtgca

SEQ ID NO: 7074 - DNA, 25 bp, Homo sapien
tgctgggagcctcagcacgttggga

SEQ ID NO: 7075 - DNA, 25 bp, Homo sapien
aacgcgggcggcaacgacacctact

SEQ ID NO: 7076 - DNA, 25 bp, Homo sapien
cgggcgaggcccacaacgagacgct

SEQ ID NO: 7077 - DNA, 25 bp, Homo sapien
acaacgagacgctggcggccctgcg

SEQ ID NO: 7078 - DNA, 25 bp, Homo sapien
gtgtccaccgccatgggctgcatca

SEQ ID NO: 7079 - DNA, 25 bp, Homo sapien
gctgcatcaccttcctgggcgtggt

SEQ ID NO: 7080 - DNA, 25 bp, Homo sapien
tgggcgtggtcctcttctgcttcgt

SEQ ID NO: 7081 - DNA, 25 bp, Homo sapien
tggtcctcttctgcttcgtgctgct

SEQ ID NO: 7082 - DNA, 25 bp, Homo sapien
ttcgtgctgctgttcgtgtggagcc

SEQ ID NO: 7083 - DNA, 25 bp, Homo sapien
gccgcgggcagcacaaaaacaactt

SEQ ID NO: 7084 - DNA, 25 bp, Homo sapien
aacaacttctcggtggagtactcct

SEQ ID NO: 7085 - DNA, 25 bp, Homo sapien
cggtggagtactccttccgcaaggt

SEQ ID NO: 7086 - DNA, 25 bp, Homo sapien
gagcatcctcagctgagcctttgtt

SEQ ID NO: 7087 - DNA, 25 bp, Homo sapien
tcctctgtcgctgatgtttcttaag

SEQ ID NO: 7088 - DNA, 25 bp, Homo sapien
aagagttagcctagtcttctctgcc

SEQ ID NO: 7089 - DNA, 25 bp, Homo sapien
aataactttttactccacatctcaa

SEQ ID NO: 7090 - DNA, 25 bp, Homo sapien
aagagccacttgacgatacagaata

SEQ ID NO: 7091 - DNA, 25 bp, Homo sapien
gaataaagagctgttcacgctagaa

SEQ ID NO: 7092 - DNA, 25 bp, Homo sapien
agctgttcacgctagaaggaggttg

SEQ ID NO: 7093 - DNA, 25 bp, Homo sapien
aggttgggtggatgtttctgcttcc

SEQ ID NO: 7094 - DNA, 25 bp, Homo sapien
gtttctgcttccttggcctcttgag

SEQ ID NO: 7095 - DNA, 25 bp, Homo sapien
tggcctcttgagttaaacacctaaa

SEQ ID NO: 7096 - DNA, 25 bp, Homo sapien
attagccaggtcctgtctctactaa

SEQ ID NO: 7097 - DNA, 25 bp, Homo sapien
cttgcttttgtcagctttgttgaag

SEQ ID NO: 7098 - DNA, 25 bp, Homo sapien
gatgcctgtaagtgtgaggccctat

SEQ ID NO: 7099 - DNA, 25 bp, Homo sapien
tgtgaggccctatttctaagctctc

SEQ ID NO: 7100 - DNA, 25 bp, Homo sapien
taagctctctattccattttattgg

SEQ ID NO: 7101 - DNA, 25 bp, Homo sapien
actgtacccctgtagtatagtttca

SEQ ID NO: 7102 - DNA, 25 bp, Homo sapien
acccctgtagtatagtttcaagtca

SEQ ID NO: 7103 - DNA, 25 bp, Homo sapien
ttcttttagtttaggattgccttgg

SEQ ID NO: 7104 - DNA, 25 bp, Homo sapien
ggattgccttggttatttgggttct

SEQ ID NO: 7105 - DNA, 25 bp, Homo sapien
gccttggttatttgggttctttctg

SEQ ID NO: 7106 - DNA, 25 bp, Homo sapien
aagcagtatgaccactttaataata

SEQ ID NO: 7107 - DNA, 25 bp, Homo sapien
gaccactttaataatactgattctt

SEQ ID NO: 7108 - DNA, 25 bp, Homo sapien
aacttgataccccttatagcagctg

SEQ ID NO: 7109 - DNA, 25 bp, Homo sapien
gataccccttatagcagctgtgcat

SEQ ID NO: 7110 - DNA, 25 bp, Homo sapien
atagcagctgtgcatacacaacagg

SEQ ID NO: 7111 - DNA, 25 bp, Homo sapien
gtgcatacacaacaggagctactca

SEQ ID NO: 7112 - DNA, 25 bp, Homo sapien
caggagctactcagaaatatgcctt

SEQ ID NO: 7113 - DNA, 25 bp, Homo sapien
ttctttgaagtgtttctttaccact

SEQ ID NO: 7114 - DNA, 25 bp, Homo sapien
aatagaatatcagccgtccacttat

SEQ ID NO: 7115 - DNA, 25 bp, Homo sapien
tatcagccgtccacttatcttaatg

SEQ ID NO: 7116 - DNA, 25 bp, Homo sapien
gccgtccacttatcttaatgacaat

SEQ ID NO: 7117 - DNA, 25 bp, Homo sapien
ttgtgaattagacactgagtagaat

SEQ ID NO: 7118 - DNA, 25 bp, Homo sapien
gtgacaaagaattgtaggcttttgc

SEQ ID NO: 7119 - DNA, 25 bp, Homo sapien
cttatgattctaagtgtgagacacc

SEQ ID NO: 7120 - DNA, 25 bp, Homo sapien
agtgtgagacaccttataaatgtta

SEQ ID NO: 7121 - DNA, 25 bp, Homo sapien
gtttcagaatttattacacatcatg

SEQ ID NO: 7122 - DNA, 25 bp, Homo sapien
ttacacatcatgatacaactggtga

SEQ ID NO: 7123 - DNA, 25 bp, Homo sapien
gtgaaaaattgaagacctccatgaa

SEQ ID NO: 7124 - DNA, 25 bp, Homo sapien
aaaaattgaagacctccatgaatgt

SEQ ID NO: 7125 - DNA, 25 bp, Homo sapien
agggaggcctttttggtggctcaga

SEQ ID NO: 7126 - DNA, 25 bp, Homo sapien
gagaggagttaatcattcagacctt

SEQ ID NO: 7127 - DNA, 25 bp, Homo sapien
cattcagacctttatcagcagcaga

SEQ ID NO: 7128 - DNA, 25 bp, Homo sapien
agcagcagagtcattagcccttagg

SEQ ID NO: 7129 - DNA, 25 bp, Homo sapien
gcagcagagtcattagcccttaggg

SEQ ID NO: 7130 - DNA, 25 bp, Homo sapien
tgccaaatccccagttatgtgtttt

SEQ ID NO: 7131 - DNA, 25 bp, Homo sapien
tccccagttatgtgttttcattttg

SEQ ID NO: 7132 - DNA, 25 bp, Homo sapien
aagacctttgtccagagcagagcct

SEQ ID NO: 7133 - DNA, 25 bp, Homo sapien
gagcagagcctaaaagattccttcc

SEQ ID NO: 7134 - DNA, 25 bp, Homo sapien
agcagagcctaaaagattccttcca

SEQ ID NO: 7135 - DNA, 25 bp, Homo sapien
atgaaaaacgtgaatatggcaattt

SEQ ID NO: 7136 - DNA, 25 bp, Homo sapien
aaacgtgaatatggcaatttagagt

SEQ ID NO: 7137 - DNA, 25 bp, Homo sapien
cgtgaatatggcaatttagagttaa

SEQ ID NO: 7138 - DNA, 25 bp, Homo sapien
gaaagtgtggatgagggtaaagtac

SEQ ID NO: 7139 - DNA, 25 bp, Homo sapien
gtgatacatatgtgaaagtctctca

SEQ ID NO: 7140 - DNA, 25 bp, Homo sapien
gtgaaagtctctcatatattttcaa

SEQ ID NO: 7141 - DNA, 25 bp, Homo sapien
gagcctggaggcctgacaattgcat

SEQ ID NO: 7142 - DNA, 25 bp, Homo sapien
gaggcctgacaattgcatccgaaaa

SEQ ID NO: 7143 - DNA, 25 bp, Homo sapien
ggcctgacaattgcatccgaaaaat

SEQ ID NO: 7144 - DNA, 25 bp, Homo sapien
acaattgcatccgaaaaatccacag

SEQ ID NO: 7145 - DNA, 25 bp, Homo sapien
gaatattaacgacagtcctcccggg

SEQ ID NO: 7146 - DNA, 25 bp, Homo sapien
tattaacgacagtcctcccgggagc

SEQ ID NO: 7147 - DNA, 25 bp, Homo sapien
caatctgggttttaagtgtggattc

SEQ ID NO: 7148 - DNA, 25 bp, Homo sapien
ctgggttttaagtgtggattcatta

SEQ ID NO: 7149 - DNA, 25 bp, Homo sapien
tatgctgacatgaattatttgtatg

SEQ ID NO: 7150 - DNA, 25 bp, Homo sapien
tgtcttcctgctcccatagtggata

SEQ ID NO: 7151 - DNA, 25 bp, Homo sapien
cttcctgctcccatagtggataaaa

SEQ ID NO: 7152 - DNA, 25 bp, Homo sapien
accacttcgggccataaccttgctg

SEQ ID NO: 7153 - DNA, 25 bp, Homo sapien
aaccttgctggcgactaagtctgaa

SEQ ID NO: 7154 - DNA, 25 bp, Homo sapien
ctaagtctgaagaacttcccgtgat

SEQ ID NO: 7155 - DNA, 25 bp, Homo sapien
gaagaacttcccgtgatttaattct

SEQ ID NO: 7156 - DNA, 25 bp, Homo sapien
tcttttcttcgagtttagtcttagc

SEQ ID NO: 7157 - DNA, 25 bp, Homo sapien
agtcttagctttgacattttaacca

SEQ ID NO: 7158 - DNA, 25 bp, Homo sapien
tggtatgaggtcaccacttctccta

SEQ ID NO: 7159 - DNA, 25 bp, Homo sapien
ttctcctattgtccttctcagtttc

SEQ ID NO: 7160 - DNA, 25 bp, Homo sapien
caacctctcctattccctattttat

SEQ ID NO: 7161 - DNA, 25 bp, Homo sapien
aatagctggaggaccttggcaccac

SEQ ID NO: 7162 - DNA, 25 bp, Homo sapien
actattggtgttatgtgtaaattcc

SEQ ID NO: 7163 - DNA, 25 bp, Homo sapien
acatggactccatttgaacaagata

SEQ ID NO: 7164 - DNA, 25 bp, Homo sapien
gaacaagatacttaattccatcaaa

SEQ ID NO: 7165 - DNA, 25 bp, Homo sapien
tttagtcacaagacactttactacc

SEQ ID NO: 7166 - DNA, 25 bp, Homo sapien
tttactaccatctaccaaagctgta

SEQ ID NO: 7167 - DNA, 25 bp, Homo sapien
aaacacacacattttccatctttga

SEQ ID NO: 7168 - DNA, 25 bp, Homo sapien
atgtctgcagtgaatagcactccct

SEQ ID NO: 7169 - DNA, 25 bp, Homo sapien
atagcactccctttgatgtggcaac

SEQ ID NO: 7170 - DNA, 25 bp, Homo sapien
tgtggcaactgggtcaatcgtgtta

SEQ ID NO: 7171 - DNA, 25 bp, Homo sapien
actgggtcaatcgtgttaacaactg

SEQ ID NO: 7172 - DNA, 25 bp, Homo sapien
gtgttaacaactgtgaattcatctt

SEQ ID NO: 7173 - DNA, 25 bp, Homo sapien
ttttccgcgacagtctcactcgtgt

SEQ ID NO: 7174 - DNA, 25 bp, Homo sapien
aaagaggtcttgtataccaatgttc

SEQ ID NO: 7175 - DNA, 25 bp, Homo sapien
aaatctctaatgactatcagtggat

SEQ ID NO: 7176 - DNA, 25 bp, Homo sapien
aacaaagtatggtctatctacacaa

SEQ ID NO: 7177 - DNA, 25 bp, Homo sapien
atctacacaatgaaacatacccagt

SEQ ID NO: 7178 - DNA, 25 bp, Homo sapien
ggagtgaaattctgatggatgctac

SEQ ID NO: 7179 - DNA, 25 bp, Homo sapien
gaaccttgaggccttatgctagatg

SEQ ID NO: 7180 - DNA, 25 bp, Homo sapien
gccttatgctagatgaaatatgcca

SEQ ID NO: 7181 - DNA, 25 bp, Homo sapien
tgattccacctatctgaaatacctg

SEQ ID NO: 7182 - DNA, 25 bp, Homo sapien
tctgaaatacctggaattctcatat

SEQ ID NO: 7183 - DNA, 25 bp, Homo sapien
gacagtagaatagtggtttccagga

SEQ ID NO: 7184 - DNA, 25 bp, Homo sapien
agatatggagtttcgcttgggatga

SEQ ID NO: 7185 - DNA, 25 bp, Homo sapien
gtattgcttgaggtacactatgaag

SEQ ID NO: 7186 - DNA, 25 bp, Homo sapien
ggtacactatgaaggatggacagaa

SEQ ID NO: 7187 - DNA, 25 bp, Homo sapien
tagggagtcatcttcaggaacgata

SEQ ID NO: 7188 - DNA, 25 bp, Homo sapien
aggaacgataactaatgcatttgac

SEQ ID NO: 7189 - DNA, 25 bp, Homo sapien
gcatttgactaaagtctggtattta

SEQ ID NO: 7190 - DNA, 25 bp, Homo sapien
gaggatgaaaagtccgggccaattc

SEQ ID NO: 7191 - DNA, 25 bp, Homo sapien
ccaattcatgggaggcctttagtgt

SEQ ID NO: 7192 - DNA, 25 bp, Homo sapien
gaggcctttagtgttgagctgatga

SEQ ID NO: 7193 - DNA, 25 bp, Homo sapien
gagctgatgaatttgtacttggttt

SEQ ID NO: 7194 - DNA, 25 bp, Homo sapien
tggtttagagttgcttatccataag

SEQ ID NO: 7195 - DNA, 25 bp, Homo sapien
attataagagtttctggccaggcgt

SEQ ID NO: 7196 - DNA, 25 bp, Homo sapien
aagtgatgttaaggttcatggtcaa

SEQ ID NO: 7197 - DNA, 25 bp, Homo sapien
gttcatggtcaagggaaagctttct

SEQ ID NO: 7198 - DNA, 25 bp, Homo sapien
gaaatggtattttgagttgtactct

SEQ ID NO: 7199 - DNA, 25 bp, Homo sapien
ctctaatgatgagttgaagtcaacc

SEQ ID NO: 7200 - DNA, 25 bp, Homo sapien
gacacgaattaaaaacttacagatc

SEQ ID NO: 7201 - DNA, 25 bp, Homo sapien
cagaaggtcagtaaggctggaacaa

SEQ ID NO: 7202 - DNA, 25 bp, Homo sapien
tcaagctggtgctgataaagtcagc

SEQ ID NO: 7203 - DNA, 25 bp, Homo sapien
gataaagtcagcaaaaggccagatg

SEQ ID NO: 7204 - DNA, 25 bp, Homo sapien
ggccagatgctgcagccttataaac

SEQ ID NO: 7205 - DNA, 25 bp, Homo sapien
gctgcagccttataaactaagtcaa

SEQ ID NO: 7206 - DNA, 25 bp, Homo sapien
gccgaggcggaagggtcaccaggtc

SEQ ID NO: 7207 - DNA, 25 bp, Homo sapien
agggactttcatctccctcagatgt

SEQ ID NO: 7208 - DNA, 25 bp, Homo sapien
tccctgtctaattgtcccttctgaa

SEQ ID NO: 7209 - DNA, 25 bp, Homo sapien
gtcccttctgaagcaatgggtccag

SEQ ID NO: 7210 - DNA, 25 bp, Homo sapien
ttctgaagcaatgggtccaggctgg

SEQ ID NO: 7211 - DNA, 25 bp, Homo sapien
ggaatccctggccagaggtcagcct

SEQ ID NO: 7212 - DNA, 25 bp, Homo sapien
aggcacagtagatcctccacaccga

SEQ ID NO: 7213 - DNA, 25 bp, Homo sapien
acagtagatcctccacaccgagagg

SEQ ID NO: 7214 - DNA, 25 bp, Homo sapien
tccacaccgagaggcccagtaagtg

SEQ ID NO: 7215 - DNA, 25 bp, Homo sapien
gaggcccagtaagtgccgatctgag

SEQ ID NO: 7216 - DNA, 25 bp, Homo sapien
gtaagtgccgatctgaggcagcaaa

SEQ ID NO: 7217 - DNA, 25 bp, Homo sapien
gagcctgccggaagggcgggtggca

SEQ ID NO: 7218 - DNA, 25 bp, Homo sapien
atttgatgcttaatgtgtatgaggc

SEQ ID NO: 7219 - DNA, 25 bp, Homo sapien
tgtgtatgaggcactgtggtgattt

SEQ ID NO: 7220 - DNA, 25 bp, Homo sapien
actgtggtgatttttcatattccag

SEQ ID NO: 7221 - DNA, 25 bp, Homo sapien
tttcatattccagtactccagcctg

SEQ ID NO: 7222 - DNA, 25 bp, Homo sapien
aatttatatttcaacctaagatgta

SEQ ID NO: 7223 - DNA, 25 bp, Homo sapien
atatctctacacatacatacgaaag

SEQ ID NO: 7224 - DNA, 25 bp, Homo sapien
gtttcacaaaacaatgcctaacttt

SEQ ID NO: 7225 - DNA, 25 bp, Homo sapien
gcctaactttgcagcatatgagtca

SEQ ID NO: 7226 - DNA, 25 bp, Homo sapien
catatgagtcatgctttttctattg

SEQ ID NO: 7227 - DNA, 25 bp, Homo sapien
gagtcatgctttttctattgttttt

SEQ ID NO: 7228 - DNA, 25 bp, Homo sapien
aaaatgctaatcaagatctactcat

SEQ ID NO: 7229 - DNA, 25 bp, Homo sapien
cacatctggcctgacgttctcgttg

SEQ ID NO: 7230 - DNA, 25 bp, Homo sapien
tgacgttctcgttgcatcaagccat

SEQ ID NO: 7231 - DNA, 25 bp, Homo sapien
ttgcatcaagccatcatccaccggg

SEQ ID NO: 7232 - DNA, 25 bp, Homo sapien
aatgctgacccactcagtagagcag

SEQ ID NO: 7233 - DNA, 25 bp, Homo sapien
gggacgaagtcaccaatccaggcac

SEQ ID NO: 7234 - DNA, 25 bp, Homo sapien
acttctctctttccagtgtgctgaa

SEQ ID NO: 7235 - DNA, 25 bp, Homo sapien
ctgaagaagggaggtgccacccctc

SEQ ID NO: 7236 - DNA, 25 bp, Homo sapien
ctcctccagataaatggccccagaa

SEQ ID NO: 7237 - DNA, 25 bp, Homo sapien
taaatggccccagaaaacgatccaa

SEQ ID NO: 7238 - DNA, 25 bp, Homo sapien
aaatacccagggagcgattccttat

SEQ ID NO: 7239 - DNA, 25 bp, Homo sapien
cagggagcgattccttatgtacccc

SEQ ID NO: 7240 - DNA, 25 bp, Homo sapien
ggtttgccataccaacattgaggat

SEQ ID NO: 7241 - DNA, 25 bp, Homo sapien
gtttgccataccaacattgaggatc

SEQ ID NO: 7242 - DNA, 25 bp, Homo sapien
tttgccataccaacattgaggatca

SEQ ID NO: 7243 - DNA, 25 bp, Homo sapien
ttgccataccaacattgaggatcat

SEQ ID NO: 7244 - DNA, 25 bp, Homo sapien
tgccataccaacattgaggatcatc

SEQ ID NO: 7245 - DNA, 25 bp, Homo sapien
gccataccaacattgaggatcatct

SEQ ID NO: 7246 - DNA, 25 bp, Homo sapien
ataccaacattgaggatcatcttgc

SEQ ID NO: 7247 - DNA, 25 bp, Homo sapien
taccaacattgaggatcatcttgct

SEQ ID NO: 7248 - DNA, 25 bp, Homo sapien
accaacattgaggatcatcttgctc

SEQ ID NO: 7249 - DNA, 25 bp, Homo sapien
gacctcatctgtaatgccctctcta

SEQ ID NO: 7250 - DNA, 25 bp, Homo sapien
acctcatctgtaatgccctctctag

SEQ ID NO: 7251 - DNA, 25 bp, Homo sapien
atgttcactgtatgtgccaagccta

SEQ ID NO: 7252 - DNA, 25 bp, Homo sapien
actgtatgtgccaagcctaatatga

SEQ ID NO: 7253 - DNA, 25 bp, Homo sapien
gtgccaagcctaatatgagagctat

SEQ ID NO: 7254 - DNA, 25 bp, Homo sapien
ttatagagtttatgctacagcccta

SEQ ID NO: 7255 - DNA, 25 bp, Homo sapien
agagtttatgctacagccctacctt

SEQ ID NO: 7256 - DNA, 25 bp, Homo sapien
acagccctaccttcaggaaacttat

SEQ ID NO: 7257 - DNA, 25 bp, Homo sapien
aggaaacttatctactggacaaaca

SEQ ID NO: 7258 - DNA, 25 bp, Homo sapien
acattgtaattatctagcataggca

SEQ ID NO: 7259 - DNA, 25 bp, Homo sapien
gcataggcaaatatagacagtaaca

SEQ ID NO: 7260 - DNA, 25 bp, Homo sapien
aacagacaggtttacaattattaag

SEQ ID NO: 7261 - DNA, 25 bp, Homo sapien
caattattaagaaagggcagccagg

SEQ ID NO: 7262 - DNA, 25 bp, Homo sapien
gaactctaggagtggtcaagtaaaa

SEQ ID NO: 7263 - DNA, 25 bp, Homo sapien
ggatggatgaggttatggactaaat

SEQ ID NO: 7264 - DNA, 25 bp, Homo sapien
atggactaaattgtatcttcccacc

SEQ ID NO: 7265 - DNA, 25 bp, Homo sapien
ctcccaaatgcagaggttgaagccc

SEQ ID NO: 7266 - DNA, 25 bp, Homo sapien
atgcagaggttgaagccctgactcc

SEQ ID NO: 7267 - DNA, 25 bp, Homo sapien
ttgaagccctgactcccagcgtgag

SEQ ID NO: 7268 - DNA, 25 bp, Homo sapien
gactcccagcgtgagtgtttttgga

SEQ ID NO: 7269 - DNA, 25 bp, Homo sapien
cccagcgtgagtgtttttggaggta

SEQ ID NO: 7270 - DNA, 25 bp, Homo sapien
tactctgagaggactggtatcccaa

SEQ ID NO: 7271 - DNA, 25 bp, Homo sapien
gactggtatcccaataagaagagag

SEQ ID NO: 7272 - DNA, 25 bp, Homo sapien
gttgagactgcgatgagccgggatt

SEQ ID NO: 7273 - DNA, 25 bp, Homo sapien
tgacatgctttttacctgtggccta

SEQ ID NO: 7274 - DNA, 25 bp, Homo sapien
acctgtggcctacatttaacctatt

SEQ ID NO: 7275 - DNA, 25 bp, Homo sapien
cacagagatgtgtatgtcttttttc

SEQ ID NO: 7276 - DNA, 25 bp, Homo sapien
ttttctttccttgactgcgatcatt

SEQ ID NO: 7277 - DNA, 25 bp, Homo sapien
ccttgactgcgatcattttattcac

SEQ ID NO: 7278 - DNA, 25 bp, Homo sapien
agttgctgtcattgctagttgttaa

SEQ ID NO: 7279 - DNA, 25 bp, Homo sapien
cattgctagttgttaagctggtgga

SEQ ID NO: 7280 - DNA, 25 bp, Homo sapien
ggaaaagcttccatttgtattgtca

SEQ ID NO: 7281 - DNA, 25 bp, Homo sapien
gcttccatttgtattgtcatttcta

SEQ ID NO: 7282 - DNA, 25 bp, Homo sapien
cattgttatagctaaattccagttt

SEQ ID NO: 7283 - DNA, 25 bp, Homo sapien
gtatcagtgatcatagggtctaaaa

SEQ ID NO: 7284 - DNA, 25 bp, Homo sapien
tgctggtacctttgaaagggctcat

SEQ ID NO: 7285 - DNA, 25 bp, Homo sapien
aaaagggagatccatcaactgcctc

SEQ ID NO: 7286 - DNA, 25 bp, Homo sapien
tcactatgcatggaatgagctggct

SEQ ID NO: 7287 - DNA, 25 bp, Homo sapien
gaatgagctggctgtttcaatatta

SEQ ID NO: 7288 - DNA, 25 bp, Homo sapien
atattagcttctgtttgactcccac

SEQ ID NO: 7289 - DNA, 25 bp, Homo sapien
tgtttgactcccacatgcaattcaa

SEQ ID NO: 7290 - DNA, 25 bp, Homo sapien
catgcaattcaaaggctcactatat

SEQ ID NO: 7291 - DNA, 25 bp, Homo sapien
gtctgaaattcatctttgttcacca

SEQ ID NO: 7292 - DNA, 25 bp, Homo sapien
tttgttcaccaatccattgtggact

SEQ ID NO: 7293 - DNA, 25 bp, Homo sapien
cattgtggactatagaaactcagat

SEQ ID NO: 7294 - DNA, 25 bp, Homo sapien
tgtaagcagtaaagccaggtgcggt

SEQ ID NO: 7295 - DNA, 25 bp, Homo sapien
ttgcagttcctgtctccacatacga

SEQ ID NO: 7296 - DNA, 25 bp, Homo sapien
ctgtctccacatacgatcccatggg

SEQ ID NO: 7297 - DNA, 25 bp, Homo sapien
gaaattcagtccacaacgggcagca

SEQ ID NO: 7298 - DNA, 25 bp, Homo sapien
aacgggcagcaacacaacttctcag

SEQ ID NO: 7299 - DNA, 25 bp, Homo sapien
gcaacacaacttctcagagccttag

SEQ ID NO: 7300 - DNA, 25 bp, Homo sapien
gccttagcttttcttgtaaaatgaa

SEQ ID NO: 7301 - DNA, 25 bp, Homo sapien
taatacttccttaaagagttctggg

SEQ ID NO: 7302 - DNA, 25 bp, Homo sapien
gaaggattcagtgaagtccctcctt

SEQ ID NO: 7303 - DNA, 25 bp, Homo sapien
gtgaagtccctccttcatgtgaatg

SEQ ID NO: 7304 - DNA, 25 bp, Homo sapien
aaatttttaccattattgtcatcat

SEQ ID NO: 7305 - DNA, 25 bp, Homo sapien
tgaagcaagataactgcttgatccc

SEQ ID NO: 7306 - DNA, 25 bp, Homo sapien
aacattctagtaactggccactgga

SEQ ID NO: 7307 - DNA, 25 bp, Homo sapien
atagccattatgctcatgatacagg

SEQ ID NO: 7308 - DNA, 25 bp, Homo sapien
tacaggcgagcagcaaagggcacca

SEQ ID NO: 7309 - DNA, 25 bp, Homo sapien
gaagctgttgcttaaatgtttgcag

SEQ ID NO: 7310 - DNA, 25 bp, Homo sapien
gcagccagtgcaagacaagtctatg

SEQ ID NO: 7311 - DNA, 25 bp, Homo sapien
caagacaagtctatgggaaattccc

SEQ ID NO: 7312 - DNA, 25 bp, Homo sapien
aaatctgtgctctttacaggacact

SEQ ID NO: 7313 - DNA, 25 bp, Homo sapien
tgtgctctttacaggacactgcgct

SEQ ID NO: 7314 - DNA, 25 bp, Homo sapien
acactgcgctgcctttatgtcagtt

SEQ ID NO: 7315 - DNA, 25 bp, Homo sapien
tttatgtcagttgttgggccttacc

SEQ ID NO: 7316 - DNA, 25 bp, Homo sapien
gggccttacctatctacaatgtgtg

SEQ ID NO: 7317 - DNA, 25 bp, Homo sapien
agtgtgaatttccactcaccctcgt

SEQ ID NO: 7318 - DNA, 25 bp, Homo sapien
accctcgtcgcagctgggtggcttt

SEQ ID NO: 7319 - DNA, 25 bp, Homo sapien
ggctttgcattctcatggccacatt

SEQ ID NO: 7320 - DNA, 25 bp, Homo sapien
catggccacattgaagtttcttctt

SEQ ID NO: 7321 - DNA, 25 bp, Homo sapien
gtttcttcttgttagctcaatgcag

SEQ ID NO: 7322 - DNA, 25 bp, Homo sapien
ttagctcaatgcagggacgctggag

SEQ ID NO: 7323 - DNA, 25 bp, Homo sapien
agaagacatgtctgcacccttgagt

SEQ ID NO: 7324 - DNA, 25 bp, Homo sapien
tgagtcctagtgtcagctcagcaca

SEQ ID NO: 7325 - DNA, 25 bp, Homo sapien
tcagcacacactcaatccatgattg

SEQ ID NO: 7326 - DNA, 25 bp, Homo sapien
ttctcttctgtcaagtggacataat

SEQ ID NO: 7327 - DNA, 25 bp, Homo sapien
aaaatctgggccaggcttgatggct

SEQ ID NO: 7328 - DNA, 25 bp, Homo sapien
tagcttggactacagaactgcttac

SEQ ID NO: 7329 - DNA, 25 bp, Homo sapien
ctacagaactgcttacaatggctaa

SEQ ID NO: 7330 - DNA, 25 bp, Homo sapien
gaactgcttacaatggctaagattt

SEQ ID NO: 7331 - DNA, 25 bp, Homo sapien
cctaagtgtccaacagaggaatgga

SEQ ID NO: 7332 - DNA, 25 bp, Homo sapien
gaagacaagcagcacattttctcac

SEQ ID NO: 7333 - DNA, 25 bp, Homo sapien
aagacaagcagcacattttctcact

SEQ ID NO: 7334 - DNA, 25 bp, Homo sapien
cacttacttgtaggacataaaagtc

SEQ ID NO: 7335 - DNA, 25 bp, Homo sapien
aagtcaaaatgattgggctcatgga

SEQ ID NO: 7336 - DNA, 25 bp, Homo sapien
gattgggctcatggatatagaaagt

SEQ ID NO: 7337 - DNA, 25 bp, Homo sapien
tatagaaagtggaaggatggttacc

SEQ ID NO: 7338 - DNA, 25 bp, Homo sapien
taaagtgtgtaattgagttgtttgt

SEQ ID NO: 7339 - DNA, 25 bp, Homo sapien
ctggtaaaatacaagcgtctagact

SEQ ID NO: 7340 - DNA, 25 bp, Homo sapien
aagcgtctagactctctttagtata

SEQ ID NO: 7341 - DNA, 25 bp, Homo sapien
gtctagactctctttagtataaaac

SEQ ID NO: 7342 - DNA, 25 bp, Homo sapien
ttagcatgtcaattttgaacaaatc

SEQ ID NO: 7343 - DNA, 25 bp, Homo sapien
atgcaatcagcaaacttcagaatgt

SEQ ID NO: 7344 - DNA, 25 bp, Homo sapien
gatactttacaaagcaaaggacttg

SEQ ID NO: 7345 - DNA, 25 bp, Homo sapien
gcaaaggacttggactcttaagtaa

SEQ ID NO: 7346 - DNA, 25 bp, Homo sapien
aagacttcagatttgaccgtcccca

SEQ ID NO: 7347 - DNA, 25 bp, Homo sapien
tgaccgtccccagtatacttatatt

SEQ ID NO: 7348 - DNA, 25 bp, Homo sapien
aactcagtaaaacagcggctcataa

SEQ ID NO: 7349 - DNA, 25 bp, Homo sapien
cagcggctcataatgataagctaca

SEQ ID NO: 7350 - DNA, 25 bp, Homo sapien
gaacttagtatactgcctgtgtcac

SEQ ID NO: 7351 - DNA, 25 bp, Homo sapien
gtatactgcctgtgtcactgcagtt

SEQ ID NO: 7352 - DNA, 25 bp, Homo sapien
tgtcactgcagttcttcagttgctg

SEQ ID NO: 7353 - DNA, 25 bp, Homo sapien
gcagttcttcagttgctgttaaatc

SEQ ID NO: 7354 - DNA, 25 bp, Homo sapien
ggaaatgacatcctgactcactgag

SEQ ID NO: 7355 - DNA, 25 bp, Homo sapien
atcctgactcactgagcaagcctca

SEQ ID NO: 7356 - DNA, 25 bp, Homo sapien
ggattctgaaggtagcatctctcct

SEQ ID NO: 7357 - DNA, 25 bp, Homo sapien
aggatgctgaggtcctgcaaagcct

SEQ ID NO: 7358 - DNA, 25 bp, Homo sapien
ggcttctcagttttacaggactggt

SEQ ID NO: 7359 - DNA, 25 bp, Homo sapien
tggatttagactcaggtttgttttt

SEQ ID NO: 7360 - DNA, 25 bp, Homo sapien
atatataagagctggctcacacctg

SEQ ID NO: 7361 - DNA, 25 bp, Homo sapien
acctgtcctgacacgtgcatttaaa

SEQ ID NO: 7362 - DNA, 25 bp, Homo sapien
cgtgcatttaaagcaagaaacacac

SEQ ID NO: 7363 - DNA, 25 bp, Homo sapien
agaaacacacacttccaggacatag

SEQ ID NO: 7364 - DNA, 25 bp, Homo sapien
acacttccaggacatagggctctgt

SEQ ID NO: 7365 - DNA, 25 bp, Homo sapien
aggacatagggctctgtcagcaata

SEQ ID NO: 7366 - DNA, 25 bp, Homo sapien
gggctctgtcagcaataactgtcat

SEQ ID NO: 7367 - DNA, 25 bp, Homo sapien
tcagcaataactgtcatctttgtat

SEQ ID NO: 7368 - DNA, 25 bp, Homo sapien
atatataagaaaccggctgggcacg

SEQ ID NO: 7369 - DNA, 25 bp, Homo sapien
gcctaggcaatggagcgaaaccctg

SEQ ID NO: 7370 - DNA, 25 bp, Homo sapien
agctggaattatggcacgcaccgcc

SEQ ID NO: 7371 - DNA, 25 bp, Homo sapien
tggaattatggcacgcaccgccacg

SEQ ID NO: 7372 - DNA, 25 bp, Homo sapien
tggacaacagccgtgtgatcctgtg

SEQ ID NO: 7373 - DNA, 25 bp, Homo sapien
gacaacagccgtgtgatcctgtgtg

SEQ ID NO: 7374 - DNA, 25 bp, Homo sapien
aacagccgtgtgatcctgtgtgaca

SEQ ID NO: 7375 - DNA, 25 bp, Homo sapien
acagccgtgtgatcctgtgtgacat

SEQ ID NO: 7376 - DNA, 25 bp, Homo sapien
agccgtgtgatcctgtgtgacatga

SEQ ID NO: 7377 - DNA, 25 bp, Homo sapien
atgccttctggttctgcctggcatg

SEQ ID NO: 7378 - DNA, 25 bp, Homo sapien
ttctggttctgcctggcatggtgca

SEQ ID NO: 7379 - DNA, 25 bp, Homo sapien
gtcctatccggaaacgcctcagctc

SEQ ID NO: 7380 - DNA, 25 bp, Homo sapien
accagctctgaggagactcagctct

SEQ ID NO: 7381 - DNA, 25 bp, Homo sapien
gctctgaggagactcagctcttcca

SEQ ID NO: 7382 - DNA, 25 bp, Homo sapien
ccgggttacctccctgaagctgtag

SEQ ID NO: 7383 - DNA, 25 bp, Homo sapien
gtgctaagatctgaaccgaggtcat

SEQ ID NO: 7384 - DNA, 25 bp, Homo sapien
tgaaccgaggtcatcttgtcccggg

SEQ ID NO: 7385 - DNA, 25 bp, Homo sapien
ttccaggcagcgtcccttgtttggg

SEQ ID NO: 7386 - DNA, 25 bp, Homo sapien
gggccctctgagatgccttcagacc

SEQ ID NO: 7387 - DNA, 25 bp, Homo sapien
gcctgtggcggaagagctttgtcct

SEQ ID NO: 7388 - DNA, 25 bp, Homo sapien
aagagctttgtcctggcctgatctg

SEQ ID NO: 7389 - DNA, 25 bp, Homo sapien
tgatctgccctgtccgtgacgcttc

SEQ ID NO: 7390 - DNA, 25 bp, Homo sapien
gtgacgcttctgctcagtagctgag

SEQ ID NO: 7391 - DNA, 25 bp, Homo sapien
ctgagcacgccctgtggtgtggaca

SEQ ID NO: 7392 - DNA, 25 bp, Homo sapien
gggctcagtccagaagcctctggtg

SEQ ID NO: 7393 - DNA, 25 bp, Homo sapien
gggcctcagggctgttaaaatccca

SEQ ID NO: 7394 - DNA, 25 bp, Homo sapien
aatgtacataatgcctccgaatggt

SEQ ID NO: 7395 - DNA, 25 bp, Homo sapien
tacataatgcctccgaatggtacac

SEQ ID NO: 7396 - DNA, 25 bp, Homo sapien
aatgcctccgaatggtacacttcac

SEQ ID NO: 7397 - DNA, 25 bp, Homo sapien
cctccgaatggtacacttcactgtg

SEQ ID NO: 7398 - DNA, 25 bp, Homo sapien
gaatggtacacttcactgtggttaa

SEQ ID NO: 7399 - DNA, 25 bp, Homo sapien
atggtacacttcactgtggttaaaa

SEQ ID NO: 7400 - DNA, 25 bp, Homo sapien
ggcaaatcttatgtctattttatca

SEQ ID NO: 7401 - DNA, 25 bp, Homo sapien
aaatcttatgtctattttatcacaa

SEQ ID NO: 7402 - DNA, 25 bp, Homo sapien
aaactcagaaataggcagcagcagc

SEQ ID NO: 7403 - DNA, 25 bp, Homo sapien
gcagctaaagataagcagaacaacc

SEQ ID NO: 7404 - DNA, 25 bp, Homo sapien
gttcatgttcatattcatgtaagaa

SEQ ID NO: 7405 - DNA, 25 bp, Homo sapien
gggtaagtatcaaaaccttgatctt

SEQ ID NO: 7406 - DNA, 25 bp, Homo sapien
aaaaccttgatcttctaataccaca

SEQ ID NO: 7407 - DNA, 25 bp, Homo sapien
accttgatcttctaataccacatat

SEQ ID NO: 7408 - DNA, 25 bp, Homo sapien
ttgatcttctaataccacatattct

SEQ ID NO: 7409 - DNA, 25 bp, Homo sapien
aaggtggagagtagaattgtagtta

SEQ ID NO: 7410 - DNA, 25 bp, Homo sapien
attgtagttattagaggatgcgaag

SEQ ID NO: 7411 - DNA, 25 bp, Homo sapien
agaggagtaagttctagtgttttgt

SEQ ID NO: 7412 - DNA, 25 bp, Homo sapien
gtagggtgaatatggttaacagtaa

SEQ ID NO: 7413 - DNA, 25 bp, Homo sapien
gacaggattctgaatattcacaaag

SEQ ID NO: 7414 - DNA, 25 bp, Homo sapien
atgataaatattcagctgggcgtgg

SEQ ID NO: 7415 - DNA, 25 bp, Homo sapien
gggcgtggttgctcgcgcctatatt

SEQ ID NO: 7416 - DNA, 25 bp, Homo sapien
ttctattataaagtggcaccattgg

SEQ ID NO: 7417 - DNA, 25 bp, Homo sapien
aaagtggcaccattggagtctaagg

SEQ ID NO: 7418 - DNA, 25 bp, Homo sapien
caccattggagtctaagggtgcttg

SEQ ID NO: 7419 - DNA, 25 bp, Homo sapien
gttgcctataaagcatatttcccag

SEQ ID NO: 7420 - DNA, 25 bp, Homo sapien
taaagcatatttcccagttctactc

SEQ ID NO: 7421 - DNA, 25 bp, Homo sapien
agcatatttcccagttctactctct

SEQ ID NO: 7422 - DNA, 25 bp, Homo sapien
acgcccggcctggagtagatgcttt

SEQ ID NO: 7423 - DNA, 25 bp, Homo sapien
cccggcctggagtagatgctttcta

SEQ ID NO: 7424 - DNA, 25 bp, Homo sapien
cggcctggagtagatgctttctaaa

SEQ ID NO: 7425 - DNA, 25 bp, Homo sapien
gatgctttctaaaggaacttccacc

SEQ ID NO: 7426 - DNA, 25 bp, Homo sapien
ggaacttccacctttaaaatctgtg

SEQ ID NO: 7427 - DNA, 25 bp, Homo sapien
agagaacgcctcagggtcttgcctg

SEQ ID NO: 7428 - DNA, 25 bp, Homo sapien
tcttgcctgctgtgagtgccttgaa

SEQ ID NO: 7429 - DNA, 25 bp, Homo sapien
tgcctgctgtgagtgccttgaagag

SEQ ID NO: 7430 - DNA, 25 bp, Homo sapien
agcagcgggcacgatcaaagagaca

SEQ ID NO: 7431 - DNA, 25 bp, Homo sapien
gggcacgatcaaagagacacctggc

SEQ ID NO: 7432 - DNA, 25 bp, Homo sapien
aagagacacctggctcaaggaccaa

SEQ ID NO: 7433 - DNA, 25 bp, Homo sapien
aagctcccatccgtgtcaggaattt

SEQ ID NO: 7434 - DNA, 25 bp, Homo sapien
gaatttgaccatcagagcaggagcc

SEQ ID NO: 7435 - DNA, 25 bp, Homo sapien
cagaacctttgtctctgccctgtac

SEQ ID NO: 7436 - DNA, 25 bp, Homo sapien
aggtccccaaagtctctgaccaggc

SEQ ID NO: 7437 - DNA, 25 bp, Homo sapien
tctgaccaggctttggtttctgccc

SEQ ID NO: 7438 - DNA, 25 bp, Homo sapien
tatttttgacagctgtgtaatggaa

SEQ ID NO: 7439 - DNA, 25 bp, Homo sapien
atatctgactatttcctaagcaaaa

SEQ ID NO: 7440 - DNA, 25 bp, Homo sapien
gtaggataataaactgacttctctt

SEQ ID NO: 7441 - DNA, 25 bp, Homo sapien
acatgacagaaagggtagccattac

SEQ ID NO: 7442 - DNA, 25 bp, Homo sapien
gggtagccattacagtagatactca

SEQ ID NO: 7443 - DNA, 25 bp, Homo sapien
agatactcagaacttgttcccctgt

SEQ ID NO: 7444 - DNA, 25 bp, Homo sapien
tgttcccctgtgtctctttattgtg

SEQ ID NO: 7445 - DNA, 25 bp, Homo sapien
gtgtctctttattgtgcttattttt

SEQ ID NO: 7446 - DNA, 25 bp, Homo sapien
ttgcatcctaaatacttagctgagg

SEQ ID NO: 7447 - DNA, 25 bp, Homo sapien
aatacgttaatttccacttcaaatg

SEQ ID NO: 7448 - DNA, 25 bp, Homo sapien
taatttccacttcaaatgcagtttt

SEQ ID NO: 7449 - DNA, 25 bp, Homo sapien
gtgcactatgccaacatgtatcctg

SEQ ID NO: 7450 - DNA, 25 bp, Homo sapien
gcagtatggaaattccacccgtgga

SEQ ID NO: 7451 - DNA, 25 bp, Homo sapien
acccgtggagacaggaagccctctt

SEQ ID NO: 7452 - DNA, 25 bp, Homo sapien
gaagccctcttaagaagtcttccgt

SEQ ID NO: 7453 - DNA, 25 bp, Homo sapien
taaggtcttaccttggcttctccca

SEQ ID NO: 7454 - DNA, 25 bp, Homo sapien
ttggcttctcccagaaagggcagtc

SEQ ID NO: 7455 - DNA, 25 bp, Homo sapien
aaagggcagtctgagccgacggcct

SEQ ID NO: 7456 - DNA, 25 bp, Homo sapien
acggcctgtgtgtcagtggtttatt

SEQ ID NO: 7457 - DNA, 25 bp, Homo sapien
gtttattttgataagccatcctagg

SEQ ID NO: 7458 - DNA, 25 bp, Homo sapien
aatctagcagaacgaaagccatgtg

SEQ ID NO: 7459 - DNA, 25 bp, Homo sapien
aagccatgtgagatcgtgccttggt

SEQ ID NO: 7460 - DNA, 25 bp, Homo sapien
gtcgtttggactgggagactcttgt

SEQ ID NO: 7461 - DNA, 25 bp, Homo sapien
ctgggagactcttgtgcacgaaaat

SEQ ID NO: 7462 - DNA, 25 bp, Homo sapien
tgtgcacgaaaatctgcccgggcta

SEQ ID NO: 7463 - DNA, 25 bp, Homo sapien
atctgcccgggctaatggaaatgga

SEQ ID NO: 7464 - DNA, 25 bp, Homo sapien
atcaggatgaccgtgtttggcccag

SEQ ID NO: 7465 - DNA, 25 bp, Homo sapien
gtgtttggcccagagactcactctt

SEQ ID NO: 7466 - DNA, 25 bp, Homo sapien
gagactcactcttccgatattttga

SEQ ID NO: 7467 - DNA, 25 bp, Homo sapien
tcttccgatattttgagttgctaga

SEQ ID NO: 7468 - DNA, 25 bp, Homo sapien
ttttgagttgctagaaaagcttcag

SEQ ID NO: 7469 - DNA, 25 bp, Homo sapien
agttacaagagtttgcagtgcaggc

SEQ ID NO: 7470 - DNA, 25 bp, Homo sapien
agtgcaggcactgatgaacttggaa

SEQ ID NO: 7471 - DNA, 25 bp, Homo sapien
gcgggaggtcgtcggtggcctctga

SEQ ID NO: 7472 - DNA, 25 bp, Homo sapien
cctgtgcccaggttgccaatgccaa

SEQ ID NO: 7473 - DNA, 25 bp, Homo sapien
aggtgagtggcctcctcgggtcccg

SEQ ID NO: 7474 - DNA, 25 bp, Homo sapien
tgaagcatgggtgtgctccccatgg

SEQ ID NO: 7475 - DNA, 25 bp, Homo sapien
aagagcacccagaaggctagtccgc

SEQ ID NO: 7476 - DNA, 25 bp, Homo sapien
acacagcgagtcagccaaggccaag

SEQ ID NO: 7477 - DNA, 25 bp, Homo sapien
cagcgagtcagccaaggccaagacc

SEQ ID NO: 7478 - DNA, 25 bp, Homo sapien
ggccaagaccaacccgcgctgcgaa

SEQ ID NO: 7479 - DNA, 25 bp, Homo sapien
gcgctgcgaactcgtggcttcctca

SEQ ID NO: 7480 - DNA, 25 bp, Homo sapien
ttcctcactgcagtcctccgtgttt

SEQ ID NO: 7481 - DNA, 25 bp, Homo sapien
tggagcaactgtggcttcccattcc

SEQ ID NO: 7482 - DNA, 25 bp, Homo sapien
aatagaacttggctaaccatctgcc

SEQ ID NO: 7483 - DNA, 25 bp, Homo sapien
ggctaaccatctgccaataagagaa

SEQ ID NO: 7484 - DNA, 25 bp, Homo sapien
gctaaatcagagaggcaggaaagtc

SEQ ID NO: 7485 - DNA, 25 bp, Homo sapien
gtctatttcagtaaaagctattttg

SEQ ID NO: 7486 - DNA, 25 bp, Homo sapien
attttgatctgaaatactgtaggca

SEQ ID NO: 7487 - DNA, 25 bp, Homo sapien
tactgtaggcagtcttacagagtat

SEQ ID NO: 7488 - DNA, 25 bp, Homo sapien
gggaggatattgatgcatgctagta

SEQ ID NO: 7489 - DNA, 25 bp, Homo sapien
aagaagtgtatttgctgatatggtt

SEQ ID NO: 7490 - DNA, 25 bp, Homo sapien
ttcagtgctaatttgttgatacttt

SEQ ID NO: 7491 - DNA, 25 bp, Homo sapien
cagtatttgtatgatgcctatggaa

SEQ ID NO: 7492 - DNA, 25 bp, Homo sapien
gatgcctatggaagacatatggatt

SEQ ID NO: 7493 - DNA, 25 bp, Homo sapien
gatgcaatagagacatctggtattt

SEQ ID NO: 7494 - DNA, 25 bp, Homo sapien
gagacatctggtatttaaaatcttt

SEQ ID NO: 7495 - DNA, 25 bp, Homo sapien
gatgtgtgtgctatagcttatgtgt

SEQ ID NO: 7496 - DNA, 25 bp, Homo sapien
gtgctatagcttatgtgtttgtaaa

SEQ ID NO: 7497 - DNA, 25 bp, Homo sapien
cttgtctttgttatctataccaaga

SEQ ID NO: 7498 - DNA, 25 bp, Homo sapien
ctataccaagatataactggctgaa

SEQ ID NO: 7499 - DNA, 25 bp, Homo sapien
ttattatgcatggaaagcactctgt

SEQ ID NO: 7500 - DNA, 25 bp, Homo sapien
aagcactctgtaaaccttgtgaagt

SEQ ID NO: 7501 - DNA, 25 bp, Homo sapien
ctctgtaaaccttgtgaagtgataa

SEQ ID NO: 7502 - DNA, 25 bp, Homo sapien
ataactattgactcttgttttgttt

SEQ ID NO: 7503 - DNA, 25 bp, Homo sapien
actagcattgttaatatatactgat

SEQ ID NO: 7504 - DNA, 25 bp, Homo sapien
aggtcactctcagggattcagggaa

SEQ ID NO: 7505 - DNA, 25 bp, Homo sapien
agaaaggccaagttctgggcatgtg

SEQ ID NO: 7506 - DNA, 25 bp, Homo sapien
gctgcaggcatgtcttacgggacag

SEQ ID NO: 7507 - DNA, 25 bp, Homo sapien
tgtcttacgggacagagacagcccc

SEQ ID NO: 7508 - DNA, 25 bp, Homo sapien
gaggactggcctcccgataactctg

SEQ ID NO: 7509 - DNA, 25 bp, Homo sapien
tgttctgcctggagtgtccttgtgc

SEQ ID NO: 7510 - DNA, 25 bp, Homo sapien
gtgtccttgtgctggacttcctcca

SEQ ID NO: 7511 - DNA, 25 bp, Homo sapien
gcaacctcacccttacagaaaaata

SEQ ID NO: 7512 - DNA, 25 bp, Homo sapien
tcctccttctaagtcagggacagat

SEQ ID NO: 7513 - DNA, 25 bp, Homo sapien
gtatactgatctgtttcttgtcact

SEQ ID NO: 7514 - DNA, 25 bp, Homo sapien
gggtcagctaccttggattcctcct

SEQ ID NO: 7515 - DNA, 25 bp, Homo sapien
atggaagcccggctctgcaacatcc

SEQ ID NO: 7516 - DNA, 25 bp, Homo sapien
atcctcgtctgcacagtcatgacat

SEQ ID NO: 7517 - DNA, 25 bp, Homo sapien
gcctttctgggcagtctggaagcag

SEQ ID NO: 7518 - DNA, 25 bp, Homo sapien
caaagaacccagtggcgggaatcct

SEQ ID NO: 7519 - DNA, 25 bp, Homo sapien
gggaatcctccagctatggccagca

SEQ ID NO: 7520 - DNA, 25 bp, Homo sapien
gcagccacagtggacagccagagac

SEQ ID NO: 7521 - DNA, 25 bp, Homo sapien
acagccagagacacaggaccttagc

SEQ ID NO: 7522 - DNA, 25 bp, Homo sapien
cacaggaccttagcggatgatcgga

SEQ ID NO: 7523 - DNA, 25 bp, Homo sapien
gagaattttacagcaggaagccttt

SEQ ID NO: 7524 - DNA, 25 bp, Homo sapien
ttgatatgggtgaccttcacctcca

SEQ ID NO: 7525 - DNA, 25 bp, Homo sapien
ggtacagccttgtcttgggttaaat

SEQ ID NO: 7526 - DNA, 25 bp, Homo sapien
aatagttagccgagtatgggggtgt

SEQ ID NO: 7527 - DNA, 25 bp, Homo sapien
ggtgtgcttggtatggcttgagccc

SEQ ID NO: 7528 - DNA, 25 bp, Homo sapien
tgtgcttggtatggcttgagcccag

SEQ ID NO: 7529 - DNA, 25 bp, Homo sapien
tttgaggctgcaccgagcaatgact

SEQ ID NO: 7530 - DNA, 25 bp, Homo sapien
caagctgaaacaatgcaaactggtt

SEQ ID NO: 7531 - DNA, 25 bp, Homo sapien
gcaaactggttttatattagatacg

SEQ ID NO: 7532 - DNA, 25 bp, Homo sapien
actggttttatattagatacgtgac

SEQ ID NO: 7533 - DNA, 25 bp, Homo sapien
gatacgtgacttaaaatatctcaat

SEQ ID NO: 7534 - DNA, 25 bp, Homo sapien
atacgtgacttaaaatatctcaata

SEQ ID NO: 7535 - DNA, 25 bp, Homo sapien
aaatatctcaatacagttttctcca

SEQ ID NO: 7536 - DNA, 25 bp, Homo sapien
atatctcaatacagttttctccaaa

SEQ ID NO: 7537 - DNA, 25 bp, Homo sapien
gggaaaatggtgacaaccagtctct

SEQ ID NO: 7538 - DNA, 25 bp, Homo sapien
aatggtgacaaccagtctctacaaa

SEQ ID NO: 7539 - DNA, 25 bp, Homo sapien
aggcccagcaacttgtaggactgag

SEQ ID NO: 7540 - DNA, 25 bp, Homo sapien
agcaacttgtaggactgaggcgaga

SEQ ID NO: 7541 - DNA, 25 bp, Homo sapien
aattagagggacttacagagcacgt

SEQ ID NO: 7542 - DNA, 25 bp, Homo sapien
gagggacttacagagcacgtagcaa

SEQ ID NO: 7543 - DNA, 25 bp, Homo sapien
gagcacgtagcaagggacctgactc

SEQ ID NO: 7544 - DNA, 25 bp, Homo sapien
gtagcaagggacctgactccatgtg

SEQ ID NO: 7545 - DNA, 25 bp, Homo sapien
agggacctgactccatgtgaaagaa

SEQ ID NO: 7546 - DNA, 25 bp, Homo sapien
gaaagaactcaagtgcaccagcctg

SEQ ID NO: 7547 - DNA, 25 bp, Homo sapien
gaactcaagtgcaccagcctggcca

SEQ ID NO: 7548 - DNA, 25 bp, Homo sapien
gaagaccccaccagaaatggagagc

SEQ ID NO: 7549 - DNA, 25 bp, Homo sapien
aatggagagcacacagcagaatggg

SEQ ID NO: 7550 - DNA, 25 bp, Homo sapien
gaatgggtgatcacagtgttctcaa

SEQ ID NO: 7551 - DNA, 25 bp, Homo sapien
gtgttctcaacagcaaatagtgggt

SEQ ID NO: 7552 - DNA, 25 bp, Homo sapien
gggtgtctaaagtccatttctgggc

SEQ ID NO: 7553 - DNA, 25 bp, Homo sapien
catttctgggctttgcatgggtcaa

SEQ ID NO: 7554 - DNA, 25 bp, Homo sapien
aaaggtaatccaatctcaccctcat

SEQ ID NO: 7555 - DNA, 25 bp, Homo sapien
gagaccaagaacaacttccatgagg

SEQ ID NO: 7556 - DNA, 25 bp, Homo sapien
tgttctctccccagtacgaattttg

SEQ ID NO: 7557 - DNA, 25 bp, Homo sapien
ctccccagtacgaattttgtccata

SEQ ID NO: 7558 - DNA, 25 bp, Homo sapien
cttgttgtttgcgtcaactttactt

SEQ ID NO: 7559 - DNA, 25 bp, Homo sapien
attctaaacattttgtctgatcacg

SEQ ID NO: 7560 - DNA, 25 bp, Homo sapien
taaacattttgtctgatcacgaggg

SEQ ID NO: 7561 - DNA, 25 bp, Homo sapien
acattttgtctgatcacgagggaat

SEQ ID NO: 7562 - DNA, 25 bp, Homo sapien
gtctgatcacgagggaatgaaacta

SEQ ID NO: 7563 - DNA, 25 bp, Homo sapien
tcacgagggaatgaaactagaaatc

SEQ ID NO: 7564 - DNA, 25 bp, Homo sapien
aatactgggtcaaagaataaatcaa

SEQ ID NO: 7565 - DNA, 25 bp, Homo sapien
taaaaacacagtatacccaaacata

SEQ ID NO: 7566 - DNA, 25 bp, Homo sapien
gtatacccaaacatataggatgcag

SEQ ID NO: 7567 - DNA, 25 bp, Homo sapien
tacccaaacatataggatgcagtaa

SEQ ID NO: 7568 - DNA, 25 bp, Homo sapien
tgcgtggctctagtcccacctactt

SEQ ID NO: 7569 - DNA, 25 bp, Homo sapien
tacttgggactcccacctactcggg

SEQ ID NO: 7570 - DNA, 25 bp, Homo sapien
ttctgaggcctctaggttgggagcc

SEQ ID NO: 7571 - DNA, 25 bp, Homo sapien
gggagatggtggtgccattatccaa

SEQ ID NO: 7572 - DNA, 25 bp, Homo sapien
ggtggtgccattatccaagtaaagg

SEQ ID NO: 7573 - DNA, 25 bp, Homo sapien
gaacttaagtttgtaatgcctgtag

SEQ ID NO: 7574 - DNA, 25 bp, Homo sapien
gtttgtaatgcctgtaggccattca

SEQ ID NO: 7575 - DNA, 25 bp, Homo sapien
aggccattcaggctatatccagaaa

SEQ ID NO: 7576 - DNA, 25 bp, Homo sapien
ggctatatccagaaaccatcttaaa

SEQ ID NO: 7577 - DNA, 25 bp, Homo sapien
aaatcttgagtggatgagcacagat

SEQ ID NO: 7578 - DNA, 25 bp, Homo sapien
gagcacagattcttatctgggtcat

SEQ ID NO: 7579 - DNA, 25 bp, Homo sapien
tctgggtcattggttaggtgaaatt

SEQ ID NO: 7580 - DNA, 25 bp, Homo sapien
aaattgcaatcatggccaggcgcgg

SEQ ID NO: 7581 - DNA, 25 bp, Homo sapien
ctttcttgaccattcccacaaatga

SEQ ID NO: 7582 - DNA, 25 bp, Homo sapien
caaatgacatatctctgctatgacc

SEQ ID NO: 7583 - DNA, 25 bp, Homo sapien
gacctaaatatgtgacccttctttt

SEQ ID NO: 7584 - DNA, 25 bp, Homo sapien
tgcctgtaccctgctaacagagaag

SEQ ID NO: 7585 - DNA, 25 bp, Homo sapien
gtgcattgtatcttgtgctaacctt

SEQ ID NO: 7586 - DNA, 25 bp, Homo sapien
atcttgtgctaaccttctatctcag

SEQ ID NO: 7587 - DNA, 25 bp, Homo sapien
ttctatctcagcctgtgaccaagaa

SEQ ID NO: 7588 - DNA, 25 bp, Homo sapien
gtgaccaagaatgcctaactgccgg

SEQ ID NO: 7589 - DNA, 25 bp, Homo sapien
taggtctcaacctcaatttgcccag

SEQ ID NO: 7590 - DNA, 25 bp, Homo sapien
aatagagtcactctggtttaaatgc

SEQ ID NO: 7591 - DNA, 25 bp, Homo sapien
agataccttgttttattctgtctaa

SEQ ID NO: 7592 - DNA, 25 bp, Homo sapien
gccaggaattcgtgactagcctgac

SEQ ID NO: 7593 - DNA, 25 bp, Homo sapien
aaggatgcggccataccagacggaa

SEQ ID NO: 7594 - DNA, 25 bp, Homo sapien
cagacggaacctttgtccacagggt

SEQ ID NO: 7595 - DNA, 25 bp, Homo sapien
agggtccctgtaaccagagctgttg

SEQ ID NO: 7596 - DNA, 25 bp, Homo sapien
gagcaggcgaaatttctgggccaat

SEQ ID NO: 7597 - DNA, 25 bp, Homo sapien
aatgtttaaacctgcctgaactcca

SEQ ID NO: 7598 - DNA, 25 bp, Homo sapien
ctctccctctttgttgtttgtatgc

SEQ ID NO: 7599 - DNA, 25 bp, Homo sapien
gtttgtatgccgtgctcagaagcta

SEQ ID NO: 7600 - DNA, 25 bp, Homo sapien
gaagctagccagaggattccgttca

SEQ ID NO: 7601 - DNA, 25 bp, Homo sapien
gataattgcgttttgtgtatgccat

SEQ ID NO: 7602 - DNA, 25 bp, Homo sapien
gtttcttagaatttggccgggcatg

SEQ ID NO: 7603 - DNA, 25 bp, Homo sapien
gtccactacatgtccttccgtttct

SEQ ID NO: 7604 - DNA, 25 bp, Homo sapien
cgtttctctcttcacatcttccatt

SEQ ID NO: 7605 - DNA, 25 bp, Homo sapien
attccacttttcactctctggtcct

SEQ ID NO: 7606 - DNA, 25 bp, Homo sapien
acttttcactctctggtccttccat

SEQ ID NO: 7607 - DNA, 25 bp, Homo sapien
aaccttccattccattcttcacatt

SEQ ID NO: 7608 - DNA, 25 bp, Homo sapien
ttcacattctttcactccacctaaa

SEQ ID NO: 7609 - DNA, 25 bp, Homo sapien
acctttcaatttcacccttcatata

SEQ ID NO: 7610 - DNA, 25 bp, Homo sapien
ttcaatttcacccttcatatacttc

SEQ ID NO: 7611 - DNA, 25 bp, Homo sapien
aatttcacccttcatatacttccac

SEQ ID NO: 7612 - DNA, 25 bp, Homo sapien
ttcatatacttccacccggcttggc

SEQ ID NO: 7613 - DNA, 25 bp, Homo sapien
ttccacccggcttggcgcagtggct

SEQ ID NO: 7614 - DNA, 25 bp, Homo sapien
attctgatgagaaaggattcgacct

SEQ ID NO: 7615 - DNA, 25 bp, Homo sapien
aggattcgacctttgtcaggaaact

SEQ ID NO: 7616 - DNA, 25 bp, Homo sapien
gacctttgtcaggaaactggcctat

SEQ ID NO: 7617 - DNA, 25 bp, Homo sapien
actggcctattgaagtaactccctt

SEQ ID NO: 7618 - DNA, 25 bp, Homo sapien
gaagtaactcccttaggctgcagtt

SEQ ID NO: 7619 - DNA, 25 bp, Homo sapien
ggctgcagtttacctttcagactag

SEQ ID NO: 7620 - DNA, 25 bp, Homo sapien
cagtttacctttcagactagctttc

SEQ ID NO: 7621 - DNA, 25 bp, Homo sapien
aactccctccgcaggtaagtcttca

SEQ ID NO: 7622 - DNA, 25 bp, Homo sapien
gcaggtaagtcttcacagccaggtg

SEQ ID NO: 7623 - DNA, 25 bp, Homo sapien
tttaggaacacaacttcatggtagt

SEQ ID NO: 7624 - DNA, 25 bp, Homo sapien
ggtagttacctttagatgattgtga

SEQ ID NO: 7625 - DNA, 25 bp, Homo sapien
gccaattttgcccagtttttattgg

SEQ ID NO: 7626 - DNA, 25 bp, Homo sapien
tttttattgggctattcccttattg

SEQ ID NO: 7627 - DNA, 25 bp, Homo sapien
gggctattcccttattgagatctaa

SEQ ID NO: 7628 - DNA, 25 bp, Homo sapien
attgagatctaagggctctttgtat

SEQ ID NO: 7629 - DNA, 25 bp, Homo sapien
gctctttgtattctagtcaggagta

SEQ ID NO: 7630 - DNA, 25 bp, Homo sapien
gtcaggagtattttgttaactgtat

SEQ ID NO: 7631 - DNA, 25 bp, Homo sapien
ttttgcaagtgttttgtctgtggct

SEQ ID NO: 7632 - DNA, 25 bp, Homo sapien
gtctgtggcttcctgtttaattttt

SEQ ID NO: 7633 - DNA, 25 bp, Homo sapien
gatgttttttgtgttgtattcaaga

SEQ ID NO: 7634 - DNA, 25 bp, Homo sapien
aaatctttgtcatgcaaaggtcact

SEQ ID NO: 7635 - DNA, 25 bp, Homo sapien
gtcatgcaaaggtcacttaagattt

SEQ ID NO: 7636 - DNA, 25 bp, Homo sapien
gaagaacaattgctattcgacagag

SEQ ID NO: 7637 - DNA, 25 bp, Homo sapien
aattgctattcgacagagctgtagt

SEQ ID NO: 7638 - DNA, 25 bp, Homo sapien
acagagctgtagtgtgactatgatt

SEQ ID NO: 7639 - DNA, 25 bp, Homo sapien
cccagccaaaacttcttataatagt

SEQ ID NO: 7640 - DNA, 25 bp, Homo sapien
gtactttttagcttatggcaccctg

SEQ ID NO: 7641 - DNA, 25 bp, Homo sapien
ttagcttatggcaccctgcagagag

SEQ ID NO: 7642 - DNA, 25 bp, Homo sapien
atggcaccctgcagagagttagttc

SEQ ID NO: 7643 - DNA, 25 bp, Homo sapien
gcagagagttagttcaggagctgta

SEQ ID NO: 7644 - DNA, 25 bp, Homo sapien
gttcaggagctgtatggttgttact

SEQ ID NO: 7645 - DNA, 25 bp, Homo sapien
gctgtatggttgttactgagatgta

SEQ ID NO: 7646 - DNA, 25 bp, Homo sapien
tgtttttcatccttttataacgaag

SEQ ID NO: 7647 - DNA, 25 bp, Homo sapien
cagtcccttgaccagcaggagttgg

SEQ ID NO: 7648 - DNA, 25 bp, Homo sapien
caggagttggtaactgttgaataat

SEQ ID NO: 7649 - DNA, 25 bp, Homo sapien
ttgaataatgacacttctctccctc

SEQ ID NO: 7650 - DNA, 25 bp, Homo sapien
actattgctcacttatttaatgaaa

SEQ ID NO: 7651 - DNA, 25 bp, Homo sapien
gaaacagcataaagtccagacccta

SEQ ID NO: 7652 - DNA, 25 bp, Homo sapien
gcataaagtccagaccctattttaa

SEQ ID NO: 7653 - DNA, 25 bp, Homo sapien
acgagacgtttactgcatctcttta

SEQ ID NO: 7654 - DNA, 25 bp, Homo sapien
gacgtttactgcatctctttaattt

SEQ ID NO: 7655 - DNA, 25 bp, Homo sapien
gtttactgcatctctttaattttaa

SEQ ID NO: 7656 - DNA, 25 bp, Homo sapien
aaattgccagatgggtgagaggaca

SEQ ID NO: 7657 - DNA, 25 bp, Homo sapien
gagaggacacctgagtcactttctt

SEQ ID NO: 7658 - DNA, 25 bp, Homo sapien
attcctgctttatgccaggcactct

SEQ ID NO: 7659 - DNA, 25 bp, Homo sapien
gccaggcactctgaaaggcattgtg

SEQ ID NO: 7660 - DNA, 25 bp, Homo sapien
gtgtacactattttcatcatcagac

SEQ ID NO: 7661 - DNA, 25 bp, Homo sapien
tcatcatcagacaatagcccataat

SEQ ID NO: 7662 - DNA, 25 bp, Homo sapien
gcccataatactttgtctgacatct

SEQ ID NO: 7663 - DNA, 25 bp, Homo sapien
gacaaagaacgatcagcctcatttt

SEQ ID NO: 7664 - DNA, 25 bp, Homo sapien
gttcatacagcacaaagtggctctg

SEQ ID NO: 7665 - DNA, 25 bp, Homo sapien
ggctctgggatttcaacccatagag

SEQ ID NO: 7666 - DNA, 25 bp, Homo sapien
ggagtgttagaataataccctcaca

SEQ ID NO: 7667 - DNA, 25 bp, Homo sapien
aataccctcacaaattcaatgttga

SEQ ID NO: 7668 - DNA, 25 bp, Homo sapien
gaaagtgctaatgaagtccgggcgc

SEQ ID NO: 7669 - DNA, 25 bp, Homo sapien
atgtgaattacgctgcctgtgcctt

SEQ ID NO: 7670 - DNA, 25 bp, Homo sapien
ttacgctgcctgtgccttagaggaa

SEQ ID NO: 7671 - DNA, 25 bp, Homo sapien
cctgtgccttagaggaagccgcgga

SEQ ID NO: 7672 - DNA, 25 bp, Homo sapien
gaataagccttcctaaggaggacca

SEQ ID NO: 7673 - DNA, 25 bp, Homo sapien
gaggaccagataagaatctttggaa

SEQ ID NO: 7674 - DNA, 25 bp, Homo sapien
tagtagtacaccatgctttctgttt

SEQ ID NO: 7675 - DNA, 25 bp, Homo sapien
caccatgctttctgtttactttaaa

SEQ ID NO: 7676 - DNA, 25 bp, Homo sapien
aaacggttgctggattgtactgccc

SEQ ID NO: 7677 - DNA, 25 bp, Homo sapien
gattgtactgccctgggtgtctaaa

SEQ ID NO: 7678 - DNA, 25 bp, Homo sapien
tgccctgggtgtctaaaagtctggt

SEQ ID NO: 7679 - DNA, 25 bp, Homo sapien
ctttcttcctttgagtagttctgaa

SEQ ID NO: 7680 - DNA, 25 bp, Homo sapien
gccgaagatcggtatagctttccat

SEQ ID NO: 7681 - DNA, 25 bp, Homo sapien
agctttccatttggtatagcagaag

SEQ ID NO: 7682 - DNA, 25 bp, Homo sapien
gatgtatcaaatcaaagccatttat

SEQ ID NO: 7683 - DNA, 25 bp, Homo sapien
tatacatttacgtaaaaatcccact

SEQ ID NO: 7684 - DNA, 25 bp, Homo sapien
taaaaacttgcagcgcaaagctatt

SEQ ID NO: 7685 - DNA, 25 bp, Homo sapien
caaagctattggttgctgcattcaa

SEQ ID NO: 7686 - DNA, 25 bp, Homo sapien
ggttgctgcattcaatctagagtag

SEQ ID NO: 7687 - DNA, 25 bp, Homo sapien
gaataacccaaatgatcaacaattt

SEQ ID NO: 7688 - DNA, 25 bp, Homo sapien
tattataacatccactcaaagaaat

SEQ ID NO: 7689 - DNA, 25 bp, Homo sapien
tgccattgacagatggtgttcagct

SEQ ID NO: 7690 - DNA, 25 bp, Homo sapien
gatggtgttcagctgatagaaagaa

SEQ ID NO: 7691 - DNA, 25 bp, Homo sapien
attcagtgagattcattgattcagg

SEQ ID NO: 7692 - DNA, 25 bp, Homo sapien
gtcatagcagtacaggccagtttct

SEQ ID NO: 7693 - DNA, 25 bp, Homo sapien
gtttctgttgcctgagggaggcaat

SEQ ID NO: 7694 - DNA, 25 bp, Homo sapien
ggaaaatggttactcagatgacttg

SEQ ID NO: 7695 - DNA, 25 bp, Homo sapien
aaggagacattactgagatgctgaa

SEQ ID NO: 7696 - DNA, 25 bp, Homo sapien
aagacttggttttattgactgaaag

SEQ ID NO: 7697 - DNA, 25 bp, Homo sapien
agtagattgtgattcttttcctcaa

SEQ ID NO: 7698 - DNA, 25 bp, Homo sapien
gattcttttcctcaattatcccaat

SEQ ID NO: 7699 - DNA, 25 bp, Homo sapien
caattatcccaatgattccctcaag

SEQ ID NO: 7700 - DNA, 25 bp, Homo sapien
gattccctcaagttctctgttgtat

SEQ ID NO: 7701 - DNA, 25 bp, Homo sapien
tctaaagagctggaaaccggccggg

SEQ ID NO: 7702 - DNA, 25 bp, Homo sapien
ctgtgagtgtggtcccttgccagaa

SEQ ID NO: 7703 - DNA, 25 bp, Homo sapien
agtgtggtcccttgccagaacatag

SEQ ID NO: 7704 - DNA, 25 bp, Homo sapien
ggtcccttgccagaacatagtgcag

SEQ ID NO: 7705 - DNA, 25 bp, Homo sapien
cttgccagaacatagtgcaggctct

SEQ ID NO: 7706 - DNA, 25 bp, Homo sapien
gaacatagtgcaggctctgtcacat

SEQ ID NO: 7707 - DNA, 25 bp, Homo sapien
atagtgcaggctctgtcacatcaca

SEQ ID NO: 7708 - DNA, 25 bp, Homo sapien
gtgcaggctctgtcacatcacacag

SEQ ID NO: 7709 - DNA, 25 bp, Homo sapien
tgtctctgtgtggtttacgtcctcc

SEQ ID NO: 7710 - DNA, 25 bp, Homo sapien
tctgtgtggtttacgtcctcctaaa

SEQ ID NO: 7711 - DNA, 25 bp, Homo sapien
ttaaaatgtattctctggctgggtg

SEQ ID NO: 7712 - DNA, 25 bp, Homo sapien
aggcaggaaagttgcctgaaccagg

SEQ ID NO: 7713 - DNA, 25 bp, Homo sapien
gatgcctctggaattttccaacata

SEQ ID NO: 7714 - DNA, 25 bp, Homo sapien
ggaattttccaacatacctgagact

SEQ ID NO: 7715 - DNA, 25 bp, Homo sapien
attttccaacatacctgagacttta

SEQ ID NO: 7716 - DNA, 25 bp, Homo sapien
aacatacctgagactttactttcta

SEQ ID NO: 7717 - DNA, 25 bp, Homo sapien
tacctgagactttactttctaattt

SEQ ID NO: 7718 - DNA, 25 bp, Homo sapien
aagtctatctataaatctacttaga

SEQ ID NO: 7719 - DNA, 25 bp, Homo sapien
atctacttagacacactaattgctt

SEQ ID NO: 7720 - DNA, 25 bp, Homo sapien
gacacactaattgcttcttattaca

SEQ ID NO: 7721 - DNA, 25 bp, Homo sapien
aataacctacacaatgatccattta

SEQ ID NO: 7722 - DNA, 25 bp, Homo sapien
acagtcttcaaaagtggatgcttat

SEQ ID NO: 7723 - DNA, 25 bp, Homo sapien
aaagtggatgcttatggtatcaggg

SEQ ID NO: 7724 - DNA, 25 bp, Homo sapien
aaacccaaatgttcaatcaagggat

SEQ ID NO: 7725 - DNA, 25 bp, Homo sapien
acccaaatgttcaatcaagggatgg

SEQ ID NO: 7726 - DNA, 25 bp, Homo sapien
caaatgttcaatcaagggatgggaa

SEQ ID NO: 7727 - DNA, 25 bp, Homo sapien
gttcaatcaagggatgggaaaatac

SEQ ID NO: 7728 - DNA, 25 bp, Homo sapien
ttaaaagttgaaaggttcacgcctg

SEQ ID NO: 7729 - DNA, 25 bp, Homo sapien
taaaagttgaaaggttcacgcctgt

SEQ ID NO: 7730 - DNA, 25 bp, Homo sapien
tagccagacatcgtagcacgcactt

SEQ ID NO: 7731 - DNA, 25 bp, Homo sapien
agccagacatcgtagcacgcactta

SEQ ID NO: 7732 - DNA, 25 bp, Homo sapien
gccagacatcgtagcacgcacttat

SEQ ID NO: 7733 - DNA, 25 bp, Homo sapien
ccagacatcgtagcacgcacttata

SEQ ID NO: 7734 - DNA, 25 bp, Homo sapien
cagacatcgtagcacgcacttataa

SEQ ID NO: 7735 - DNA, 25 bp, Homo sapien
taaaagggagttccctgcccaagct

SEQ ID NO: 7736 - DNA, 25 bp, Homo sapien
cctggatctcatggctgtgggcaat

SEQ ID NO: 7737 - DNA, 25 bp, Homo sapien
ctgagggaactggagaacagctgct

SEQ ID NO: 7738 - DNA, 25 bp, Homo sapien
ctgttctgcctcatgccaaagggag

SEQ ID NO: 7739 - DNA, 25 bp, Homo sapien
tgcctcatgccaaagggagacaatg

SEQ ID NO: 7740 - DNA, 25 bp, Homo sapien
caggccctgcagagaaacagaacac

SEQ ID NO: 7741 - DNA, 25 bp, Homo sapien
gaacacacaggttgtgtatgcatgt

SEQ ID NO: 7742 - DNA, 25 bp, Homo sapien
agagaggttcgagaaattggctcat

SEQ ID NO: 7743 - DNA, 25 bp, Homo sapien
tcgagaaattggctcatgtgattac

SEQ ID NO: 7744 - DNA, 25 bp, Homo sapien
gctcatgtgattacagaggctggca

SEQ ID NO: 7745 - DNA, 25 bp, Homo sapien
ccaaaatttgcagggtgggtgatac

SEQ ID NO: 7746 - DNA, 25 bp, Homo sapien
tgtgtccatgtgtggctcagtttac

SEQ ID NO: 7747 - DNA, 25 bp, Homo sapien
gtgtggctcagtttacagtaccatt

SEQ ID NO: 7748 - DNA, 25 bp, Homo sapien
ggctcagtttacagtaccatttgga

SEQ ID NO: 7749 - DNA, 25 bp, Homo sapien
ttgattgcttctgtgagttgggtga

SEQ ID NO: 7750 - DNA, 25 bp, Homo sapien
ttgaggtccagatcaaccccaggag

SEQ ID NO: 7751 - DNA, 25 bp, Homo sapien
ccagatcaaccccaggaggagccta

SEQ ID NO: 7752 - DNA, 25 bp, Homo sapien
attgggcgccccatttcagcagaag

SEQ ID NO: 7753 - DNA, 25 bp, Homo sapien
gggcgccccatttcagcagaagtag

SEQ ID NO: 7754 - DNA, 25 bp, Homo sapien
agaagtagccaggagtcgtcaccca

SEQ ID NO: 7755 - DNA, 25 bp, Homo sapien
gtagccaggagtcgtcacccagaac

SEQ ID NO: 7756 - DNA, 25 bp, Homo sapien
taacagcagttagtgtggcatctcc

SEQ ID NO: 7757 - DNA, 25 bp, Homo sapien
gctactttcaagtgactctgttcca

SEQ ID NO: 7758 - DNA, 25 bp, Homo sapien
aagtgactctgttccatgtccctag

SEQ ID NO: 7759 - DNA, 25 bp, Homo sapien
tgttccatgtccctaggcctgtgtg

SEQ ID NO: 7760 - DNA, 25 bp, Homo sapien
aaaagttgcaatcatgtggtaactg

SEQ ID NO: 7761 - DNA, 25 bp, Homo sapien
tgtggtaactgccattttgaattac

SEQ ID NO: 7762 - DNA, 25 bp, Homo sapien
aatagcaacactatggcatgataga

SEQ ID NO: 7763 - DNA, 25 bp, Homo sapien
tagaaaaaacatgggctaggccggg

SEQ ID NO: 7764 - DNA, 25 bp, Homo sapien
gttacatcgtgacaacatactggaa

SEQ ID NO: 7765 - DNA, 25 bp, Homo sapien
catactggaacttgggaaagcccca

SEQ ID NO: 7766 - DNA, 25 bp, Homo sapien
gggaaagccccacatgacaattcag

SEQ ID NO: 7767 - DNA, 25 bp, Homo sapien
gccccacatgacaattcagctactt

SEQ ID NO: 7768 - DNA, 25 bp, Homo sapien
ttctgaatacatcacgaacacaaag

SEQ ID NO: 7769 - DNA, 25 bp, Homo sapien
atacatcacgaacacaaagtggtat

SEQ ID NO: 7770 - DNA, 25 bp, Homo sapien
taaaatgaaccctatttaaacatca

SEQ ID NO: 7771 - DNA, 25 bp, Homo sapien
gacacagaacattaccaatgagcct

SEQ ID NO: 7772 - DNA, 25 bp, Homo sapien
cattaccaatgagcctgaatattct

SEQ ID NO: 7773 - DNA, 25 bp, Homo sapien
tgaatattctcatgcgtggccacat

SEQ ID NO: 7774 - DNA, 25 bp, Homo sapien
atattctcatgcgtggccacatctc

SEQ ID NO: 7775 - DNA, 25 bp, Homo sapien
ctcatgcgtggccacatctcttttc

SEQ ID NO: 7776 - DNA, 25 bp, Homo sapien
tattccccgtcatagaaatcactcc

SEQ ID NO: 7777 - DNA, 25 bp, Homo sapien
gtcatagaaatcactccatcccaaa

SEQ ID NO: 7778 - DNA, 25 bp, Homo sapien
tggatttatatcatacacaaagcac

SEQ ID NO: 7779 - DNA, 25 bp, Homo sapien
ttcttcctgactaaagaggctagaa

SEQ ID NO: 7780 - DNA, 25 bp, Homo sapien
gttttcccaggcttcattgcagtag

SEQ ID NO: 7781 - DNA, 25 bp, Homo sapien
gcttcattgcagtagaggtggcact

SEQ ID NO: 7782 - DNA, 25 bp, Homo sapien
tggcactgtgacactgttctgcaga

SEQ ID NO: 7783 - DNA, 25 bp, Homo sapien
aacagaagtcagctgggatggtttc

SEQ ID NO: 7784 - DNA, 25 bp, Homo sapien
tgagggtgctatgcttttcctatca

SEQ ID NO: 7785 - DNA, 25 bp, Homo sapien
ttcctatcagagaggtttgttctag

SEQ ID NO: 7786 - DNA, 25 bp, Homo sapien
gttctagttactattgctgcatgaa

SEQ ID NO: 7787 - DNA, 25 bp, Homo sapien
tgaaaaactatccaaaacacgcatt

SEQ ID NO: 7788 - DNA, 25 bp, Homo sapien
aaacacgcatttactgtggcacaaa

SEQ ID NO: 7789 - DNA, 25 bp, Homo sapien
tattatacccttggatcctgtaggt

SEQ ID NO: 7790 - DNA, 25 bp, Homo sapien
gctcatttgtactctatgctttaaa

SEQ ID NO: 7791 - DNA, 25 bp, Homo sapien
ctatgctttaaataattgtcgtaca

SEQ ID NO: 7792 - DNA, 25 bp, Homo sapien
gtcgtacatttggtagaaaagcctt

SEQ ID NO: 7793 - DNA, 25 bp, Homo sapien
tagaaaagcctttacatacatgtat

SEQ ID NO: 7794 - DNA, 25 bp, Homo sapien
atgtgttgtgtaggaatacattcac

SEQ ID NO: 7795 - DNA, 25 bp, Homo sapien
cacgcaaacataacatatacacctg

SEQ ID NO: 7796 - DNA, 25 bp, Homo sapien
atacacctgtaggatgtagggccac

SEQ ID NO: 7797 - DNA, 25 bp, Homo sapien
gggccacaggacaaataacttagga

SEQ ID NO: 7798 - DNA, 25 bp, Homo sapien
taaacaggtcctattttactgaaat

SEQ ID NO: 7799 - DNA, 25 bp, Homo sapien
ataattatgcaaggctatatggtta

SEQ ID NO: 7800 - DNA, 25 bp, Homo sapien
tgataatgtactttaaattctctgt

SEQ ID NO: 7801 - DNA, 25 bp, Homo sapien
aggtaagaatcatcagtggctgatc

SEQ ID NO: 7802 - DNA, 25 bp, Homo sapien
gtggctgatcatccctcaaagacaa

SEQ ID NO: 7803 - DNA, 25 bp, Homo sapien
gatggaagaacgcaggccaccacct

SEQ ID NO: 7804 - DNA, 25 bp, Homo sapien
aacctctcctttctggttgatgatg

SEQ ID NO: 7805 - DNA, 25 bp, Homo sapien
ggaacagcgtattgtaacttcacat

SEQ ID NO: 7806 - DNA, 25 bp, Homo sapien
tcgaggaagacattggccaccccaa

SEQ ID NO: 7807 - DNA, 25 bp, Homo sapien
gagactgtgattttcctgctcatca

SEQ ID NO: 7808 - DNA, 25 bp, Homo sapien
catagaatggatcagcacgtttgaa

SEQ ID NO: 7809 - DNA, 25 bp, Homo sapien
gaagtatgatcgtattacctgtaaa

SEQ ID NO: 7810 - DNA, 25 bp, Homo sapien
ttggttcaatcttctgctcgagtgg

SEQ ID NO: 7811 - DNA, 25 bp, Homo sapien
gagccgaccaaggagaggttatcta

SEQ ID NO: 7812 - DNA, 25 bp, Homo sapien
agctaccaccctgataagtcagcag

SEQ ID NO: 7813 - DNA, 25 bp, Homo sapien
ctgataagtcagcagccagcatcgt

SEQ ID NO: 7814 - DNA, 25 bp, Homo sapien
agcatcgtggaagcaggaccctcta

SEQ ID NO: 7815 - DNA, 25 bp, Homo sapien
tcactgcaggctcggaggattgtta

SEQ ID NO: 7816 - DNA, 25 bp, Homo sapien
ggctcggaggattgttactgtcttt

SEQ ID NO: 7817 - DNA, 25 bp, Homo sapien
gaagaaacctctaatgtcacgaaat

SEQ ID NO: 7818 - DNA, 25 bp, Homo sapien
agatggaatctacttaaaatgcacc

SEQ ID NO: 7819 - DNA, 25 bp, Homo sapien
gaatctacttaaaatgcaccacatg

SEQ ID NO: 7820 - DNA, 25 bp, Homo sapien
acttaaaatgcaccacatggagcaa

SEQ ID NO: 7821 - DNA, 25 bp, Homo sapien
catggagcaaaaatctgccgttcta

SEQ ID NO: 7822 - DNA, 25 bp, Homo sapien
aatctgccgttctaaagcaacgctt

SEQ ID NO: 7823 - DNA, 25 bp, Homo sapien
aattcttgtagcttatgattctgta

SEQ ID NO: 7824 - DNA, 25 bp, Homo sapien
attctgtagctcaagttcaaatcct

SEQ ID NO: 7825 - DNA, 25 bp, Homo sapien
ttcaaatcctacctacctcagacat

SEQ ID NO: 7826 - DNA, 25 bp, Homo sapien
tacctcagacatttcacactatctc

SEQ ID NO: 7827 - DNA, 25 bp, Homo sapien
atctccctgctggtgtcatcaattt

SEQ ID NO: 7828 - DNA, 25 bp, Homo sapien
agtgggaaatcctaagcctttgcct

SEQ ID NO: 7829 - DNA, 25 bp, Homo sapien
aagcctttgcctgaacctaaattgg

SEQ ID NO: 7830 - DNA, 25 bp, Homo sapien
tccttcccatcccttaggtataaat

SEQ ID NO: 7831 - DNA, 25 bp, Homo sapien
tcttctagggaagtctttcatcatt

SEQ ID NO: 7832 - DNA, 25 bp, Homo sapien
tgccataccatgttttctcacttat

SEQ ID NO: 7833 - DNA, 25 bp, Homo sapien
tagtatgtacaacaggccaggcgcg

SEQ ID NO: 7834 - DNA, 25 bp, Homo sapien
gactccgggcggtaaagaagcctgg

SEQ ID NO: 7835 - DNA, 25 bp, Homo sapien
agagccctctgcattctgggggttc

SEQ ID NO: 7836 - DNA, 25 bp, Homo sapien
gagcttgtaggctcactttgctcca

SEQ ID NO: 7837 - DNA, 25 bp, Homo sapien
ttgtaggctcactttgctccactga

SEQ ID NO: 7838 - DNA, 25 bp, Homo sapien
tttgctccactgagcgatgagtggt

SEQ ID NO: 7839 - DNA, 25 bp, Homo sapien
actgagcgatgagtggtctttccac

SEQ ID NO: 7840 - DNA, 25 bp, Homo sapien
gagcgatgagtggtctttccacatt

SEQ ID NO: 7841 - DNA, 25 bp, Homo sapien
ggtctttccacattctagagagggc

SEQ ID NO: 7842 - DNA, 25 bp, Homo sapien
tttccacattctagagagggctcgg

SEQ ID NO: 7843 - DNA, 25 bp, Homo sapien
gagagggctcggaggcctttatttt

SEQ ID NO: 7844 - DNA, 25 bp, Homo sapien
gaatgaaggcactgccgggcgctgt

SEQ ID NO: 7845 - DNA, 25 bp, Homo sapien
ctgggattataagtgcaagccacaa

SEQ ID NO: 7846 - DNA, 25 bp, Homo sapien
agtgcaagccacaacaccaggctga

SEQ ID NO: 7847 - DNA, 25 bp, Homo sapien
acaacaccaggctgataggtttttt

SEQ ID NO: 7848 - DNA, 25 bp, Homo sapien
gatgtaatttacaaccatacagttt

SEQ ID NO: 7849 - DNA, 25 bp, Homo sapien
aaccatacagtttacctgctttggg

SEQ ID NO: 7850 - DNA, 25 bp, Homo sapien
catacagtttacctgctttgggttt

SEQ ID NO: 7851 - DNA, 25 bp, Homo sapien
ctgctttgggtttacaactcaagat

SEQ ID NO: 7852 - DNA, 25 bp, Homo sapien
ttgggtttacaactcaagatttttg

SEQ ID NO: 7853 - DNA, 25 bp, Homo sapien
tagaaaattttcaacgcccgagaga

SEQ ID NO: 7854 - DNA, 25 bp, Homo sapien
tcaacgcccgagagaaattcctcat

SEQ ID NO: 7855 - DNA, 25 bp, Homo sapien
gagaaattcctcatgctcatatgca

SEQ ID NO: 7856 - DNA, 25 bp, Homo sapien
gaacccacctcctttgaagatacag

SEQ ID NO: 7857 - DNA, 25 bp, Homo sapien
tcatccagaaagttctcctgtgctt

SEQ ID NO: 7858 - DNA, 25 bp, Homo sapien
tcctgtgctttcatgctgtcccgca

SEQ ID NO: 7859 - DNA, 25 bp, Homo sapien
gaacatgctgaggacattggtactg

SEQ ID NO: 7860 - DNA, 25 bp, Homo sapien
acattggtactggattctggccgcc

SEQ ID NO: 7861 - DNA, 25 bp, Homo sapien
tggccgccccaaaagagccgctttg

SEQ ID NO: 7862 - DNA, 25 bp, Homo sapien
aaagagccgctttgaccaggcttac

SEQ ID NO: 7863 - DNA, 25 bp, Homo sapien
tgaccaggcttacccagcactaaat

SEQ ID NO: 7864 - DNA, 25 bp, Homo sapien
ctgctctctcaaaatttccatcttt

SEQ ID NO: 7865 - DNA, 25 bp, Homo sapien
tggttgtacctataaccctccctca

SEQ ID NO: 7866 - DNA, 25 bp, Homo sapien
aaccctccctcatcaagtcaataga

SEQ ID NO: 7867 - DNA, 25 bp, Homo sapien
gaatctacctgaagaatcctcaggc

SEQ ID NO: 7868 - DNA, 25 bp, Homo sapien
tgaagaatcctcaggccatccgatt

SEQ ID NO: 7869 - DNA, 25 bp, Homo sapien
tcctcaggccatccgatttgatgat

SEQ ID NO: 7870 - DNA, 25 bp, Homo sapien
tccgatttgatgatatagtcagtag

SEQ ID NO: 7871 - DNA, 25 bp, Homo sapien
tagtcagtaggattgtttggtttgc

SEQ ID NO: 7872 - DNA, 25 bp, Homo sapien
gtttggtttgctagtaacataaatt

SEQ ID NO: 7873 - DNA, 25 bp, Homo sapien
agtaacataaattcaaagcttcagg

SEQ ID NO: 7874 - DNA, 25 bp, Homo sapien
aaggcagactaaattatatggtaag

SEQ ID NO: 7875 - DNA, 25 bp, Homo sapien
tggtaagtaggctgtttcattgaac

SEQ ID NO: 7876 - DNA, 25 bp, Homo sapien
aagtaggctgtttcattgaactgaa

SEQ ID NO: 7877 - DNA, 25 bp, Homo sapien
gtaaaccggagatgtaagttgtcac

SEQ ID NO: 7878 - DNA, 25 bp, Homo sapien
gatacatacaatacgtgtgaatctc

SEQ ID NO: 7879 - DNA, 25 bp, Homo sapien
acaatacgtgtgaatctcaagataa

SEQ ID NO: 7880 - DNA, 25 bp, Homo sapien
aattatgctgaaagaatgcacacaa

SEQ ID NO: 7881 - DNA, 25 bp, Homo sapien
atgttattccatttgcataaaattc

SEQ ID NO: 7882 - DNA, 25 bp, Homo sapien
tgcataaaattctagaatgcgcaaa

SEQ ID NO: 7883 - DNA, 25 bp, Homo sapien
gaatgcgcaaattaatctattactg

SEQ ID NO: 7884 - DNA, 25 bp, Homo sapien
gcgcaaattaatctattactgtttt

SEQ ID NO: 7885 - DNA, 25 bp, Homo sapien
agcaatgctgttaataaatggtgat

SEQ ID NO: 7886 - DNA, 25 bp, Homo sapien
aaatggtgatgcaggatattaatcc

SEQ ID NO: 7887 - DNA, 25 bp, Homo sapien
ggatattaatccagttctgctacat

SEQ ID NO: 7888 - DNA, 25 bp, Homo sapien
ttaatccagttctgctacatcctaa

SEQ ID NO: 7889 - DNA, 25 bp, Homo sapien
aagctcactcacctgaatgctggca

SEQ ID NO: 7890 - DNA, 25 bp, Homo sapien
aatgctggcaggattctgttcctca

SEQ ID NO: 7891 - DNA, 25 bp, Homo sapien
tctgttcctcatggcctgttgggct

SEQ ID NO: 7892 - DNA, 25 bp, Homo sapien
tagctcctcgacagctgttggccaa

SEQ ID NO: 7893 - DNA, 25 bp, Homo sapien
tggccaaggcatctctcatgttcct

SEQ ID NO: 7894 - DNA, 25 bp, Homo sapien
atgttcctggccatgtgggtgtctt

SEQ ID NO: 7895 - DNA, 25 bp, Homo sapien
ggtgtcttcatagggcagctcatac

SEQ ID NO: 7896 - DNA, 25 bp, Homo sapien
tcatacagtggtgggaggcttcgtc

SEQ ID NO: 7897 - DNA, 25 bp, Homo sapien
tgggaggcttcgtcagagccagcaa

SEQ ID NO: 7898 - DNA, 25 bp, Homo sapien
tcctttcgtaacctactctcagaag

SEQ ID NO: 7899 - DNA, 25 bp, Homo sapien
tcagaagtgacatcccggctgagtc

SEQ ID NO: 7900 - DNA, 25 bp, Homo sapien
acttctgtcaccttacatggatctg

SEQ ID NO: 7901 - DNA, 25 bp, Homo sapien
gatagccagttcatgatgtctatat

SEQ ID NO: 7902 - DNA, 25 bp, Homo sapien
atagtaatctcttaggacatggtaa

SEQ ID NO: 7903 - DNA, 25 bp, Homo sapien
ttatgatcatcattagttttgcccc

SEQ ID NO: 7904 - DNA, 25 bp, Homo sapien
ccccatgtgtcaggttcttcattta

SEQ ID NO: 7905 - DNA, 25 bp, Homo sapien
tatacttactacgtgctaggcacag

SEQ ID NO: 7906 - DNA, 25 bp, Homo sapien
attaatgtcattctaactccaaaag

SEQ ID NO: 7907 - DNA, 25 bp, Homo sapien
ggaagcccagacaacttgtcacgta

SEQ ID NO: 7908 - DNA, 25 bp, Homo sapien
gtcacgtagcagtctcaatcaaaat

SEQ ID NO: 7909 - DNA, 25 bp, Homo sapien
tttatttgctactgtctctgaacca

SEQ ID NO: 7910 - DNA, 25 bp, Homo sapien
ctgtctctgaaccatggtattttga

SEQ ID NO: 7911 - DNA, 25 bp, Homo sapien
acttggttgtaggtatttccagagc

SEQ ID NO: 7912 - DNA, 25 bp, Homo sapien
cagagcctgcgctctctagggctgg

SEQ ID NO: 7913 - DNA, 25 bp, Homo sapien
tctagggctgggacgcccatttctt

SEQ ID NO: 7914 - DNA, 25 bp, Homo sapien
gacgcccatttcttcttgccctggg

SEQ ID NO: 7915 - DNA, 25 bp, Homo sapien
gccttgccttggtgtgaaacctcgg

SEQ ID NO: 7916 - DNA, 25 bp, Homo sapien
gctccctgcaccgaaaccgtttaat

SEQ ID NO: 7917 - DNA, 25 bp, Homo sapien
agaaaaaacactgggtcgagtgcgg

SEQ ID NO: 7918 - DNA, 25 bp, Homo sapien
ggtcgagtgcggctcaagcctgtaa

SEQ ID NO: 7919 - DNA, 25 bp, Homo sapien
agccctgggtgccttctggtcacac

SEQ ID NO: 7920 - DNA, 25 bp, Homo sapien
ttctggtcacactgtcctcttaggg

SEQ ID NO: 7921 - DNA, 25 bp, Homo sapien
ctgctaggccttccgggcaactttg

SEQ ID NO: 7922 - DNA, 25 bp, Homo sapien
ggccaacatggtttcatggcatgat

SEQ ID NO: 7923 - DNA, 25 bp, Homo sapien
gcatgatatggctcaatccacagac

SEQ ID NO: 7924 - DNA, 25 bp, Homo sapien
atggctcaatccacagacaaaggct

SEQ ID NO: 7925 - DNA, 25 bp, Homo sapien
aatccacagacaaaggctgctgagc

SEQ ID NO: 7926 - DNA, 25 bp, Homo sapien
gctgctgagcccagaacaacttatt

SEQ ID NO: 7927 - DNA, 25 bp, Homo sapien
agaacaacttattggaccagcccct

SEQ ID NO: 7928 - DNA, 25 bp, Homo sapien
aacttattggaccagcccctatgag

SEQ ID NO: 7929 - DNA, 25 bp, Homo sapien
ttggaccagcccctatgagaagcag

SEQ ID NO: 7930 - DNA, 25 bp, Homo sapien
cagcccctatgagaagcagaaatgt

SEQ ID NO: 7931 - DNA, 25 bp, Homo sapien
gtatagaagcaaactgaacccaagg

SEQ ID NO: 7932 - DNA, 25 bp, Homo sapien
gcaaactgaacccaaggaaagattg

SEQ ID NO: 7933 - DNA, 25 bp, Homo sapien
taatattaccattgctttaagacaa

SEQ ID NO: 7934 - DNA, 25 bp, Homo sapien
cattgctttaagacaattaccttca

SEQ ID NO: 7935 - DNA, 25 bp, Homo sapien
ctcattactttcctggacagtttac

SEQ ID NO: 7936 - DNA, 25 bp, Homo sapien
ggacagtttacaggccagagtggtc

SEQ ID NO: 7937 - DNA, 25 bp, Homo sapien
gagtggtctccactcagccactaga

SEQ ID NO: 7938 - DNA, 25 bp, Homo sapien
tcagccactagatcttagaggattc

SEQ ID NO: 7939 - DNA, 25 bp, Homo sapien
gaggattctaagaaaccctattcgt

SEQ ID NO: 7940 - DNA, 25 bp, Homo sapien
taagaaaccctattcgttaagccag

SEQ ID NO: 7941 - DNA, 25 bp, Homo sapien
ttaagccaggtaactcatatattct

SEQ ID NO: 7942 - DNA, 25 bp, Homo sapien
tattctgaatctataaacatgtctg

SEQ ID NO: 7943 - DNA, 25 bp, Homo sapien
atacatacattgtgccgggtacggt

SEQ ID NO: 7944 - DNA, 25 bp, Homo sapien
gggcttgggtaatatgaatctgcaa

SEQ ID NO: 7945 - DNA, 25 bp, Homo sapien
taatatgaatctgcaactgaccggg

SEQ ID NO: 7946 - DNA, 25 bp, Homo sapien
agatgttactctcagatggttgggt

SEQ ID NO: 7947 - DNA, 25 bp, Homo sapien
ctctcagatggttgggtttatccta

SEQ ID NO: 7948 - DNA, 25 bp, Homo sapien
ggttgggtttatcctatttatgaat

SEQ ID NO: 7949 - DNA, 25 bp, Homo sapien
tttatgaatccacaggcccaaaggt

SEQ ID NO: 7950 - DNA, 25 bp, Homo sapien
gaccaattaaatttaccaaaggcag

SEQ ID NO: 7951 - DNA, 25 bp, Homo sapien
aaaggcaggcatgtttccccgtgag

SEQ ID NO: 7952 - DNA, 25 bp, Homo sapien
ttccccgtgaggtgtcctggcaaca

SEQ ID NO: 7953 - DNA, 25 bp, Homo sapien
ttctttcctgctttcactgggcgct

SEQ ID NO: 7954 - DNA, 25 bp, Homo sapien
ttcactgggcgctccctttctctgt

SEQ ID NO: 7955 - DNA, 25 bp, Homo sapien
aattcattaacttcagaaaaggctg

SEQ ID NO: 7956 - DNA, 25 bp, Homo sapien
cgtaggttagggaatgtgtctttga

SEQ ID NO: 7957 - DNA, 25 bp, Homo sapien
cactttatattgtgaactcgccaag

SEQ ID NO: 7958 - DNA, 25 bp, Homo sapien
aactcgccaagtgtttgctctttag

SEQ ID NO: 7959 - DNA, 25 bp, Homo sapien
tgctctttagcaatcaggacaaggc

SEQ ID NO: 7960 - DNA, 25 bp, Homo sapien
ggacaaggcctattagagcatatta

SEQ ID NO: 7961 - DNA, 25 bp, Homo sapien
gtctttatgacctatactaaccttg

SEQ ID NO: 7962 - DNA, 25 bp, Homo sapien
gacctatactaaccttggtgcagaa

SEQ ID NO: 7963 - DNA, 25 bp, Homo sapien
aaatagcacttttttgagtcttcca

SEQ ID NO: 7964 - DNA, 25 bp, Homo sapien
gagtcttccatataatatcatcata

SEQ ID NO: 7965 - DNA, 25 bp, Homo sapien
tacatagcaaacgactgtaatccca

SEQ ID NO: 7966 - DNA, 25 bp, Homo sapien
caggaccccattcacgaagctaggg

SEQ ID NO: 7967 - DNA, 25 bp, Homo sapien
attcacgaagctagggtgcccctct

SEQ ID NO: 7968 - DNA, 25 bp, Homo sapien
tttctctcagtttttgccatctaca

SEQ ID NO: 7969 - DNA, 25 bp, Homo sapien
ttgccatctacaccctcaggttaaa

SEQ ID NO: 7970 - DNA, 25 bp, Homo sapien
tacaccctcaggttaaacccatgag

SEQ ID NO: 7971 - DNA, 25 bp, Homo sapien
ccccagatcagtgttgactgctgta

SEQ ID NO: 7972 - DNA, 25 bp, Homo sapien
gactgctgtattctgacagctcttg

SEQ ID NO: 7973 - DNA, 25 bp, Homo sapien
gacagctcttgtctattctcagagg

SEQ ID NO: 7974 - DNA, 25 bp, Homo sapien
cagaggctgcaggttgcttttcaaa

SEQ ID NO: 7975 - DNA, 25 bp, Homo sapien
ggttgcttttcaaaattgcgtccag

SEQ ID NO: 7976 - DNA, 25 bp, Homo sapien
aattgcgtccagaggccaggcatag

SEQ ID NO: 7977 - DNA, 25 bp, Homo sapien
ggtcttatgtaccttttgacaagaa

SEQ ID NO: 7978 - DNA, 25 bp, Homo sapien
taaaattatctcatgcaacagatga

SEQ ID NO: 7979 - DNA, 25 bp, Homo sapien
aattatctcatgcaacagatgaaag

SEQ ID NO: 7980 - DNA, 25 bp, Homo sapien
tatctcatgcaacagatgaaagaag

SEQ ID NO: 7981 - DNA, 25 bp, Homo sapien
gtatatatttctttatctgcacttt

SEQ ID NO: 7982 - DNA, 25 bp, Homo sapien
tatatatttctttatctgcactttg

SEQ ID NO: 7983 - DNA, 25 bp, Homo sapien
atctgcactttgtagttgaaagaaa

SEQ ID NO: 7984 - DNA, 25 bp, Homo sapien
gcactttgtagttgaaagaaaccaa

SEQ ID NO: 7985 - DNA, 25 bp, Homo sapien
agttgaaagaaaccaagctcagaga

SEQ ID NO: 7986 - DNA, 25 bp, Homo sapien
gaggttaaatatcatttccaatgtc

SEQ ID NO: 7987 - DNA, 25 bp, Homo sapien
agtggcgtgatcaggctgaaatgca

SEQ ID NO: 7988 - DNA, 25 bp, Homo sapien
tgtgcccgagcctgaattttcatag

SEQ ID NO: 7989 - DNA, 25 bp, Homo sapien
gggtgcccacaagtgacagcagctt

SEQ ID NO: 7990 - DNA, 25 bp, Homo sapien
gtgacagcagcttttatggaagcca

SEQ ID NO: 7991 - DNA, 25 bp, Homo sapien
tatggaagccagtcttagcaagatg

SEQ ID NO: 7992 - DNA, 25 bp, Homo sapien
agatggcagagcacccatttctcca

SEQ ID NO: 7993 - DNA, 25 bp, Homo sapien
agagcacccatttctccatgaggcc

SEQ ID NO: 7994 - DNA, 25 bp, Homo sapien
gcccaggcttctcagagaagggcaa

SEQ ID NO: 7995 - DNA, 25 bp, Homo sapien
agggcaagaactgtcttctgctttg

SEQ ID NO: 7996 - DNA, 25 bp, Homo sapien
ttctgctttggccatcgtgatgaca

SEQ ID NO: 7997 - DNA, 25 bp, Homo sapien
ggccatcgtgatgacacattgaatg

SEQ ID NO: 7998 - DNA, 25 bp, Homo sapien
gttttcaatagatacttgtacgtgt

SEQ ID NO: 7999 - DNA, 25 bp, Homo sapien
tacattttcccacccgtactcttga

SEQ ID NO: 8000 - DNA, 25 bp, Homo sapien
ctctttatggcccatcacttacttt

SEQ ID NO: 8001 - DNA, 25 bp, Homo sapien
atcacttacttttgccatgttttca

SEQ ID NO: 8002 - DNA, 25 bp, Homo sapien
acttacttttgccatgttttcattt

SEQ ID NO: 8003 - DNA, 25 bp, Homo sapien
tttccatctctgattcccaacatct

SEQ ID NO: 8004 - DNA, 25 bp, Homo sapien
ttcccaacatcttagtaagtagcag

SEQ ID NO: 8005 - DNA, 25 bp, Homo sapien
tagcagaaattctcaaaacagtttt

SEQ ID NO: 8006 - DNA, 25 bp, Homo sapien
gagagaataaacactgaatccatca

SEQ ID NO: 8007 - DNA, 25 bp, Homo sapien
acactgaatccatcatgttgtctgc

SEQ ID NO: 8008 - DNA, 25 bp, Homo sapien
atccatcatgttgtctgctatgaaa

SEQ ID NO: 8009 - DNA, 25 bp, Homo sapien
gttgtctgctatgaaaactggtaac

SEQ ID NO: 8010 - DNA, 25 bp, Homo sapien
gttcagaaagatcatttagctttcc

SEQ ID NO: 8011 - DNA, 25 bp, Homo sapien
atttagctttcctggtgccttcttt

SEQ ID NO: 8012 - DNA, 25 bp, Homo sapien
atgtcaaaggtcattgggtacgcat

SEQ ID NO: 8013 - DNA, 25 bp, Homo sapien
gtcaaaggtcattgggtacgcatgc

SEQ ID NO: 8014 - DNA, 25 bp, Homo sapien
tcaaaggtcattgggtacgcatgct

SEQ ID NO: 8015 - DNA, 25 bp, Homo sapien
aaaggtcattgggtacgcatgcttt

SEQ ID NO: 8016 - DNA, 25 bp, Homo sapien
aaggtcattgggtacgcatgcttta

SEQ ID NO: 8017 - DNA, 25 bp, Homo sapien
aggtcattgggtacgcatgctttat

SEQ ID NO: 8018 - DNA, 25 bp, Homo sapien
ggtcattgggtacgcatgctttata

SEQ ID NO: 8019 - DNA, 25 bp, Homo sapien
ttataataaatttccccttgatcct

SEQ ID NO: 8020 - DNA, 25 bp, Homo sapien
tataataaatttccccttgatcctt

SEQ ID NO: 8021 - DNA, 25 bp, Homo sapien
agttcctgaatatggtcaaacccaa

SEQ ID NO: 8022 - DNA, 25 bp, Homo sapien
atggtcaaacccaaaacgtcagtga

SEQ ID NO: 8023 - DNA, 25 bp, Homo sapien
tcaaacccaaaacgtcagtgaattt

SEQ ID NO: 8024 - DNA, 25 bp, Homo sapien
agccaagtaaatagtcaaggaaata

SEQ ID NO: 8025 - DNA, 25 bp, Homo sapien
caagacatagtgcaaaggatatata

SEQ ID NO: 8026 - DNA, 25 bp, Homo sapien
gaaagagactcgtgatcccattctg

SEQ ID NO: 8027 - DNA, 25 bp, Homo sapien
agagactcgtgatcccattctggca

SEQ ID NO: 8028 - DNA, 25 bp, Homo sapien
tcgtgatcccattctggcatgacag

SEQ ID NO: 8029 - DNA, 25 bp, Homo sapien
tggcatgacagaaacttcattggaa

SEQ ID NO: 8030 - DNA, 25 bp, Homo sapien
caataagtgtgagcgttttagcagt

SEQ ID NO: 8031 - DNA, 25 bp, Homo sapien
gtgagcgttttagcagtgaatgtat

SEQ ID NO: 8032 - DNA, 25 bp, Homo sapien
aatatgtgtccaactttatctaaag

SEQ ID NO: 8033 - DNA, 25 bp, Homo sapien
tttatctaaagtcatcagtgatgcc

SEQ ID NO: 8034 - DNA, 25 bp, Homo sapien
tgatgccatctgacccttgaaaggt

SEQ ID NO: 8035 - DNA, 25 bp, Homo sapien
tgccatctgacccttgaaaggtatt

SEQ ID NO: 8036 - DNA, 25 bp, Homo sapien
cttgaaaggtattcaggtcggccgg

SEQ ID NO: 8037 - DNA, 25 bp, Homo sapien
aaggtattcaggtcggccgggtgtg

SEQ ID NO: 8038 - DNA, 25 bp, Homo sapien
ccagcctgaccgatatgatgaattt

SEQ ID NO: 8039 - DNA, 25 bp, Homo sapien
gcctgaccgatatgatgaattttta

SEQ ID NO: 8040 - DNA, 25 bp, Homo sapien
gatatgatgaatttttagtctctac

SEQ ID NO: 8041 - DNA, 25 bp, Homo sapien
gaaaggtattcagatcagcctcaac

SEQ ID NO: 8042 - DNA, 25 bp, Homo sapien
gtattcagatcagcctcaactcact

SEQ ID NO: 8043 - DNA, 25 bp, Homo sapien
aagccggcggaggacaagggagctc

SEQ ID NO: 8044 - DNA, 25 bp, Homo sapien
agctcctgggaggacagctgtgctc

SEQ ID NO: 8045 - DNA, 25 bp, Homo sapien
gacagctgtgctccggcctagcaat

SEQ ID NO: 8046 - DNA, 25 bp, Homo sapien
cacagagcaacgatggtccttgtac

SEQ ID NO: 8047 - DNA, 25 bp, Homo sapien
gagcaacgatggtccttgtacatga

SEQ ID NO: 8048 - DNA, 25 bp, Homo sapien
cgatggtccttgtacatgaagataa

SEQ ID NO: 8049 - DNA, 25 bp, Homo sapien
aaaaatgctcaggtgtgcccaggtt

SEQ ID NO: 8050 - DNA, 25 bp, Homo sapien
atgctcaggtgtgcccaggttgaag

SEQ ID NO: 8051 - DNA, 25 bp, Homo sapien
gtgtgcccaggttgaagaagatgaa

SEQ ID NO: 8052 - DNA, 25 bp, Homo sapien
atgcccggcctacctggagcattat

SEQ ID NO: 8053 - DNA, 25 bp, Homo sapien
cggcctacctggagcattattaaaa

SEQ ID NO: 8054 - DNA, 25 bp, Homo sapien
tcttatctgaaacagtggaacccag

SEQ ID NO: 8055 - DNA, 25 bp, Homo sapien
aacggcacaacatttttcgtgtatt

SEQ ID NO: 8056 - DNA, 25 bp, Homo sapien
acatttttcgtgtatttgaagtgaa

SEQ ID NO: 8057 - DNA, 25 bp, Homo sapien
ttcaaccacagattttatgtctggg

SEQ ID NO: 8058 - DNA, 25 bp, Homo sapien
tatgtctgggaacactatccttcag

SEQ ID NO: 8059 - DNA, 25 bp, Homo sapien
ctgggaacactatccttcaggaatg

SEQ ID NO: 8060 - DNA, 25 bp, Homo sapien
aaaaatttgtgcctaggagacttat

SEQ ID NO: 8061 - DNA, 25 bp, Homo sapien
ggagacttatccttaaagattggat

SEQ ID NO: 8062 - DNA, 25 bp, Homo sapien
ggataatttatcaaacagcaaggaa

SEQ ID NO: 8063 - DNA, 25 bp, Homo sapien
taagagggaatcctgaagcatcaga

SEQ ID NO: 8064 - DNA, 25 bp, Homo sapien
aatgaaaatatggaagccgggcatg

SEQ ID NO: 8065 - DNA, 25 bp, Homo sapien
tctgcctatgcctgctttctctttg

SEQ ID NO: 8066 - DNA, 25 bp, Homo sapien
tgcctatgcctgctttctctttgcc

SEQ ID NO: 8067 - DNA, 25 bp, Homo sapien
tcttcttccagcaataccaggcagc

SEQ ID NO: 8068 - DNA, 25 bp, Homo sapien
aggcagccacccctggtcaggacct

SEQ ID NO: 8069 - DNA, 25 bp, Homo sapien
gtcaggacctgctgcgctgtaagat

SEQ ID NO: 8070 - DNA, 25 bp, Homo sapien
tcaggacctgctgcgctgtaagatc

SEQ ID NO: 8071 - DNA, 25 bp, Homo sapien
ggacctgctgcgctgtaagatcctg

SEQ ID NO: 8072 - DNA, 25 bp, Homo sapien
acctgctgcgctgtaagatcctgat

SEQ ID NO: 8073 - DNA, 25 bp, Homo sapien
ctgctgcgctgtaagatcctgatga

SEQ ID NO: 8074 - DNA, 25 bp, Homo sapien
tgctgcgctgtaagatcctgatgaa

SEQ ID NO: 8075 - DNA, 25 bp, Homo sapien
gctgcgctgtaagatcctgatgaag

SEQ ID NO: 8076 - DNA, 25 bp, Homo sapien
tcaggctttaacacatattaagaca

SEQ ID NO: 8077 - DNA, 25 bp, Homo sapien
caggctttaacacatattaagacag

SEQ ID NO: 8078 - DNA, 25 bp, Homo sapien
ggctttaacacatattaagacagat

SEQ ID NO: 8079 - DNA, 25 bp, Homo sapien
gctttaacacatattaagacagatt

SEQ ID NO: 8080 - DNA, 25 bp, Homo sapien
agacagatttgggattatcatacct

SEQ ID NO: 8081 - DNA, 25 bp, Homo sapien
gcagtggtcacagctgtaattccag

SEQ ID NO: 8082 - DNA, 25 bp, Homo sapien
aagagttcattgataattgattagc

SEQ ID NO: 8083 - DNA, 25 bp, Homo sapien
gttcattgataattgattagcatgt

SEQ ID NO: 8084 - DNA, 25 bp, Homo sapien
aatggatataatttcaggctttaac

SEQ ID NO: 8085 - DNA, 25 bp, Homo sapien
atggatataatttcaggctttaaca

SEQ ID NO: 8086 - DNA, 25 bp, Homo sapien
tggatataatttcaggctttaacac

SEQ ID NO: 8087 - DNA, 25 bp, Homo sapien
gtaaaatcctgtgcgtgaggccaaa

SEQ ID NO: 8088 - DNA, 25 bp, Homo sapien
ggaaattggacactcttgtccctca

SEQ ID NO: 8089 - DNA, 25 bp, Homo sapien
actcttgtccctcacatggaggagg

SEQ ID NO: 8090 - DNA, 25 bp, Homo sapien
ggcacactctaaataagtcatccca

SEQ ID NO: 8091 - DNA, 25 bp, Homo sapien
agtcatcccacttttgcgaatctgt

SEQ ID NO: 8092 - DNA, 25 bp, Homo sapien
acttttgcgaatctgttctgtggaa

SEQ ID NO: 8093 - DNA, 25 bp, Homo sapien
gaaaatgcatgttcttcctaacctt

SEQ ID NO: 8094 - DNA, 25 bp, Homo sapien
gttcttcctaacctttgctaagcat

SEQ ID NO: 8095 - DNA, 25 bp, Homo sapien
gtgatatctattatggcactgttca

SEQ ID NO: 8096 - DNA, 25 bp, Homo sapien
atggcactgttcattgtggcaaaaa

SEQ ID NO: 8097 - DNA, 25 bp, Homo sapien
aatccggaagcaaccttatgtccat

SEQ ID NO: 8098 - DNA, 25 bp, Homo sapien
agggaaccaatagcaggaaatctga

SEQ ID NO: 8099 - DNA, 25 bp, Homo sapien
ggaaatctgataagacaagccatat

SEQ ID NO: 8100 - DNA, 25 bp, Homo sapien
atgatagacgagtcctatggtgtga

SEQ ID NO: 8101 - DNA, 25 bp, Homo sapien
agtcctatggtgtgagaaaagctat

SEQ ID NO: 8102 - DNA, 25 bp, Homo sapien
tctgaacctgtaaacttaagacact

SEQ ID NO: 8103 - DNA, 25 bp, Homo sapien
aacttaagacactaatttcacataa

SEQ ID NO: 8104 - DNA, 25 bp, Homo sapien
aagtcaaatcccatataaagttaag

SEQ ID NO: 8105 - DNA, 25 bp, Homo sapien
gaacacagggtctaacttctctaca

SEQ ID NO: 8106 - DNA, 25 bp, Homo sapien
gggtctaacttctctacagataata

SEQ ID NO: 8107 - DNA, 25 bp, Homo sapien
aagcacatcggaaagacatgtccat

SEQ ID NO: 8108 - DNA, 25 bp, Homo sapien
gacatgtccataaaataggtgacca

SEQ ID NO: 8109 - DNA, 25 bp, Homo sapien
ggaaatacagaccatattatcaatt

SEQ ID NO: 8110 - DNA, 25 bp, Homo sapien
tacagaccatattatcaattacttt

SEQ ID NO: 8111 - DNA, 25 bp, Homo sapien
tactttttgtaaactgtaacatctg

SEQ ID NO: 8112 - DNA, 25 bp, Homo sapien
actgtaacatctgaaaatttcctaa

SEQ ID NO: 8113 - DNA, 25 bp, Homo sapien
atatattcattgttagcacatagca

SEQ ID NO: 8114 - DNA, 25 bp, Homo sapien
attcattgttagcacatagcaaaac

SEQ ID NO: 8115 - DNA, 25 bp, Homo sapien
aaaatgattattaccccaatcccat

SEQ ID NO: 8116 - DNA, 25 bp, Homo sapien
tgattattaccccaatcccatcatc

SEQ ID NO: 8117 - DNA, 25 bp, Homo sapien
aatcccatcatctagagatgctcaa

SEQ ID NO: 8118 - DNA, 25 bp, Homo sapien
gatgctcaatggttggctgggcaca

SEQ ID NO: 8119 - DNA, 25 bp, Homo sapien
acaaagtccaatgtggtggcacgtg

SEQ ID NO: 8120 - DNA, 25 bp, Homo sapien
gttaatacttatgagactacatttg

SEQ ID NO: 8121 - DNA, 25 bp, Homo sapien
tacttatgagactacatttgtaaaa

SEQ ID NO: 8122 - DNA, 25 bp, Homo sapien
gaaacccttgcacatcgttagtagg

SEQ ID NO: 8123 - DNA, 25 bp, Homo sapien
aacccttgcacatcgttagtaggaa

SEQ ID NO: 8124 - DNA, 25 bp, Homo sapien
cttgcacatcgttagtaggaataga

SEQ ID NO: 8125 - DNA, 25 bp, Homo sapien
taggaatagaaattagagccgccat

SEQ ID NO: 8126 - DNA, 25 bp, Homo sapien
gaatagaaattagagccgccattat

SEQ ID NO: 8127 - DNA, 25 bp, Homo sapien
attagagccgccattattaaaacct

SEQ ID NO: 8128 - DNA, 25 bp, Homo sapien
gagccgccattattaaaacctatat

SEQ ID NO: 8129 - DNA, 25 bp, Homo sapien
aacctatatgacagtttctcaaaag

SEQ ID NO: 8130 - DNA, 25 bp, Homo sapien
taaagatagaactagctgggtgcag

SEQ ID NO: 8131 - DNA, 25 bp, Homo sapien
atttctagacttggtaagtatctta

SEQ ID NO: 8132 - DNA, 25 bp, Homo sapien
gtatcttaagtatccactagtccct

SEQ ID NO: 8133 - DNA, 25 bp, Homo sapien
ttaagtatccactagtcccttgtac

SEQ ID NO: 8134 - DNA, 25 bp, Homo sapien
ctagtcccttgtacaatctctgtgt

SEQ ID NO: 8135 - DNA, 25 bp, Homo sapien
tctgtgtagagattcctgttttgtg

SEQ ID NO: 8136 - DNA, 25 bp, Homo sapien
atttctcataagatagtgtcatcct

SEQ ID NO: 8137 - DNA, 25 bp, Homo sapien
aagatagtgtcatcctctgacccta

SEQ ID NO: 8138 - DNA, 25 bp, Homo sapien
gtgtcatcctctgaccctaaagaaa

SEQ ID NO: 8139 - DNA, 25 bp, Homo sapien
ttgaaccccgaaggcagtgtttgtg

SEQ ID NO: 8140 - DNA, 25 bp, Homo sapien
accccgaaggcagtgtttgtggtga

SEQ ID NO: 8141 - DNA, 25 bp, Homo sapien
ggtgagcagaaattgcttcattgca

SEQ ID NO: 8142 - DNA, 25 bp, Homo sapien
ataatgcttttctccctcctgatac

SEQ ID NO: 8143 - DNA, 25 bp, Homo sapien
agccccgtgctattgatacacattc

SEQ ID NO: 8144 - DNA, 25 bp, Homo sapien
gctattgatacacattctggctttg

SEQ ID NO: 8145 - DNA, 25 bp, Homo sapien
ttttctctttggcatgttgatctac

SEQ ID NO: 8146 - DNA, 25 bp, Homo sapien
gttgatctacagagtgctaccaaga

SEQ ID NO: 8147 - DNA, 25 bp, Homo sapien
agtgctaccaagacctcgatgaggc

SEQ ID NO: 8148 - DNA, 25 bp, Homo sapien
gaggccaatattcaatatcactata

SEQ ID NO: 8149 - DNA, 25 bp, Homo sapien
gtttatctgattggagttgcctcac

SEQ ID NO: 8150 - DNA, 25 bp, Homo sapien
gttgcctcactggtgatggtgatta

SEQ ID NO: 8151 - DNA, 25 bp, Homo sapien
ttgaatctggaaggcccaggttgta

SEQ ID NO: 8152 - DNA, 25 bp, Homo sapien
gctgtactgcagtctgggcgccaga

SEQ ID NO: 8153 - DNA, 25 bp, Homo sapien
agctggacatgtgatgcatgcatgt

SEQ ID NO: 8154 - DNA, 25 bp, Homo sapien
agttcaaggctataggctgtcgtgt

SEQ ID NO: 8155 - DNA, 25 bp, Homo sapien
aaggctataggctgtcgtgtgctct

SEQ ID NO: 8156 - DNA, 25 bp, Homo sapien
tataggctgtcgtgtgctctgatca

SEQ ID NO: 8157 - DNA, 25 bp, Homo sapien
aggctgtcgtgtgctctgatcatgc

SEQ ID NO: 8158 - DNA, 25 bp, Homo sapien
tcgtgtgctctgatcatgcctatga

SEQ ID NO: 8159 - DNA, 25 bp, Homo sapien
ggggatttgtcccaagtcacacttt

SEQ ID NO: 8160 - DNA, 25 bp, Homo sapien
taatttatggcagagctagaactaa

SEQ ID NO: 8161 - DNA, 25 bp, Homo sapien
gctagaactaaactggtatgagtaa

SEQ ID NO: 8162 - DNA, 25 bp, Homo sapien
gaagcaataatagggcaccgggtac

SEQ ID NO: 8163 - DNA, 25 bp, Homo sapien
caataatagggcaccgggtacagtg

SEQ ID NO: 8164 - DNA, 25 bp, Homo sapien
ggcagctttgcagtgttctctgaga

SEQ ID NO: 8165 - DNA, 25 bp, Homo sapien
gcagtgttctctgagatgcttgaag

SEQ ID NO: 8166 - DNA, 25 bp, Homo sapien
ggatgtgtatagtgtctttgccatt

SEQ ID NO: 8167 - DNA, 25 bp, Homo sapien
ctttgccattttagaaggttccagt

SEQ ID NO: 8168 - DNA, 25 bp, Homo sapien
agagttgcaaggactctttggagtc

SEQ ID NO: 8169 - DNA, 25 bp, Homo sapien
ctctttggagtcagtcattttcctc

SEQ ID NO: 8170 - DNA, 25 bp, Homo sapien
ctgaaaaatctgaacgctgagcggt

SEQ ID NO: 8171 - DNA, 25 bp, Homo sapien
aacgctgagcggtggcatgacttgc

SEQ ID NO: 8172 - DNA, 25 bp, Homo sapien
atgacttgcccgtggttgtgcagct

SEQ ID NO: 8173 - DNA, 25 bp, Homo sapien
tggcattagaacacagctgtcctta

SEQ ID NO: 8174 - DNA, 25 bp, Homo sapien
gtcaacatagtggaccccagacttt

SEQ ID NO: 8175 - DNA, 25 bp, Homo sapien
gtttgtcttaaccagaattattctg

SEQ ID NO: 8176 - DNA, 25 bp, Homo sapien
ccatgctctgatagcccttggtttg

SEQ ID NO: 8177 - DNA, 25 bp, Homo sapien
atagcccttggtttgcacctatata

SEQ ID NO: 8178 - DNA, 25 bp, Homo sapien
gcacctatataaaagcacctaaata

SEQ ID NO: 8179 - DNA, 25 bp, Homo sapien
aaataccagtgcaatggaggcagta

SEQ ID NO: 8180 - DNA, 25 bp, Homo sapien
ggcagtagagtatgctgggcaaccc

SEQ ID NO: 8181 - DNA, 25 bp, Homo sapien
tggctttgtatcctgcctcttttag

SEQ ID NO: 8182 - DNA, 25 bp, Homo sapien
gcctcttttagcttcaaagacaagt

SEQ ID NO: 8183 - DNA, 25 bp, Homo sapien
agttatgagaacttaaccactctgg

SEQ ID NO: 8184 - DNA, 25 bp, Homo sapien
aaatttgcctagtataagtgctact

SEQ ID NO: 8185 - DNA, 25 bp, Homo sapien
aagtgctactttctacagaaggcct

SEQ ID NO: 8186 - DNA, 25 bp, Homo sapien
aatctgttagtaagtggctaaggaa

SEQ ID NO: 8187 - DNA, 25 bp, Homo sapien
aagagtctgtgatttaatacatgta

SEQ ID NO: 8188 - DNA, 25 bp, Homo sapien
gtatgaactttattttcagtcccag

SEQ ID NO: 8189 - DNA, 25 bp, Homo sapien
tgaactttattttcagtcccagaaa

SEQ ID NO: 8190 - DNA, 25 bp, Homo sapien
gattatgaattgacttttgtcccgg

SEQ ID NO: 8191 - DNA, 25 bp, Homo sapien
tgaattgacttttgtcccggtggtt

SEQ ID NO: 8192 - DNA, 25 bp, Homo sapien
ccagttatacttcccttgctctttc

SEQ ID NO: 8193 - DNA, 25 bp, Homo sapien
ttctttcttaaatgtcctctttact

SEQ ID NO: 8194 - DNA, 25 bp, Homo sapien
actttctctatcatttttcagacta

SEQ ID NO: 8195 - DNA, 25 bp, Homo sapien
atcatttttcagactattcttatct

SEQ ID NO: 8196 - DNA, 25 bp, Homo sapien
ttcagactattcttatcttttttaa

SEQ ID NO: 8197 - DNA, 25 bp, Homo sapien
taatccatacttgtggctccaatta

SEQ ID NO: 8198 - DNA, 25 bp, Homo sapien
acttgtggctccaattaagaaacac

SEQ ID NO: 8199 - DNA, 25 bp, Homo sapien
ttctttgttttttaccacttgcatg

SEQ ID NO: 8200 - DNA, 25 bp, Homo sapien
aagaagggtgattcttgcagcccta

SEQ ID NO: 8201 - DNA, 25 bp, Homo sapien
tgcagccctaatgaacagacaccat

SEQ ID NO: 8202 - DNA, 25 bp, Homo sapien
gaacagacaccatcagaacaccaaa

SEQ ID NO: 8203 - DNA, 25 bp, Homo sapien
aagagaggcgacttaattttgtgag

SEQ ID NO: 8204 - DNA, 25 bp, Homo sapien
ttgtgagacagagccattttcctcc

SEQ ID NO: 8205 - DNA, 25 bp, Homo sapien
tttcctcctttctgtgaagtatctc

SEQ ID NO: 8206 - DNA, 25 bp, Homo sapien
tcctttctgtgaagtatctctgata

SEQ ID NO: 8207 - DNA, 25 bp, Homo sapien
tgaggaaattatatggtctgggccg

SEQ ID NO: 8208 - DNA, 25 bp, Homo sapien
aaacagattggtgatttctcagaaa

SEQ ID NO: 8209 - DNA, 25 bp, Homo sapien
actgtcatctgacccagttattcca

SEQ ID NO: 8210 - DNA, 25 bp, Homo sapien
tattccactcccagattaagaagac

SEQ ID NO: 8211 - DNA, 25 bp, Homo sapien
gtcagataacttgcccagagtcaaa

SEQ ID NO: 8212 - DNA, 25 bp, Homo sapien
caaaactcagttttccgaacttcag

SEQ ID NO: 8213 - DNA, 25 bp, Homo sapien
tttccgaacttcagagaccttactt

SEQ ID NO: 8214 - DNA, 25 bp, Homo sapien
gaccttacttttaccatcttaccat

SEQ ID NO: 8215 - DNA, 25 bp, Homo sapien
catcttaccatgctgtcttctaaac

SEQ ID NO: 8216 - DNA, 25 bp, Homo sapien
tggattatcttgagcctttcccttt

SEQ ID NO: 8217 - DNA, 25 bp, Homo sapien
cacctataatcttcgcactctggga

SEQ ID NO: 8218 - DNA, 25 bp, Homo sapien
gggtgaggcccggaactgcttcaac

SEQ ID NO: 8219 - DNA, 25 bp, Homo sapien
tccacctcgacattactgacatttg

SEQ ID NO: 8220 - DNA, 25 bp, Homo sapien
cacctcgacattactgacatttggg

SEQ ID NO: 8221 - DNA, 25 bp, Homo sapien
caaccatacccctggttgtgacagc

SEQ ID NO: 8222 - DNA, 25 bp, Homo sapien
gtgacagcccccaaaaatgtctcta

SEQ ID NO: 8223 - DNA, 25 bp, Homo sapien
gacattgcgaaatgttccctgcagg

SEQ ID NO: 8224 - DNA, 25 bp, Homo sapien
gaagggactacaaatgtacttcctc

SEQ ID NO: 8225 - DNA, 25 bp, Homo sapien
attcttttgacgctaagccaccctg

SEQ ID NO: 8226 - DNA, 25 bp, Homo sapien
tgacgctaagccaccctggtcctga

SEQ ID NO: 8227 - DNA, 25 bp, Homo sapien
gacgcctcccctcacttagaaaagg

SEQ ID NO: 8228 - DNA, 25 bp, Homo sapien
cctcccctcacttagaaaaggcata

SEQ ID NO: 8229 - DNA, 25 bp, Homo sapien
aaaaggcatacaggaggccgggcat

SEQ ID NO: 8230 - DNA, 25 bp, Homo sapien
atttgatgtgtttttccgcaacctg

SEQ ID NO: 8231 - DNA, 25 bp, Homo sapien
tgatgtgtttttccgcaacctgatc

SEQ ID NO: 8232 - DNA, 25 bp, Homo sapien
ccgcaacctgatcatgggcatggat

SEQ ID NO: 8233 - DNA, 25 bp, Homo sapien
gggcatggatgataaccacccaagg

SEQ ID NO: 8234 - DNA, 25 bp, Homo sapien
atggatgataaccacccaaggccca

SEQ ID NO: 8235 - DNA, 25 bp, Homo sapien
atgataaccacccaaggcccaaaag

SEQ ID NO: 8236 - DNA, 25 bp, Homo sapien
ggcccaaaagcgtcaaactcaccaa

SEQ ID NO: 8237 - DNA, 25 bp, Homo sapien
tcaccaaaaacaacatctttccaga

SEQ ID NO: 8238 - DNA, 25 bp, Homo sapien
ggtaatttagaacctgtttgttatg

SEQ ID NO: 8239 - DNA, 25 bp, Homo sapien
aacctgtttgttatgttctagtata

SEQ ID NO: 8240 - DNA, 25 bp, Homo sapien
taatagttggaattacgtgttctaa

SEQ ID NO: 8241 - DNA, 25 bp, Homo sapien
gggctggtattcagaatatataaat

SEQ ID NO: 8242 - DNA, 25 bp, Homo sapien
ctcaatcaaaagtgggcaaagcctt

SEQ ID NO: 8243 - DNA, 25 bp, Homo sapien
ggcaaagcctttgaatagacacttc

SEQ ID NO: 8244 - DNA, 25 bp, Homo sapien
aagcctttgaatagacacttctcca

SEQ ID NO: 8245 - DNA, 25 bp, Homo sapien
gacgttcaacgtcataagtcactag

SEQ ID NO: 8246 - DNA, 25 bp, Homo sapien
gttcaacgtcataagtcactaggga

SEQ ID NO: 8247 - DNA, 25 bp, Homo sapien
caacgtcataagtcactagggaaat

SEQ ID NO: 8248 - DNA, 25 bp, Homo sapien
tacaatgattgctgtcaggcctctg

SEQ ID NO: 8249 - DNA, 25 bp, Homo sapien
cctgccggcaaaacgttgctcttaa

SEQ ID NO: 8250 - DNA, 25 bp, Homo sapien
gccggcaaaacgttgctcttaactt

SEQ ID NO: 8251 - DNA, 25 bp, Homo sapien
cggcaaaacgttgctcttaacttca

SEQ ID NO: 8252 - DNA, 25 bp, Homo sapien
tgtacaaaatcaaccttgcatggtg

SEQ ID NO: 8253 - DNA, 25 bp, Homo sapien
atcaaccttgcatggtgattggcac

SEQ ID NO: 8254 - DNA, 25 bp, Homo sapien
aaccttgcatggtgattggcacctg

SEQ ID NO: 8255 - DNA, 25 bp, Homo sapien
ccttgcatggtgattggcacctgta

SEQ ID NO: 8256 - DNA, 25 bp, Homo sapien
tgtagtcccatctaattcagaaggt

SEQ ID NO: 8257 - DNA, 25 bp, Homo sapien
tagtcccatctaattcagaaggtga

SEQ ID NO: 8258 - DNA, 25 bp, Homo sapien
gtcccatctaattcagaaggtgatc

SEQ ID NO: 8259 - DNA, 25 bp, Homo sapien
catctaattcagaaggtgatctgga

SEQ ID NO: 8260 - DNA, 25 bp, Homo sapien
gcttaagagacagagcaagtccctg

SEQ ID NO: 8261 - DNA, 25 bp, Homo sapien
cctgctgtcttctgactggggattt

SEQ ID NO: 8262 - DNA, 25 bp, Homo sapien
gggatttacggaatgcaggaaaatg

SEQ ID NO: 8263 - DNA, 25 bp, Homo sapien
gtgatgaggagatggtttacataaa

SEQ ID NO: 8264 - DNA, 25 bp, Homo sapien
gaaaactccaagttaagatactgtt

SEQ ID NO: 8265 - DNA, 25 bp, Homo sapien
actgttttttatctatcgtataggc

SEQ ID NO: 8266 - DNA, 25 bp, Homo sapien
atctatcgtataggcaaggactaaa

SEQ ID NO: 8267 - DNA, 25 bp, Homo sapien
aatagctgatattaccatgatggtg

SEQ ID NO: 8268 - DNA, 25 bp, Homo sapien
agaactctcagaaacatggctatgg

SEQ ID NO: 8269 - DNA, 25 bp, Homo sapien
ctctcagaaacatggctatggattt

SEQ ID NO: 8270 - DNA, 25 bp, Homo sapien
gatttcacttctaatccttgtctga

SEQ ID NO: 8271 - DNA, 25 bp, Homo sapien
ttcacttctaatccttgtctgatgg

SEQ ID NO: 8272 - DNA, 25 bp, Homo sapien
aatccttgtctgatggaagtacaca

SEQ ID NO: 8273 - DNA, 25 bp, Homo sapien
gaagtacacaagtaagaggccaggt

SEQ ID NO: 8274 - DNA, 25 bp, Homo sapien
aaaacttgtccctgaatgacttttg

SEQ ID NO: 8275 - DNA, 25 bp, Homo sapien
aacttgtccctgaatgacttttgga

SEQ ID NO: 8276 - DNA, 25 bp, Homo sapien
ttgtccctgaatgacttttggataa

SEQ ID NO: 8277 - DNA, 25 bp, Homo sapien
gaatgacttttggataaacagcaaa

SEQ ID NO: 8278 - DNA, 25 bp, Homo sapien
ttaaaatagagacccaacataccaa

SEQ ID NO: 8279 - DNA, 25 bp, Homo sapien
agagcactaaatacctacatcaaaa

SEQ ID NO: 8280 - DNA, 25 bp, Homo sapien
ttgacccatgctcagtcataaagca

SEQ ID NO: 8281 - DNA, 25 bp, Homo sapien
gacccatgctcagtcataaagcaaa

SEQ ID NO: 8282 - DNA, 25 bp, Homo sapien
gaaatcacatcaagcaccaacttgg

SEQ ID NO: 8283 - DNA, 25 bp, Homo sapien
atcaagcaccaacttggaccacagt

SEQ ID NO: 8284 - DNA, 25 bp, Homo sapien
gcaccaacttggaccacagtggaat

SEQ ID NO: 8285 - DNA, 25 bp, Homo sapien
gaactggaggttattatgtgaattg

SEQ ID NO: 8286 - DNA, 25 bp, Homo sapien
gacaaatattgcatgttttcattca

SEQ ID NO: 8287 - DNA, 25 bp, Homo sapien
ttcattcatatgtgggagttttaaa

SEQ ID NO: 8288 - DNA, 25 bp, Homo sapien
tttaaaagtggatctcatagagata

SEQ ID NO: 8289 - DNA, 25 bp, Homo sapien
gtagagagataagttaccagaggct

SEQ ID NO: 8290 - DNA, 25 bp, Homo sapien
gaagagagattgattactgagtaca

SEQ ID NO: 8291 - DNA, 25 bp, Homo sapien
gagagattgattactgagtacaaac

SEQ ID NO: 8292 - DNA, 25 bp, Homo sapien
gattactgagtacaaacatacaatt

SEQ ID NO: 8293 - DNA, 25 bp, Homo sapien
gatagcatagtagggtgagtataat

SEQ ID NO: 8294 - DNA, 25 bp, Homo sapien
aatagctagaagatggccaggcacc

SEQ ID NO: 8295 - DNA, 25 bp, Homo sapien
tagctagaagatggccaggcaccat

SEQ ID NO: 8296 - DNA, 25 bp, Homo sapien
aatcatcagatatttatagcctacc

SEQ ID NO: 8297 - DNA, 25 bp, Homo sapien
atagcctacctcctatttgcggtat

SEQ ID NO: 8298 - DNA, 25 bp, Homo sapien
tcctatttgcggtataccatacaag

SEQ ID NO: 8299 - DNA, 25 bp, Homo sapien
aggatgaatgaggtacatgccacca

SEQ ID NO: 8300 - DNA, 25 bp, Homo sapien
ggtacatgccaccattgactcctgg

SEQ ID NO: 8301 - DNA, 25 bp, Homo sapien
cttctgcgtcctgcttaacattagg

SEQ ID NO: 8302 - DNA, 25 bp, Homo sapien
acattaggatagcacaggagtttaa

SEQ ID NO: 8303 - DNA, 25 bp, Homo sapien
gtttaaataaacagccacccctctg

SEQ ID NO: 8304 - DNA, 25 bp, Homo sapien
tgccatgctttctcacaggctgtgt

SEQ ID NO: 8305 - DNA, 25 bp, Homo sapien
gtgtccatttggtgtgttgatttgt

SEQ ID NO: 8306 - DNA, 25 bp, Homo sapien
aatggctacctttgtcaatcatcag

SEQ ID NO: 8307 - DNA, 25 bp, Homo sapien
agaggccatgccttcttctttatat

SEQ ID NO: 8308 - DNA, 25 bp, Homo sapien
gccttcttctttatatctgtccagt

SEQ ID NO: 8309 - DNA, 25 bp, Homo sapien
attgacacataattgatcttgagca

SEQ ID NO: 8310 - DNA, 25 bp, Homo sapien
gatcttgagcaaatttcttatgata

SEQ ID NO: 8311 - DNA, 25 bp, Homo sapien
aaatctgtggtagcaccaacccaac

SEQ ID NO: 8312 - DNA, 25 bp, Homo sapien
aacccaactggtattagctcacaaa

SEQ ID NO: 8313 - DNA, 25 bp, Homo sapien
gctcacaaattgtttcttcctctag

SEQ ID NO: 8314 - DNA, 25 bp, Homo sapien
cttcctctaggagtttacagttcca

SEQ ID NO: 8315 - DNA, 25 bp, Homo sapien
gagtttacagttccacaggcattat

SEQ ID NO: 8316 - DNA, 25 bp, Homo sapien
tattaaaagaatatgccggctgggc

SEQ ID NO: 8317 - DNA, 25 bp, Homo sapien
actccagcccgcacgatagtgtaag

SEQ ID NO: 8318 - DNA, 25 bp, Homo sapien
aatgtctttctctttggtctaggag

SEQ ID NO: 8319 - DNA, 25 bp, Homo sapien
tctttggtctaggagatatcgcact

SEQ ID NO: 8320 - DNA, 25 bp, Homo sapien
aggagatatcgcactatgggaatgt

SEQ ID NO: 8321 - DNA, 25 bp, Homo sapien
gggctctgtctgtcattactctggc

SEQ ID NO: 8322 - DNA, 25 bp, Homo sapien
gtctgtcattactctggcatttcaa

SEQ ID NO: 8323 - DNA, 25 bp, Homo sapien
tcaactcctcattcatggcctaatt

SEQ ID NO: 8324 - DNA, 25 bp, Homo sapien
aactcctcattcatggcctaattcc

SEQ ID NO: 8325 - DNA, 25 bp, Homo sapien
gggcaccaataatactgtggcctgg

SEQ ID NO: 8326 - DNA, 25 bp, Homo sapien
caataatactgtggcctggcctgtg

SEQ ID NO: 8327 - DNA, 25 bp, Homo sapien
ggataccagggcaaggctggcccaa

SEQ ID NO: 8328 - DNA, 25 bp, Homo sapien
cagggcaaggctggcccaaggacct

SEQ ID NO: 8329 - DNA, 25 bp, Homo sapien
aaattagacccgaagagcaacttag

SEQ ID NO: 8330 - DNA, 25 bp, Homo sapien
attagacccgaagagcaacttagga

SEQ ID NO: 8331 - DNA, 25 bp, Homo sapien
tagacccgaagagcaacttaggaaa

SEQ ID NO: 8332 - DNA, 25 bp, Homo sapien
acactgaaacatcaacaccaggtga

SEQ ID NO: 8333 - DNA, 25 bp, Homo sapien
tcaacaccaggtgaaggaaaataaa

SEQ ID NO: 8334 - DNA, 25 bp, Homo sapien
aaacagtaacaaaaagggcatctca

SEQ ID NO: 8335 - DNA, 25 bp, Homo sapien
aacaaaaagggcatctcagtataga

SEQ ID NO: 8336 - DNA, 25 bp, Homo sapien
aaagggcatctcagtatagagagca

SEQ ID NO: 8337 - DNA, 25 bp, Homo sapien
gggcatctcagtatagagagcagct

SEQ ID NO: 8338 - DNA, 25 bp, Homo sapien
gcatctcagtatagagagcagctta

SEQ ID NO: 8339 - DNA, 25 bp, Homo sapien
agtatagagagcagcttaaagttct

SEQ ID NO: 8340 - DNA, 25 bp, Homo sapien
ggcaaatttgttaatggcacctctc

SEQ ID NO: 8341 - DNA, 25 bp, Homo sapien
atggcacctctcatgtcttcactga

SEQ ID NO: 8342 - DNA, 25 bp, Homo sapien
actgaatgtggcctgaccctaaact

SEQ ID NO: 8343 - DNA, 25 bp, Homo sapien
aatgctgaactctgtgaatatctgg

SEQ ID NO: 8344 - DNA, 25 bp, Homo sapien
gacagagaccaagaagccttctatt

SEQ ID NO: 8345 - DNA, 25 bp, Homo sapien
tgtatgaagcctcaacacatgccct

SEQ ID NO: 8346 - DNA, 25 bp, Homo sapien
aacacatgccctgtgaggctctgac

SEQ ID NO: 8347 - DNA, 25 bp, Homo sapien
tgtgaggctctgacctacatgacca

SEQ ID NO: 8348 - DNA, 25 bp, Homo sapien
acctacatgaccacccggaatagag

SEQ ID NO: 8349 - DNA, 25 bp, Homo sapien
gagaggtatcttatcttacagacaa

SEQ ID NO: 8350 - DNA, 25 bp, Homo sapien
gaaggatcgtaaacacattgatgtc

SEQ ID NO: 8351 - DNA, 25 bp, Homo sapien
tgatttcaattgtcttaggtttttt

SEQ ID NO: 8352 - DNA, 25 bp, Homo sapien
ctttgaaagatgaaggttcctatat

SEQ ID NO: 8353 - DNA, 25 bp, Homo sapien
gaaggttcctatataagatgatggg

SEQ ID NO: 8354 - DNA, 25 bp, Homo sapien
gacttagaatagtggagactggcct

SEQ ID NO: 8355 - DNA, 25 bp, Homo sapien
tggagactggccttaaactgacata

SEQ ID NO: 8356 - DNA, 25 bp, Homo sapien
gactggccttaaactgacatataaa

SEQ ID NO: 8357 - DNA, 25 bp, Homo sapien
tacttgctaagcataaagtggtata

SEQ ID NO: 8358 - DNA, 25 bp, Homo sapien
agtggtataaaccttcctatgcagt

SEQ ID NO: 8359 - DNA, 25 bp, Homo sapien
ggtataaaccttcctatgcagtaga

SEQ ID NO: 8360 - DNA, 25 bp, Homo sapien
aaccttcctatgcagtagaaagaac

SEQ ID NO: 8361 - DNA, 25 bp, Homo sapien
ataagaatccagatgggctgggcgc

SEQ ID NO: 8362 - DNA, 25 bp, Homo sapien
ttccttaggccccaatagggaatgg

SEQ ID NO: 8363 - DNA, 25 bp, Homo sapien
ccatcagttcctacaccaagctaag

SEQ ID NO: 8364 - DNA, 25 bp, Homo sapien
gttcctacaccaagctaagcctcag

SEQ ID NO: 8365 - DNA, 25 bp, Homo sapien
accacagggacctctgagcacagag

SEQ ID NO: 8366 - DNA, 25 bp, Homo sapien
gagcacagagttaacattcagcaga

SEQ ID NO: 8367 - DNA, 25 bp, Homo sapien
gagtagctaacatgaatgcctgtat

SEQ ID NO: 8368 - DNA, 25 bp, Homo sapien
tgtatttctaccctgctgtttcttc

SEQ ID NO: 8369 - DNA, 25 bp, Homo sapien
ggaagctgacaagaacatatacttt

SEQ ID NO: 8370 - DNA, 25 bp, Homo sapien
aaaatataaaatgagcgctgtggct

SEQ ID NO: 8371 - DNA, 25 bp, Homo sapien
aatcagccgggcttgatggtacata

SEQ ID NO: 8372 - DNA, 25 bp, Homo sapien
gccgggcttgatggtacatacctgt

SEQ ID NO: 8373 - DNA, 25 bp, Homo sapien
ttgtcactctatagacatgagaatc

SEQ ID NO: 8374 - DNA, 25 bp, Homo sapien
tgtcactctatagacatgagaatct

SEQ ID NO: 8375 - DNA, 25 bp, Homo sapien
ggacagttagaagacgacggagttt

SEQ ID NO: 8376 - DNA, 25 bp, Homo sapien
gacagttagaagacgacggagtttc

SEQ ID NO: 8377 - DNA, 25 bp, Homo sapien
cagttagaagacgacggagtttcac

SEQ ID NO: 8378 - DNA, 25 bp, Homo sapien
gttagaagacgacggagtttcactc

SEQ ID NO: 8379 - DNA, 25 bp, Homo sapien
ggtaattcatccgattcaaaattgt

SEQ ID NO: 8380 - DNA, 25 bp, Homo sapien
gtaattcatccgattcaaaattgtt

SEQ ID NO: 8381 - DNA, 25 bp, Homo sapien
aattcatccgattcaaaattgtttt

SEQ ID NO: 8382 - DNA, 25 bp, Homo sapien
gtacaccagtgtttcgtagtttttg

SEQ ID NO: 8383 - DNA, 25 bp, Homo sapien
gtgtttcgtagtttttgaaatctga

SEQ ID NO: 8384 - DNA, 25 bp, Homo sapien
gggtctcttcatgttacccgggctg

SEQ ID NO: 8385 - DNA, 25 bp, Homo sapien
taagctcgagccatctgtccacctt

SEQ ID NO: 8386 - DNA, 25 bp, Homo sapien
cccgcccacagctaatgttgtagtt

SEQ ID NO: 8387 - DNA, 25 bp, Homo sapien
aatgttgtagttgctagttctccat

SEQ ID NO: 8388 - DNA, 25 bp, Homo sapien
tgttgtagttgctagttctccatat

SEQ ID NO: 8389 - DNA, 25 bp, Homo sapien
ttgctagttctccatattgattaaa

SEQ ID NO: 8390 - DNA, 25 bp, Homo sapien
ctagttctccatattgattaaagca

SEQ ID NO: 8391 - DNA, 25 bp, Homo sapien
agcaacaataacagtaacctctacc

SEQ ID NO: 8392 - DNA, 25 bp, Homo sapien
atttcaggccctcagatgatgactt

SEQ ID NO: 8393 - DNA, 25 bp, Homo sapien
tcaggccctcagatgatgacttaga

SEQ ID NO: 8394 - DNA, 25 bp, Homo sapien
ggccctcagatgatgacttagattt

SEQ ID NO: 8395 - DNA, 25 bp, Homo sapien
gtatcttctacatccagggaattgg

SEQ ID NO: 8396 - DNA, 25 bp, Homo sapien
acatccagggaattgggctgagtgt

SEQ ID NO: 8397 - DNA, 25 bp, Homo sapien
gattttggtcttggcagtttttact

SEQ ID NO: 8398 - DNA, 25 bp, Homo sapien
gtcaggtggttttacatgcgttatt

SEQ ID NO: 8399 - DNA, 25 bp, Homo sapien
acatgcgttatttatcacgttaata

SEQ ID NO: 8400 - DNA, 25 bp, Homo sapien
gatattttccacgtgtaaatttatg

SEQ ID NO: 8401 - DNA, 25 bp, Homo sapien
taaaggcaggaaactagtgagattt

SEQ ID NO: 8402 - DNA, 25 bp, Homo sapien
gtgagatttcatattctagggatca

SEQ ID NO: 8403 - DNA, 25 bp, Homo sapien
gattgttttagtaactagcctcaga

SEQ ID NO: 8404 - DNA, 25 bp, Homo sapien
gtaactagcctcagaaagtatcttg

SEQ ID NO: 8405 - DNA, 25 bp, Homo sapien
attagtaaagagtcaggccaggcgt

SEQ ID NO: 8406 - DNA, 25 bp, Homo sapien
gcaggaccatgtatatctacccaac

SEQ ID NO: 8407 - DNA, 25 bp, Homo sapien
caactcactgttttttccctaggct

SEQ ID NO: 8408 - DNA, 25 bp, Homo sapien
ttccctaggcttggcattttatcag

SEQ ID NO: 8409 - DNA, 25 bp, Homo sapien
cattttatcagtgtttggtgaggac

SEQ ID NO: 8410 - DNA, 25 bp, Homo sapien
gtacatttacctttctttaacgcat

SEQ ID NO: 8411 - DNA, 25 bp, Homo sapien
tttaacgcatgcatccaggccattt

SEQ ID NO: 8412 - DNA, 25 bp, Homo sapien
catttcagcctgtttgggtcattca

SEQ ID NO: 8413 - DNA, 25 bp, Homo sapien
gtttgggtcattcatcccagagtaa

SEQ ID NO: 8414 - DNA, 25 bp, Homo sapien
gtggcactgtaccaatatatttcca

SEQ ID NO: 8415 - DNA, 25 bp, Homo sapien
gtgtggtgtcttaggcagagtttcc

SEQ ID NO: 8416 - DNA, 25 bp, Homo sapien
aaccacaaaaaacgagccaggcatt

SEQ ID NO: 8417 - DNA, 25 bp, Homo sapien
ggatatggaaatacagatctctcat

SEQ ID NO: 8418 - DNA, 25 bp, Homo sapien
aaatacagatctctcatgtgaggga

SEQ ID NO: 8419 - DNA, 25 bp, Homo sapien
atctctcatgtgagggatggctcat

SEQ ID NO: 8420 - DNA, 25 bp, Homo sapien
tcatgtgagggatggctcatctgaa

SEQ ID NO: 8421 - DNA, 25 bp, Homo sapien
gttattccaagggttaggacaccag

SEQ ID NO: 8422 - DNA, 25 bp, Homo sapien
ttccaagggttaggacaccagagtg

SEQ ID NO: 8423 - DNA, 25 bp, Homo sapien
acaccagagtgggattcaaggcctc

SEQ ID NO: 8424 - DNA, 25 bp, Homo sapien
agtgggattcaaggcctctcatttt

SEQ ID NO: 8425 - DNA, 25 bp, Homo sapien
ctctcatttttaagacccctgcatt

SEQ ID NO: 8426 - DNA, 25 bp, Homo sapien
tttttaagacccctgcattggctgg

SEQ ID NO: 8427 - DNA, 25 bp, Homo sapien
aagacccctgcattggctgggcaca

SEQ ID NO: 8428 - DNA, 25 bp, Homo sapien
gataaagactccctctacctttatg

SEQ ID NO: 8429 - DNA, 25 bp, Homo sapien
accttctagcccctaagatgtatgt

SEQ ID NO: 8430 - DNA, 25 bp, Homo sapien
agatgtatgttgcatcgctttccac

SEQ ID NO: 8431 - DNA, 25 bp, Homo sapien
gcatcgctttccaccggtataggga

SEQ ID NO: 8432 - DNA, 25 bp, Homo sapien
atagggactaaccatcagtgcatcc

SEQ ID NO: 8433 - DNA, 25 bp, Homo sapien
agtgcatcctcgttacaaattcctg

SEQ ID NO: 8434 - DNA, 25 bp, Homo sapien
agcctgattggcttagtctggatca

SEQ ID NO: 8435 - DNA, 25 bp, Homo sapien
tggatcagttgttcactctgggcca

SEQ ID NO: 8436 - DNA, 25 bp, Homo sapien
actctgggccagttggatctgtcca

SEQ ID NO: 8437 - DNA, 25 bp, Homo sapien
cagggccaactcttgagggaagact

SEQ ID NO: 8438 - DNA, 25 bp, Homo sapien
ggagccattgctagctgagtaaata

SEQ ID NO: 8439 - DNA, 25 bp, Homo sapien
tgaaacaaatgaagagcaggaggcc

SEQ ID NO: 8440 - DNA, 25 bp, Homo sapien
aatgaagagcaggaggccccaacat

SEQ ID NO: 8441 - DNA, 25 bp, Homo sapien
atcaccatcacctgtgaatcttttt

SEQ ID NO: 8442 - DNA, 25 bp, Homo sapien
tcaccatcacctgtgaatctttttt

SEQ ID NO: 8443 - DNA, 25 bp, Homo sapien
caccatcacctgtgaatcttttttt

SEQ ID NO: 8444 - DNA, 25 bp, Homo sapien
ttttttgtaagcgtttcgctcttgt

SEQ ID NO: 8445 - DNA, 25 bp, Homo sapien
tttttgtaagcgtttcgctcttgtc

SEQ ID NO: 8446 - DNA, 25 bp, Homo sapien
ttttgtaagcgtttcgctcttgtcg

SEQ ID NO: 8447 - DNA, 25 bp, Homo sapien
ttgtcgcctaggctgccctgcagtg

SEQ ID NO: 8448 - DNA, 25 bp, Homo sapien
cgcctaggctgccctgcagtggtgt

SEQ ID NO: 8449 - DNA, 25 bp, Homo sapien
taggctgccctgcagtggtgtggtc

SEQ ID NO: 8450 - DNA, 25 bp, Homo sapien
gaaaccatagagttcagaaggcact

SEQ ID NO: 8451 - DNA, 25 bp, Homo sapien
cagaaggcactggaatgttgacaaa

SEQ ID NO: 8452 - DNA, 25 bp, Homo sapien
gaaggcactggaatgttgacaaatt

SEQ ID NO: 8453 - DNA, 25 bp, Homo sapien
ggcactggaatgttgacaaatttag

SEQ ID NO: 8454 - DNA, 25 bp, Homo sapien
actgtcatgcaggaattgtgtgtct

SEQ ID NO: 8455 - DNA, 25 bp, Homo sapien
gaattgtgtgtctggaaaaactctc

SEQ ID NO: 8456 - DNA, 25 bp, Homo sapien
aaactctccttcagaaataatggat

SEQ ID NO: 8457 - DNA, 25 bp, Homo sapien
tgactatacatagtaccacatatat

SEQ ID NO: 8458 - DNA, 25 bp, Homo sapien
agtagtcctataaaagctagtagta

SEQ ID NO: 8459 - DNA, 25 bp, Homo sapien
aagaaaatgcccattgactaatgaa

SEQ ID NO: 8460 - DNA, 25 bp, Homo sapien
gaataaacaacatgtagtgtatttc

SEQ ID NO: 8461 - DNA, 25 bp, Homo sapien
tttctccacctaccccttaaatgtg

SEQ ID NO: 8462 - DNA, 25 bp, Homo sapien
atgtggatgttccttgcattccact

SEQ ID NO: 8463 - DNA, 25 bp, Homo sapien
tctccccgtattcccaggatgactg

SEQ ID NO: 8464 - DNA, 25 bp, Homo sapien
ccaggatgactgcatccacttcggg

SEQ ID NO: 8465 - DNA, 25 bp, Homo sapien
agaggcgtgcactcctgaggtcctg

SEQ ID NO: 8466 - DNA, 25 bp, Homo sapien
ggtcctgactcaaggcatcaaggca

SEQ ID NO: 8467 - DNA, 25 bp, Homo sapien
agaggtgttctcagacaggactgga

SEQ ID NO: 8468 - DNA, 25 bp, Homo sapien
ggactggagttcacatcctagctgg

SEQ ID NO: 8469 - DNA, 25 bp, Homo sapien
gttcacatcctagctgggcgtctta

SEQ ID NO: 8470 - DNA, 25 bp, Homo sapien
gcgtcttactggctatgggtcttag

SEQ ID NO: 8471 - DNA, 25 bp, Homo sapien
gttacctattattgctgggtgtggt

SEQ ID NO: 8472 - DNA, 25 bp, Homo sapien
gtgcacattttcatcgttaatataa

SEQ ID NO: 8473 - DNA, 25 bp, Homo sapien
taaactctcctcttaatcattttct

SEQ ID NO: 8474 - DNA, 25 bp, Homo sapien
atatagtttgcacgtgtgtccctgc

SEQ ID NO: 8475 - DNA, 25 bp, Homo sapien
tccctgcccgaatctcatattgaaa

SEQ ID NO: 8476 - DNA, 25 bp, Homo sapien
actgtgggtgtggatctctcaaata

SEQ ID NO: 8477 - DNA, 25 bp, Homo sapien
ggtgtggatctctcaaatacggttt

SEQ ID NO: 8478 - DNA, 25 bp, Homo sapien
aatacggtttagcagcatccgcctt

SEQ ID NO: 8479 - DNA, 25 bp, Homo sapien
cttgctaccatcctcttgatagtga

SEQ ID NO: 8480 - DNA, 25 bp, Homo sapien
gtgagtgacttctcgtgagagatct

SEQ ID NO: 8481 - DNA, 25 bp, Homo sapien
cttctcgtgagagatctggtcgttt

SEQ ID NO: 8482 - DNA, 25 bp, Homo sapien
tttaagtgtgtagcaccagccgggc

SEQ ID NO: 8483 - DNA, 25 bp, Homo sapien
attaacaatagggtcctcatctcag

SEQ ID NO: 8484 - DNA, 25 bp, Homo sapien
aatagggtcctcatctcagtttaga

SEQ ID NO: 8485 - DNA, 25 bp, Homo sapien
ggtaaacggtgatgtttgccacact

SEQ ID NO: 8486 - DNA, 25 bp, Homo sapien
aacggtgatgtttgccacactagtg

SEQ ID NO: 8487 - DNA, 25 bp, Homo sapien
gccacactagtggtgaggttttcat

SEQ ID NO: 8488 - DNA, 25 bp, Homo sapien
ctagtggtgaggttttcatagtttt

SEQ ID NO: 8489 - DNA, 25 bp, Homo sapien
aaacattatttgtgactgtttctct

SEQ ID NO: 8490 - DNA, 25 bp, Homo sapien
tgtttctctttggacagtgcttttt

SEQ ID NO: 8491 - DNA, 25 bp, Homo sapien
gggtagaaggtaataacacatgcaa

SEQ ID NO: 8492 - DNA, 25 bp, Homo sapien
acatgcaaagggatgtgtagcaatc

SEQ ID NO: 8493 - DNA, 25 bp, Homo sapien
gtagcaatcaaagggaaatgttatc

SEQ ID NO: 8494 - DNA, 25 bp, Homo sapien
attatgcatgtgtggtctgtctcta

SEQ ID NO: 8495 - DNA, 25 bp, Homo sapien
aaatatatttcctatagtacccagc

SEQ ID NO: 8496 - DNA, 25 bp, Homo sapien
atatatttcctatagtacccagcac

SEQ ID NO: 8497 - DNA, 25 bp, Homo sapien
atatttcctatagtacccagcacag

SEQ ID NO: 8498 - DNA, 25 bp, Homo sapien
tacccagcacagtgacttgcaccaa

SEQ ID NO: 8499 - DNA, 25 bp, Homo sapien
ccagcacagtgacttgcaccaaaca

SEQ ID NO: 8500 - DNA, 25 bp, Homo sapien
gcacagtgacttgcaccaaacaggt

SEQ ID NO: 8501 - DNA, 25 bp, Homo sapien
cagtgacttgcaccaaacaggtgtt

SEQ ID NO: 8502 - DNA, 25 bp, Homo sapien
gtgacttgcaccaaacaggtgttgc

SEQ ID NO: 8503 - DNA, 25 bp, Homo sapien
gacttgcaccaaacaggtgttgcaa

SEQ ID NO: 8504 - DNA, 25 bp, Homo sapien
tgcaccaaacaggtgttgcaaaaat

SEQ ID NO: 8505 - DNA, 25 bp, Homo sapien
ttttttcacatttagttatttctga

SEQ ID NO: 8506 - DNA, 25 bp, Homo sapien
gttatttctgaaatcaaggtatata

SEQ ID NO: 8507 - DNA, 25 bp, Homo sapien
ggtatatattattatcagtgtgagc

SEQ ID NO: 8508 - DNA, 25 bp, Homo sapien
tatcagtgtgagcattgaatggaat

SEQ ID NO: 8509 - DNA, 25 bp, Homo sapien
gagcattgaatggaatcgtttcttt

SEQ ID NO: 8510 - DNA, 25 bp, Homo sapien
cattttataatcagtagtgtcgtag

SEQ ID NO: 8511 - DNA, 25 bp, Homo sapien
atcagtagtgtcgtagtatatacta

SEQ ID NO: 8512 - DNA, 25 bp, Homo sapien
atatactactataaagattcatcta

SEQ ID NO: 8513 - DNA, 25 bp, Homo sapien
agattcatctaaactaagctgggca

SEQ ID NO: 8514 - DNA, 25 bp, Homo sapien
catggcaaagcccctactctaaaaa

SEQ ID NO: 8515 - DNA, 25 bp, Homo sapien
tgagctcagggtgagccatgatcgt

SEQ ID NO: 8516 - DNA, 25 bp, Homo sapien
taattcccttgcctcagctgttgcc

SEQ ID NO: 8517 - DNA, 25 bp, Homo sapien
tgttgcctccacaatagacccacaa

SEQ ID NO: 8518 - DNA, 25 bp, Homo sapien
atagacccacaaaggccatcatttt

SEQ ID NO: 8519 - DNA, 25 bp, Homo sapien
aagatcaactacctactatgccaca

SEQ ID NO: 8520 - DNA, 25 bp, Homo sapien
ctatgccacaccaagtttcatgcta

SEQ ID NO: 8521 - DNA, 25 bp, Homo sapien
agtcaaatagctccaaatgtaattg

SEQ ID NO: 8522 - DNA, 25 bp, Homo sapien
gatatattatctgtctgtactcaaa

SEQ ID NO: 8523 - DNA, 25 bp, Homo sapien
gtctgtactcaaataacatttccct

SEQ ID NO: 8524 - DNA, 25 bp, Homo sapien
tttccctaaaaattcatgtccactt

SEQ ID NO: 8525 - DNA, 25 bp, Homo sapien
atgtccacttggaacctgcaaaggt

SEQ ID NO: 8526 - DNA, 25 bp, Homo sapien
gaacctgcaaaggtgccctatttaa

SEQ ID NO: 8527 - DNA, 25 bp, Homo sapien
tgggagtgggagttttgcattttca

SEQ ID NO: 8528 - DNA, 25 bp, Homo sapien
gagttttgcattttcacatcttaca

SEQ ID NO: 8529 - DNA, 25 bp, Homo sapien
aacattgaaccatggatagaacagt

SEQ ID NO: 8530 - DNA, 25 bp, Homo sapien
tggggagctctcttttgaacaactt

SEQ ID NO: 8531 - DNA, 25 bp, Homo sapien
gagtaaatcaacactagcacttatg

SEQ ID NO: 8532 - DNA, 25 bp, Homo sapien
actagcacttatgtctatccagaaa

SEQ ID NO: 8533 - DNA, 25 bp, Homo sapien
taatcaggagattatcacagctcat

SEQ ID NO: 8534 - DNA, 25 bp, Homo sapien
ggagattatcacagctcatgagata

SEQ ID NO: 8535 - DNA, 25 bp, Homo sapien
acagctcatgagataagcacagtag

SEQ ID NO: 8536 - DNA, 25 bp, Homo sapien
gcacagtagatacgttatagctttt

SEQ ID NO: 8537 - DNA, 25 bp, Homo sapien
gatacgttatagcttttaaacaaat

SEQ ID NO: 8538 - DNA, 25 bp, Homo sapien
tggagcacaggaaatgccccattta

SEQ ID NO: 8539 - DNA, 25 bp, Homo sapien
atgccccatttacacatggaccgga

SEQ ID NO: 8540 - DNA, 25 bp, Homo sapien
agtgtctttcgcaccaggatcccgg

SEQ ID NO: 8541 - DNA, 25 bp, Homo sapien
aacttgaatatctgggccatgctct

SEQ ID NO: 8542 - DNA, 25 bp, Homo sapien
aatatctgggccatgctctccagga

SEQ ID NO: 8543 - DNA, 25 bp, Homo sapien
tgggccatgctctccaggagtctct

SEQ ID NO: 8544 - DNA, 25 bp, Homo sapien
ggagtctctctgagaaccaggccaa

SEQ ID NO: 8545 - DNA, 25 bp, Homo sapien
gaaccaggccaaagtagctgcttat

SEQ ID NO: 8546 - DNA, 25 bp, Homo sapien
tagctgcttatggtctaggatacac

SEQ ID NO: 8547 - DNA, 25 bp, Homo sapien
gcttatggtctaggatacacctaaa

SEQ ID NO: 8548 - DNA, 25 bp, Homo sapien
acctcccctatgcaggagcatgcag

SEQ ID NO: 8549 - DNA, 25 bp, Homo sapien
ttctcatttaacaagccaatgatga

SEQ ID NO: 8550 - DNA, 25 bp, Homo sapien
ttaacaagccaatgatgaagacact

SEQ ID NO: 8551 - DNA, 25 bp, Homo sapien
aacaagccaatgatgaagacactta

SEQ ID NO: 8552 - DNA, 25 bp, Homo sapien
caagccaatgatgaagacacttaat

SEQ ID NO: 8553 - DNA, 25 bp, Homo sapien
agccaatgatgaagacacttaataa

SEQ ID NO: 8554 - DNA, 25 bp, Homo sapien
gatgaagacacttaataagcatcat

SEQ ID NO: 8555 - DNA, 25 bp, Homo sapien
gaagacacttaataagcatcatgat

SEQ ID NO: 8556 - DNA, 25 bp, Homo sapien
aagacacttaataagcatcatgatt

SEQ ID NO: 8557 - DNA, 25 bp, Homo sapien
tagaattaagaaacttaggccaggc

SEQ ID NO: 8558 - DNA, 25 bp, Homo sapien
taggtaggcacggtggcacgcgcct

SEQ ID NO: 8559 - DNA, 25 bp, Homo sapien
cagggagccaagattgcagcaccac

SEQ ID NO: 8560 - DNA, 25 bp, Homo sapien
gtgaatggtgctgctatgagtattt

SEQ ID NO: 8561 - DNA, 25 bp, Homo sapien
atggtgctgctatgagtatttatgt

SEQ ID NO: 8562 - DNA, 25 bp, Homo sapien
gctgctatgagtatttatgtgtaag

SEQ ID NO: 8563 - DNA, 25 bp, Homo sapien
gtttgaatatctttttctcaattct

SEQ ID NO: 8564 - DNA, 25 bp, Homo sapien
cttttaaaagcagatcttatttgac

SEQ ID NO: 8565 - DNA, 25 bp, Homo sapien
gaaattacatcttgctgatgaatgg

SEQ ID NO: 8566 - DNA, 25 bp, Homo sapien
catcttgctgatgaatggatgaaga

SEQ ID NO: 8567 - DNA, 25 bp, Homo sapien
aggtgcactaatatctcagacacag

SEQ ID NO: 8568 - DNA, 25 bp, Homo sapien
gcactaatatctcagacacagacat

SEQ ID NO: 8569 - DNA, 25 bp, Homo sapien
gacacagacatcaccactaaaaaat

SEQ ID NO: 8570 - DNA, 25 bp, Homo sapien
caccactaaaaaatcttatccccat

SEQ ID NO: 8571 - DNA, 25 bp, Homo sapien
tacagaaactacactcctgcatgca

SEQ ID NO: 8572 - DNA, 25 bp, Homo sapien
ggttttctgaccaactaacaccata

SEQ ID NO: 8573 - DNA, 25 bp, Homo sapien
taacaccatacatacatcatcagga

SEQ ID NO: 8574 - DNA, 25 bp, Homo sapien
gtcttcccttatgaaagtcaatcca

SEQ ID NO: 8575 - DNA, 25 bp, Homo sapien
aagttagaagtgacttttgcaccaa

SEQ ID NO: 8576 - DNA, 25 bp, Homo sapien
gaagtgacttttgcaccaaatgtgc

SEQ ID NO: 8577 - DNA, 25 bp, Homo sapien
caccaaatgtgcagatatcaacgta

SEQ ID NO: 8578 - DNA, 25 bp, Homo sapien
gcagatatcaacgtaaagacacatg

SEQ ID NO: 8579 - DNA, 25 bp, Homo sapien
aaatatgacacctctaagggagtac

SEQ ID NO: 8580 - DNA, 25 bp, Homo sapien
gatagtaaagaagctcactggccag

SEQ ID NO: 8581 - DNA, 25 bp, Homo sapien
aaagaagctcactggccaggcacgg

SEQ ID NO: 8582 - DNA, 25 bp, Homo sapien
agaagcccattgaaccccaagtagg

SEQ ID NO: 8583 - DNA, 25 bp, Homo sapien
attgaaccccaagtaggatgaatgc

SEQ ID NO: 8584 - DNA, 25 bp, Homo sapien
aaagatctacccaggtatatcagag

SEQ ID NO: 8585 - DNA, 25 bp, Homo sapien
atctacccaggtatatcagagtaag

SEQ ID NO: 8586 - DNA, 25 bp, Homo sapien
gaaaatgactttgcttggacacagg

SEQ ID NO: 8587 - DNA, 25 bp, Homo sapien
gactttgcttggacacaggaaactt

SEQ ID NO: 8588 - DNA, 25 bp, Homo sapien
tttgcttggacacaggaaacttagt

SEQ ID NO: 8589 - DNA, 25 bp, Homo sapien
tcatcaggaataatggcgaccagga

SEQ ID NO: 8590 - DNA, 25 bp, Homo sapien
gtcaaccaagaattatacatccagc

SEQ ID NO: 8591 - DNA, 25 bp, Homo sapien
aatacttagaaatttcgtcaggctg

SEQ ID NO: 8592 - DNA, 25 bp, Homo sapien
ttcgtcaggctgaaaatccaagcaa

SEQ ID NO: 8593 - DNA, 25 bp, Homo sapien
ggacagcaccttcgacagcggccag

SEQ ID NO: 8594 - DNA, 25 bp, Homo sapien
agcaccttcgacagcggccagggct

SEQ ID NO: 8595 - DNA, 25 bp, Homo sapien
agcggccagggctctaccgtgtact

SEQ ID NO: 8596 - DNA, 25 bp, Homo sapien
agggctctaccgtgtactcagactc

SEQ ID NO: 8597 - DNA, 25 bp, Homo sapien
tctaccgtgtactcagactcgcaga

SEQ ID NO: 8598 - DNA, 25 bp, Homo sapien
gtgtactcagactcgcagagcagcc

SEQ ID NO: 8599 - DNA, 25 bp, Homo sapien
actcagactcgcagagcagccagca

SEQ ID NO: 8600 - DNA, 25 bp, Homo sapien
cagcagagcgtgatgcttggctccc

SEQ ID NO: 8601 - DNA, 25 bp, Homo sapien
atgcttggctcccttgccgacgcag

SEQ ID NO: 8602 - DNA, 25 bp, Homo sapien
agtgtgtgtgcagcccccctgtgag

SEQ ID NO: 8603 - DNA, 25 bp, Homo sapien
gcagatgcccccgattcctgttgtg

SEQ ID NO: 8604 - DNA, 25 bp, Homo sapien
ggcacggctgtgtgggagtctcctg

SEQ ID NO: 8605 - DNA, 25 bp, Homo sapien
cagggacgcggctgtttatatccgc

SEQ ID NO: 8606 - DNA, 25 bp, Homo sapien
cggctgtttatatccgcgccgggtg

SEQ ID NO: 8607 - DNA, 25 bp, Homo sapien
tgggcaccaggacagagcttgtcct

SEQ ID NO: 8608 - DNA, 25 bp, Homo sapien
cagagcttgtcctgacagtggtgcg

SEQ ID NO: 8609 - DNA, 25 bp, Homo sapien
agcagaggtctagctgagaggtcac

SEQ ID NO: 8610 - DNA, 25 bp, Homo sapien
ctagctgagaggtcactggcggctt

SEQ ID NO: 8611 - DNA, 25 bp, Homo sapien
tcactggcggcttcctccactgagg

SEQ ID NO: 8612 - DNA, 25 bp, Homo sapien
actgaggcatggctggcattccctt

SEQ ID NO: 8613 - DNA, 25 bp, Homo sapien
tggcattcccttcggttcattaaaa

SEQ ID NO: 8614 - DNA, 25 bp, Homo sapien
ttaaaacccatcagtgggccgggcg

SEQ ID NO: 8615 - DNA, 25 bp, Homo sapien
attaatacaatcactgtttctgtac

SEQ ID NO: 8616 - DNA, 25 bp, Homo sapien
gtttctgtacagactatggttccca

SEQ ID NO: 8617 - DNA, 25 bp, Homo sapien
actatggttcccaaactgcttgcta

SEQ ID NO: 8618 - DNA, 25 bp, Homo sapien
aaactgcttgctatggtttgaccat

SEQ ID NO: 8619 - DNA, 25 bp, Homo sapien
tatggtttgaccatctcctccaaaa

SEQ ID NO: 8620 - DNA, 25 bp, Homo sapien
ccatctcctccaaaagtcacattga

SEQ ID NO: 8621 - DNA, 25 bp, Homo sapien
cacattgaagcttaacctacagtgt

SEQ ID NO: 8622 - DNA, 25 bp, Homo sapien
gcttaacctacagtgtggtagtact

SEQ ID NO: 8623 - DNA, 25 bp, Homo sapien
ggtagtactgagaggtgcgaccttt

SEQ ID NO: 8624 - DNA, 25 bp, Homo sapien
tagactaatgggttatcctgggaga

SEQ ID NO: 8625 - DNA, 25 bp, Homo sapien
atcctgggagaactggtggttttat

SEQ ID NO: 8626 - DNA, 25 bp, Homo sapien
agcatattaggagactgaagcggga

SEQ ID NO: 8627 - DNA, 25 bp, Homo sapien
tattaggagactgaagcgggaggat

SEQ ID NO: 8628 - DNA, 25 bp, Homo sapien
gaggctaggaggcttaggctgcagt

SEQ ID NO: 8629 - DNA, 25 bp, Homo sapien
ctgcagtgagccgtgcttgaatcac

SEQ ID NO: 8630 - DNA, 25 bp, Homo sapien
tgcagtgagccgtgcttgaatcact

SEQ ID NO: 8631 - DNA, 25 bp, Homo sapien
agtgagccgtgcttgaatcactgcc

SEQ ID NO: 8632 - DNA, 25 bp, Homo sapien
gtgagccgtgcttgaatcactgccc

SEQ ID NO: 8633 - DNA, 25 bp, Homo sapien
tgagccgtgcttgaatcactgccct

SEQ ID NO: 8634 - DNA, 25 bp, Homo sapien
gagccgtgcttgaatcactgccctc

SEQ ID NO: 8635 - DNA, 25 bp, Homo sapien
agccgtgcttgaatcactgccctct

SEQ ID NO: 8636 - DNA, 25 bp, Homo sapien
gccgtgcttgaatcactgccctcta

SEQ ID NO: 8637 - DNA, 25 bp, Homo sapien
aactagctatctccctttttatgac

SEQ ID NO: 8638 - DNA, 25 bp, Homo sapien
ctagctatctccctttttatgacag

SEQ ID NO: 8639 - DNA, 25 bp, Homo sapien
ctatctccctttttatgacagcaaa

SEQ ID NO: 8640 - DNA, 25 bp, Homo sapien
tcatctgttcagttttattcctaag

SEQ ID NO: 8641 - DNA, 25 bp, Homo sapien
tctgttcagttttattcctaaggca

SEQ ID NO: 8642 - DNA, 25 bp, Homo sapien
cagttttattcctaaggcaatcaaa

SEQ ID NO: 8643 - DNA, 25 bp, Homo sapien
aattaaatgtttttagccaggtgca

SEQ ID NO: 8644 - DNA, 25 bp, Homo sapien
cctgggtgatgtagcgagatacttt

SEQ ID NO: 8645 - DNA, 25 bp, Homo sapien
gtagcgagatactttgtctcttaaa

SEQ ID NO: 8646 - DNA, 25 bp, Homo sapien
aaatgaaatgtttggctgagagcgg

SEQ ID NO: 8647 - DNA, 25 bp, Homo sapien
aatgtttggctgagagcggtggctc

SEQ ID NO: 8648 - DNA, 25 bp, Homo sapien
gttaatacattaccaaagtttcaga

SEQ ID NO: 8649 - DNA, 25 bp, Homo sapien
gcaactccttttggcatctatgaga

SEQ ID NO: 8650 - DNA, 25 bp, Homo sapien
catctatgagagtagctgtgctttt

SEQ ID NO: 8651 - DNA, 25 bp, Homo sapien
agagtagctgtgcttttattttact

SEQ ID NO: 8652 - DNA, 25 bp, Homo sapien
atgctaataatgttccagcctgaaa

SEQ ID NO: 8653 - DNA, 25 bp, Homo sapien
ggtatcaagatactcaagtccttaa

SEQ ID NO: 8654 - DNA, 25 bp, Homo sapien
agtccttaagctgaccttgttagaa

SEQ ID NO: 8655 - DNA, 25 bp, Homo sapien
gctgaccttgttagaaatcctggga

SEQ ID NO: 8656 - DNA, 25 bp, Homo sapien
gaaagctgactgttccaaagctgtc

SEQ ID NO: 8657 - DNA, 25 bp, Homo sapien
aacttggtgcatgttggctgggcac

SEQ ID NO: 8658 - DNA, 25 bp, Homo sapien
aagttcagtggttctagaccagcct

SEQ ID NO: 8659 - DNA, 25 bp, Homo sapien
taaaaaagcccctgccaagcatcat

SEQ ID NO: 8660 - DNA, 25 bp, Homo sapien
caagcatcatctctcctaattattg

SEQ ID NO: 8661 - DNA, 25 bp, Homo sapien
ttgaacactttcaggcttggcagaa

SEQ ID NO: 8662 - DNA, 25 bp, Homo sapien
caggcttggcagaaactggaagaaa

SEQ ID NO: 8663 - DNA, 25 bp, Homo sapien
acacaatgagagctggttaataaac

SEQ ID NO: 8664 - DNA, 25 bp, Homo sapien
gggcaaagaccctgcaatctattta

SEQ ID NO: 8665 - DNA, 25 bp, Homo sapien
aaacatgccatttaagactagaaac

SEQ ID NO: 8666 - DNA, 25 bp, Homo sapien
gaaactgatgacctgtactatataa

SEQ ID NO: 8667 - DNA, 25 bp, Homo sapien
gtactatataatgcatgtagctatt

SEQ ID NO: 8668 - DNA, 25 bp, Homo sapien
ctcatgttctcaaattccatgaaca

SEQ ID NO: 8669 - DNA, 25 bp, Homo sapien
gaacaaaatctggtagccttgagat

SEQ ID NO: 8670 - DNA, 25 bp, Homo sapien
gatggcaagggctcttggcttcacc

SEQ ID NO: 8671 - DNA, 25 bp, Homo sapien
gcttcacccggaaatgacgcaactg

SEQ ID NO: 8672 - DNA, 25 bp, Homo sapien
aaatgacgcaactgctcctcaaagt

SEQ ID NO: 8673 - DNA, 25 bp, Homo sapien
ctcaaagtcgcagcccagcagaaaa

SEQ ID NO: 8674 - DNA, 25 bp, Homo sapien
cagcagaaaagagccgcttccttca

SEQ ID NO: 8675 - DNA, 25 bp, Homo sapien
gcttccttcaaataactgccaagtt

SEQ ID NO: 8676 - DNA, 25 bp, Homo sapien
gtaattagcaatatccacaaacctt

SEQ ID NO: 8677 - DNA, 25 bp, Homo sapien
ccacaaaccttgttcatgacagaaa

SEQ ID NO: 8678 - DNA, 25 bp, Homo sapien
atgacagaaaatattacctttgcct

SEQ ID NO: 8679 - DNA, 25 bp, Homo sapien
aagcaatctgatctgagctatttaa

SEQ ID NO: 8680 - DNA, 25 bp, Homo sapien
attaactaaatctggccaggcctgg

SEQ ID NO: 8681 - DNA, 25 bp, Homo sapien
tgacaactaacaggcagcatgcggt

SEQ ID NO: 8682 - DNA, 25 bp, Homo sapien
gcatgcggtggagtttcaggaagcc

SEQ ID NO: 8683 - DNA, 25 bp, Homo sapien
aagggcccagcctagacagggaagc

SEQ ID NO: 8684 - DNA, 25 bp, Homo sapien
gtggaataagcttcagtgggagcca

SEQ ID NO: 8685 - DNA, 25 bp, Homo sapien
gagccaggaggttgtatttcccgtt

SEQ ID NO: 8686 - DNA, 25 bp, Homo sapien
gtgcccagagaggaactatggatta

SEQ ID NO: 8687 - DNA, 25 bp, Homo sapien
aactatggattaggcccaggccggc

SEQ ID NO: 8688 - DNA, 25 bp, Homo sapien
caggccggccactcagagtgcttgg

SEQ ID NO: 8689 - DNA, 25 bp, Homo sapien
actcagagtgcttggcatccaggat

SEQ ID NO: 8690 - DNA, 25 bp, Homo sapien
tccaggatgtgttaagatggcattg

SEQ ID NO: 8691 - DNA, 25 bp, Homo sapien
agatggcattgaggccgagcgcggt

SEQ ID NO: 8692 - DNA, 25 bp, Homo sapien
gctgagctgaaaaccagacagcaaa

SEQ ID NO: 8693 - DNA, 25 bp, Homo sapien
gctggtgagtcaacagagctacctc

SEQ ID NO: 8694 - DNA, 25 bp, Homo sapien
ctgctacaaaaaagacttggcatgg

SEQ ID NO: 8695 - DNA, 25 bp, Homo sapien
gggattttcccggaatgctccaagt

SEQ ID NO: 8696 - DNA, 25 bp, Homo sapien
gaatgctccaagtttatccacccat

SEQ ID NO: 8697 - DNA, 25 bp, Homo sapien
caagtttatccacccatctttgagg

SEQ ID NO: 8698 - DNA, 25 bp, Homo sapien
tctttgaggagtgtgcatgcaccat

SEQ ID NO: 8699 - DNA, 25 bp, Homo sapien
gggtagcatagtactaacaccacat

SEQ ID NO: 8700 - DNA, 25 bp, Homo sapien
aaggtcatgttgttcattacaacaa

SEQ ID NO: 8701 - DNA, 25 bp, Homo sapien
agaaattggcaaggtggcttaatcc

SEQ ID NO: 8702 - DNA, 25 bp, Homo sapien
ggcttaatcctgaggcgctggccag

SEQ ID NO: 8703 - DNA, 25 bp, Homo sapien
gtagttattcgctgtatgtggcttt

SEQ ID NO: 8704 - DNA, 25 bp, Homo sapien
gccagatcggccctcttcattatgc

SEQ ID NO: 8705 - DNA, 25 bp, Homo sapien
tcttcattatgctaaacggcggaat

SEQ ID NO: 8706 - DNA, 25 bp, Homo sapien
aacggcggaatcatctggagcgaga

SEQ ID NO: 8707 - DNA, 25 bp, Homo sapien
gaatcatctggagcgagatacccaa

SEQ ID NO: 8708 - DNA, 25 bp, Homo sapien
gagcgagatacccaatgaactacat

SEQ ID NO: 8709 - DNA, 25 bp, Homo sapien
atgaactacattgagctcaggagag

SEQ ID NO: 8710 - DNA, 25 bp, Homo sapien
agagttttatgagcagaagagcaaa

SEQ ID NO: 8711 - DNA, 25 bp, Homo sapien
aatacacatattggccgagcgtggt

SEQ ID NO: 8712 - DNA, 25 bp, Homo sapien
gctgttttcggaaagcagttagtag

SEQ ID NO: 8713 - DNA, 25 bp, Homo sapien
agcagttagtagttattcgctgtat

SEQ ID NO: 8714 - DNA, 25 bp, Homo sapien
atatatgtgtgggtcacacctgtgg

SEQ ID NO: 8715 - DNA, 25 bp, Homo sapien
atatgtgtgggtcacacctgtggtc

SEQ ID NO: 8716 - DNA, 25 bp, Homo sapien
tatgtgtgggtcacacctgtggtct

SEQ ID NO: 8717 - DNA, 25 bp, Homo sapien
ctccagcctgcctgacaaagaggga

SEQ ID NO: 8718 - DNA, 25 bp, Homo sapien
tccagcctgcctgacaaagagggac

SEQ ID NO: 8719 - DNA, 25 bp, Homo sapien
ccagcctgcctgacaaagagggacc

SEQ ID NO: 8720 - DNA, 25 bp, Homo sapien
cataaatgtttaacttcacttagag

SEQ ID NO: 8721 - DNA, 25 bp, Homo sapien
aatgtttaacttcacttagagaaat

SEQ ID NO: 8722 - DNA, 25 bp, Homo sapien
tgtttaacttcacttagagaaatgc

SEQ ID NO: 8723 - DNA, 25 bp, Homo sapien
ataaaagtggtctacatatatatgt

SEQ ID NO: 8724 - DNA, 25 bp, Homo sapien
aaaagtggtctacatatatatgtgt

SEQ ID NO: 8725 - DNA, 25 bp, Homo sapien
ttccccaaacataggctttcttcac

SEQ ID NO: 8726 - DNA, 25 bp, Homo sapien
gctttcttcacttcctccaagtaaa

SEQ ID NO: 8727 - DNA, 25 bp, Homo sapien
aaatctatatatatttcctttattc

SEQ ID NO: 8728 - DNA, 25 bp, Homo sapien
aatgttacactgactttatacacac

SEQ ID NO: 8729 - DNA, 25 bp, Homo sapien
gactttatacacactgtaaaacgca

SEQ ID NO: 8730 - DNA, 25 bp, Homo sapien
acacactgtaaaacgcagaattttg

SEQ ID NO: 8731 - DNA, 25 bp, Homo sapien
taaaacgcagaattttgtttgtttg

SEQ ID NO: 8732 - DNA, 25 bp, Homo sapien
aattcccattattgtaattactctg

SEQ ID NO: 8733 - DNA, 25 bp, Homo sapien
tgtaattactctgtgtacgtttttt

SEQ ID NO: 8734 - DNA, 25 bp, Homo sapien
ctctgtgtacgtttttttgttgttg

SEQ ID NO: 8735 - DNA, 25 bp, Homo sapien
ttgatatggaattgcactctagcct

SEQ ID NO: 8736 - DNA, 25 bp, Homo sapien
tttttctgcctcagcttttcgagta

SEQ ID NO: 8737 - DNA, 25 bp, Homo sapien
aatttttgtattctcgcatccagta

SEQ ID NO: 8738 - DNA, 25 bp, Homo sapien
gtattctcgcatccagtacaaagat

SEQ ID NO: 8739 - DNA, 25 bp, Homo sapien
aagatgctttttgtagtagccacat

SEQ ID NO: 8740 - DNA, 25 bp, Homo sapien
tgtagtagccacatttctaaaaagc

SEQ ID NO: 8741 - DNA, 25 bp, Homo sapien
aagcggtatgcaaattgagattgtc

SEQ ID NO: 8742 - DNA, 25 bp, Homo sapien
gattcttttatcagacaacttcttc

SEQ ID NO: 8743 - DNA, 25 bp, Homo sapien
ttatcagacaacttcttccttctcc

SEQ ID NO: 8744 - DNA, 25 bp, Homo sapien
ctccgtggagctcagaggcagctta

SEQ ID NO: 8745 - DNA, 25 bp, Homo sapien
gaggcagcttacgttgtgattagaa

SEQ ID NO: 8746 - DNA, 25 bp, Homo sapien
gtgattagaaatgtgggcttggcca

SEQ ID NO: 8747 - DNA, 25 bp, Homo sapien
gtgcaatctcgatcttggctcattg

SEQ ID NO: 8748 - DNA, 25 bp, Homo sapien
agtagctgggattgaagttgcacgc

SEQ ID NO: 8749 - DNA, 25 bp, Homo sapien
gggattgaagttgcacgccaccaca

SEQ ID NO: 8750 - DNA, 25 bp, Homo sapien
ggattgaagttgcacgccaccacac

SEQ ID NO: 8751 - DNA, 25 bp, Homo sapien
aagcaacctgcccacctcgggtcct

SEQ ID NO: 8752 - DNA, 25 bp, Homo sapien
cacgcttggcttgtcttctagtttt

SEQ ID NO: 8753 - DNA, 25 bp, Homo sapien
gaaattcaacatgccactggctgca

SEQ ID NO: 8754 - DNA, 25 bp, Homo sapien
aattcaacatgccactggctgcagt

SEQ ID NO: 8755 - DNA, 25 bp, Homo sapien
ttcaacatgccactggctgcagtgt

SEQ ID NO: 8756 - DNA, 25 bp, Homo sapien
caacatgccactggctgcagtgtct

SEQ ID NO: 8757 - DNA, 25 bp, Homo sapien
atgccactggctgcagtgtctcatg

SEQ ID NO: 8758 - DNA, 25 bp, Homo sapien
aatcataccacttaaaatttaggca

SEQ ID NO: 8759 - DNA, 25 bp, Homo sapien
atttaggcatacttcttaatctttt

SEQ ID NO: 8760 - DNA, 25 bp, Homo sapien
cttaatcttttatggtgtgtgtgtg

SEQ ID NO: 8761 - DNA, 25 bp, Homo sapien
gtgtccatacacattaaacatacgt

SEQ ID NO: 8762 - DNA, 25 bp, Homo sapien
gatacattaactgggtctaaatgga

SEQ ID NO: 8763 - DNA, 25 bp, Homo sapien
ggaaagtaacatgaagagcttgctg

SEQ ID NO: 8764 - DNA, 25 bp, Homo sapien
gaagagcttgctgccatatgacatt

SEQ ID NO: 8765 - DNA, 25 bp, Homo sapien
agcttgctgccatatgacattcgta

SEQ ID NO: 8766 - DNA, 25 bp, Homo sapien
tgctgccatatgacattcgtaattt

SEQ ID NO: 8767 - DNA, 25 bp, Homo sapien
gccatatgacattcgtaatttatta

SEQ ID NO: 8768 - DNA, 25 bp, Homo sapien
gcatttgaatataggttgtttgttt

SEQ ID NO: 8769 - DNA, 25 bp, Homo sapien
gggatgtgagaagcagcgctccacc

SEQ ID NO: 8770 - DNA, 25 bp, Homo sapien
agcgctccaccctgagtaggttcat

SEQ ID NO: 8771 - DNA, 25 bp, Homo sapien
tgagtaggttcatcacacagtctgt

SEQ ID NO: 8772 - DNA, 25 bp, Homo sapien
acacagtctgtgtataccgtggtca

SEQ ID NO: 8773 - DNA, 25 bp, Homo sapien
tataccgtggtcagagtgtggctga

SEQ ID NO: 8774 - DNA, 25 bp, Homo sapien
tggctgagacacacatgagatggta

SEQ ID NO: 8775 - DNA, 25 bp, Homo sapien
gactcagaaggtccagggattcctg

SEQ ID NO: 8776 - DNA, 25 bp, Homo sapien
attcctggaaggttccaggccgaga

SEQ ID NO: 8777 - DNA, 25 bp, Homo sapien
aaaatctcagggaggaagggcatcc

SEQ ID NO: 8778 - DNA, 25 bp, Homo sapien
ggacaggacagccacctgtggacac

SEQ ID NO: 8779 - DNA, 25 bp, Homo sapien
agggtcacaagagggcgcccaggtt

SEQ ID NO: 8780 - DNA, 25 bp, Homo sapien
atttcctctcatagacagatgatta

SEQ ID NO: 8781 - DNA, 25 bp, Homo sapien
ttcctctcatagacagatgattaga

SEQ ID NO: 8782 - DNA, 25 bp, Homo sapien
tgattagaaaaagtcactggagcca

SEQ ID NO: 8783 - DNA, 25 bp, Homo sapien
atctgtatttttatctactcaggag

SEQ ID NO: 8784 - DNA, 25 bp, Homo sapien
ggaagaaaataataacgactcacaa

SEQ ID NO: 8785 - DNA, 25 bp, Homo sapien
aataacgactcacaattacatcatt

SEQ ID NO: 8786 - DNA, 25 bp, Homo sapien
gactcacaattacatcattgactgc

SEQ ID NO: 8787 - DNA, 25 bp, Homo sapien
aattacatcattgactgctaacatt

SEQ ID NO: 8788 - DNA, 25 bp, Homo sapien
tacatcattgactgctaacattaag

SEQ ID NO: 8789 - DNA, 25 bp, Homo sapien
atcattgactgctaacattaagaca

SEQ ID NO: 8790 - DNA, 25 bp, Homo sapien
attgactgctaacattaagacacat

SEQ ID NO: 8791 - DNA, 25 bp, Homo sapien
gaaatctctaagactgcaagccaaa

SEQ ID NO: 8792 - DNA, 25 bp, Homo sapien
gactgcaagccaaattctatattaa

SEQ ID NO: 8793 - DNA, 25 bp, Homo sapien
attctatattaaagtgtccctctga

SEQ ID NO: 8794 - DNA, 25 bp, Homo sapien
gtccctctgaaaggacagactcaaa

SEQ ID NO: 8795 - DNA, 25 bp, Homo sapien
agaataatgattacgggccaggtgt

SEQ ID NO: 8796 - DNA, 25 bp, Homo sapien
gtagagtccacgtttgctttacttc

SEQ ID NO: 8797 - DNA, 25 bp, Homo sapien
tttgctttacttcctagtcgtcaac

SEQ ID NO: 8798 - DNA, 25 bp, Homo sapien
gtcgtcaaccttaactgcaacacaa

SEQ ID NO: 8799 - DNA, 25 bp, Homo sapien
actgcaacacaatgctgcctgtatg

SEQ ID NO: 8800 - DNA, 25 bp, Homo sapien
acaatgctgcctgtatgtgtgtctg

SEQ ID NO: 8801 - DNA, 25 bp, Homo sapien
tgtctgtgtaggtgtttgtgtgcat

SEQ ID NO: 8802 - DNA, 25 bp, Homo sapien
tttaccatgtaacccaacagttcaa

SEQ ID NO: 8803 - DNA, 25 bp, Homo sapien
catgtaacccaacagttcaactttt

SEQ ID NO: 8804 - DNA, 25 bp, Homo sapien
tgtaacccaacagttcaacttttag

SEQ ID NO: 8805 - DNA, 25 bp, Homo sapien
gagaaatgaaagtccacgtccataa

SEQ ID NO: 8806 - DNA, 25 bp, Homo sapien
tgaaagtccacgtccataaagatac

SEQ ID NO: 8807 - DNA, 25 bp, Homo sapien
agtccacgtccataaagatacttga

SEQ ID NO: 8808 - DNA, 25 bp, Homo sapien
acgtccataaagatacttgactaca

SEQ ID NO: 8809 - DNA, 25 bp, Homo sapien
tacttgactacaaatatccatacag

SEQ ID NO: 8810 - DNA, 25 bp, Homo sapien
gactacaaatatccatacagtttta

SEQ ID NO: 8811 - DNA, 25 bp, Homo sapien
tagccccaaactgggtgggcgcggt

SEQ ID NO: 8812 - DNA, 25 bp, Homo sapien
aacaaatcagccgggcggctactca

SEQ ID NO: 8813 - DNA, 25 bp, Homo sapien
cattctgttcatgtggtgtattgca

SEQ ID NO: 8814 - DNA, 25 bp, Homo sapien
gtggtgtattgcatttaccagtttt

SEQ ID NO: 8815 - DNA, 25 bp, Homo sapien
aggaataaatcccacctggtcatgg

SEQ ID NO: 8816 - DNA, 25 bp, Homo sapien
tatgctgctgaattcaatttcctag

SEQ ID NO: 8817 - DNA, 25 bp, Homo sapien
gctgaattcaatttcctagtttttt

SEQ ID NO: 8818 - DNA, 25 bp, Homo sapien
gaggattgttacatcactgttcata

SEQ ID NO: 8819 - DNA, 25 bp, Homo sapien
gttacatcactgttcataagggata

SEQ ID NO: 8820 - DNA, 25 bp, Homo sapien
gatatgatattggtctgtagctttg

SEQ ID NO: 8821 - DNA, 25 bp, Homo sapien
atattggtctgtagctttgggtttt

SEQ ID NO: 8822 - DNA, 25 bp, Homo sapien
ggaggtcaagtttgcagtgaactac

SEQ ID NO: 8823 - DNA, 25 bp, Homo sapien
gtcaagtttgcagtgaactacgatt

SEQ ID NO: 8824 - DNA, 25 bp, Homo sapien
gtataattcaaaatcaattcaagaa

SEQ ID NO: 8825 - DNA, 25 bp, Homo sapien
caggaatggtacctcattcaaacta

SEQ ID NO: 8826 - DNA, 25 bp, Homo sapien
aggaatggtacctcattcaaactag

SEQ ID NO: 8827 - DNA, 25 bp, Homo sapien
ggaatggtacctcattcaaactagt

SEQ ID NO: 8828 - DNA, 25 bp, Homo sapien
gaatggtacctcattcaaactagta

SEQ ID NO: 8829 - DNA, 25 bp, Homo sapien
aatggtacctcattcaaactagtaa

SEQ ID NO: 8830 - DNA, 25 bp, Homo sapien
tggtcaaatggtgaagccctgactc

SEQ ID NO: 8831 - DNA, 25 bp, Homo sapien
ggtcaaatggtgaagccctgactct

SEQ ID NO: 8832 - DNA, 25 bp, Homo sapien
gtcaaatggtgaagccctgactcta

SEQ ID NO: 8833 - DNA, 25 bp, Homo sapien
tcaaatggtgaagccctgactctac

SEQ ID NO: 8834 - DNA, 25 bp, Homo sapien
acgtgcctgtgatgccagcgactcg

SEQ ID NO: 8835 - DNA, 25 bp, Homo sapien
aaggctccagtgagccttgacctgg

SEQ ID NO: 8836 - DNA, 25 bp, Homo sapien
ccagtgagccttgacctgggcaaca

SEQ ID NO: 8837 - DNA, 25 bp, Homo sapien
gggatccttcgcacccatttaagct

SEQ ID NO: 8838 - DNA, 25 bp, Homo sapien
cttcgcacccatttaagctctataa

SEQ ID NO: 8839 - DNA, 25 bp, Homo sapien
cgcacccatttaagctctataatcc

SEQ ID NO: 8840 - DNA, 25 bp, Homo sapien
ttaagctctataatcctacaataat

SEQ ID NO: 8841 - DNA, 25 bp, Homo sapien
tagaagatcccttcataatcatgat

SEQ ID NO: 8842 - DNA, 25 bp, Homo sapien
gatcccttcataatcatgatctctt

SEQ ID NO: 8843 - DNA, 25 bp, Homo sapien
gtagtccaggcaaatatcatcagct

SEQ ID NO: 8844 - DNA, 25 bp, Homo sapien
ggcaaatatcatcagctccatttta

SEQ ID NO: 8845 - DNA, 25 bp, Homo sapien
aatatcatcagctccattttagagg

SEQ ID NO: 8846 - DNA, 25 bp, Homo sapien
tgcctggccagaagacatgatttta

SEQ ID NO: 8847 - DNA, 25 bp, Homo sapien
cctggccagaagacatgattttaat

SEQ ID NO: 8848 - DNA, 25 bp, Homo sapien
tttaatgagtgctttagtgagtcct

SEQ ID NO: 8849 - DNA, 25 bp, Homo sapien
gagtgctttagtgagtcctcagcca

SEQ ID NO: 8850 - DNA, 25 bp, Homo sapien
tttagtgagtcctcagccacccaaa

SEQ ID NO: 8851 - DNA, 25 bp, Homo sapien
caaaaggaataaagcctgcgtggca

SEQ ID NO: 8852 - DNA, 25 bp, Homo sapien
ggcaggtgccgggttacttatccca

SEQ ID NO: 8853 - DNA, 25 bp, Homo sapien
gccgggttacttatcccaggcagaa

SEQ ID NO: 8854 - DNA, 25 bp, Homo sapien
cgggttacttatcccaggcagaaga

SEQ ID NO: 8855 - DNA, 25 bp, Homo sapien
agttaccatatgatttagcaatgct

SEQ ID NO: 8856 - DNA, 25 bp, Homo sapien
gaaagcagggactcggccgggcccg

SEQ ID NO: 8857 - DNA, 25 bp, Homo sapien
gtagttacagcacctatgatacata

SEQ ID NO: 8858 - DNA, 25 bp, Homo sapien
tatgtcactatgaacctcctctgga

SEQ ID NO: 8859 - DNA, 25 bp, Homo sapien
taattattccaacacaagcttgcgt

SEQ ID NO: 8860 - DNA, 25 bp, Homo sapien
aagcttgcgtgaacagataatcatc

SEQ ID NO: 8861 - DNA, 25 bp, Homo sapien
ctacgagtatattgtgtgcctgcta

SEQ ID NO: 8862 - DNA, 25 bp, Homo sapien
tgctaagcaccacgcctgagataag

SEQ ID NO: 8863 - DNA, 25 bp, Homo sapien
cacgcctgagataagcatttgctgt

SEQ ID NO: 8864 - DNA, 25 bp, Homo sapien
gcaacagtgttgcaaggtgagaact

SEQ ID NO: 8865 - DNA, 25 bp, Homo sapien
gatgatcaggtcatgagaactctgc

SEQ ID NO: 8866 - DNA, 25 bp, Homo sapien
atacccttatcgcagtagtggaccc

SEQ ID NO: 8867 - DNA, 25 bp, Homo sapien
tttcaccatgggataacacagcaag

SEQ ID NO: 8868 - DNA, 25 bp, Homo sapien
gaagtggttcattacatagtcacaa

SEQ ID NO: 8869 - DNA, 25 bp, Homo sapien
ggaataacagcaccaggacccagaa

SEQ ID NO: 8870 - DNA, 25 bp, Homo sapien
ggacccagaagcaagtcgctgcctt

SEQ ID NO: 8871 - DNA, 25 bp, Homo sapien
aagcaagtcgctgccttgggcctgg

SEQ ID NO: 8872 - DNA, 25 bp, Homo sapien
tgaaactttcacagccccacaacat

SEQ ID NO: 8873 - DNA, 25 bp, Homo sapien
agccccacaacatgtctgttcaaaa

SEQ ID NO: 8874 - DNA, 25 bp, Homo sapien
gctaatacttattgaggacctcgtg

SEQ ID NO: 8875 - DNA, 25 bp, Homo sapien
tgaggacctcgtgtggctgtctctt

SEQ ID NO: 8876 - DNA, 25 bp, Homo sapien
gctgtctcttgttctaggcacttta

SEQ ID NO: 8877 - DNA, 25 bp, Homo sapien
gttctaggcactttagagtcattct

SEQ ID NO: 8878 - DNA, 25 bp, Homo sapien
gagtcattctacgaaatggatacat

SEQ ID NO: 8879 - DNA, 25 bp, Homo sapien
acgtgtcctttggtattaacacaca

SEQ ID NO: 8880 - DNA, 25 bp, Homo sapien
cacacactatctagttcactattca

SEQ ID NO: 8881 - DNA, 25 bp, Homo sapien
atctagttcactattcatggctaat

SEQ ID NO: 8882 - DNA, 25 bp, Homo sapien
ttcactattcatggctaatataggc

SEQ ID NO: 8883 - DNA, 25 bp, Homo sapien
gctaatataggccaatctcatgctt

SEQ ID NO: 8884 - DNA, 25 bp, Homo sapien
tataggccaatctcatgcttttgtg

SEQ ID NO: 8885 - DNA, 25 bp, Homo sapien
tgctcttcaacatcaatgtattcta

SEQ ID NO: 8886 - DNA, 25 bp, Homo sapien
gtattctatacttttgtagtctcag

SEQ ID NO: 8887 - DNA, 25 bp, Homo sapien
acttttgtagtctcagttggtataa

SEQ ID NO: 8888 - DNA, 25 bp, Homo sapien
gagcactgaattcaagttctgccac

SEQ ID NO: 8889 - DNA, 25 bp, Homo sapien
cactgaattcaagttctgccactaa

SEQ ID NO: 8890 - DNA, 25 bp, Homo sapien
atcacacattcctaactctgagtcc

SEQ ID NO: 8891 - DNA, 25 bp, Homo sapien
actctgagtccccaggtgtggaata

SEQ ID NO: 8892 - DNA, 25 bp, Homo sapien
agtccccaggtgtggaatacccgtg

SEQ ID NO: 8893 - DNA, 25 bp, Homo sapien
ggaatacccgtgctcacctgtggtg

SEQ ID NO: 8894 - DNA, 25 bp, Homo sapien
gtgaaggctttgctcggctccacca

SEQ ID NO: 8895 - DNA, 25 bp, Homo sapien
atagttcagcctgtctgagcgccgc

SEQ ID NO: 8896 - DNA, 25 bp, Homo sapien
gcctggcccggagtagatgcccaat

SEQ ID NO: 8897 - DNA, 25 bp, Homo sapien
gatgcccaattgatggtactgcttg

SEQ ID NO: 8898 - DNA, 25 bp, Homo sapien
attgatggtactgcttgtctgtatt

SEQ ID NO: 8899 - DNA, 25 bp, Homo sapien
gtattcctctcctagaggtgatggc

SEQ ID NO: 8900 - DNA, 25 bp, Homo sapien
ttattagaatccttctctcggctgg

SEQ ID NO: 8901 - DNA, 25 bp, Homo sapien
ctgttggttcctttagcccagccta

SEQ ID NO: 8902 - DNA, 25 bp, Homo sapien
tttagcccagcctacaccgctggaa

SEQ ID NO: 8903 - DNA, 25 bp, Homo sapien
tacaccgctggaaataggcccttta

SEQ ID NO: 8904 - DNA, 25 bp, Homo sapien
gaaataggccctttatgagattctc

SEQ ID NO: 8905 - DNA, 25 bp, Homo sapien
aatcctagaagagtgtaccctccat

SEQ ID NO: 8906 - DNA, 25 bp, Homo sapien
gtgtaccctccatttcctgaagaat

SEQ ID NO: 8907 - DNA, 25 bp, Homo sapien
tttcctgaagaatcctgacaagtat

SEQ ID NO: 8908 - DNA, 25 bp, Homo sapien
aagaaattgctgactaccaaccaaa

SEQ ID NO: 8909 - DNA, 25 bp, Homo sapien
gctgactaccaaccaaattttcatt

SEQ ID NO: 8910 - DNA, 25 bp, Homo sapien
gaaagattcttatcaaccaatcaaa

SEQ ID NO: 8911 - DNA, 25 bp, Homo sapien
attagttttcttactattgttcata

SEQ ID NO: 8912 - DNA, 25 bp, Homo sapien
ataactaatctttaacgtaggctgg

SEQ ID NO: 8913 - DNA, 25 bp, Homo sapien
taatctttaacgtaggctggacgcg

SEQ ID NO: 8914 - DNA, 25 bp, Homo sapien
atctttaacgtaggctggacgcggt

SEQ ID NO: 8915 - DNA, 25 bp, Homo sapien
catttttgggaaatcatgtagtcta

SEQ ID NO: 8916 - DNA, 25 bp, Homo sapien
ttttgggaaatcatgtagtctatat

SEQ ID NO: 8917 - DNA, 25 bp, Homo sapien
gtagtctatatgatcacattctgga

SEQ ID NO: 8918 - DNA, 25 bp, Homo sapien
gtctatatgatcacattctggatcc

SEQ ID NO: 8919 - DNA, 25 bp, Homo sapien
tatgatcacattctggatcctttag

SEQ ID NO: 8920 - DNA, 25 bp, Homo sapien
atcacattctggatcctttagtatg

SEQ ID NO: 8921 - DNA, 25 bp, Homo sapien
cacattctggatcctttagtatgaa

SEQ ID NO: 8922 - DNA, 25 bp, Homo sapien
ttctggatcctttagtatgaataaa

SEQ ID NO: 8923 - DNA, 25 bp, Homo sapien
ctaccttccacaagcgtcaagaatt

SEQ ID NO: 8924 - DNA, 25 bp, Homo sapien
agaattaaatcaggcctggcgcggt

SEQ ID NO: 8925 - DNA, 25 bp, Homo sapien
ttagggcctttggaggatttcctat

SEQ ID NO: 8926 - DNA, 25 bp, Homo sapien
gatttcctatggaaggtccccactt

SEQ ID NO: 8927 - DNA, 25 bp, Homo sapien
cattctgggttaaaatgtccttggt

SEQ ID NO: 8928 - DNA, 25 bp, Homo sapien
gggctgaagctagattttcttgctt

SEQ ID NO: 8929 - DNA, 25 bp, Homo sapien
tgcattacaagcttctgaaccaagg

SEQ ID NO: 8930 - DNA, 25 bp, Homo sapien
aggacttcaatgtcacctggacttg

SEQ ID NO: 8931 - DNA, 25 bp, Homo sapien
tggacttggattcacatcccagctc

SEQ ID NO: 8932 - DNA, 25 bp, Homo sapien
agctttaagactgtgtaaccttggg

SEQ ID NO: 8933 - DNA, 25 bp, Homo sapien
ccgctttaagccttaactgtttcat

SEQ ID NO: 8934 - DNA, 25 bp, Homo sapien
tcgaaactttttgaacactgacatc

SEQ ID NO: 8935 - DNA, 25 bp, Homo sapien
ttttgaacactgacatcatgatgaa

SEQ ID NO: 8936 - DNA, 25 bp, Homo sapien
gatgaccttaacactataggaaatg

SEQ ID NO: 8937 - DNA, 25 bp, Homo sapien
gaaatgtacagaaacaccgtggtga

SEQ ID NO: 8938 - DNA, 25 bp, Homo sapien
atgggcttactgaagagctggagca

SEQ ID NO: 8939 - DNA, 25 bp, Homo sapien
atggcagtgtacaaaatcagagtga

SEQ ID NO: 8940 - DNA, 25 bp, Homo sapien
aaatcagagtgatgtctaagacaaa

SEQ ID NO: 8941 - DNA, 25 bp, Homo sapien
aggcagatgaccctggaggaatcac

SEQ ID NO: 8942 - DNA, 25 bp, Homo sapien
tgaccctggaggaatcactttaaaa

SEQ ID NO: 8943 - DNA, 25 bp, Homo sapien
tggtccctcagctgcatctgaggtt

SEQ ID NO: 8944 - DNA, 25 bp, Homo sapien
cctcagctgcatctgaggtttcttc

SEQ ID NO: 8945 - DNA, 25 bp, Homo sapien
cggactccttagtcaagaagggcat

SEQ ID NO: 8946 - DNA, 25 bp, Homo sapien
ggcatggttgaaaagtgctgaactg

SEQ ID NO: 8947 - DNA, 25 bp, Homo sapien
gaactggacactggaagacattggt

SEQ ID NO: 8948 - DNA, 25 bp, Homo sapien
gacattggttcaagttttgcttcta

SEQ ID NO: 8949 - DNA, 25 bp, Homo sapien
agttttgcttctaccttgatttgtt

SEQ ID NO: 8950 - DNA, 25 bp, Homo sapien
cttgggcaaattagtctctgaaaat

SEQ ID NO: 8951 - DNA, 25 bp, Homo sapien
cagtttcttcacgtgtggaatgaga

SEQ ID NO: 8952 - DNA, 25 bp, Homo sapien
gagaatcactgtatctatctgcatt

SEQ ID NO: 8953 - DNA, 25 bp, Homo sapien
tatctgcattgtctacctcgtaggg

SEQ ID NO: 8954 - DNA, 25 bp, Homo sapien
acctcgtagggtatatgagcttcaa

SEQ ID NO: 8955 - DNA, 25 bp, Homo sapien
gtgttaactcaaatctagaaacttc

SEQ ID NO: 8956 - DNA, 25 bp, Homo sapien
taaatcggatcttctcagcttagcg

SEQ ID NO: 8957 - DNA, 25 bp, Homo sapien
aagactgatgctgccagatgacttt

SEQ ID NO: 8958 - DNA, 25 bp, Homo sapien
ctgatgctgccagatgactttggaa

SEQ ID NO: 8959 - DNA, 25 bp, Homo sapien
gctgccagatgactttggaagcccc

SEQ ID NO: 8960 - DNA, 25 bp, Homo sapien
cagatgactttggaagccccctgga

SEQ ID NO: 8961 - DNA, 25 bp, Homo sapien
ctcttacagtggaggaagacaggaa

SEQ ID NO: 8962 - DNA, 25 bp, Homo sapien
acaggaatatcaggtctctgagccc

SEQ ID NO: 8963 - DNA, 25 bp, Homo sapien
agaagtgaaaatggcgcgtgcctgc

SEQ ID NO: 8964 - DNA, 25 bp, Homo sapien
tgaaaatggcgcgtgcctgccttaa

SEQ ID NO: 8965 - DNA, 25 bp, Homo sapien
atggcgcgtgcctgccttaactgat

SEQ ID NO: 8966 - DNA, 25 bp, Homo sapien
gcctaacagagaacaatcccctttg

SEQ ID NO: 8967 - DNA, 25 bp, Homo sapien
gactatttctggcagggaactgtca

SEQ ID NO: 8968 - DNA, 25 bp, Homo sapien
ggaactgtcagcctgccctgttcaa

SEQ ID NO: 8969 - DNA, 25 bp, Homo sapien
ggaatgtcctgggatcagctgaaaa

SEQ ID NO: 8970 - DNA, 25 bp, Homo sapien
aggagacatcctagcagcagttaat

SEQ ID NO: 8971 - DNA, 25 bp, Homo sapien
gaaatttttcatctgtgggtatgag

SEQ ID NO: 8972 - DNA, 25 bp, Homo sapien
aagacaaggtttccacattcctcgg

SEQ ID NO: 8973 - DNA, 25 bp, Homo sapien
tgcctggagcaactttttgggtata

SEQ ID NO: 8974 - DNA, 25 bp, Homo sapien
gggtatagccatttatacataggct

SEQ ID NO: 8975 - DNA, 25 bp, Homo sapien
ggctaggcaaccattaagaatcagt

SEQ ID NO: 8976 - DNA, 25 bp, Homo sapien
aagaatcagtggatcagccaggtgt

SEQ ID NO: 8977 - DNA, 25 bp, Homo sapien
tgagccacgaagacgccactgtact

SEQ ID NO: 8978 - DNA, 25 bp, Homo sapien
atggttcactcggtctgagtgtgac

SEQ ID NO: 8979 - DNA, 25 bp, Homo sapien
actcggtctgagtgtgactcttgaa

SEQ ID NO: 8980 - DNA, 25 bp, Homo sapien
gtgactcttgaatggacgggactat

SEQ ID NO: 8981 - DNA, 25 bp, Homo sapien
tgaatggacgggactatccacctcg

SEQ ID NO: 8982 - DNA, 25 bp, Homo sapien
gcaggctcaacgtggggctatgtca

SEQ ID NO: 8983 - DNA, 25 bp, Homo sapien
aaacggacaatcacccgagtctcag

SEQ ID NO: 8984 - DNA, 25 bp, Homo sapien
attcgctcattccttgggaggcgga

SEQ ID NO: 8985 - DNA, 25 bp, Homo sapien
cgctcattccttgggaggcggaatt

SEQ ID NO: 8986 - DNA, 25 bp, Homo sapien
aggcggaattcgtctgaatcgctcc

SEQ ID NO: 8987 - DNA, 25 bp, Homo sapien
attttcccggagtgcgaggtcctgc

SEQ ID NO: 8988 - DNA, 25 bp, Homo sapien
tttctcctttccaatatccctctgt

SEQ ID NO: 8989 - DNA, 25 bp, Homo sapien
agccaggaatgcctgtagtcatgcc

SEQ ID NO: 8990 - DNA, 25 bp, Homo sapien
ggaatgcctgtagtcatgcctgtag

SEQ ID NO: 8991 - DNA, 25 bp, Homo sapien
aatgcctgtagtcatgcctgtagtc

SEQ ID NO: 8992 - DNA, 25 bp, Homo sapien
ggagatcaacactgcagtgcactat

SEQ ID NO: 8993 - DNA, 25 bp, Homo sapien
gcctgtgaattttagagctgagatt

SEQ ID NO: 8994 - DNA, 25 bp, Homo sapien
tagagctgagatttccctgttgcac

SEQ ID NO: 8995 - DNA, 25 bp, Homo sapien
gagctgagatttccctgttgcacag

SEQ ID NO: 8996 - DNA, 25 bp, Homo sapien
tgagatttccctgttgcacaggcta

SEQ ID NO: 8997 - DNA, 25 bp, Homo sapien
tgcacaggctagagcaacatagaga

SEQ ID NO: 8998 - DNA, 25 bp, Homo sapien
aaggttgcagaatacagggctgata

SEQ ID NO: 8999 - DNA, 25 bp, Homo sapien
acagggctgatataggaaaattcac

SEQ ID NO: 9000 - DNA, 25 bp, Homo sapien
tgagcaggctcaagtcgtccctgga

SEQ ID NO: 9001 - DNA, 25 bp, Homo sapien
cagttcagtcatgctaggactctat

SEQ ID NO: 9002 - DNA, 25 bp, Homo sapien
gacaaatacaggcaaagcacgtttt

SEQ ID NO: 9003 - DNA, 25 bp, Homo sapien
gcacgttttagatcttggttctcag

SEQ ID NO: 9004 - DNA, 25 bp, Homo sapien
ggaaagctctgttctgctttgctct

SEQ ID NO: 9005 - DNA, 25 bp, Homo sapien
gctttgctctgctagttggctagta

SEQ ID NO: 9006 - DNA, 25 bp, Homo sapien
gctagttggctagtaggcttgtgat

SEQ ID NO: 9007 - DNA, 25 bp, Homo sapien
ggcttgtgatatcatcatccctatc

SEQ ID NO: 9008 - DNA, 25 bp, Homo sapien
tatcaatgtcctgcccaattggcct

SEQ ID NO: 9009 - DNA, 25 bp, Homo sapien
aattggccttgcgaagccccatcaa

SEQ ID NO: 9010 - DNA, 25 bp, Homo sapien
agccccatcaagattctcctagaat

SEQ ID NO: 9011 - DNA, 25 bp, Homo sapien
accaaagagaggctgcaaacggatg

SEQ ID NO: 9012 - DNA, 25 bp, Homo sapien
caaacggatgatgactgcagtggat

SEQ ID NO: 9013 - DNA, 25 bp, Homo sapien
acaactcgttgatacttttcatggc

SEQ ID NO: 9014 - DNA, 25 bp, Homo sapien
tcgttgatacttttcatggctgcta

SEQ ID NO: 9015 - DNA, 25 bp, Homo sapien
gctagggctactcattactctgaaa

SEQ ID NO: 9016 - DNA, 25 bp, Homo sapien
tctgaaaatagacttagccccgccc

SEQ ID NO: 9017 - DNA, 25 bp, Homo sapien
ggacataatcaaccacgtactctgc

SEQ ID NO: 9018 - DNA, 25 bp, Homo sapien
gtactctgcctttcagggactgtat

SEQ ID NO: 9019 - DNA, 25 bp, Homo sapien
ctgcctttcagggactgtatttcag

SEQ ID NO: 9020 - DNA, 25 bp, Homo sapien
aatgcttgaggaaagtcgtgtggta

SEQ ID NO: 9021 - DNA, 25 bp, Homo sapien
aacaatgagagttgggccgggcaca

SEQ ID NO: 9022 - DNA, 25 bp, Homo sapien
ttttgtagacatttacttcaacatg

SEQ ID NO: 9023 - DNA, 25 bp, Homo sapien
gacatttacttcaacatgtattgat

SEQ ID NO: 9024 - DNA, 25 bp, Homo sapien
atttcatttgaatattgcagccaat

SEQ ID NO: 9025 - DNA, 25 bp, Homo sapien
tattgcagccaataattcttttttg

SEQ ID NO: 9026 - DNA, 25 bp, Homo sapien
ggtttttgcaagttatgcattgttt

SEQ ID NO: 9027 - DNA, 25 bp, Homo sapien
atgcattgttttttatggtgaaaag

SEQ ID NO: 9028 - DNA, 25 bp, Homo sapien
gaacataatatctaacactaggagg

SEQ ID NO: 9029 - DNA, 25 bp, Homo sapien
gaaaataaaccctgtgcaaccataa

SEQ ID NO: 9030 - DNA, 25 bp, Homo sapien
aaccctgtgcaaccataaacttgtt

SEQ ID NO: 9031 - DNA, 25 bp, Homo sapien
aaagccaatatgcagcctagcgcgg

SEQ ID NO: 9032 - DNA, 25 bp, Homo sapien
ccaatatgcagcctagcgcggtggc

SEQ ID NO: 9033 - DNA, 25 bp, Homo sapien
tgggctgtttgatggtacctcttgc

SEQ ID NO: 9034 - DNA, 25 bp, Homo sapien
tttgatggtacctcttgcaatccca

SEQ ID NO: 9035 - DNA, 25 bp, Homo sapien
tggtacctcttgcaatcccattctt

SEQ ID NO: 9036 - DNA, 25 bp, Homo sapien
aatcccattcttcttgcctggcttc

SEQ ID NO: 9037 - DNA, 25 bp, Homo sapien
gcttctttctctaaggcagttccat

SEQ ID NO: 9038 - DNA, 25 bp, Homo sapien
tctctaaggcagttccatcaagact

SEQ ID NO: 9039 - DNA, 25 bp, Homo sapien
atcaagactgtctttgtatcgcgaa

SEQ ID NO: 9040 - DNA, 25 bp, Homo sapien
agactgtctttgtatcgcgaagccc

SEQ ID NO: 9041 - DNA, 25 bp, Homo sapien
ctgtctttgtatcgcgaagcccaca

SEQ ID NO: 9042 - DNA, 25 bp, Homo sapien
cgaagcccacatcctcttagttttt

SEQ ID NO: 9043 - DNA, 25 bp, Homo sapien
tttcttgtagcagcaatagacatag

SEQ ID NO: 9044 - DNA, 25 bp, Homo sapien
tgattgggctgatcagagcagagct

SEQ ID NO: 9045 - DNA, 25 bp, Homo sapien
attgggctgatcagagcagagctgt

SEQ ID NO: 9046 - DNA, 25 bp, Homo sapien
agctgtgctggtctgagaaagactc

SEQ ID NO: 9047 - DNA, 25 bp, Homo sapien
tgtgctggtctgagaaagactccta

SEQ ID NO: 9048 - DNA, 25 bp, Homo sapien
gctggtctgagaaagactcctagaa

SEQ ID NO: 9049 - DNA, 25 bp, Homo sapien
ctgagaaagactcctagaagaagac

SEQ ID NO: 9050 - DNA, 25 bp, Homo sapien
tatattggccccattttacagttgg

SEQ ID NO: 9051 - DNA, 25 bp, Homo sapien
ttggccccattttacagttggtgac

SEQ ID NO: 9052 - DNA, 25 bp, Homo sapien
cattttacagttggtgacactgagg

SEQ ID NO: 9053 - DNA, 25 bp, Homo sapien
aggttaagtgggttgctcaaggctg

SEQ ID NO: 9054 - DNA, 25 bp, Homo sapien
aagtgggttgctcaaggctgggtgt

SEQ ID NO: 9055 - DNA, 25 bp, Homo sapien
tcaggatctgaaaccattctggtgc

SEQ ID NO: 9056 - DNA, 25 bp, Homo sapien
attctggtgccaagcattgtgggta

SEQ ID NO: 9057 - DNA, 25 bp, Homo sapien
ggatactcagcctgtattgtcgatg

SEQ ID NO: 9058 - DNA, 25 bp, Homo sapien
cagcctgtattgtcgatgagaaatc

SEQ ID NO: 9059 - DNA, 25 bp, Homo sapien
gatgagaaatctggtattactctaa

SEQ ID NO: 9060 - DNA, 25 bp, Homo sapien
attactctaattgtcattccgtggt

SEQ ID NO: 9061 - DNA, 25 bp, Homo sapien
attgtcattccgtggtaagagatgt

SEQ ID NO: 9062 - DNA, 25 bp, Homo sapien
gtctaagtgtgaggctgcttctgtt

SEQ ID NO: 9063 - DNA, 25 bp, Homo sapien
ctgcttctgtttttcctgattcgga

SEQ ID NO: 9064 - DNA, 25 bp, Homo sapien
tgtttttcctgattcggacctcaca

SEQ ID NO: 9065 - DNA, 25 bp, Homo sapien
tcggacctcacatgctttttgacat

SEQ ID NO: 9066 - DNA, 25 bp, Homo sapien
gggcaaaatcaccaactgctcagtt

SEQ ID NO: 9067 - DNA, 25 bp, Homo sapien
aactgctcagtttccatttaacaag

SEQ ID NO: 9068 - DNA, 25 bp, Homo sapien
catttaacaagtatgttctgagcaa

SEQ ID NO: 9069 - DNA, 25 bp, Homo sapien
ttctgagcaaacatggctcccgcac

SEQ ID NO: 9070 - DNA, 25 bp, Homo sapien
gctcccgcacacaaggactttaaga

SEQ ID NO: 9071 - DNA, 25 bp, Homo sapien
gttaaatagcaatgtaaggcagtac

SEQ ID NO: 9072 - DNA, 25 bp, Homo sapien
gtaaggcagtacagtattatagtat

SEQ ID NO: 9073 - DNA, 25 bp, Homo sapien
ggatgacacttttgcttagtggcta

SEQ ID NO: 9074 - DNA, 25 bp, Homo sapien
tggctaaataggcatcaggacacat

SEQ ID NO: 9075 - DNA, 25 bp, Homo sapien
atcaggacacatggctcagaggctt

SEQ ID NO: 9076 - DNA, 25 bp, Homo sapien
atggctcagaggcttgacaaatcag

SEQ ID NO: 9077 - DNA, 25 bp, Homo sapien
gtaagagataaaactgtgattcaaa

SEQ ID NO: 9078 - DNA, 25 bp, Homo sapien
aactgtgattcaaatctatgttaga

SEQ ID NO: 9079 - DNA, 25 bp, Homo sapien
atctatgttagacatgtatctactg

SEQ ID NO: 9080 - DNA, 25 bp, Homo sapien
gacatgtatctactgtaaccctgta

SEQ ID NO: 9081 - DNA, 25 bp, Homo sapien
atgtatctactgtaaccctgtatta

SEQ ID NO: 9082 - DNA, 25 bp, Homo sapien
gaaattccagtgaagagttgattcc

SEQ ID NO: 9083 - DNA, 25 bp, Homo sapien
ttccagtgaagagttgattccatct

SEQ ID NO: 9084 - DNA, 25 bp, Homo sapien
gaagagttgattccatctttatggt

SEQ ID NO: 9085 - DNA, 25 bp, Homo sapien
gagttgattccatctttatggtatc

SEQ ID NO: 9086 - DNA, 25 bp, Homo sapien
tgattccatctttatggtatcttta

SEQ ID NO: 9087 - DNA, 25 bp, Homo sapien
ggttataaggtatgttgatttatca

SEQ ID NO: 9088 - DNA, 25 bp, Homo sapien
aaaacattccgaaaatgtccacagc

SEQ ID NO: 9089 - DNA, 25 bp, Homo sapien
aacattccgaaaatgtccacagcct

SEQ ID NO: 9090 - DNA, 25 bp, Homo sapien
ttaccctcagctcttggctgggtct

SEQ ID NO: 9091 - DNA, 25 bp, Homo sapien
taccctcagctcttggctgggtctc

SEQ ID NO: 9092 - DNA, 25 bp, Homo sapien
gctgggtctcccactatgccccatc

SEQ ID NO: 9093 - DNA, 25 bp, Homo sapien
atatttttcttcacagcttgaactg

SEQ ID NO: 9094 - DNA, 25 bp, Homo sapien
ttttcttcacagcttgaactgaaca

SEQ ID NO: 9095 - DNA, 25 bp, Homo sapien
tcacagcttgaactgaacacaatat

SEQ ID NO: 9096 - DNA, 25 bp, Homo sapien
cacagcttgaactgaacacaatatt

SEQ ID NO: 9097 - DNA, 25 bp, Homo sapien
tgaactgaacacaatattgcccggt

SEQ ID NO: 9098 - DNA, 25 bp, Homo sapien
aactgaacacaatattgcccggttt

SEQ ID NO: 9099 - DNA, 25 bp, Homo sapien
tgtctttttgtaccctaatgagttg

SEQ ID NO: 9100 - DNA, 25 bp, Homo sapien
tttgtaccctaatgagttgaccagt

SEQ ID NO: 9101 - DNA, 25 bp, Homo sapien
gttgaccagtgatgggcagccccta

SEQ ID NO: 9102 - DNA, 25 bp, Homo sapien
tgggcagcccctacgaaacttcagg

SEQ ID NO: 9103 - DNA, 25 bp, Homo sapien
aaacttcagggtagggctagtcaca

SEQ ID NO: 9104 - DNA, 25 bp, Homo sapien
gagctggtcaccaatagccaataat

SEQ ID NO: 9105 - DNA, 25 bp, Homo sapien
aatcaatcacacctataccatgaag

SEQ ID NO: 9106 - DNA, 25 bp, Homo sapien
tgaagtcacacttttgccttcagta

SEQ ID NO: 9107 - DNA, 25 bp, Homo sapien
tagttaacagcatctacagccccgt

SEQ ID NO: 9108 - DNA, 25 bp, Homo sapien
gccccgtgtttccacatttgtacaa

SEQ ID NO: 9109 - DNA, 25 bp, Homo sapien
ggaatgttcagactgaaccacactt

SEQ ID NO: 9110 - DNA, 25 bp, Homo sapien
gccatctttaagtgtacaatctagt

SEQ ID NO: 9111 - DNA, 25 bp, Homo sapien
gtgtacaatctagtggcaccaagca

SEQ ID NO: 9112 - DNA, 25 bp, Homo sapien
tagtggcaccaagcacacctacaag

SEQ ID NO: 9113 - DNA, 25 bp, Homo sapien
acctacaagctgtgcaaatgtcatc

SEQ ID NO: 9114 - DNA, 25 bp, Homo sapien
tgcaaatgtcatcactcttcatctc

SEQ ID NO: 9115 - DNA, 25 bp, Homo sapien
atgtcatcactcttcatctccagaa

SEQ ID NO: 9116 - DNA, 25 bp, Homo sapien
taataaataactgctctctttaaaa

SEQ ID NO: 9117 - DNA, 25 bp, Homo sapien
aaataactcccattaccctctctag

SEQ ID NO: 9118 - DNA, 25 bp, Homo sapien
tgtctctacggatttccctagtcta

SEQ ID NO: 9119 - DNA, 25 bp, Homo sapien
ctacggatttccctagtctagatac

SEQ ID NO: 9120 - DNA, 25 bp, Homo sapien
gatttccctagtctagatacctcat

SEQ ID NO: 9121 - DNA, 25 bp, Homo sapien
gactctggagccaacgacaaagtgt

SEQ ID NO: 9122 - DNA, 25 bp, Homo sapien
gagccaacgacaaagtgtttgagca

SEQ ID NO: 9123 - DNA, 25 bp, Homo sapien
agcaagcagggtccaagcaagggca

SEQ ID NO: 9124 - DNA, 25 bp, Homo sapien
atgaagtgggcaggaaccgagtttc

SEQ ID NO: 9125 - DNA, 25 bp, Homo sapien
ggaaccgagtttcccaggtgacatc

SEQ ID NO: 9126 - DNA, 25 bp, Homo sapien
ccaggtgacatcctgcctgtgctca

SEQ ID NO: 9127 - DNA, 25 bp, Homo sapien
tgttgcacaatcacaccgattcttt

SEQ ID NO: 9128 - DNA, 25 bp, Homo sapien
aatcacaccgattctttgtcactac

SEQ ID NO: 9129 - DNA, 25 bp, Homo sapien
cacaccgattctttgtcactactga

SEQ ID NO: 9130 - DNA, 25 bp, Homo sapien
gtcactactgagtgcagtgttctta

SEQ ID NO: 9131 - DNA, 25 bp, Homo sapien
actgagtgcagtgttcttaagaatg

SEQ ID NO: 9132 - DNA, 25 bp, Homo sapien
gagccccgggtccttccttcaacat

SEQ ID NO: 9133 - DNA, 25 bp, Homo sapien
tcccttcctttatcctgggtggctg

SEQ ID NO: 9134 - DNA, 25 bp, Homo sapien
ccttcctttatcctgggtggctggg

SEQ ID NO: 9135 - DNA, 25 bp, Homo sapien
acccagcctctcttgtgctttttag

SEQ ID NO: 9136 - DNA, 25 bp, Homo sapien
cccagcctctcttgtgctttttaga

SEQ ID NO: 9137 - DNA, 25 bp, Homo sapien
cagcctctcttgtgctttttagata

SEQ ID NO: 9138 - DNA, 25 bp, Homo sapien
gcctctcttgtgctttttagataag

SEQ ID NO: 9139 - DNA, 25 bp, Homo sapien
cttgtgctttttagataagtatttt

SEQ ID NO: 9140 - DNA, 25 bp, Homo sapien
aaagtgtttgttagttgtcggctgg

SEQ ID NO: 9141 - DNA, 25 bp, Homo sapien
agtgtttgttagttgtcggctgggc

SEQ ID NO: 9142 - DNA, 25 bp, Homo sapien
gtttgttagttgtcggctgggcgtg

SEQ ID NO: 9143 - DNA, 25 bp, Homo sapien
ggacactgtacccttggctgaaaat

SEQ ID NO: 9144 - DNA, 25 bp, Homo sapien
tgaaaattccctccttagtctactt

SEQ ID NO: 9145 - DNA, 25 bp, Homo sapien
tagtctacttcccatcccaaattct

SEQ ID NO: 9146 - DNA, 25 bp, Homo sapien
aaattctacccatccacactgtggc

SEQ ID NO: 9147 - DNA, 25 bp, Homo sapien
acactgtggcatcctaggtctctct

SEQ ID NO: 9148 - DNA, 25 bp, Homo sapien
taggtctctctagcagctgaacagg

SEQ ID NO: 9149 - DNA, 25 bp, Homo sapien
aacaggcaggcctctgtaacaactg

SEQ ID NO: 9150 - DNA, 25 bp, Homo sapien
gaaagagccagtaaccttatacaaa

SEQ ID NO: 9151 - DNA, 25 bp, Homo sapien
gaatagaacaaaagcccaccacaag

SEQ ID NO: 9152 - DNA, 25 bp, Homo sapien
caagtttttgcctaagtctttcctg

SEQ ID NO: 9153 - DNA, 25 bp, Homo sapien
aagtctttcctgtgccttgaaccat

SEQ ID NO: 9154 - DNA, 25 bp, Homo sapien
agccatgcgcgataataaaattgtg

SEQ ID NO: 9155 - DNA, 25 bp, Homo sapien
gttgaaacaagtctcatgcctcagt

SEQ ID NO: 9156 - DNA, 25 bp, Homo sapien
attgtttcaagtcactatgttttgg

SEQ ID NO: 9157 - DNA, 25 bp, Homo sapien
gaattttctacaaatgctgccccta

SEQ ID NO: 9158 - DNA, 25 bp, Homo sapien
atgctgcccctaaatgctttgggat

SEQ ID NO: 9159 - DNA, 25 bp, Homo sapien
gggatgtctctgcaaatctcagcaa

SEQ ID NO: 9160 - DNA, 25 bp, Homo sapien
aagtgaccatcactctacctttatt

SEQ ID NO: 9161 - DNA, 25 bp, Homo sapien
acctttattctctcactggtaggct

SEQ ID NO: 9162 - DNA, 25 bp, Homo sapien
ctcactggtaggctctccaattaaa

SEQ ID NO: 9163 - DNA, 25 bp, Homo sapien
aatattcattcaggaagctcatagc

SEQ ID NO: 9164 - DNA, 25 bp, Homo sapien
atcttactgttcagttttgacccta

SEQ ID NO: 9165 - DNA, 25 bp, Homo sapien
ggagcacatttgctcacgtctccca

SEQ ID NO: 9166 - DNA, 25 bp, Homo sapien
aggctggctgtacactctgaggcca

SEQ ID NO: 9167 - DNA, 25 bp, Homo sapien
tcccgattccgctgggctttctaag

SEQ ID NO: 9168 - DNA, 25 bp, Homo sapien
ccaggcccagccttgaagctgtaaa

SEQ ID NO: 9169 - DNA, 25 bp, Homo sapien
ttgaagctgtaaagacctctcaccc

SEQ ID NO: 9170 - DNA, 25 bp, Homo sapien
tcaccccatccaaatgagactggtc

SEQ ID NO: 9171 - DNA, 25 bp, Homo sapien
agactggtcagatatctcccgcatg

SEQ ID NO: 9172 - DNA, 25 bp, Homo sapien
atgtcagccgccactggattgggaa

SEQ ID NO: 9173 - DNA, 25 bp, Homo sapien
gcagtaggtgcaaggctggcccttt

SEQ ID NO: 9174 - DNA, 25 bp, Homo sapien
ggctggccctttttatgagagttat

SEQ ID NO: 9175 - DNA, 25 bp, Homo sapien
tgactgagagagatcctggctccaa

SEQ ID NO: 9176 - DNA, 25 bp, Homo sapien
tatatgccatgggatatatggaaaa

SEQ ID NO: 9177 - DNA, 25 bp, Homo sapien
tccttacaaactgcagaacaaatat

SEQ ID NO: 9178 - DNA, 25 bp, Homo sapien
gaaagtaagtacagttataacagat

SEQ ID NO: 9179 - DNA, 25 bp, Homo sapien
aatcaatgtgtattctttactggaa

SEQ ID NO: 9180 - DNA, 25 bp, Homo sapien
ttactggaaagattacatacatttg

SEQ ID NO: 9181 - DNA, 25 bp, Homo sapien
gaaattactctcaagaacttcagaa

SEQ ID NO: 9182 - DNA, 25 bp, Homo sapien
aacttcagaaatctgcaacataatt

SEQ ID NO: 9183 - DNA, 25 bp, Homo sapien
acactacatatacactttcagaaag

SEQ ID NO: 9184 - DNA, 25 bp, Homo sapien
ttctcaagtcattttaaagttacct

SEQ ID NO: 9185 - DNA, 25 bp, Homo sapien
tacctaacgttcttcttgaataact

SEQ ID NO: 9186 - DNA, 25 bp, Homo sapien
gaataactaatacagtgggtcaaat

SEQ ID NO: 9187 - DNA, 25 bp, Homo sapien
tcatgtgatcctctaccagaagctg

SEQ ID NO: 9188 - DNA, 25 bp, Homo sapien
cagcagcaggccaaaggatagtgga

SEQ ID NO: 9189 - DNA, 25 bp, Homo sapien
gacaagaaggcctgggtgagccttc

SEQ ID NO: 9190 - DNA, 25 bp, Homo sapien
ccttctctgagaatcactgagctct

SEQ ID NO: 9191 - DNA, 25 bp, Homo sapien
gaatcactgagctctgaaccatgaa

SEQ ID NO: 9192 - DNA, 25 bp, Homo sapien
aaccatgaatgaactgcctacctct

SEQ ID NO: 9193 - DNA, 25 bp, Homo sapien
tgaatgaactgcctacctctgtact

SEQ ID NO: 9194 - DNA, 25 bp, Homo sapien
acctctgtacttcctgttgtatagg

SEQ ID NO: 9195 - DNA, 25 bp, Homo sapien
gaaatccctatctatttaaaccact

SEQ ID NO: 9196 - DNA, 25 bp, Homo sapien
aaaccactgtagtcaggtctatgta

SEQ ID NO: 9197 - DNA, 25 bp, Homo sapien
ggtctatgtatttgtgctgtggaac

SEQ ID NO: 9198 - DNA, 25 bp, Homo sapien
tagtcgcttacggattctgagtctt

SEQ ID NO: 9199 - DNA, 25 bp, Homo sapien
cttattgtgattttgcctgagtggc

SEQ ID NO: 9200 - DNA, 25 bp, Homo sapien
ggcaagcttttcaggcacgtgtact

SEQ ID NO: 9201 - DNA, 25 bp, Homo sapien
gtggtagaatttgcctccagctagg

SEQ ID NO: 9202 - DNA, 25 bp, Homo sapien
agctaggaatccacagacttgggtt

SEQ ID NO: 9203 - DNA, 25 bp, Homo sapien
agacttgggtttgagctccacgtcc

SEQ ID NO: 9204 - DNA, 25 bp, Homo sapien
agtcaccacgtgatcttcagaaaag

SEQ ID NO: 9205 - DNA, 25 bp, Homo sapien
aaagaatcactgaactgcctgtgcc

SEQ ID NO: 9206 - DNA, 25 bp, Homo sapien
aggtggtaatacctgctgcggtttt

SEQ ID NO: 9207 - DNA, 25 bp, Homo sapien
ctgcggtttttatgtggatcgaatg

SEQ ID NO: 9208 - DNA, 25 bp, Homo sapien
gatcgaatgggcctaaaactcatag

SEQ ID NO: 9209 - DNA, 25 bp, Homo sapien
tctcactgttgttcaaactggtctc

SEQ ID NO: 9210 - DNA, 25 bp, Homo sapien
cactgttgttcaaactggtctcaaa

SEQ ID NO: 9211 - DNA, 25 bp, Homo sapien
acccggcccacttataatcttgata

SEQ ID NO: 9212 - DNA, 25 bp, Homo sapien
atacacttgatatattctttttcag

SEQ ID NO: 9213 - DNA, 25 bp, Homo sapien
atattctttttcagcatgacatgta

SEQ ID NO: 9214 - DNA, 25 bp, Homo sapien
agcatgacatgtatcaaccagtgat

SEQ ID NO: 9215 - DNA, 25 bp, Homo sapien
gtatcaaccagtgatataacttgat

SEQ ID NO: 9216 - DNA, 25 bp, Homo sapien
aacaacaagggctcaccaagtccta

SEQ ID NO: 9217 - DNA, 25 bp, Homo sapien
caagtcctaccttggcatgatttaa

SEQ ID NO: 9218 - DNA, 25 bp, Homo sapien
cctaccttggcatgatttaaataca

SEQ ID NO: 9219 - DNA, 25 bp, Homo sapien
atttaaatacatatgctttcagcca

SEQ ID NO: 9220 - DNA, 25 bp, Homo sapien
agccagtgaaagacagacagagatg

SEQ ID NO: 9221 - DNA, 25 bp, Homo sapien
aatagagagagaggcaaacatagag

SEQ ID NO: 9222 - DNA, 25 bp, Homo sapien
agagacagagtcacaacaggagaaa

SEQ ID NO: 9223 - DNA, 25 bp, Homo sapien
atctccttcttaccggcatcatgat

SEQ ID NO: 9224 - DNA, 25 bp, Homo sapien
ttcttaccggcatcatgatcacagt

SEQ ID NO: 9225 - DNA, 25 bp, Homo sapien
gcatcatgatcacagtgcccggtgg

SEQ ID NO: 9226 - DNA, 25 bp, Homo sapien
atcatgatcacagtgcccggtgggc

SEQ ID NO: 9227 - DNA, 25 bp, Homo sapien
tcacagtgcccggtgggcctcggat

SEQ ID NO: 9228 - DNA, 25 bp, Homo sapien
ggaggcacagaaggatgagtcagaa

SEQ ID NO: 9229 - DNA, 25 bp, Homo sapien
gagacacagaatcaaagagggatca

SEQ ID NO: 9230 - DNA, 25 bp, Homo sapien
cagagatggaacagagacaaacaga

SEQ ID NO: 9231 - DNA, 25 bp, Homo sapien
aagtacttgattttgcgattacagt

SEQ ID NO: 9232 - DNA, 25 bp, Homo sapien
gcgattacagtatgcattcttaaaa

SEQ ID NO: 9233 - DNA, 25 bp, Homo sapien
tcttaaaatgtcacagtctggaaat

SEQ ID NO: 9234 - DNA, 25 bp, Homo sapien
acagtctggaaataatttgtgttgt

SEQ ID NO: 9235 - DNA, 25 bp, Homo sapien
atttgtgttgtagtacttcaggtaa

SEQ ID NO: 9236 - DNA, 25 bp, Homo sapien
gtagtacttcaggtaaagtgtaaga

SEQ ID NO: 9237 - DNA, 25 bp, Homo sapien
atttatcactgcataatttcattaa

SEQ ID NO: 9238 - DNA, 25 bp, Homo sapien
tatttcggtatgtgttataaactcc

SEQ ID NO: 9239 - DNA, 25 bp, Homo sapien
gtgttataaactccagaaggattat

SEQ ID NO: 9240 - DNA, 25 bp, Homo sapien
ttttgcttaagaaggtcagttctct

SEQ ID NO: 9241 - DNA, 25 bp, Homo sapien
gcttaagaaggtcagttctctatta

SEQ ID NO: 9242 - DNA, 25 bp, Homo sapien
agagatctcttaacaaccatctgag

SEQ ID NO: 9243 - DNA, 25 bp, Homo sapien
ttaacaaccatctgagagagcttgg

SEQ ID NO: 9244 - DNA, 25 bp, Homo sapien
ggaagcagaccattgaaccccagac

SEQ ID NO: 9245 - DNA, 25 bp, Homo sapien
ttgaaccccagacaagctttgcgat

SEQ ID NO: 9246 - DNA, 25 bp, Homo sapien
accccagacaagctttgcgatgaga

SEQ ID NO: 9247 - DNA, 25 bp, Homo sapien
tttgcgatgagacggcaaccccagc

SEQ ID NO: 9248 - DNA, 25 bp, Homo sapien
atgagacggcaaccccagcttccgg

SEQ ID NO: 9249 - DNA, 25 bp, Homo sapien
gggaagtcagctactacctagtgaa

SEQ ID NO: 9250 - DNA, 25 bp, Homo sapien
agtcagctactacctagtgaagaca

SEQ ID NO: 9251 - DNA, 25 bp, Homo sapien
agtgaagacactcaggtagcctcct

SEQ ID NO: 9252 - DNA, 25 bp, Homo sapien
gtagcctcctgtcaagtcacagaga

SEQ ID NO: 9253 - DNA, 25 bp, Homo sapien
gcctttccttgttagttccaagttg

SEQ ID NO: 9254 - DNA, 25 bp, Homo sapien
aagttgtactgctagcacacagagc

SEQ ID NO: 9255 - DNA, 25 bp, Homo sapien
ggagtggcatttacaggccgtcctt

SEQ ID NO: 9256 - DNA, 25 bp, Homo sapien
acaggccgtccttgaacggctgagt

SEQ ID NO: 9257 - DNA, 25 bp, Homo sapien
cctgaacctccagcgtgaacaagga

SEQ ID NO: 9258 - DNA, 25 bp, Homo sapien
aacaaggagtgaatgctgcagagca

SEQ ID NO: 9259 - DNA, 25 bp, Homo sapien
agctccatgatgggcccaggtagca

SEQ ID NO: 9260 - DNA, 25 bp, Homo sapien
agggaggagctcacaaggcctgtct

SEQ ID NO: 9261 - DNA, 25 bp, Homo sapien
tcacaaggcctgtcttggtgatgtg

SEQ ID NO: 9262 - DNA, 25 bp, Homo sapien
atggttttgcctttcagcctttaga

SEQ ID NO: 9263 - DNA, 25 bp, Homo sapien
ttttgcctttcagcctttagaagaa

SEQ ID NO: 9264 - DNA, 25 bp, Homo sapien
tgtgttccagagatttaaagataaa

SEQ ID NO: 9265 - DNA, 25 bp, Homo sapien
taaatttgttcagacccgtagaatg

SEQ ID NO: 9266 - DNA, 25 bp, Homo sapien
aatttgttcagacccgtagaatgta

SEQ ID NO: 9267 - DNA, 25 bp, Homo sapien
tgaaccctaaggtaaactgtagacg

SEQ ID NO: 9268 - DNA, 25 bp, Homo sapien
ggtaaactgtagacgttgggtgata

SEQ ID NO: 9269 - DNA, 25 bp, Homo sapien
actgtagacgttgggtgatagtgat

SEQ ID NO: 9270 - DNA, 25 bp, Homo sapien
tcagtgtagattcatcaattgtaat

SEQ ID NO: 9271 - DNA, 25 bp, Homo sapien
aataaatgtaccacttttggtagtg

SEQ ID NO: 9272 - DNA, 25 bp, Homo sapien
atgtaccacttttggtagtggatgt

SEQ ID NO: 9273 - DNA, 25 bp, Homo sapien
gtgggaggctatgcatatgtaggat

SEQ ID NO: 9274 - DNA, 25 bp, Homo sapien
aggatggggaatatggctgtacctt

SEQ ID NO: 9275 - DNA, 25 bp, Homo sapien
gaatgttcagtaactttacaaccct

SEQ ID NO: 9276 - DNA, 25 bp, Homo sapien
tttacaaccctccacttggacaggg

SEQ ID NO: 9277 - DNA, 25 bp, Homo sapien
tattgtaactctacagcattttaga

SEQ ID NO: 9278 - DNA, 25 bp, Homo sapien
gactttgccttacaaaatactttca

SEQ ID NO: 9279 - DNA, 25 bp, Homo sapien
gtttaaaagtgtatagctgccagtt

SEQ ID NO: 9280 - DNA, 25 bp, Homo sapien
cgactagaataataggtccaacttc

SEQ ID NO: 9281 - DNA, 25 bp, Homo sapien
taggtccaacttcacaagggtcatt

SEQ ID NO: 9282 - DNA, 25 bp, Homo sapien
caagggtcattgtacgaggaccaaa

SEQ ID NO: 9283 - DNA, 25 bp, Homo sapien
gaccaaattagataaaccatgctta

SEQ ID NO: 9284 - DNA, 25 bp, Homo sapien
aaccatgcttagtatatcagaagac

SEQ ID NO: 9285 - DNA, 25 bp, Homo sapien
gttagcatgatgattagttcaattt

SEQ ID NO: 9286 - DNA, 25 bp, Homo sapien
tcaaggcatgatcagccaggctcca

SEQ ID NO: 9287 - DNA, 25 bp, Homo sapien
aggctccacagcctaggcacaagaa

SEQ ID NO: 9288 - DNA, 25 bp, Homo sapien
gcctaggcacaagaacgaagtcaaa

SEQ ID NO: 9289 - DNA, 25 bp, Homo sapien
atggtcatcggccagcccaaggcaa

SEQ ID NO: 9290 - DNA, 25 bp, Homo sapien
ccaaggcaagaagggctgctcacca

SEQ ID NO: 9291 - DNA, 25 bp, Homo sapien
aagacataggaacttcacaccagag

SEQ ID NO: 9292 - DNA, 25 bp, Homo sapien
ggaacttcacaccagagccctttat

SEQ ID NO: 9293 - DNA, 25 bp, Homo sapien
agagccctttatcatggcctgtcag

SEQ ID NO: 9294 - DNA, 25 bp, Homo sapien
gccctttatcatggcctgtcagcga

SEQ ID NO: 9295 - DNA, 25 bp, Homo sapien
catgatttgaaggaaaccagcaaga

SEQ ID NO: 9296 - DNA, 25 bp, Homo sapien
ataatgagacacagactctacaaaa

SEQ ID NO: 9297 - DNA, 25 bp, Homo sapien
ggtggctgcgtcctgaggctgagca

SEQ ID NO: 9298 - DNA, 25 bp, Homo sapien
tggcctcgggacaggatgtgcgcag

SEQ ID NO: 9299 - DNA, 25 bp, Homo sapien
gaagttcctggaatgatgggcaaga

SEQ ID NO: 9300 - DNA, 25 bp, Homo sapien
cattgggatagcagaggcctcggac

SEQ ID NO: 9301 - DNA, 25 bp, Homo sapien
atagcagaggcctcggacaggcccg

SEQ ID NO: 9302 - DNA, 25 bp, Homo sapien
gacaggcccgctcagcatgtagact

SEQ ID NO: 9303 - DNA, 25 bp, Homo sapien
tggccccttccctaggatgacagtg

SEQ ID NO: 9304 - DNA, 25 bp, Homo sapien
ggatgacagtggaggtccatcccca

SEQ ID NO: 9305 - DNA, 25 bp, Homo sapien
gtggtgagggcaatcctgacacaga

SEQ ID NO: 9306 - DNA, 25 bp, Homo sapien
gagggcaatcctgacacagagaccc

SEQ ID NO: 9307 - DNA, 25 bp, Homo sapien
gtgaaaattgacactagctgggcat

SEQ ID NO: 9308 - DNA, 25 bp, Homo sapien
atatgttgctacagggcctcacctg

SEQ ID NO: 9309 - DNA, 25 bp, Homo sapien
gctacagggcctcacctgttggcca

SEQ ID NO: 9310 - DNA, 25 bp, Homo sapien
aagccagaagataatttgacagcgc

SEQ ID NO: 9311 - DNA, 25 bp, Homo sapien
ttgacagcgctgaaaggttctaaag

SEQ ID NO: 9312 - DNA, 25 bp, Homo sapien
aaggttctaaagtatgatggcttaa

SEQ ID NO: 9313 - DNA, 25 bp, Homo sapien
gctgaaagaagaaacctgcccacct

SEQ ID NO: 9314 - DNA, 25 bp, Homo sapien
aagaagaaacctgcccacctagcat

SEQ ID NO: 9315 - DNA, 25 bp, Homo sapien
agcatccagtgctcagtagctgttt

SEQ ID NO: 9316 - DNA, 25 bp, Homo sapien
agtgctcagtagctgtttcctttaa

SEQ ID NO: 9317 - DNA, 25 bp, Homo sapien
tgctcagtagctgtttcctttaaaa

SEQ ID NO: 9318 - DNA, 25 bp, Homo sapien
aaactgatggcaaaggtctggcgca

SEQ ID NO: 9319 - DNA, 25 bp, Homo sapien
gtataattgctagatactgccaact

SEQ ID NO: 9320 - DNA, 25 bp, Homo sapien
attgctagatactgccaactaccta

SEQ ID NO: 9321 - DNA, 25 bp, Homo sapien
gatactgccaactacctaaataacc

SEQ ID NO: 9322 - DNA, 25 bp, Homo sapien
tgccaactacctaaataacctaacg

SEQ ID NO: 9323 - DNA, 25 bp, Homo sapien
ctatgatacatccaaataacagagt

SEQ ID NO: 9324 - DNA, 25 bp, Homo sapien
gaagatctctgtgaaatgacagcat

SEQ ID NO: 9325 - DNA, 25 bp, Homo sapien
atctctgtgaaatgacagcatagct

SEQ ID NO: 9326 - DNA, 25 bp, Homo sapien
gctatttccaggatacactaagtga

SEQ ID NO: 9327 - DNA, 25 bp, Homo sapien
gcaaggtacagaatacatgtatgct

SEQ ID NO: 9328 - DNA, 25 bp, Homo sapien
tgtatgctatattatcttttgtgga

SEQ ID NO: 9329 - DNA, 25 bp, Homo sapien
cttttgtggatgaccaaagagggta

SEQ ID NO: 9330 - DNA, 25 bp, Homo sapien
agtgcatagcacttggcatggcgca

SEQ ID NO: 9331 - DNA, 25 bp, Homo sapien
tagcacttggcatggcgcaggtaat

SEQ ID NO: 9332 - DNA, 25 bp, Homo sapien
ggcatggcgcaggtaataaatgtta

SEQ ID NO: 9333 - DNA, 25 bp, Homo sapien
aaaggaagcctgttctttctctgat

SEQ ID NO: 9334 - DNA, 25 bp, Homo sapien
ataccttggagaaagctgaagccct

SEQ ID NO: 9335 - DNA, 25 bp, Homo sapien
aagtgctatcccaaattgtaccgta

SEQ ID NO: 9336 - DNA, 25 bp, Homo sapien
tgtaccgtaaatatcaaccacccgt

SEQ ID NO: 9337 - DNA, 25 bp, Homo sapien
gtaaatatcaaccacccgttatctc

SEQ ID NO: 9338 - DNA, 25 bp, Homo sapien
accacccgttatctcagtatttatc

SEQ ID NO: 9339 - DNA, 25 bp, Homo sapien
gtatttatccttaacttgtgtttgt

SEQ ID NO: 9340 - DNA, 25 bp, Homo sapien
tcttaagaaatgaactggtggccag

SEQ ID NO: 9341 - DNA, 25 bp, Homo sapien
caggaaggaggctgatgatagctac

SEQ ID NO: 9342 - DNA, 25 bp, Homo sapien
gatagctacagcgtgaacaggcaga

SEQ ID NO: 9343 - DNA, 25 bp, Homo sapien
agctacagcgtgaacaggcagacta

SEQ ID NO: 9344 - DNA, 25 bp, Homo sapien
tacagcgtgaacaggcagactagag

SEQ ID NO: 9345 - DNA, 25 bp, Homo sapien
agcgtgaacaggcagactagagata

SEQ ID NO: 9346 - DNA, 25 bp, Homo sapien
gtgaacaggcagactagagatagag

SEQ ID NO: 9347 - DNA, 25 bp, Homo sapien
agggagtgcttctggggaacccatt

SEQ ID NO: 9348 - DNA, 25 bp, Homo sapien
atgtgggggcactttggaaaacaga

SEQ ID NO: 9349 - DNA, 25 bp, Homo sapien
agtggcaaatggatcaggcaggcca

SEQ ID NO: 9350 - DNA, 25 bp, Homo sapien
gacccctagaggaagcagggcttag

SEQ ID NO: 9351 - DNA, 25 bp, Homo sapien
cctagaggaagcagggcttagttaa

SEQ ID NO: 9352 - DNA, 25 bp, Homo sapien
tttcgtttgcttgtttatctatgat

SEQ ID NO: 9353 - DNA, 25 bp, Homo sapien
gagaattgctgtcttagtgacatta

SEQ ID NO: 9354 - DNA, 25 bp, Homo sapien
gtcttagtgacattaacatttttgg

SEQ ID NO: 9355 - DNA, 25 bp, Homo sapien
tgtacagtctttatacttcccctcg

SEQ ID NO: 9356 - DNA, 25 bp, Homo sapien
atacttcccctcgtagagatacagt

SEQ ID NO: 9357 - DNA, 25 bp, Homo sapien
gagatacagtggtcagacacctttc

SEQ ID NO: 9358 - DNA, 25 bp, Homo sapien
gtggtcagacacctttcatgtctag

SEQ ID NO: 9359 - DNA, 25 bp, Homo sapien
tcatgtctagtctctgcaaacttaa

SEQ ID NO: 9360 - DNA, 25 bp, Homo sapien
gacataattttcctgcttgttactt

SEQ ID NO: 9361 - DNA, 25 bp, Homo sapien
ttagaacttaacgtggccatgcatg

SEQ ID NO: 9362 - DNA, 25 bp, Homo sapien
acgtggccatgcatgatggcttaca

SEQ ID NO: 9363 - DNA, 25 bp, Homo sapien
ttataactttcaaaggccgggtgca

SEQ ID NO: 9364 - DNA, 25 bp, Homo sapien
tataactttcaaaggccgggtgcat

SEQ ID NO: 9365 - DNA, 25 bp, Homo sapien
ataactttcaaaggccgggtgcatt

SEQ ID NO: 9366 - DNA, 25 bp, Homo sapien
aactttcaaaggccgggtgcattgg

SEQ ID NO: 9367 - DNA, 25 bp, Homo sapien
ttcaaaggccgggtgcattggctca

SEQ ID NO: 9368 - DNA, 25 bp, Homo sapien
aaaatttgcttcagtatataataca

SEQ ID NO: 9369 - DNA, 25 bp, Homo sapien
tataatacatatgtttttcagattc

SEQ ID NO: 9370 - DNA, 25 bp, Homo sapien
gtttttcagattcctacaaagcata

SEQ ID NO: 9371 - DNA, 25 bp, Homo sapien
ttttcagattcctacaaagcataaa

SEQ ID NO: 9372 - DNA, 25 bp, Homo sapien
ttcagattcctacaaagcataaaaa

SEQ ID NO: 9373 - DNA, 25 bp, Homo sapien
cagattcctacaaagcataaaaatt

SEQ ID NO: 9374 - DNA, 25 bp, Homo sapien
agtgtcttttcaagcatgtttttta

SEQ ID NO: 9375 - DNA, 25 bp, Homo sapien
ttttttgcacaaacggaatcacagt

SEQ ID NO: 9376 - DNA, 25 bp, Homo sapien
gaatcatactacagtcaccagtcaa

SEQ ID NO: 9377 - DNA, 25 bp, Homo sapien
gtcaccagtcaagggattttgtcca

SEQ ID NO: 9378 - DNA, 25 bp, Homo sapien
gattttgtccaagaccccaagagca

SEQ ID NO: 9379 - DNA, 25 bp, Homo sapien
aggttcttggctctcatgcagggaa

SEQ ID NO: 9380 - DNA, 25 bp, Homo sapien
ttcagggcaagtcacagagtagagt

SEQ ID NO: 9381 - DNA, 25 bp, Homo sapien
aaatgatttactacagactactgaa

SEQ ID NO: 9382 - DNA, 25 bp, Homo sapien
cagaatagggcatcctcagagagca

SEQ ID NO: 9383 - DNA, 25 bp, Homo sapien
gggtgcacccatttcaatataatgc

SEQ ID NO: 9384 - DNA, 25 bp, Homo sapien
aaaagtgtactttggccaggcgcag

SEQ ID NO: 9385 - DNA, 25 bp, Homo sapien
aagggtcatgaattcaaggcagtaa

SEQ ID NO: 9386 - DNA, 25 bp, Homo sapien
gcatgggatccatggagcatggccc

SEQ ID NO: 9387 - DNA, 25 bp, Homo sapien
gagcatggcccatctaaaacagcag

SEQ ID NO: 9388 - DNA, 25 bp, Homo sapien
ggcccatctaaaacagcagcatctc

SEQ ID NO: 9389 - DNA, 25 bp, Homo sapien
gcagcatctcagctcaagttgactg

SEQ ID NO: 9390 - DNA, 25 bp, Homo sapien
gttgactgtcatcatgttgaatgtg

SEQ ID NO: 9391 - DNA, 25 bp, Homo sapien
gttgaatgtgttgacaaggccaggt

SEQ ID NO: 9392 - DNA, 25 bp, Homo sapien
tttgaaatcagcctaggtaactagg

SEQ ID NO: 9393 - DNA, 25 bp, Homo sapien
ggtaactaggcaagacctcatgtct

SEQ ID NO: 9394 - DNA, 25 bp, Homo sapien
atattcatactctcaaacaccttct

SEQ ID NO: 9395 - DNA, 25 bp, Homo sapien
aacaccttctgtagactaagggtca

SEQ ID NO: 9396 - DNA, 25 bp, Homo sapien
aaaatctccagaactccatagtctc

SEQ ID NO: 9397 - DNA, 25 bp, Homo sapien
atagtctcttgaaatgattgtccac

SEQ ID NO: 9398 - DNA, 25 bp, Homo sapien
aaatgattgtccactgaagttccac

SEQ ID NO: 9399 - DNA, 25 bp, Homo sapien
acgtattcataaagtgctcccacaa

SEQ ID NO: 9400 - DNA, 25 bp, Homo sapien
gctcccacaacttgctgacaagcat

SEQ ID NO: 9401 - DNA, 25 bp, Homo sapien
gtattttacatcctgccatgagttt

SEQ ID NO: 9402 - DNA, 25 bp, Homo sapien
agacattaactcctttagctatcaa

SEQ ID NO: 9403 - DNA, 25 bp, Homo sapien
aaaccacaggtgactgacaagactt

SEQ ID NO: 9404 - DNA, 25 bp, Homo sapien
gacaagactttcacaagtgcagaca

SEQ ID NO: 9405 - DNA, 25 bp, Homo sapien
gtttggattcaaagcctggtcatat

SEQ ID NO: 9406 - DNA, 25 bp, Homo sapien
ttttcaggtttatctcaccccgatg

SEQ ID NO: 9407 - DNA, 25 bp, Homo sapien
aaaccctctgtttcccgaatgctca

SEQ ID NO: 9408 - DNA, 25 bp, Homo sapien
aaccctctgtttcccgaatgctcag

SEQ ID NO: 9409 - DNA, 25 bp, Homo sapien
cctctgtttcccgaatgctcaggga

SEQ ID NO: 9410 - DNA, 25 bp, Homo sapien
ataaaactcctggctggacacagtg

SEQ ID NO: 9411 - DNA, 25 bp, Homo sapien
cagttatgtgtgtttccctacaatc

SEQ ID NO: 9412 - DNA, 25 bp, Homo sapien
agttatgtgtgtttccctacaatca

SEQ ID NO: 9413 - DNA, 25 bp, Homo sapien
gtgtgtttccctacaatcaaacaat

SEQ ID NO: 9414 - DNA, 25 bp, Homo sapien
tgtgtttccctacaatcaaacaatg

SEQ ID NO: 9415 - DNA, 25 bp, Homo sapien
gtgtttccctacaatcaaacaatga

SEQ ID NO: 9416 - DNA, 25 bp, Homo sapien
gtttccctacaatcaaacaatgatt

SEQ ID NO: 9417 - DNA, 25 bp, Homo sapien
ttccctacaatcaaacaatgattta

SEQ ID NO: 9418 - DNA, 25 bp, Homo sapien
tagcactagatcaacactctcctta

SEQ ID NO: 9419 - DNA, 25 bp, Homo sapien
actctccttagtctcaacttttcaa

SEQ ID NO: 9420 - DNA, 25 bp, Homo sapien
gtctcaacttttcaagggtcactag

SEQ ID NO: 9421 - DNA, 25 bp, Homo sapien
gtcactagtaagttcgaaggatcct

SEQ ID NO: 9422 - DNA, 25 bp, Homo sapien
atccttgatgactccgatgatcttg

SEQ ID NO: 9423 - DNA, 25 bp, Homo sapien
gatgatcttgtaatgcccaacagta

SEQ ID NO: 9424 - DNA, 25 bp, Homo sapien
tgcccaacagtatctcccaggagta

SEQ ID NO: 9425 - DNA, 25 bp, Homo sapien
aagatcctctccacataagacactc

SEQ ID NO: 9426 - DNA, 25 bp, Homo sapien
agacactcttgatagttctcttccg

SEQ ID NO: 9427 - DNA, 25 bp, Homo sapien
ttgatagttctcttccgattcagcc

SEQ ID NO: 9428 - DNA, 25 bp, Homo sapien
ccaccccagtggttaacataacaat

SEQ ID NO: 9429 - DNA, 25 bp, Homo sapien
ttatctgcatttttccttggtgttt

SEQ ID NO: 9430 - DNA, 25 bp, Homo sapien
atttgtgggcaaataagcgctaaac

SEQ ID NO: 9431 - DNA, 25 bp, Homo sapien
agcgctaaacattgttttccatgtt

SEQ ID NO: 9432 - DNA, 25 bp, Homo sapien
gttgatttcatttgcagaacattat

SEQ ID NO: 9433 - DNA, 25 bp, Homo sapien
tttgcagaacattataggatacttt

SEQ ID NO: 9434 - DNA, 25 bp, Homo sapien
caaataagcattttccaggcagaat

SEQ ID NO: 9435 - DNA, 25 bp, Homo sapien
ggcagaattatttttgtcacaggtt

SEQ ID NO: 9436 - DNA, 25 bp, Homo sapien
attattttagcccagttttgctgaa

SEQ ID NO: 9437 - DNA, 25 bp, Homo sapien
gctgaatttttacatgtacttccaa

SEQ ID NO: 9438 - DNA, 25 bp, Homo sapien
acatgtacttccaactcttagaaaa

SEQ ID NO: 9439 - DNA, 25 bp, Homo sapien
aattttccagtactggccgggcgtg

SEQ ID NO: 9440 - DNA, 25 bp, Homo sapien
gagagagctgttgttgcacccctgt

SEQ ID NO: 9441 - DNA, 25 bp, Homo sapien
tgctccatgcaaggtaggcccaggc

SEQ ID NO: 9442 - DNA, 25 bp, Homo sapien
gtaggcccaggcttcaaggtgcaga

SEQ ID NO: 9443 - DNA, 25 bp, Homo sapien
gcagggtggccatatctaaggcgac

SEQ ID NO: 9444 - DNA, 25 bp, Homo sapien
atatctaaggcgacagggctgcatt

SEQ ID NO: 9445 - DNA, 25 bp, Homo sapien
cgacagggctgcattggcctagatt

SEQ ID NO: 9446 - DNA, 25 bp, Homo sapien
gcattggcctagattggatctccta

SEQ ID NO: 9447 - DNA, 25 bp, Homo sapien
tggatctcctagagaaggccctgga

SEQ ID NO: 9448 - DNA, 25 bp, Homo sapien
agatgacacttactgggccttttta

SEQ ID NO: 9449 - DNA, 25 bp, Homo sapien
gggcctttttaatccagtgaatatt

SEQ ID NO: 9450 - DNA, 25 bp, Homo sapien
gtgacccatagatgggcctgatctt

SEQ ID NO: 9451 - DNA, 25 bp, Homo sapien
aagactggtagactcattgggtgca

SEQ ID NO: 9452 - DNA, 25 bp, Homo sapien
actggtagactcattgggtgcaatc

SEQ ID NO: 9453 - DNA, 25 bp, Homo sapien
gggtgcaatcacttaatgaaacctc

SEQ ID NO: 9454 - DNA, 25 bp, Homo sapien
atgaaacctctgtctagtctttggc

SEQ ID NO: 9455 - DNA, 25 bp, Homo sapien
acctctgtctagtctttggctaagc

SEQ ID NO: 9456 - DNA, 25 bp, Homo sapien
ggctaagctagccaagcagacactt

SEQ ID NO: 9457 - DNA, 25 bp, Homo sapien
gctagccaagcagacacttcagtgg

SEQ ID NO: 9458 - DNA, 25 bp, Homo sapien
acacaattagtaaagtcacgacaca

SEQ ID NO: 9459 - DNA, 25 bp, Homo sapien
aagtcacgacacaagcaaacaacaa

SEQ ID NO: 9460 - DNA, 25 bp, Homo sapien
gaaatgccacattatacttgccagg

SEQ ID NO: 9461 - DNA, 25 bp, Homo sapien
attatacttgccaggcctctgagcc

SEQ ID NO: 9462 - DNA, 25 bp, Homo sapien
cctggccaacataaggagacctaag

SEQ ID NO: 9463 - DNA, 25 bp, Homo sapien
caacataaggagacctaagtgccta

SEQ ID NO: 9464 - DNA, 25 bp, Homo sapien
cataaggagacctaagtgcctaact

SEQ ID NO: 9465 - DNA, 25 bp, Homo sapien
tctgattgtcctcacggctcattat

SEQ ID NO: 9466 - DNA, 25 bp, Homo sapien
tgattgtcctcacggctcattatat

SEQ ID NO: 9467 - DNA, 25 bp, Homo sapien
tcctcacggctcattatatgccaat

SEQ ID NO: 9468 - DNA, 25 bp, Homo sapien
tcacggctcattatatgccaattag

SEQ ID NO: 9469 - DNA, 25 bp, Homo sapien
cggctcattatatgccaattagaat

SEQ ID NO: 9470 - DNA, 25 bp, Homo sapien
ggtctggatcagagccccccctttt

SEQ ID NO: 9471 - DNA, 25 bp, Homo sapien
cccttttccagtaacaccagcactt

SEQ ID NO: 9472 - DNA, 25 bp, Homo sapien
cactttgtgggaaagacagaggcgg

SEQ ID NO: 9473 - DNA, 25 bp, Homo sapien
ggatggtgcttaagatacatgtcaa

SEQ ID NO: 9474 - DNA, 25 bp, Homo sapien
gagaaacaagagtgtccataaactt

SEQ ID NO: 9475 - DNA, 25 bp, Homo sapien
taaaagttatgtcactggagagtaa

SEQ ID NO: 9476 - DNA, 25 bp, Homo sapien
atgcctattgcatttgtctatgaca

SEQ ID NO: 9477 - DNA, 25 bp, Homo sapien
tttgtctatgacacagctctgttat

SEQ ID NO: 9478 - DNA, 25 bp, Homo sapien
tgttatgaacacctccaggccagaa

SEQ ID NO: 9479 - DNA, 25 bp, Homo sapien
tccaggccagaaggcttgtgttatc

SEQ ID NO: 9480 - DNA, 25 bp, Homo sapien
aaggcttgtgttatctgcacagcta

SEQ ID NO: 9481 - DNA, 25 bp, Homo sapien
gtgttatctgcacagctaagaataa

SEQ ID NO: 9482 - DNA, 25 bp, Homo sapien
ggtatattcaggacattggtccctt

SEQ ID NO: 9483 - DNA, 25 bp, Homo sapien
taaaagaggcatccaggccggacgc

SEQ ID NO: 9484 - DNA, 25 bp, Homo sapien
agccaaagcttcaggattgaggaga

SEQ ID NO: 9485 - DNA, 25 bp, Homo sapien
ggagaccctgccttacattaggtag

SEQ ID NO: 9486 - DNA, 25 bp, Homo sapien
gtgaattagacctacatcagtgtta

SEQ ID NO: 9487 - DNA, 25 bp, Homo sapien
cagtgttagatttagccaagtgtat

SEQ ID NO: 9488 - DNA, 25 bp, Homo sapien
ccaagtgtatcaggcggttctctta

SEQ ID NO: 9489 - DNA, 25 bp, Homo sapien
gcggttctcttaaagccaggtgctg

SEQ ID NO: 9490 - DNA, 25 bp, Homo sapien
ccaggtgctgagtggcaactgagta

SEQ ID NO: 9491 - DNA, 25 bp, Homo sapien
aaggtcaattgatacggtttctgaa

SEQ ID NO: 9492 - DNA, 25 bp, Homo sapien
gacctgcagaatggtatctccctaa

SEQ ID NO: 9493 - DNA, 25 bp, Homo sapien
ggccaagcgggctattcccttgagc

SEQ ID NO: 9494 - DNA, 25 bp, Homo sapien
atttagagagagaagcctgggcaac

SEQ ID NO: 9495 - DNA, 25 bp, Homo sapien
atgtgggatggttttacatggtcca

SEQ ID NO: 9496 - DNA, 25 bp, Homo sapien
acatggtccatagactttgggaagt

SEQ ID NO: 9497 - DNA, 25 bp, Homo sapien
gaaactagtcatggtggctgcctct

SEQ ID NO: 9498 - DNA, 25 bp, Homo sapien
gtggctgcctctaggaatggagact

SEQ ID NO: 9499 - DNA, 25 bp, Homo sapien
tatttagttttctctatatcccctt

SEQ ID NO: 9500 - DNA, 25 bp, Homo sapien
tatcccctttttaagcatttgaact

SEQ ID NO: 9501 - DNA, 25 bp, Homo sapien
atggacttatgtacacatgattcaa

SEQ ID NO: 9502 - DNA, 25 bp, Homo sapien
gttccattccttagaaataaccagt

SEQ ID NO: 9503 - DNA, 25 bp, Homo sapien
gtgttaacactacttgtgtatcctt

SEQ ID NO: 9504 - DNA, 25 bp, Homo sapien
cttgtgtatccttctagaaattttt

SEQ ID NO: 9505 - DNA, 25 bp, Homo sapien
ttttatggctaggtatggtggctca

SEQ ID NO: 9506 - DNA, 25 bp, Homo sapien
aggccacctggattacgaggctcgt

SEQ ID NO: 9507 - DNA, 25 bp, Homo sapien
attacgaggctcgtggcccttctca

SEQ ID NO: 9508 - DNA, 25 bp, Homo sapien
aagccagcagtgtgactctaaagca

SEQ ID NO: 9509 - DNA, 25 bp, Homo sapien
cagcaaaaccatcagatcctacgtc

SEQ ID NO: 9510 - DNA, 25 bp, Homo sapien
agatcctacgtctgagaatgagaag

SEQ ID NO: 9511 - DNA, 25 bp, Homo sapien
gagaaggttgtttccttttcagttg

SEQ ID NO: 9512 - DNA, 25 bp, Homo sapien
tcagttgactggtatatctaagctt

SEQ ID NO: 9513 - DNA, 25 bp, Homo sapien
gcttatatccagaagaatgcctcca

SEQ ID NO: 9514 - DNA, 25 bp, Homo sapien
aagaatgcctccatttcatgctggt

SEQ ID NO: 9515 - DNA, 25 bp, Homo sapien
catgctggtctttatacctttgcct

SEQ ID NO: 9516 - DNA, 25 bp, Homo sapien
aagttggagtgagccgataatcgca

SEQ ID NO: 9517 - DNA, 25 bp, Homo sapien
caaaacctcattggttttagatcag

SEQ ID NO: 9518 - DNA, 25 bp, Homo sapien
gcagggagttagatgcacacacaca

SEQ ID NO: 9519 - DNA, 25 bp, Homo sapien
agcctcatgactgcctctgacattg

SEQ ID NO: 9520 - DNA, 25 bp, Homo sapien
actgcctctgacattgagaagctgc

SEQ ID NO: 9521 - DNA, 25 bp, Homo sapien
ggacacaaactatagctgaaggcca

SEQ ID NO: 9522 - DNA, 25 bp, Homo sapien
atagctgaaggccaggatgaactca

SEQ ID NO: 9523 - DNA, 25 bp, Homo sapien
gattaaatgcggatgctatctccat

SEQ ID NO: 9524 - DNA, 25 bp, Homo sapien
aaatgcggatgctatctccattccc

SEQ ID NO: 9525 - DNA, 25 bp, Homo sapien
gcggatgctatctccattccccagg

SEQ ID NO: 9526 - DNA, 25 bp, Homo sapien
caggctgaaaattggagggtagttt

SEQ ID NO: 9527 - DNA, 25 bp, Homo sapien
acatagattgtgatatttgggaggc

SEQ ID NO: 9528 - DNA, 25 bp, Homo sapien
cttcaatcagatctctcaacttgtt

SEQ ID NO: 9529 - DNA, 25 bp, Homo sapien
aatcagatctctcaacttgttgaac

SEQ ID NO: 9530 - DNA, 25 bp, Homo sapien
agatctctcaacttgttgaacatga

SEQ ID NO: 9531 - DNA, 25 bp, Homo sapien
tctcaacttgttgaacatgagcgaa

SEQ ID NO: 9532 - DNA, 25 bp, Homo sapien
tttaatcagagctccaaactcttcg

SEQ ID NO: 9533 - DNA, 25 bp, Homo sapien
atcagagctccaaactcttcgacca

SEQ ID NO: 9534 - DNA, 25 bp, Homo sapien
tccaaactcttcgaccaccagagaa

SEQ ID NO: 9535 - DNA, 25 bp, Homo sapien
aaaaatcttgttcgacatcagtttc

SEQ ID NO: 9536 - DNA, 25 bp, Homo sapien
tcttgttcgacatcagtttctgcac

SEQ ID NO: 9537 - DNA, 25 bp, Homo sapien
tgttcgacatcagtttctgcacact

SEQ ID NO: 9538 - DNA, 25 bp, Homo sapien
ttcgacatcagtttctgcacactgg

SEQ ID NO: 9539 - DNA, 25 bp, Homo sapien
ttcttttgtgtttctgataattgca

SEQ ID NO: 9540 - DNA, 25 bp, Homo sapien
aattgcaatattacgctgggagctc

SEQ ID NO: 9541 - DNA, 25 bp, Homo sapien
ggagctcagctacaaggtttaaaag

SEQ ID NO: 9542 - DNA, 25 bp, Homo sapien
ttatattaaacccagaatgcctagg

SEQ ID NO: 9543 - DNA, 25 bp, Homo sapien
atgcctaggtgtgctttgtcagttg

SEQ ID NO: 9544 - DNA, 25 bp, Homo sapien
gtgtgctttgtcagttgttttttca

SEQ ID NO: 9545 - DNA, 25 bp, Homo sapien
acattactgccagaaacaggagtct

SEQ ID NO: 9546 - DNA, 25 bp, Homo sapien
acaggagtctgttttctgacattga

SEQ ID NO: 9547 - DNA, 25 bp, Homo sapien
gttaacaggcttttaccaagcaggt

SEQ ID NO: 9548 - DNA, 25 bp, Homo sapien
attattacatataggccgggctcag

SEQ ID NO: 9549 - DNA, 25 bp, Homo sapien
acaaacgaaagtcaggcatggtgct

SEQ ID NO: 9550 - DNA, 25 bp, Homo sapien
gtctgtctcagtgatggaggtgtca

SEQ ID NO: 9551 - DNA, 25 bp, Homo sapien
atggaggtgtcaggtccgtaagaaa

SEQ ID NO: 9552 - DNA, 25 bp, Homo sapien
gtaagaaagacagccggcaggagca

SEQ ID NO: 9553 - DNA, 25 bp, Homo sapien
gcacaggaggaaggctgcttttgat

SEQ ID NO: 9554 - DNA, 25 bp, Homo sapien
ttgattgggcagaagcattattggc

SEQ ID NO: 9555 - DNA, 25 bp, Homo sapien
cattattggcttaaagtcagaggca

SEQ ID NO: 9556 - DNA, 25 bp, Homo sapien
gaggcaggtaaagcaacttcttttg

SEQ ID NO: 9557 - DNA, 25 bp, Homo sapien
gcaacttcttttgggagagagagcc

SEQ ID NO: 9558 - DNA, 25 bp, Homo sapien
acaagtatctggtgcctctttgaag

SEQ ID NO: 9559 - DNA, 25 bp, Homo sapien
gggtcttacgactcagaaataaagg

SEQ ID NO: 9560 - DNA, 25 bp, Homo sapien
gaatgccttgtacccttttgaaatc

SEQ ID NO: 9561 - DNA, 25 bp, Homo sapien
tgtttgacatactccctgaggaata

SEQ ID NO: 9562 - DNA, 25 bp, Homo sapien
tacttaacagatatagctcttatta

SEQ ID NO: 9563 - DNA, 25 bp, Homo sapien
tagctcttattattacatcagtgga

SEQ ID NO: 9564 - DNA, 25 bp, Homo sapien
attacatcagtggagaatctagtta

SEQ ID NO: 9565 - DNA, 25 bp, Homo sapien
ggagaatctagttattatccagaat

SEQ ID NO: 9566 - DNA, 25 bp, Homo sapien
attggcatggaaaaagcatctggtt

SEQ ID NO: 9567 - DNA, 25 bp, Homo sapien
aatagcattcatggatagtactcat

SEQ ID NO: 9568 - DNA, 25 bp, Homo sapien
cattcatggatagtactcatttctt

SEQ ID NO: 9569 - DNA, 25 bp, Homo sapien
cagcctgggagtccttcatttttat

SEQ ID NO: 9570 - DNA, 25 bp, Homo sapien
ttaaacattatacttcgggctgggc

SEQ ID NO: 9571 - DNA, 25 bp, Homo sapien
aaacattatacttcgggctgggcgc

SEQ ID NO: 9572 - DNA, 25 bp, Homo sapien
tgacatctgcatcaaactccaaaga

SEQ ID NO: 9573 - DNA, 25 bp, Homo sapien
aacaatccaatgtctcctactcctg

SEQ ID NO: 9574 - DNA, 25 bp, Homo sapien
actccaccttcttagcctggctgaa

SEQ ID NO: 9575 - DNA, 25 bp, Homo sapien
cctggctgaaggacgtctggcatat

SEQ ID NO: 9576 - DNA, 25 bp, Homo sapien
gtctggcatatgagagcatgctgca

SEQ ID NO: 9577 - DNA, 25 bp, Homo sapien
gcatgctgcaaatttaagtaactcc

SEQ ID NO: 9578 - DNA, 25 bp, Homo sapien
tgtttcccaaataccaagcattaat

SEQ ID NO: 9579 - DNA, 25 bp, Homo sapien
aatcctggtatttgccatgtctaga

SEQ ID NO: 9580 - DNA, 25 bp, Homo sapien
gccatgtctagaaactactgctact

SEQ ID NO: 9581 - DNA, 25 bp, Homo sapien
gagttcagcttggaattaccagctt

SEQ ID NO: 9582 - DNA, 25 bp, Homo sapien
gcttggaattaccagcttggccgac

SEQ ID NO: 9583 - DNA, 25 bp, Homo sapien
gtgagagctttacaatacttggtaa

SEQ ID NO: 9584 - DNA, 25 bp, Homo sapien
gagaaaagtcatttgtttccaaaag

SEQ ID NO: 9585 - DNA, 25 bp, Homo sapien
aagaacagggaaggccagtgtctac

SEQ ID NO: 9586 - DNA, 25 bp, Homo sapien
cagtgtctacactagcataccataa

SEQ ID NO: 9587 - DNA, 25 bp, Homo sapien
agcataccataataggagttgccta

SEQ ID NO: 9588 - DNA, 25 bp, Homo sapien
gtgatcattttgtcacaggcagaca

SEQ ID NO: 9589 - DNA, 25 bp, Homo sapien
caggcagacatttgacttggctata

SEQ ID NO: 9590 - DNA, 25 bp, Homo sapien
tgacttggctatatatacattctat

SEQ ID NO: 9591 - DNA, 25 bp, Homo sapien
attttaccttgatagtccacatcga

SEQ ID NO: 9592 - DNA, 25 bp, Homo sapien
gatagtccacatcgaggttaaaaaa

SEQ ID NO: 9593 - DNA, 25 bp, Homo sapien
ccagaactctgtgaggccgaggctg

SEQ ID NO: 9594 - DNA, 25 bp, Homo sapien
ggccgggaccaaggtccagacaaat

SEQ ID NO: 9595 - DNA, 25 bp, Homo sapien
aggtccagacaaatgatgctcagtg

SEQ ID NO: 9596 - DNA, 25 bp, Homo sapien
caaatgatgctcagtggagcttggt

SEQ ID NO: 9597 - DNA, 25 bp, Homo sapien
gaacagggcggagctgagcttaaaa

SEQ ID NO: 9598 - DNA, 25 bp, Homo sapien
tgagcttaaaatcggctgcttcctg

SEQ ID NO: 9599 - DNA, 25 bp, Homo sapien
cttaaaatcggctgcttcctggact

SEQ ID NO: 9600 - DNA, 25 bp, Homo sapien
acagggaggctgatgtttttctttc

SEQ ID NO: 9601 - DNA, 25 bp, Homo sapien
ttacttctcctgatatttctttctt

SEQ ID NO: 9602 - DNA, 25 bp, Homo sapien
gtgcccggcccttttcctgatagtt

SEQ ID NO: 9603 - DNA, 25 bp, Homo sapien
tttcctgatagttctttaacaacgt

SEQ ID NO: 9604 - DNA, 25 bp, Homo sapien
acaacgttaacttatgtaatcagag

SEQ ID NO: 9605 - DNA, 25 bp, Homo sapien
attacatctaaaagctgatttaagc

SEQ ID NO: 9606 - DNA, 25 bp, Homo sapien
tgatttaagcaaacacctccagagt

SEQ ID NO: 9607 - DNA, 25 bp, Homo sapien
atttaagcaaacacctccagagtct

SEQ ID NO: 9608 - DNA, 25 bp, Homo sapien
gcaaacacctccagagtctttttat

SEQ ID NO: 9609 - DNA, 25 bp, Homo sapien
acacctccagagtctttttatagaa

SEQ ID NO: 9610 - DNA, 25 bp, Homo sapien
gaagaccagtattgtcagacattga

SEQ ID NO: 9611 - DNA, 25 bp, Homo sapien
aagcatttagtaacatttgcacaat

SEQ ID NO: 9612 - DNA, 25 bp, Homo sapien
gaaaaatgtgccaagttccctgaaa

SEQ ID NO: 9613 - DNA, 25 bp, Homo sapien
aaatgtgccaagttccctgaaatac

SEQ ID NO: 9614 - DNA, 25 bp, Homo sapien
tacagtcattccaatataaggttgt

SEQ ID NO: 9615 - DNA, 25 bp, Homo sapien
ctcttcccagaattatttaagatag

SEQ ID NO: 9616 - DNA, 25 bp, Homo sapien
ggatctcaagttccataacacacgg

SEQ ID NO: 9617 - DNA, 25 bp, Homo sapien
taacacacggaccattcagtggtgt

SEQ ID NO: 9618 - DNA, 25 bp, Homo sapien
cattcagtggtgttgtttctgggct

SEQ ID NO: 9619 - DNA, 25 bp, Homo sapien
tttctgggcttgattcactgtgggt

SEQ ID NO: 9620 - DNA, 25 bp, Homo sapien
actgtgggtcacttgaacgatgtcg

SEQ ID NO: 9621 - DNA, 25 bp, Homo sapien
agtctgtggcttgtggccagctgtt

SEQ ID NO: 9622 - DNA, 25 bp, Homo sapien
tgttggctgtgttaaggcctgctgc

SEQ ID NO: 9623 - DNA, 25 bp, Homo sapien
ggcctgctgcagaaacatctcattt

SEQ ID NO: 9624 - DNA, 25 bp, Homo sapien
catttctagcatgtttttctcaagc

SEQ ID NO: 9625 - DNA, 25 bp, Homo sapien
gggtcaagtcttcaatatcaaataa

SEQ ID NO: 9626 - DNA, 25 bp, Homo sapien
gaggcagagttcaggtggatcattt

SEQ ID NO: 9627 - DNA, 25 bp, Homo sapien
gcctggcgcgctcatgcttcaggaa

SEQ ID NO: 9628 - DNA, 25 bp, Homo sapien
ctggcgcgctcatgcttcaggaatg

SEQ ID NO: 9629 - DNA, 25 bp, Homo sapien
tggcgcgctcatgcttcaggaatgc

SEQ ID NO: 9630 - DNA, 25 bp, Homo sapien
gcgcgctcatgcttcaggaatgcgg

SEQ ID NO: 9631 - DNA, 25 bp, Homo sapien
gtcgcgcgtccctgggaatttccgc

SEQ ID NO: 9632 - DNA, 25 bp, Homo sapien
gtccctgggaatttccgcgcccgct

SEQ ID NO: 9633 - DNA, 25 bp, Homo sapien
agcagcagccagtacaggaccgcgc

SEQ ID NO: 9634 - DNA, 25 bp, Homo sapien
agcagccagtacaggaccgcgccga

SEQ ID NO: 9635 - DNA, 25 bp, Homo sapien
agccagtacaggaccgcgccgagca

SEQ ID NO: 9636 - DNA, 25 bp, Homo sapien
tgcccctcggcgtgagcgcagctgc

SEQ ID NO: 9637 - DNA, 25 bp, Homo sapien
cgtgagcgcagctgctcggctcact

SEQ ID NO: 9638 - DNA, 25 bp, Homo sapien
gcacatggccatacaaataaaggtt

SEQ ID NO: 9639 - DNA, 25 bp, Homo sapien
ccttgcaaacagaatcgtaggattg

SEQ ID NO: 9640 - DNA, 25 bp, Homo sapien
gaatcgtaggattgactactcaaat

SEQ ID NO: 9641 - DNA, 25 bp, Homo sapien
ggattgactactcaaattttctcat

SEQ ID NO: 9642 - DNA, 25 bp, Homo sapien
gtagatactagtcttcacatgttta

SEQ ID NO: 9643 - DNA, 25 bp, Homo sapien
gaaggaaaatactctgggatgccat

SEQ ID NO: 9644 - DNA, 25 bp, Homo sapien
aaatactctgggatgccattcacaa

SEQ ID NO: 9645 - DNA, 25 bp, Homo sapien
ctgggatgccattcacaaactattc

SEQ ID NO: 9646 - DNA, 25 bp, Homo sapien
gatgccattcacaaactattcagtt

SEQ ID NO: 9647 - DNA, 25 bp, Homo sapien
gaggaatggtcttgttaggattttt

SEQ ID NO: 9648 - DNA, 25 bp, Homo sapien
atgttttttctctgattgtaaaaag

SEQ ID NO: 9649 - DNA, 25 bp, Homo sapien
ggcaggaacatattaatactttcaa

SEQ ID NO: 9650 - DNA, 25 bp, Homo sapien
caagatactttgtacagatctgaag

SEQ ID NO: 9651 - DNA, 25 bp, Homo sapien
aaatgtatcatgtaaaactgagttt

SEQ ID NO: 9652 - DNA, 25 bp, Homo sapien
aactgagtttgcttataatatgata

SEQ ID NO: 9653 - DNA, 25 bp, Homo sapien
agtaaatgtgatttaactccaaaat

SEQ ID NO: 9654 - DNA, 25 bp, Homo sapien
aatgcatttagttttgatacttgta

SEQ ID NO: 9655 - DNA, 25 bp, Homo sapien
tttacaactattttacaatcgtcaa

SEQ ID NO: 9656 - DNA, 25 bp, Homo sapien
tacaatcgtcaaactgtatttttac

SEQ ID NO: 9657 - DNA, 25 bp, Homo sapien
gtatttttaccagcatatgtatggg

SEQ ID NO: 9658 - DNA, 25 bp, Homo sapien
gatagagaacacctctgaaaatttg

SEQ ID NO: 9659 - DNA, 25 bp, Homo sapien
ttgaaaccctgggtgacctttcatt

SEQ ID NO: 9660 - DNA, 25 bp, Homo sapien
attcaacttcagagctctcatgctg

SEQ ID NO: 9661 - DNA, 25 bp, Homo sapien
tcatgctgttccacttctcagaaaa

SEQ ID NO: 9662 - DNA, 25 bp, Homo sapien
gaatctggccctcgctttttaggtt

SEQ ID NO: 9663 - DNA, 25 bp, Homo sapien
ttaggttcctgttcgtcttgccaga

SEQ ID NO: 9664 - DNA, 25 bp, Homo sapien
aaccatcacctattctgttggtgcc

SEQ ID NO: 9665 - DNA, 25 bp, Homo sapien
ggtgcctcctcttaccttaagaatc

SEQ ID NO: 9666 - DNA, 25 bp, Homo sapien
tgagccaagctggattgtctccctg

SEQ ID NO: 9667 - DNA, 25 bp, Homo sapien
gtctccctgtgcctagaattagcaa

SEQ ID NO: 9668 - DNA, 25 bp, Homo sapien
gaattagcaaatgtccccagagaaa

SEQ ID NO: 9669 - DNA, 25 bp, Homo sapien
atgagaggccatttcccttctgaaa

SEQ ID NO: 9670 - DNA, 25 bp, Homo sapien
tagttcttctagtccattgttaaaa

SEQ ID NO: 9671 - DNA, 25 bp, Homo sapien
ggctgggtgtgatggaaaccataac

SEQ ID NO: 9672 - DNA, 25 bp, Homo sapien
aacacatgattcttgggagcaggtc

SEQ ID NO: 9673 - DNA, 25 bp, Homo sapien
tcttgggagcaggtccatgctggct

SEQ ID NO: 9674 - DNA, 25 bp, Homo sapien
gctggctggcaggatatttggctct

SEQ ID NO: 9675 - DNA, 25 bp, Homo sapien
ttgaacagtctgacaacagccataa

SEQ ID NO: 9676 - DNA, 25 bp, Homo sapien
agccataaagcctagcagctgtgag

SEQ ID NO: 9677 - DNA, 25 bp, Homo sapien
gcagctgtgaggtatttcaggtacc

SEQ ID NO: 9678 - DNA, 25 bp, Homo sapien
ttcaggtaccggaggacttctggac

SEQ ID NO: 9679 - DNA, 25 bp, Homo sapien
gacttctggacttcggttaaccttg

SEQ ID NO: 9680 - DNA, 25 bp, Homo sapien
taagggcttggcctgtaacctcacg

SEQ ID NO: 9681 - DNA, 25 bp, Homo sapien
tggcctgtaacctcacgcctgtaac

SEQ ID NO: 9682 - DNA, 25 bp, Homo sapien
aaggcagagtctgcctgtgcaccaa

SEQ ID NO: 9683 - DNA, 25 bp, Homo sapien
agagtctgcctgtgcaccaagcccg

SEQ ID NO: 9684 - DNA, 25 bp, Homo sapien
tcagctcccccggtctgagagaggg

SEQ ID NO: 9685 - DNA, 25 bp, Homo sapien
aggctggcattggtggagccaccca

SEQ ID NO: 9686 - DNA, 25 bp, Homo sapien
tggcattggtggagccacccactgc

SEQ ID NO: 9687 - DNA, 25 bp, Homo sapien
ccactgcactgccagtcatacaaag

SEQ ID NO: 9688 - DNA, 25 bp, Homo sapien
tgcactgccagtcatacaaagaagt

SEQ ID NO: 9689 - DNA, 25 bp, Homo sapien
ctgccagtcatacaaagaagtctat

SEQ ID NO: 9690 - DNA, 25 bp, Homo sapien
agaagtctatcacacagaattatgt

SEQ ID NO: 9691 - DNA, 25 bp, Homo sapien
atcacacagaattatgtgcagtatt

SEQ ID NO: 9692 - DNA, 25 bp, Homo sapien
agagttttgatcttgtctctcaggc

SEQ ID NO: 9693 - DNA, 25 bp, Homo sapien
aatagccagtgccaactgagggctt

SEQ ID NO: 9694 - DNA, 25 bp, Homo sapien
atagccagtgccaactgagggcttc

SEQ ID NO: 9695 - DNA, 25 bp, Homo sapien
gccagtgccaactgagggcttccta

SEQ ID NO: 9696 - DNA, 25 bp, Homo sapien
cagtgccaactgagggcttcctaca

SEQ ID NO: 9697 - DNA, 25 bp, Homo sapien
agtgccaactgagggcttcctacac

SEQ ID NO: 9698 - DNA, 25 bp, Homo sapien
aactgagggcttcctacacgcctgg

SEQ ID NO: 9699 - DNA, 25 bp, Homo sapien
tgagggcttcctacacgcctggcct

SEQ ID NO: 9700 - DNA, 25 bp, Homo sapien
agggcttcctacacgcctggccttg

SEQ ID NO: 9701 - DNA, 25 bp, Homo sapien
ttcctacacgcctggccttgggctt

SEQ ID NO: 9702 - DNA, 25 bp, Homo sapien
tggccttgggctttccctctattaa

SEQ ID NO: 9703 - DNA, 25 bp, Homo sapien
gataataatagccaggttcggtggc

SEQ ID NO: 9704 - DNA, 25 bp, Homo sapien
cagcctggccggtatgatggaaccg

SEQ ID NO: 9705 - DNA, 25 bp, Homo sapien
agcctggccggtatgatggaaccgt

SEQ ID NO: 9706 - DNA, 25 bp, Homo sapien
cctggccggtatgatggaaccgtgt

SEQ ID NO: 9707 - DNA, 25 bp, Homo sapien
gagaccggctgggctaacatggcga

SEQ ID NO: 9708 - DNA, 25 bp, Homo sapien
tgtggcaccacgcatctgtggtctc

SEQ ID NO: 9709 - DNA, 25 bp, Homo sapien
gtggcaccacgcatctgtggtctca

SEQ ID NO: 9710 - DNA, 25 bp, Homo sapien
gtggtctcagttgtacaggaggctg

SEQ ID NO: 9711 - DNA, 25 bp, Homo sapien
tgattgcagtaagatgtgatcacat

SEQ ID NO: 9712 - DNA, 25 bp, Homo sapien
taagatgtgatcacatccagttaca

SEQ ID NO: 9713 - DNA, 25 bp, Homo sapien
ttgattttcagttaaacaacagaag

SEQ ID NO: 9714 - DNA, 25 bp, Homo sapien
acaacagaagtttagtggaggctgg

SEQ ID NO: 9715 - DNA, 25 bp, Homo sapien
caccctcaattctaattctgacttc

SEQ ID NO: 9716 - DNA, 25 bp, Homo sapien
aactgagagttttcttcaatgggcc

SEQ ID NO: 9717 - DNA, 25 bp, Homo sapien
taacaaattgcctccagtactgacc

SEQ ID NO: 9718 - DNA, 25 bp, Homo sapien
gaccacaatgtcaacctggatgtag

SEQ ID NO: 9719 - DNA, 25 bp, Homo sapien
gaattatcaactgtctcagcctcaa

SEQ ID NO: 9720 - DNA, 25 bp, Homo sapien
aagccagtcctctcggttgacagat

SEQ ID NO: 9721 - DNA, 25 bp, Homo sapien
gttgtctacaactgcctagggagta

SEQ ID NO: 9722 - DNA, 25 bp, Homo sapien
tagggagtacccaacagacaagcac

SEQ ID NO: 9723 - DNA, 25 bp, Homo sapien
ctcctggtctggtgcattcaaatgg

SEQ ID NO: 9724 - DNA, 25 bp, Homo sapien
attcaaatggcctgtcctgttggga

SEQ ID NO: 9725 - DNA, 25 bp, Homo sapien
caggaaactgactctgggctgggca

SEQ ID NO: 9726 - DNA, 25 bp, Homo sapien
aataaaattcgttgtagagatgagg

SEQ ID NO: 9727 - DNA, 25 bp, Homo sapien
gagatgaggtcttgaggtcttgcta

SEQ ID NO: 9728 - DNA, 25 bp, Homo sapien
agatgaggtcttgaggtcttgctat

SEQ ID NO: 9729 - DNA, 25 bp, Homo sapien
taagccattactcccggccagtatc

SEQ ID NO: 9730 - DNA, 25 bp, Homo sapien
attactcccggccagtatctatttt

SEQ ID NO: 9731 - DNA, 25 bp, Homo sapien
ttactcccggccagtatctattttt

SEQ ID NO: 9732 - DNA, 25 bp, Homo sapien
tactcccggccagtatctattttta

SEQ ID NO: 9733 - DNA, 25 bp, Homo sapien
ctcccggccagtatctatttttaag

SEQ ID NO: 9734 - DNA, 25 bp, Homo sapien
tcccggccagtatctatttttaagt

SEQ ID NO: 9735 - DNA, 25 bp, Homo sapien
ttaagtttaaattagcattgggccg

SEQ ID NO: 9736 - DNA, 25 bp, Homo sapien
taagtttaaattagcattgggccgg

SEQ ID NO: 9737 - DNA, 25 bp, Homo sapien
aaatgacatcgggaactggccagat

SEQ ID NO: 9738 - DNA, 25 bp, Homo sapien
acatcgggaactggccagatgtttt

SEQ ID NO: 9739 - DNA, 25 bp, Homo sapien
tgtttttcacctcctccgttttgat

SEQ ID NO: 9740 - DNA, 25 bp, Homo sapien
tccgttttgattccgattgcttcag

SEQ ID NO: 9741 - DNA, 25 bp, Homo sapien
gattccgattgcttcaggacttgaa

SEQ ID NO: 9742 - DNA, 25 bp, Homo sapien
aggacttgaactgttactccgctcg

SEQ ID NO: 9743 - DNA, 25 bp, Homo sapien
actccgctcgctggttgttggttgg

SEQ ID NO: 9744 - DNA, 25 bp, Homo sapien
gtggtggatagataactggttttca

SEQ ID NO: 9745 - DNA, 25 bp, Homo sapien
gtttatttttgacattgcttttcct

SEQ ID NO: 9746 - DNA, 25 bp, Homo sapien
tgcctgtttgcttccctattcactt

SEQ ID NO: 9747 - DNA, 25 bp, Homo sapien
ttttttctcctcacaggatgggaag

SEQ ID NO: 9748 - DNA, 25 bp, Homo sapien
gggccctcctgcctaggtgagaaac

SEQ ID NO: 9749 - DNA, 25 bp, Homo sapien
cctcctgcctaggtgagaaactaga

SEQ ID NO: 9750 - DNA, 25 bp, Homo sapien
gggcttcttcaccagataaaccgtc

SEQ ID NO: 9751 - DNA, 25 bp, Homo sapien
ggcttcttcaccagataaaccgtct

SEQ ID NO: 9752 - DNA, 25 bp, Homo sapien
tagaggcaaccatgggctccagcag

SEQ ID NO: 9753 - DNA, 25 bp, Homo sapien
aaccatgggctccagcagcataaat

SEQ ID NO: 9754 - DNA, 25 bp, Homo sapien
atgggctccagcagcataaatgctt

SEQ ID NO: 9755 - DNA, 25 bp, Homo sapien
tggagatgaccctgggcaacaaagg

SEQ ID NO: 9756 - DNA, 25 bp, Homo sapien
ggcaacaaagggagccaccccgtat

SEQ ID NO: 9757 - DNA, 25 bp, Homo sapien
caaagggagccaccccgtatctaca

SEQ ID NO: 9758 - DNA, 25 bp, Homo sapien
aaaaaatataaggagccgggcacag

SEQ ID NO: 9759 - DNA, 25 bp, Homo sapien
agagagagctctcccctggcagtga

SEQ ID NO: 9760 - DNA, 25 bp, Homo sapien
ctctcccctggcagtgacaagatgg

SEQ ID NO: 9761 - DNA, 25 bp, Homo sapien
ccatccagggtccttgtgagctcct

SEQ ID NO: 9762 - DNA, 25 bp, Homo sapien
ggatgtgcagtaaacactcacgtgt

SEQ ID NO: 9763 - DNA, 25 bp, Homo sapien
agtaaacactcacgtgtcctttcct

SEQ ID NO: 9764 - DNA, 25 bp, Homo sapien
actcacgtgtcctttcctgaggagc

SEQ ID NO: 9765 - DNA, 25 bp, Homo sapien
cacagtgcagcaaccttggttagct

SEQ ID NO: 9766 - DNA, 25 bp, Homo sapien
ttggttagctcacccatcagggcag

SEQ ID NO: 9767 - DNA, 25 bp, Homo sapien
atcagggcagacttgggcagaaatc

SEQ ID NO: 9768 - DNA, 25 bp, Homo sapien
gcagaaatcatgtcttggcatattg

SEQ ID NO: 9769 - DNA, 25 bp, Homo sapien
ttatgagcatttccctataatatac

SEQ ID NO: 9770 - DNA, 25 bp, Homo sapien
gtatataaacatctaagctcaacaa

SEQ ID NO: 9771 - DNA, 25 bp, Homo sapien
caaactccaggtaagatgaactcaa

SEQ ID NO: 9772 - DNA, 25 bp, Homo sapien
gaactcaaagaacccacaccaagat

SEQ ID NO: 9773 - DNA, 25 bp, Homo sapien
gaacccacaccaagatacatcaaac

SEQ ID NO: 9774 - DNA, 25 bp, Homo sapien
gcaacaagaggaattactcatcaca

SEQ ID NO: 9775 - DNA, 25 bp, Homo sapien
tcatcacatacaaggaattgccaca

SEQ ID NO: 9776 - DNA, 25 bp, Homo sapien
gaattgccacaagattatcagcaga

SEQ ID NO: 9777 - DNA, 25 bp, Homo sapien
ccagaaagcagtgggctgatatata

SEQ ID NO: 9778 - DNA, 25 bp, Homo sapien
gggctgatatatattctgagtgttc

SEQ ID NO: 9779 - DNA, 25 bp, Homo sapien
aaaactaaggactctatatctagca

SEQ ID NO: 9780 - DNA, 25 bp, Homo sapien
tctatatctagcaaaactgtccttc

SEQ ID NO: 9781 - DNA, 25 bp, Homo sapien
gggtgtgctgcttcctatactggtg

SEQ ID NO: 9782 - DNA, 25 bp, Homo sapien
gtgtgctgcttcctatactggtggg

SEQ ID NO: 9783 - DNA, 25 bp, Homo sapien
gggtgacttcaggatggtgtgtgga

SEQ ID NO: 9784 - DNA, 25 bp, Homo sapien
gtagggatgtagaggttttggctgt

SEQ ID NO: 9785 - DNA, 25 bp, Homo sapien
tgatgactgtgtgagtacttggagt

SEQ ID NO: 9786 - DNA, 25 bp, Homo sapien
gactgtgtgagtacttggagtcacc

SEQ ID NO: 9787 - DNA, 25 bp, Homo sapien
ctgtgtgagtacttggagtcaccaa

SEQ ID NO: 9788 - DNA, 25 bp, Homo sapien
aacgtgagtgggaagtgtggtctga

SEQ ID NO: 9789 - DNA, 25 bp, Homo sapien
aagtgtggtctgagggtgtgatggg

SEQ ID NO: 9790 - DNA, 25 bp, Homo sapien
ttctggtgcctgtactggtgtggct

SEQ ID NO: 9791 - DNA, 25 bp, Homo sapien
tggtgcctgtactggtgtggctggg

SEQ ID NO: 9792 - DNA, 25 bp, Homo sapien
ataggttgtacacccattgtctttt

SEQ ID NO: 9793 - DNA, 25 bp, Homo sapien
tctcttgttttctacaacacccagg

SEQ ID NO: 9794 - DNA, 25 bp, Homo sapien
tacaacacccaggtaatccctaatt

SEQ ID NO: 9795 - DNA, 25 bp, Homo sapien
ggtaatccctaattcctagagagac

SEQ ID NO: 9796 - DNA, 25 bp, Homo sapien
gagactggagatgtctttccctttg

SEQ ID NO: 9797 - DNA, 25 bp, Homo sapien
gaggtccccaaagttgatggatcat

SEQ ID NO: 9798 - DNA, 25 bp, Homo sapien
tgatggatcattttccaagcccttc

SEQ ID NO: 9799 - DNA, 25 bp, Homo sapien
tttccaagcccttcacatttgcctg

SEQ ID NO: 9800 - DNA, 25 bp, Homo sapien
tgctctgctgcagtgcttctccagg

SEQ ID NO: 9801 - DNA, 25 bp, Homo sapien
cttgttagacatgcacactctgggc

SEQ ID NO: 9802 - DNA, 25 bp, Homo sapien
ggtggacacctgtagcctagctact

SEQ ID NO: 9803 - DNA, 25 bp, Homo sapien
ggagatcacatcaatttacttcaag

SEQ ID NO: 9804 - DNA, 25 bp, Homo sapien
tttacttcaagtaaggcacaattac

SEQ ID NO: 9805 - DNA, 25 bp, Homo sapien
ggcacaattacattggctttcaaag

SEQ ID NO: 9806 - DNA, 25 bp, Homo sapien
aagaacatagaaacacgttggcggg

SEQ ID NO: 9807 - DNA, 25 bp, Homo sapien
gaatcagtaatgtatgcagccaggt

SEQ ID NO: 9808 - DNA, 25 bp, Homo sapien
aatgtatgcagccaggtagctcctc

SEQ ID NO: 9809 - DNA, 25 bp, Homo sapien
aggtagctcctctaatttcagtcaa

SEQ ID NO: 9810 - DNA, 25 bp, Homo sapien
gctcctctaatttcagtcaaactga

SEQ ID NO: 9811 - DNA, 25 bp, Homo sapien
gaaaactcaattccccctgaagaag

SEQ ID NO: 9812 - DNA, 25 bp, Homo sapien
aggtagcttgactctctgttcgagg

SEQ ID NO: 9813 - DNA, 25 bp, Homo sapien
ctgttcgaggctcagtccttttgat

SEQ ID NO: 9814 - DNA, 25 bp, Homo sapien
gatgcatctcaatcagtatttagaa

SEQ ID NO: 9815 - DNA, 25 bp, Homo sapien
cttaaaatgcaactcaagaacttag

SEQ ID NO: 9816 - DNA, 25 bp, Homo sapien
atgcaactcaagaacttagaggaag

SEQ ID NO: 9817 - DNA, 25 bp, Homo sapien
agaaatatggccagcatggcgctca

SEQ ID NO: 9818 - DNA, 25 bp, Homo sapien
aatatggccagcatggcgctcaggc

SEQ ID NO: 9819 - DNA, 25 bp, Homo sapien
ccagcatggcgctcaggcttgtaat

SEQ ID NO: 9820 - DNA, 25 bp, Homo sapien
gaacctgggcagtgaaggctgcaat

SEQ ID NO: 9821 - DNA, 25 bp, Homo sapien
tcgatctcaaacaacaaaacgccat

SEQ ID NO: 9822 - DNA, 25 bp, Homo sapien
gatctcaaacaacaaaacgccatag

SEQ ID NO: 9823 - DNA, 25 bp, Homo sapien
caatgaaacagtagagaaactcaac

SEQ ID NO: 9824 - DNA, 25 bp, Homo sapien
agcaaatagatttctagcagagttg

SEQ ID NO: 9825 - DNA, 25 bp, Homo sapien
aagtgatccctcagtgaatgttcaa

SEQ ID NO: 9826 - DNA, 25 bp, Homo sapien
aattatgggtcagctgaaccacagc

SEQ ID NO: 9827 - DNA, 25 bp, Homo sapien
tgaaccacagcttaggataaatact

SEQ ID NO: 9828 - DNA, 25 bp, Homo sapien
atactacaggttttgaagtcagccc

SEQ ID NO: 9829 - DNA, 25 bp, Homo sapien
gtataaaatctcaatgctggcgcta

SEQ ID NO: 9830 - DNA, 25 bp, Homo sapien
ctggcgctaatgtgtatcccttgaa

SEQ ID NO: 9831 - DNA, 25 bp, Homo sapien
taatgtgtatcccttgaacctcagc

SEQ ID NO: 9832 - DNA, 25 bp, Homo sapien
gaacctcagcttttacatcagacat

SEQ ID NO: 9833 - DNA, 25 bp, Homo sapien
catgacaacatgttcttatagagtt

SEQ ID NO: 9834 - DNA, 25 bp, Homo sapien
aagtcacacaggtaaagcaatgggt

SEQ ID NO: 9835 - DNA, 25 bp, Homo sapien
cttttgaaaagataggccaggcgca

SEQ ID NO: 9836 - DNA, 25 bp, Homo sapien
ataggtcatagccacagctgagcac

SEQ ID NO: 9837 - DNA, 25 bp, Homo sapien
atagccacagctgagcacttggtgt

SEQ ID NO: 9838 - DNA, 25 bp, Homo sapien
gagcacttggtgtcttactactcag

SEQ ID NO: 9839 - DNA, 25 bp, Homo sapien
tggtgtcttactactcagtggagag

SEQ ID NO: 9840 - DNA, 25 bp, Homo sapien
agagtgggccatgcctcatctagag

SEQ ID NO: 9841 - DNA, 25 bp, Homo sapien
gcctcatctagagagcaagcatctt

SEQ ID NO: 9842 - DNA, 25 bp, Homo sapien
atcttccagaaaggagagcccttgg

SEQ ID NO: 9843 - DNA, 25 bp, Homo sapien
gagagcccttgggtccttttacaga

SEQ ID NO: 9844 - DNA, 25 bp, Homo sapien
gcccttgggtccttttacagaagca

SEQ ID NO: 9845 - DNA, 25 bp, Homo sapien
gaagcaatcagaaaatcatcgggaa

SEQ ID NO: 9846 - DNA, 25 bp, Homo sapien
tcatcgggaatctcccagaagactg

SEQ ID NO: 9847 - DNA, 25 bp, Homo sapien
gagaggtttgatttgtcctgtatac

SEQ ID NO: 9848 - DNA, 25 bp, Homo sapien
caggccattcttcatgctgagacat

SEQ ID NO: 9849 - DNA, 25 bp, Homo sapien
agacatgcagatggtctcagcctcc

SEQ ID NO: 9850 - DNA, 25 bp, Homo sapien
tggtctcagcctccgtaggagagta

SEQ ID NO: 9851 - DNA, 25 bp, Homo sapien
agtagcttagtatttcagagggcat

SEQ ID NO: 9852 - DNA, 25 bp, Homo sapien
agagggcatgtgtgctcttcagacc

SEQ ID NO: 9853 - DNA, 25 bp, Homo sapien
gtgctcttcagacctctaggaagct

SEQ ID NO: 9854 - DNA, 25 bp, Homo sapien
gctcctcgcagcttcatcagtgaaa

SEQ ID NO: 9855 - DNA, 25 bp, Homo sapien
aatgtatacccctcctagggagcaa

SEQ ID NO: 9856 - DNA, 25 bp, Homo sapien
aatgaacgtggctattacctctctt

SEQ ID NO: 9857 - DNA, 25 bp, Homo sapien
caccccagttgtctcaagatcaatg

SEQ ID NO: 9858 - DNA, 25 bp, Homo sapien
tagacccctacccaaattatcaagt

SEQ ID NO: 9859 - DNA, 25 bp, Homo sapien
tacccaaattatcaagtcctgcaat

SEQ ID NO: 9860 - DNA, 25 bp, Homo sapien
tcctgcaattctctcttcatttcat

SEQ ID NO: 9861 - DNA, 25 bp, Homo sapien
actgccactaacctagttctggctg

SEQ ID NO: 9862 - DNA, 25 bp, Homo sapien
tggctgcctttggatctcacctgga

SEQ ID NO: 9863 - DNA, 25 bp, Homo sapien
atctcacctggactactgcattagg

SEQ ID NO: 9864 - DNA, 25 bp, Homo sapien
attagggcaggtctctctgtctcca

SEQ ID NO: 9865 - DNA, 25 bp, Homo sapien
aatctgatcatgtgattctctctat

SEQ ID NO: 9866 - DNA, 25 bp, Homo sapien
catgtgattctctctataaaaccct

SEQ ID NO: 9867 - DNA, 25 bp, Homo sapien
tataaaacccttaactctgggccag

SEQ ID NO: 9868 - DNA, 25 bp, Homo sapien
aactctgagttgtacactataaaag

SEQ ID NO: 9869 - DNA, 25 bp, Homo sapien
ggagtcggagctattttctccgcta

SEQ ID NO: 9870 - DNA, 25 bp, Homo sapien
tattttctccgctacttactagctg

SEQ ID NO: 9871 - DNA, 25 bp, Homo sapien
gggcgatcagaataaacctccttca

SEQ ID NO: 9872 - DNA, 25 bp, Homo sapien
atcagaataaacctccttcatatgg

SEQ ID NO: 9873 - DNA, 25 bp, Homo sapien
cctccttcatatggttattttgagc

SEQ ID NO: 9874 - DNA, 25 bp, Homo sapien
aagagacaatactggctgagcacgg

SEQ ID NO: 9875 - DNA, 25 bp, Homo sapien
acatagggaatgagactcctgtctc

SEQ ID NO: 9876 - DNA, 25 bp, Homo sapien
tgaaaccctgtctgagagagagaga

SEQ ID NO: 9877 - DNA, 25 bp, Homo sapien
gagaaaatactactatggtgcttat

SEQ ID NO: 9878 - DNA, 25 bp, Homo sapien
actactatggtgcttataaaagttc

SEQ ID NO: 9879 - DNA, 25 bp, Homo sapien
caataaattttagctgttgttagta

SEQ ID NO: 9880 - DNA, 25 bp, Homo sapien
ttcctgcttaacacctttaaaatag

SEQ ID NO: 9881 - DNA, 25 bp, Homo sapien
gatgtgttgacttaataaccaaatc

SEQ ID NO: 9882 - DNA, 25 bp, Homo sapien
aaatcaaaaccatagcacctctctt

SEQ ID NO: 9883 - DNA, 25 bp, Homo sapien
tctcttatccaaggatctgggacta

SEQ ID NO: 9884 - DNA, 25 bp, Homo sapien
tgggactaggattttaacagatgta

SEQ ID NO: 9885 - DNA, 25 bp, Homo sapien
gttaaccacttactggaagcctagt

SEQ ID NO: 9886 - DNA, 25 bp, Homo sapien
ggaagcctagtgtttatcaggatca

SEQ ID NO: 9887 - DNA, 25 bp, Homo sapien
atcaggatcacgttcatttacatat

SEQ ID NO: 9888 - DNA, 25 bp, Homo sapien
atctcaatccttaatgcaactgtac

SEQ ID NO: 9889 - DNA, 25 bp, Homo sapien
gtacaagcacaaattagtcttcttt

SEQ ID NO: 9890 - DNA, 25 bp, Homo sapien
tggctaacactgtggaacccctaaa

SEQ ID NO: 9891 - DNA, 25 bp, Homo sapien
accatgcatggcttctgaagttctt

SEQ ID NO: 9892 - DNA, 25 bp, Homo sapien
tttttaacatatcaactgcatcttg

SEQ ID NO: 9893 - DNA, 25 bp, Homo sapien
actgcatcttgaaacaaataccgtt

SEQ ID NO: 9894 - DNA, 25 bp, Homo sapien
aagatataatacttgcaggtcaaaa

SEQ ID NO: 9895 - DNA, 25 bp, Homo sapien
atattgtatgggaactgctttgaga

SEQ ID NO: 9896 - DNA, 25 bp, Homo sapien
agtttataccaagacaacccacaca

SEQ ID NO: 9897 - DNA, 25 bp, Homo sapien
gacaacccacacaatataaatcagt

SEQ ID NO: 9898 - DNA, 25 bp, Homo sapien
ggatgactactgaacaaattactga

SEQ ID NO: 9899 - DNA, 25 bp, Homo sapien
aaattactgactgtccaacctcatt

SEQ ID NO: 9900 - DNA, 25 bp, Homo sapien
gactgtccaacctcattaaaaataa

SEQ ID NO: 9901 - DNA, 25 bp, Homo sapien
aataagacaacagggccgggcacgg

SEQ ID NO: 9902 - DNA, 25 bp, Homo sapien
ttaagagaactgtgtagaagactat

SEQ ID NO: 9903 - DNA, 25 bp, Homo sapien
gagaactgtgtagaagactataaaa

SEQ ID NO: 9904 - DNA, 25 bp, Homo sapien
taaaaagggctttataactgatctt

SEQ ID NO: 9905 - DNA, 25 bp, Homo sapien
agggctttataactgatcttttgac

SEQ ID NO: 9906 - DNA, 25 bp, Homo sapien
ctgatcttttgacatactcactttg

SEQ ID NO: 9907 - DNA, 25 bp, Homo sapien
gatcttttgacatactcactttgag

SEQ ID NO: 9908 - DNA, 25 bp, Homo sapien
atcttttgacatactcactttgagt

SEQ ID NO: 9909 - DNA, 25 bp, Homo sapien
ttttgacatactcactttgagtggc

SEQ ID NO: 9910 - DNA, 25 bp, Homo sapien
actttgagtggcatatgcccaggaa

SEQ ID NO: 9911 - DNA, 25 bp, Homo sapien
tttgagtggcatatgcccaggaaaa

SEQ ID NO: 9912 - DNA, 25 bp, Homo sapien
tgagtggcatatgcccaggaaaata

SEQ ID NO: 9913 - DNA, 25 bp, Homo sapien
gatgggctgggtttgacacacccca

SEQ ID NO: 9914 - DNA, 25 bp, Homo sapien
tttgacacaccccagcatatttaat

SEQ ID NO: 9915 - DNA, 25 bp, Homo sapien
gcatatttaataaccacctgagagt

SEQ ID NO: 9916 - DNA, 25 bp, Homo sapien
gggctctgggctgtttctcagctga

SEQ ID NO: 9917 - DNA, 25 bp, Homo sapien
tcagctgacctgtttggagcacctc

SEQ ID NO: 9918 - DNA, 25 bp, Homo sapien
ggagcacctcctggatttgggacca

SEQ ID NO: 9919 - DNA, 25 bp, Homo sapien
gggaccagattttgaatccccactc

SEQ ID NO: 9920 - DNA, 25 bp, Homo sapien
gaatccccactcaccagttgtgtga

SEQ ID NO: 9921 - DNA, 25 bp, Homo sapien
ccagttgtgtgaccataggcatcat

SEQ ID NO: 9922 - DNA, 25 bp, Homo sapien
ataggcatcatcactaggtcccctc

SEQ ID NO: 9923 - DNA, 25 bp, Homo sapien
gtcatgaggattaaatggtgccaca

SEQ ID NO: 9924 - DNA, 25 bp, Homo sapien
tggcgcagtcggtttaataatgata

SEQ ID NO: 9925 - DNA, 25 bp, Homo sapien
gcatttagttgtattgccctgttaa

SEQ ID NO: 9926 - DNA, 25 bp, Homo sapien
agttgtattgccctgttaagttggc

SEQ ID NO: 9927 - DNA, 25 bp, Homo sapien
ccctgttaagttggcatagcaaata

SEQ ID NO: 9928 - DNA, 25 bp, Homo sapien
tctttgtgtttcctaacctatagca

SEQ ID NO: 9929 - DNA, 25 bp, Homo sapien
gtttcctaacctatagcactgtgct

SEQ ID NO: 9930 - DNA, 25 bp, Homo sapien
ctaacctatagcactgtgctgggca

SEQ ID NO: 9931 - DNA, 25 bp, Homo sapien
gctgggcacagaatggacttcagtt

SEQ ID NO: 9932 - DNA, 25 bp, Homo sapien
tattattctacttaaaatctcctta

SEQ ID NO: 9933 - DNA, 25 bp, Homo sapien
ttttttatattctttaggcgcgaat

SEQ ID NO: 9934 - DNA, 25 bp, Homo sapien
tctttaggcgcgaatgtgtgtttaa

SEQ ID NO: 9935 - DNA, 25 bp, Homo sapien
gggaggcttcgtggcagggctacgc

SEQ ID NO: 9936 - DNA, 25 bp, Homo sapien
gtggcagggctacgccgtggaaggc

SEQ ID NO: 9937 - DNA, 25 bp, Homo sapien
tggaaggcccgtggtcctcggagga

SEQ ID NO: 9938 - DNA, 25 bp, Homo sapien
tggtcctcggaggagcctcacgagc

SEQ ID NO: 9939 - DNA, 25 bp, Homo sapien
cggaggagcctcacgagccaaggct

SEQ ID NO: 9940 - DNA, 25 bp, Homo sapien
cctcacgagccaaggctgggaagga

SEQ ID NO: 9941 - DNA, 25 bp, Homo sapien
tagctcctcgggacctgcgctgaga

SEQ ID NO: 9942 - DNA, 25 bp, Homo sapien
acctgcgctgagaggagcaccgcca

SEQ ID NO: 9943 - DNA, 25 bp, Homo sapien
agcgcacctggacacgaacacgtgt

SEQ ID NO: 9944 - DNA, 25 bp, Homo sapien
gacacgaacacgtgtcctgcgacaa

SEQ ID NO: 9945 - DNA, 25 bp, Homo sapien
attacctccctcacctgtgtcactg

SEQ ID NO: 9946 - DNA, 25 bp, Homo sapien
tggaatccaggagccgcgctcgcag

SEQ ID NO: 9947 - DNA, 25 bp, Homo sapien
gtcccagcagctgcggaatgcaaag

SEQ ID NO: 9948 - DNA, 25 bp, Homo sapien
gaatgcaaagtagccgccttttctt

SEQ ID NO: 9949 - DNA, 25 bp, Homo sapien
aagtagccgccttttctttattgcg

SEQ ID NO: 9950 - DNA, 25 bp, Homo sapien
gccttttctttattgcgtggcatct

SEQ ID NO: 9951 - DNA, 25 bp, Homo sapien
attgcgtggcatctctgaaataagc

SEQ ID NO: 9952 - DNA, 25 bp, Homo sapien
ggcatctctgaaataagccaagagg

SEQ ID NO: 9953 - DNA, 25 bp, Homo sapien
gggcgagagcccagcgtcggaagat

SEQ ID NO: 9954 - DNA, 25 bp, Homo sapien
gccactgtgggcgtccgtgtccatt

SEQ ID NO: 9955 - DNA, 25 bp, Homo sapien
cgtgtccattccagcgcctgggaag

SEQ ID NO: 9956 - DNA, 25 bp, Homo sapien
aggctggaatccaggagccgcgctc

SEQ ID NO: 9957 - DNA, 25 bp, Homo sapien
tttgctctcctttagtcattggttg

SEQ ID NO: 9958 - DNA, 25 bp, Homo sapien
gattggaaaacgctctccagaggtt

SEQ ID NO: 9959 - DNA, 25 bp, Homo sapien
tctccagaggtttgtccttagggcc

SEQ ID NO: 9960 - DNA, 25 bp, Homo sapien
ttaggcactgggaccctgtctggag

SEQ ID NO: 9961 - DNA, 25 bp, Homo sapien
ttctagcttctcagaactactggtt

SEQ ID NO: 9962 - DNA, 25 bp, Homo sapien
gccattacttatttctggtgtacac

SEQ ID NO: 9963 - DNA, 25 bp, Homo sapien
aagttttctctctgataatttgatg

SEQ ID NO: 9964 - DNA, 25 bp, Homo sapien
taatttgatgtgtttactgcctatc

SEQ ID NO: 9965 - DNA, 25 bp, Homo sapien
actgcctatcagtttaaattggttg

SEQ ID NO: 9966 - DNA, 25 bp, Homo sapien
aaattggttgactctctagtctcat

SEQ ID NO: 9967 - DNA, 25 bp, Homo sapien
gcataatctaaaccggtaagcctaa

SEQ ID NO: 9968 - DNA, 25 bp, Homo sapien
gtgaaatgatggcagcaatgtccta

SEQ ID NO: 9969 - DNA, 25 bp, Homo sapien
tgatggcagcaatgtcctaagggac

SEQ ID NO: 9970 - DNA, 25 bp, Homo sapien
ggaactgggaatattctatcagaag

SEQ ID NO: 9971 - DNA, 25 bp, Homo sapien
tgtatattgcagactctagggaaag

SEQ ID NO: 9972 - DNA, 25 bp, Homo sapien
ttgcagactctagggaaagtactaa

SEQ ID NO: 9973 - DNA, 25 bp, Homo sapien
ggaattgtatgacacgttcagttga

SEQ ID NO: 9974 - DNA, 25 bp, Homo sapien
gacacgttcagttgaaaccagagaa

SEQ ID NO: 9975 - DNA, 25 bp, Homo sapien
caaacgtagtagatatgaatccaat

SEQ ID NO: 9976 - DNA, 25 bp, Homo sapien
cactttgaatgtgaatggtctaaac

SEQ ID NO: 9977 - DNA, 25 bp, Homo sapien
gtctaaacataccattgaacatatt

SEQ ID NO: 9978 - DNA, 25 bp, Homo sapien
cataccattgaacatattgaaaccc

SEQ ID NO: 9979 - DNA, 25 bp, Homo sapien
tataaacataagcatagacacgcac

SEQ ID NO: 9980 - DNA, 25 bp, Homo sapien
atagacacgcacaaaaaagacatag

SEQ ID NO: 9981 - DNA, 25 bp, Homo sapien
aaagacatagtacggaacagtggtt

SEQ ID NO: 9982 - DNA, 25 bp, Homo sapien
aacagtggttgaaagcttggcttct

SEQ ID NO: 9983 - DNA, 25 bp, Homo sapien
ggttgaaagcttggcttctgagtca

SEQ ID NO: 9984 - DNA, 25 bp, Homo sapien
ttgaaagcttggcttctgagtcaga

SEQ ID NO: 9985 - DNA, 25 bp, Homo sapien
gactgcattctgtgacaattttctt

SEQ ID NO: 9986 - DNA, 25 bp, Homo sapien
gcattctgtgacaattttcttcact

SEQ ID NO: 9987 - DNA, 25 bp, Homo sapien
tcatcttcagtgcatttaaaggcag

SEQ ID NO: 9988 - DNA, 25 bp, Homo sapien
agtgcatttaaaggcagaacaaaac

SEQ ID NO: 9989 - DNA, 25 bp, Homo sapien
tctcccatgtttaagcaattctctg

SEQ ID NO: 9990 - DNA, 25 bp, Homo sapien
aggccaacgcgggtagatcaactgg

SEQ ID NO: 9991 - DNA, 25 bp, Homo sapien
aatacaaaaaaatggccctgcgcgg

SEQ ID NO: 9992 - DNA, 25 bp, Homo sapien
atacaaaaaaatggccctgcgcggt

SEQ ID NO: 9993 - DNA, 25 bp, Homo sapien
aaaaaaatggccctgcgcggtggct

SEQ ID NO: 9994 - DNA, 25 bp, Homo sapien
atcctggataataggtgaaaccccg

SEQ ID NO: 9995 - DNA, 25 bp, Homo sapien
tagccagctatggtggtaggcgcat

SEQ ID NO: 9996 - DNA, 25 bp, Homo sapien
agccagctatggtggtaggcgcatg

SEQ ID NO: 9997 - DNA, 25 bp, Homo sapien
ccagctatggtggtaggcgcatgta

SEQ ID NO: 9998 - DNA, 25 bp, Homo sapien
cagctatggtggtaggcgcatgtaa

SEQ ID NO: 9999 - DNA, 25 bp, Homo sapien
agctatggtggtaggcgcatgtaat

SEQ ID NO: 10000 - DNA, 25 bp, Homo sapien
gctatggtggtaggcgcatgtaatc

SEQ ID NO: 10001 - DNA, 25 bp, Homo sapien
aattatatctcattcagtctgaaat

SEQ ID NO: 10002 - DNA, 25 bp, Homo sapien
aaatgatgctcagtcgagtgcggtg

SEQ ID NO: 10003 - DNA, 25 bp, Homo sapien
aaatattttcctttacagactggag

SEQ ID NO: 10004 - DNA, 25 bp, Homo sapien
acagactggagtgctagatggtgaa

SEQ ID NO: 10005 - DNA, 25 bp, Homo sapien
gtgaaagggcccaagagcaagtgaa

SEQ ID NO: 10006 - DNA, 25 bp, Homo sapien
aagccagtgtgggttagcatttccc

SEQ ID NO: 10007 - DNA, 25 bp, Homo sapien
gggttagcatttcccatgacaaatt

SEQ ID NO: 10008 - DNA, 25 bp, Homo sapien
ctaaaggatagttaatcagctggga

SEQ ID NO: 10009 - DNA, 25 bp, Homo sapien
tcagctgggaaaagtgtgcaattct

SEQ ID NO: 10010 - DNA, 25 bp, Homo sapien
gtgcaattctgctggaacaactggg

SEQ ID NO: 10011 - DNA, 25 bp, Homo sapien
aagatacttctagctggccagccaa

SEQ ID NO: 10012 - DNA, 25 bp, Homo sapien
aaacctgcttttaagagacttggag

SEQ ID NO: 10013 - DNA, 25 bp, Homo sapien
acatgtagacagaatgaggcccagt

SEQ ID NO: 10014 - DNA, 25 bp, Homo sapien
atgaggcccagtagacttttcacca

SEQ ID NO: 10015 - DNA, 25 bp, Homo sapien
agacttttcaccaggaaggcagact

SEQ ID NO: 10016 - DNA, 25 bp, Homo sapien
ttgtcctgggccttggaagattgca

SEQ ID NO: 10017 - DNA, 25 bp, Homo sapien
ttctccttacactgggaaaagttca

SEQ ID NO: 10018 - DNA, 25 bp, Homo sapien
gagcagagcccgagatgttcaagac

SEQ ID NO: 10019 - DNA, 25 bp, Homo sapien
atgttcaagacagggctagtgtgta

SEQ ID NO: 10020 - DNA, 25 bp, Homo sapien
gtggacacacacagccagttttcct

SEQ ID NO: 10021 - DNA, 25 bp, Homo sapien
cagttttcctgctggtttaccaggt

SEQ ID NO: 10022 - DNA, 25 bp, Homo sapien
aaaatcaaaagaccctcatgccagc

SEQ ID NO: 10023 - DNA, 25 bp, Homo sapien
gagcgcccgagctgtttcccgaagg

SEQ ID NO: 10024 - DNA, 25 bp, Homo sapien
gagctgtttcccgaaggcgcccaga

SEQ ID NO: 10025 - DNA, 25 bp, Homo sapien
ctgtttcccgaaggcgcccagaaga

SEQ ID NO: 10026 - DNA, 25 bp, Homo sapien
agatgcagctactggcgccccaagt

SEQ ID NO: 10027 - DNA, 25 bp, Homo sapien
gccagggcgtcctgctgccgaagtc

SEQ ID NO: 10028 - DNA, 25 bp, Homo sapien
ccgggtgagtagaccatggccatgc

SEQ ID NO: 10029 - DNA, 25 bp, Homo sapien
tgagtagaccatggccatgcggagc

SEQ ID NO: 10030 - DNA, 25 bp, Homo sapien
tagaccatggccatgcggagccgcg

SEQ ID NO: 10031 - DNA, 25 bp, Homo sapien
accttcggggcagctagggacgaca

SEQ ID NO: 10032 - DNA, 25 bp, Homo sapien
acctgctccttgttttgcagtgagg

SEQ ID NO: 10033 - DNA, 25 bp, Homo sapien
ggccccaagcgcaataaacaccctg

SEQ ID NO: 10034 - DNA, 25 bp, Homo sapien
aataccatgcagtatagtctccgcc

SEQ ID NO: 10035 - DNA, 25 bp, Homo sapien
gacaaacagtgtaacgagctttatt

SEQ ID NO: 10036 - DNA, 25 bp, Homo sapien
gtgtaacgagctttattttataaca

SEQ ID NO: 10037 - DNA, 25 bp, Homo sapien
aacttatctgttgaggtggtactaa

SEQ ID NO: 10038 - DNA, 25 bp, Homo sapien
ttcaaaaacctggacccggcaggca

SEQ ID NO: 10039 - DNA, 25 bp, Homo sapien
ggacccggcaggcagctaatttagc

SEQ ID NO: 10040 - DNA, 25 bp, Homo sapien
atttagctacttgaaaatcactggg

SEQ ID NO: 10041 - DNA, 25 bp, Homo sapien
tagatgctaagattactgaaaccag

SEQ ID NO: 10042 - DNA, 25 bp, Homo sapien
tgaaaccagcttaacacctgccaag

SEQ ID NO: 10043 - DNA, 25 bp, Homo sapien
ctgccaagttacatcgcttttaaaa

SEQ ID NO: 10044 - DNA, 25 bp, Homo sapien
taaaaaatgctaggaaggcccaggc

SEQ ID NO: 10045 - DNA, 25 bp, Homo sapien
aaatcctttcattcggtgctatggg

SEQ ID NO: 10046 - DNA, 25 bp, Homo sapien
gcaatggcagagttattagcaatat

SEQ ID NO: 10047 - DNA, 25 bp, Homo sapien
agcaatattacagttacctaggaaa

SEQ ID NO: 10048 - DNA, 25 bp, Homo sapien
aaggagcaaacagctctgccttgcc

SEQ ID NO: 10049 - DNA, 25 bp, Homo sapien
aaacagctctgccttgcccaggcaa

SEQ ID NO: 10050 - DNA, 25 bp, Homo sapien
ggaggtgatacttaaccagcatctt

SEQ ID NO: 10051 - DNA, 25 bp, Homo sapien
acttaaccagcatcttgaagagtga

SEQ ID NO: 10052 - DNA, 25 bp, Homo sapien
gttacaggcagaggaagtgacatga

SEQ ID NO: 10053 - DNA, 25 bp, Homo sapien
gtggttttgtatgaacagagctgga

SEQ ID NO: 10054 - DNA, 25 bp, Homo sapien
gaattggaatcatcacagatgctgt

SEQ ID NO: 10055 - DNA, 25 bp, Homo sapien
ttaagaattgtctgtggctcacacc

SEQ ID NO: 10056 - DNA, 25 bp, Homo sapien
agagtaggtagatccatagagatgg

SEQ ID NO: 10057 - DNA, 25 bp, Homo sapien
gactgtgagtgggtacaggcttcct

SEQ ID NO: 10058 - DNA, 25 bp, Homo sapien
gtgagtgggtacaggcttccttctg

SEQ ID NO: 10059 - DNA, 25 bp, Homo sapien
tctggaactcagtggtggttgtaca

SEQ ID NO: 10060 - DNA, 25 bp, Homo sapien
gaactcagtggtggttgtacatcat

SEQ ID NO: 10061 - DNA, 25 bp, Homo sapien
cagtggtggttgtacatcattgtga

SEQ ID NO: 10062 - DNA, 25 bp, Homo sapien
gtactaagtgccactgaattgctca

SEQ ID NO: 10063 - DNA, 25 bp, Homo sapien
tcctccactttagcctctcgagtac

SEQ ID NO: 10064 - DNA, 25 bp, Homo sapien
tggctaattttatgtcatgcaaatc

SEQ ID NO: 10065 - DNA, 25 bp, Homo sapien
atgtcatgcaaatcttatccccatc

SEQ ID NO: 10066 - DNA, 25 bp, Homo sapien
gtcatgcaaatcttatccccatcaa

SEQ ID NO: 10067 - DNA, 25 bp, Homo sapien
atagaggaagaccagccagaagttt

SEQ ID NO: 10068 - DNA, 25 bp, Homo sapien
ggaggccttgctaaaatcacggtca

SEQ ID NO: 10069 - DNA, 25 bp, Homo sapien
gccttgctaaaatcacggtcatact

SEQ ID NO: 10070 - DNA, 25 bp, Homo sapien
cacggtcatacttggtgatatggaa

SEQ ID NO: 10071 - DNA, 25 bp, Homo sapien
gtgtacacatacgtaaatctgcatt

SEQ ID NO: 10072 - DNA, 25 bp, Homo sapien
tacgtaaatctgcattctctcagaa

SEQ ID NO: 10073 - DNA, 25 bp, Homo sapien
gagacaaacttataaactccctgaa

SEQ ID NO: 10074 - DNA, 25 bp, Homo sapien
ataaactccctgaagtgtgaaagca

SEQ ID NO: 10075 - DNA, 25 bp, Homo sapien
gtgtgaaagcagtctccaagctaca

SEQ ID NO: 10076 - DNA, 25 bp, Homo sapien
agcagtctccaagctacagagcaaa

SEQ ID NO: 10077 - DNA, 25 bp, Homo sapien
agtaatgaatggaaaccttattggg

SEQ ID NO: 10078 - DNA, 25 bp, Homo sapien
ctagagtaggttttccactttcatc

SEQ ID NO: 10079 - DNA, 25 bp, Homo sapien
acccacagctacaaaattattcagt

SEQ ID NO: 10080 - DNA, 25 bp, Homo sapien
aatataccatattacgggctgctta

SEQ ID NO: 10081 - DNA, 25 bp, Homo sapien
ttacgggctgcttaatatcttcctt

SEQ ID NO: 10082 - DNA, 25 bp, Homo sapien
ggctgcttaatatcttccttgttta

SEQ ID NO: 10083 - DNA, 25 bp, Homo sapien
taatatcttccttgtttaagacttt

SEQ ID NO: 10084 - DNA, 25 bp, Homo sapien
aagactttaacagtatcagccgggc

SEQ ID NO: 10085 - DNA, 25 bp, Homo sapien
gcacaaatttgccagctaagatcag

SEQ ID NO: 10086 - DNA, 25 bp, Homo sapien
gctaagatcagtataggccctcctc

SEQ ID NO: 10087 - DNA, 25 bp, Homo sapien
tccaacttatctgcaatgcactggg

SEQ ID NO: 10088 - DNA, 25 bp, Homo sapien
atgcactgggagaatatatcttcat

SEQ ID NO: 10089 - DNA, 25 bp, Homo sapien
ccactctctgcagggtatgtggaga

SEQ ID NO: 10090 - DNA, 25 bp, Homo sapien
gagatcatcaaatggcagtccctgt

SEQ ID NO: 10091 - DNA, 25 bp, Homo sapien
agtccctgtcaaggaactacacaat

SEQ ID NO: 10092 - DNA, 25 bp, Homo sapien
ggttctcaactcatagaaggtccta

SEQ ID NO: 10093 - DNA, 25 bp, Homo sapien
gaaggtcctaaaatcacataagcat

SEQ ID NO: 10094 - DNA, 25 bp, Homo sapien
atcacataagcataagcccctgcac

SEQ ID NO: 10095 - DNA, 25 bp, Homo sapien
acctactgagtcaggacctctgggt

SEQ ID NO: 10096 - DNA, 25 bp, Homo sapien
gacctctgggtggtcagtaccctga

SEQ ID NO: 10097 - DNA, 25 bp, Homo sapien
aaattgtgagacaaggctggcctaa

SEQ ID NO: 10098 - DNA, 25 bp, Homo sapien
aaggctggcctaattcagtttcaca

SEQ ID NO: 10099 - DNA, 25 bp, Homo sapien
ttcagtttcacagcctgcttttgaa

SEQ ID NO: 10100 - DNA, 25 bp, Homo sapien
gagggcaacggtacgatctcgacac

SEQ ID NO: 10101 - DNA, 25 bp, Homo sapien
gccacttctgactgaagggccaccg

SEQ ID NO: 10102 - DNA, 25 bp, Homo sapien
ggccaccgcgcttgttagaaatatt

SEQ ID NO: 10103 - DNA, 25 bp, Homo sapien
gcatgtgagaaactctttccaaagt

SEQ ID NO: 10104 - DNA, 25 bp, Homo sapien
agttttgctcatttattcccttctt

SEQ ID NO: 10105 - DNA, 25 bp, Homo sapien
ttctttctttgggttgacctcacaa

SEQ ID NO: 10106 - DNA, 25 bp, Homo sapien
gacctcacaagttttgttggtgaca

SEQ ID NO: 10107 - DNA, 25 bp, Homo sapien
tttgttggtgacattagctcccctg

SEQ ID NO: 10108 - DNA, 25 bp, Homo sapien
attagctcccctgtttgccgttact

SEQ ID NO: 10109 - DNA, 25 bp, Homo sapien
tgccgttactgttgatgctctttca

SEQ ID NO: 10110 - DNA, 25 bp, Homo sapien
ggatataggctacacactttcttaa

SEQ ID NO: 10111 - DNA, 25 bp, Homo sapien
ggattttaactttaaccagcctcat

SEQ ID NO: 10112 - DNA, 25 bp, Homo sapien
taactttaaccagcctcatttaagt

SEQ ID NO: 10113 - DNA, 25 bp, Homo sapien
aagttaatcacctctttaaatgctc

SEQ ID NO: 10114 - DNA, 25 bp, Homo sapien
cacctctttaaatgctcaatctcca

SEQ ID NO: 10115 - DNA, 25 bp, Homo sapien
atggtggcagggtacatgaacccct

SEQ ID NO: 10116 - DNA, 25 bp, Homo sapien
agggtacatgaacccctaccaggct

SEQ ID NO: 10117 - DNA, 25 bp, Homo sapien
ccttcttctattcacacccttgtgt

SEQ ID NO: 10118 - DNA, 25 bp, Homo sapien
cattgaataggcctgacttgtgtaa

SEQ ID NO: 10119 - DNA, 25 bp, Homo sapien
aggcctgacttgtgtaaccactaca

SEQ ID NO: 10120 - DNA, 25 bp, Homo sapien
gtaaccactacactattgaagaaat

SEQ ID NO: 10121 - DNA, 25 bp, Homo sapien
atgagagtttgacttctgagggtaa

SEQ ID NO: 10122 - DNA, 25 bp, Homo sapien
tatggagcctccaaaagccatctgt

SEQ ID NO: 10123 - DNA, 25 bp, Homo sapien
aaaagccatctgtctagccgggcag

SEQ ID NO: 10124 - DNA, 25 bp, Homo sapien
tgtgcactgcaaaactctaggagag

SEQ ID NO: 10125 - DNA, 25 bp, Homo sapien
tgcaaaactctaggagaggccactc

SEQ ID NO: 10126 - DNA, 25 bp, Homo sapien
gtaaggcagagctcctttagggaag

SEQ ID NO: 10127 - DNA, 25 bp, Homo sapien
gaagggtggcaaatgggatttctcc

SEQ ID NO: 10128 - DNA, 25 bp, Homo sapien
aatgggatttctcccattgcagaca

SEQ ID NO: 10129 - DNA, 25 bp, Homo sapien
gtgttgcttagcagacaaggtgtca

SEQ ID NO: 10130 - DNA, 25 bp, Homo sapien
agacaaggtgtcacggtagcctaat

SEQ ID NO: 10131 - DNA, 25 bp, Homo sapien
ggtagcctaataaggtctggagtag

SEQ ID NO: 10132 - DNA, 25 bp, Homo sapien
gccttcctggtcctaaaatatggag

SEQ ID NO: 10133 - DNA, 25 bp, Homo sapien
ggagactcggagatatttactttct

SEQ ID NO: 10134 - DNA, 25 bp, Homo sapien
gactcggagatatttactttcttgg

SEQ ID NO: 10135 - DNA, 25 bp, Homo sapien
ctcggagatatttactttcttggaa

SEQ ID NO: 10136 - DNA, 25 bp, Homo sapien
ggagatatttactttcttggaaaca

SEQ ID NO: 10137 - DNA, 25 bp, Homo sapien
gatatttactttcttggaaacacaa

SEQ ID NO: 10138 - DNA, 25 bp, Homo sapien
actttcttggaaacacaacagtcta

SEQ ID NO: 10139 - DNA, 25 bp, Homo sapien
tttcttggaaacacaacagtctatt

SEQ ID NO: 10140 - DNA, 25 bp, Homo sapien
tcttggaaacacaacagtctattaa

SEQ ID NO: 10141 - DNA, 25 bp, Homo sapien
gatcaccagctcaggagatccagat

SEQ ID NO: 10142 - DNA, 25 bp, Homo sapien
tgggcacctataacctcagcctccc

SEQ ID NO: 10143 - DNA, 25 bp, Homo sapien
agctgtgactagagtgcaccaccac

SEQ ID NO: 10144 - DNA, 25 bp, Homo sapien
gattaccatctggttgacctgttgt

SEQ ID NO: 10145 - DNA, 25 bp, Homo sapien
gacctgttgtgcattttctagctta

SEQ ID NO: 10146 - DNA, 25 bp, Homo sapien
taagggttgaatccagttacccaag

SEQ ID NO: 10147 - DNA, 25 bp, Homo sapien
gaaactaactgattcactacaggga

SEQ ID NO: 10148 - DNA, 25 bp, Homo sapien
ttcactacagggaactggtaccaag

SEQ ID NO: 10149 - DNA, 25 bp, Homo sapien
accaagggaagctagatgactctca

SEQ ID NO: 10150 - DNA, 25 bp, Homo sapien
gaaaatgtgcaaactccacgttgat

SEQ ID NO: 10151 - DNA, 25 bp, Homo sapien
aactccacgttgattttccagctaa

SEQ ID NO: 10152 - DNA, 25 bp, Homo sapien
gattttccagctaatgagtaagttg

SEQ ID NO: 10153 - DNA, 25 bp, Homo sapien
gtagtcacatattggacttatacca

SEQ ID NO: 10154 - DNA, 25 bp, Homo sapien
cattaagaatagcagccccaaagat

SEQ ID NO: 10155 - DNA, 25 bp, Homo sapien
cagtgtgggagaacatgaagatgat

SEQ ID NO: 10156 - DNA, 25 bp, Homo sapien
acaatcaggaacacagccaagggaa

SEQ ID NO: 10157 - DNA, 25 bp, Homo sapien
caagggaaacacagcttcacaacag

SEQ ID NO: 10158 - DNA, 25 bp, Homo sapien
cttcacaacagccatgaacgccttt

SEQ ID NO: 10159 - DNA, 25 bp, Homo sapien
ttcacaacagccatgaacgcctttg

SEQ ID NO: 10160 - DNA, 25 bp, Homo sapien
tcacaacagccatgaacgcctttgg

SEQ ID NO: 10161 - DNA, 25 bp, Homo sapien
cacaacagccatgaacgcctttgga

SEQ ID NO: 10162 - DNA, 25 bp, Homo sapien
acaacagccatgaacgcctttggag

SEQ ID NO: 10163 - DNA, 25 bp, Homo sapien
caacagccatgaacgcctttggaga

SEQ ID NO: 10164 - DNA, 25 bp, Homo sapien
aacagccatgaacgcctttggagac

SEQ ID NO: 10165 - DNA, 25 bp, Homo sapien
agccatgaacgcctttggagacatg

SEQ ID NO: 10166 - DNA, 25 bp, Homo sapien
tgggaacatacagagacctacaggg

SEQ ID NO: 10167 - DNA, 25 bp, Homo sapien
acctacagggaagacggccatggga

SEQ ID NO: 10168 - DNA, 25 bp, Homo sapien
agacggccatgggacaagggaggca

SEQ ID NO: 10169 - DNA, 25 bp, Homo sapien
tacgctgcctacagtcacggaatgc

SEQ ID NO: 10170 - DNA, 25 bp, Homo sapien
ctgcctacagtcacggaatgccaag

SEQ ID NO: 10171 - DNA, 25 bp, Homo sapien
cagtcacggaatgccaaggacagct

SEQ ID NO: 10172 - DNA, 25 bp, Homo sapien
acggaatgccaaggacagctggaaa

SEQ ID NO: 10173 - DNA, 25 bp, Homo sapien
cagaagctaagaaggagattttacc

SEQ ID NO: 10174 - DNA, 25 bp, Homo sapien
agcctctcaaagaaatcaatcatac

SEQ ID NO: 10175 - DNA, 25 bp, Homo sapien
agaaatcaatcatactcacacctcc

SEQ ID NO: 10176 - DNA, 25 bp, Homo sapien
aatcaatcatactcacacctccttt

SEQ ID NO: 10177 - DNA, 25 bp, Homo sapien
cgtgggagagacgattccagtttct

SEQ ID NO: 10178 - DNA, 25 bp, Homo sapien
agacgattccagtttctgaaaacga

SEQ ID NO: 10179 - DNA, 25 bp, Homo sapien
gagggagatgccagtgaatcaatca

SEQ ID NO: 10180 - DNA, 25 bp, Homo sapien
gtgaatcaatcaaaaccaggaccaa

SEQ ID NO: 10181 - DNA, 25 bp, Homo sapien
ggaccaaagggcagataaaagatca

SEQ ID NO: 10182 - DNA, 25 bp, Homo sapien
aaaagatcagtatggctatcaatta

SEQ ID NO: 10183 - DNA, 25 bp, Homo sapien
aagagcttcaatcttccgaatggaa

SEQ ID NO: 10184 - DNA, 25 bp, Homo sapien
gaagattaagttgtgccctcatgaa

SEQ ID NO: 10185 - DNA, 25 bp, Homo sapien
agattaagttgtgccctcatgaatg

SEQ ID NO: 10186 - DNA, 25 bp, Homo sapien
gattagtcgtttctaaaagggcttg

SEQ ID NO: 10187 - DNA, 25 bp, Homo sapien
gggaatgatcttaggccttttttgc

SEQ ID NO: 10188 - DNA, 25 bp, Homo sapien
cttgggtcatgtggccatcctgaag

SEQ ID NO: 10189 - DNA, 25 bp, Homo sapien
ggtcatgtggccatcctgaagaaaa

SEQ ID NO: 10190 - DNA, 25 bp, Homo sapien
gaaatgggctattatgatcatatgc

SEQ ID NO: 10191 - DNA, 25 bp, Homo sapien
tattatgatcatatgcccatccccg

SEQ ID NO: 10192 - DNA, 25 bp, Homo sapien
tcatatgcccatccccgagggtgaa

SEQ ID NO: 10193 - DNA, 25 bp, Homo sapien
catccccgagggtgaatggacagtg

SEQ ID NO: 10194 - DNA, 25 bp, Homo sapien
gggtactgtggtgacagctctatca

SEQ ID NO: 10195 - DNA, 25 bp, Homo sapien
ggtgacagctctatcacaacaatgt

SEQ ID NO: 10196 - DNA, 25 bp, Homo sapien
gagatgtgaaatacaggtttccaaa

SEQ ID NO: 10197 - DNA, 25 bp, Homo sapien
gggtaggtaaaaaacatgctggata

SEQ ID NO: 10198 - DNA, 25 bp, Homo sapien
aaacatgctggataatgcctataat

SEQ ID NO: 10199 - DNA, 25 bp, Homo sapien
agcctctgagctggtcatccgaaca

SEQ ID NO: 10200 - DNA, 25 bp, Homo sapien
tggtcatccgaacaccctaggaaag

SEQ ID NO: 10201 - DNA, 25 bp, Homo sapien
ggaaagagtccaccccgtccttcat

SEQ ID NO: 10202 - DNA, 25 bp, Homo sapien
gtccttcatgttctatcactgcttg

SEQ ID NO: 10203 - DNA, 25 bp, Homo sapien
atgttctatcactgcttggcctagc

SEQ ID NO: 10204 - DNA, 25 bp, Homo sapien
tggcctagctaagccaagcacctgg

SEQ ID NO: 10205 - DNA, 25 bp, Homo sapien
tggaggaatgtgacctccagcccaa

SEQ ID NO: 10206 - DNA, 25 bp, Homo sapien
tcgactctgctctttgccagttcag

SEQ ID NO: 10207 - DNA, 25 bp, Homo sapien
ttcagtcttgcccaagtcacttggg

SEQ ID NO: 10208 - DNA, 25 bp, Homo sapien
ttgggttctccaagcctatgatctc

SEQ ID NO: 10209 - DNA, 25 bp, Homo sapien
agcctatgatctcctctttaaaatg

SEQ ID NO: 10210 - DNA, 25 bp, Homo sapien
gcagatggtccgagtcacaagtaaa

SEQ ID NO: 10211 - DNA, 25 bp, Homo sapien
taaagaatgtctggtggtcttgggc

SEQ ID NO: 10212 - DNA, 25 bp, Homo sapien
cttgggcagagagattcatgtcata

SEQ ID NO: 10213 - DNA, 25 bp, Homo sapien
aggaatcactaacaccttgactcca

SEQ ID NO: 10214 - DNA, 25 bp, Homo sapien
accttgactccagatcatggcttga

SEQ ID NO: 10215 - DNA, 25 bp, Homo sapien
gatcatggcttgaaacacactggaa

SEQ ID NO: 10216 - DNA, 25 bp, Homo sapien
aacacactggaatgggattttgcat

SEQ ID NO: 10217 - DNA, 25 bp, Homo sapien
ttacacaccatggatctagaaggga

SEQ ID NO: 10218 - DNA, 25 bp, Homo sapien
tagaagggagtctataaccccagaa

SEQ ID NO: 10219 - DNA, 25 bp, Homo sapien
aatctcatgatttaactgctatata

SEQ ID NO: 10220 - DNA, 25 bp, Homo sapien
ttaactgctatataaccttggccaa

SEQ ID NO: 10221 - DNA, 25 bp, Homo sapien
atgttaggccaagtgcatgcaggat

SEQ ID NO: 10222 - DNA, 25 bp, Homo sapien
gataaacaagaccagcacagtgcca

SEQ ID NO: 10223 - DNA, 25 bp, Homo sapien
gaatggacggaatcacgtgtgcaga

SEQ ID NO: 10224 - DNA, 25 bp, Homo sapien
tgtgcagagacactgagtcgcgcta

SEQ ID NO: 10225 - DNA, 25 bp, Homo sapien
gagtcgcgctagacactccaggata

SEQ ID NO: 10226 - DNA, 25 bp, Homo sapien
gacactccaggatacatttgaagca

SEQ ID NO: 10227 - DNA, 25 bp, Homo sapien
gaagcatgtttctctgctacactgt

SEQ ID NO: 10228 - DNA, 25 bp, Homo sapien
gtttctctgctacactgtactgaca

SEQ ID NO: 10229 - DNA, 25 bp, Homo sapien
ataagtactgcacattttactctag

SEQ ID NO: 10230 - DNA, 25 bp, Homo sapien
aatttaaagcaaaggccacgcacgt

SEQ ID NO: 10231 - DNA, 25 bp, Homo sapien
aaaggccacgcacgtgtgactcacg

SEQ ID NO: 10232 - DNA, 25 bp, Homo sapien
ggtggctcaccaagagactgctgac

SEQ ID NO: 10233 - DNA, 25 bp, Homo sapien
ggctcaccaagagactgctgacctg

SEQ ID NO: 10234 - DNA, 25 bp, Homo sapien
cggcccagcgggagacttcatttgg

SEQ ID NO: 10235 - DNA, 25 bp, Homo sapien
gagacttcatttgggagtcagacaa

SEQ ID NO: 10236 - DNA, 25 bp, Homo sapien
gtgaaggccaaaggctcccctgggt

SEQ ID NO: 10237 - DNA, 25 bp, Homo sapien
tcctccttgttccttgtgatgagag

SEQ ID NO: 10238 - DNA, 25 bp, Homo sapien
gaggagctgatggtctgcttagctt

SEQ ID NO: 10239 - DNA, 25 bp, Homo sapien
gatggtctgcttagcttagcagctc

SEQ ID NO: 10240 - DNA, 25 bp, Homo sapien
agcttagcagctcaaaaatcccctt

SEQ ID NO: 10241 - DNA, 25 bp, Homo sapien
agcagctcaaaaatccccttccttt

SEQ ID NO: 10242 - DNA, 25 bp, Homo sapien
gaacaagaatcagcttctcagcctg

SEQ ID NO: 10243 - DNA, 25 bp, Homo sapien
tatagataacaatccttccaggttg

SEQ ID NO: 10244 - DNA, 25 bp, Homo sapien
gtaaatattattagccaaccacaga

SEQ ID NO: 10245 - DNA, 25 bp, Homo sapien
gaaaagcatgaagtgggtaccaagt

SEQ ID NO: 10246 - DNA, 25 bp, Homo sapien
aatgagcacgtacactcttctgaca

SEQ ID NO: 10247 - DNA, 25 bp, Homo sapien
cactcttctgacactttagtctgaa

SEQ ID NO: 10248 - DNA, 25 bp, Homo sapien
gacactttagtctgaatttagtctg

SEQ ID NO: 10249 - DNA, 25 bp, Homo sapien
gtctgacaactctgactaaattcaa

SEQ ID NO: 10250 - DNA, 25 bp, Homo sapien
taaattcaacttactttagtcaatg

SEQ ID NO: 10251 - DNA, 25 bp, Homo sapien
tttatttatcttctaggtaactcaa

SEQ ID NO: 10252 - DNA, 25 bp, Homo sapien
ggtaactcaatatcgtcttttttat

SEQ ID NO: 10253 - DNA, 25 bp, Homo sapien
gattcattttactcttaactatgtt

SEQ ID NO: 10254 - DNA, 25 bp, Homo sapien
gaacacgaaacgtcacttccacacg

SEQ ID NO: 10255 - DNA, 25 bp, Homo sapien
ccacacgacctgcaatttctagaat

SEQ ID NO: 10256 - DNA, 25 bp, Homo sapien
gaaagcttcagtaaacattcagtaa

SEQ ID NO: 10257 - DNA, 25 bp, Homo sapien
gaccaagttacgatttcaacccaga

SEQ ID NO: 10258 - DNA, 25 bp, Homo sapien
gaaatacttgattccaaagccccaa

SEQ ID NO: 10259 - DNA, 25 bp, Homo sapien
aagccccaactctactgcatgatat

SEQ ID NO: 10260 - DNA, 25 bp, Homo sapien
tactaagcactattatatctctact

SEQ ID NO: 10261 - DNA, 25 bp, Homo sapien
ctacttctgagtagaatgctccaag

SEQ ID NO: 10262 - DNA, 25 bp, Homo sapien
aatgctccaagattttgctgggaca

SEQ ID NO: 10263 - DNA, 25 bp, Homo sapien
tacacttccatattattttggtgac

SEQ ID NO: 10264 - DNA, 25 bp, Homo sapien
tgagctttagccacagagagtatct

SEQ ID NO: 10265 - DNA, 25 bp, Homo sapien
ttcacagattttctccaggaaacat

SEQ ID NO: 10266 - DNA, 25 bp, Homo sapien
catgttttacttgtgcacgttcagt

SEQ ID NO: 10267 - DNA, 25 bp, Homo sapien
ttttacttgtgcacgttcagttttc

SEQ ID NO: 10268 - DNA, 25 bp, Homo sapien
tacttgtgcacgttcagttttcaaa

SEQ ID NO: 10269 - DNA, 25 bp, Homo sapien
cttgtgcacgttcagttttcaaatt

SEQ ID NO: 10270 - DNA, 25 bp, Homo sapien
aattttcaggtgtgaacgctggtga

SEQ ID NO: 10271 - DNA, 25 bp, Homo sapien
tgtgaacgctggtgagagctgctta

SEQ ID NO: 10272 - DNA, 25 bp, Homo sapien
tgaacgctggtgagagctgcttaaa

SEQ ID NO: 10273 - DNA, 25 bp, Homo sapien
aaaacaaagctatgggccgggcgcg

SEQ ID NO: 10274 - DNA, 25 bp, Homo sapien
tcagggtgcagccttaatgagaggt

SEQ ID NO: 10275 - DNA, 25 bp, Homo sapien
ttctcactgcactggtgacagagcg

SEQ ID NO: 10276 - DNA, 25 bp, Homo sapien
cacgcccggctgatactgttaaagt

SEQ ID NO: 10277 - DNA, 25 bp, Homo sapien
ccggctgatactgttaaagtcttaa

SEQ ID NO: 10278 - DNA, 25 bp, Homo sapien
caaggaagatattaagcagcccgta

SEQ ID NO: 10279 - DNA, 25 bp, Homo sapien
taagcagcccgtaatatggtatatt

SEQ ID NO: 10280 - DNA, 25 bp, Homo sapien
aactgaataattttgtagctgtggg

SEQ ID NO: 10281 - DNA, 25 bp, Homo sapien
cttatatgcatgtttctaaatagat

SEQ ID NO: 10282 - DNA, 25 bp, Homo sapien
gatatattctcccagtgcattgcag

SEQ ID NO: 10283 - DNA, 25 bp, Homo sapien
tctcccagtgcattgcagataagtt

SEQ ID NO: 10284 - DNA, 25 bp, Homo sapien
ggaggagggcctatactgatcttag

SEQ ID NO: 10285 - DNA, 25 bp, Homo sapien
gggcctatactgatcttagctggca

SEQ ID NO: 10286 - DNA, 25 bp, Homo sapien
ctgatcttagctggcaaatttgtgc

SEQ ID NO: 10287 - DNA, 25 bp, Homo sapien
aaatttgcatggtacaggtgtggac

SEQ ID NO: 10288 - DNA, 25 bp, Homo sapien
accaggcagaatggacagtgccctt

SEQ ID NO: 10289 - DNA, 25 bp, Homo sapien
tagaagcccttgctgtgtgccaggt

SEQ ID NO: 10290 - DNA, 25 bp, Homo sapien
gtgtgccaggtgtcaatcattttgt

SEQ ID NO: 10291 - DNA, 25 bp, Homo sapien
gttgggtggtccacaaggtcccacg

SEQ ID NO: 10292 - DNA, 25 bp, Homo sapien
tccacaaggtcccacgggagggatt

SEQ ID NO: 10293 - DNA, 25 bp, Homo sapien
agagaagcagctccttaccaaccag

SEQ ID NO: 10294 - DNA, 25 bp, Homo sapien
gctccttaccaaccagtagagatgt

SEQ ID NO: 10295 - DNA, 25 bp, Homo sapien
taacaatgcatcaacttcactggtg

SEQ ID NO: 10296 - DNA, 25 bp, Homo sapien
acttcactggtgtgaaccggcaggt

SEQ ID NO: 10297 - DNA, 25 bp, Homo sapien
gagaccggtgggtgccactccctct

SEQ ID NO: 10298 - DNA, 25 bp, Homo sapien
tgagctccagtttccatcactgaag

SEQ ID NO: 10299 - DNA, 25 bp, Homo sapien
gggcaaatcttgagtgtatccattg

SEQ ID NO: 10300 - DNA, 25 bp, Homo sapien
gtatccattggagaatgccgtagat

SEQ ID NO: 10301 - DNA, 25 bp, Homo sapien
gccgtagatactttgagatttcatt

SEQ ID NO: 10302 - DNA, 25 bp, Homo sapien
atggattaatatgctcaccctggag

SEQ ID NO: 10303 - DNA, 25 bp, Homo sapien
gagggattttaaggccactggcttg

SEQ ID NO: 10304 - DNA, 25 bp, Homo sapien
ttgaaataagcgacgtgcacctgag

SEQ ID NO: 10305 - DNA, 25 bp, Homo sapien
gcacctgagggattggatgtatctt

SEQ ID NO: 10306 - DNA, 25 bp, Homo sapien
tttggtaacaccatagggcgtaggt

SEQ ID NO: 10307 - DNA, 25 bp, Homo sapien
gtaggtttgagcttcttagcctttg

SEQ ID NO: 10308 - DNA, 25 bp, Homo sapien
tagcctttggcgctgtctgaaaaga

SEQ ID NO: 10309 - DNA, 25 bp, Homo sapien
gcacagctttgcaggctttgggaag

SEQ ID NO: 10310 - DNA, 25 bp, Homo sapien
ggtatttggatgaagccctggcata

SEQ ID NO: 10311 - DNA, 25 bp, Homo sapien
gccctggcatactaaccctatgaaa

SEQ ID NO: 10312 - DNA, 25 bp, Homo sapien
aagtttatagttcccaaattgcagg

SEQ ID NO: 10313 - DNA, 25 bp, Homo sapien
ggataacaaggctctgtaatcttca

SEQ ID NO: 10314 - DNA, 25 bp, Homo sapien
tcatttcctcaaagttttacaccag

SEQ ID NO: 10315 - DNA, 25 bp, Homo sapien
ttacaccaggattctatggccaagt

SEQ ID NO: 10316 - DNA, 25 bp, Homo sapien
agagccagtgtaattgcccaacggg

SEQ ID NO: 10317 - DNA, 25 bp, Homo sapien
gctgcctaagcaaagccgatttatc

SEQ ID NO: 10318 - DNA, 25 bp, Homo sapien
aaagagtttaggtccaggcacggtg

SEQ ID NO: 10319 - DNA, 25 bp, Homo sapien
aagatgctgatattggccaggcgta

SEQ ID NO: 10320 - DNA, 25 bp, Homo sapien
acggtaaggcgggagggctgccctg

SEQ ID NO: 10321 - DNA, 25 bp, Homo sapien
aagacctgcacagttacgagacctg

SEQ ID NO: 10322 - DNA, 25 bp, Homo sapien
gacctgcacagttacgagacctgca

SEQ ID NO: 10323 - DNA, 25 bp, Homo sapien
tgcacagttacgagacctgcacaga

SEQ ID NO: 10324 - DNA, 25 bp, Homo sapien
cacagttacgagacctgcacagaga

SEQ ID NO: 10325 - DNA, 25 bp, Homo sapien
gttacgagacctgcacagagaccat

SEQ ID NO: 10326 - DNA, 25 bp, Homo sapien
tacgagacctgcacagagaccatct

SEQ ID NO: 10327 - DNA, 25 bp, Homo sapien
gagacctgcacagagaccatcttct

SEQ ID NO: 10328 - DNA, 25 bp, Homo sapien
accatcttctctggtctcttaaaaa

SEQ ID NO: 10329 - DNA, 25 bp, Homo sapien
aaatctggcaacttgagccaggtgc

SEQ ID NO: 10330 - DNA, 25 bp, Homo sapien
tctggcaacttgagccaggtgcggt

SEQ ID NO: 10331 - DNA, 25 bp, Homo sapien
tcctttggagattgtgggaaatgat

SEQ ID NO: 10332 - DNA, 25 bp, Homo sapien
ggtggtgccgatcccagaaggcctg

SEQ ID NO: 10333 - DNA, 25 bp, Homo sapien
ggagatttctctaagggtcagggtc

SEQ ID NO: 10334 - DNA, 25 bp, Homo sapien
tttctctaagggtcagggtctcatc

SEQ ID NO: 10335 - DNA, 25 bp, Homo sapien
taagggtcagggtctcatctcccgc

SEQ ID NO: 10336 - DNA, 25 bp, Homo sapien
tctcatctcccgcagcctttgggtt

SEQ ID NO: 10337 - DNA, 25 bp, Homo sapien
ttcaccacccaatctaatccgtagt

SEQ ID NO: 10338 - DNA, 25 bp, Homo sapien
aatctaatccgtagtcccgtcatgg

SEQ ID NO: 10339 - DNA, 25 bp, Homo sapien
ctaatccgtagtcccgtcatggcca

SEQ ID NO: 10340 - DNA, 25 bp, Homo sapien
ttggaaggaagggtcttagttctca

SEQ ID NO: 10341 - DNA, 25 bp, Homo sapien
aagggtcttagttctcagaggcgaa

SEQ ID NO: 10342 - DNA, 25 bp, Homo sapien
agaagcaatttgcacctggcctggc

SEQ ID NO: 10343 - DNA, 25 bp, Homo sapien
cccaccatagctctctcaaatgatg

SEQ ID NO: 10344 - DNA, 25 bp, Homo sapien
tccctcctcaaactgttcaattagt

SEQ ID NO: 10345 - DNA, 25 bp, Homo sapien
caattagtgggttcattcttcctta

SEQ ID NO: 10346 - DNA, 25 bp, Homo sapien
agtgggttcattcttccttacatac

SEQ ID NO: 10347 - DNA, 25 bp, Homo sapien
attcttccttacataccagtttcac

SEQ ID NO: 10348 - DNA, 25 bp, Homo sapien
tccttacataccagtttcacatacc

SEQ ID NO: 10349 - DNA, 25 bp, Homo sapien
ttcacataccttatgtactgggtgt

SEQ ID NO: 10350 - DNA, 25 bp, Homo sapien
cttatgtactgggtgttgtcttagg

SEQ ID NO: 10351 - DNA, 25 bp, Homo sapien
gttgtcttaggaggaccactaacct

SEQ ID NO: 10352 - DNA, 25 bp, Homo sapien
gaccactaacctcaagaggctgggt

SEQ ID NO: 10353 - DNA, 25 bp, Homo sapien
tcgcctaacctcttaagactcagtt

SEQ ID NO: 10354 - DNA, 25 bp, Homo sapien
gggagtcataaaagtaccatcacat

SEQ ID NO: 10355 - DNA, 25 bp, Homo sapien
agtaccatcacataaggttactgta

SEQ ID NO: 10356 - DNA, 25 bp, Homo sapien
aattctcagaatagtgctaatactc

SEQ ID NO: 10357 - DNA, 25 bp, Homo sapien
gtgctaatactcaactatttgattc

SEQ ID NO: 10358 - DNA, 25 bp, Homo sapien
atttatggaactcataccctggcca

SEQ ID NO: 10359 - DNA, 25 bp, Homo sapien
atggaactcataccctggccaggta

SEQ ID NO: 10360 - DNA, 25 bp, Homo sapien
tggccaggtactgctctagactttg

SEQ ID NO: 10361 - DNA, 25 bp, Homo sapien
ggtactgctctagactttggaaata

SEQ ID NO: 10362 - DNA, 25 bp, Homo sapien
ggaaatacagcagtgaaccaaagca

SEQ ID NO: 10363 - DNA, 25 bp, Homo sapien
aatacatagtaggacaggcgcggtg

SEQ ID NO: 10364 - DNA, 25 bp, Homo sapien
agcctactcgtcatcctcttttaaa

SEQ ID NO: 10365 - DNA, 25 bp, Homo sapien
taaaccatcgcattactcattagga

SEQ ID NO: 10366 - DNA, 25 bp, Homo sapien
gcattactcattaggatgttaccag

SEQ ID NO: 10367 - DNA, 25 bp, Homo sapien
aggatgttaccagatatgtgagttg

SEQ ID NO: 10368 - DNA, 25 bp, Homo sapien
tggtcagagggactcctagctacaa

SEQ ID NO: 10369 - DNA, 25 bp, Homo sapien
gagggactcctagctacaagtagaa

SEQ ID NO: 10370 - DNA, 25 bp, Homo sapien
gctacaagtagaaggagtccactct

SEQ ID NO: 10371 - DNA, 25 bp, Homo sapien
gaaggagtccactctaccattgact

SEQ ID NO: 10372 - DNA, 25 bp, Homo sapien
actctaccattgactgtgtgcaaag

SEQ ID NO: 10373 - DNA, 25 bp, Homo sapien
gcaaagtagcacattttatctacct

SEQ ID NO: 10374 - DNA, 25 bp, Homo sapien
cctttttaagatactcggccggatg

SEQ ID NO: 10375 - DNA, 25 bp, Homo sapien
cctccccaagttcacagaaaagata

SEQ ID NO: 10376 - DNA, 25 bp, Homo sapien
gttcacagaaaagatagctccgcag

SEQ ID NO: 10377 - DNA, 25 bp, Homo sapien
atagctccgcagcagggtttgccaa

SEQ ID NO: 10378 - DNA, 25 bp, Homo sapien
gggttcccaggtactgtaggatgtt

SEQ ID NO: 10379 - DNA, 25 bp, Homo sapien
tctctggtctctaccgagtagattc

SEQ ID NO: 10380 - DNA, 25 bp, Homo sapien
gagtagattccaatagcaccccatc

SEQ ID NO: 10381 - DNA, 25 bp, Homo sapien
catccctggaaccacaatgtctatg

SEQ ID NO: 10382 - DNA, 25 bp, Homo sapien
ctggaaccacaatgtctatggacat

SEQ ID NO: 10383 - DNA, 25 bp, Homo sapien
atggacattgccatatgtcccctac

SEQ ID NO: 10384 - DNA, 25 bp, Homo sapien
tatgtcccctacagggcaaaattgc

SEQ ID NO: 10385 - DNA, 25 bp, Homo sapien
accactgctctaaggagaacagaac

SEQ ID NO: 10386 - DNA, 25 bp, Homo sapien
gaaaggaaaccctattcaataaatg

SEQ ID NO: 10387 - DNA, 25 bp, Homo sapien
atcaactcaagatggctcaaatact

SEQ ID NO: 10388 - DNA, 25 bp, Homo sapien
cctgaaaccataaagattccagaag

SEQ ID NO: 10389 - DNA, 25 bp, Homo sapien
agattccagaagataacatcggaaa

SEQ ID NO: 10390 - DNA, 25 bp, Homo sapien
gataacatcggaaaaacccttctag

SEQ ID NO: 10391 - DNA, 25 bp, Homo sapien
tcggaaaaacccttctagacattgg

SEQ ID NO: 10392 - DNA, 25 bp, Homo sapien
attggcttaggcaaagccttcatga

SEQ ID NO: 10393 - DNA, 25 bp, Homo sapien
ggcttaggcaaagccttcatgacca

SEQ ID NO: 10394 - DNA, 25 bp, Homo sapien
taggcaaagccttcatgaccaagaa

SEQ ID NO: 10395 - DNA, 25 bp, Homo sapien
aggcaaagccttcatgaccaagaac

SEQ ID NO: 10396 - DNA, 25 bp, Homo sapien
caaaagaaataatcaggctgggcgc

SEQ ID NO: 10397 - DNA, 25 bp, Homo sapien
tccatctgatggaatacttctcatt

SEQ ID NO: 10398 - DNA, 25 bp, Homo sapien
gaaagttctggaaaatgcacactaa

SEQ ID NO: 10399 - DNA, 25 bp, Homo sapien
gaaaatgcacactaacctactaatg

SEQ ID NO: 10400 - DNA, 25 bp, Homo sapien
aacctactaatgtgaagccaaccag

SEQ ID NO: 10401 - DNA, 25 bp, Homo sapien
tgtgaagccaaccagtggtagcctg

SEQ ID NO: 10402 - DNA, 25 bp, Homo sapien
gccaaccagtggtagcctggaagct

SEQ ID NO: 10403 - DNA, 25 bp, Homo sapien
gctgggatggcaagaagaatcgatt

SEQ ID NO: 10404 - DNA, 25 bp, Homo sapien
aagaagaatcgattgcaaagagaca

SEQ ID NO: 10405 - DNA, 25 bp, Homo sapien
ttttgtgggtggtggaagtattcca

SEQ ID NO: 10406 - DNA, 25 bp, Homo sapien
aattgtgatcatttcactcatgtat

SEQ ID NO: 10407 - DNA, 25 bp, Homo sapien
tatttcaaaattatcgggccaggcg

SEQ ID NO: 10408 - DNA, 25 bp, Homo sapien
agtgtgtctaaagccctgtgcctga

SEQ ID NO: 10409 - DNA, 25 bp, Homo sapien
ctgagccctgggatgtagaagtact

SEQ ID NO: 10410 - DNA, 25 bp, Homo sapien
ggaaatcttatcatgagcactgtta

SEQ ID NO: 10411 - DNA, 25 bp, Homo sapien
gagcactgttaatccatgaaagtta

SEQ ID NO: 10412 - DNA, 25 bp, Homo sapien
aagttagggattgttcctgatgcta

SEQ ID NO: 10413 - DNA, 25 bp, Homo sapien
gttcctgatgctagagttgtaatga

SEQ ID NO: 10414 - DNA, 25 bp, Homo sapien
gtaagtgctggctggatcagagcaa

SEQ ID NO: 10415 - DNA, 25 bp, Homo sapien
agctatggcccacaggctaaatcca

SEQ ID NO: 10416 - DNA, 25 bp, Homo sapien
atgtattgtccataactgctttagt

SEQ ID NO: 10417 - DNA, 25 bp, Homo sapien
taactgctttagtgctaccactgca

SEQ ID NO: 10418 - DNA, 25 bp, Homo sapien
gtgctaccactgcagagttaagaag

SEQ ID NO: 10419 - DNA, 25 bp, Homo sapien
aaattagatagcagtgcttgcttct

SEQ ID NO: 10420 - DNA, 25 bp, Homo sapien
cagtgcttgcttctttatagataca

SEQ ID NO: 10421 - DNA, 25 bp, Homo sapien
gcttgcttctttatagatacattag

SEQ ID NO: 10422 - DNA, 25 bp, Homo sapien
tagtgttccaaataacatacttgaa

SEQ ID NO: 10423 - DNA, 25 bp, Homo sapien
tatcatctttgaagtaaacaccatg

SEQ ID NO: 10424 - DNA, 25 bp, Homo sapien
gtaaacaccatgttagactccctgg

SEQ ID NO: 10425 - DNA, 25 bp, Homo sapien
atgttagactccctggtgataccac

SEQ ID NO: 10426 - DNA, 25 bp, Homo sapien
tccctggtgataccactcttgaatt

SEQ ID NO: 10427 - DNA, 25 bp, Homo sapien
gtgataccactcttgaattggttaa

SEQ ID NO: 10428 - DNA, 25 bp, Homo sapien
gttttttattaccagttgatctctc

SEQ ID NO: 10429 - DNA, 25 bp, Homo sapien
ttattaccagttgatctctcaaatg

SEQ ID NO: 10430 - DNA, 25 bp, Homo sapien
tagacgttgtccatttcaaagcatc

SEQ ID NO: 10431 - DNA, 25 bp, Homo sapien
atttcaaagcatctccagtctggat

SEQ ID NO: 10432 - DNA, 25 bp, Homo sapien
ggatgatgtgtttatgtccttccat

SEQ ID NO: 10433 - DNA, 25 bp, Homo sapien
gtccttccatgtctgttccttaaag

SEQ ID NO: 10434 - DNA, 25 bp, Homo sapien
taaagcaaccttaagtctggaacat

SEQ ID NO: 10435 - DNA, 25 bp, Homo sapien
agtctggaacatgaattctcttttt

SEQ ID NO: 10436 - DNA, 25 bp, Homo sapien
acacaggctaccattgtcaccgctt

SEQ ID NO: 10437 - DNA, 25 bp, Homo sapien
tcaccgcttccttgtagcttctgga

SEQ ID NO: 10438 - DNA, 25 bp, Homo sapien
gtagcttctggactcttggtggcat

SEQ ID NO: 10439 - DNA, 25 bp, Homo sapien
tggactcttggtggcatttgccaat

SEQ ID NO: 10440 - DNA, 25 bp, Homo sapien
tgttttcccctgtgactttaagcta

SEQ ID NO: 10441 - DNA, 25 bp, Homo sapien
agttgagtgcaagcatgtcgtctcc

SEQ ID NO: 10442 - DNA, 25 bp, Homo sapien
aagcatgtcgtctccgtacatgaaa

SEQ ID NO: 10443 - DNA, 25 bp, Homo sapien
gtctccgtacatgaaagtaagcctg

SEQ ID NO: 10444 - DNA, 25 bp, Homo sapien
gtaagcctgaagactcaggtctcgt

SEQ ID NO: 10445 - DNA, 25 bp, Homo sapien
caggtctcgtctctcattttctgaa

SEQ ID NO: 10446 - DNA, 25 bp, Homo sapien
tgagaactagctccaagatggccat

SEQ ID NO: 10447 - DNA, 25 bp, Homo sapien
tccaagatggccatggtcgcctctg

SEQ ID NO: 10448 - DNA, 25 bp, Homo sapien
aagggactaggatgtagctaagtac

SEQ ID NO: 10449 - DNA, 25 bp, Homo sapien
tacaactagcaagtcctgtggagcc

SEQ ID NO: 10450 - DNA, 25 bp, Homo sapien
tgtggagcctcacgtccaggttctg

SEQ ID NO: 10451 - DNA, 25 bp, Homo sapien
taagactctatgaagcgggccgggc

SEQ ID NO: 10452 - DNA, 25 bp, Homo sapien
acttccttccttattcaacacatgg

SEQ ID NO: 10453 - DNA, 25 bp, Homo sapien
agctcttgccaggtacacacgtggg

SEQ ID NO: 10454 - DNA, 25 bp, Homo sapien
tgccaggtacacacgtgggtgcaca

SEQ ID NO: 10455 - DNA, 25 bp, Homo sapien
ggtgcacacgtgagaggccttacat

SEQ ID NO: 10456 - DNA, 25 bp, Homo sapien
cacgtgagaggccttacatcttggg

SEQ ID NO: 10457 - DNA, 25 bp, Homo sapien
gggcacacatgcttgatacacgtgt

SEQ ID NO: 10458 - DNA, 25 bp, Homo sapien
atgcttgatacacgtgtggccccaa

SEQ ID NO: 10459 - DNA, 25 bp, Homo sapien
cgtgtggccccaagcctgtgaacgg

SEQ ID NO: 10460 - DNA, 25 bp, Homo sapien
tttgcccaaatcacatttcttcttc

SEQ ID NO: 10461 - DNA, 25 bp, Homo sapien
gctgccctttgtgggtatggccaga

SEQ ID NO: 10462 - DNA, 25 bp, Homo sapien
gctacagagatagttcctcttgggt

SEQ ID NO: 10463 - DNA, 25 bp, Homo sapien
gtagcttcctactcgttttacaaag

SEQ ID NO: 10464 - DNA, 25 bp, Homo sapien
tactcgttttacaaagccctgcttg

SEQ ID NO: 10465 - DNA, 25 bp, Homo sapien
tttacaaagccctgcttgtgctcac

SEQ ID NO: 10466 - DNA, 25 bp, Homo sapien
cttgtgctcacctgcccggttggcg

SEQ ID NO: 10467 - DNA, 25 bp, Homo sapien
ctgcatccggcgctgtaatgtgtgt

SEQ ID NO: 10468 - DNA, 25 bp, Homo sapien
gcgctgtaatgtgtgtgtgcctccc

SEQ ID NO: 10469 - DNA, 25 bp, Homo sapien
tggcctaggcctggttcctggttaa

SEQ ID NO: 10470 - DNA, 25 bp, Homo sapien
ctggttcctggttaataagctctca

SEQ ID NO: 10471 - DNA, 25 bp, Homo sapien
taataagctctcagtaagaaggttc

SEQ ID NO: 10472 - DNA, 25 bp, Homo sapien
aagaaggttctgatggcccaggcac

SEQ ID NO: 10473 - DNA, 25 bp, Homo sapien
aggcactatggctcaggccagcact

SEQ ID NO: 10474 - DNA, 25 bp, Homo sapien
gaagagcttgaagttcctgtctgat

SEQ ID NO: 10475 - DNA, 25 bp, Homo sapien
ttgaagttcctgtctgatcatcaga

SEQ ID NO: 10476 - DNA, 25 bp, Homo sapien
gatcatcagatcctgtaagtctttg

SEQ ID NO: 10477 - DNA, 25 bp, Homo sapien
gatcctgtaagtctttgaccttgaa

SEQ ID NO: 10478 - DNA, 25 bp, Homo sapien
ggatgagagtcgtatttatttgttg

SEQ ID NO: 10479 - DNA, 25 bp, Homo sapien
tacacaaacacaaagtttaccgtct

SEQ ID NO: 10480 - DNA, 25 bp, Homo sapien
ccatttttaattgtgcagcttagtg

SEQ ID NO: 10481 - DNA, 25 bp, Homo sapien
aattgtgcagcttagtggtattaaa

SEQ ID NO: 10482 - DNA, 25 bp, Homo sapien
acattaaatgccacccatcttcata

SEQ ID NO: 10483 - DNA, 25 bp, Homo sapien
ttgtgaaatgcaactctgtacccat

SEQ ID NO: 10484 - DNA, 25 bp, Homo sapien
ttaaacaatagctccttggccgggc

SEQ ID NO: 10485 - DNA, 25 bp, Homo sapien
gaggaagagacctgcagtagcatgt

SEQ ID NO: 10486 - DNA, 25 bp, Homo sapien
aagagacctgcagtagcatgtttgc

SEQ ID NO: 10487 - DNA, 25 bp, Homo sapien
gtagcatgtttgcatgctcagctcc

SEQ ID NO: 10488 - DNA, 25 bp, Homo sapien
atgtttgcatgctcagctccctcac

SEQ ID NO: 10489 - DNA, 25 bp, Homo sapien
gctccctcaccatgtcactttggga

SEQ ID NO: 10490 - DNA, 25 bp, Homo sapien
aggctttcaccaggtgtggcccctt

SEQ ID NO: 10491 - DNA, 25 bp, Homo sapien
aggtgtggccccttaactgtggact

SEQ ID NO: 10492 - DNA, 25 bp, Homo sapien
tggccccttaactgtggacttccca

SEQ ID NO: 10493 - DNA, 25 bp, Homo sapien
aatggattaaggcacatgcattcta

SEQ ID NO: 10494 - DNA, 25 bp, Homo sapien
ttaaggcacatgcattctaaatatt

SEQ ID NO: 10495 - DNA, 25 bp, Homo sapien
aaaaatgcatacttgggctgggcgc

SEQ ID NO: 10496 - DNA, 25 bp, Homo sapien
gtgacttacccaaagccatccagca

SEQ ID NO: 10497 - DNA, 25 bp, Homo sapien
aagccatccagcattgttgtggcgg

SEQ ID NO: 10498 - DNA, 25 bp, Homo sapien
catagctgctctgaagggactgctg

SEQ ID NO: 10499 - DNA, 25 bp, Homo sapien
tggcatgggctggaacaatccagaa

SEQ ID NO: 10500 - DNA, 25 bp, Homo sapien
gacttcccagagagccttgaaggat

SEQ ID NO: 10501 - DNA, 25 bp, Homo sapien
gaaagatttggattagtacctctca

SEQ ID NO: 10502 - DNA, 25 bp, Homo sapien
gtacctctcaaagtggcttttgcaa

SEQ ID NO: 10503 - DNA, 25 bp, Homo sapien
ttcttgggctgggttcagtgactca

SEQ ID NO: 10504 - DNA, 25 bp, Homo sapien
atcccagcacccaaggatctcttga

SEQ ID NO: 10505 - DNA, 25 bp, Homo sapien
tcaagaccagcttaaacagcatagt

SEQ ID NO: 10506 - DNA, 25 bp, Homo sapien
tggctcataactgtagtcttagcca

SEQ ID NO: 10507 - DNA, 25 bp, Homo sapien
agcagtatcagcatctctggaaact

SEQ ID NO: 10508 - DNA, 25 bp, Homo sapien
atctctggaaacttgttggaaatgc

SEQ ID NO: 10509 - DNA, 25 bp, Homo sapien
tcttgggccccactcaatatttact

SEQ ID NO: 10510 - DNA, 25 bp, Homo sapien
gataccttataacaaatcctgcagg

SEQ ID NO: 10511 - DNA, 25 bp, Homo sapien
caggtgattctgatagttctaatag

SEQ ID NO: 10512 - DNA, 25 bp, Homo sapien
gaaaattattaattcgtccagtgaa

SEQ ID NO: 10513 - DNA, 25 bp, Homo sapien
gattggcaacattcacagagaggaa

SEQ ID NO: 10514 - DNA, 25 bp, Homo sapien
gaggaataaactctgatcttatgat

SEQ ID NO: 10515 - DNA, 25 bp, Homo sapien
gagaaccctgttcagtctttagaaa

SEQ ID NO: 10516 - DNA, 25 bp, Homo sapien
caaccatgctgtagtgatggctgca

SEQ ID NO: 10517 - DNA, 25 bp, Homo sapien
gtgagcctatatagttagattgaca

SEQ ID NO: 10518 - DNA, 25 bp, Homo sapien
acaaagctgagctatctaagccaca

SEQ ID NO: 10519 - DNA, 25 bp, Homo sapien
ctatctaagccacagctggagttct

SEQ ID NO: 10520 - DNA, 25 bp, Homo sapien
tttccattcacctgtaagactgtag

SEQ ID NO: 10521 - DNA, 25 bp, Homo sapien
ttcacctgtaagactgtagagagac

SEQ ID NO: 10522 - DNA, 25 bp, Homo sapien
cataaatgatagagcgctgtgacct

SEQ ID NO: 10523 - DNA, 25 bp, Homo sapien
gagcgctgtgacctaggacagtctt

SEQ ID NO: 10524 - DNA, 25 bp, Homo sapien
aggacagtctttccatcctaaccta

SEQ ID NO: 10525 - DNA, 25 bp, Homo sapien
gaagcagtgagccagcaactttccc

SEQ ID NO: 10526 - DNA, 25 bp, Homo sapien
gcaactttcccaagggtatgcagct

SEQ ID NO: 10527 - DNA, 25 bp, Homo sapien
aatgagaaagccgatgtggatgcag

SEQ ID NO: 10528 - DNA, 25 bp, Homo sapien
cagcacacccgtttattctcatttt

SEQ ID NO: 10529 - DNA, 25 bp, Homo sapien
ttacctgataaattcgaaagatgtg

SEQ ID NO: 10530 - DNA, 25 bp, Homo sapien
aaaagatcgtcttgagccagaatac

SEQ ID NO: 10531 - DNA, 25 bp, Homo sapien
ttgagccagaatacacacgtgtcct

SEQ ID NO: 10532 - DNA, 25 bp, Homo sapien
acgtgtccttccagcgtggagatta

SEQ ID NO: 10533 - DNA, 25 bp, Homo sapien
gcgtggagattactgtgaacttgca

SEQ ID NO: 10534 - DNA, 25 bp, Homo sapien
gtgaacttgcaaaccagctttcgtg

SEQ ID NO: 10535 - DNA, 25 bp, Homo sapien
gcaaaccagctttcgtgcagaaggg

SEQ ID NO: 10536 - DNA, 25 bp, Homo sapien
acattttctgaccatctattattga

SEQ ID NO: 10537 - DNA, 25 bp, Homo sapien
gattgtacagtaaaccctgaagtga

SEQ ID NO: 10538 - DNA, 25 bp, Homo sapien
cattttgataacttacagacatttg

SEQ ID NO: 10539 - DNA, 25 bp, Homo sapien
cagacatttgcaatttatctttctt

SEQ ID NO: 10540 - DNA, 25 bp, Homo sapien
gttgtttcaaatctgttaggaatgt

SEQ ID NO: 10541 - DNA, 25 bp, Homo sapien
ttaggtaagagtgtcagttgaaatc

SEQ ID NO: 10542 - DNA, 25 bp, Homo sapien
agttgaaatctctggctgaatggtt

SEQ ID NO: 10543 - DNA, 25 bp, Homo sapien
ctgaatggttagagttgtgtgaaga

SEQ ID NO: 10544 - DNA, 25 bp, Homo sapien
gaaagctcctataaatacaattttg

SEQ ID NO: 10545 - DNA, 25 bp, Homo sapien
gaaagtgttgatttattccattcat

SEQ ID NO: 10546 - DNA, 25 bp, Homo sapien
ccattcatctctgttctatgaatga

SEQ ID NO: 10547 - DNA, 25 bp, Homo sapien
gttctatgaatgaaaatctctcttt

SEQ ID NO: 10548 - DNA, 25 bp, Homo sapien
taaatgctgaagtctgtaataaatt

SEQ ID NO: 10549 - DNA, 25 bp, Homo sapien
acatttgtgttttagcattgagagt

SEQ ID NO: 10550 - DNA, 25 bp, Homo sapien
gagtatctatagttggtttattgaa

SEQ ID NO: 10551 - DNA, 25 bp, Homo sapien
ttttgagctcctactaagtgtaagg

SEQ ID NO: 10552 - DNA, 25 bp, Homo sapien
tttgagctcctactaagtgtaagga

SEQ ID NO: 10553 - DNA, 25 bp, Homo sapien
gagctcctactaagtgtaaggagta

SEQ ID NO: 10554 - DNA, 25 bp, Homo sapien
aacaatatatttggcttacaattct

SEQ ID NO: 10555 - DNA, 25 bp, Homo sapien
atttggcttacaattctagaagttg

SEQ ID NO: 10556 - DNA, 25 bp, Homo sapien
ttggcttacaattctagaagttggt

SEQ ID NO: 10557 - DNA, 25 bp, Homo sapien
ttacaattctagaagttggtgtctc

SEQ ID NO: 10558 - DNA, 25 bp, Homo sapien
aactccaggtggcttgtaagaatat

SEQ ID NO: 10559 - DNA, 25 bp, Homo sapien
ctccaggtggcttgtaagaatattt

SEQ ID NO: 10560 - DNA, 25 bp, Homo sapien
caggtggcttgtaagaatatttcaa

SEQ ID NO: 10561 - DNA, 25 bp, Homo sapien
cttgtaagaatatttcaaaggccag

SEQ ID NO: 10562 - DNA, 25 bp, Homo sapien
gctaggaggtaggtattttgttgct

SEQ ID NO: 10563 - DNA, 25 bp, Homo sapien
gaggcaagtgagtcaatgtatttca

SEQ ID NO: 10564 - DNA, 25 bp, Homo sapien
aatgtatttcaattgcacagctcta

SEQ ID NO: 10565 - DNA, 25 bp, Homo sapien
aattgcacagctctatctggtggca

SEQ ID NO: 10566 - DNA, 25 bp, Homo sapien
cagctctatctggtggcaagtttta

SEQ ID NO: 10567 - DNA, 25 bp, Homo sapien
ggtggcaagttttaagtcagaatct

SEQ ID NO: 10568 - DNA, 25 bp, Homo sapien
taatttagtctgtgcatggcctgcc

SEQ ID NO: 10569 - DNA, 25 bp, Homo sapien
tgtgcatggcctgcccattatttta

SEQ ID NO: 10570 - DNA, 25 bp, Homo sapien
tttatttaccacttctgtctgtgcc

SEQ ID NO: 10571 - DNA, 25 bp, Homo sapien
ttctgtctgtgcctctttgctgcac

SEQ ID NO: 10572 - DNA, 25 bp, Homo sapien
tttgctgcactgaacacttgtctca

SEQ ID NO: 10573 - DNA, 25 bp, Homo sapien
agggacccctggcattaccagacca

SEQ ID NO: 10574 - DNA, 25 bp, Homo sapien
gcattaccagaccacactcttgaga

SEQ ID NO: 10575 - DNA, 25 bp, Homo sapien
gaccacactcttgagaatcactgat

SEQ ID NO: 10576 - DNA, 25 bp, Homo sapien
gagaatcactgatatccatttattt

SEQ ID NO: 10577 - DNA, 25 bp, Homo sapien
gaagaggagcctgccaactgtaagc

SEQ ID NO: 10578 - DNA, 25 bp, Homo sapien
gagcctgccaactgtaagcggcaaa

SEQ ID NO: 10579 - DNA, 25 bp, Homo sapien
aaactgagcaggttataggattcaa

SEQ ID NO: 10580 - DNA, 25 bp, Homo sapien
ggatttgagccctaactccactgta

SEQ ID NO: 10581 - DNA, 25 bp, Homo sapien
tccactgtacacttttctggctatt

SEQ ID NO: 10582 - DNA, 25 bp, Homo sapien
cacttttctggctatttgaactaag

SEQ ID NO: 10583 - DNA, 25 bp, Homo sapien
ctctttcaagagtttcaggccgggt

SEQ ID NO: 10584 - DNA, 25 bp, Homo sapien
accagttctaatcacgtttcaagtc

SEQ ID NO: 10585 - DNA, 25 bp, Homo sapien
tcaagtcaaatgaaccagtcgcagc

SEQ ID NO: 10586 - DNA, 25 bp, Homo sapien
aatggctgacataaggagttaattc

SEQ ID NO: 10587 - DNA, 25 bp, Homo sapien
gaagcagctcaatactatggacaat

SEQ ID NO: 10588 - DNA, 25 bp, Homo sapien
agtggacaatattagcatactgctc

SEQ ID NO: 10589 - DNA, 25 bp, Homo sapien
agcatactgctcgtacaacaaagat

SEQ ID NO: 10590 - DNA, 25 bp, Homo sapien
aagataccgtagtctctggtgctgc

SEQ ID NO: 10591 - DNA, 25 bp, Homo sapien
ggtgctgcctcttcaggacgaattt

SEQ ID NO: 10592 - DNA, 25 bp, Homo sapien
aaaaacattggctgcgcgcgatggc

SEQ ID NO: 10593 - DNA, 25 bp, Homo sapien
gctgcgcgcgatggcttactcctgt

SEQ ID NO: 10594 - DNA, 25 bp, Homo sapien
tgagatttatcattcctcctctctc

SEQ ID NO: 10595 - DNA, 25 bp, Homo sapien
gaaggtgagaaggacgccccagtca

SEQ ID NO: 10596 - DNA, 25 bp, Homo sapien
aagcatggctgcttctgaaatcccc

SEQ ID NO: 10597 - DNA, 25 bp, Homo sapien
ggtgtggctgcaacatggatgtcta

SEQ ID NO: 10598 - DNA, 25 bp, Homo sapien
ggagccacatggaaacacccaactt

SEQ ID NO: 10599 - DNA, 25 bp, Homo sapien
gaaacacccaacttgtcattttgga

SEQ ID NO: 10600 - DNA, 25 bp, Homo sapien
ttgaactttatccagaggcttccca

SEQ ID NO: 10601 - DNA, 25 bp, Homo sapien
aaggtcctagccaggtttgcatttt

SEQ ID NO: 10602 - DNA, 25 bp, Homo sapien
cattttgggtaggtagctctctctg

SEQ ID NO: 10603 - DNA, 25 bp, Homo sapien
ggtagctctctctgctgacaaggca

SEQ ID NO: 10604 - DNA, 25 bp, Homo sapien
gggaagggctgtaaccacaccagat

SEQ ID NO: 10605 - DNA, 25 bp, Homo sapien
tgtaaccacaccagatgcggtggct

SEQ ID NO: 10606 - DNA, 25 bp, Homo sapien
tgctggcttttactaggcaagtgta

SEQ ID NO: 10607 - DNA, 25 bp, Homo sapien
gtatctggaagtgggagactacaat

SEQ ID NO: 10608 - DNA, 25 bp, Homo sapien
ttgtcctctttgtgaactacctatg

SEQ ID NO: 10609 - DNA, 25 bp, Homo sapien
tcaaggatttcttaccacttctggt

SEQ ID NO: 10610 - DNA, 25 bp, Homo sapien
taccacttctggtctgaacgatctt

SEQ ID NO: 10611 - DNA, 25 bp, Homo sapien
atcttccccgccagtagctggtgta

SEQ ID NO: 10612 - DNA, 25 bp, Homo sapien
cagtagctggtgtatgtccatggaa

SEQ ID NO: 10613 - DNA, 25 bp, Homo sapien
gtccatggaattgtcactgtagcaa

SEQ ID NO: 10614 - DNA, 25 bp, Homo sapien
gaggtaaattatgaacacctccctc

SEQ ID NO: 10615 - DNA, 25 bp, Homo sapien
aaagtctggacttgcttggtggctc

SEQ ID NO: 10616 - DNA, 25 bp, Homo sapien
actaatactttggtaggtcaaggca

SEQ ID NO: 10617 - DNA, 25 bp, Homo sapien
tgcaacaacagcaggctctccaggc

SEQ ID NO: 10618 - DNA, 25 bp, Homo sapien
aacaacagcaggctctccaggcagc

SEQ ID NO: 10619 - DNA, 25 bp, Homo sapien
gctctccaggcagcaagacaacttc

SEQ ID NO: 10620 - DNA, 25 bp, Homo sapien
agacaacttcttttacagcagcaaa

SEQ ID NO: 10621 - DNA, 25 bp, Homo sapien
ttttacagcagcaaacaagtggatt

SEQ ID NO: 10622 - DNA, 25 bp, Homo sapien
gtggattgaaatctcctaagagcag

SEQ ID NO: 10623 - DNA, 25 bp, Homo sapien
ctaagagcagtgataaacagagacc

SEQ ID NO: 10624 - DNA, 25 bp, Homo sapien
gtgcctgtgtcagtggccatgatga

SEQ ID NO: 10625 - DNA, 25 bp, Homo sapien
tgtgtcagtggccatgatgactccc

SEQ ID NO: 10626 - DNA, 25 bp, Homo sapien
cagtggccatgatgactccccaggt

SEQ ID NO: 10627 - DNA, 25 bp, Homo sapien
tacaagcccttctccaacaacagca

SEQ ID NO: 10628 - DNA, 25 bp, Homo sapien
gaagagatacaaacagcccatgatt

SEQ ID NO: 10629 - DNA, 25 bp, Homo sapien
caaacagcccatgatttaagaagaa

SEQ ID NO: 10630 - DNA, 25 bp, Homo sapien
ttaagcctcgttaatggtaggtgtt

SEQ ID NO: 10631 - DNA, 25 bp, Homo sapien
aaaccctaacattagcctctagcat

SEQ ID NO: 10632 - DNA, 25 bp, Homo sapien
attagcctctagcatgagggagtga

SEQ ID NO: 10633 - DNA, 25 bp, Homo sapien
gaaattaacatagtcacacatccgc

SEQ ID NO: 10634 - DNA, 25 bp, Homo sapien
tcacacatccgcaacacagcagtag

SEQ ID NO: 10635 - DNA, 25 bp, Homo sapien
cacagcagtagtgtattcatttatt

SEQ ID NO: 10636 - DNA, 25 bp, Homo sapien
attcatttattaatagctgggtaca

SEQ ID NO: 10637 - DNA, 25 bp, Homo sapien
aattgtgaagacatgtgcttggcaa

SEQ ID NO: 10638 - DNA, 25 bp, Homo sapien
gtgcttggcaatgactacgatgaga

SEQ ID NO: 10639 - DNA, 25 bp, Homo sapien
aagacaggccatgccaggcgaagag

SEQ ID NO: 10640 - DNA, 25 bp, Homo sapien
aggaagggcaaggtggctccctccg

SEQ ID NO: 10641 - DNA, 25 bp, Homo sapien
aggtggctccctccgggtatggaga

SEQ ID NO: 10642 - DNA, 25 bp, Homo sapien
tctgagcagaggactccagaggctc

SEQ ID NO: 10643 - DNA, 25 bp, Homo sapien
agcagagccgcccaagatgatagac

SEQ ID NO: 10644 - DNA, 25 bp, Homo sapien
gatgatagacaggagctgaaggcca

SEQ ID NO: 10645 - DNA, 25 bp, Homo sapien
gaccacgcctggagtcttggcggga

SEQ ID NO: 10646 - DNA, 25 bp, Homo sapien
tcttggcgggaggagcatggacaca

SEQ ID NO: 10647 - DNA, 25 bp, Homo sapien
agaggcagtgccgaccatcctgcta

SEQ ID NO: 10648 - DNA, 25 bp, Homo sapien
cgaccatcctgctaaacacacggaa

SEQ ID NO: 10649 - DNA, 25 bp, Homo sapien
tcctgctaaacacacggaacggcct

SEQ ID NO: 10650 - DNA, 25 bp, Homo sapien
tagacatcaagcataatcggccgcg

SEQ ID NO: 10651 - DNA, 25 bp, Homo sapien
atcaagcataatcggccgcgcagag

SEQ ID NO: 10652 - DNA, 25 bp, Homo sapien
aggccctggtcagtgcttgtcctgt

SEQ ID NO: 10653 - DNA, 25 bp, Homo sapien
ctggtcagtgcttgtcctgtcgaaa

SEQ ID NO: 10654 - DNA, 25 bp, Homo sapien
gtcagtgcttgtcctgtcgaaatta

SEQ ID NO: 10655 - DNA, 25 bp, Homo sapien
agtgcttgtcctgtcgaaattatag

SEQ ID NO: 10656 - DNA, 25 bp, Homo sapien
gcttgtcctgtcgaaattatagccg

SEQ ID NO: 10657 - DNA, 25 bp, Homo sapien
attatagccgaggaggtgtctgtgt

SEQ ID NO: 10658 - DNA, 25 bp, Homo sapien
cgaggaggtgtctgtgtgacccact

SEQ ID NO: 10659 - DNA, 25 bp, Homo sapien
tgtgacccactgcaactttctgaat

SEQ ID NO: 10660 - DNA, 25 bp, Homo sapien
gacccactgcaactttctgaatggg

SEQ ID NO: 10661 - DNA, 25 bp, Homo sapien
acaggcgtgtcctccgtgtagaggc

SEQ ID NO: 10662 - DNA, 25 bp, Homo sapien
ggcgaagtcatggtggctacccaac

SEQ ID NO: 10663 - DNA, 25 bp, Homo sapien
agcagctctaggtgctgtgcgtgta

SEQ ID NO: 10664 - DNA, 25 bp, Homo sapien
tgtgcgtgtacagcgctcaccgtgg

SEQ ID NO: 10665 - DNA, 25 bp, Homo sapien
ctgcccgttgctggtgcatggacag

SEQ ID NO: 10666 - DNA, 25 bp, Homo sapien
atggacagcgctcagctggcgtctc

SEQ ID NO: 10667 - DNA, 25 bp, Homo sapien
acaatcctcggttccttcagaattt

SEQ ID NO: 10668 - DNA, 25 bp, Homo sapien
ggttccttcagaattttgagccagg

SEQ ID NO: 10669 - DNA, 25 bp, Homo sapien
caaagcatcgccatttgcaatgtaa

SEQ ID NO: 10670 - DNA, 25 bp, Homo sapien
caatgtaaattagggctgggcggta

SEQ ID NO: 10671 - DNA, 25 bp, Homo sapien
ggctgggcggtagctataatcccag

SEQ ID NO: 10672 - DNA, 25 bp, Homo sapien
tcagcatttcgttttcatgacccac

SEQ ID NO: 10673 - DNA, 25 bp, Homo sapien
atgacccaccatgattgcattggaa

SEQ ID NO: 10674 - DNA, 25 bp, Homo sapien
tagtgggtttcaggagttcaggctc

SEQ ID NO: 10675 - DNA, 25 bp, Homo sapien
tccccacatcccatgttaaacaatt

SEQ ID NO: 10676 - DNA, 25 bp, Homo sapien
gaaagttgacgaatagcccttctta

SEQ ID NO: 10677 - DNA, 25 bp, Homo sapien
aatagcccttcttagatgaccacac

SEQ ID NO: 10678 - DNA, 25 bp, Homo sapien
atgaccacacacagtcttccaggca

SEQ ID NO: 10679 - DNA, 25 bp, Homo sapien
agtcttccaggcaagagtttcagga

SEQ ID NO: 10680 - DNA, 25 bp, Homo sapien
tcaggaggccattcaaagagtaatt

SEQ ID NO: 10681 - DNA, 25 bp, Homo sapien
gtttttgctactactaagatcttta

SEQ ID NO: 10682 - DNA, 25 bp, Homo sapien
ttaaaacaatctcaaggccaggcat

SEQ ID NO: 10683 - DNA, 25 bp, Homo sapien
tttctctctgtggtccagaatctgg

SEQ ID NO: 10684 - DNA, 25 bp, Homo sapien
agaatctggcctcccaaagaaccca

SEQ ID NO: 10685 - DNA, 25 bp, Homo sapien
tcggtgaccaacagactagcctaat

SEQ ID NO: 10686 - DNA, 25 bp, Homo sapien
gactagcctaatttctacaacagaa

SEQ ID NO: 10687 - DNA, 25 bp, Homo sapien
ttcgcaggcgctcactggacagtat

SEQ ID NO: 10688 - DNA, 25 bp, Homo sapien
ctccaggagtaccagtgctctagta

SEQ ID NO: 10689 - DNA, 25 bp, Homo sapien
agaagaagcggcacttacagcaagc

SEQ ID NO: 10690 - DNA, 25 bp, Homo sapien
ttacagcaagccagatactctcacg

SEQ ID NO: 10691 - DNA, 25 bp, Homo sapien
gatactctcacgcacacagatgtta

SEQ ID NO: 10692 - DNA, 25 bp, Homo sapien
ctgacttacttctccagtctgaaga

SEQ ID NO: 10693 - DNA, 25 bp, Homo sapien
gaagattccactggcagcatcacaa

SEQ ID NO: 10694 - DNA, 25 bp, Homo sapien
aaggaaggtggcctgctcagcgtgc

SEQ ID NO: 10695 - DNA, 25 bp, Homo sapien
tcagcgtgctgtcctgggaaaagca

SEQ ID NO: 10696 - DNA, 25 bp, Homo sapien
tggagcgtgtagaggccacagtttt

SEQ ID NO: 10697 - DNA, 25 bp, Homo sapien
ggccacagttttgggcaatctgcat

SEQ ID NO: 10698 - DNA, 25 bp, Homo sapien
gggcaatctgcatatttttgtctac

SEQ ID NO: 10699 - DNA, 25 bp, Homo sapien
tttttgtctacaagatttctgaaaa

SEQ ID NO: 10700 - DNA, 25 bp, Homo sapien
ataagctttctatgcaccttcgtga

SEQ ID NO: 10701 - DNA, 25 bp, Homo sapien
gcaccttcgtgaatgcagatagaaa

SEQ ID NO: 10702 - DNA, 25 bp, Homo sapien
atagaaatatctgctgtgggctggg

SEQ ID NO: 10703 - DNA, 25 bp, Homo sapien
gggaggctgagtctgtcgagttgct

SEQ ID NO: 10704 - DNA, 25 bp, Homo sapien
aagacaagccatggactaggagtaa

SEQ ID NO: 10705 - DNA, 25 bp, Homo sapien
agtgcaacactaaattcggaaggcg

SEQ ID NO: 10706 - DNA, 25 bp, Homo sapien
ttcggaaggcgaacgccatggagct

SEQ ID NO: 10707 - DNA, 25 bp, Homo sapien
ggagctggaattgcattctgttgct

SEQ ID NO: 10708 - DNA, 25 bp, Homo sapien
gcattctgttgctccatttctttca

SEQ ID NO: 10709 - DNA, 25 bp, Homo sapien
ttcaccgtctctttttactggacat

SEQ ID NO: 10710 - DNA, 25 bp, Homo sapien
aaagggcaagcctggagtgacaaag

SEQ ID NO: 10711 - DNA, 25 bp, Homo sapien
gacaaagggaatcctccattcactc

SEQ ID NO: 10712 - DNA, 25 bp, Homo sapien
attcactccatacagtgctgttgct

SEQ ID NO: 10713 - DNA, 25 bp, Homo sapien
gtgaagacatcctggtgcctttgca

SEQ ID NO: 10714 - DNA, 25 bp, Homo sapien
gcctttgcagggtcgtcatgaggat

SEQ ID NO: 10715 - DNA, 25 bp, Homo sapien
gtgtgacagctcaggtttataatcc

SEQ ID NO: 10716 - DNA, 25 bp, Homo sapien
tgacctcaagtgcataccctatttt

SEQ ID NO: 10717 - DNA, 25 bp, Homo sapien
gtgcataccctattttcatctttga

SEQ ID NO: 10718 - DNA, 25 bp, Homo sapien
ttcatctttgagtggcttctggcag

SEQ ID NO: 10719 - DNA, 25 bp, Homo sapien
agtggcttctggcagctcacaggac

SEQ ID NO: 10720 - DNA, 25 bp, Homo sapien
gcagctcacaggacctttgtttatt

SEQ ID NO: 10721 - DNA, 25 bp, Homo sapien
tgttttatccctactcaataccttt

SEQ ID NO: 10722 - DNA, 25 bp, Homo sapien
ctttctggaaggtaaggactgtctt

SEQ ID NO: 10723 - DNA, 25 bp, Homo sapien
actgtctttcagctatacttcctat

SEQ ID NO: 10724 - DNA, 25 bp, Homo sapien
aatctctgcattgttactccttgaa

SEQ ID NO: 10725 - DNA, 25 bp, Homo sapien
gttactccttgaatctctattataa

SEQ ID NO: 10726 - DNA, 25 bp, Homo sapien
acatttaaaaacgtcatggctgggt

SEQ ID NO: 10727 - DNA, 25 bp, Homo sapien
gggacccagaagtcatatccacaca

SEQ ID NO: 10728 - DNA, 25 bp, Homo sapien
tatccacacatgaagctcctagagc

SEQ ID NO: 10729 - DNA, 25 bp, Homo sapien
atcacttgtaggatgtggtgtccgt

SEQ ID NO: 10730 - DNA, 25 bp, Homo sapien
gtggtgtccgtaggatgaaatccca

SEQ ID NO: 10731 - DNA, 25 bp, Homo sapien
atcccaatgcatagatggtcatggt

SEQ ID NO: 10732 - DNA, 25 bp, Homo sapien
catggtgggtcattgctgcagtcat

SEQ ID NO: 10733 - DNA, 25 bp, Homo sapien
agtcatcgtcatgctgcagccttca

SEQ ID NO: 10734 - DNA, 25 bp, Homo sapien
cagccttcaccagggttctaagtgg

SEQ ID NO: 10735 - DNA, 25 bp, Homo sapien
tggtcccagtcacttctccaaaggg

SEQ ID NO: 10736 - DNA, 25 bp, Homo sapien
tgccctgtggccaccgggaagtcca

SEQ ID NO: 10737 - DNA, 25 bp, Homo sapien
agcaaaattgctttgcccagttccc

SEQ ID NO: 10738 - DNA, 25 bp, Homo sapien
taaatgcatagaacactttcaccac

SEQ ID NO: 10739 - DNA, 25 bp, Homo sapien
aatgcatagaacactttcaccacta

SEQ ID NO: 10740 - DNA, 25 bp, Homo sapien
tgcatagaacactttcaccactaat

SEQ ID NO: 10741 - DNA, 25 bp, Homo sapien
gcatagaacactttcaccactaata

SEQ ID NO: 10742 - DNA, 25 bp, Homo sapien
atagaacactttcaccactaataaa

SEQ ID NO: 10743 - DNA, 25 bp, Homo sapien
tagaacactttcaccactaataaaa

SEQ ID NO: 10744 - DNA, 25 bp, Homo sapien
gaacactttcaccactaataaaaga

SEQ ID NO: 10745 - DNA, 25 bp, Homo sapien
gaaatgcaataagtatctgcatatg

SEQ ID NO: 10746 - DNA, 25 bp, Homo sapien
aaaagatactgaactagggctgggc

SEQ ID NO: 10747 - DNA, 25 bp, Homo sapien
tgaatgacaattcatagatgaggaa

SEQ ID NO: 10748 - DNA, 25 bp, Homo sapien
gaggaaattcaagagccaataaatg

SEQ ID NO: 10749 - DNA, 25 bp, Homo sapien
ggagctgaagctctaagcctacctg

SEQ ID NO: 10750 - DNA, 25 bp, Homo sapien
gaagctctaagcctacctgtgactt

SEQ ID NO: 10751 - DNA, 25 bp, Homo sapien
taagcctacctgtgacttgtctctt

SEQ ID NO: 10752 - DNA, 25 bp, Homo sapien
tacctgtgacttgtctcttttcctt

SEQ ID NO: 10753 - DNA, 25 bp, Homo sapien
attatttgtctgaacccttgaattg

SEQ ID NO: 10754 - DNA, 25 bp, Homo sapien
acccttgaattgagattttaaacat

SEQ ID NO: 10755 - DNA, 25 bp, Homo sapien
aggactgatgtgaacatggcttaga

SEQ ID NO: 10756 - DNA, 25 bp, Homo sapien
acatggcttagatgtttttacaaac

SEQ ID NO: 10757 - DNA, 25 bp, Homo sapien
taccaaagttcttgtgctttctttt

SEQ ID NO: 10758 - DNA, 25 bp, Homo sapien
tttaaagaaaagttgggctgagcgt

SEQ ID NO: 10759 - DNA, 25 bp, Homo sapien
atcacttaaccgcaggaggtccagg

SEQ ID NO: 10760 - DNA, 25 bp, Homo sapien
aaaaaaggtttagtccagatgcagt

SEQ ID NO: 10761 - DNA, 25 bp, Homo sapien
aaaaaggtttagtccagatgcagtg

SEQ ID NO: 10762 - DNA, 25 bp, Homo sapien
aaaaggtttagtccagatgcagtgg

SEQ ID NO: 10763 - DNA, 25 bp, Homo sapien
aaaggtttagtccagatgcagtggc

SEQ ID NO: 10764 - DNA, 25 bp, Homo sapien
aaggtttagtccagatgcagtggct

SEQ ID NO: 10765 - DNA, 25 bp, Homo sapien
tagcaggaccctgtctatgcaaaaa

SEQ ID NO: 10766 - DNA, 25 bp, Homo sapien
cttgagccagggagatcgagattgc

SEQ ID NO: 10767 - DNA, 25 bp, Homo sapien
ttgagccagggagatcgagattgca

SEQ ID NO: 10768 - DNA, 25 bp, Homo sapien
gagccagggagatcgagattgcagt

SEQ ID NO: 10769 - DNA, 25 bp, Homo sapien
cagggagatcgagattgcagtgagt

SEQ ID NO: 10770 - DNA, 25 bp, Homo sapien
ctgatctgaaatgatccacccactt

SEQ ID NO: 10771 - DNA, 25 bp, Homo sapien
caaagtgtctttgccgatataatta

SEQ ID NO: 10772 - DNA, 25 bp, Homo sapien
gtctttgccgatataattaaggatc

SEQ ID NO: 10773 - DNA, 25 bp, Homo sapien
aggtggccccaaaatccaatgacaa

SEQ ID NO: 10774 - DNA, 25 bp, Homo sapien
tataagagaaaggaggtcgggcaca

SEQ ID NO: 10775 - DNA, 25 bp, Homo sapien
gtgagactttgggactacaaaaaat

SEQ ID NO: 10776 - DNA, 25 bp, Homo sapien
gagcgatgagaacccctggaagcca

SEQ ID NO: 10777 - DNA, 25 bp, Homo sapien
gatgagaacccctggaagccatgaa

SEQ ID NO: 10778 - DNA, 25 bp, Homo sapien
aagccatgaagcagggccgagactt

SEQ ID NO: 10779 - DNA, 25 bp, Homo sapien
aagcagggccgagacttgctcagat

SEQ ID NO: 10780 - DNA, 25 bp, Homo sapien
gccgagacttgctcagatgtaccag

SEQ ID NO: 10781 - DNA, 25 bp, Homo sapien
ggaggggctcctgttgaccactcag

SEQ ID NO: 10782 - DNA, 25 bp, Homo sapien
gaccagaggttgatgtgatgtgcac

SEQ ID NO: 10783 - DNA, 25 bp, Homo sapien
accagaggttgatgtgatgtgcact

SEQ ID NO: 10784 - DNA, 25 bp, Homo sapien
gaggttgatgtgatgtgcactgctt

SEQ ID NO: 10785 - DNA, 25 bp, Homo sapien
aggttgatgtgatgtgcactgcttt

SEQ ID NO: 10786 - DNA, 25 bp, Homo sapien
agaaatgaatgcttcttgcaacaca

SEQ ID NO: 10787 - DNA, 25 bp, Homo sapien
aatgaatgcttcttgcaacacaaag

SEQ ID NO: 10788 - DNA, 25 bp, Homo sapien
gaatgcttcttgcaacacaaagatg

SEQ ID NO: 10789 - DNA, 25 bp, Homo sapien
atgcttcttgcaacacaaagatgac

SEQ ID NO: 10790 - DNA, 25 bp, Homo sapien
gcttcttgcaacacaaagatgacaa

SEQ ID NO: 10791 - DNA, 25 bp, Homo sapien
tgcaacacaaagatgacaacccaaa

SEQ ID NO: 10792 - DNA, 25 bp, Homo sapien
acacaaagatgacaacccaaacctc

SEQ ID NO: 10793 - DNA, 25 bp, Homo sapien
gcatgcaccatcataaccagatcat

SEQ ID NO: 10794 - DNA, 25 bp, Homo sapien
gcaccatcataaccagatcattttt

SEQ ID NO: 10795 - DNA, 25 bp, Homo sapien
ccatcataaccagatcattttttgt

SEQ ID NO: 10796 - DNA, 25 bp, Homo sapien
aaaggctttctagaaaaacactgca

SEQ ID NO: 10797 - DNA, 25 bp, Homo sapien
aaatgtgaattttaggagcagtgaa

SEQ ID NO: 10798 - DNA, 25 bp, Homo sapien
gattggatttttgctgattctctaa

SEQ ID NO: 10799 - DNA, 25 bp, Homo sapien
gctgattctctaaaaatagctgtta

SEQ ID NO: 10800 - DNA, 25 bp, Homo sapien
tagctgttagctattccatctacaa

SEQ ID NO: 10801 - DNA, 25 bp, Homo sapien
gctgttagctattccatctacaaca

SEQ ID NO: 10802 - DNA, 25 bp, Homo sapien
tgttagctattccatctacaacaaa

SEQ ID NO: 10803 - DNA, 25 bp, Homo sapien
atatttggtaatttgaggaaggcat

SEQ ID NO: 10804 - DNA, 25 bp, Homo sapien
ttgtagatggaatagctaacagcta

SEQ ID NO: 10805 - DNA, 25 bp, Homo sapien
acagctatttttagagaatcagcaa

SEQ ID NO: 10806 - DNA, 25 bp, Homo sapien
aatccaatctttccaaaaatatctc

SEQ ID NO: 10807 - DNA, 25 bp, Homo sapien
aaaaatatctctttcactgctccta

SEQ ID NO: 10808 - DNA, 25 bp, Homo sapien
atatctctttcactgctcctaaaat

SEQ ID NO: 10809 - DNA, 25 bp, Homo sapien
tctctttcactgctcctaaaattca

SEQ ID NO: 10810 - DNA, 25 bp, Homo sapien
gcagtgtttttctagaaagcctttt

SEQ ID NO: 10811 - DNA, 25 bp, Homo sapien
tgatctggttatgatggtgcatgcc

SEQ ID NO: 10812 - DNA, 25 bp, Homo sapien
tatgccttcctcaaattaccaaata

SEQ ID NO: 10813 - DNA, 25 bp, Homo sapien
gccttcctcaaattaccaaatataa

SEQ ID NO: 10814 - DNA, 25 bp, Homo sapien
aatattcatttgtggtctcatcagg

SEQ ID NO: 10815 - DNA, 25 bp, Homo sapien
ggtgaggagaccctgtcctaaattt

SEQ ID NO: 10816 - DNA, 25 bp, Homo sapien
gtgaggagaccctgtcctaaattta

SEQ ID NO: 10817 - DNA, 25 bp, Homo sapien
gtgagcggtccggaacttgacacac

SEQ ID NO: 10818 - DNA, 25 bp, Homo sapien
agcggtccggaacttgacacactcg

SEQ ID NO: 10819 - DNA, 25 bp, Homo sapien
ggaacttgacacactcggagctgga

SEQ ID NO: 10820 - DNA, 25 bp, Homo sapien
aacttgacacactcggagctggagc

SEQ ID NO: 10821 - DNA, 25 bp, Homo sapien
tgacacactcggagctggagcatct

SEQ ID NO: 10822 - DNA, 25 bp, Homo sapien
acactcggagctggagcatctcaag

SEQ ID NO: 10823 - DNA, 25 bp, Homo sapien
actcggagctggagcatctcaagag

SEQ ID NO: 10824 - DNA, 25 bp, Homo sapien
agctggagcatctcaagaggtggaa

SEQ ID NO: 10825 - DNA, 25 bp, Homo sapien
gggcgcgtcggctaactcctgtaac

SEQ ID NO: 10826 - DNA, 25 bp, Homo sapien
gagcactaacaagatagtattcatt

SEQ ID NO: 10827 - DNA, 25 bp, Homo sapien
gacaaagtgtctaaaaatcaggcca

SEQ ID NO: 10828 - DNA, 25 bp, Homo sapien
aatcaggccatagaaagtacagcta

SEQ ID NO: 10829 - DNA, 25 bp, Homo sapien
ggccatagaaagtacagctagattg

SEQ ID NO: 10830 - DNA, 25 bp, Homo sapien
attgtatacctgtgtcaaaatatca

SEQ ID NO: 10831 - DNA, 25 bp, Homo sapien
gtcaattcaaatgggttattcacct

SEQ ID NO: 10832 - DNA, 25 bp, Homo sapien
aattcaaatgggttattcacctttg

SEQ ID NO: 10833 - DNA, 25 bp, Homo sapien
atgggttattcacctttgaaaagag

SEQ ID NO: 10834 - DNA, 25 bp, Homo sapien
ctttgaaaagaggtgactatagttt

SEQ ID NO: 10835 - DNA, 25 bp, Homo sapien
gacaaacatttaacatgatggatat

SEQ ID NO: 10836 - DNA, 25 bp, Homo sapien
tctttacaaatcacatgaatgtatc

SEQ ID NO: 10837 - DNA, 25 bp, Homo sapien
gccataggaaatttgcagaagccca

SEQ ID NO: 10838 - DNA, 25 bp, Homo sapien
gcccacagcaggcaaatgtctcttg

SEQ ID NO: 10839 - DNA, 25 bp, Homo sapien
atagaaagtagacttctgattccaa

SEQ ID NO: 10840 - DNA, 25 bp, Homo sapien
caaattatcagcaaagtcatgcaga

SEQ ID NO: 10841 - DNA, 25 bp, Homo sapien
gtcatgcagaaaacaggcaactttt

SEQ ID NO: 10842 - DNA, 25 bp, Homo sapien
aaggttttagtctgtgtaaggtgat

SEQ ID NO: 10843 - DNA, 25 bp, Homo sapien
gaggaatattccttctacgggtctg

SEQ ID NO: 10844 - DNA, 25 bp, Homo sapien
tccttctacgggtctgcttagcttt

SEQ ID NO: 10845 - DNA, 25 bp, Homo sapien
ttagctttctcctaaccactgcttt

SEQ ID NO: 10846 - DNA, 25 bp, Homo sapien
tcctaaccactgcttttgatttatc

SEQ ID NO: 10847 - DNA, 25 bp, Homo sapien
gatttatccagttcatcatcttttt

SEQ ID NO: 10848 - DNA, 25 bp, Homo sapien
agaagcctggctgagaacgagctgt

SEQ ID NO: 10849 - DNA, 25 bp, Homo sapien
ccagtcctcccagttctgaaatggg

SEQ ID NO: 10850 - DNA, 25 bp, Homo sapien
agtcatgaggcttaactgagatgtt

SEQ ID NO: 10851 - DNA, 25 bp, Homo sapien
aatcagggatggttgtgcagatgct

SEQ ID NO: 10852 - DNA, 25 bp, Homo sapien
ggttgtgcagatgctagccattact

SEQ ID NO: 10853 - DNA, 25 bp, Homo sapien
gtgcagatgctagccattactaaac

SEQ ID NO: 10854 - DNA, 25 bp, Homo sapien
gatgctagccattactaaacaaggg

SEQ ID NO: 10855 - DNA, 25 bp, Homo sapien
aagggaagtgatcgttgtgtaacaa

SEQ ID NO: 10856 - DNA, 25 bp, Homo sapien
gttgtgtaacaatgatctagattat

SEQ ID NO: 10857 - DNA, 25 bp, Homo sapien
atatttttagatgtcctcagtgtag

SEQ ID NO: 10858 - DNA, 25 bp, Homo sapien
ttagatgtcctcagtgtaggaaagt

SEQ ID NO: 10859 - DNA, 25 bp, Homo sapien
ctcatgtgtaatctttaaagcatat

SEQ ID NO: 10860 - DNA, 25 bp, Homo sapien
gaaaaattactattctcaagtaagg

SEQ ID NO: 10861 - DNA, 25 bp, Homo sapien
gataatgtatatctcaggtcactta

SEQ ID NO: 10862 - DNA, 25 bp, Homo sapien
gtatatctcaggtcacttacagtct

SEQ ID NO: 10863 - DNA, 25 bp, Homo sapien
atctcaggtcacttacagtctcaaa

SEQ ID NO: 10864 - DNA, 25 bp, Homo sapien
ggtcacttacagtctcaaagttttg

SEQ ID NO: 10865 - DNA, 25 bp, Homo sapien
cacttacagtctcaaagttttgtca

SEQ ID NO: 10866 - DNA, 25 bp, Homo sapien
agaatcatgaactcgaggtggcccc

SEQ ID NO: 10867 - DNA, 25 bp, Homo sapien
aatcatgaactcgaggtggccccgg

SEQ ID NO: 10868 - DNA, 25 bp, Homo sapien
ggtcacgcacctgggagcctgttgc

SEQ ID NO: 10869 - DNA, 25 bp, Homo sapien
gagcctgttgctggcacggtccggg

SEQ ID NO: 10870 - DNA, 25 bp, Homo sapien
gtttcaccctaaacctgtgtaatag

SEQ ID NO: 10871 - DNA, 25 bp, Homo sapien
aataggcctgataacagccgcctct

SEQ ID NO: 10872 - DNA, 25 bp, Homo sapien
ttgcacccaggattgctctgaggac

SEQ ID NO: 10873 - DNA, 25 bp, Homo sapien
gactaagatgtttccattgcgcgta

SEQ ID NO: 10874 - DNA, 25 bp, Homo sapien
ttccattgcgcgtaatttgataggt

SEQ ID NO: 10875 - DNA, 25 bp, Homo sapien
gaatacgcgagagagttactttctt

SEQ ID NO: 10876 - DNA, 25 bp, Homo sapien
tcactctccctctatttcaacagat

SEQ ID NO: 10877 - DNA, 25 bp, Homo sapien
aatgctcaacttcgtaccaagctct

SEQ ID NO: 10878 - DNA, 25 bp, Homo sapien
cttcgtaccaagctctgttctagaa

SEQ ID NO: 10879 - DNA, 25 bp, Homo sapien
tatacaaatgaatcagccgggcgtg

SEQ ID NO: 10880 - DNA, 25 bp, Homo sapien
aatttgccgggcgtgattggtgcct

SEQ ID NO: 10881 - DNA, 25 bp, Homo sapien
cattttttaaatgcttaccagtcat

SEQ ID NO: 10882 - DNA, 25 bp, Homo sapien
ttttaaatgcttaccagtcatttgt

SEQ ID NO: 10883 - DNA, 25 bp, Homo sapien
cagcttttgtgaatggacctattca

SEQ ID NO: 10884 - DNA, 25 bp, Homo sapien
gaatggacctattcatcttttgact

SEQ ID NO: 10885 - DNA, 25 bp, Homo sapien
atggacctattcatcttttgacttt

SEQ ID NO: 10886 - DNA, 25 bp, Homo sapien
acctcgtctcccaggagggagcaat

SEQ ID NO: 10887 - DNA, 25 bp, Homo sapien
tcgtctcccaggagggagcaattca

SEQ ID NO: 10888 - DNA, 25 bp, Homo sapien
ccaggagggagcaattcaagcaatt

SEQ ID NO: 10889 - DNA, 25 bp, Homo sapien
ggagggagcaattcaagcaattcaa

SEQ ID NO: 10890 - DNA, 25 bp, Homo sapien
ggagcaattcaagcaattcaagcaa

SEQ ID NO: 10891 - DNA, 25 bp, Homo sapien
caattcaagcaattcaagcaattct

SEQ ID NO: 10892 - DNA, 25 bp, Homo sapien
tcagaccacacttcccactcacgtt

SEQ ID NO: 10893 - DNA, 25 bp, Homo sapien
ttggtgactccaagtactcacacag

SEQ ID NO: 10894 - DNA, 25 bp, Homo sapien
gactccaagtactcacacagtcatc

SEQ ID NO: 10895 - DNA, 25 bp, Homo sapien
actccaagtactcacacagtcatca

SEQ ID NO: 10896 - DNA, 25 bp, Homo sapien
tcttccacaggtcctatgactgcaa

SEQ ID NO: 10897 - DNA, 25 bp, Homo sapien
ttccacaggtcctatgactgcaaca

SEQ ID NO: 10898 - DNA, 25 bp, Homo sapien
tccacaggtcctatgactgcaacat

SEQ ID NO: 10899 - DNA, 25 bp, Homo sapien
ccacaggtcctatgactgcaacatc

SEQ ID NO: 10900 - DNA, 25 bp, Homo sapien
caggtcctatgactgcaacatcctt

SEQ ID NO: 10901 - DNA, 25 bp, Homo sapien
aggtcctatgactgcaacatccttc

SEQ ID NO: 10902 - DNA, 25 bp, Homo sapien
gtcctatgactgcaacatccttcca

SEQ ID NO: 10903 - DNA, 25 bp, Homo sapien
ccacattgtggtctattatatagca

SEQ ID NO: 10904 - DNA, 25 bp, Homo sapien
ggtatagacatggaaaaaacggatc

SEQ ID NO: 10905 - DNA, 25 bp, Homo sapien
aaaacggatcccaagacagtctaca

SEQ ID NO: 10906 - DNA, 25 bp, Homo sapien
ggatcccaagacagtctacatgaaa

SEQ ID NO: 10907 - DNA, 25 bp, Homo sapien
gaagaatatgtgtgatatgccattt

SEQ ID NO: 10908 - DNA, 25 bp, Homo sapien
caaacaaacctcttagatacacaga

SEQ ID NO: 10909 - DNA, 25 bp, Homo sapien
agatacacagaaaactagtcacagt

SEQ ID NO: 10910 - DNA, 25 bp, Homo sapien
ctagtcacagtgattatctctcaaa

SEQ ID NO: 10911 - DNA, 25 bp, Homo sapien
ttgtaatgtttggagtttttagcct

SEQ ID NO: 10912 - DNA, 25 bp, Homo sapien
gagtttttagcctcacagtggattt

SEQ ID NO: 10913 - DNA, 25 bp, Homo sapien
agcctcacagtggatttgataaatt

SEQ ID NO: 10914 - DNA, 25 bp, Homo sapien
ttcatttgcaattcctttaccactg

SEQ ID NO: 10915 - DNA, 25 bp, Homo sapien
tttgcaattcctttaccactgaagt

SEQ ID NO: 10916 - DNA, 25 bp, Homo sapien
accactgaagtaccatatattttta

SEQ ID NO: 10917 - DNA, 25 bp, Homo sapien
tgtccctaaaaaataggtggtctct

SEQ ID NO: 10918 - DNA, 25 bp, Homo sapien
taggtggtctctcagatatgccctt

SEQ ID NO: 10919 - DNA, 25 bp, Homo sapien
aaattagggccattggattttcctg

SEQ ID NO: 10920 - DNA, 25 bp, Homo sapien
gggccattggattttcctgagttaa

SEQ ID NO: 10921 - DNA, 25 bp, Homo sapien
ggattttcctgagttaagtgtgtaa

SEQ ID NO: 10922 - DNA, 25 bp, Homo sapien
gactagaggaattaagggctttgaa

SEQ ID NO: 10923 - DNA, 25 bp, Homo sapien
aatggagacgtttttacagtctaga

SEQ ID NO: 10924 - DNA, 25 bp, Homo sapien
gattgcgccactggaatccgggcct

SEQ ID NO: 10925 - DNA, 25 bp, Homo sapien
gcaacaaatgctgcaaaagtgctag

SEQ ID NO: 10926 - DNA, 25 bp, Homo sapien
agtggtataatttcccatcttcaga

SEQ ID NO: 10927 - DNA, 25 bp, Homo sapien
gtcaagagactattgtgtacacttt

SEQ ID NO: 10928 - DNA, 25 bp, Homo sapien
gtacactttgaacatacagacacca

SEQ ID NO: 10929 - DNA, 25 bp, Homo sapien
gacaccaaaagcatcccaactttag

SEQ ID NO: 10930 - DNA, 25 bp, Homo sapien
aagcatcccaactttagatggtttc

SEQ ID NO: 10931 - DNA, 25 bp, Homo sapien
ttagatggtttctggcagtgcaaca

SEQ ID NO: 10932 - DNA, 25 bp, Homo sapien
tctggcagtgcaacaggctttcttt

SEQ ID NO: 10933 - DNA, 25 bp, Homo sapien
agagctgttttttcagattctgcag

SEQ ID NO: 10934 - DNA, 25 bp, Homo sapien
atcaccttgaaagagtcctccttgg

SEQ ID NO: 10935 - DNA, 25 bp, Homo sapien
gaaagagtcctccttggctgatgtg

SEQ ID NO: 10936 - DNA, 25 bp, Homo sapien
acaaattaccagatgcaggttgcac

SEQ ID NO: 10937 - DNA, 25 bp, Homo sapien
aattaccagatgcaggttgcacaag

SEQ ID NO: 10938 - DNA, 25 bp, Homo sapien
gatgcaggttgcacaaggtccaact

SEQ ID NO: 10939 - DNA, 25 bp, Homo sapien
gcaggttgcacaaggtccaactgaa

SEQ ID NO: 10940 - DNA, 25 bp, Homo sapien
ggttgcacaaggtccaactgaagat

SEQ ID NO: 10941 - DNA, 25 bp, Homo sapien
tgcacaaggtccaactgaagatgaa

SEQ ID NO: 10942 - DNA, 25 bp, Homo sapien
agatgaaagaatgtcatgagtcaaa

SEQ ID NO: 10943 - DNA, 25 bp, Homo sapien
gaataaccctaagcacttaaattca

SEQ ID NO: 10944 - DNA, 25 bp, Homo sapien
taaccctaagcacttaaattcagta

SEQ ID NO: 10945 - DNA, 25 bp, Homo sapien
gaacgtgcagtggagtgactgtatt

SEQ ID NO: 10946 - DNA, 25 bp, Homo sapien
gtggagtgactgtattataaggaaa

SEQ ID NO: 10947 - DNA, 25 bp, Homo sapien
gaaactattcagtggccacatgtac

SEQ ID NO: 10948 - DNA, 25 bp, Homo sapien
tattcagtggccacatgtacccagt

SEQ ID NO: 10949 - DNA, 25 bp, Homo sapien
ttcagtggccacatgtacccagtaa

SEQ ID NO: 10950 - DNA, 25 bp, Homo sapien
gtggccacatgtacccagtaacaga

SEQ ID NO: 10951 - DNA, 25 bp, Homo sapien
tatcccggagctcagcaaaggagtc

SEQ ID NO: 10952 - DNA, 25 bp, Homo sapien
agcaaaggagtccattcatcctcta

SEQ ID NO: 10953 - DNA, 25 bp, Homo sapien
ccattcatcctctataactgctata

SEQ ID NO: 10954 - DNA, 25 bp, Homo sapien
ttcatcctctataactgctatacaa

SEQ ID NO: 10955 - DNA, 25 bp, Homo sapien
ctctataactgctatacaatatctc

SEQ ID NO: 10956 - DNA, 25 bp, Homo sapien
ttaaaatgctgagaagatttatcct

SEQ ID NO: 10957 - DNA, 25 bp, Homo sapien
aagcaatggggttcatcaactcagg

SEQ ID NO: 10958 - DNA, 25 bp, Homo sapien
ggtgattgagaaacacatacttctg

SEQ ID NO: 10959 - DNA, 25 bp, Homo sapien
gaaacacatacttctgattacttaa

SEQ ID NO: 10960 - DNA, 25 bp, Homo sapien
aggcatttcgtactagtttcttgga

SEQ ID NO: 10961 - DNA, 25 bp, Homo sapien
atttcgtactagtttcttggatcac

SEQ ID NO: 10962 - DNA, 25 bp, Homo sapien
tatgggaaaacctagtttccgacag

SEQ ID NO: 10963 - DNA, 25 bp, Homo sapien
taatatgcttggctgaggagtcaat

SEQ ID NO: 10964 - DNA, 25 bp, Homo sapien
ggagtcaatgtcatgctaccacctg

SEQ ID NO: 10965 - DNA, 25 bp, Homo sapien
tcaatgtcatgctaccacctgtggg

SEQ ID NO: 10966 - DNA, 25 bp, Homo sapien
taccacctgtgggtttaacactcaa

SEQ ID NO: 10967 - DNA, 25 bp, Homo sapien
tgtgggtttaacactcaacacgtta

SEQ ID NO: 10968 - DNA, 25 bp, Homo sapien
gtcaaatttccctaaattgctatgg

SEQ ID NO: 10969 - DNA, 25 bp, Homo sapien
ggaccgtgccagcaacaggctccca

SEQ ID NO: 10970 - DNA, 25 bp, Homo sapien
gcaacaggctcccaggtgcgtgacc

SEQ ID NO: 10971 - DNA, 25 bp, Homo sapien
tctgttcgcaggattgttttaaagt

SEQ ID NO: 10972 - DNA, 25 bp, Homo sapien
tcgcaggattgttttaaagtatact

SEQ ID NO: 10973 - DNA, 25 bp, Homo sapien
gtgacctgagatatacattatcctt

SEQ ID NO: 10974 - DNA, 25 bp, Homo sapien
atatgctttaaagattacacatgag

SEQ ID NO: 10975 - DNA, 25 bp, Homo sapien
tccaataatgaactccaataaggaa

SEQ ID NO: 10976 - DNA, 25 bp, Homo sapien
atggttacagaaaatcagagcattt

SEQ ID NO: 10977 - DNA, 25 bp, Homo sapien
tcagagcatttttttcctatccact

SEQ ID NO: 10978 - DNA, 25 bp, Homo sapien
ttttcctatccactaatggtcaaga

SEQ ID NO: 10979 - DNA, 25 bp, Homo sapien
tcctatccactaatggtcaagaaga

SEQ ID NO: 10980 - DNA, 25 bp, Homo sapien
gagtagacatacaggccaggtctca

SEQ ID NO: 10981 - DNA, 25 bp, Homo sapien
aggccaggtctcacatgtaaagcat

SEQ ID NO: 10982 - DNA, 25 bp, Homo sapien
gtaaagcatcagaacacctttagaa

SEQ ID NO: 10983 - DNA, 25 bp, Homo sapien
gcaagcagcacctctctgtttcttg

SEQ ID NO: 10984 - DNA, 25 bp, Homo sapien
tcattttctttcaggaccttctgct

SEQ ID NO: 10985 - DNA, 25 bp, Homo sapien
caaaggtggtatgcaatcagaagac

SEQ ID NO: 10986 - DNA, 25 bp, Homo sapien
ggagacaagtatgcatctcccacca

SEQ ID NO: 10987 - DNA, 25 bp, Homo sapien
cttggagtaaaaacagtcctccctg

SEQ ID NO: 10988 - DNA, 25 bp, Homo sapien
ctgttcctacccacgaatgtattat

SEQ ID NO: 10989 - DNA, 25 bp, Homo sapien
aataaagattgctgccaggcatggt

SEQ ID NO: 10990 - DNA, 25 bp, Homo sapien
ggaagtccaggcaacagtaagccat

SEQ ID NO: 10991 - DNA, 25 bp, Homo sapien
agacagactagatggctgatcaaga

SEQ ID NO: 10992 - DNA, 25 bp, Homo sapien
actagatggctgatcaagaaggaga

SEQ ID NO: 10993 - DNA, 25 bp, Homo sapien
agccactttctggtgcttggagtta

SEQ ID NO: 10994 - DNA, 25 bp, Homo sapien
gagtgaagatgccactctcctgtgc

SEQ ID NO: 10995 - DNA, 25 bp, Homo sapien
tcctgtgcctgccagtattgggtcc

SEQ ID NO: 10996 - DNA, 25 bp, Homo sapien
agtattgggtcctgggtcatcacat

SEQ ID NO: 10997 - DNA, 25 bp, Homo sapien
tcctgggtcatcacatgctgggtgc

SEQ ID NO: 10998 - DNA, 25 bp, Homo sapien
ctttgaatcgaggtggccaaggttt

SEQ ID NO: 10999 - DNA, 25 bp, Homo sapien
ccaaggtttgctgtgggaggcccag

SEQ ID NO: 11000 - DNA, 25 bp, Homo sapien
ggcccagggagctcccgtctgtgtc

SEQ ID NO: 11001 - DNA, 25 bp, Homo sapien
tgacagtaactctcacgagatctga

SEQ ID NO: 11002 - DNA, 25 bp, Homo sapien
agctgggactttaggcctgtatgat

SEQ ID NO: 11003 - DNA, 25 bp, Homo sapien
aggcctgtatgatttctaactgtga

SEQ ID NO: 11004 - DNA, 25 bp, Homo sapien
gtatgatttctaactgtgatgtgat

SEQ ID NO: 11005 - DNA, 25 bp, Homo sapien
gagagggtgaattttggtgcctgca

SEQ ID NO: 11006 - DNA, 25 bp, Homo sapien
tgcaaagcagcctggcctcgcgtga

SEQ ID NO: 11007 - DNA, 25 bp, Homo sapien
ctggcctcgcgtgatgccaaagcaa

SEQ ID NO: 11008 - DNA, 25 bp, Homo sapien
ggcagatggaatctggcttgcatct

SEQ ID NO: 11009 - DNA, 25 bp, Homo sapien
gagtgggactcctgagaccctgctg

SEQ ID NO: 11010 - DNA, 25 bp, Homo sapien
tcctgagaccctgctgtgggatgag

SEQ ID NO: 11011 - DNA, 25 bp, Homo sapien
ggtagacaggaagcacagaccctca

SEQ ID NO: 11012 - DNA, 25 bp, Homo sapien
agacaggaagcacagaccctcagcc

SEQ ID NO: 11013 - DNA, 25 bp, Homo sapien
tggtcctcatcgagggcggtgagat

SEQ ID NO: 11014 - DNA, 25 bp, Homo sapien
gagatgactgaggaccctcagacct

SEQ ID NO: 11015 - DNA, 25 bp, Homo sapien
agacctcagtctccgtatctgggaa

SEQ ID NO: 11016 - DNA, 25 bp, Homo sapien
cagtctccgtatctgggaaacgggt

SEQ ID NO: 11017 - DNA, 25 bp, Homo sapien
ctgggaaacgggtagagatatctga

SEQ ID NO: 11018 - DNA, 25 bp, Homo sapien
agagatatctgatgtggagtctgag

SEQ ID NO: 11019 - DNA, 25 bp, Homo sapien
ggatccaccaggcttaggttcatgt

SEQ ID NO: 11020 - DNA, 25 bp, Homo sapien
ggcttaggttcatgttcaggcccag

SEQ ID NO: 11021 - DNA, 25 bp, Homo sapien
atggccccagtgaccccgaggaagc

SEQ ID NO: 11022 - DNA, 25 bp, Homo sapien
gaggaagccactgtacctttctgta

SEQ ID NO: 11023 - DNA, 25 bp, Homo sapien
gcccatctcatagaattgtcatgac

SEQ ID NO: 11024 - DNA, 25 bp, Homo sapien
ttcagtaaacacactggaacattta

SEQ ID NO: 11025 - DNA, 25 bp, Homo sapien
aaataggtaagtggcatggcctaga

SEQ ID NO: 11026 - DNA, 25 bp, Homo sapien
tggcatggcctagaaacactgaaaa

SEQ ID NO: 11027 - DNA, 25 bp, Homo sapien
tataaaacgttaatgcagagctggg

SEQ ID NO: 11028 - DNA, 25 bp, Homo sapien
aaacgttaatgcagagctgggcgtg

SEQ ID NO: 11029 - DNA, 25 bp, Homo sapien
ccccacgtgtacaatcggacatatg

SEQ ID NO: 11030 - DNA, 25 bp, Homo sapien
cacgtgtacaatcggacatatgcaa

SEQ ID NO: 11031 - DNA, 25 bp, Homo sapien
tacaatcggacatatgcaatacata

SEQ ID NO: 11032 - DNA, 25 bp, Homo sapien
atacatacaatacagctgacccttg

SEQ ID NO: 11033 - DNA, 25 bp, Homo sapien
ttgaaccaccttggtctatttaaat

SEQ ID NO: 11034 - DNA, 25 bp, Homo sapien
ccttggtctatttaaatacagattt

SEQ ID NO: 11035 - DNA, 25 bp, Homo sapien
gggaggaaatcctgctcgagcgcac

SEQ ID NO: 11036 - DNA, 25 bp, Homo sapien
gagcgcacctgttttccaggatgat

SEQ ID NO: 11037 - DNA, 25 bp, Homo sapien
ccaggatgatatgtcgcttttataa

SEQ ID NO: 11038 - DNA, 25 bp, Homo sapien
aatggctgcaggtccctttgagaaa

SEQ ID NO: 11039 - DNA, 25 bp, Homo sapien
tgcagcagtggtgcaaggtccttcc

SEQ ID NO: 11040 - DNA, 25 bp, Homo sapien
tagcctccctttccatcatgggact

SEQ ID NO: 11041 - DNA, 25 bp, Homo sapien
cggcggtgacttaggtctggaaact

SEQ ID NO: 11042 - DNA, 25 bp, Homo sapien
tctggaaactgggttcgaggctgta

SEQ ID NO: 11043 - DNA, 25 bp, Homo sapien
ggttcgaggctgtaacaccactggg

SEQ ID NO: 11044 - DNA, 25 bp, Homo sapien
tacaagtcaggaattgcggcggagt

SEQ ID NO: 11045 - DNA, 25 bp, Homo sapien
catggcgaaaaaccgcctctacaaa

SEQ ID NO: 11046 - DNA, 25 bp, Homo sapien
gtagctcaccgtgacgaagctgcgt

SEQ ID NO: 11047 - DNA, 25 bp, Homo sapien
tagctcaccgtgacgaagctgcgtt

SEQ ID NO: 11048 - DNA, 25 bp, Homo sapien
gctcaccgtgacgaagctgcgtttg

SEQ ID NO: 11049 - DNA, 25 bp, Homo sapien
tcaccgtgacgaagctgcgtttgct

SEQ ID NO: 11050 - DNA, 25 bp, Homo sapien
ggacatattgggagaaggcccccca

SEQ ID NO: 11051 - DNA, 25 bp, Homo sapien
gagaaggccccccaaaatctggcca

SEQ ID NO: 11052 - DNA, 25 bp, Homo sapien
ttgggtttaccggaatgaaggcaag

SEQ ID NO: 11053 - DNA, 25 bp, Homo sapien
ggcattcttaaaccacaaacagtag

SEQ ID NO: 11054 - DNA, 25 bp, Homo sapien
attcttaaaccacaaacagtagcat

SEQ ID NO: 11055 - DNA, 25 bp, Homo sapien
gacccacccctttatttcaggccat

SEQ ID NO: 11056 - DNA, 25 bp, Homo sapien
ctttatttcaggccatcccttcatt

SEQ ID NO: 11057 - DNA, 25 bp, Homo sapien
taaagccttcaggtgacacagagag

SEQ ID NO: 11058 - DNA, 25 bp, Homo sapien
gaacacagcacacaggtgggctagt

SEQ ID NO: 11059 - DNA, 25 bp, Homo sapien
ggtgggctagtgactctcagaccaa

SEQ ID NO: 11060 - DNA, 25 bp, Homo sapien
tcagaccaagattcagcacacatgt

SEQ ID NO: 11061 - DNA, 25 bp, Homo sapien
agcacacatgtgaggctgtaactgc

SEQ ID NO: 11062 - DNA, 25 bp, Homo sapien
gaggctgtaactgcactgaaaggac

SEQ ID NO: 11063 - DNA, 25 bp, Homo sapien
ataaactgtggctgtcttgcaaaaa

SEQ ID NO: 11064 - DNA, 25 bp, Homo sapien
aaccattgagactgtgactcacaca

SEQ ID NO: 11065 - DNA, 25 bp, Homo sapien
gactcacacacttagatccaacatc

SEQ ID NO: 11066 - DNA, 25 bp, Homo sapien
gatccaacatccaaggctgggcgca

SEQ ID NO: 11067 - DNA, 25 bp, Homo sapien
aatagatccaacatccaggaggtgt

SEQ ID NO: 11068 - DNA, 25 bp, Homo sapien
gaggagcttgcctagagtcagtcca

SEQ ID NO: 11069 - DNA, 25 bp, Homo sapien
tcagtccaggagaggtgcacgcagc

SEQ ID NO: 11070 - DNA, 25 bp, Homo sapien
aggagaggtgcacgcagcctcccat

SEQ ID NO: 11071 - DNA, 25 bp, Homo sapien
cccatcccaggattcatgttttcat

SEQ ID NO: 11072 - DNA, 25 bp, Homo sapien
tgttttcatggtaatcagtggtaag

SEQ ID NO: 11073 - DNA, 25 bp, Homo sapien
gtaagaaatctaattgcatctggaa

SEQ ID NO: 11074 - DNA, 25 bp, Homo sapien
gcatctggaaagaatcctcttgagg

SEQ ID NO: 11075 - DNA, 25 bp, Homo sapien
tctaatttcagactgtacaacacag

SEQ ID NO: 11076 - DNA, 25 bp, Homo sapien
gagaaacagttccaacatgacttaa

SEQ ID NO: 11077 - DNA, 25 bp, Homo sapien
ataaatacactgactgggctgggtg

SEQ ID NO: 11078 - DNA, 25 bp, Homo sapien
caacggattgagaccatctaggcca

SEQ ID NO: 11079 - DNA, 25 bp, Homo sapien
aaagcagctgggataagtaaaacaa

SEQ ID NO: 11080 - DNA, 25 bp, Homo sapien
aacaaacaacatcaataattaccta

SEQ ID NO: 11081 - DNA, 25 bp, Homo sapien
atcaatagactaaatgccaattaaa

SEQ ID NO: 11082 - DNA, 25 bp, Homo sapien
taaaaggcataaatgtcaggataaa

SEQ ID NO: 11083 - DNA, 25 bp, Homo sapien
aaaaagctaactgtttgtggatata

SEQ ID NO: 11084 - DNA, 25 bp, Homo sapien
aagctaactgtttgtggatataaac

SEQ ID NO: 11085 - DNA, 25 bp, Homo sapien
atatgataagaaagacctacaaggt

SEQ ID NO: 11086 - DNA, 25 bp, Homo sapien
gacctacaaggtgaattgtttgcat

SEQ ID NO: 11087 - DNA, 25 bp, Homo sapien
gaattgtttgcataaataagctcac

SEQ ID NO: 11088 - DNA, 25 bp, Homo sapien
gtttgcataaataagctcacagagg

SEQ ID NO: 11089 - DNA, 25 bp, Homo sapien
gcataaataagctcacagaggctgg

SEQ ID NO: 11090 - DNA, 25 bp, Homo sapien
ttccaggccggacgcgttggctcat

SEQ ID NO: 11091 - DNA, 25 bp, Homo sapien
atttccatgggctgttaaatgcagt

SEQ ID NO: 11092 - DNA, 25 bp, Homo sapien
atagtagcttttaaattgcacacat

SEQ ID NO: 11093 - DNA, 25 bp, Homo sapien
acatatgtcagaggtgcagagcagg

SEQ ID NO: 11094 - DNA, 25 bp, Homo sapien
cagagcagggaggacttctgatgct

SEQ ID NO: 11095 - DNA, 25 bp, Homo sapien
tgatgcttctcacacttgccaagat

SEQ ID NO: 11096 - DNA, 25 bp, Homo sapien
gcttctcacacttgccaagatggtg

SEQ ID NO: 11097 - DNA, 25 bp, Homo sapien
gatggtgtctctctgctttggatct

SEQ ID NO: 11098 - DNA, 25 bp, Homo sapien
gtgtctctctgctttggatcttttc

SEQ ID NO: 11099 - DNA, 25 bp, Homo sapien
ggatcttttccttcaatttctatat

SEQ ID NO: 11100 - DNA, 25 bp, Homo sapien
agaattgattccaggccggacgcgt

SEQ ID NO: 11101 - DNA, 25 bp, Homo sapien
aggtaggccgttgttaatcctagca

SEQ ID NO: 11102 - DNA, 25 bp, Homo sapien
taggccgttgttaatcctagcactt

SEQ ID NO: 11103 - DNA, 25 bp, Homo sapien
attatttggttacggtggcatgcac

SEQ ID NO: 11104 - DNA, 25 bp, Homo sapien
aaaactcttaatattgtaggattag

SEQ ID NO: 11105 - DNA, 25 bp, Homo sapien
ggattagatggttatttccttaaca

SEQ ID NO: 11106 - DNA, 25 bp, Homo sapien
ggttatttccttaacataacatgac

SEQ ID NO: 11107 - DNA, 25 bp, Homo sapien
catgacaaaatatgtctcaactcaa

SEQ ID NO: 11108 - DNA, 25 bp, Homo sapien
agccaacttgatacttaatagggaa

SEQ ID NO: 11109 - DNA, 25 bp, Homo sapien
gaaaaagcgtaagcattcctgttaa

SEQ ID NO: 11110 - DNA, 25 bp, Homo sapien
gcgtaagcattcctgttaatgtcag

SEQ ID NO: 11111 - DNA, 25 bp, Homo sapien
attcctgttaatgtcaggacctgga

SEQ ID NO: 11112 - DNA, 25 bp, Homo sapien
aaacaagcccctggagcagtctgtg

SEQ ID NO: 11113 - DNA, 25 bp, Homo sapien
caagcccctggagcagtctgtggaa

SEQ ID NO: 11114 - DNA, 25 bp, Homo sapien
gagcagtctgtggaagacctcagca

SEQ ID NO: 11115 - DNA, 25 bp, Homo sapien
aaaagccgccacctgaccatcaagt

SEQ ID NO: 11116 - DNA, 25 bp, Homo sapien
acctgaccatcaagtatgtgggcca

SEQ ID NO: 11117 - DNA, 25 bp, Homo sapien
gaccatcaagtatgtgggccacaaa

SEQ ID NO: 11118 - DNA, 25 bp, Homo sapien
agccatgcattaggggtccgagtaa

SEQ ID NO: 11119 - DNA, 25 bp, Homo sapien
gtccgagtaagggactcatacagag

SEQ ID NO: 11120 - DNA, 25 bp, Homo sapien
ctcatacagagtttgggacaccagt

SEQ ID NO: 11121 - DNA, 25 bp, Homo sapien
ggacaccagtatgttaagaagccat

SEQ ID NO: 11122 - DNA, 25 bp, Homo sapien
ccagtatgttaagaagccatcaggg

SEQ ID NO: 11123 - DNA, 25 bp, Homo sapien
tagaatgggtaggacttgctaacat

SEQ ID NO: 11124 - DNA, 25 bp, Homo sapien
gggtaggacttgctaacataataaa

SEQ ID NO: 11125 - DNA, 25 bp, Homo sapien
gtttctgttttcaacctggatccta

SEQ ID NO: 11126 - DNA, 25 bp, Homo sapien
gttttcaacctggatcctattggta

SEQ ID NO: 11127 - DNA, 25 bp, Homo sapien
caacctggatcctattggtattact

SEQ ID NO: 11128 - DNA, 25 bp, Homo sapien
gatcctattggtattactaacgtcc

SEQ ID NO: 11129 - DNA, 25 bp, Homo sapien
gtattactaacgtcccaataacagg

SEQ ID NO: 11130 - DNA, 25 bp, Homo sapien
taacgtcccaataacaggaatagga

SEQ ID NO: 11131 - DNA, 25 bp, Homo sapien
tttgatagaatggtgaaggcagccg

SEQ ID NO: 11132 - DNA, 25 bp, Homo sapien
caggcgtggtagtcgtcccctgtta

SEQ ID NO: 11133 - DNA, 25 bp, Homo sapien
ggtagtcgtcccctgttaataccag

SEQ ID NO: 11134 - DNA, 25 bp, Homo sapien
acatggtgaaaagccgtctttcaaa

SEQ ID NO: 11135 - DNA, 25 bp, Homo sapien
tgaaaagccgtctttcaaaaacata

SEQ ID NO: 11136 - DNA, 25 bp, Homo sapien
ggtacgcacttatggttctagctac

SEQ ID NO: 11137 - DNA, 25 bp, Homo sapien
tacgcacttatggttctagctactc

SEQ ID NO: 11138 - DNA, 25 bp, Homo sapien
gatgacaccactgtaactgtactca

SEQ ID NO: 11139 - DNA, 25 bp, Homo sapien
tatcactgtccttctcactatgttg

SEQ ID NO: 11140 - DNA, 25 bp, Homo sapien
cactgtccttctcactatgttgtgc

SEQ ID NO: 11141 - DNA, 25 bp, Homo sapien
gatggaaggcttcttgtttctactt

SEQ ID NO: 11142 - DNA, 25 bp, Homo sapien
gtattattttttgcagtcaaaacaa

SEQ ID NO: 11143 - DNA, 25 bp, Homo sapien
tataaacggtaacttaatggcaact

SEQ ID NO: 11144 - DNA, 25 bp, Homo sapien
cggtaacttaatggcaactaagtat

SEQ ID NO: 11145 - DNA, 25 bp, Homo sapien
cagacagcccgggaaatgaagaaga

SEQ ID NO: 11146 - DNA, 25 bp, Homo sapien
ggctgagagacgcaagccgctcaaa

SEQ ID NO: 11147 - DNA, 25 bp, Homo sapien
agacgcaagccgctcaaacatcgat

SEQ ID NO: 11148 - DNA, 25 bp, Homo sapien
gctcaaacatcgatcaccttggtga

SEQ ID NO: 11149 - DNA, 25 bp, Homo sapien
atcaccttggtgaagacaaactgag

SEQ ID NO: 11150 - DNA, 25 bp, Homo sapien
gggagaccccacaatcctgtcaggg

SEQ ID NO: 11151 - DNA, 25 bp, Homo sapien
gtggagagaccatcccgggcgtccc

SEQ ID NO: 11152 - DNA, 25 bp, Homo sapien
ggcgtccccgcgtctgtgtccttgg

SEQ ID NO: 11153 - DNA, 25 bp, Homo sapien
tgtgtccttggctgcttcatcccct

SEQ ID NO: 11154 - DNA, 25 bp, Homo sapien
ttctcacactcgacccgcagaaacc

SEQ ID NO: 11155 - DNA, 25 bp, Homo sapien
gcagaaaccacccaccttcaccatg

SEQ ID NO: 11156 - DNA, 25 bp, Homo sapien
attcattgatgtaccccaaacacct

SEQ ID NO: 11157 - DNA, 25 bp, Homo sapien
aggtgctcaacatatatttgtggaa

SEQ ID NO: 11158 - DNA, 25 bp, Homo sapien
gatccggatgctagtattgtcagta

SEQ ID NO: 11159 - DNA, 25 bp, Homo sapien
ttgtcagtaactggcagagtacttg

SEQ ID NO: 11160 - DNA, 25 bp, Homo sapien
gagtacttgtatgctaatcgtggaa

SEQ ID NO: 11161 - DNA, 25 bp, Homo sapien
atcgtggaacttgatgctaaggccc

SEQ ID NO: 11162 - DNA, 25 bp, Homo sapien
tgctaaggcccagcttaaaattcct

SEQ ID NO: 11163 - DNA, 25 bp, Homo sapien
atgacttcttcattatgatggttac

SEQ ID NO: 11164 - DNA, 25 bp, Homo sapien
tgatggttacattagtgcactttga

SEQ ID NO: 11165 - DNA, 25 bp, Homo sapien
gcactttgaaacagcactagaggct

SEQ ID NO: 11166 - DNA, 25 bp, Homo sapien
taattctagctcttgggagacagag

SEQ ID NO: 11167 - DNA, 25 bp, Homo sapien
gaagagtgcttaaggttgaagtaca

SEQ ID NO: 11168 - DNA, 25 bp, Homo sapien
gcttaaggttgaagtacaatggcac

SEQ ID NO: 11169 - DNA, 25 bp, Homo sapien
ttaaggttgaagtacaatggcacaa

SEQ ID NO: 11170 - DNA, 25 bp, Homo sapien
tttaaatagctgcagtaatcccggc

SEQ ID NO: 11171 - DNA, 25 bp, Homo sapien
taaatagctgcagtaatcccggctt

SEQ ID NO: 11172 - DNA, 25 bp, Homo sapien
aaatagctgcagtaatcccggcttt

SEQ ID NO: 11173 - DNA, 25 bp, Homo sapien
aatagctgcagtaatcccggcttta

SEQ ID NO: 11174 - DNA, 25 bp, Homo sapien
atagctgcagtaatcccggctttag

SEQ ID NO: 11175 - DNA, 25 bp, Homo sapien
tagctgcagtaatcccggctttaga

SEQ ID NO: 11176 - DNA, 25 bp, Homo sapien
agctgcagtaatcccggctttagat

SEQ ID NO: 11177 - DNA, 25 bp, Homo sapien
gaactaataatatcactagtgttca

SEQ ID NO: 11178 - DNA, 25 bp, Homo sapien
tcctcccactacagtgattccagat

SEQ ID NO: 11179 - DNA, 25 bp, Homo sapien
agtgattccagatctcccagcaggc

SEQ ID NO: 11180 - DNA, 25 bp, Homo sapien
tgagccccaagcaccgagacgaagg

SEQ ID NO: 11181 - DNA, 25 bp, Homo sapien
agcaccgagacgaagggcgaaagac

SEQ ID NO: 11182 - DNA, 25 bp, Homo sapien
cggtccagcggaagccggtcgcctt

SEQ ID NO: 11183 - DNA, 25 bp, Homo sapien
ccgggagtgcttaggccagttgctg

SEQ ID NO: 11184 - DNA, 25 bp, Homo sapien
aggtctgattctgggtcccggagga

SEQ ID NO: 11185 - DNA, 25 bp, Homo sapien
agacggcacagatctcgaagctcca

SEQ ID NO: 11186 - DNA, 25 bp, Homo sapien
gatctcgaagctccaagtgcaaaag

SEQ ID NO: 11187 - DNA, 25 bp, Homo sapien
aagaagaggcctcacacagagtccc

SEQ ID NO: 11188 - DNA, 25 bp, Homo sapien
agagtccccaggccggaggtctcat

SEQ ID NO: 11189 - DNA, 25 bp, Homo sapien
ggggcatcttcggtcttacactttt

SEQ ID NO: 11190 - DNA, 25 bp, Homo sapien
cccttcagtaatcttccttcaagtt

SEQ ID NO: 11191 - DNA, 25 bp, Homo sapien
aatcttccttcaagtttacagtgac

SEQ ID NO: 11192 - DNA, 25 bp, Homo sapien
tttacagtgacagccaaagtaccgt

SEQ ID NO: 11193 - DNA, 25 bp, Homo sapien
agtgacagccaaagtaccgttcatg

SEQ ID NO: 11194 - DNA, 25 bp, Homo sapien
ccaaagtaccgttcatggcatacaa

SEQ ID NO: 11195 - DNA, 25 bp, Homo sapien
taccgttcatggcatacaagagagt

SEQ ID NO: 11196 - DNA, 25 bp, Homo sapien
caagagagtgcacaatctttttgtt

SEQ ID NO: 11197 - DNA, 25 bp, Homo sapien
cacagatatctgcatgattttaaga

SEQ ID NO: 11198 - DNA, 25 bp, Homo sapien
tctgcatgattttaagatactccat

SEQ ID NO: 11199 - DNA, 25 bp, Homo sapien
ttaagatactccatgttaaactatc

SEQ ID NO: 11200 - DNA, 25 bp, Homo sapien
gaaaatcttggttcgtttccactga

SEQ ID NO: 11201 - DNA, 25 bp, Homo sapien
tccactgaatgtctcttgggcacat

SEQ ID NO: 11202 - DNA, 25 bp, Homo sapien
gccactgctctaaacctggaggaca

SEQ ID NO: 11203 - DNA, 25 bp, Homo sapien
actgatgccctggattcggtgtctc

SEQ ID NO: 11204 - DNA, 25 bp, Homo sapien
tgtatatccttcctaccagagccag

SEQ ID NO: 11205 - DNA, 25 bp, Homo sapien
accagagccagattagctttcctaa

SEQ ID NO: 11206 - DNA, 25 bp, Homo sapien
agctttcctaataaccatctttctc

SEQ ID NO: 11207 - DNA, 25 bp, Homo sapien
ttctcttgctcaaaacctcacatgg

SEQ ID NO: 11208 - DNA, 25 bp, Homo sapien
aacctcacatggcttcttatttgct

SEQ ID NO: 11209 - DNA, 25 bp, Homo sapien
gaggccatatccttttaaggtcctt

SEQ ID NO: 11210 - DNA, 25 bp, Homo sapien
atccttttaagaagctatggccggg

SEQ ID NO: 11211 - DNA, 25 bp, Homo sapien
gggttcaagtgatcattccaccttg

SEQ ID NO: 11212 - DNA, 25 bp, Homo sapien
catgaaccaccgtggccaggtgcct

SEQ ID NO: 11213 - DNA, 25 bp, Homo sapien
atgaaccaccgtggccaggtgcctt

SEQ ID NO: 11214 - DNA, 25 bp, Homo sapien
tgaaccaccgtggccaggtgccttt

SEQ ID NO: 11215 - DNA, 25 bp, Homo sapien
gaaccaccgtggccaggtgcctttt

SEQ ID NO: 11216 - DNA, 25 bp, Homo sapien
gctgaggtagtagagtcgcctgaac

SEQ ID NO: 11217 - DNA, 25 bp, Homo sapien
ctgaggtagtagagtcgcctgaacc

SEQ ID NO: 11218 - DNA, 25 bp, Homo sapien
tgaggtagtagagtcgcctgaacct

SEQ ID NO: 11219 - DNA, 25 bp, Homo sapien
gaggtagtagagtcgcctgaacctg

SEQ ID NO: 11220 - DNA, 25 bp, Homo sapien
aggtagtagagtcgcctgaacctgg

SEQ ID NO: 11221 - DNA, 25 bp, Homo sapien
ggtagtagagtcgcctgaacctggg

SEQ ID NO: 11222 - DNA, 25 bp, Homo sapien
atatcctttaggttctcagcatagt

SEQ ID NO: 11223 - DNA, 25 bp, Homo sapien
gttctcagcatagtgatggtgcttt

SEQ ID NO: 11224 - DNA, 25 bp, Homo sapien
agagataactctatgcaaagcagat

SEQ ID NO: 11225 - DNA, 25 bp, Homo sapien
aggaaaaggtccctcctttgcagag

SEQ ID NO: 11226 - DNA, 25 bp, Homo sapien
ggtccctcctttgcagaggcaaaag

SEQ ID NO: 11227 - DNA, 25 bp, Homo sapien
aatccacttcctcaaggatctgtag

SEQ ID NO: 11228 - DNA, 25 bp, Homo sapien
gaataggacctattaagccagcagg

SEQ ID NO: 11229 - DNA, 25 bp, Homo sapien
ctattaagccagcaggacctgtcac

SEQ ID NO: 11230 - DNA, 25 bp, Homo sapien
aggacctgtcacagctgtaccctgt

SEQ ID NO: 11231 - DNA, 25 bp, Homo sapien
agctgtaccctgtgatgataaaata

SEQ ID NO: 11232 - DNA, 25 bp, Homo sapien
gaagatctgggccaattaagccaga

SEQ ID NO: 11233 - DNA, 25 bp, Homo sapien
gcctcttcttgcctattagatggac

SEQ ID NO: 11234 - DNA, 25 bp, Homo sapien
cttcttgcctattagatggacaaag

SEQ ID NO: 11235 - DNA, 25 bp, Homo sapien
gacaaagagttgatgctcaagttga

SEQ ID NO: 11236 - DNA, 25 bp, Homo sapien
tcaagttgatggttgagtcaggact

SEQ ID NO: 11237 - DNA, 25 bp, Homo sapien
ttgagtcaggacttggctaggatgt

SEQ ID NO: 11238 - DNA, 25 bp, Homo sapien
cactcctctgctgttgggaatggaa

SEQ ID NO: 11239 - DNA, 25 bp, Homo sapien
gcaaatgtgaactgcgggcatccct

SEQ ID NO: 11240 - DNA, 25 bp, Homo sapien
tcaagcccgcagttccatatgttgg

SEQ ID NO: 11241 - DNA, 25 bp, Homo sapien
agcccgcagttccatatgttggcag

SEQ ID NO: 11242 - DNA, 25 bp, Homo sapien
atatgttggcagcttcttagggact

SEQ ID NO: 11243 - DNA, 25 bp, Homo sapien
gaaaatcacataaacaggccaggca

SEQ ID NO: 11244 - DNA, 25 bp, Homo sapien
acctgtcacattgctgtctcctggg

SEQ ID NO: 11245 - DNA, 25 bp, Homo sapien
gggcagcttcttggcgtctccttgt

SEQ ID NO: 11246 - DNA, 25 bp, Homo sapien
tggcgtctccttgttgccttctcag

SEQ ID NO: 11247 - DNA, 25 bp, Homo sapien
acacacacgcggtcacctgactttg

SEQ ID NO: 11248 - DNA, 25 bp, Homo sapien
acacgcggtcacctgactttgctca

SEQ ID NO: 11249 - DNA, 25 bp, Homo sapien
gttgggtgggtatttccttctacag

SEQ ID NO: 11250 - DNA, 25 bp, Homo sapien
gtgggtatttccttctacagggtca

SEQ ID NO: 11251 - DNA, 25 bp, Homo sapien
tatttccttctacagggtcactggg

SEQ ID NO: 11252 - DNA, 25 bp, Homo sapien
gtgtcctgtgcaccttcgctgcatg

SEQ ID NO: 11253 - DNA, 25 bp, Homo sapien
tgtgcaccttcgctgcatgccctgt

SEQ ID NO: 11254 - DNA, 25 bp, Homo sapien
ggcctcacctgtcacattgctgtct

SEQ ID NO: 11255 - DNA, 25 bp, Homo sapien
gcaaatgtctatccagttaagtcac

SEQ ID NO: 11256 - DNA, 25 bp, Homo sapien
tctatccagttaagtcacatgccct

SEQ ID NO: 11257 - DNA, 25 bp, Homo sapien
tcacatgccctgtgtttattcttct

SEQ ID NO: 11258 - DNA, 25 bp, Homo sapien
aagtactagtggttctgtctacagg

SEQ ID NO: 11259 - DNA, 25 bp, Homo sapien
gttctgtctacagggattattgtgt

SEQ ID NO: 11260 - DNA, 25 bp, Homo sapien
gattattgtgtttgttgagcttgga

SEQ ID NO: 11261 - DNA, 25 bp, Homo sapien
gcttggagggaaattccccctgtgt

SEQ ID NO: 11262 - DNA, 25 bp, Homo sapien
tattttcttttgcatatccattaga

SEQ ID NO: 11263 - DNA, 25 bp, Homo sapien
gatagtcaaagtgttctgaactgga

SEQ ID NO: 11264 - DNA, 25 bp, Homo sapien
aactggaggtacaaacacattcatg

SEQ ID NO: 11265 - DNA, 25 bp, Homo sapien
gaaaatacctccctgagcctgggag

SEQ ID NO: 11266 - DNA, 25 bp, Homo sapien
tgcagccacattatctcagcttgag

SEQ ID NO: 11267 - DNA, 25 bp, Homo sapien
tcagcttgagtcctagttttcacca

SEQ ID NO: 11268 - DNA, 25 bp, Homo sapien
tagttttcaccagctactagctagc

SEQ ID NO: 11269 - DNA, 25 bp, Homo sapien
tactagctagctatctctggtcaag

SEQ ID NO: 11270 - DNA, 25 bp, Homo sapien
agctatctctggtcaagtcacttac

SEQ ID NO: 11271 - DNA, 25 bp, Homo sapien
agtcacttaccttgcttgagcctca

SEQ ID NO: 11272 - DNA, 25 bp, Homo sapien
gggaagattaactgagaagccacat

SEQ ID NO: 11273 - DNA, 25 bp, Homo sapien
cacatagagtttactggcacattaa

SEQ ID NO: 11274 - DNA, 25 bp, Homo sapien
agaatgttagctgtccttttgcacg

SEQ ID NO: 11275 - DNA, 25 bp, Homo sapien
ttagctgtccttttgcacggcaaaa

SEQ ID NO: 11276 - DNA, 25 bp, Homo sapien
aaatcttcccaatctatacatccga

SEQ ID NO: 11277 - DNA, 25 bp, Homo sapien
cacgctgctggatctgcctcctgtg

SEQ ID NO: 11278 - DNA, 25 bp, Homo sapien
gtgcccaatgggacaggaccttaga

SEQ ID NO: 11279 - DNA, 25 bp, Homo sapien
ccttagaagggaggcacaccagctt

SEQ ID NO: 11280 - DNA, 25 bp, Homo sapien
gcacaaaggagctgtgtagtgcacc

SEQ ID NO: 11281 - DNA, 25 bp, Homo sapien
tgtgtagtgcaccaggcctcctagc

SEQ ID NO: 11282 - DNA, 25 bp, Homo sapien
ccaacctgcagggaagatgaccata

SEQ ID NO: 11283 - DNA, 25 bp, Homo sapien
gcagggaagatgaccatagtattat

SEQ ID NO: 11284 - DNA, 25 bp, Homo sapien
ctgggtgggacctagagctctcaaa

SEQ ID NO: 11285 - DNA, 25 bp, Homo sapien
gggacctagagctctcaaaagactt

SEQ ID NO: 11286 - DNA, 25 bp, Homo sapien
caaaagacttagcaaggccgggcgc

SEQ ID NO: 11287 - DNA, 25 bp, Homo sapien
ccaggtcaggggatcattaagtcaa

SEQ ID NO: 11288 - DNA, 25 bp, Homo sapien
ttcagggcaggcctaacctgtgcta

SEQ ID NO: 11289 - DNA, 25 bp, Homo sapien
aggcctaacctgtgctagggcagca

SEQ ID NO: 11290 - DNA, 25 bp, Homo sapien
taacctgtgctagggcagcatgatg

SEQ ID NO: 11291 - DNA, 25 bp, Homo sapien
gggcagcatgatgcctggtacagaa

SEQ ID NO: 11292 - DNA, 25 bp, Homo sapien
gtgtgtccccagttctggacactta

SEQ ID NO: 11293 - DNA, 25 bp, Homo sapien
tccccagttctggacacttattcag

SEQ ID NO: 11294 - DNA, 25 bp, Homo sapien
ctggacacttattcagcagacctgt

SEQ ID NO: 11295 - DNA, 25 bp, Homo sapien
gcagacctgtaagttttgctggcca

SEQ ID NO: 11296 - DNA, 25 bp, Homo sapien
gacctgtaagttttgctggccagcc

SEQ ID NO: 11297 - DNA, 25 bp, Homo sapien
gtaagttttgctggccagcctatct

SEQ ID NO: 11298 - DNA, 25 bp, Homo sapien
cagcctatctccctggctagactga

SEQ ID NO: 11299 - DNA, 25 bp, Homo sapien
ggtgcatgcagaaacttttcctgtt

SEQ ID NO: 11300 - DNA, 25 bp, Homo sapien
gttcaacacacttatatggcactat

SEQ ID NO: 11301 - DNA, 25 bp, Homo sapien
atagggatataccaaatagctcagg

SEQ ID NO: 11302 - DNA, 25 bp, Homo sapien
aaatgctaatcttacttgccaatat

SEQ ID NO: 11303 - DNA, 25 bp, Homo sapien
aaattattctccctaatattagcaa

SEQ ID NO: 11304 - DNA, 25 bp, Homo sapien
ttgcattaatggcatgtaccgtgtg

SEQ ID NO: 11305 - DNA, 25 bp, Homo sapien
taccgtgtgccagtttgtttccaaa

SEQ ID NO: 11306 - DNA, 25 bp, Homo sapien
aatgtaccttgatatgccacttcag

SEQ ID NO: 11307 - DNA, 25 bp, Homo sapien
ttgatatgccacttcagagccagca

SEQ ID NO: 11308 - DNA, 25 bp, Homo sapien
cagcagagggagctcatactttttt

SEQ ID NO: 11309 - DNA, 25 bp, Homo sapien
aaagctactgtgttataaccaatga

SEQ ID NO: 11310 - DNA, 25 bp, Homo sapien
cacctactactgtccacatgtagca

SEQ ID NO: 11311 - DNA, 25 bp, Homo sapien
actactgtccacatgtagcattatt

SEQ ID NO: 11312 - DNA, 25 bp, Homo sapien
gtccacatgtagcattatttaagtt

SEQ ID NO: 11313 - DNA, 25 bp, Homo sapien
atgtagcattatttaagtttctctt

SEQ ID NO: 11314 - DNA, 25 bp, Homo sapien
gaagaacaactttggtgcatataac

SEQ ID NO: 11315 - DNA, 25 bp, Homo sapien
ctttggtgcatataacacacacata

SEQ ID NO: 11316 - DNA, 25 bp, Homo sapien
aaagtacctgcatttcaccatttca

SEQ ID NO: 11317 - DNA, 25 bp, Homo sapien
gtacctgcatttcaccatttcaaat

SEQ ID NO: 11318 - DNA, 25 bp, Homo sapien
cctgcatttcaccatttcaaatata

SEQ ID NO: 11319 - DNA, 25 bp, Homo sapien
taaattgtccctattcctttccact

SEQ ID NO: 11320 - DNA, 25 bp, Homo sapien
aattgtccctattcctttccactct

SEQ ID NO: 11321 - DNA, 25 bp, Homo sapien
tgttgtatacttgcaacatggtttg

SEQ ID NO: 11322 - DNA, 25 bp, Homo sapien
aacatggtttgcttacatctgccag

SEQ ID NO: 11323 - DNA, 25 bp, Homo sapien
atggtttgcttacatctgccagcag

SEQ ID NO: 11324 - DNA, 25 bp, Homo sapien
ttgcttacatctgccagcagctgga

SEQ ID NO: 11325 - DNA, 25 bp, Homo sapien
acatctgccagcagctggatttcca

SEQ ID NO: 11326 - DNA, 25 bp, Homo sapien
tggatttccaatcttcccaacaata

SEQ ID NO: 11327 - DNA, 25 bp, Homo sapien
atttccaatcttcccaacaatagtc

SEQ ID NO: 11328 - DNA, 25 bp, Homo sapien
ccaacaatagtctgggcttcattct

SEQ ID NO: 11329 - DNA, 25 bp, Homo sapien
tacctggtccaggaaacacttgtac

SEQ ID NO: 11330 - DNA, 25 bp, Homo sapien
ggaaacacttgtacctagaaacgag

SEQ ID NO: 11331 - DNA, 25 bp, Homo sapien
ttgtacctagaaacgagttccaaag

SEQ ID NO: 11332 - DNA, 25 bp, Homo sapien
atggagcctccccttacaaaaggca

SEQ ID NO: 11333 - DNA, 25 bp, Homo sapien
caaaaggcaaaggtctggatggagc

SEQ ID NO: 11334 - DNA, 25 bp, Homo sapien
gccatagggtttaagttctgccaat

SEQ ID NO: 11335 - DNA, 25 bp, Homo sapien
agccagaaaggcctagagaccctga

SEQ ID NO: 11336 - DNA, 25 bp, Homo sapien
ctagagaccctgacccagctgagaa

SEQ ID NO: 11337 - DNA, 25 bp, Homo sapien
gagaagggcccctggtcaccactcg

SEQ ID NO: 11338 - DNA, 25 bp, Homo sapien
tcaccactcgaattcactagggcag

SEQ ID NO: 11339 - DNA, 25 bp, Homo sapien
ttcactagggcagagtgactggcat

SEQ ID NO: 11340 - DNA, 25 bp, Homo sapien
gcatggtccatgtggctccaacaat

SEQ ID NO: 11341 - DNA, 25 bp, Homo sapien
gcatgccagggaatgagcgatccaa

SEQ ID NO: 11342 - DNA, 25 bp, Homo sapien
gaagcagctacatcttaaacagact

SEQ ID NO: 11343 - DNA, 25 bp, Homo sapien
atgtaagagttcagactcacattct

SEQ ID NO: 11344 - DNA, 25 bp, Homo sapien
gtaagagttcagactcacattctat

SEQ ID NO: 11345 - DNA, 25 bp, Homo sapien
aagagttcagactcacattctatta

SEQ ID NO: 11346 - DNA, 25 bp, Homo sapien
agagttcagactcacattctattaa

SEQ ID NO: 11347 - DNA, 25 bp, Homo sapien
gagttcagactcacattctattaaa

SEQ ID NO: 11348 - DNA, 25 bp, Homo sapien
aatttagccctaaaatgacaagcct

SEQ ID NO: 11349 - DNA, 25 bp, Homo sapien
tttagccctaaaatgacaagccttc

SEQ ID NO: 11350 - DNA, 25 bp, Homo sapien
ttagccctaaaatgacaagccttct

SEQ ID NO: 11351 - DNA, 25 bp, Homo sapien
tagccctaaaatgacaagccttctt

SEQ ID NO: 11352 - DNA, 25 bp, Homo sapien
tgacaagccttcttaaagccttatt

SEQ ID NO: 11353 - DNA, 25 bp, Homo sapien
gacaagccttcttaaagccttattt

SEQ ID NO: 11354 - DNA, 25 bp, Homo sapien
aaggacttagtcttcaggacagtac

SEQ ID NO: 11355 - DNA, 25 bp, Homo sapien
gagcaacaggtttagaatttacaca

SEQ ID NO: 11356 - DNA, 25 bp, Homo sapien
aagttctatttccaaagttccacag

SEQ ID NO: 11357 - DNA, 25 bp, Homo sapien
agttccacagttccttgaaggctgc

SEQ ID NO: 11358 - DNA, 25 bp, Homo sapien
gaaggctgctatgaactatatctat

SEQ ID NO: 11359 - DNA, 25 bp, Homo sapien
ttgttccttgagttatgtgggcaaa

SEQ ID NO: 11360 - DNA, 25 bp, Homo sapien
atcactgtgatgtctgttccggctt

SEQ ID NO: 11361 - DNA, 25 bp, Homo sapien
ttccggcttctctttgggagaggag

SEQ ID NO: 11362 - DNA, 25 bp, Homo sapien
gaggagcatctgtttgggtgctaaa

SEQ ID NO: 11363 - DNA, 25 bp, Homo sapien
aaacattagcatcaggccaggcgca

SEQ ID NO: 11364 - DNA, 25 bp, Homo sapien
gtaatcctaagtactcgggagacta

SEQ ID NO: 11365 - DNA, 25 bp, Homo sapien
attaggcatctattttaaatcaaca

SEQ ID NO: 11366 - DNA, 25 bp, Homo sapien
gaaagtctgaatccataatttaaaa

SEQ ID NO: 11367 - DNA, 25 bp, Homo sapien
ttctgtagtgaaatctctaggctca

SEQ ID NO: 11368 - DNA, 25 bp, Homo sapien
tctaggctcaggtagcttcaccagt

SEQ ID NO: 11369 - DNA, 25 bp, Homo sapien
gctcaggtagcttcaccagtgaatt

SEQ ID NO: 11370 - DNA, 25 bp, Homo sapien
acagccatatacaagcctatctgga

SEQ ID NO: 11371 - DNA, 25 bp, Homo sapien
tacaagcctatctggagagtggaaa

SEQ ID NO: 11372 - DNA, 25 bp, Homo sapien
cattccaacatgttttgctaccaga

SEQ ID NO: 11373 - DNA, 25 bp, Homo sapien
tgctaccagaataaccttgatacca

SEQ ID NO: 11374 - DNA, 25 bp, Homo sapien
aattgtgggccagttctatttatga

SEQ ID NO: 11375 - DNA, 25 bp, Homo sapien
atttagatatccacttgtagttgag

SEQ ID NO: 11376 - DNA, 25 bp, Homo sapien
tggcggacttcggaatctgattcaa

SEQ ID NO: 11377 - DNA, 25 bp, Homo sapien
caatgttcatgttgctttcctctag

SEQ ID NO: 11378 - DNA, 25 bp, Homo sapien
ttgctttcctctaggctaccttgag

SEQ ID NO: 11379 - DNA, 25 bp, Homo sapien
gctaccttgaggagtatgttcttct

SEQ ID NO: 11380 - DNA, 25 bp, Homo sapien
agtttagtctagtgccatacttagg

SEQ ID NO: 11381 - DNA, 25 bp, Homo sapien
gtgggaacaaaggtctcttcagttt

SEQ ID NO: 11382 - DNA, 25 bp, Homo sapien
gttagtctattccatcctaagcctt

SEQ ID NO: 11383 - DNA, 25 bp, Homo sapien
cttctcctctcctgtatacactaag

SEQ ID NO: 11384 - DNA, 25 bp, Homo sapien
gtatacactaagctaactctggaaa

SEQ ID NO: 11385 - DNA, 25 bp, Homo sapien
actctggaaaaattacctcactagg

SEQ ID NO: 11386 - DNA, 25 bp, Homo sapien
ctaggagtgaaccattacagtgtaa

SEQ ID NO: 11387 - DNA, 25 bp, Homo sapien
taatgattgctagggcttgtgacat

SEQ ID NO: 11388 - DNA, 25 bp, Homo sapien
ataggatcagcgtatcgggctcctt

SEQ ID NO: 11389 - DNA, 25 bp, Homo sapien
tccttttgcttgctgaggccctaga

SEQ ID NO: 11390 - DNA, 25 bp, Homo sapien
gccctagacttgacagtggcctgga

SEQ ID NO: 11391 - DNA, 25 bp, Homo sapien
gtgagggtttacttgcaagccagca

SEQ ID NO: 11392 - DNA, 25 bp, Homo sapien
aagccagcactatccttgggcaaca

SEQ ID NO: 11393 - DNA, 25 bp, Homo sapien
tgggcaacattctctcttcctgagg

SEQ ID NO: 11394 - DNA, 25 bp, Homo sapien
tgaggtcttctggactctagtctgt

SEQ ID NO: 11395 - DNA, 25 bp, Homo sapien
gtacgccatggtgcaggctgctcag

SEQ ID NO: 11396 - DNA, 25 bp, Homo sapien
cttctccaggagtcagtcttgagct

SEQ ID NO: 11397 - DNA, 25 bp, Homo sapien
tactgatcaaagtctcctggccggg

SEQ ID NO: 11398 - DNA, 25 bp, Homo sapien
gaaaccgcgtgacagccatgtgcaa

SEQ ID NO: 11399 - DNA, 25 bp, Homo sapien
aaaaaaccagccacactcactggga

SEQ ID NO: 11400 - DNA, 25 bp, Homo sapien
actgggaccagtgacgagccttaaa

SEQ ID NO: 11401 - DNA, 25 bp, Homo sapien
acagcggtgtcctgagagtcggaca

SEQ ID NO: 11402 - DNA, 25 bp, Homo sapien
agtcggacaccctggctaagttgaa

SEQ ID NO: 11403 - DNA, 25 bp, Homo sapien
taagttgaaggtcctcattccagag

SEQ ID NO: 11404 - DNA, 25 bp, Homo sapien
attccagaggatatacacgggcttt

SEQ ID NO: 11405 - DNA, 25 bp, Homo sapien
tacacgggctttatacggagaaacg

SEQ ID NO: 11406 - DNA, 25 bp, Homo sapien
gagaaacggtcatactgcctccaac

SEQ ID NO: 11407 - DNA, 25 bp, Homo sapien
acttactctcaaatgactcaggata

SEQ ID NO: 11408 - DNA, 25 bp, Homo sapien
tgagccgtgagtatgccactactct

SEQ ID NO: 11409 - DNA, 25 bp, Homo sapien
attccttgtcttccaaagctaggga

SEQ ID NO: 11410 - DNA, 25 bp, Homo sapien
aaagctagggatttcctgagccagt

SEQ ID NO: 11411 - DNA, 25 bp, Homo sapien
tagggatttcctgagccagtgggat

SEQ ID NO: 11412 - DNA, 25 bp, Homo sapien
agcacggactgcaaagggccatgaa

SEQ ID NO: 11413 - DNA, 25 bp, Homo sapien
tgggcttgccattttctccaataac

SEQ ID NO: 11414 - DNA, 25 bp, Homo sapien
tgccattttctccaataacctccag

SEQ ID NO: 11415 - DNA, 25 bp, Homo sapien
tctgaaggtcggaacaccactttct

SEQ ID NO: 11416 - DNA, 25 bp, Homo sapien
gtcggaacaccactttctgcactaa

SEQ ID NO: 11417 - DNA, 25 bp, Homo sapien
tttctgcactaacaccagctcctga

SEQ ID NO: 11418 - DNA, 25 bp, Homo sapien
ccagctcctgagatgatgactatgt

SEQ ID NO: 11419 - DNA, 25 bp, Homo sapien
atgactatgtgctttgcttttgcaa

SEQ ID NO: 11420 - DNA, 25 bp, Homo sapien
aacccaatgctattcaaactcctgt

SEQ ID NO: 11421 - DNA, 25 bp, Homo sapien
gtaaataactgacagcaggctacag

SEQ ID NO: 11422 - DNA, 25 bp, Homo sapien
agcaggctacagtcccaaattacaa

SEQ ID NO: 11423 - DNA, 25 bp, Homo sapien
gtcccaaattacaacacgattttct

SEQ ID NO: 11424 - DNA, 25 bp, Homo sapien
tttcgccccctattaaatatctgtc

SEQ ID NO: 11425 - DNA, 25 bp, Homo sapien
tgggttctttttctgagaactagac

SEQ ID NO: 11426 - DNA, 25 bp, Homo sapien
gagaactagacatacctctgataaa

SEQ ID NO: 11427 - DNA, 25 bp, Homo sapien
gacatacctctgataaaggtcatgc

SEQ ID NO: 11428 - DNA, 25 bp, Homo sapien
aaaataacaatatgggcctggcgtg

SEQ ID NO: 11429 - DNA, 25 bp, Homo sapien
atgcctgcaaggctacatgcctgta

SEQ ID NO: 11430 - DNA, 25 bp, Homo sapien
acttggaggccgaagcaagaggatt

SEQ ID NO: 11431 - DNA, 25 bp, Homo sapien
gttgctaatgattcattccttattg

SEQ ID NO: 11432 - DNA, 25 bp, Homo sapien
gctaatgattcattccttattggag

SEQ ID NO: 11433 - DNA, 25 bp, Homo sapien
taatgattcattccttattggaggc

SEQ ID NO: 11434 - DNA, 25 bp, Homo sapien
atgattcattccttattggaggctt

SEQ ID NO: 11435 - DNA, 25 bp, Homo sapien
gattcattccttattggaggcttat

SEQ ID NO: 11436 - DNA, 25 bp, Homo sapien
ttcattccttattggaggcttattg

SEQ ID NO: 11437 - DNA, 25 bp, Homo sapien
cattccttattggaggcttattgag

SEQ ID NO: 11438 - DNA, 25 bp, Homo sapien
ccttattggaggcttattgagaatt

SEQ ID NO: 11439 - DNA, 25 bp, Homo sapien
ggaggcttattgagaattggttgta

SEQ ID NO: 11440 - DNA, 25 bp, Homo sapien
aggcttattgagaattggttgtaaa

SEQ ID NO: 11441 - DNA, 25 bp, Homo sapien
aattgttggcctatgttaagtattt

SEQ ID NO: 11442 - DNA, 25 bp, Homo sapien
gaaggctcacgcagaatgctaggca

SEQ ID NO: 11443 - DNA, 25 bp, Homo sapien
gctcacgcagaatgctaggcactgt

SEQ ID NO: 11444 - DNA, 25 bp, Homo sapien
gaatgctaggcactgtacattacag

SEQ ID NO: 11445 - DNA, 25 bp, Homo sapien
gtacattacagttgatgacgtgttt

SEQ ID NO: 11446 - DNA, 25 bp, Homo sapien
atgacgtgtttaaagtgtaatcgct

SEQ ID NO: 11447 - DNA, 25 bp, Homo sapien
aagtgtaatcgcttatgtaccagac

SEQ ID NO: 11448 - DNA, 25 bp, Homo sapien
tgtaccagacatagaaacataccat

SEQ ID NO: 11449 - DNA, 25 bp, Homo sapien
gaaacataccatacaaacgcataaa

SEQ ID NO: 11450 - DNA, 25 bp, Homo sapien
tatggtgacatgtatcaagtttaga

SEQ ID NO: 11451 - DNA, 25 bp, Homo sapien
tacaataaacattgcataactgcat

SEQ ID NO: 11452 - DNA, 25 bp, Homo sapien
atatgtaacagatggccgggcacgg

SEQ ID NO: 11453 - DNA, 25 bp, Homo sapien
ggagaccccggactgggcgcccgag

SEQ ID NO: 11454 - DNA, 25 bp, Homo sapien
gccttcaagacttcgacacgctggt

SEQ ID NO: 11455 - DNA, 25 bp, Homo sapien
ttcaagacttcgacacgctggtcac

SEQ ID NO: 11456 - DNA, 25 bp, Homo sapien
aagacttcgacacgctggtcaccgt

SEQ ID NO: 11457 - DNA, 25 bp, Homo sapien
cgctggtcaccgtgggaaagcaact

SEQ ID NO: 11458 - DNA, 25 bp, Homo sapien
ggtcaccgtgggaaagcaactagaa

SEQ ID NO: 11459 - DNA, 25 bp, Homo sapien
gtgggaaagcaactagaagccattt

SEQ ID NO: 11460 - DNA, 25 bp, Homo sapien
gaaagcaactagaagccatttgtgt

SEQ ID NO: 11461 - DNA, 25 bp, Homo sapien
gcaactagaagccatttgtgtcaag

SEQ ID NO: 11462 - DNA, 25 bp, Homo sapien
gaaaaacgttgacctcttggcgaga

SEQ ID NO: 11463 - DNA, 25 bp, Homo sapien
cctggaatcacgtgtcatttcaacc

SEQ ID NO: 11464 - DNA, 25 bp, Homo sapien
gaatatgaacacagagcaccagagt

SEQ ID NO: 11465 - DNA, 25 bp, Homo sapien
accagagtgccgtctgggtctgaag

SEQ ID NO: 11466 - DNA, 25 bp, Homo sapien
gaaggaaggccgtccattctcaggg

SEQ ID NO: 11467 - DNA, 25 bp, Homo sapien
gcccacagagacttgcacaacatgc

SEQ ID NO: 11468 - DNA, 25 bp, Homo sapien
gacttgcacaacatgcagaatggca

SEQ ID NO: 11469 - DNA, 25 bp, Homo sapien
gaatggcagcacattggtatgcact

SEQ ID NO: 11470 - DNA, 25 bp, Homo sapien
acattggtatgcactctcactagag

SEQ ID NO: 11471 - DNA, 25 bp, Homo sapien
gagtggtgccattcaggtactgagt

SEQ ID NO: 11472 - DNA, 25 bp, Homo sapien
agagccagtcaagacttgccgacaa

SEQ ID NO: 11473 - DNA, 25 bp, Homo sapien
agaagccaagaaagctgcagctgaa

SEQ ID NO: 11474 - DNA, 25 bp, Homo sapien
acgcaagccaggctaaacagttggc

SEQ ID NO: 11475 - DNA, 25 bp, Homo sapien
ttgaatccatcatcaaggaagcagc

SEQ ID NO: 11476 - DNA, 25 bp, Homo sapien
atcttcgaaatgcttgaaggagtgc

SEQ ID NO: 11477 - DNA, 25 bp, Homo sapien
ttgaaggagtgcaaggacctactgc

SEQ ID NO: 11478 - DNA, 25 bp, Homo sapien
tgaaggagtgcaaggacctactgca

SEQ ID NO: 11479 - DNA, 25 bp, Homo sapien
gagtgcaaggacctactgcagtcag

SEQ ID NO: 11480 - DNA, 25 bp, Homo sapien
agtgcaaggacctactgcagtcagg

SEQ ID NO: 11481 - DNA, 25 bp, Homo sapien
gtgcaaggacctactgcagtcagga

SEQ ID NO: 11482 - DNA, 25 bp, Homo sapien
tgcaaggacctactgcagtcaggaa

SEQ ID NO: 11483 - DNA, 25 bp, Homo sapien
cgattttttgaatccatcatcaagg

SEQ ID NO: 11484 - DNA, 25 bp, Homo sapien
gattttttgaatccatcatcaagga

SEQ ID NO: 11485 - DNA, 25 bp, Homo sapien
tttttgaatccatcatcaaggaagc

SEQ ID NO: 11486 - DNA, 25 bp, Homo sapien
atgtgaggtagtatgctaagcatcc

SEQ ID NO: 11487 - DNA, 25 bp, Homo sapien
gtatgctaagcatccattgtttatg

SEQ ID NO: 11488 - DNA, 25 bp, Homo sapien
gcatccattgtttatggttctagta

SEQ ID NO: 11489 - DNA, 25 bp, Homo sapien
gttctagtaataaccctcaaaggtg

SEQ ID NO: 11490 - DNA, 25 bp, Homo sapien
cctcaaaggtgggtattatattata

SEQ ID NO: 11491 - DNA, 25 bp, Homo sapien
tgaaatgaggtctcttggtcttcaa

SEQ ID NO: 11492 - DNA, 25 bp, Homo sapien
gttcatatattttctaaagggcagg

SEQ ID NO: 11493 - DNA, 25 bp, Homo sapien
ttcttacattgaagatgtcctttaa

SEQ ID NO: 11494 - DNA, 25 bp, Homo sapien
gtcctttaagattctggagcaactt

SEQ ID NO: 11495 - DNA, 25 bp, Homo sapien
catagagattaagactgggccaggt

SEQ ID NO: 11496 - DNA, 25 bp, Homo sapien
aaggagatcgagagcagtctgacca

SEQ ID NO: 11497 - DNA, 25 bp, Homo sapien
aaagcgtatctggtttatgcatata

SEQ ID NO: 11498 - DNA, 25 bp, Homo sapien
gcgtatctggtttatgcatatacaa

SEQ ID NO: 11499 - DNA, 25 bp, Homo sapien
atctggtttatgcatatacaaatat

SEQ ID NO: 11500 - DNA, 25 bp, Homo sapien
aaatatacatttatcttttctacct

SEQ ID NO: 11501 - DNA, 25 bp, Homo sapien
ctccttcttgtaagggtatggaaca

SEQ ID NO: 11502 - DNA, 25 bp, Homo sapien
gatatgatgcatgtgaagtatttaa

SEQ ID NO: 11503 - DNA, 25 bp, Homo sapien
gcatgtgaagtatttaagttacgta

SEQ ID NO: 11504 - DNA, 25 bp, Homo sapien
ttttccctttgccattttcctgtct

SEQ ID NO: 11505 - DNA, 25 bp, Homo sapien
ttttcctgtctctttatcatgatga

SEQ ID NO: 11506 - DNA, 25 bp, Homo sapien
ttcctgtctctttatcatgatgatt

SEQ ID NO: 11507 - DNA, 25 bp, Homo sapien
atcatgatgattttcatccccgccc

SEQ ID NO: 11508 - DNA, 25 bp, Homo sapien
cagctctggcttccttggaatatgt

SEQ ID NO: 11509 - DNA, 25 bp, Homo sapien
agctctggcttccttggaatatgtc

SEQ ID NO: 11510 - DNA, 25 bp, Homo sapien
cttggaatatgtcctcgcagccctg

SEQ ID NO: 11511 - DNA, 25 bp, Homo sapien
ggaatatgtcctcgcagccctgctt

SEQ ID NO: 11512 - DNA, 25 bp, Homo sapien
aatatgtcctcgcagccctgcttct

SEQ ID NO: 11513 - DNA, 25 bp, Homo sapien
tttgctgatcaaaaattctgacata

SEQ ID NO: 11514 - DNA, 25 bp, Homo sapien
aaaattctgacatattactgacaat

SEQ ID NO: 11515 - DNA, 25 bp, Homo sapien
gacatattactgacaatttcaaaaa

SEQ ID NO: 11516 - DNA, 25 bp, Homo sapien
aaagtctgacagtattagtagggtt

SEQ ID NO: 11517 - DNA, 25 bp, Homo sapien
tctgacagtattagtagggttgact

SEQ ID NO: 11518 - DNA, 25 bp, Homo sapien
gtagggttgactaaaacaatatgaa

SEQ ID NO: 11519 - DNA, 25 bp, Homo sapien
ggagtacagtggcctacacctgtaa

SEQ ID NO: 11520 - DNA, 25 bp, Homo sapien
aaaatcagcagcgtgtagtggatac

SEQ ID NO: 11521 - DNA, 25 bp, Homo sapien
atcagcagcgtgtagtggatacatg

SEQ ID NO: 11522 - DNA, 25 bp, Homo sapien
gcagcgtgtagtggatacatgcctg

SEQ ID NO: 11523 - DNA, 25 bp, Homo sapien
gaaggaaagacagacatctaagata

SEQ ID NO: 11524 - DNA, 25 bp, Homo sapien
aagacagacatctaagatatatcaa

SEQ ID NO: 11525 - DNA, 25 bp, Homo sapien
atatatcaaatgtatctgtgggtac

SEQ ID NO: 11526 - DNA, 25 bp, Homo sapien
atcaaatgtatctgtgggtacaaga

SEQ ID NO: 11527 - DNA, 25 bp, Homo sapien
atgtatctgtgggtacaagagggta

SEQ ID NO: 11528 - DNA, 25 bp, Homo sapien
tacaagagggtaggtgcggcacaga

SEQ ID NO: 11529 - DNA, 25 bp, Homo sapien
cacagagggagtgggaaaatcacta

SEQ ID NO: 11530 - DNA, 25 bp, Homo sapien
gtgatacaagattagctaagagagt

SEQ ID NO: 11531 - DNA, 25 bp, Homo sapien
aagagagttaaagcagagtccagaa

SEQ ID NO: 11532 - DNA, 25 bp, Homo sapien
agcagagtccagaaaatgcaattaa

SEQ ID NO: 11533 - DNA, 25 bp, Homo sapien
gctagaagtaataggcagccaatga

SEQ ID NO: 11534 - DNA, 25 bp, Homo sapien
aataggcagccaatgaaaaatgtca

SEQ ID NO: 11535 - DNA, 25 bp, Homo sapien
tagtatacagtacaatgtgcccttt

SEQ ID NO: 11536 - DNA, 25 bp, Homo sapien
acagtacaatgtgccctttataaag

SEQ ID NO: 11537 - DNA, 25 bp, Homo sapien
acaatgtgccctttataaagtatgc

SEQ ID NO: 11538 - DNA, 25 bp, Homo sapien
gtatgcagatctatcaattttgacc

SEQ ID NO: 11539 - DNA, 25 bp, Homo sapien
caattttgaccagtgcatacaatca

SEQ ID NO: 11540 - DNA, 25 bp, Homo sapien
gataaaaagttgtcgggccagtcgt

SEQ ID NO: 11541 - DNA, 25 bp, Homo sapien
tgacgcagccgtgagtgaccaagcc

SEQ ID NO: 11542 - DNA, 25 bp, Homo sapien
cgtgagtgaccaagccagcccctgt

SEQ ID NO: 11543 - DNA, 25 bp, Homo sapien
agcccctgtgtggtccatacttgca

SEQ ID NO: 11544 - DNA, 25 bp, Homo sapien
tgtgtggtccatacttgcaccccat

SEQ ID NO: 11545 - DNA, 25 bp, Homo sapien
tggccccttcgccctggcaaaaaag

SEQ ID NO: 11546 - DNA, 25 bp, Homo sapien
aaaagctgcttatgctgtcttccct

SEQ ID NO: 11547 - DNA, 25 bp, Homo sapien
cttatgctgtcttcccttggctgca

SEQ ID NO: 11548 - DNA, 25 bp, Homo sapien
cttggctgcactctgccgaaataaa

SEQ ID NO: 11549 - DNA, 25 bp, Homo sapien
ctctgccgaaataaaagttctgccc

SEQ ID NO: 11550 - DNA, 25 bp, Homo sapien
ttgtgccgcagtccttcccgggaaa

SEQ ID NO: 11551 - DNA, 25 bp, Homo sapien
agacagaaccctgggttgctgggca

SEQ ID NO: 11552 - DNA, 25 bp, Homo sapien
ccccagaggcttgtaagagttggga

SEQ ID NO: 11553 - DNA, 25 bp, Homo sapien
agagggactgggtctctgggaacag

SEQ ID NO: 11554 - DNA, 25 bp, Homo sapien
tgggaacaggttggaggtcttatct

SEQ ID NO: 11555 - DNA, 25 bp, Homo sapien
aggtcttatctgtggactgtctgac

SEQ ID NO: 11556 - DNA, 25 bp, Homo sapien
ttatctgtggactgtctgactccca

SEQ ID NO: 11557 - DNA, 25 bp, Homo sapien
tggactgtctgactcccagctgagg

SEQ ID NO: 11558 - DNA, 25 bp, Homo sapien
ccgtctctgcttagcgtctgggtga

SEQ ID NO: 11559 - DNA, 25 bp, Homo sapien
ctctgcttagcgtctgggtgagaaa

SEQ ID NO: 11560 - DNA, 25 bp, Homo sapien
aaaacaggctgtgatccagaagaag

SEQ ID NO: 11561 - DNA, 25 bp, Homo sapien
gggctgacactgtcagccaatcctc

SEQ ID NO: 11562 - DNA, 25 bp, Homo sapien
tataacgggctttttggtgggagat

SEQ ID NO: 11563 - DNA, 25 bp, Homo sapien
gtgatcttaaatgcttttaactttg

SEQ ID NO: 11564 - DNA, 25 bp, Homo sapien
gaacttgtgacaataatgtgctatt

SEQ ID NO: 11565 - DNA, 25 bp, Homo sapien
tgtgctattaatttcttcatccagt

SEQ ID NO: 11566 - DNA, 25 bp, Homo sapien
aatttcttcatccagttttatcagg

SEQ ID NO: 11567 - DNA, 25 bp, Homo sapien
gttttatcaggatacagttttctga

SEQ ID NO: 11568 - DNA, 25 bp, Homo sapien
tacagttttctgatagatgaagctt

SEQ ID NO: 11569 - DNA, 25 bp, Homo sapien
gatgaagcttattctctagattgtc

SEQ ID NO: 11570 - DNA, 25 bp, Homo sapien
ttctctagattgtcagtaccgttta

SEQ ID NO: 11571 - DNA, 25 bp, Homo sapien
gtcagtaccgtttatttgaattatt

SEQ ID NO: 11572 - DNA, 25 bp, Homo sapien
ttcccaccttactagcctaatttga

SEQ ID NO: 11573 - DNA, 25 bp, Homo sapien
aaaacagcttaattaaaccatcatt

SEQ ID NO: 11574 - DNA, 25 bp, Homo sapien
cggtcagactctctcgtttctagga

SEQ ID NO: 11575 - DNA, 25 bp, Homo sapien
gtcagactctctcgtttctaggagg

SEQ ID NO: 11576 - DNA, 25 bp, Homo sapien
cagactctctcgtttctaggaggga

SEQ ID NO: 11577 - DNA, 25 bp, Homo sapien
gactctctcgtttctaggagggacg

SEQ ID NO: 11578 - DNA, 25 bp, Homo sapien
tctctcgtttctaggagggacggtc

SEQ ID NO: 11579 - DNA, 25 bp, Homo sapien
ctcgtttctaggagggacggtcttg

SEQ ID NO: 11580 - DNA, 25 bp, Homo sapien
ggagggacggtcttggaggctccaa

SEQ ID NO: 11581 - DNA, 25 bp, Homo sapien
ctccaaggagaaggcgtcgcctggc

SEQ ID NO: 11582 - DNA, 25 bp, Homo sapien
aaggagaaggcgtcgcctggcccca

SEQ ID NO: 11583 - DNA, 25 bp, Homo sapien
gaagcgccctggtgaggcgtccctc

SEQ ID NO: 11584 - DNA, 25 bp, Homo sapien
gcgcgcctgtgtaggagcctcgagg

SEQ ID NO: 11585 - DNA, 25 bp, Homo sapien
ttacattaagaatctgactcagctt

SEQ ID NO: 11586 - DNA, 25 bp, Homo sapien
gactcagcttccttacatgtagagc

SEQ ID NO: 11587 - DNA, 25 bp, Homo sapien
tgttggttggcaaattcttgagttc

SEQ ID NO: 11588 - DNA, 25 bp, Homo sapien
gagttcttattgaagcttcctttgg

SEQ ID NO: 11589 - DNA, 25 bp, Homo sapien
agcttcctttggtattaattgtatc

SEQ ID NO: 11590 - DNA, 25 bp, Homo sapien
aattgtatcttttcagccaagatca

SEQ ID NO: 11591 - DNA, 25 bp, Homo sapien
ctagcttacttttaatcgttataat

SEQ ID NO: 11592 - DNA, 25 bp, Homo sapien
gttttattgcaaggtctctgggtaa

SEQ ID NO: 11593 - DNA, 25 bp, Homo sapien
ctctgggtaaaagtaggttcgcatc

SEQ ID NO: 11594 - DNA, 25 bp, Homo sapien
gttcgcatcttacagatgcagctat

SEQ ID NO: 11595 - DNA, 25 bp, Homo sapien
taaaagaagttagtggccaggctca

SEQ ID NO: 11596 - DNA, 25 bp, Homo sapien
tatgagatgaccacaagtataacta

SEQ ID NO: 11597 - DNA, 25 bp, Homo sapien
ttgcatgatagattactcctgatac

SEQ ID NO: 11598 - DNA, 25 bp, Homo sapien
actcctgatacatgaaaattgctct

SEQ ID NO: 11599 - DNA, 25 bp, Homo sapien
attgctctataaaataatctctttc

SEQ ID NO: 11600 - DNA, 25 bp, Homo sapien
atagtttagcatgttggaattacca

SEQ ID NO: 11601 - DNA, 25 bp, Homo sapien
gaattaccaattgttccctatctct

SEQ ID NO: 11602 - DNA, 25 bp, Homo sapien
aattgttccctatctctgtctttga

SEQ ID NO: 11603 - DNA, 25 bp, Homo sapien
atctctgtctttgactaattgccag

SEQ ID NO: 11604 - DNA, 25 bp, Homo sapien
tgactaattgccagaagtttcattt

SEQ ID NO: 11605 - DNA, 25 bp, Homo sapien
gtatatgatacctactattatgtgt

SEQ ID NO: 11606 - DNA, 25 bp, Homo sapien
ttgaaatgcagcagagtggtcgagc

SEQ ID NO: 11607 - DNA, 25 bp, Homo sapien
gtggcttaacacaaatgaacaaata

SEQ ID NO: 11608 - DNA, 25 bp, Homo sapien
caaatactagttccggttactctag

SEQ ID NO: 11609 - DNA, 25 bp, Homo sapien
gttccggttactctagaatgtctgg

SEQ ID NO: 11610 - DNA, 25 bp, Homo sapien
gaatgtctggtatatcctttgtcag

SEQ ID NO: 11611 - DNA, 25 bp, Homo sapien
gtatatcctttgtcagcaagcagtt

SEQ ID NO: 11612 - DNA, 25 bp, Homo sapien
gcaagcagtttttaacggatcctaa

SEQ ID NO: 11613 - DNA, 25 bp, Homo sapien
tttcaagaatgtttacgaggttaat

SEQ ID NO: 11614 - DNA, 25 bp, Homo sapien
tacgaggttaatatgcggaagtttg

SEQ ID NO: 11615 - DNA, 25 bp, Homo sapien
gtacataatttcacagtggctcatg

SEQ ID NO: 11616 - DNA, 25 bp, Homo sapien
acctgcctgggtaatatgatggaac

SEQ ID NO: 11617 - DNA, 25 bp, Homo sapien
gagaatttgctggagcctggaaggc

SEQ ID NO: 11618 - DNA, 25 bp, Homo sapien
actatcagtcacacttataacccct

SEQ ID NO: 11619 - DNA, 25 bp, Homo sapien
tatcagtcacacttataacccctgg

SEQ ID NO: 11620 - DNA, 25 bp, Homo sapien
atcagtcacacttataacccctggg

SEQ ID NO: 11621 - DNA, 25 bp, Homo sapien
gtcacacttataacccctggggatg

SEQ ID NO: 11622 - DNA, 25 bp, Homo sapien
taacccctggggatggtcagaacag

SEQ ID NO: 11623 - DNA, 25 bp, Homo sapien
cagtgaagccctgcacacatttaaa

SEQ ID NO: 11624 - DNA, 25 bp, Homo sapien
agtgaagccctgcacacatttaaaa

SEQ ID NO: 11625 - DNA, 25 bp, Homo sapien
gaagccctgcacacatttaaaaata

SEQ ID NO: 11626 - DNA, 25 bp, Homo sapien
tttaaaaatagctctaggccgggca

SEQ ID NO: 11627 - DNA, 25 bp, Homo sapien
aggtgggcatgattgcgtcagccca

SEQ ID NO: 11628 - DNA, 25 bp, Homo sapien
ggcatgattgcgtcagcccaggagt

SEQ ID NO: 11629 - DNA, 25 bp, Homo sapien
acagggaggaattctcacgcccaag

SEQ ID NO: 11630 - DNA, 25 bp, Homo sapien
ctctctacgccttggaggactcctg

SEQ ID NO: 11631 - DNA, 25 bp, Homo sapien
acaggttaggccaggtaacagccct

SEQ ID NO: 11632 - DNA, 25 bp, Homo sapien
atcccatctctctgcagacggatgt

SEQ ID NO: 11633 - DNA, 25 bp, Homo sapien
tctgcagacggatgtgtgtggcccc

SEQ ID NO: 11634 - DNA, 25 bp, Homo sapien
aaggagaacctttggcaggtgctta

SEQ ID NO: 11635 - DNA, 25 bp, Homo sapien
ggtgcttaggacactgactacctag

SEQ ID NO: 11636 - DNA, 25 bp, Homo sapien
gtagacgcagcagagttgctcccaa

SEQ ID NO: 11637 - DNA, 25 bp, Homo sapien
agcagagttgctcccaagtcgaggc

SEQ ID NO: 11638 - DNA, 25 bp, Homo sapien
cccaagtcgaggctcctcagagcag

SEQ ID NO: 11639 - DNA, 25 bp, Homo sapien
tgacagcagtggattctcccagcag

SEQ ID NO: 11640 - DNA, 25 bp, Homo sapien
tgaggcgcccggatttcttctgcag

SEQ ID NO: 11641 - DNA, 25 bp, Homo sapien
gcccggatttcttctgcaggcagaa

SEQ ID NO: 11642 - DNA, 25 bp, Homo sapien
ttctgcaggcagaagggagccaaga

SEQ ID NO: 11643 - DNA, 25 bp, Homo sapien
agccaagacaggatgtctagcaggg

SEQ ID NO: 11644 - DNA, 25 bp, Homo sapien
gcaggacagctgtgaagaggccgca

SEQ ID NO: 11645 - DNA, 25 bp, Homo sapien
tgagcacgggtgacagatgtcgtca

SEQ ID NO: 11646 - DNA, 25 bp, Homo sapien
agcttctgcccattgttgccgcagc

SEQ ID NO: 11647 - DNA, 25 bp, Homo sapien
cagagcttccgacgtctcaagagaa

SEQ ID NO: 11648 - DNA, 25 bp, Homo sapien
gtgggaagtgagatttatgcatgaa

SEQ ID NO: 11649 - DNA, 25 bp, Homo sapien
tatgcatgaaagaaaccgcttggtt

SEQ ID NO: 11650 - DNA, 25 bp, Homo sapien
cgcttggtttttagagattggtgac

SEQ ID NO: 11651 - DNA, 25 bp, Homo sapien
acggaccttaaaataccagcaacag

SEQ ID NO: 11652 - DNA, 25 bp, Homo sapien
ggaccttaaaataccagcaacagcc

SEQ ID NO: 11653 - DNA, 25 bp, Homo sapien
gaccttaaaataccagcaacagccc

SEQ ID NO: 11654 - DNA, 25 bp, Homo sapien
cccttcgccccaaggtcttgctctg

SEQ ID NO: 11655 - DNA, 25 bp, Homo sapien
atggctcttacacagggacctttga

SEQ ID NO: 11656 - DNA, 25 bp, Homo sapien
tggctcttacacagggacctttgac

SEQ ID NO: 11657 - DNA, 25 bp, Homo sapien
ggctcttacacagggacctttgaca

SEQ ID NO: 11658 - DNA, 25 bp, Homo sapien
ctcttacacagggacctttgacatt

SEQ ID NO: 11659 - DNA, 25 bp, Homo sapien
cttacacagggacctttgacattca

SEQ ID NO: 11660 - DNA, 25 bp, Homo sapien
tacacagggacctttgacattcagg

SEQ ID NO: 11661 - DNA, 25 bp, Homo sapien
acacagggacctttgacattcaggg

SEQ ID NO: 11662 - DNA, 25 bp, Homo sapien
ttaaggagagggtagcaatttccag

SEQ ID NO: 11663 - DNA, 25 bp, Homo sapien
cattttagagacacctggctgcagt

SEQ ID NO: 11664 - DNA, 25 bp, Homo sapien
gtgggctgcatattaggacagagac

SEQ ID NO: 11665 - DNA, 25 bp, Homo sapien
ggacagagactattccagtgttaga

SEQ ID NO: 11666 - DNA, 25 bp, Homo sapien
ggaagctaaaggtcaagggtcaaga

SEQ ID NO: 11667 - DNA, 25 bp, Homo sapien
ggtcaagaaccttttctaggtctct

SEQ ID NO: 11668 - DNA, 25 bp, Homo sapien
ttctaggtctctctgatttgggcat

SEQ ID NO: 11669 - DNA, 25 bp, Homo sapien
gtctctctgatttgggcatctggct

SEQ ID NO: 11670 - DNA, 25 bp, Homo sapien
catctggctggctggaaatgctaat

SEQ ID NO: 11671 - DNA, 25 bp, Homo sapien
gataaagagctaagggccgtttgca

SEQ ID NO: 11672 - DNA, 25 bp, Homo sapien
ctaagggccgtttgcagtggctcaa

SEQ ID NO: 11673 - DNA, 25 bp, Homo sapien
tccatctccatggtaacaagtatat

SEQ ID NO: 11674 - DNA, 25 bp, Homo sapien
catctccatggtaacaagtatatat

SEQ ID NO: 11675 - DNA, 25 bp, Homo sapien
ctccatggtaacaagtatatatagt

SEQ ID NO: 11676 - DNA, 25 bp, Homo sapien
gtaagtactcaataactcataaatc

SEQ ID NO: 11677 - DNA, 25 bp, Homo sapien
gtactcaataactcataaatctatt

SEQ ID NO: 11678 - DNA, 25 bp, Homo sapien
attcaagggaaatttaaagctcatt

SEQ ID NO: 11679 - DNA, 25 bp, Homo sapien
gggaaatttaaagctcatttgaagg

SEQ ID NO: 11680 - DNA, 25 bp, Homo sapien
gaaatttaaagctcatttgaaggtt

SEQ ID NO: 11681 - DNA, 25 bp, Homo sapien
aaaacggataacatagccgggtgcg

SEQ ID NO: 11682 - DNA, 25 bp, Homo sapien
aaacggataacatagccgggtgcgg

SEQ ID NO: 11683 - DNA, 25 bp, Homo sapien
tgtggtcccagttaagaggtttaag

SEQ ID NO: 11684 - DNA, 25 bp, Homo sapien
agaggccccaaatactgtgtgtaga

SEQ ID NO: 11685 - DNA, 25 bp, Homo sapien
ggccccaaatactgtgtgtagaaca

SEQ ID NO: 11686 - DNA, 25 bp, Homo sapien
taaagtatattagcactgtgtatta

SEQ ID NO: 11687 - DNA, 25 bp, Homo sapien
atatttgcttcatggctatttgttt

SEQ ID NO: 11688 - DNA, 25 bp, Homo sapien
tttgcttcatggctatttgtttgtt

SEQ ID NO: 11689 - DNA, 25 bp, Homo sapien
ctgcttctggtgacagcctccggaa

SEQ ID NO: 11690 - DNA, 25 bp, Homo sapien
tggtgacagcctccggaagcttaca

SEQ ID NO: 11691 - DNA, 25 bp, Homo sapien
gacagcctccggaagcttacagtca

SEQ ID NO: 11692 - DNA, 25 bp, Homo sapien
ggagccagcgcatgacatggcaaga

SEQ ID NO: 11693 - DNA, 25 bp, Homo sapien
caaaaaattagtcatgcacctataa

SEQ ID NO: 11694 - DNA, 25 bp, Homo sapien
actccacagggcacagggagctttc

SEQ ID NO: 11695 - DNA, 25 bp, Homo sapien
gtctggactaaatcctaggtgtctt

SEQ ID NO: 11696 - DNA, 25 bp, Homo sapien
tcctaggtgtcttaattccttaatg

SEQ ID NO: 11697 - DNA, 25 bp, Homo sapien
ttccttaatgagtcgaggcgttctc

SEQ ID NO: 11698 - DNA, 25 bp, Homo sapien
gagtcgaggcgttctcaggttgtat

SEQ ID NO: 11699 - DNA, 25 bp, Homo sapien
ggcgttctcaggttgtatggatttt

SEQ ID NO: 11700 - DNA, 25 bp, Homo sapien
caggttgtatggattttgtgaagta

SEQ ID NO: 11701 - DNA, 25 bp, Homo sapien
gtaatggagaatgctactgacgtct

SEQ ID NO: 11702 - DNA, 25 bp, Homo sapien
gaatgctactgacgtctccaaagat

SEQ ID NO: 11703 - DNA, 25 bp, Homo sapien
gacgtctccaaagatgcgttttcta

SEQ ID NO: 11704 - DNA, 25 bp, Homo sapien
tgcgttttctaaggaaatcaccccg

SEQ ID NO: 11705 - DNA, 25 bp, Homo sapien
cccgctgtcgtcattgacatagttt

SEQ ID NO: 11706 - DNA, 25 bp, Homo sapien
aactttctgtaatagatctgtgttc

SEQ ID NO: 11707 - DNA, 25 bp, Homo sapien
atagatctgtgttcattttatggta

SEQ ID NO: 11708 - DNA, 25 bp, Homo sapien
attcatgacatacctcactttctta

SEQ ID NO: 11709 - DNA, 25 bp, Homo sapien
tggctatgaggttcatctgtttttt

SEQ ID NO: 11710 - DNA, 25 bp, Homo sapien
aaactctgcataacattggacttga

SEQ ID NO: 11711 - DNA, 25 bp, Homo sapien
ggacttgagaagttcaaacctgtgt

SEQ ID NO: 11712 - DNA, 25 bp, Homo sapien
gttcaatggccaactgtattatttt

SEQ ID NO: 11713 - DNA, 25 bp, Homo sapien
aatgcacgtaggagatgttggcaac

SEQ ID NO: 11714 - DNA, 25 bp, Homo sapien
gttggcaacgtctatgcattttccg

SEQ ID NO: 11715 - DNA, 25 bp, Homo sapien
gtctatgcattttccgtgcaagcta

SEQ ID NO: 11716 - DNA, 25 bp, Homo sapien
ccgtgcaagctaaggaagtctctga

SEQ ID NO: 11717 - DNA, 25 bp, Homo sapien
gattatgcataaccttggacttaga

SEQ ID NO: 11718 - DNA, 25 bp, Homo sapien
tagatctggatcttagagctgatac

SEQ ID NO: 11719 - DNA, 25 bp, Homo sapien
gagctgatacttgacctggtactgg

SEQ ID NO: 11720 - DNA, 25 bp, Homo sapien
taaccttggacttcagacatggatt

SEQ ID NO: 11721 - DNA, 25 bp, Homo sapien
taatctgggccttgggatgatttaa

SEQ ID NO: 11722 - DNA, 25 bp, Homo sapien
ttagaccttggacttatgtgcctga

SEQ ID NO: 11723 - DNA, 25 bp, Homo sapien
atgtgcctgagcctggactttggaa

SEQ ID NO: 11724 - DNA, 25 bp, Homo sapien
gaagtggactttgggccttgtaact

SEQ ID NO: 11725 - DNA, 25 bp, Homo sapien
gggccttgtaactcaaccttgaata

SEQ ID NO: 11726 - DNA, 25 bp, Homo sapien
tcaaatgtagactgtgggccaggca

SEQ ID NO: 11727 - DNA, 25 bp, Homo sapien
gctgagcttgtacagctgcactcca

SEQ ID NO: 11728 - DNA, 25 bp, Homo sapien
gggtgccctttgacctgaagaggct

SEQ ID NO: 11729 - DNA, 25 bp, Homo sapien
acctgaagaggctggcattctctgg

SEQ ID NO: 11730 - DNA, 25 bp, Homo sapien
gggagaccgacaagatgggatcaat

SEQ ID NO: 11731 - DNA, 25 bp, Homo sapien
gtctgcccttgacttttgtgcaaaa

SEQ ID NO: 11732 - DNA, 25 bp, Homo sapien
tggcacaaagatctcacttccgtgt

SEQ ID NO: 11733 - DNA, 25 bp, Homo sapien
tcacttccgtgtctgttgtagtagt

SEQ ID NO: 11734 - DNA, 25 bp, Homo sapien
atttgatttatataccctccacctg

SEQ ID NO: 11735 - DNA, 25 bp, Homo sapien
tgtttctttttatggtcttggtaat

SEQ ID NO: 11736 - DNA, 25 bp, Homo sapien
tggtagaaaaggcaaagtccctctt

SEQ ID NO: 11737 - DNA, 25 bp, Homo sapien
caaagtccctcttctagtagagaaa

SEQ ID NO: 11738 - DNA, 25 bp, Homo sapien
tggcgaaactacatctctgctgaag

SEQ ID NO: 11739 - DNA, 25 bp, Homo sapien
tgtgctgacagggcaggagggctga

SEQ ID NO: 11740 - DNA, 25 bp, Homo sapien
ggctgagcggcagacacaaggcact

SEQ ID NO: 11741 - DNA, 25 bp, Homo sapien
ctgagcggcagacacaaggcactcc

SEQ ID NO: 11742 - DNA, 25 bp, Homo sapien
gccagtcttaagtttcagagcatca

SEQ ID NO: 11743 - DNA, 25 bp, Homo sapien
tggtactcaccctggtcctgcagct

SEQ ID NO: 11744 - DNA, 25 bp, Homo sapien
ctgggcccagagacaggatttcgtg

SEQ ID NO: 11745 - DNA, 25 bp, Homo sapien
gggcccagagacaggatttcgtgtt

SEQ ID NO: 11746 - DNA, 25 bp, Homo sapien
cccagagacaggatttcgtgttagc

SEQ ID NO: 11747 - DNA, 25 bp, Homo sapien
gacaggatttcgtgttagcctcctc

SEQ ID NO: 11748 - DNA, 25 bp, Homo sapien
acaggatttcgtgttagcctcctcg

SEQ ID NO: 11749 - DNA, 25 bp, Homo sapien
agaaaaatcgcttgaacttcgggag

SEQ ID NO: 11750 - DNA, 25 bp, Homo sapien
gatccaggatctggtacagctacca

SEQ ID NO: 11751 - DNA, 25 bp, Homo sapien
gatctggtacagctaccatgatgaa

SEQ ID NO: 11752 - DNA, 25 bp, Homo sapien
gaacagcagctcaagaggctcttcc

SEQ ID NO: 11753 - DNA, 25 bp, Homo sapien
caagaggctcttcccctaccagggt

SEQ ID NO: 11754 - DNA, 25 bp, Homo sapien
ctaccagggtactcgatgaaggcaa

SEQ ID NO: 11755 - DNA, 25 bp, Homo sapien
ggtactcgatgaaggcaaggttaat

SEQ ID NO: 11756 - DNA, 25 bp, Homo sapien
ggcaaggttaatatggctccaaaag

SEQ ID NO: 11757 - DNA, 25 bp, Homo sapien
taatatggctccaaaagggccccct

SEQ ID NO: 11758 - DNA, 25 bp, Homo sapien
tttcccaggagtccctctcatgagc

SEQ ID NO: 11759 - DNA, 25 bp, Homo sapien
tgtaccaccacccattcgatatgga

SEQ ID NO: 11760 - DNA, 25 bp, Homo sapien
agctctgcggaccttttgggcctcg

SEQ ID NO: 11761 - DNA, 25 bp, Homo sapien
ttgaacggccctccggacgtggaca

SEQ ID NO: 11762 - DNA, 25 bp, Homo sapien
tccggacgtggacactcgtatacgc

SEQ ID NO: 11763 - DNA, 25 bp, Homo sapien
ggacgtggacactcgtatacgccca

SEQ ID NO: 11764 - DNA, 25 bp, Homo sapien
tatacgcccaccctgcgtgggatct

SEQ ID NO: 11765 - DNA, 25 bp, Homo sapien
gtgggatctccctgcgtggacccat

SEQ ID NO: 11766 - DNA, 25 bp, Homo sapien
tgggaagctaccctggttgtccgct

SEQ ID NO: 11767 - DNA, 25 bp, Homo sapien
aagctaccctggttgtccgctgtct

SEQ ID NO: 11768 - DNA, 25 bp, Homo sapien
gggagctctcattgattctgtgatg

SEQ ID NO: 11769 - DNA, 25 bp, Homo sapien
attgattctgtgatgatgcatgaca

SEQ ID NO: 11770 - DNA, 25 bp, Homo sapien
tgatgatgcatgacagaagagcatt

SEQ ID NO: 11771 - DNA, 25 bp, Homo sapien
gctctgttgccaggcaggcttgagt

SEQ ID NO: 11772 - DNA, 25 bp, Homo sapien
tgacccagggcaagtcactctgcat

SEQ ID NO: 11773 - DNA, 25 bp, Homo sapien
cttggtgtcccgtctgtgaagtgtg

SEQ ID NO: 11774 - DNA, 25 bp, Homo sapien
gtgtggctggtagtaatgtctgtct

SEQ ID NO: 11775 - DNA, 25 bp, Homo sapien
aatgtctgtcttggagggctgctgt

SEQ ID NO: 11776 - DNA, 25 bp, Homo sapien
gaatgcgattcaagtgcgtggaaca

SEQ ID NO: 11777 - DNA, 25 bp, Homo sapien
gcgtggaacagcacctggcacagaa

SEQ ID NO: 11778 - DNA, 25 bp, Homo sapien
aaagtgtctgatgttccatccgtca

SEQ ID NO: 11779 - DNA, 25 bp, Homo sapien
atccgtcagaagatcagcacctatg

SEQ ID NO: 11780 - DNA, 25 bp, Homo sapien
agcacctatgccaaagtgagcgcag

SEQ ID NO: 11781 - DNA, 25 bp, Homo sapien
agtgagcgcagggactgctgcccaa

SEQ ID NO: 11782 - DNA, 25 bp, Homo sapien
tgtagtgacccttgatcagctccac

SEQ ID NO: 11783 - DNA, 25 bp, Homo sapien
ccccaaattgctgctctgttttctt

SEQ ID NO: 11784 - DNA, 25 bp, Homo sapien
gttttcttaactggcttggcttgga

SEQ ID NO: 11785 - DNA, 25 bp, Homo sapien
ttggcttggactcatcgtcaacagc

SEQ ID NO: 11786 - DNA, 25 bp, Homo sapien
atcatcaatggctgagccctcactg

SEQ ID NO: 11787 - DNA, 25 bp, Homo sapien
actgtgcttcctgggagccgggctc

SEQ ID NO: 11788 - DNA, 25 bp, Homo sapien
gagggaacaaagtcacctgtcagga

SEQ ID NO: 11789 - DNA, 25 bp, Homo sapien
gtcacctgtcaggatcatgtggaaa

SEQ ID NO: 11790 - DNA, 25 bp, Homo sapien
gaggccaagggtggatttaacccag

SEQ ID NO: 11791 - DNA, 25 bp, Homo sapien
ttaacccaggcaccacatgattgga

SEQ ID NO: 11792 - DNA, 25 bp, Homo sapien
tgcagtgcctgcgttagaaaagcat

SEQ ID NO: 11793 - DNA, 25 bp, Homo sapien
aaagcattctaaggctgaggtgggc

SEQ ID NO: 11794 - DNA, 25 bp, Homo sapien
ctgggccaacatagctacaaattta

SEQ ID NO: 11795 - DNA, 25 bp, Homo sapien
tgggccaacatagctacaaatttag

SEQ ID NO: 11796 - DNA, 25 bp, Homo sapien
ggccaacatagctacaaatttagaa

SEQ ID NO: 11797 - DNA, 25 bp, Homo sapien
taaaactacaaacatcagccgaggt

SEQ ID NO: 11798 - DNA, 25 bp, Homo sapien
aaactacaaacatcagccgaggttg

SEQ ID NO: 11799 - DNA, 25 bp, Homo sapien
actacaaacatcagccgaggttggt

SEQ ID NO: 11800 - DNA, 25 bp, Homo sapien
caaacatcagccgaggttggtggta

SEQ ID NO: 11801 - DNA, 25 bp, Homo sapien
aaacatcagccgaggttggtggtat

SEQ ID NO: 11802 - DNA, 25 bp, Homo sapien
acatcagccgaggttggtggtatgc

SEQ ID NO: 11803 - DNA, 25 bp, Homo sapien
atcagccgaggttggtggtatgcac

SEQ ID NO: 11804 - DNA, 25 bp, Homo sapien
tcagccgaggttggtggtatgcacc

SEQ ID NO: 11805 - DNA, 25 bp, Homo sapien
ggtcctgaccttccactagtagtga

SEQ ID NO: 11806 - DNA, 25 bp, Homo sapien
tagtgagaccaatccagctcttgct

SEQ ID NO: 11807 - DNA, 25 bp, Homo sapien
aggtgggtccaggtcctgatctctt

SEQ ID NO: 11808 - DNA, 25 bp, Homo sapien
tctcttcttctaaatatcagctctg

SEQ ID NO: 11809 - DNA, 25 bp, Homo sapien
gaaaaagaacccttcctattctctg

SEQ ID NO: 11810 - DNA, 25 bp, Homo sapien
ctattctctgccctattttggagat

SEQ ID NO: 11811 - DNA, 25 bp, Homo sapien
agttgagaggttcttcaccgttctt

SEQ ID NO: 11812 - DNA, 25 bp, Homo sapien
cgttcttggttcacggtgccattag

SEQ ID NO: 11813 - DNA, 25 bp, Homo sapien
acggtgccattagtgtctcattaat

SEQ ID NO: 11814 - DNA, 25 bp, Homo sapien
taatttttccagtatcccttgaaca

SEQ ID NO: 11815 - DNA, 25 bp, Homo sapien
aattaagtagttagggctgggcata

SEQ ID NO: 11816 - DNA, 25 bp, Homo sapien
gaagaggtaagtggccccttcagac

SEQ ID NO: 11817 - DNA, 25 bp, Homo sapien
ggccccttcagacaagcatatatgt

SEQ ID NO: 11818 - DNA, 25 bp, Homo sapien
atgttggctcatatcctagattccc

SEQ ID NO: 11819 - DNA, 25 bp, Homo sapien
tggctcatatcctagattcccaaac

SEQ ID NO: 11820 - DNA, 25 bp, Homo sapien
tagattcccaaacccagagagaacg

SEQ ID NO: 11821 - DNA, 25 bp, Homo sapien
cccagagagaacgaatgcaggtata

SEQ ID NO: 11822 - DNA, 25 bp, Homo sapien
aatgcaggtatagtttgtgtcagga

SEQ ID NO: 11823 - DNA, 25 bp, Homo sapien
ggatggagctgttgacataggcccc

SEQ ID NO: 11824 - DNA, 25 bp, Homo sapien
cataggccccctggatttatgtatt

SEQ ID NO: 11825 - DNA, 25 bp, Homo sapien
agtctcctgccccagtagctagggc

SEQ ID NO: 11826 - DNA, 25 bp, Homo sapien
taccacattggccagactaagcatt

SEQ ID NO: 11827 - DNA, 25 bp, Homo sapien
aatacagcagtataatcttatggga

SEQ ID NO: 11828 - DNA, 25 bp, Homo sapien
ttgtatatgtggtccatcgttgatg

SEQ ID NO: 11829 - DNA, 25 bp, Homo sapien
ccatcgttgatggaaacattgttat

SEQ ID NO: 11830 - DNA, 25 bp, Homo sapien
acatgactgtatatgcttcgtatat

SEQ ID NO: 11831 - DNA, 25 bp, Homo sapien
cttcgtatatagtgaacattcagca

SEQ ID NO: 11832 - DNA, 25 bp, Homo sapien
aattggcaacttttatgggcttaat

SEQ ID NO: 11833 - DNA, 25 bp, Homo sapien
ttatgggcttaattgggctaaaata

SEQ ID NO: 11834 - DNA, 25 bp, Homo sapien
gggctaaaatatatacggagtcact

SEQ ID NO: 11835 - DNA, 25 bp, Homo sapien
gtcactatttgacttaacacctaga

SEQ ID NO: 11836 - DNA, 25 bp, Homo sapien
agccttccttccatttgggtgcaat

SEQ ID NO: 11837 - DNA, 25 bp, Homo sapien
catttgggtgcaatttccacttggg

SEQ ID NO: 11838 - DNA, 25 bp, Homo sapien
taatcctaatactcctaccaacagt

SEQ ID NO: 11839 - DNA, 25 bp, Homo sapien
tcctttttctctgtaacttcaccag

SEQ ID NO: 11840 - DNA, 25 bp, Homo sapien
ctgtaacttcaccagaatctgtttt

SEQ ID NO: 11841 - DNA, 25 bp, Homo sapien
ttgactttgtaatagccatgggctg

SEQ ID NO: 11842 - DNA, 25 bp, Homo sapien
acaggaatgtacaccagtacccagt

SEQ ID NO: 11843 - DNA, 25 bp, Homo sapien
cagtacccagtacagtgtatccctg

SEQ ID NO: 11844 - DNA, 25 bp, Homo sapien
cagtacagtgtatccctggaatgca

SEQ ID NO: 11845 - DNA, 25 bp, Homo sapien
atgcaacgttatttcatcagctgga

SEQ ID NO: 11846 - DNA, 25 bp, Homo sapien
gaaatgattagtgcaacagactgaa

SEQ ID NO: 11847 - DNA, 25 bp, Homo sapien
aaacaacatggtcatctcaatagat

SEQ ID NO: 11848 - DNA, 25 bp, Homo sapien
ctcaatagattgtggacggctggaa

SEQ ID NO: 11849 - DNA, 25 bp, Homo sapien
atccatgactgataatcggctcaca

SEQ ID NO: 11850 - DNA, 25 bp, Homo sapien
atcggctcacatcccttcaagggag

SEQ ID NO: 11851 - DNA, 25 bp, Homo sapien
gagaagctgccatgtgcttcgtgtc

SEQ ID NO: 11852 - DNA, 25 bp, Homo sapien
atgtgcttcgtgtccagagatgcag

SEQ ID NO: 11853 - DNA, 25 bp, Homo sapien
gcagaggaaacacactatgacatca

SEQ ID NO: 11854 - DNA, 25 bp, Homo sapien
ggaatagcacgttcccagacacaga

SEQ ID NO: 11855 - DNA, 25 bp, Homo sapien
cagacacagacatggccagttgaag

SEQ ID NO: 11856 - DNA, 25 bp, Homo sapien
ggccagttgaaggacatacccacat

SEQ ID NO: 11857 - DNA, 25 bp, Homo sapien
ggttatagctatgcctatctctcct

SEQ ID NO: 11858 - DNA, 25 bp, Homo sapien
caactgcttgacttttccatctgaa

SEQ ID NO: 11859 - DNA, 25 bp, Homo sapien
gaacccaggagatcacaccattgaa

SEQ ID NO: 11860 - DNA, 25 bp, Homo sapien
ttcacttcctgtctttatctctatt

SEQ ID NO: 11861 - DNA, 25 bp, Homo sapien
tcacttcctgtctttatctctattt

SEQ ID NO: 11862 - DNA, 25 bp, Homo sapien
cacttcctgtctttatctctatttt

SEQ ID NO: 11863 - DNA, 25 bp, Homo sapien
acttcctgtctttatctctattttc

SEQ ID NO: 11864 - DNA, 25 bp, Homo sapien
tcctgtctttatctctattttcttt

SEQ ID NO: 11865 - DNA, 25 bp, Homo sapien
ttgcttaatcatgcgctttgttttt

SEQ ID NO: 11866 - DNA, 25 bp, Homo sapien
tgcttaatcatgcgctttgtttttt

SEQ ID NO: 11867 - DNA, 25 bp, Homo sapien
gcttaatcatgcgctttgtttttta

SEQ ID NO: 11868 - DNA, 25 bp, Homo sapien
cttaatcatgcgctttgttttttat

SEQ ID NO: 11869 - DNA, 25 bp, Homo sapien
ttaatcatgcgctttgttttttatg

SEQ ID NO: 11870 - DNA, 25 bp, Homo sapien
taatcatgcgctttgttttttatgc

SEQ ID NO: 11871 - DNA, 25 bp, Homo sapien
cttgttgcttgactgttggcagcac

SEQ ID NO: 11872 - DNA, 25 bp, Homo sapien
ttgactgttggcagcacctgcttac

SEQ ID NO: 11873 - DNA, 25 bp, Homo sapien
gttggcagcacctgcttacttacca

SEQ ID NO: 11874 - DNA, 25 bp, Homo sapien
acctgcttacttaccactcatggtg

SEQ ID NO: 11875 - DNA, 25 bp, Homo sapien
gcttacttaccactcatggtgcaag

SEQ ID NO: 11876 - DNA, 25 bp, Homo sapien
taccactcatggtgcaagatgacac

SEQ ID NO: 11877 - DNA, 25 bp, Homo sapien
tggtgcaagatgacacttcagcctc

SEQ ID NO: 11878 - DNA, 25 bp, Homo sapien
tgcaagatgacacttcagcctccgc

SEQ ID NO: 11879 - DNA, 25 bp, Homo sapien
aaaatgctcaccttccagccagcag

SEQ ID NO: 11880 - DNA, 25 bp, Homo sapien
catggcgtccatccttagaggatgc

SEQ ID NO: 11881 - DNA, 25 bp, Homo sapien
catccttagaggatgctgccacctg

SEQ ID NO: 11882 - DNA, 25 bp, Homo sapien
agaaatatacttaatgcagccataa

SEQ ID NO: 11883 - DNA, 25 bp, Homo sapien
taagtttataggcagcagcactcat

SEQ ID NO: 11884 - DNA, 25 bp, Homo sapien
aggcagcagcactcattagaaaaga

SEQ ID NO: 11885 - DNA, 25 bp, Homo sapien
caagttattttatttccctgtgtct

SEQ ID NO: 11886 - DNA, 25 bp, Homo sapien
gtgtctccatttgctgtctgtaaaa

SEQ ID NO: 11887 - DNA, 25 bp, Homo sapien
gggataataacacttcattggattt

SEQ ID NO: 11888 - DNA, 25 bp, Homo sapien
tcattggattttgcagtagcctagc

SEQ ID NO: 11889 - DNA, 25 bp, Homo sapien
gcagtagcctagcatatgtaatgtg

SEQ ID NO: 11890 - DNA, 25 bp, Homo sapien
tatgtaatgtgcttattcctgtcag

SEQ ID NO: 11891 - DNA, 25 bp, Homo sapien
tattcctgtcagctggcacacagta

SEQ ID NO: 11892 - DNA, 25 bp, Homo sapien
aaagtagcagttttgggctgggtat

SEQ ID NO: 11893 - DNA, 25 bp, Homo sapien
attctaggacaggtgaaaataatca

SEQ ID NO: 11894 - DNA, 25 bp, Homo sapien
ggccataagggaactttttgcagtg

SEQ ID NO: 11895 - DNA, 25 bp, Homo sapien
ttactaaccagtacacttaaaatgg

SEQ ID NO: 11896 - DNA, 25 bp, Homo sapien
aaattatagcttaatggccaggtgc

SEQ ID NO: 11897 - DNA, 25 bp, Homo sapien
aattatagcttaatggccaggtgcg

SEQ ID NO: 11898 - DNA, 25 bp, Homo sapien
gagtgaaagaaaccacgtgttaaag

SEQ ID NO: 11899 - DNA, 25 bp, Homo sapien
aaccacgtgttaaagagtgtatact

SEQ ID NO: 11900 - DNA, 25 bp, Homo sapien
agtgtatactgtgactctatgtaga

SEQ ID NO: 11901 - DNA, 25 bp, Homo sapien
gtatactgtgactctatgtagatga

SEQ ID NO: 11902 - DNA, 25 bp, Homo sapien
ctgtgactctatgtagatgaaattc

SEQ ID NO: 11903 - DNA, 25 bp, Homo sapien
gatgaaattctaggacaggtgaaaa

SEQ ID NO: 11904 - DNA, 25 bp, Homo sapien
catgttttccaagtatttcgtactg

SEQ ID NO: 11905 - DNA, 25 bp, Homo sapien
gtatttcgtactgttgtggaactgt

SEQ ID NO: 11906 - DNA, 25 bp, Homo sapien
cgtactgttgtggaactgtatcatt

SEQ ID NO: 11907 - DNA, 25 bp, Homo sapien
gttgtggaactgtatcattgtggaa

SEQ ID NO: 11908 - DNA, 25 bp, Homo sapien
gtatcattgtggaaaagtctgaaat

SEQ ID NO: 11909 - DNA, 25 bp, Homo sapien
atccaagatgtaaaggtagtaactg

SEQ ID NO: 11910 - DNA, 25 bp, Homo sapien
gtaactgttaagcttctaattgatt

SEQ ID NO: 11911 - DNA, 25 bp, Homo sapien
gtctttctttgtgtctacttctata

SEQ ID NO: 11912 - DNA, 25 bp, Homo sapien
gtgtctacttctatatttgttgata

SEQ ID NO: 11913 - DNA, 25 bp, Homo sapien
tattgctaatagagactaaactagt

SEQ ID NO: 11914 - DNA, 25 bp, Homo sapien
ctaaactagtgaggctggttgtggt

SEQ ID NO: 11915 - DNA, 25 bp, Homo sapien
tgaatgtagcccctgacacatacag

SEQ ID NO: 11916 - DNA, 25 bp, Homo sapien
ctgacacatacaggccagaggcaga

SEQ ID NO: 11917 - DNA, 25 bp, Homo sapien
aagcaaagaggccttcatccatcca

SEQ ID NO: 11918 - DNA, 25 bp, Homo sapien
ccacccatgcaaccaacaaatatgt

SEQ ID NO: 11919 - DNA, 25 bp, Homo sapien
aatatgtatggagcatctactatgt

SEQ ID NO: 11920 - DNA, 25 bp, Homo sapien
gtgccaggcgctgagttatggacac

SEQ ID NO: 11921 - DNA, 25 bp, Homo sapien
gttatggacacagcatgaacaagat

SEQ ID NO: 11922 - DNA, 25 bp, Homo sapien
aagatggatacggtcctgctctctt

SEQ ID NO: 11923 - DNA, 25 bp, Homo sapien
cctgctctcttggagctgacattct

SEQ ID NO: 11924 - DNA, 25 bp, Homo sapien
tgtgttgaaatgtgatgcccagcca

SEQ ID NO: 11925 - DNA, 25 bp, Homo sapien
aaatgtgatgcccagccaggcatgg

SEQ ID NO: 11926 - DNA, 25 bp, Homo sapien
gatcgtgggctcagaaatagacagt

SEQ ID NO: 11927 - DNA, 25 bp, Homo sapien
tagacagtacgggaaaattcgcttt

SEQ ID NO: 11928 - DNA, 25 bp, Homo sapien
gaaaattcgcttttcctgcttctgt

SEQ ID NO: 11929 - DNA, 25 bp, Homo sapien
tttcctgcttctgtagtgtctccaa

SEQ ID NO: 11930 - DNA, 25 bp, Homo sapien
gtgtctccaaccactcaagtgctgg

SEQ ID NO: 11931 - DNA, 25 bp, Homo sapien
gggcaggaactttcgcgtcctcaag

SEQ ID NO: 11932 - DNA, 25 bp, Homo sapien
gaactttcgcgtcctcaagtacttt

SEQ ID NO: 11933 - DNA, 25 bp, Homo sapien
ctcggagccttgaggacaaggaccg

SEQ ID NO: 11934 - DNA, 25 bp, Homo sapien
gttctggaagtttcgggagctgaca

SEQ ID NO: 11935 - DNA, 25 bp, Homo sapien
ggagctgacagcagacactggtctc

SEQ ID NO: 11936 - DNA, 25 bp, Homo sapien
agcagacactggtctctacctggcg

SEQ ID NO: 11937 - DNA, 25 bp, Homo sapien
cccctccaaattatagtattgtctt

SEQ ID NO: 11938 - DNA, 25 bp, Homo sapien
agtattgtctttggagtgtttgatc

SEQ ID NO: 11939 - DNA, 25 bp, Homo sapien
gtctttggagtgtttgatccacatt

SEQ ID NO: 11940 - DNA, 25 bp, Homo sapien
gtgtttgatccacattggcagggac

SEQ ID NO: 11941 - DNA, 25 bp, Homo sapien
ttgatccacattggcagggactggg

SEQ ID NO: 11942 - DNA, 25 bp, Homo sapien
caggaaaagtcattagcaattgcac

SEQ ID NO: 11943 - DNA, 25 bp, Homo sapien
gtcattagcaattgcacttagaatt

SEQ ID NO: 11944 - DNA, 25 bp, Homo sapien
aaatcatgacagaaagaccggtgca

SEQ ID NO: 11945 - DNA, 25 bp, Homo sapien
tcatgacagaaagaccggtgcagtg

SEQ ID NO: 11946 - DNA, 25 bp, Homo sapien
ttgggagcctaaggcaggtgatcgc

SEQ ID NO: 11947 - DNA, 25 bp, Homo sapien
ctataaccactatgaagttcccctc

SEQ ID NO: 11948 - DNA, 25 bp, Homo sapien
gcacacataaagatacgcatagcat

SEQ ID NO: 11949 - DNA, 25 bp, Homo sapien
tacgcatagcatgattgagggcttg

SEQ ID NO: 11950 - DNA, 25 bp, Homo sapien
gagggcttggtgttttgtttctgta

SEQ ID NO: 11951 - DNA, 25 bp, Homo sapien
aacactggatttgaaacgaaactat

SEQ ID NO: 11952 - DNA, 25 bp, Homo sapien
taatgagaatgtatagcagggctgg

SEQ ID NO: 11953 - DNA, 25 bp, Homo sapien
gctgggcgaatgacaggcttgctta

SEQ ID NO: 11954 - DNA, 25 bp, Homo sapien
aatgacaggcttgcttatgactgga

SEQ ID NO: 11955 - DNA, 25 bp, Homo sapien
tatgactggagggtcaagggctatt

SEQ ID NO: 11956 - DNA, 25 bp, Homo sapien
ggatgtaatcagattagctcagtgt

SEQ ID NO: 11957 - DNA, 25 bp, Homo sapien
tatagctatgcattttagcgtttaa

SEQ ID NO: 11958 - DNA, 25 bp, Homo sapien
ttaaaccatggtaaagaacagcttt

SEQ ID NO: 11959 - DNA, 25 bp, Homo sapien
acgcccggccaagggcagaaactgt

SEQ ID NO: 11960 - DNA, 25 bp, Homo sapien
ccggccaagggcagaaactgttata

SEQ ID NO: 11961 - DNA, 25 bp, Homo sapien
aaactgttataccttgttcaccgct

SEQ ID NO: 11962 - DNA, 25 bp, Homo sapien
actgttataccttgttcaccgctgt

SEQ ID NO: 11963 - DNA, 25 bp, Homo sapien
gtttcctgggcacctattatagtgc

SEQ ID NO: 11964 - DNA, 25 bp, Homo sapien
ctgggcacctattatagtgcctggt

SEQ ID NO: 11965 - DNA, 25 bp, Homo sapien
cacctattatagtgcctggtatata

SEQ ID NO: 11966 - DNA, 25 bp, Homo sapien
ggtatatagtaggagctcaagaagt

SEQ ID NO: 11967 - DNA, 25 bp, Homo sapien
gtaggagctcaagaagtgtttgtta

SEQ ID NO: 11968 - DNA, 25 bp, Homo sapien
agtgtttgttagggcctgatgtgtt

SEQ ID NO: 11969 - DNA, 25 bp, Homo sapien
gggcctgatgtgttggcgcaagcct

SEQ ID NO: 11970 - DNA, 25 bp, Homo sapien
gaaagtctccaatggaaggtaatgc

SEQ ID NO: 11971 - DNA, 25 bp, Homo sapien
gaatctaatgtattattaaccccag

SEQ ID NO: 11972 - DNA, 25 bp, Homo sapien
aatgtattattaaccccaggatata

SEQ ID NO: 11973 - DNA, 25 bp, Homo sapien
taaccccaggatatatagaggccga

SEQ ID NO: 11974 - DNA, 25 bp, Homo sapien
atatagaggccgaagcactgaatga

SEQ ID NO: 11975 - DNA, 25 bp, Homo sapien
aggccgaagcactgaatgaggagct

SEQ ID NO: 11976 - DNA, 25 bp, Homo sapien
gcactgaatgaggagcttggatgct

SEQ ID NO: 11977 - DNA, 25 bp, Homo sapien
cctgtacccctagagtcacattatt

SEQ ID NO: 11978 - DNA, 25 bp, Homo sapien
gtacccctagagtcacattattaat

SEQ ID NO: 11979 - DNA, 25 bp, Homo sapien
cacattattaataaccttcctttag

SEQ ID NO: 11980 - DNA, 25 bp, Homo sapien
aaactgaccttagaggccgggcgca

SEQ ID NO: 11981 - DNA, 25 bp, Homo sapien
tcctggccatcacggccttcaggga

SEQ ID NO: 11982 - DNA, 25 bp, Homo sapien
gaccacaagatcaaccacctgggct

SEQ ID NO: 11983 - DNA, 25 bp, Homo sapien
tgggctgcctggtcttcagcagccg

SEQ ID NO: 11984 - DNA, 25 bp, Homo sapien
cgctcccacctgaagtgaaaggcag

SEQ ID NO: 11985 - DNA, 25 bp, Homo sapien
aggcacagtggtctctgaacagccg

SEQ ID NO: 11986 - DNA, 25 bp, Homo sapien
ctgaacagccggcacaggacagtaa

SEQ ID NO: 11987 - DNA, 25 bp, Homo sapien
ggacagtaaagctcagtctgctaac

SEQ ID NO: 11988 - DNA, 25 bp, Homo sapien
agtctgctaacagctcggctcagga

SEQ ID NO: 11989 - DNA, 25 bp, Homo sapien
acagctcggctcaggacagcagcaa

SEQ ID NO: 11990 - DNA, 25 bp, Homo sapien
caaagtgaaactgccgccaagtgct

SEQ ID NO: 11991 - DNA, 25 bp, Homo sapien
aaactgccgccaagtgctgatatgt

SEQ ID NO: 11992 - DNA, 25 bp, Homo sapien
agactgactaagaaactattggaat

SEQ ID NO: 11993 - DNA, 25 bp, Homo sapien
ataggccatgtgagatcagttcaag

SEQ ID NO: 11994 - DNA, 25 bp, Homo sapien
gttcaagggcctgaaacctgcggaa

SEQ ID NO: 11995 - DNA, 25 bp, Homo sapien
aaacctgcggaagagccacggaaat

SEQ ID NO: 11996 - DNA, 25 bp, Homo sapien
aaaatgactgtgcttggtgaccaac

SEQ ID NO: 11997 - DNA, 25 bp, Homo sapien
gtcagaggtcacacgaagctttcta

SEQ ID NO: 11998 - DNA, 25 bp, Homo sapien
acacgaagctttctagtctctgcag

SEQ ID NO: 11999 - DNA, 25 bp, Homo sapien
gtctctgcagctgtgttactatata

SEQ ID NO: 12000 - DNA, 25 bp, Homo sapien
caatgatcgtgacaaggaagaccaa

SEQ ID NO: 12001 - DNA, 25 bp, Homo sapien
gaaaatttgaatctagcactcagca

SEQ ID NO: 12002 - DNA, 25 bp, Homo sapien
ctagcactcagcaaatgaccatttt

SEQ ID NO: 12003 - DNA, 25 bp, Homo sapien
tgattttctcatgtggcacttctgt

SEQ ID NO: 12004 - DNA, 25 bp, Homo sapien
caggagatcacagcgcgggttttgt

SEQ ID NO: 12005 - DNA, 25 bp, Homo sapien
gttttgttggctgctcatggacccc

SEQ ID NO: 12006 - DNA, 25 bp, Homo sapien
caatgaggctcatacctgactgaat

SEQ ID NO: 12007 - DNA, 25 bp, Homo sapien
acctgactgaatgaaggacccttgg

SEQ ID NO: 12008 - DNA, 25 bp, Homo sapien
ggaggcccagtctcctctgagaaaa

SEQ ID NO: 12009 - DNA, 25 bp, Homo sapien
gtctcctctgagaaaagcctaacca

SEQ ID NO: 12010 - DNA, 25 bp, Homo sapien
gggacatcttctcttgtctataacc

SEQ ID NO: 12011 - DNA, 25 bp, Homo sapien
aaccaaggtagattgctcccatgca

SEQ ID NO: 12012 - DNA, 25 bp, Homo sapien
ttgctcccatgcacacagatgatca

SEQ ID NO: 12013 - DNA, 25 bp, Homo sapien
attgtgttttgcgttatactaccaa

SEQ ID NO: 12014 - DNA, 25 bp, Homo sapien
ggacagatgactgatttgtagtttt

SEQ ID NO: 12015 - DNA, 25 bp, Homo sapien
ttttcatttggacactgtccttgcc

SEQ ID NO: 12016 - DNA, 25 bp, Homo sapien
tcatttggacactgtccttgccgca

SEQ ID NO: 12017 - DNA, 25 bp, Homo sapien
ttggacactgtccttgccgcacaag

SEQ ID NO: 12018 - DNA, 25 bp, Homo sapien
tgtccttgccgcacaagcacagcag

SEQ ID NO: 12019 - DNA, 25 bp, Homo sapien
agcacagcagcttgaacctctttga

SEQ ID NO: 12020 - DNA, 25 bp, Homo sapien
acagcagcttgaacctctttgaaca

SEQ ID NO: 12021 - DNA, 25 bp, Homo sapien
gcagcttgaacctctttgaacaaga

SEQ ID NO: 12022 - DNA, 25 bp, Homo sapien
gaacctctttgaacaagagtcgaga

SEQ ID NO: 12023 - DNA, 25 bp, Homo sapien
cagctaattacccactagttaaact

SEQ ID NO: 12024 - DNA, 25 bp, Homo sapien
gacaaaagttaaattcgctgggcgt

SEQ ID NO: 12025 - DNA, 25 bp, Homo sapien
tcaaggtgtggttcgggccatctga

SEQ ID NO: 12026 - DNA, 25 bp, Homo sapien
ggccatctgagtccctcattggctg

SEQ ID NO: 12027 - DNA, 25 bp, Homo sapien
tatgtccttggctgcaaagggctgt

SEQ ID NO: 12028 - DNA, 25 bp, Homo sapien
aaagggctgtgtcctgactctgcag

SEQ ID NO: 12029 - DNA, 25 bp, Homo sapien
gataagcaaaaggaccctgggtaag

SEQ ID NO: 12030 - DNA, 25 bp, Homo sapien
tgggtaagtggttttcttctctgct

SEQ ID NO: 12031 - DNA, 25 bp, Homo sapien
gactctgctttctaaggtctcacaa

SEQ ID NO: 12032 - DNA, 25 bp, Homo sapien
tctaaggtctcacaaagtttcaatg

SEQ ID NO: 12033 - DNA, 25 bp, Homo sapien
gggtaccaagcactttgcagactgc

SEQ ID NO: 12034 - DNA, 25 bp, Homo sapien
tttgcagactgctttacctcattca

SEQ ID NO: 12035 - DNA, 25 bp, Homo sapien
aatcgaaaaatcacacaggctgggt

SEQ ID NO: 12036 - DNA, 25 bp, Homo sapien
tgacccgagatcaggccactgttct

SEQ ID NO: 12037 - DNA, 25 bp, Homo sapien
gtggcaggtgcctggctacttggga

SEQ ID NO: 12038 - DNA, 25 bp, Homo sapien
ccatgacatgacaattcgtgacagg

SEQ ID NO: 12039 - DNA, 25 bp, Homo sapien
atgacatgacaattcgtgacaggcc

SEQ ID NO: 12040 - DNA, 25 bp, Homo sapien
tgacatgacaattcgtgacaggccc

SEQ ID NO: 12041 - DNA, 25 bp, Homo sapien
gacaattcgtgacaggccctttgaa

SEQ ID NO: 12042 - DNA, 25 bp, Homo sapien
gccctttgaacggacgattaccaag

SEQ ID NO: 12043 - DNA, 25 bp, Homo sapien
tgaacggacgattaccaagcataag

SEQ ID NO: 12044 - DNA, 25 bp, Homo sapien
gattaccaagcataaggatagcact

SEQ ID NO: 12045 - DNA, 25 bp, Homo sapien
ggatagcactagacatgttggtttt

SEQ ID NO: 12046 - DNA, 25 bp, Homo sapien
ctagacatgttggttttatctttaa

SEQ ID NO: 12047 - DNA, 25 bp, Homo sapien
tctgcaaacctgttagggtcactgt

SEQ ID NO: 12048 - DNA, 25 bp, Homo sapien
gggcatgagcctacagtcccccgtg

SEQ ID NO: 12049 - DNA, 25 bp, Homo sapien
gtttgtccgggtgagtcccagaaga

SEQ ID NO: 12050 - DNA, 25 bp, Homo sapien
gctaagggacaccaagtcaagtgcc

SEQ ID NO: 12051 - DNA, 25 bp, Homo sapien
gggacaccaagtcaagtgccaaaga

SEQ ID NO: 12052 - DNA, 25 bp, Homo sapien
agtgccaaagacagacgtgctccgc

SEQ ID NO: 12053 - DNA, 25 bp, Homo sapien
tgccaaagacagacgtgctccgcct

SEQ ID NO: 12054 - DNA, 25 bp, Homo sapien
tcctcactgccacaggagctgatgg

SEQ ID NO: 12055 - DNA, 25 bp, Homo sapien
tggacctgggctatgtgagtctcct

SEQ ID NO: 12056 - DNA, 25 bp, Homo sapien
acctgggctatgtgagtctcctctg

SEQ ID NO: 12057 - DNA, 25 bp, Homo sapien
tgggctatgtgagtctcctctgctc

SEQ ID NO: 12058 - DNA, 25 bp, Homo sapien
tagaggaacacctgcgtggcgccgt

SEQ ID NO: 12059 - DNA, 25 bp, Homo sapien
agaggaacacctgcgtggcgccgtc

SEQ ID NO: 12060 - DNA, 25 bp, Homo sapien
aggaacacctgcgtggcgccgtcgg

SEQ ID NO: 12061 - DNA, 25 bp, Homo sapien
ggaacacctgcgtggcgccgtcggt

SEQ ID NO: 12062 - DNA, 25 bp, Homo sapien
gaacacctgcgtggcgccgtcggtc

SEQ ID NO: 12063 - DNA, 25 bp, Homo sapien
ttgtcccgcaggcactggccaacat

SEQ ID NO: 12064 - DNA, 25 bp, Homo sapien
tgtcccgcaggcactggccaacatg

SEQ ID NO: 12065 - DNA, 25 bp, Homo sapien
gtcccgcaggcactggccaacatgg

SEQ ID NO: 12066 - DNA, 25 bp, Homo sapien
tcccgcaggcactggccaacatggc

SEQ ID NO: 12067 - DNA, 25 bp, Homo sapien
tgggcgtggtgataggcgcttgtaa

SEQ ID NO: 12068 - DNA, 25 bp, Homo sapien
aaaaattgctggacgcggtggccca

SEQ ID NO: 12069 - DNA, 25 bp, Homo sapien
gaaatatcccactatgcaatcctat

SEQ ID NO: 12070 - DNA, 25 bp, Homo sapien
gcattagttacctaccagcttgaca

SEQ ID NO: 12071 - DNA, 25 bp, Homo sapien
gatttccaaatctgacacaccatag

SEQ ID NO: 12072 - DNA, 25 bp, Homo sapien
tgacacaccatagcctgaattctca

SEQ ID NO: 12073 - DNA, 25 bp, Homo sapien
aattctcaccagtttgctcctggaa

SEQ ID NO: 12074 - DNA, 25 bp, Homo sapien
gtgggatggcagtaatctctgctaa

SEQ ID NO: 12075 - DNA, 25 bp, Homo sapien
gataaacgggagcttctgtggataa

SEQ ID NO: 12076 - DNA, 25 bp, Homo sapien
aatgcctctacagtgcttagataca

SEQ ID NO: 12077 - DNA, 25 bp, Homo sapien
ggaattccagaggtagagcactgct

SEQ ID NO: 12078 - DNA, 25 bp, Homo sapien
gagcactgctgattggagacatatt

SEQ ID NO: 12079 - DNA, 25 bp, Homo sapien
gtcattgtatgtattcaggtgtcca

SEQ ID NO: 12080 - DNA, 25 bp, Homo sapien
ggatgaggcaacacagcccttagga

SEQ ID NO: 12081 - DNA, 25 bp, Homo sapien
acacagcccttaggaatgcatccaa

SEQ ID NO: 12082 - DNA, 25 bp, Homo sapien
atgcatccaagattcaggcaccctg

SEQ ID NO: 12083 - DNA, 25 bp, Homo sapien
ttcaggcaccctgaagatctctgct

SEQ ID NO: 12084 - DNA, 25 bp, Homo sapien
tctctgctttgctcagcttaaactc

SEQ ID NO: 12085 - DNA, 25 bp, Homo sapien
tgctcagcttaaactctaagtggaa

SEQ ID NO: 12086 - DNA, 25 bp, Homo sapien
tactttcttcagtagttgtaccctg

SEQ ID NO: 12087 - DNA, 25 bp, Homo sapien
ttcagtagttgtaccctgtctcctt

SEQ ID NO: 12088 - DNA, 25 bp, Homo sapien
cctgtctccttccaagtgatttgaa

SEQ ID NO: 12089 - DNA, 25 bp, Homo sapien
tttgaaggtatctggcggattgcac

SEQ ID NO: 12090 - DNA, 25 bp, Homo sapien
gcacgcaaggtgaaacaaggtattt

SEQ ID NO: 12091 - DNA, 25 bp, Homo sapien
gcatgggtaccttttacatgtcccg

SEQ ID NO: 12092 - DNA, 25 bp, Homo sapien
ttacatgtcccgaaggagctatgct

SEQ ID NO: 12093 - DNA, 25 bp, Homo sapien
aaggagctatgctggcagttcccca

SEQ ID NO: 12094 - DNA, 25 bp, Homo sapien
cagttccccaatctaccttctttga

SEQ ID NO: 12095 - DNA, 25 bp, Homo sapien
aatcctgtgttctatgactttcttt

SEQ ID NO: 12096 - DNA, 25 bp, Homo sapien
acttcctgtagagagtaagccacgt

SEQ ID NO: 12097 - DNA, 25 bp, Homo sapien
agccacgtgacatataatccccaaa

SEQ ID NO: 12098 - DNA, 25 bp, Homo sapien
ataatccccaaagagacacaggtgt

SEQ ID NO: 12099 - DNA, 25 bp, Homo sapien
acaggtgtaatcactgtgaggccat

SEQ ID NO: 12100 - DNA, 25 bp, Homo sapien
gacaaccctttgttttattgcactt

SEQ ID NO: 12101 - DNA, 25 bp, Homo sapien
tgttttattgcactttctctatttc

SEQ ID NO: 12102 - DNA, 25 bp, Homo sapien
ttgcctgccgtatccgcccaggagg

SEQ ID NO: 12103 - DNA, 25 bp, Homo sapien
ggacaggtacacaagcagggcaaac

SEQ ID NO: 12104 - DNA, 25 bp, Homo sapien
gcagggcaaactgtttattcatgaa

SEQ ID NO: 12105 - DNA, 25 bp, Homo sapien
gaatgactagaattcttagcccttg

SEQ ID NO: 12106 - DNA, 25 bp, Homo sapien
ctagaattcttagcccttgtaatcc

SEQ ID NO: 12107 - DNA, 25 bp, Homo sapien
attcttagcccttgtaatcctagca

SEQ ID NO: 12108 - DNA, 25 bp, Homo sapien
gagactgtctctaacttaaatttta

SEQ ID NO: 12109 - DNA, 25 bp, Homo sapien
tcactacaatctctggcttctggtt

SEQ ID NO: 12110 - DNA, 25 bp, Homo sapien
aatctctggcttctggttcgggtga

SEQ ID NO: 12111 - DNA, 25 bp, Homo sapien
ttctggttcgggtgagtctcctgcc

SEQ ID NO: 12112 - DNA, 25 bp, Homo sapien
agccgagttcgtggtcactgcactc

SEQ ID NO: 12113 - DNA, 25 bp, Homo sapien
cattaaccacttctgcctacattca

SEQ ID NO: 12114 - DNA, 25 bp, Homo sapien
acttctgcctacattcactgggcaa

SEQ ID NO: 12115 - DNA, 25 bp, Homo sapien
gcctacattcactgggcaaatcagg

SEQ ID NO: 12116 - DNA, 25 bp, Homo sapien
attcactgggcaaatcaggtcccat

SEQ ID NO: 12117 - DNA, 25 bp, Homo sapien
ggcaaatcaggtcccatggcaacgt

SEQ ID NO: 12118 - DNA, 25 bp, Homo sapien
aaatcaggtcccatggcaacgtgag

SEQ ID NO: 12119 - DNA, 25 bp, Homo sapien
atcaggtcccatggcaacgtgagag

SEQ ID NO: 12120 - DNA, 25 bp, Homo sapien
atggcaacgtgagagggcatgtact

SEQ ID NO: 12121 - DNA, 25 bp, Homo sapien
ggcaacgtgagagggcatgtactct

SEQ ID NO: 12122 - DNA, 25 bp, Homo sapien
aaagacatgttgtaggatgggatcc

SEQ ID NO: 12123 - DNA, 25 bp, Homo sapien
acatgttgtaggatgggatcctgga

SEQ ID NO: 12124 - DNA, 25 bp, Homo sapien
ctgctttacataagtcttttagaag

SEQ ID NO: 12125 - DNA, 25 bp, Homo sapien
gtaaatgtggatcaaaaccacccca

SEQ ID NO: 12126 - DNA, 25 bp, Homo sapien
tggatcaaaaccaccccaagacagg

SEQ ID NO: 12127 - DNA, 25 bp, Homo sapien
caaaaccaccccaagacaggattga

SEQ ID NO: 12128 - DNA, 25 bp, Homo sapien
ttagcttgggactttaaatgatatg

SEQ ID NO: 12129 - DNA, 25 bp, Homo sapien
aacatttctatactgcattttggcc

SEQ ID NO: 12130 - DNA, 25 bp, Homo sapien
atttctatactgcattttggccatc

SEQ ID NO: 12131 - DNA, 25 bp, Homo sapien
tctatactgcattttggccatcttt

SEQ ID NO: 12132 - DNA, 25 bp, Homo sapien
ttgaaaatgctgacagaggccgagt

SEQ ID NO: 12133 - DNA, 25 bp, Homo sapien
aatgctgacagaggccgagtgtagt

SEQ ID NO: 12134 - DNA, 25 bp, Homo sapien
cagaggccgagtgtagtagctcaca

SEQ ID NO: 12135 - DNA, 25 bp, Homo sapien
aaactgtaactgtaaccatcctcct

SEQ ID NO: 12136 - DNA, 25 bp, Homo sapien
taactgtaaccatcctcctagggag

SEQ ID NO: 12137 - DNA, 25 bp, Homo sapien
tcctcctagggaggcatttggaaat

SEQ ID NO: 12138 - DNA, 25 bp, Homo sapien
accccaaggatgctttacttccatc

SEQ ID NO: 12139 - DNA, 25 bp, Homo sapien
tttacttccatctcctggttttctg

SEQ ID NO: 12140 - DNA, 25 bp, Homo sapien
tggttttctgctcatgctccctatg

SEQ ID NO: 12141 - DNA, 25 bp, Homo sapien
ttctgctcatgctccctatgaactg

SEQ ID NO: 12142 - DNA, 25 bp, Homo sapien
gtaaaggtcagcctatttaagcata

SEQ ID NO: 12143 - DNA, 25 bp, Homo sapien
gcctatttaagcatagagccaggta

SEQ ID NO: 12144 - DNA, 25 bp, Homo sapien
ggaaatggaattgacatggcaaaac

SEQ ID NO: 12145 - DNA, 25 bp, Homo sapien
agatgggctgaacccaatggctcct

SEQ ID NO: 12146 - DNA, 25 bp, Homo sapien
actataaaaaatcagaatggcacct

SEQ ID NO: 12147 - DNA, 25 bp, Homo sapien
atggcacctgaattctaaacaatag

SEQ ID NO: 12148 - DNA, 25 bp, Homo sapien
gaagacagagggacaatatccttaa

SEQ ID NO: 12149 - DNA, 25 bp, Homo sapien
ggattgtcattatataaacccctat

SEQ ID NO: 12150 - DNA, 25 bp, Homo sapien
gtcattatataaacccctatccacc

SEQ ID NO: 12151 - DNA, 25 bp, Homo sapien
ctatccacccaaacacaatcatgga

SEQ ID NO: 12152 - DNA, 25 bp, Homo sapien
gatattctcaacacggatctggaac

SEQ ID NO: 12153 - DNA, 25 bp, Homo sapien
ttctcaacacggatctggaaccgcg

SEQ ID NO: 12154 - DNA, 25 bp, Homo sapien
acggatctggaaccgcgctccagtt

SEQ ID NO: 12155 - DNA, 25 bp, Homo sapien
gcgctccagttccagaactctagta

SEQ ID NO: 12156 - DNA, 25 bp, Homo sapien
aaaggtggccggacgcggtgcctca

SEQ ID NO: 12157 - DNA, 25 bp, Homo sapien
ggagtgttagggatgccttttctct

SEQ ID NO: 12158 - DNA, 25 bp, Homo sapien
catctttctagacttagcctgattc

SEQ ID NO: 12159 - DNA, 25 bp, Homo sapien
gacttagcctgattcacttcttgaa

SEQ ID NO: 12160 - DNA, 25 bp, Homo sapien
gagtgaattaatcacacccttttct

SEQ ID NO: 12161 - DNA, 25 bp, Homo sapien
taatcacacccttttctgttaaatt

SEQ ID NO: 12162 - DNA, 25 bp, Homo sapien
taacttgccttatttctccattact

SEQ ID NO: 12163 - DNA, 25 bp, Homo sapien
actactagaacctcagtcttttgtg

SEQ ID NO: 12164 - DNA, 25 bp, Homo sapien
tcttttgtgttacccttgtacctag

SEQ ID NO: 12165 - DNA, 25 bp, Homo sapien
ttgtacctagagctgcctggcatgt

SEQ ID NO: 12166 - DNA, 25 bp, Homo sapien
tggcatgtgataagcacctaataaa

SEQ ID NO: 12167 - DNA, 25 bp, Homo sapien
aaagatggtaattcataggccgggt

SEQ ID NO: 12168 - DNA, 25 bp, Homo sapien
agcctggccaacaactctgttgcta

SEQ ID NO: 12169 - DNA, 25 bp, Homo sapien
ctggccaacaactctgttgctacta

SEQ ID NO: 12170 - DNA, 25 bp, Homo sapien
ggccaacaactctgttgctactaaa

SEQ ID NO: 12171 - DNA, 25 bp, Homo sapien
ccaacaactctgttgctactaaaaa

SEQ ID NO: 12172 - DNA, 25 bp, Homo sapien
aacaaaaacaccacagaattagctg

SEQ ID NO: 12173 - DNA, 25 bp, Homo sapien
aacaccacagaattagctggatgcc

SEQ ID NO: 12174 - DNA, 25 bp, Homo sapien
accacagaattagctggatgccgtg

SEQ ID NO: 12175 - DNA, 25 bp, Homo sapien
cagaattagctggatgccgtggctc

SEQ ID NO: 12176 - DNA, 25 bp, Homo sapien
agaattagctggatgccgtggctca

SEQ ID NO: 12177 - DNA, 25 bp, Homo sapien
gaattagctggatgccgtggctcac

SEQ ID NO: 12178 - DNA, 25 bp, Homo sapien
aattagctggatgccgtggctcaca

SEQ ID NO: 12179 - DNA, 25 bp, Homo sapien
ggatgtgttcaaggcaagaccgaat

SEQ ID NO: 12180 - DNA, 25 bp, Homo sapien
tgtgttcaaggcaagaccgaattca

SEQ ID NO: 12181 - DNA, 25 bp, Homo sapien
gttcaaggcaagaccgaattcagaa

SEQ ID NO: 12182 - DNA, 25 bp, Homo sapien
gaattcagaaggatatcgacgtcgt

SEQ ID NO: 12183 - DNA, 25 bp, Homo sapien
ttcagaaggatatcgacgtcgtgat

SEQ ID NO: 12184 - DNA, 25 bp, Homo sapien
aaggatatcgacgtcgtgatccaga

SEQ ID NO: 12185 - DNA, 25 bp, Homo sapien
gatatcgacgtcgtgatccagaagt

SEQ ID NO: 12186 - DNA, 25 bp, Homo sapien
atcgacgtcgtgatccagaagtcca

SEQ ID NO: 12187 - DNA, 25 bp, Homo sapien
acgtcgtgatccagaagtccagagc

SEQ ID NO: 12188 - DNA, 25 bp, Homo sapien
tcgtgatccagaagtccagagctga

SEQ ID NO: 12189 - DNA, 25 bp, Homo sapien
tgatccagaagtccagagctgagga

SEQ ID NO: 12190 - DNA, 25 bp, Homo sapien
gtttcttgcatatgtatttactggt

SEQ ID NO: 12191 - DNA, 25 bp, Homo sapien
gtatttactggtccacagcacaaaa

SEQ ID NO: 12192 - DNA, 25 bp, Homo sapien
aagtgaccacatatacataggaaag

SEQ ID NO: 12193 - DNA, 25 bp, Homo sapien
gatgttcagcatcaagatttcactg

SEQ ID NO: 12194 - DNA, 25 bp, Homo sapien
gtacagcatgaaaggcttcctctac

SEQ ID NO: 12195 - DNA, 25 bp, Homo sapien
gagagctgcggtttctaatctttgt

SEQ ID NO: 12196 - DNA, 25 bp, Homo sapien
taatctttgtccattactcccttac

SEQ ID NO: 12197 - DNA, 25 bp, Homo sapien
tcccttactccctatgagactgtgg

SEQ ID NO: 12198 - DNA, 25 bp, Homo sapien
gagactgtggacctgtcacttggcc

SEQ ID NO: 12199 - DNA, 25 bp, Homo sapien
tggcctctctggtcttcagttttct

SEQ ID NO: 12200 - DNA, 25 bp, Homo sapien
aaatgacctctagtgttccccttgg

SEQ ID NO: 12201 - DNA, 25 bp, Homo sapien
aaggtggctttagtggccgcatgaa

SEQ ID NO: 12202 - DNA, 25 bp, Homo sapien
tttagtggccgcatgaagcacaccc

SEQ ID NO: 12203 - DNA, 25 bp, Homo sapien
atgaagcacaccctgattgccgagg

SEQ ID NO: 12204 - DNA, 25 bp, Homo sapien
aagcacaccctgattgccgaggaac

SEQ ID NO: 12205 - DNA, 25 bp, Homo sapien
cctgattgccgaggaacaagagtgc

SEQ ID NO: 12206 - DNA, 25 bp, Homo sapien
ggaacaagagtgcaaagctaagaaa

SEQ ID NO: 12207 - DNA, 25 bp, Homo sapien
ttccttatctgacccccaaagatga

SEQ ID NO: 12208 - DNA, 25 bp, Homo sapien
aattaattctccaagaagccagcag

SEQ ID NO: 12209 - DNA, 25 bp, Homo sapien
attctccaagaagccagcagtgtat

SEQ ID NO: 12210 - DNA, 25 bp, Homo sapien
gggagctccataaagaggctcaaga

SEQ ID NO: 12211 - DNA, 25 bp, Homo sapien
aaagaggctcaagaggccgggcgca

SEQ ID NO: 12212 - DNA, 25 bp, Homo sapien
ccaggcatgtgttcatgccaaataa

SEQ ID NO: 12213 - DNA, 25 bp, Homo sapien
gtacacataaaaagccaggctgcaa

SEQ ID NO: 12214 - DNA, 25 bp, Homo sapien
gccaggctgcaagtgggactcttaa

SEQ ID NO: 12215 - DNA, 25 bp, Homo sapien
agagccagagacttgctgtgcaggt

SEQ ID NO: 12216 - DNA, 25 bp, Homo sapien
tgcaggtgaggcagctcccttagca

SEQ ID NO: 12217 - DNA, 25 bp, Homo sapien
agctcccttagcaactatgcagcaa

SEQ ID NO: 12218 - DNA, 25 bp, Homo sapien
tatgcagcaagacattgcgagcttt

SEQ ID NO: 12219 - DNA, 25 bp, Homo sapien
tgcgagctttgtggagctccaggaa

SEQ ID NO: 12220 - DNA, 25 bp, Homo sapien
gctccaggaagcaatatatgccaac

SEQ ID NO: 12221 - DNA, 25 bp, Homo sapien
gcaatatatgccaacaggcctgtct

SEQ ID NO: 12222 - DNA, 25 bp, Homo sapien
tgggctccaaaccagcaaacatctg

SEQ ID NO: 12223 - DNA, 25 bp, Homo sapien
ttggtgggggctgtattgttctata

SEQ ID NO: 12224 - DNA, 25 bp, Homo sapien
aactttttcttcttgatatgtaagc

SEQ ID NO: 12225 - DNA, 25 bp, Homo sapien
tatattatatactaaccctttgtta

SEQ ID NO: 12226 - DNA, 25 bp, Homo sapien
tactaaccctttgttagattatttg

SEQ ID NO: 12227 - DNA, 25 bp, Homo sapien
tgtcttcattccttatggttttttt

SEQ ID NO: 12228 - DNA, 25 bp, Homo sapien
gcgcctggcctctcaattttttaag

SEQ ID NO: 12229 - DNA, 25 bp, Homo sapien
tggcctctcaattttttaaggtcgt

SEQ ID NO: 12230 - DNA, 25 bp, Homo sapien
tctgtattaggatttggtacatctt

SEQ ID NO: 12231 - DNA, 25 bp, Homo sapien
attaggatttggtacatcttttgtt

SEQ ID NO: 12232 - DNA, 25 bp, Homo sapien
aggatttggtacatcttttgttata

SEQ ID NO: 12233 - DNA, 25 bp, Homo sapien
gatttggtacatcttttgttatatt

SEQ ID NO: 12234 - DNA, 25 bp, Homo sapien
catgcaaccgtcaatgcctgagaca

SEQ ID NO: 12235 - DNA, 25 bp, Homo sapien
caatgcctgagacaatggagtgaaa

SEQ ID NO: 12236 - DNA, 25 bp, Homo sapien
gagtgaaagctaccagatccttaag

SEQ ID NO: 12237 - DNA, 25 bp, Homo sapien
ttaaagccaccagccctgatgttgg

SEQ ID NO: 12238 - DNA, 25 bp, Homo sapien
agccctgatgttggccacgggaaaa

SEQ ID NO: 12239 - DNA, 25 bp, Homo sapien
gttggccacgggaaaagacaatcaa

SEQ ID NO: 12240 - DNA, 25 bp, Homo sapien
tcaaggaaaatctccgaccttcggt

SEQ ID NO: 12241 - DNA, 25 bp, Homo sapien
aatctccgaccttcggtgaaatgca

SEQ ID NO: 12242 - DNA, 25 bp, Homo sapien
gtgaaatgcagagactaagggaccc

SEQ ID NO: 12243 - DNA, 25 bp, Homo sapien
taagggacccctgtgctgcgtgtga

SEQ ID NO: 12244 - DNA, 25 bp, Homo sapien
ctgtgctgcgtgtgatgcgattttg

SEQ ID NO: 12245 - DNA, 25 bp, Homo sapien
ccttcatcaaccatggtgagggtca

SEQ ID NO: 12246 - DNA, 25 bp, Homo sapien
atcaaccatggtgagggtcaggcag

SEQ ID NO: 12247 - DNA, 25 bp, Homo sapien
ggtgtagtgggagggttctgcgact

SEQ ID NO: 12248 - DNA, 25 bp, Homo sapien
ggttctgcgactgagctgccgagct

SEQ ID NO: 12249 - DNA, 25 bp, Homo sapien
tgagctgccgagctcatctacctct

SEQ ID NO: 12250 - DNA, 25 bp, Homo sapien
aactggctccagactgcaaacccaa

SEQ ID NO: 12251 - DNA, 25 bp, Homo sapien
aacccaactgcaaggtaaggccttg

SEQ ID NO: 12252 - DNA, 25 bp, Homo sapien
actgcaaggtaaggccttgggactc

SEQ ID NO: 12253 - DNA, 25 bp, Homo sapien
taaggccttgggactcgggaggaga

SEQ ID NO: 12254 - DNA, 25 bp, Homo sapien
tggtcagtaaagagccaaacaccgg

SEQ ID NO: 12255 - DNA, 25 bp, Homo sapien
cagtaaagagccaaacaccggccgg

SEQ ID NO: 12256 - DNA, 25 bp, Homo sapien
ctgacctggaacagtctctgcctct

SEQ ID NO: 12257 - DNA, 25 bp, Homo sapien
ctcggtttccccagctggacggtga

SEQ ID NO: 12258 - DNA, 25 bp, Homo sapien
gtgagggctagctgagggctctcct

SEQ ID NO: 12259 - DNA, 25 bp, Homo sapien
tgagggctctcctgcccttcgtgca

SEQ ID NO: 12260 - DNA, 25 bp, Homo sapien
ccttcgtgcattcgctggtcactaa

SEQ ID NO: 12261 - DNA, 25 bp, Homo sapien
gtgcattcgctggtcactaatcggg

SEQ ID NO: 12262 - DNA, 25 bp, Homo sapien
cattcgctggtcactaatcgggcac

SEQ ID NO: 12263 - DNA, 25 bp, Homo sapien
gctggtcactaatcgggcaccttgt

SEQ ID NO: 12264 - DNA, 25 bp, Homo sapien
taatcgggcaccttgtgggtgctgt

SEQ ID NO: 12265 - DNA, 25 bp, Homo sapien
accttgtgggtgctgtgctccgcat

SEQ ID NO: 12266 - DNA, 25 bp, Homo sapien
cacagaacagtgaacggttggccgg

SEQ ID NO: 12267 - DNA, 25 bp, Homo sapien
ttcttaattccatttaggttcacat

SEQ ID NO: 12268 - DNA, 25 bp, Homo sapien
tccatttaggttcacataaattcca

SEQ ID NO: 12269 - DNA, 25 bp, Homo sapien
taaattccatttaggttcatatcca

SEQ ID NO: 12270 - DNA, 25 bp, Homo sapien
ttaggttcatatccaacttcagatg

SEQ ID NO: 12271 - DNA, 25 bp, Homo sapien
ttcagatgaattttcttgatagaac

SEQ ID NO: 12272 - DNA, 25 bp, Homo sapien
gaacaaatgtgcagacttttcagta

SEQ ID NO: 12273 - DNA, 25 bp, Homo sapien
gtgcagacttttcagtaatatagac

SEQ ID NO: 12274 - DNA, 25 bp, Homo sapien
aaaactatattgacgctacatgaca

SEQ ID NO: 12275 - DNA, 25 bp, Homo sapien
attgacgctacatgacagaactaaa

SEQ ID NO: 12276 - DNA, 25 bp, Homo sapien
ttagggtcagtttaatgtttcatta

SEQ ID NO: 12277 - DNA, 25 bp, Homo sapien
gtttcattaggtatttagagaccaa

SEQ ID NO: 12278 - DNA, 25 bp, Homo sapien
atgagccaccgcgagtggtctttat

SEQ ID NO: 12279 - DNA, 25 bp, Homo sapien
gccaccgcgagtggtctttatcatt

SEQ ID NO: 12280 - DNA, 25 bp, Homo sapien
ggtctttatcattattatcgctgtt

SEQ ID NO: 12281 - DNA, 25 bp, Homo sapien
tatcattattatcgctgttttacag

SEQ ID NO: 12282 - DNA, 25 bp, Homo sapien
aggcacagagacctgcttatggtga

SEQ ID NO: 12283 - DNA, 25 bp, Homo sapien
gacctgcttatggtgacagaagtag

SEQ ID NO: 12284 - DNA, 25 bp, Homo sapien
gagatttgaatctagctggtctaat

SEQ ID NO: 12285 - DNA, 25 bp, Homo sapien
gctggtctaatttatcctgaagttc

SEQ ID NO: 12286 - DNA, 25 bp, Homo sapien
tcctgaagttcaagatagcaataca

SEQ ID NO: 12287 - DNA, 25 bp, Homo sapien
gagtggatatgatcgctcaagataa

SEQ ID NO: 12288 - DNA, 25 bp, Homo sapien
agataaatctcttggccgggcgcag

SEQ ID NO: 12289 - DNA, 25 bp, Homo sapien
ttcacatggttgagaattcgaactg

SEQ ID NO: 12290 - DNA, 25 bp, Homo sapien
gtatacgatgaacagacctttttcc

SEQ ID NO: 12291 - DNA, 25 bp, Homo sapien
atgaacagacctttttccactcttg

SEQ ID NO: 12292 - DNA, 25 bp, Homo sapien
agacctttttccactcttgtgttct

SEQ ID NO: 12293 - DNA, 25 bp, Homo sapien
actcttgtgttcttgtctccacaga

SEQ ID NO: 12294 - DNA, 25 bp, Homo sapien
gtgttcttgtctccacagaaaagca

SEQ ID NO: 12295 - DNA, 25 bp, Homo sapien
gcagtattattagtttcatgtgtag

SEQ ID NO: 12296 - DNA, 25 bp, Homo sapien
gggttgatgcttaatcagacataca

SEQ ID NO: 12297 - DNA, 25 bp, Homo sapien
cacaatatatatgttggtatgtctg

SEQ ID NO: 12298 - DNA, 25 bp, Homo sapien
atatgtatgtatgcctattctaata

SEQ ID NO: 12299 - DNA, 25 bp, Homo sapien
atgtatatcaacgtgcttttattta

SEQ ID NO: 12300 - DNA, 25 bp, Homo sapien
ggttaaaccaattcatgcttctgtt

SEQ ID NO: 12301 - DNA, 25 bp, Homo sapien
aattcatgcttctgttaataacgta

SEQ ID NO: 12302 - DNA, 25 bp, Homo sapien
tgaaagtgatagttgctccacatcc

SEQ ID NO: 12303 - DNA, 25 bp, Homo sapien
caccaacacttggttttaccagtct

SEQ ID NO: 12304 - DNA, 25 bp, Homo sapien
aagattttatctattctagtgggac

SEQ ID NO: 12305 - DNA, 25 bp, Homo sapien
gtgggacatagtggtttctcattat

SEQ ID NO: 12306 - DNA, 25 bp, Homo sapien
gatgaagctgaattcctttttatat

SEQ ID NO: 12307 - DNA, 25 bp, Homo sapien
gtttattggcatttggatatactcc

SEQ ID NO: 12308 - DNA, 25 bp, Homo sapien
ggatatactcctttgtgaatccctg

SEQ ID NO: 12309 - DNA, 25 bp, Homo sapien
tgaatccctgttaaagttgtccttt

SEQ ID NO: 12310 - DNA, 25 bp, Homo sapien
tgtttacttcctgaatattaagtgt

SEQ ID NO: 12311 - DNA, 25 bp, Homo sapien
agtcccagaggctactgtactcagg

SEQ ID NO: 12312 - DNA, 25 bp, Homo sapien
gtcccagaggctactgtactcagga

SEQ ID NO: 12313 - DNA, 25 bp, Homo sapien
tcccagaggctactgtactcaggag

SEQ ID NO: 12314 - DNA, 25 bp, Homo sapien
cccagaggctactgtactcaggagg

SEQ ID NO: 12315 - DNA, 25 bp, Homo sapien
ccagaggctactgtactcaggaggc

SEQ ID NO: 12316 - DNA, 25 bp, Homo sapien
ggttggattgattgagcccggaaat

SEQ ID NO: 12317 - DNA, 25 bp, Homo sapien
ggattgattgagcccggaaatttga

SEQ ID NO: 12318 - DNA, 25 bp, Homo sapien
tagccagatgtggtgttgtagacct

SEQ ID NO: 12319 - DNA, 25 bp, Homo sapien
agccagatgtggtgttgtagacctc

SEQ ID NO: 12320 - DNA, 25 bp, Homo sapien
gccagatgtggtgttgtagacctct

SEQ ID NO: 12321 - DNA, 25 bp, Homo sapien
tgttgtagacctctggttccagcta

SEQ ID NO: 12322 - DNA, 25 bp, Homo sapien
tgtggctgcactgcctgggtgccgt

SEQ ID NO: 12323 - DNA, 25 bp, Homo sapien
aaccttgccacacctgcacctgcgt

SEQ ID NO: 12324 - DNA, 25 bp, Homo sapien
agctgctgcagcatgcctgtgctct

SEQ ID NO: 12325 - DNA, 25 bp, Homo sapien
atgcctgtgctctgtgcttgcctca

SEQ ID NO: 12326 - DNA, 25 bp, Homo sapien
ctgtgctctgtgcttgcctcaccag

SEQ ID NO: 12327 - DNA, 25 bp, Homo sapien
gtgctctgtgcttgcctcaccagct

SEQ ID NO: 12328 - DNA, 25 bp, Homo sapien
tctctgctcacatttctctctccca

SEQ ID NO: 12329 - DNA, 25 bp, Homo sapien
agtctgtcatagtggtgagctgatc

SEQ ID NO: 12330 - DNA, 25 bp, Homo sapien
gtctgtcatagtggtgagctgatcc

SEQ ID NO: 12331 - DNA, 25 bp, Homo sapien
tctgtcatagtggtgagctgatcca

SEQ ID NO: 12332 - DNA, 25 bp, Homo sapien
gtcatagtggtgagctgatccaggt

SEQ ID NO: 12333 - DNA, 25 bp, Homo sapien
tcaggtctgcgaaacttcttagatt

SEQ ID NO: 12334 - DNA, 25 bp, Homo sapien
caggtctgcgaaacttcttagattt

SEQ ID NO: 12335 - DNA, 25 bp, Homo sapien
ggtctgcgaaacttcttagattttg

SEQ ID NO: 12336 - DNA, 25 bp, Homo sapien
gtctgcgaaacttcttagattttga

SEQ ID NO: 12337 - DNA, 25 bp, Homo sapien
gcgaaacttcttagattttgacctc

SEQ ID NO: 12338 - DNA, 25 bp, Homo sapien
cgaaacttcttagattttgacctca

SEQ ID NO: 12339 - DNA, 25 bp, Homo sapien
aacttcttagattttgacctcagtc

SEQ ID NO: 12340 - DNA, 25 bp, Homo sapien
acttcttagattttgacctcagtcc

SEQ ID NO: 12341 - DNA, 25 bp, Homo sapien
cttcttagattttgacctcagtcca

SEQ ID NO: 12342 - DNA, 25 bp, Homo sapien
ttcttagattttgacctcagtccat

SEQ ID NO: 12343 - DNA, 25 bp, Homo sapien
tcttagattttgacctcagtccata

SEQ ID NO: 12344 - DNA, 25 bp, Homo sapien
attttccatatccttcagtatcctg

SEQ ID NO: 12345 - DNA, 25 bp, Homo sapien
gaacttaagacccagccactgctgg

SEQ ID NO: 12346 - DNA, 25 bp, Homo sapien
actgctggagaatatctgcctgtga

SEQ ID NO: 12347 - DNA, 25 bp, Homo sapien
aatgagcagtttgtgtctgtgcctg

SEQ ID NO: 12348 - DNA, 25 bp, Homo sapien
cagccagggtggtctttcaaaaatg

SEQ ID NO: 12349 - DNA, 25 bp, Homo sapien
aaagctgataatgttactcccctgc

SEQ ID NO: 12350 - DNA, 25 bp, Homo sapien
atgttactcccctgctgtaaacctt

SEQ ID NO: 12351 - DNA, 25 bp, Homo sapien
tgtaaaccttccagcggtttcctat

SEQ ID NO: 12352 - DNA, 25 bp, Homo sapien
gcggtttcctattgccttcagaata

SEQ ID NO: 12353 - DNA, 25 bp, Homo sapien
aaaatacgaatcatctggcctccat

SEQ ID NO: 12354 - DNA, 25 bp, Homo sapien
tcatcctctctcaattttccatatc

SEQ ID NO: 12355 - DNA, 25 bp, Homo sapien
aagaacctgatgacggaaaccacga

SEQ ID NO: 12356 - DNA, 25 bp, Homo sapien
ggaaattcccaaattgcgcttaaga

SEQ ID NO: 12357 - DNA, 25 bp, Homo sapien
ttgactttcgggatattctggcgtt

SEQ ID NO: 12358 - DNA, 25 bp, Homo sapien
gatattctggcgttaattttcccgt

SEQ ID NO: 12359 - DNA, 25 bp, Homo sapien
tcccgtccgcctaaatgtgggcaaa

SEQ ID NO: 12360 - DNA, 25 bp, Homo sapien
gggcaaaaattcacagctacgttat

SEQ ID NO: 12361 - DNA, 25 bp, Homo sapien
gtttagatctttagtgtcacattga

SEQ ID NO: 12362 - DNA, 25 bp, Homo sapien
tgacttatctgggacatcgcttttt

SEQ ID NO: 12363 - DNA, 25 bp, Homo sapien
tcctcacatgagatttggctaagtt

SEQ ID NO: 12364 - DNA, 25 bp, Homo sapien
gttaagcacagtttaaacccattct

SEQ ID NO: 12365 - DNA, 25 bp, Homo sapien
attcatctgtaaggcaatctatttg

SEQ ID NO: 12366 - DNA, 25 bp, Homo sapien
aggaattccctgctaagtgccacag

SEQ ID NO: 12367 - DNA, 25 bp, Homo sapien
gctaagtgccacagtcatctcttca

SEQ ID NO: 12368 - DNA, 25 bp, Homo sapien
agtcatctcttcaccactcggtttc

SEQ ID NO: 12369 - DNA, 25 bp, Homo sapien
agatcccactgttaggcctttttca

SEQ ID NO: 12370 - DNA, 25 bp, Homo sapien
tgttaggcctttttcaagcacggac

SEQ ID NO: 12371 - DNA, 25 bp, Homo sapien
ttttcaagcacggaccttctcatgc

SEQ ID NO: 12372 - DNA, 25 bp, Homo sapien
acggaccttctcatgctcagtctct

SEQ ID NO: 12373 - DNA, 25 bp, Homo sapien
gaagtgtctactgggtgggcctcac

SEQ ID NO: 12374 - DNA, 25 bp, Homo sapien
tgggtgggcctcacagaaggttcca

SEQ ID NO: 12375 - DNA, 25 bp, Homo sapien
tccgataaagtttctgccactctgc

SEQ ID NO: 12376 - DNA, 25 bp, Homo sapien
gataaagtttctgccactctgcatt

SEQ ID NO: 12377 - DNA, 25 bp, Homo sapien
gggaagtcagagctcatcttatcac

SEQ ID NO: 12378 - DNA, 25 bp, Homo sapien
atcttatcactgtgtgagtccactg

SEQ ID NO: 12379 - DNA, 25 bp, Homo sapien
gtgagtccactgacagtacctagga

SEQ ID NO: 12380 - DNA, 25 bp, Homo sapien
tacctaggaggtgagattattttgt

SEQ ID NO: 12381 - DNA, 25 bp, Homo sapien
tattttgtgaactgactgacatgca

SEQ ID NO: 12382 - DNA, 25 bp, Homo sapien
gactgacatgcacagtggtcaatca

SEQ ID NO: 12383 - DNA, 25 bp, Homo sapien
ggtcaatcagaatgccatccataga

SEQ ID NO: 12384 - DNA, 25 bp, Homo sapien
atccatagagtaaaacagggtcctg

SEQ ID NO: 12385 - DNA, 25 bp, Homo sapien
ttgcacatagtggtggctcagggca

SEQ ID NO: 12386 - DNA, 25 bp, Homo sapien
gtggctcagggcagcagatatttat

SEQ ID NO: 12387 - DNA, 25 bp, Homo sapien
gacaggtatagctgaatattatcca

SEQ ID NO: 12388 - DNA, 25 bp, Homo sapien
gaagtgtagcatagaaaccccgcct

SEQ ID NO: 12389 - DNA, 25 bp, Homo sapien
aagtgtagcatagaaaccccgcctg

SEQ ID NO: 12390 - DNA, 25 bp, Homo sapien
agtgtagcatagaaaccccgcctgc

SEQ ID NO: 12391 - DNA, 25 bp, Homo sapien
gtgtagcatagaaaccccgcctgct

SEQ ID NO: 12392 - DNA, 25 bp, Homo sapien
tgtagcatagaaaccccgcctgctg

SEQ ID NO: 12393 - DNA, 25 bp, Homo sapien
gtagcatagaaaccccgcctgctgg

SEQ ID NO: 12394 - DNA, 25 bp, Homo sapien
tagaaaccccgcctgctggctgtgg

SEQ ID NO: 12395 - DNA, 25 bp, Homo sapien
agaaaccccgcctgctggctgtgga

SEQ ID NO: 12396 - DNA, 25 bp, Homo sapien
gaaaccccgcctgctggctgtggaa

SEQ ID NO: 12397 - DNA, 25 bp, Homo sapien
cgcctgctggctgtggaacagaaat

SEQ ID NO: 12398 - DNA, 25 bp, Homo sapien
cctgctggctgtggaacagaaataa

SEQ ID NO: 12399 - DNA, 25 bp, Homo sapien
tcaccacaacttctgtcttccaagt

SEQ ID NO: 12400 - DNA, 25 bp, Homo sapien
caccacaacttctgtcttccaagtt

SEQ ID NO: 12401 - DNA, 25 bp, Homo sapien
gaatttacttgggttctattaatag

SEQ ID NO: 12402 - DNA, 25 bp, Homo sapien
aagcaacaacaaatccaacctaaat

SEQ ID NO: 12403 - DNA, 25 bp, Homo sapien
gcaacaacaaatccaacctaaatgt

SEQ ID NO: 12404 - DNA, 25 bp, Homo sapien
caaatccaacctaaatgtttgactt

SEQ ID NO: 12405 - DNA, 25 bp, Homo sapien
tagttttaactaatgccgttgggat

SEQ ID NO: 12406 - DNA, 25 bp, Homo sapien
ttaactaatgccgttgggattatta

SEQ ID NO: 12407 - DNA, 25 bp, Homo sapien
aatgccgttgggattattagtggta

SEQ ID NO: 12408 - DNA, 25 bp, Homo sapien
atgccgttgggattattagtggtat

SEQ ID NO: 12409 - DNA, 25 bp, Homo sapien
gccgttgggattattagtggtattt

SEQ ID NO: 12410 - DNA, 25 bp, Homo sapien
ttttgttcctggagaccgggtctgg

SEQ ID NO: 12411 - DNA, 25 bp, Homo sapien
ggagaacttctggtcaggaaacttg

SEQ ID NO: 12412 - DNA, 25 bp, Homo sapien
ctggtcaggaaacttgttgagttaa

SEQ ID NO: 12413 - DNA, 25 bp, Homo sapien
aatttgctttttcctaattgtgcat

SEQ ID NO: 12414 - DNA, 25 bp, Homo sapien
taattgtgcatctcgacttttccca

SEQ ID NO: 12415 - DNA, 25 bp, Homo sapien
tcgacttttcccatcaatcttattt

SEQ ID NO: 12416 - DNA, 25 bp, Homo sapien
aatcttatttctagagtctcttcac

SEQ ID NO: 12417 - DNA, 25 bp, Homo sapien
tctagagtctcttcacaaccggtgt

SEQ ID NO: 12418 - DNA, 25 bp, Homo sapien
agagtctcttcacaaccggtgtctc

SEQ ID NO: 12419 - DNA, 25 bp, Homo sapien
ccctgtctcatgatgttaccgagct

SEQ ID NO: 12420 - DNA, 25 bp, Homo sapien
gatgttaccgagctattcagaaaag

SEQ ID NO: 12421 - DNA, 25 bp, Homo sapien
gcagtcttgggctgaactttcaaat

SEQ ID NO: 12422 - DNA, 25 bp, Homo sapien
atgagtttcctcagggagcttcaga

SEQ ID NO: 12423 - DNA, 25 bp, Homo sapien
agggagcttcagagctctttcctta

SEQ ID NO: 12424 - DNA, 25 bp, Homo sapien
gctctttccttatggacggcctctc

SEQ ID NO: 12425 - DNA, 25 bp, Homo sapien
gcaccacccttctgggcactgggta

SEQ ID NO: 12426 - DNA, 25 bp, Homo sapien
ggcactgggtaagacagcagcctct

SEQ ID NO: 12427 - DNA, 25 bp, Homo sapien
ctgggtaagacagcagcctctgatc

SEQ ID NO: 12428 - DNA, 25 bp, Homo sapien
cctctgatcttcttggcctggcttt

SEQ ID NO: 12429 - DNA, 25 bp, Homo sapien
tggctttcccagcatgggtgctcta

SEQ ID NO: 12430 - DNA, 25 bp, Homo sapien
atgggtgctctaccctactgtttta

SEQ ID NO: 12431 - DNA, 25 bp, Homo sapien
tgctctaccctactgttttaaccta

SEQ ID NO: 12432 - DNA, 25 bp, Homo sapien
atagatgcatcttaagacaagaaag

SEQ ID NO: 12433 - DNA, 25 bp, Homo sapien
gtgttgtgtccccgagaaagtgtca

SEQ ID NO: 12434 - DNA, 25 bp, Homo sapien
cctttacgtggaccttctcatgaaa

SEQ ID NO: 12435 - DNA, 25 bp, Homo sapien
cagaacaaaccttaccagtggcttt

SEQ ID NO: 12436 - DNA, 25 bp, Homo sapien
agcaatcacaggtcaaagaaggaaa

SEQ ID NO: 12437 - DNA, 25 bp, Homo sapien
caactatcagaaaatgtatgtcata

SEQ ID NO: 12438 - DNA, 25 bp, Homo sapien
tgtcatagtacatcttctgctgctg

SEQ ID NO: 12439 - DNA, 25 bp, Homo sapien
gctgctgctgacagattaaccaaag

SEQ ID NO: 12440 - DNA, 25 bp, Homo sapien
gctgctgacagattaaccaaagaaa

SEQ ID NO: 12441 - DNA, 25 bp, Homo sapien
attgggaaaacgtatcctcagcaaa

SEQ ID NO: 12442 - DNA, 25 bp, Homo sapien
tatcctcagcaaatttcccaagaaa

SEQ ID NO: 12443 - DNA, 25 bp, Homo sapien
actggtcgatgctagatgatcttga

SEQ ID NO: 12444 - DNA, 25 bp, Homo sapien
agatgatcttgagaccctgtgctga

SEQ ID NO: 12445 - DNA, 25 bp, Homo sapien
gaccctgtgctgaggactggagaac

SEQ ID NO: 12446 - DNA, 25 bp, Homo sapien
actacaggaaaggagcagtatctct

SEQ ID NO: 12447 - DNA, 25 bp, Homo sapien
agtatctctgaattatcgtgtggaa

SEQ ID NO: 12448 - DNA, 25 bp, Homo sapien
ttgtctagcccctgatgactgtgag

SEQ ID NO: 12449 - DNA, 25 bp, Homo sapien
tgatgactgtgagcctcttcctcct

SEQ ID NO: 12450 - DNA, 25 bp, Homo sapien
tcacaagacggctgctgcgactcag

SEQ ID NO: 12451 - DNA, 25 bp, Homo sapien
tgcgactcaggctcatgtcccaatt

SEQ ID NO: 12452 - DNA, 25 bp, Homo sapien
aggctcatgtcccaattcaaggcag

SEQ ID NO: 12453 - DNA, 25 bp, Homo sapien
catgtcccaattcaaggcagcaaga

SEQ ID NO: 12454 - DNA, 25 bp, Homo sapien
aaattacaactcactgaagactcag

SEQ ID NO: 12455 - DNA, 25 bp, Homo sapien
gaagactcagacgatcattagcatt

SEQ ID NO: 12456 - DNA, 25 bp, Homo sapien
atggacatgatgctattgcacactg

SEQ ID NO: 12457 - DNA, 25 bp, Homo sapien
gtgagactcatgatattgtaatatg

SEQ ID NO: 12458 - DNA, 25 bp, Homo sapien
atatgtgctttattgcggtgatctg

SEQ ID NO: 12459 - DNA, 25 bp, Homo sapien
gaactgaacccatgatatctccaaa

SEQ ID NO: 12460 - DNA, 25 bp, Homo sapien
gatatctccaaagcatgcctgtact

SEQ ID NO: 12461 - DNA, 25 bp, Homo sapien
acacatgaaaacttaaacttatctg

SEQ ID NO: 12462 - DNA, 25 bp, Homo sapien
attcaaatgtttcactatagtttta

SEQ ID NO: 12463 - DNA, 25 bp, Homo sapien
ttttcatattcagaggaaggtcatt

SEQ ID NO: 12464 - DNA, 25 bp, Homo sapien
tttttgtataagcagtacacatgca

SEQ ID NO: 12465 - DNA, 25 bp, Homo sapien
gccaacacagaaggaccacttgagt

SEQ ID NO: 12466 - DNA, 25 bp, Homo sapien
ccaacacagaaggaccacttgagtc

SEQ ID NO: 12467 - DNA, 25 bp, Homo sapien
aacacagaaggaccacttgagtcca

SEQ ID NO: 12468 - DNA, 25 bp, Homo sapien
acacagaaggaccacttgagtccag

SEQ ID NO: 12469 - DNA, 25 bp, Homo sapien
cacagaaggaccacttgagtccagg

SEQ ID NO: 12470 - DNA, 25 bp, Homo sapien
ggacaacattgtgaggctcccccta

SEQ ID NO: 12471 - DNA, 25 bp, Homo sapien
gacaacattgtgaggctccccctac

SEQ ID NO: 12472 - DNA, 25 bp, Homo sapien
aacattgtgaggctccccctaccta

SEQ ID NO: 12473 - DNA, 25 bp, Homo sapien
tgaggctccccctacctatacaaaa

SEQ ID NO: 12474 - DNA, 25 bp, Homo sapien
agccatgatcatactattgcacttc

SEQ ID NO: 12475 - DNA, 25 bp, Homo sapien
tgatcatactattgcacttcagcat

SEQ ID NO: 12476 - DNA, 25 bp, Homo sapien
tagggttttaggagccactggcaac

SEQ ID NO: 12477 - DNA, 25 bp, Homo sapien
ggtaaattctgtgacaacagggtaa

SEQ ID NO: 12478 - DNA, 25 bp, Homo sapien
gaatacttagtgacatcagcagtag

SEQ ID NO: 12479 - DNA, 25 bp, Homo sapien
gtgacatcagcagtagcagaggaaa

SEQ ID NO: 12480 - DNA, 25 bp, Homo sapien
aaggctggaaaactagcatcagtga

SEQ ID NO: 12481 - DNA, 25 bp, Homo sapien
gacaggtattccagttcatcagcta

SEQ ID NO: 12482 - DNA, 25 bp, Homo sapien
gtattccagttcatcagctacagaa

SEQ ID NO: 12483 - DNA, 25 bp, Homo sapien
ggagaagccctttggctagatttct

SEQ ID NO: 12484 - DNA, 25 bp, Homo sapien
ccctttggctagatttctcttttgt

SEQ ID NO: 12485 - DNA, 25 bp, Homo sapien
caggtatttttgttagtggttcata

SEQ ID NO: 12486 - DNA, 25 bp, Homo sapien
tagctgggcattgcggcgcatgtct

SEQ ID NO: 12487 - DNA, 25 bp, Homo sapien
aatgtgaagttatcaattgtcccaa

SEQ ID NO: 12488 - DNA, 25 bp, Homo sapien
attgtcccaatttatagctatctgt

SEQ ID NO: 12489 - DNA, 25 bp, Homo sapien
tagctatctgtattacttgtaagtc

SEQ ID NO: 12490 - DNA, 25 bp, Homo sapien
gtaagtctgattaccactttttata

SEQ ID NO: 12491 - DNA, 25 bp, Homo sapien
tatctttgcaaatattgatcctggc

SEQ ID NO: 12492 - DNA, 25 bp, Homo sapien
aaatattgatcctggctgaattacc

SEQ ID NO: 12493 - DNA, 25 bp, Homo sapien
gaattacccatgataaaaagctgct

SEQ ID NO: 12494 - DNA, 25 bp, Homo sapien
aagctgctaataaaaagtggtctcg

SEQ ID NO: 12495 - DNA, 25 bp, Homo sapien
aaagtggtctcgcagcagatttctt

SEQ ID NO: 12496 - DNA, 25 bp, Homo sapien
gtctcgcagcagatttctttttcag

SEQ ID NO: 12497 - DNA, 25 bp, Homo sapien
aaattgtcctgtataggccaggcac

SEQ ID NO: 12498 - DNA, 25 bp, Homo sapien
agatcatggctgtctctgagcacaa

SEQ ID NO: 12499 - DNA, 25 bp, Homo sapien
gtctctgagcacaagtattccatgt

SEQ ID NO: 12500 - DNA, 25 bp, Homo sapien
gcacaagtattccatgtggatcagc

SEQ ID NO: 12501 - DNA, 25 bp, Homo sapien
atcagcaagcgggagtgccaccagt

SEQ ID NO: 12502 - DNA, 25 bp, Homo sapien
gactgtgatgagatacgtagcctgt

SEQ ID NO: 12503 - DNA, 25 bp, Homo sapien
agatacgtagcctgtgctgcctgag

SEQ ID NO: 12504 - DNA, 25 bp, Homo sapien
gtgctgcctgagtcaattcagaagt

SEQ ID NO: 12505 - DNA, 25 bp, Homo sapien
gtacaaatttgtccctggaaaatgt

SEQ ID NO: 12506 - DNA, 25 bp, Homo sapien
tgtccctggaaaatgtatacatctc

SEQ ID NO: 12507 - DNA, 25 bp, Homo sapien
gtatacatctcatgctagccttagg

SEQ ID NO: 12508 - DNA, 25 bp, Homo sapien
catctcatgctagccttaggaaact

SEQ ID NO: 12509 - DNA, 25 bp, Homo sapien
tgctgcccgagagcagggaccagaa

SEQ ID NO: 12510 - DNA, 25 bp, Homo sapien
tgcccgagagcagggaccagaacct

SEQ ID NO: 12511 - DNA, 25 bp, Homo sapien
cgagagcagggaccagaacctgcct

SEQ ID NO: 12512 - DNA, 25 bp, Homo sapien
caacgccgagctcaaggactactcg

SEQ ID NO: 12513 - DNA, 25 bp, Homo sapien
gagctcaaggactactcgggcctcc

SEQ ID NO: 12514 - DNA, 25 bp, Homo sapien
agccgcgggtgacacactgcccgag

SEQ ID NO: 12515 - DNA, 25 bp, Homo sapien
tcagccaagctgagcctctcaactg

SEQ ID NO: 12516 - DNA, 25 bp, Homo sapien
aagctgagcctctcaactggtgtgg

SEQ ID NO: 12517 - DNA, 25 bp, Homo sapien
tggggaaatcctgtctttccaaaag

SEQ ID NO: 12518 - DNA, 25 bp, Homo sapien
tccaaaagtccaaggagcgcgggtc

SEQ ID NO: 12519 - DNA, 25 bp, Homo sapien
cgcgggtcggaggagacaaactctt

SEQ ID NO: 12520 - DNA, 25 bp, Homo sapien
cgcacccaaccaaatctatacattt

SEQ ID NO: 12521 - DNA, 25 bp, Homo sapien
aaccaaatctatacatttcaatgaa

SEQ ID NO: 12522 - DNA, 25 bp, Homo sapien
gtaaggttttgttactatcataatg

SEQ ID NO: 12523 - DNA, 25 bp, Homo sapien
tcagagcgttcatactaaataagaa

SEQ ID NO: 12524 - DNA, 25 bp, Homo sapien
gaagtgtaattactgtcaaacgact

SEQ ID NO: 12525 - DNA, 25 bp, Homo sapien
gtaattactgtcaaacgactgatca

SEQ ID NO: 12526 - DNA, 25 bp, Homo sapien
tactgtcaaacgactgatcagaaaa

SEQ ID NO: 12527 - DNA, 25 bp, Homo sapien
aatatgaagaggcattatttatgac

SEQ ID NO: 12528 - DNA, 25 bp, Homo sapien
tatgaccttttctatggaaagacgg

SEQ ID NO: 12529 - DNA, 25 bp, Homo sapien
ttttctatggaaagacggagtcttg

SEQ ID NO: 12530 - DNA, 25 bp, Homo sapien
gatctcgtcccactgctcactgcaa

SEQ ID NO: 12531 - DNA, 25 bp, Homo sapien
agatgctggtgcaggttcccagcaa

SEQ ID NO: 12532 - DNA, 25 bp, Homo sapien
agcaaggctcagagctgcgggtctc

SEQ ID NO: 12533 - DNA, 25 bp, Homo sapien
ggtctccagggagttcccgcagagc

SEQ ID NO: 12534 - DNA, 25 bp, Homo sapien
gtggacacctctgtccccagagatg

SEQ ID NO: 12535 - DNA, 25 bp, Homo sapien
atgatgctgcgcgttggagctttcc

SEQ ID NO: 12536 - DNA, 25 bp, Homo sapien
cgcgttggagctttcctgctttttt

SEQ ID NO: 12537 - DNA, 25 bp, Homo sapien
tccagatttccttataagcgatttg

SEQ ID NO: 12538 - DNA, 25 bp, Homo sapien
agcgatttgacttcacagcgtgacc

SEQ ID NO: 12539 - DNA, 25 bp, Homo sapien
cacagcgtgacctttttatatacat

SEQ ID NO: 12540 - DNA, 25 bp, Homo sapien
tatctggtatttgtttagaccttag

SEQ ID NO: 12541 - DNA, 25 bp, Homo sapien
ccttagaagtgttctgaggccgggc

SEQ ID NO: 12542 - DNA, 25 bp, Homo sapien
gggaggtcctcgcacatgaccttgt

SEQ ID NO: 12543 - DNA, 25 bp, Homo sapien
atgaccttgtctggtagctgcagtt

SEQ ID NO: 12544 - DNA, 25 bp, Homo sapien
ctggtagctgcagtttgtccctcgt

SEQ ID NO: 12545 - DNA, 25 bp, Homo sapien
cttcaacagctacctattgaggccc

SEQ ID NO: 12546 - DNA, 25 bp, Homo sapien
atggttctgtcttgacatctgggac

SEQ ID NO: 12547 - DNA, 25 bp, Homo sapien
tctgtcttgacatctgggacagcag

SEQ ID NO: 12548 - DNA, 25 bp, Homo sapien
tgccttcccacacaagctcagagga

SEQ ID NO: 12549 - DNA, 25 bp, Homo sapien
ctcagaggagcagtttagcatttct

SEQ ID NO: 12550 - DNA, 25 bp, Homo sapien
gtttagcatttctcagtgactcggg

SEQ ID NO: 12551 - DNA, 25 bp, Homo sapien
ctgggaacagtcatctttgtacttt

SEQ ID NO: 12552 - DNA, 25 bp, Homo sapien
tttgtactttagaaaatggcagctg

SEQ ID NO: 12553 - DNA, 25 bp, Homo sapien
aacagcacagaagggttcaaggtgg

SEQ ID NO: 12554 - DNA, 25 bp, Homo sapien
gtggaagctgaaggtactccccagt

SEQ ID NO: 12555 - DNA, 25 bp, Homo sapien
taggtcccacatggcctttgggaaa

SEQ ID NO: 12556 - DNA, 25 bp, Homo sapien
tggcctttgggaaacatatgcattg

SEQ ID NO: 12557 - DNA, 25 bp, Homo sapien
aaacatatgcattgttccctcttcc

SEQ ID NO: 12558 - DNA, 25 bp, Homo sapien
tccctcttcccatagaagccagaag

SEQ ID NO: 12559 - DNA, 25 bp, Homo sapien
agggaagtctggaatcagtgagcca

SEQ ID NO: 12560 - DNA, 25 bp, Homo sapien
attattccgtcctgtctccctagga

SEQ ID NO: 12561 - DNA, 25 bp, Homo sapien
tgccaacccatgaataaaattacag

SEQ ID NO: 12562 - DNA, 25 bp, Homo sapien
gaagtaatccctgctttcttgttaa

SEQ ID NO: 12563 - DNA, 25 bp, Homo sapien
atccctgctttcttgttaacatgtt

SEQ ID NO: 12564 - DNA, 25 bp, Homo sapien
aacagagcgtccttgagaggcagga

SEQ ID NO: 12565 - DNA, 25 bp, Homo sapien
tcttgtccacctacatttagccata

SEQ ID NO: 12566 - DNA, 25 bp, Homo sapien
atttagccatatgacccttctgatc

SEQ ID NO: 12567 - DNA, 25 bp, Homo sapien
atatgacccttctgatctcctttgc

SEQ ID NO: 12568 - DNA, 25 bp, Homo sapien
ctgatctcctttgcctaagtccgag

SEQ ID NO: 12569 - DNA, 25 bp, Homo sapien
taagtccgaggcttaggcctagcac

SEQ ID NO: 12570 - DNA, 25 bp, Homo sapien
aggcttaggcctagcactgtaggat

SEQ ID NO: 12571 - DNA, 25 bp, Homo sapien
tgcttacatttcagagcagaccagc

SEQ ID NO: 12572 - DNA, 25 bp, Homo sapien
ccagccaccacactattggagatat

SEQ ID NO: 12573 - DNA, 25 bp, Homo sapien
gagatatattggagatctccccttg

SEQ ID NO: 12574 - DNA, 25 bp, Homo sapien
tctccccttgactcactaattgaaa

SEQ ID NO: 12575 - DNA, 25 bp, Homo sapien
gaggtgtgtacatgttaaatttgaa

SEQ ID NO: 12576 - DNA, 25 bp, Homo sapien
aaagtagggatcacctgtgggacat

SEQ ID NO: 12577 - DNA, 25 bp, Homo sapien
gatcacctgtgggacatatatttat

SEQ ID NO: 12578 - DNA, 25 bp, Homo sapien
caggttatgcttatatatttgtgct

SEQ ID NO: 12579 - DNA, 25 bp, Homo sapien
tattataataggtagcaggagcatc

SEQ ID NO: 12580 - DNA, 25 bp, Homo sapien
tagcaggagcatcatattatcaagc

SEQ ID NO: 12581 - DNA, 25 bp, Homo sapien
gttttagaaaacttattagccacat

SEQ ID NO: 12582 - DNA, 25 bp, Homo sapien
attagccacatatctactatgtcat

SEQ ID NO: 12583 - DNA, 25 bp, Homo sapien
tgaattaatcctcataagcatccag

SEQ ID NO: 12584 - DNA, 25 bp, Homo sapien
taagcatccaggtaagataggtatt

SEQ ID NO: 12585 - DNA, 25 bp, Homo sapien
ataggtattatcgttttcatttcaa

SEQ ID NO: 12586 - DNA, 25 bp, Homo sapien
gagagataccaatttgtctttctaa

SEQ ID NO: 12587 - DNA, 25 bp, Homo sapien
gttagaattgccttgctagatttcc

SEQ ID NO: 12588 - DNA, 25 bp, Homo sapien
agaattgccttgctagatttccctt

SEQ ID NO: 12589 - DNA, 25 bp, Homo sapien
aattgccttgctagatttccctttg

SEQ ID NO: 12590 - DNA, 25 bp, Homo sapien
gctagatttccctttgctgtataac

SEQ ID NO: 12591 - DNA, 25 bp, Homo sapien
ttccctttgctgtataacatcactg

SEQ ID NO: 12592 - DNA, 25 bp, Homo sapien
aacatcactgttatctaatgttttt

SEQ ID NO: 12593 - DNA, 25 bp, Homo sapien
tagacgttattgaaatttggagtat

SEQ ID NO: 12594 - DNA, 25 bp, Homo sapien
aaacacaaaagcacctgtaatctca

SEQ ID NO: 12595 - DNA, 25 bp, Homo sapien
caccaaagttgcatgactgctgttt

SEQ ID NO: 12596 - DNA, 25 bp, Homo sapien
gcatgactgctgtttgagagatacc

SEQ ID NO: 12597 - DNA, 25 bp, Homo sapien
tagcaccgtcaagggagggccagtc

SEQ ID NO: 12598 - DNA, 25 bp, Homo sapien
tcctgcggaagaccactacggtcaa

SEQ ID NO: 12599 - DNA, 25 bp, Homo sapien
tacggtcaagacgtccagccagagg

SEQ ID NO: 12600 - DNA, 25 bp, Homo sapien
aagacgtccagccagaggtattagc

SEQ ID NO: 12601 - DNA, 25 bp, Homo sapien
aggtattagctgctgagccctgcaa

SEQ ID NO: 12602 - DNA, 25 bp, Homo sapien
ggacctcagacccagggtattttca

SEQ ID NO: 12603 - DNA, 25 bp, Homo sapien
gggtattttcataccagactatttg

SEQ ID NO: 12604 - DNA, 25 bp, Homo sapien
gggaagcgctcaaatctactcaggt

SEQ ID NO: 12605 - DNA, 25 bp, Homo sapien
aatctactcaggttttctccttggt

SEQ ID NO: 12606 - DNA, 25 bp, Homo sapien
tctccttggtcctgcagtaggatgg

SEQ ID NO: 12607 - DNA, 25 bp, Homo sapien
gaccaccgagaggaggctgaatttc

SEQ ID NO: 12608 - DNA, 25 bp, Homo sapien
gccatctccttctaactctttgtta

SEQ ID NO: 12609 - DNA, 25 bp, Homo sapien
ttcccttttcaagaagtgctccggt

SEQ ID NO: 12610 - DNA, 25 bp, Homo sapien
gaagtgctccggtttaattcaacca

SEQ ID NO: 12611 - DNA, 25 bp, Homo sapien
taattcaaccaacatttcctgagca

SEQ ID NO: 12612 - DNA, 25 bp, Homo sapien
accaacatttcctgagcaaagcacc

SEQ ID NO: 12613 - DNA, 25 bp, Homo sapien
catttcctgagcaaagcaccatgcc

SEQ ID NO: 12614 - DNA, 25 bp, Homo sapien
cctggctctctgaggaattaaaagt

SEQ ID NO: 12615 - DNA, 25 bp, Homo sapien
ttacaggtatgagcaacagtgccct

SEQ ID NO: 12616 - DNA, 25 bp, Homo sapien
ggtatgagcaacagtgccctgcaga

SEQ ID NO: 12617 - DNA, 25 bp, Homo sapien
gtgccctgcagaatccactaattta

SEQ ID NO: 12618 - DNA, 25 bp, Homo sapien
tttaaagaactatctccagagaggg

SEQ ID NO: 12619 - DNA, 25 bp, Homo sapien
gtgttagatgcttttcatgcgctat

SEQ ID NO: 12620 - DNA, 25 bp, Homo sapien
gatgcttttcatgcgctattttact

SEQ ID NO: 12621 - DNA, 25 bp, Homo sapien
tcatgcgctattttactgaatgtaa

SEQ ID NO: 12622 - DNA, 25 bp, Homo sapien
tgaatgtaaacaaccaccttattaa

SEQ ID NO: 12623 - DNA, 25 bp, Homo sapien
aaccaccttattaaatatactcact

SEQ ID NO: 12624 - DNA, 25 bp, Homo sapien
aaatgtgggtaatcgtatggtgcaa

SEQ ID NO: 12625 - DNA, 25 bp, Homo sapien
aatcgtatggtgcaagtggtagcaa

SEQ ID NO: 12626 - DNA, 25 bp, Homo sapien
ttaggttttgcccagtcttgctgtt

SEQ ID NO: 12627 - DNA, 25 bp, Homo sapien
gttttgcccagtcttgctgtttaaa

SEQ ID NO: 12628 - DNA, 25 bp, Homo sapien
ttgcccagtcttgctgtttaaagcc

SEQ ID NO: 12629 - DNA, 25 bp, Homo sapien
ccagtcttgctgtttaaagccctgt

SEQ ID NO: 12630 - DNA, 25 bp, Homo sapien
gttggaatttctttcggtgtgagac

SEQ ID NO: 12631 - DNA, 25 bp, Homo sapien
ctttcggtgtgagacaagaattcaa

SEQ ID NO: 12632 - DNA, 25 bp, Homo sapien
tgtctgtttggtccgtcttttctta

SEQ ID NO: 12633 - DNA, 25 bp, Homo sapien
ttttcttattccctacctcactgtt

SEQ ID NO: 12634 - DNA, 25 bp, Homo sapien
ttccctacctcactgttttatttat

SEQ ID NO: 12635 - DNA, 25 bp, Homo sapien
cttcataatatgctagtttcttctg

SEQ ID NO: 12636 - DNA, 25 bp, Homo sapien
gctagtttcttctgttactcatctc

SEQ ID NO: 12637 - DNA, 25 bp, Homo sapien
tcttctgttactcatctctttttag

SEQ ID NO: 12638 - DNA, 25 bp, Homo sapien
ttttcctgttcttggctgggcgtca

SEQ ID NO: 12639 - DNA, 25 bp, Homo sapien
ctgttcttggctgggcgtcatggct

SEQ ID NO: 12640 - DNA, 25 bp, Homo sapien
gggcgtcatggctcacgcttacaat

SEQ ID NO: 12641 - DNA, 25 bp, Homo sapien
aactaaccctggcttactacagaga

SEQ ID NO: 12642 - DNA, 25 bp, Homo sapien
gagaagattctcctacagtaaaaat

SEQ ID NO: 12643 - DNA, 25 bp, Homo sapien
gaaacctcgcttctactaaagaaat

SEQ ID NO: 12644 - DNA, 25 bp, Homo sapien
tctttgtttgaagcttgcgttacca

SEQ ID NO: 12645 - DNA, 25 bp, Homo sapien
tgcgttaccatttctattggcgtta

SEQ ID NO: 12646 - DNA, 25 bp, Homo sapien
atttctattggcgttatgtccacac

SEQ ID NO: 12647 - DNA, 25 bp, Homo sapien
tatgtccacacaagatgagcctgaa

SEQ ID NO: 12648 - DNA, 25 bp, Homo sapien
ggattgtacagaactatcgcgatac

SEQ ID NO: 12649 - DNA, 25 bp, Homo sapien
tatcgcgatacaactagggaacaaa

SEQ ID NO: 12650 - DNA, 25 bp, Homo sapien
aaaattctgggattgtctcagcttg

SEQ ID NO: 12651 - DNA, 25 bp, Homo sapien
ggattgtctcagcttgttttatgga

SEQ ID NO: 12652 - DNA, 25 bp, Homo sapien
ttagctattaataagtctcggctgg

SEQ ID NO: 12653 - DNA, 25 bp, Homo sapien
gctattaataagtctcggctgggcg

SEQ ID NO: 12654 - DNA, 25 bp, Homo sapien
taggatggagctaggtgctgtgact

SEQ ID NO: 12655 - DNA, 25 bp, Homo sapien
gaaggcccaagtgggacgatgactt

SEQ ID NO: 12656 - DNA, 25 bp, Homo sapien
aggcccaagtgggacgatgacttga

SEQ ID NO: 12657 - DNA, 25 bp, Homo sapien
caagtgggacgatgacttgagttca

SEQ ID NO: 12658 - DNA, 25 bp, Homo sapien
attaggcaggcgcacgcctatagtc

SEQ ID NO: 12659 - DNA, 25 bp, Homo sapien
ttaggcaggcgcacgcctatagtcc

SEQ ID NO: 12660 - DNA, 25 bp, Homo sapien
tctcattcacttctgtcaggctaga

SEQ ID NO: 12661 - DNA, 25 bp, Homo sapien
tcattcacttctgtcaggctagact

SEQ ID NO: 12662 - DNA, 25 bp, Homo sapien
attcacttctgtcaggctagactct

SEQ ID NO: 12663 - DNA, 25 bp, Homo sapien
aatgccagccacaggcacgcgcacg

SEQ ID NO: 12664 - DNA, 25 bp, Homo sapien
gcattcaacagcgaagcggcacagc

SEQ ID NO: 12665 - DNA, 25 bp, Homo sapien
cattcaacagcgaagcggcacagct

SEQ ID NO: 12666 - DNA, 25 bp, Homo sapien
ttcaacagcgaagcggcacagctgg

SEQ ID NO: 12667 - DNA, 25 bp, Homo sapien
caacagcgaagcggcacagctggtt

SEQ ID NO: 12668 - DNA, 25 bp, Homo sapien
gctggtttccagaaccgtctcccgg

SEQ ID NO: 12669 - DNA, 25 bp, Homo sapien
ggtcaaagccacaggctgtgctacg

SEQ ID NO: 12670 - DNA, 25 bp, Homo sapien
gtcaaagccacaggctgtgctacgg

SEQ ID NO: 12671 - DNA, 25 bp, Homo sapien
aaagccacaggctgtgctacggccc

SEQ ID NO: 12672 - DNA, 25 bp, Homo sapien
gccccccgggactcgctaagagtag

SEQ ID NO: 12673 - DNA, 25 bp, Homo sapien
tctttcctcctcttgtgtataggta

SEQ ID NO: 12674 - DNA, 25 bp, Homo sapien
aacatctcctacgtgcatttctaaa

SEQ ID NO: 12675 - DNA, 25 bp, Homo sapien
atctcctacgtgcatttctaaaata

SEQ ID NO: 12676 - DNA, 25 bp, Homo sapien
ttctaaaataatacagttggccatt

SEQ ID NO: 12677 - DNA, 25 bp, Homo sapien
caggtttgaacttctcaagtccaat

SEQ ID NO: 12678 - DNA, 25 bp, Homo sapien
acttctcaagtccaatgttatgcag

SEQ ID NO: 12679 - DNA, 25 bp, Homo sapien
agtccaatgttatgcagagttttaa

SEQ ID NO: 12680 - DNA, 25 bp, Homo sapien
ttttggaggtatgtgacaatttgaa

SEQ ID NO: 12681 - DNA, 25 bp, Homo sapien
gatgaacctcatagccaagaaataa

SEQ ID NO: 12682 - DNA, 25 bp, Homo sapien
tatatgttggtagtctattttatca

SEQ ID NO: 12683 - DNA, 25 bp, Homo sapien
aaatgaacacagatctattacagaa

SEQ ID NO: 12684 - DNA, 25 bp, Homo sapien
tgcatagacgttgccaacatctcct

SEQ ID NO: 12685 - DNA, 25 bp, Homo sapien
tgcttatatccccactttggcttag

SEQ ID NO: 12686 - DNA, 25 bp, Homo sapien
cttatatccccactttggcttagtt

SEQ ID NO: 12687 - DNA, 25 bp, Homo sapien
ttggcttagtttaatgtccagcagt

SEQ ID NO: 12688 - DNA, 25 bp, Homo sapien
tagtttaatgtccagcagtacccct

SEQ ID NO: 12689 - DNA, 25 bp, Homo sapien
agtttaatgtccagcagtacccctg

SEQ ID NO: 12690 - DNA, 25 bp, Homo sapien
gcagtacccctggaaccagggagga

SEQ ID NO: 12691 - DNA, 25 bp, Homo sapien
gcaggaggtaagtattggtgactac

SEQ ID NO: 12692 - DNA, 25 bp, Homo sapien
gtaagtattggtgactacctccaac

SEQ ID NO: 12693 - DNA, 25 bp, Homo sapien
gtattggtgactacctccaacacta

SEQ ID NO: 12694 - DNA, 25 bp, Homo sapien
ttggtgactacctccaacactaggc

SEQ ID NO: 12695 - DNA, 25 bp, Homo sapien
ccaacactaggcagcatgtcccatt

SEQ ID NO: 12696 - DNA, 25 bp, Homo sapien
tgcagtggctatgcggtggcactat

SEQ ID NO: 12697 - DNA, 25 bp, Homo sapien
cagtggctatgcggtggcactatag

SEQ ID NO: 12698 - DNA, 25 bp, Homo sapien
agtggctatgcggtggcactatagg

SEQ ID NO: 12699 - DNA, 25 bp, Homo sapien
gtggctatgcggtggcactatagga

SEQ ID NO: 12700 - DNA, 25 bp, Homo sapien
ctatgcggtggcactataggaggct

SEQ ID NO: 12701 - DNA, 25 bp, Homo sapien
gcggtggcactataggaggctgagg

SEQ ID NO: 12702 - DNA, 25 bp, Homo sapien
actcaagaggcgaaggcagggaaga

SEQ ID NO: 12703 - DNA, 25 bp, Homo sapien
tcaagaggcgaaggcagggaagatt

SEQ ID NO: 12704 - DNA, 25 bp, Homo sapien
aagaaagaacatggccaggcgtggt

SEQ ID NO: 12705 - DNA, 25 bp, Homo sapien
gaggcagtcagatcatgaggccagt

SEQ ID NO: 12706 - DNA, 25 bp, Homo sapien
gcagtcagatcatgaggccagtttg

SEQ ID NO: 12707 - DNA, 25 bp, Homo sapien
gagtagggccatttttaatttcctg

SEQ ID NO: 12708 - DNA, 25 bp, Homo sapien
cttttccaccagtgcgagagaggga

SEQ ID NO: 12709 - DNA, 25 bp, Homo sapien
tacttttcagggtgttgcctatttt

SEQ ID NO: 12710 - DNA, 25 bp, Homo sapien
tttcagggtgttgcctattttcccg

SEQ ID NO: 12711 - DNA, 25 bp, Homo sapien
tcagggtgttgcctattttcccgtt

SEQ ID NO: 12712 - DNA, 25 bp, Homo sapien
gtgttgcctattttcccgtttgcag

SEQ ID NO: 12713 - DNA, 25 bp, Homo sapien
ggctaaatttgggttgattatggcc

SEQ ID NO: 12714 - DNA, 25 bp, Homo sapien
taaatttgggttgattatggccctg

SEQ ID NO: 12715 - DNA, 25 bp, Homo sapien
gggctctacagcagtcgtgatgaaa

SEQ ID NO: 12716 - DNA, 25 bp, Homo sapien
aaatatatatcctttgtcctcgaga

SEQ ID NO: 12717 - DNA, 25 bp, Homo sapien
atatcctttgtcctcgagattttag

SEQ ID NO: 12718 - DNA, 25 bp, Homo sapien
gtcaacaagaaatggtaagcagtat

SEQ ID NO: 12719 - DNA, 25 bp, Homo sapien
aaaagaagtgccacacccttctagg

SEQ ID NO: 12720 - DNA, 25 bp, Homo sapien
cacccttctaggcatccaaattcaa

SEQ ID NO: 12721 - DNA, 25 bp, Homo sapien
cttctaggcatccaaattcaagcat

SEQ ID NO: 12722 - DNA, 25 bp, Homo sapien
agcatttacaatgtacttcatgaag

SEQ ID NO: 12723 - DNA, 25 bp, Homo sapien
acttcatgaagcagtaccctataca

SEQ ID NO: 12724 - DNA, 25 bp, Homo sapien
gaagcagtaccctatacagcactaa

SEQ ID NO: 12725 - DNA, 25 bp, Homo sapien
acagcactaataacagcccaaactt

SEQ ID NO: 12726 - DNA, 25 bp, Homo sapien
gcccaaacttgcttgacatttctac

SEQ ID NO: 12727 - DNA, 25 bp, Homo sapien
tgcttgacatttctacataacacat

SEQ ID NO: 12728 - DNA, 25 bp, Homo sapien
aaataaggactaggcgcctgggcgc

SEQ ID NO: 12729 - DNA, 25 bp, Homo sapien
ctgacatctgccctgtgcagttgaa

SEQ ID NO: 12730 - DNA, 25 bp, Homo sapien
actactaatggcctgctgttatcca

SEQ ID NO: 12731 - DNA, 25 bp, Homo sapien
ctaatggcctgctgttatccagagg

SEQ ID NO: 12732 - DNA, 25 bp, Homo sapien
gctgttatccagaggccttaccaat

SEQ ID NO: 12733 - DNA, 25 bp, Homo sapien
ttatccagaggccttaccaataaca

SEQ ID NO: 12734 - DNA, 25 bp, Homo sapien
acataaacagttgcttcacacataa

SEQ ID NO: 12735 - DNA, 25 bp, Homo sapien
cagttgcttcacacataaatagatt

SEQ ID NO: 12736 - DNA, 25 bp, Homo sapien
tttctaggctagacagtttatctgc

SEQ ID NO: 12737 - DNA, 25 bp, Homo sapien
agacagtttatctgcgagttttttc

SEQ ID NO: 12738 - DNA, 25 bp, Homo sapien
gagttttttcaaattattgcacatt

SEQ ID NO: 12739 - DNA, 25 bp, Homo sapien
attattgcacatttccaaaacattt

SEQ ID NO: 12740 - DNA, 25 bp, Homo sapien
accactcctggcatataacactttt

SEQ ID NO: 12741 - DNA, 25 bp, Homo sapien
cactcctggcatataacacttttca

SEQ ID NO: 12742 - DNA, 25 bp, Homo sapien
cctggcatataacacttttcagtaa

SEQ ID NO: 12743 - DNA, 25 bp, Homo sapien
acacttttcagtaaattcatcttct

SEQ ID NO: 12744 - DNA, 25 bp, Homo sapien
ttcatcttctatttaatttagccag

SEQ ID NO: 12745 - DNA, 25 bp, Homo sapien
tctatttaatttagccagagttcac

SEQ ID NO: 12746 - DNA, 25 bp, Homo sapien
ccagagttcacttctaacaagcaag

SEQ ID NO: 12747 - DNA, 25 bp, Homo sapien
gttcacttctaacaagcaagatagt

SEQ ID NO: 12748 - DNA, 25 bp, Homo sapien
gatatatcaagaatcctagctggga

SEQ ID NO: 12749 - DNA, 25 bp, Homo sapien
tatcaagaatcctagctgggagctg

SEQ ID NO: 12750 - DNA, 25 bp, Homo sapien
tcaagaatcctagctgggagctgtg

SEQ ID NO: 12751 - DNA, 25 bp, Homo sapien
agttagccatagtattaaataagtc

SEQ ID NO: 12752 - DNA, 25 bp, Homo sapien
aagtcgagtggtaaatttgttgcca

SEQ ID NO: 12753 - DNA, 25 bp, Homo sapien
gttgccaaaaattgatagtttactc

SEQ ID NO: 12754 - DNA, 25 bp, Homo sapien
gatagtttactcctaagtcaaatta

SEQ ID NO: 12755 - DNA, 25 bp, Homo sapien
gtcattaatcatttctattattgct

SEQ ID NO: 12756 - DNA, 25 bp, Homo sapien
attattgctttaagccattaacatg

SEQ ID NO: 12757 - DNA, 25 bp, Homo sapien
catggatgaaggatgactaatcttt

SEQ ID NO: 12758 - DNA, 25 bp, Homo sapien
catatttttacttaactgccctata

SEQ ID NO: 12759 - DNA, 25 bp, Homo sapien
acttaactgccctataaataagcaa

SEQ ID NO: 12760 - DNA, 25 bp, Homo sapien
gcaaacaaaatggtattactagctt

SEQ ID NO: 12761 - DNA, 25 bp, Homo sapien
agatcatatgtcctagcacttttgg

SEQ ID NO: 12762 - DNA, 25 bp, Homo sapien
ataagccaaaatttgcaagactcag

SEQ ID NO: 12763 - DNA, 25 bp, Homo sapien
tttgcaagactcagcagaaacaaga

SEQ ID NO: 12764 - DNA, 25 bp, Homo sapien
aacaagaaacacagatctacatccc

SEQ ID NO: 12765 - DNA, 25 bp, Homo sapien
catcccccatgccttataacattgg

SEQ ID NO: 12766 - DNA, 25 bp, Homo sapien
gggtgcagaatactgcatatagaaa

SEQ ID NO: 12767 - DNA, 25 bp, Homo sapien
aaatacatgtgagctatatagagaa

SEQ ID NO: 12768 - DNA, 25 bp, Homo sapien
aaaacgttgagcaaagagtcagcaa

SEQ ID NO: 12769 - DNA, 25 bp, Homo sapien
ttgagcaaagagtcagcaaccatca

SEQ ID NO: 12770 - DNA, 25 bp, Homo sapien
gtcagcaaccatcaaaaacaaccag

SEQ ID NO: 12771 - DNA, 25 bp, Homo sapien
gataggttaaaagggtattacacat

SEQ ID NO: 12772 - DNA, 25 bp, Homo sapien
agtaagtgggccaggaacagtggct

SEQ ID NO: 12773 - DNA, 25 bp, Homo sapien
gtatgcacttctatgttcacacgga

SEQ ID NO: 12774 - DNA, 25 bp, Homo sapien
gaaaatcacagctgaatccctagaa

SEQ ID NO: 12775 - DNA, 25 bp, Homo sapien
gctgaatccctagaattgacatcat

SEQ ID NO: 12776 - DNA, 25 bp, Homo sapien
gaaagggactctcattagaagttaa

SEQ ID NO: 12777 - DNA, 25 bp, Homo sapien
gaagttaaaatctccgaagtgcagg

SEQ ID NO: 12778 - DNA, 25 bp, Homo sapien
gcaataaaacgaatcccttagctct

SEQ ID NO: 12779 - DNA, 25 bp, Homo sapien
gaatcccttagctctattattgaag

SEQ ID NO: 12780 - DNA, 25 bp, Homo sapien
tgaagctgtttcacagtgccaatct

SEQ ID NO: 12781 - DNA, 25 bp, Homo sapien
tttcacagtgccaatctagttccct

SEQ ID NO: 12782 - DNA, 25 bp, Homo sapien
ataggttttaactaggctgggtatg

SEQ ID NO: 12783 - DNA, 25 bp, Homo sapien
agtaattgcagcctcccttaggagg

SEQ ID NO: 12784 - DNA, 25 bp, Homo sapien
ggtactgctgcctttttctgttcca

SEQ ID NO: 12785 - DNA, 25 bp, Homo sapien
gtactgctgcctttttctgttccac

SEQ ID NO: 12786 - DNA, 25 bp, Homo sapien
tactgctgcctttttctgttccaca

SEQ ID NO: 12787 - DNA, 25 bp, Homo sapien
tgctgcctttttctgttccacactg

SEQ ID NO: 12788 - DNA, 25 bp, Homo sapien
gctgcctttttctgttccacactgt

SEQ ID NO: 12789 - DNA, 25 bp, Homo sapien
tgcctttttctgttccacactgtca

SEQ ID NO: 12790 - DNA, 25 bp, Homo sapien
gcctttttctgttccacactgtcag

SEQ ID NO: 12791 - DNA, 25 bp, Homo sapien
ctttttctgttccacactgtcaggg

SEQ ID NO: 12792 - DNA, 25 bp, Homo sapien
tttttctgttccacactgtcaggga

SEQ ID NO: 12793 - DNA, 25 bp, Homo sapien
ttttctgttccacactgtcagggaa

SEQ ID NO: 12794 - DNA, 25 bp, Homo sapien
gaatgccgtagaaggcattttttcc

SEQ ID NO: 12795 - DNA, 25 bp, Homo sapien
aatcctcaagtgtctatgctggagt

SEQ ID NO: 12796 - DNA, 25 bp, Homo sapien
atgatattgcatgagttgtccatct

SEQ ID NO: 12797 - DNA, 25 bp, Homo sapien
gttgtccatctttgtatatatctca

SEQ ID NO: 12798 - DNA, 25 bp, Homo sapien
atctcaagacttgtggtgttagtta

SEQ ID NO: 12799 - DNA, 25 bp, Homo sapien
aaagattcagagctctgtgtcctga

SEQ ID NO: 12800 - DNA, 25 bp, Homo sapien
ttcagagctctgtgtcctgaacaca

SEQ ID NO: 12801 - DNA, 25 bp, Homo sapien
tgaacacagagtaataccagcatta

SEQ ID NO: 12802 - DNA, 25 bp, Homo sapien
gcattactaaggatgatcgtgggat

SEQ ID NO: 12803 - DNA, 25 bp, Homo sapien
aaaattcctcccttagatagatctt

SEQ ID NO: 12804 - DNA, 25 bp, Homo sapien
gatagatcttacgaacttaggttac

SEQ ID NO: 12805 - DNA, 25 bp, Homo sapien
ttaggttaccaatcaacataagtta

SEQ ID NO: 12806 - DNA, 25 bp, Homo sapien
tgcacatcaccacaggtgcacatca

SEQ ID NO: 12807 - DNA, 25 bp, Homo sapien
gcatttattgctggaattctgaaaa

SEQ ID NO: 12808 - DNA, 25 bp, Homo sapien
ttattgctggaattctgaaaaattt

SEQ ID NO: 12809 - DNA, 25 bp, Homo sapien
gtttttgctcatcagttattttata

SEQ ID NO: 12810 - DNA, 25 bp, Homo sapien
tatatgtggaggtacaatttgtata

SEQ ID NO: 12811 - DNA, 25 bp, Homo sapien
gaataaatgagttgcttcactatca

SEQ ID NO: 12812 - DNA, 25 bp, Homo sapien
ataaatgagttgcttcactatcacc

SEQ ID NO: 12813 - DNA, 25 bp, Homo sapien
aaatgagttgcttcactatcaccct

SEQ ID NO: 12814 - DNA, 25 bp, Homo sapien
aatgagttgcttcactatcaccctc

SEQ ID NO: 12815 - DNA, 25 bp, Homo sapien
tgagttgcttcactatcaccctcca

SEQ ID NO: 12816 - DNA, 25 bp, Homo sapien
agttgcttcactatcaccctccaaa

SEQ ID NO: 12817 - DNA, 25 bp, Homo sapien
gtgcgaagactcagcaggcagtcca

SEQ ID NO: 12818 - DNA, 25 bp, Homo sapien
tcagcaggcagtccaccagaaagga

SEQ ID NO: 12819 - DNA, 25 bp, Homo sapien
gcagtccaccagaaaggaacctgta

SEQ ID NO: 12820 - DNA, 25 bp, Homo sapien
aagcaagtccggctttgcgtttcac

SEQ ID NO: 12821 - DNA, 25 bp, Homo sapien
agaagtcaacagtgggatcccctga

SEQ ID NO: 12822 - DNA, 25 bp, Homo sapien
agtgggatcccctgatctattccag

SEQ ID NO: 12823 - DNA, 25 bp, Homo sapien
ggatcccctgatctattccagcatc

SEQ ID NO: 12824 - DNA, 25 bp, Homo sapien
ttccagcatctttgagtgcaagcct

SEQ ID NO: 12825 - DNA, 25 bp, Homo sapien
ttgcttgtctgattaaggaagacgc

SEQ ID NO: 12826 - DNA, 25 bp, Homo sapien
gagtatctgctatgtgttcaaagcc

SEQ ID NO: 12827 - DNA, 25 bp, Homo sapien
ctatgtgttcaaagccgatgatcaa

SEQ ID NO: 12828 - DNA, 25 bp, Homo sapien
aactatgagccaaacaaatttctgc

SEQ ID NO: 12829 - DNA, 25 bp, Homo sapien
gagccaaacaaatttctgcttatta

SEQ ID NO: 12830 - DNA, 25 bp, Homo sapien
tacccagtctgtggtgttgttataa

SEQ ID NO: 12831 - DNA, 25 bp, Homo sapien
cccagtctgtggtgttgttataaca

SEQ ID NO: 12832 - DNA, 25 bp, Homo sapien
cagtctgtggtgttgttataacaac

SEQ ID NO: 12833 - DNA, 25 bp, Homo sapien
tggactaaaacaatccctttgtaat

SEQ ID NO: 12834 - DNA, 25 bp, Homo sapien
gtaatttttcatgaggttgcattga

SEQ ID NO: 12835 - DNA, 25 bp, Homo sapien
atgaggttgcattgaattaatagat

SEQ ID NO: 12836 - DNA, 25 bp, Homo sapien
taatagatgatttagggccgggcgc

SEQ ID NO: 12837 - DNA, 25 bp, Homo sapien
catgatatgtgtgctcattccactt

SEQ ID NO: 12838 - DNA, 25 bp, Homo sapien
tgtgctcattccacttttcttttgt

SEQ ID NO: 12839 - DNA, 25 bp, Homo sapien
ggctccccatctcaaagtacgtgat

SEQ ID NO: 12840 - DNA, 25 bp, Homo sapien
gtgatctcatgatctagctctccca

SEQ ID NO: 12841 - DNA, 25 bp, Homo sapien
cccacaacacctttcagactttatt

SEQ ID NO: 12842 - DNA, 25 bp, Homo sapien
ctttactcaaccaattctagccaca

SEQ ID NO: 12843 - DNA, 25 bp, Homo sapien
aattctagccacactgacttcactg

SEQ ID NO: 12844 - DNA, 25 bp, Homo sapien
gacttcactgtcattcttagaaaca

SEQ ID NO: 12845 - DNA, 25 bp, Homo sapien
agaatccattgactgcgtctgtctt

SEQ ID NO: 12846 - DNA, 25 bp, Homo sapien
ttgttcccaacagtgcattctctac

SEQ ID NO: 12847 - DNA, 25 bp, Homo sapien
gcattctctacatagcaggcacagt

SEQ ID NO: 12848 - DNA, 25 bp, Homo sapien
agcaggcacagtactctttttgaaa

SEQ ID NO: 12849 - DNA, 25 bp, Homo sapien
tattcactcaagacatccaatggct

SEQ ID NO: 12850 - DNA, 25 bp, Homo sapien
gggaacaccaaggaaatgcccatgt

SEQ ID NO: 12851 - DNA, 25 bp, Homo sapien
gcccatgttctgattccaaggtaat

SEQ ID NO: 12852 - DNA, 25 bp, Homo sapien
attccaaggtaatggctcagaccca

SEQ ID NO: 12853 - DNA, 25 bp, Homo sapien
caaggtaatggctcagacccaaggg

SEQ ID NO: 12854 - DNA, 25 bp, Homo sapien
ggcccacctcagcagtatgatgcag

SEQ ID NO: 12855 - DNA, 25 bp, Homo sapien
ctcagcagtatgatgcagcactggg

SEQ ID NO: 12856 - DNA, 25 bp, Homo sapien
gatattttaaaattccaccctccag

SEQ ID NO: 12857 - DNA, 25 bp, Homo sapien
taaaattccaccctccaggcagcat

SEQ ID NO: 12858 - DNA, 25 bp, Homo sapien
aggcagcatctggttgctacagcaa

SEQ ID NO: 12859 - DNA, 25 bp, Homo sapien
agctctgcagggtgtcccgattacc

SEQ ID NO: 12860 - DNA, 25 bp, Homo sapien
gcagggtgtcccgattaccagcagg

SEQ ID NO: 12861 - DNA, 25 bp, Homo sapien
taaaaaacatcagagacatcacact

SEQ ID NO: 12862 - DNA, 25 bp, Homo sapien
aagccttcagctataactcttcact

SEQ ID NO: 12863 - DNA, 25 bp, Homo sapien
gctataactcttcacttagtcgaca

SEQ ID NO: 12864 - DNA, 25 bp, Homo sapien
aactcttcacttagtcgacatcatg

SEQ ID NO: 12865 - DNA, 25 bp, Homo sapien
agtcgacatcatgaaatacacagga

SEQ ID NO: 12866 - DNA, 25 bp, Homo sapien
atacacaggaggaacgccttccgaa

SEQ ID NO: 12867 - DNA, 25 bp, Homo sapien
gaggaacgccttccgaaataaggtg

SEQ ID NO: 12868 - DNA, 25 bp, Homo sapien
atttcaggactcagatatgaggaat

SEQ ID NO: 12869 - DNA, 25 bp, Homo sapien
tgatgtaatgatgccaacttttaat

SEQ ID NO: 12870 - DNA, 25 bp, Homo sapien
cattacattgacaggtattgactac

SEQ ID NO: 12871 - DNA, 25 bp, Homo sapien
acaggtattgactactaacacctct

SEQ ID NO: 12872 - DNA, 25 bp, Homo sapien
acagctgtgaccacggtctctcagc

SEQ ID NO: 12873 - DNA, 25 bp, Homo sapien
gctgcctcctcagggtttctatgtt

SEQ ID NO: 12874 - DNA, 25 bp, Homo sapien
accccatagttgcttctcagagttt

SEQ ID NO: 12875 - DNA, 25 bp, Homo sapien
agagtttccattccgggctctcttt

SEQ ID NO: 12876 - DNA, 25 bp, Homo sapien
gctctctttcctgttgtcctgtggg

SEQ ID NO: 12877 - DNA, 25 bp, Homo sapien
gttgtcctgtgggttgtgctgttcc

SEQ ID NO: 12878 - DNA, 25 bp, Homo sapien
gctgttccctctgcatatcacaagg

SEQ ID NO: 12879 - DNA, 25 bp, Homo sapien
tgcatatcacaaggccggacacggg

SEQ ID NO: 12880 - DNA, 25 bp, Homo sapien
gccggacacgggatgtggttttcca

SEQ ID NO: 12881 - DNA, 25 bp, Homo sapien
aatcctgacccgctgggaagagcct

SEQ ID NO: 12882 - DNA, 25 bp, Homo sapien
ggaagagccttgctgattctcctgc

SEQ ID NO: 12883 - DNA, 25 bp, Homo sapien
gccaggcaggccctcaggcgggaag

SEQ ID NO: 12884 - DNA, 25 bp, Homo sapien
ggcaggccctcaggcgggaagggat

SEQ ID NO: 12885 - DNA, 25 bp, Homo sapien
gccctcaggcgggaagggatgcgcg

SEQ ID NO: 12886 - DNA, 25 bp, Homo sapien
tgcgcgcctgcgattccgggacgta

SEQ ID NO: 12887 - DNA, 25 bp, Homo sapien
gcgcgcctgcgattccgggacgtac

SEQ ID NO: 12888 - DNA, 25 bp, Homo sapien
tgcgattccgggacgtaccgcgcca

SEQ ID NO: 12889 - DNA, 25 bp, Homo sapien
caggccaggggcactcgtgatccag

SEQ ID NO: 12890 - DNA, 25 bp, Homo sapien
aggggcactcgtgatccagaggccg

SEQ ID NO: 12891 - DNA, 25 bp, Homo sapien
tgactgaggccaagtcaggcggtct

SEQ ID NO: 12892 - DNA, 25 bp, Homo sapien
actgaggccaagtcaggcggtctgc

SEQ ID NO: 12893 - DNA, 25 bp, Homo sapien
gagtcacggccaggcaggccctcag

SEQ ID NO: 12894 - DNA, 25 bp, Homo sapien
ttgttttttactgccttctagtcct

SEQ ID NO: 12895 - DNA, 25 bp, Homo sapien
ttttactgccttctagtcctctgtt

SEQ ID NO: 12896 - DNA, 25 bp, Homo sapien
gtcctctgttcccttactaatatac

SEQ ID NO: 12897 - DNA, 25 bp, Homo sapien
cctctgttcccttactaatatactg

SEQ ID NO: 12898 - DNA, 25 bp, Homo sapien
tgttcccttactaatatactgtctt

SEQ ID NO: 12899 - DNA, 25 bp, Homo sapien
atttgaaaccccaatttgagacaca

SEQ ID NO: 12900 - DNA, 25 bp, Homo sapien
aatttgtcataggtttccatgaatt

SEQ ID NO: 12901 - DNA, 25 bp, Homo sapien
gtcataggtttccatgaattaatct

SEQ ID NO: 12902 - DNA, 25 bp, Homo sapien
aaatatgacagcttttgactttaac

SEQ ID NO: 12903 - DNA, 25 bp, Homo sapien
gacagcttttgactttaacaatgta

SEQ ID NO: 12904 - DNA, 25 bp, Homo sapien
gactttaacaatgtagcttgtgtaa

SEQ ID NO: 12905 - DNA, 25 bp, Homo sapien
cttctggagaaggtaccgagctgtc

SEQ ID NO: 12906 - DNA, 25 bp, Homo sapien
gaaggtaccgagctgtcggtcccct

SEQ ID NO: 12907 - DNA, 25 bp, Homo sapien
tggtgctgcctcaccggcagctctt

SEQ ID NO: 12908 - DNA, 25 bp, Homo sapien
cagctcttcgctgcttgagactagt

SEQ ID NO: 12909 - DNA, 25 bp, Homo sapien
ttcgctgcttgagactagtcccaag

SEQ ID NO: 12910 - DNA, 25 bp, Homo sapien
gcttgagactagtcccaagtctgtc

SEQ ID NO: 12911 - DNA, 25 bp, Homo sapien
actagtcccaagtctgtctcagctt

SEQ ID NO: 12912 - DNA, 25 bp, Homo sapien
aagtctgtctcagcttggcttgccc

SEQ ID NO: 12913 - DNA, 25 bp, Homo sapien
ttggcttgccctagctgaccgactg

SEQ ID NO: 12914 - DNA, 25 bp, Homo sapien
tagctgaccgactgcggtctgtgcc

SEQ ID NO: 12915 - DNA, 25 bp, Homo sapien
tgccttctcagccttgccaaagcca

SEQ ID NO: 12916 - DNA, 25 bp, Homo sapien
cacacaggaccatgaaggtgcttct

SEQ ID NO: 12917 - DNA, 25 bp, Homo sapien
cctgttcttcgcctattattgggat

SEQ ID NO: 12918 - DNA, 25 bp, Homo sapien
cttcgcctattattgggatgacaac

SEQ ID NO: 12919 - DNA, 25 bp, Homo sapien
gggatgacaacttcgacccagccag

SEQ ID NO: 12920 - DNA, 25 bp, Homo sapien
gggagcgcgagtgctgctgacaggg

SEQ ID NO: 12921 - DNA, 25 bp, Homo sapien
tggtgaggagctggcctatcactac

SEQ ID NO: 12922 - DNA, 25 bp, Homo sapien
tggcctatcactacgcgcgtctggg

SEQ ID NO: 12923 - DNA, 25 bp, Homo sapien
cacactgaggctctcctgcagaagg

SEQ ID NO: 12924 - DNA, 25 bp, Homo sapien
tctcctgcagaaggcacggtggctc

SEQ ID NO: 12925 - DNA, 25 bp, Homo sapien
aactgaggcctgagcgggcccacac

SEQ ID NO: 12926 - DNA, 25 bp, Homo sapien
gagcgggcccacacaggaccatgaa

SEQ ID NO: 12927 - DNA, 25 bp, Homo sapien
aagttattcactttcgcaagaacag

SEQ ID NO: 12928 - DNA, 25 bp, Homo sapien
cactttcgcaagaacagctcaggaa

SEQ ID NO: 12929 - DNA, 25 bp, Homo sapien
tccctcccatgacagataggaatta

SEQ ID NO: 12930 - DNA, 25 bp, Homo sapien
aactaaatcatatcaggtccttact

SEQ ID NO: 12931 - DNA, 25 bp, Homo sapien
ggtccttactaaaattccatactgc

SEQ ID NO: 12932 - DNA, 25 bp, Homo sapien
aaattccatactgcctatgaaactt

SEQ ID NO: 12933 - DNA, 25 bp, Homo sapien
gcctatgaaactttatgatttactg

SEQ ID NO: 12934 - DNA, 25 bp, Homo sapien
aactatctctgaactctaagctctc

SEQ ID NO: 12935 - DNA, 25 bp, Homo sapien
tgaactctaagctctccctggactc

SEQ ID NO: 12936 - DNA, 25 bp, Homo sapien
ccaagctctacaagcataagaatta

SEQ ID NO: 12937 - DNA, 25 bp, Homo sapien
tagctgagcgtagtagcgctcgcct

SEQ ID NO: 12938 - DNA, 25 bp, Homo sapien
aggctacggtcttgcaggtcagcca

SEQ ID NO: 12939 - DNA, 25 bp, Homo sapien
accacctggctttgtggtctgttat

SEQ ID NO: 12940 - DNA, 25 bp, Homo sapien
tttgtggtctgttatgcccggccta

SEQ ID NO: 12941 - DNA, 25 bp, Homo sapien
tatgcccggcctagtgtccagggtg

SEQ ID NO: 12942 - DNA, 25 bp, Homo sapien
gtccagggtggtgacatttatttga

SEQ ID NO: 12943 - DNA, 25 bp, Homo sapien
ttgaacaaagaccagtctccaccac

SEQ ID NO: 12944 - DNA, 25 bp, Homo sapien
agtctccaccaccaaagtcatggct

SEQ ID NO: 12945 - DNA, 25 bp, Homo sapien
aaagtcatggctctgctgttgcttc

SEQ ID NO: 12946 - DNA, 25 bp, Homo sapien
ttccagaaccaaagaaaggctggct

SEQ ID NO: 12947 - DNA, 25 bp, Homo sapien
gtgcaccctcagcatgggacacgga

SEQ ID NO: 12948 - DNA, 25 bp, Homo sapien
gcagctctgaggctacggtcttgca

SEQ ID NO: 12949 - DNA, 25 bp, Homo sapien
atgaggttttcaatggtgagtgttt

SEQ ID NO: 12950 - DNA, 25 bp, Homo sapien
tataacactaggcttgatatatcaa

SEQ ID NO: 12951 - DNA, 25 bp, Homo sapien
ttgatatatcaagccctctttttaa

SEQ ID NO: 12952 - DNA, 25 bp, Homo sapien
aataagctaaggacagtatgcagaa

SEQ ID NO: 12953 - DNA, 25 bp, Homo sapien
agtatgcagaaaaatctgtgttttc

SEQ ID NO: 12954 - DNA, 25 bp, Homo sapien
gttttctgaattacaatgacaatat

SEQ ID NO: 12955 - DNA, 25 bp, Homo sapien
aatgacaatatgttagtctggattt

SEQ ID NO: 12956 - DNA, 25 bp, Homo sapien
gtctggattttgtaatggctagaat

SEQ ID NO: 12957 - DNA, 25 bp, Homo sapien
aattttattcatatcactgactaga

SEQ ID NO: 12958 - DNA, 25 bp, Homo sapien
gactagaatatatcctcattctggg

SEQ ID NO: 12959 - DNA, 25 bp, Homo sapien
cctcattctgggaaaggagagtctt

SEQ ID NO: 12960 - DNA, 25 bp, Homo sapien
taggaccccggactgattgattttc

SEQ ID NO: 12961 - DNA, 25 bp, Homo sapien
gaccccggactgattgattttcaca

SEQ ID NO: 12962 - DNA, 25 bp, Homo sapien
gactgattgattttcacatagaacg

SEQ ID NO: 12963 - DNA, 25 bp, Homo sapien
gaacgaaatttcacacgtccgtctg

SEQ ID NO: 12964 - DNA, 25 bp, Homo sapien
aaatttcacacgtccgtctgttgtt

SEQ ID NO: 12965 - DNA, 25 bp, Homo sapien
acgtccgtctgttgttctctttctg

SEQ ID NO: 12966 - DNA, 25 bp, Homo sapien
tgttgttctctttctgcctcgctgt

SEQ ID NO: 12967 - DNA, 25 bp, Homo sapien
tgcctattcttccttgcagcgcgag

SEQ ID NO: 12968 - DNA, 25 bp, Homo sapien
ttcttccttgcagcgcgagcctggt

SEQ ID NO: 12969 - DNA, 25 bp, Homo sapien
taaaacaggtattgtctcatcgaaa

SEQ ID NO: 12970 - DNA, 25 bp, Homo sapien
acaggtattgtctcatcgaaaataa

SEQ ID NO: 12971 - DNA, 25 bp, Homo sapien
ttttatcctaaattgtccagactta

SEQ ID NO: 12972 - DNA, 25 bp, Homo sapien
ttgtccagacttaacacctttggct

SEQ ID NO: 12973 - DNA, 25 bp, Homo sapien
ttggctttccagttgatatatctta

SEQ ID NO: 12974 - DNA, 25 bp, Homo sapien
aatgatcttcattactttcccacag

SEQ ID NO: 12975 - DNA, 25 bp, Homo sapien
gaaattcaacaacttgagttcctta

SEQ ID NO: 12976 - DNA, 25 bp, Homo sapien
tagaattttcaccattgcttttaat

SEQ ID NO: 12977 - DNA, 25 bp, Homo sapien
attactgttcttccaattgggttat

SEQ ID NO: 12978 - DNA, 25 bp, Homo sapien
tcttccaattgggttattttccttg

SEQ ID NO: 12979 - DNA, 25 bp, Homo sapien
gaacttgatgtttcctataatgaac

SEQ ID NO: 12980 - DNA, 25 bp, Homo sapien
atgaacttacttttattccaaatga

SEQ ID NO: 12981 - DNA, 25 bp, Homo sapien
aattatttctttgttcattgtccaa

SEQ ID NO: 12982 - DNA, 25 bp, Homo sapien
tttcagaaattgctcggcactaaaa

SEQ ID NO: 12983 - DNA, 25 bp, Homo sapien
ctcggcactaaaagagagctctggt

SEQ ID NO: 12984 - DNA, 25 bp, Homo sapien
gagctctggtattgaaagccatctc

SEQ ID NO: 12985 - DNA, 25 bp, Homo sapien
ggtattgaaagccatctctgatccg

SEQ ID NO: 12986 - DNA, 25 bp, Homo sapien
ttgaaagccatctctgatccgctct

SEQ ID NO: 12987 - DNA, 25 bp, Homo sapien
ctctgatccgctctccatgtggctt

SEQ ID NO: 12988 - DNA, 25 bp, Homo sapien
aacatagtgataaccctccatcact

SEQ ID NO: 12989 - DNA, 25 bp, Homo sapien
tgataaccctccatcactacaaaaa

SEQ ID NO: 12990 - DNA, 25 bp, Homo sapien
gttcaaggttgcatgaaggagttca

SEQ ID NO: 12991 - DNA, 25 bp, Homo sapien
gagttcaaggttgccatgatcacac

SEQ ID NO: 12992 - DNA, 25 bp, Homo sapien
ctgggctacaaagcaagatcctctc

SEQ ID NO: 12993 - DNA, 25 bp, Homo sapien
ggaggatggtcaggcgtcaccaaca

SEQ ID NO: 12994 - DNA, 25 bp, Homo sapien
ggatggtcaggcgtcaccaacaacc

SEQ ID NO: 12995 - DNA, 25 bp, Homo sapien
ccatcacccagtaacaagaaccttg

SEQ ID NO: 12996 - DNA, 25 bp, Homo sapien
cccagtaacaagaaccttgactctc

SEQ ID NO: 12997 - DNA, 25 bp, Homo sapien
tcagtccctctgcatcaagacactt

SEQ ID NO: 12998 - DNA, 25 bp, Homo sapien
tctgcatcaagacacttacccattt

SEQ ID NO: 12999 - DNA, 25 bp, Homo sapien
tgcatcaagacacttacccatttcc

SEQ ID NO: 13000 - DNA, 25 bp, Homo sapien
cacctcatgcctgctaacttgaatg

SEQ ID NO: 13001 - DNA, 25 bp, Homo sapien
aacttgaatgaaacaatcgctggga

SEQ ID NO: 13002 - DNA, 25 bp, Homo sapien
gaaacaatcgctgggaaagcattaa

SEQ ID NO: 13003 - DNA, 25 bp, Homo sapien
gcattaagagaattaaggctgggca

SEQ ID NO: 13004 - DNA, 25 bp, Homo sapien
gaagtgtacattagaaggaggattt

SEQ ID NO: 13005 - DNA, 25 bp, Homo sapien
ggaggatttgagagcccttccttaa

SEQ ID NO: 13006 - DNA, 25 bp, Homo sapien
atttgagagcccttccttaaatgga

SEQ ID NO: 13007 - DNA, 25 bp, Homo sapien
gagagcccttccttaaatggataag

SEQ ID NO: 13008 - DNA, 25 bp, Homo sapien
ctttgggagaaagccttagtggagt

SEQ ID NO: 13009 - DNA, 25 bp, Homo sapien
aaagccttagtggagtacttgacat

SEQ ID NO: 13010 - DNA, 25 bp, Homo sapien
tggagtacttgacattaaacacctt

SEQ ID NO: 13011 - DNA, 25 bp, Homo sapien
tttgcctactcaatttctcaagtgg

SEQ ID NO: 13012 - DNA, 25 bp, Homo sapien
tcaatttctcaagtgggctccattt

SEQ ID NO: 13013 - DNA, 25 bp, Homo sapien
tcaagtgggctccattttctaaatt

SEQ ID NO: 13014 - DNA, 25 bp, Homo sapien
gtgatctgtacatctcagctactca

SEQ ID NO: 13015 - DNA, 25 bp, Homo sapien
tggatgggtaatgacttagtatttc

SEQ ID NO: 13016 - DNA, 25 bp, Homo sapien
aatgttcatttctctcgagttattt

SEQ ID NO: 13017 - DNA, 25 bp, Homo sapien
ttcatttctctcgagttatttctgg

SEQ ID NO: 13018 - DNA, 25 bp, Homo sapien
agaggatagctctagtagtcccctt

SEQ ID NO: 13019 - DNA, 25 bp, Homo sapien
agctctagtagtccccttctctttt

SEQ ID NO: 13020 - DNA, 25 bp, Homo sapien
ttacctttgtcctaatgaaagtact

SEQ ID NO: 13021 - DNA, 25 bp, Homo sapien
agtacttagttatctctttgggcag

SEQ ID NO: 13022 - DNA, 25 bp, Homo sapien
cttagttatctctttgggcagatgc

SEQ ID NO: 13023 - DNA, 25 bp, Homo sapien
ttctctagctaaattaacatgtcat

SEQ ID NO: 13024 - DNA, 25 bp, Homo sapien
acatgtcatcattcacagttggaaa

SEQ ID NO: 13025 - DNA, 25 bp, Homo sapien
ggctgtgctttttcatttttagaga

SEQ ID NO: 13026 - DNA, 25 bp, Homo sapien
agccaggccaatctccgagcttttg

SEQ ID NO: 13027 - DNA, 25 bp, Homo sapien
caaaggcatctccacatggatcagt

SEQ ID NO: 13028 - DNA, 25 bp, Homo sapien
tctccacatggatcagtgcctctaa

SEQ ID NO: 13029 - DNA, 25 bp, Homo sapien
gatcagtgcctctaaacacatccta

SEQ ID NO: 13030 - DNA, 25 bp, Homo sapien
atcctacccaaaagttgatgcaatc

SEQ ID NO: 13031 - DNA, 25 bp, Homo sapien
aagttgatgcaatcacttctctccc

SEQ ID NO: 13032 - DNA, 25 bp, Homo sapien
tcccagctccattagcagaggttga

SEQ ID NO: 13033 - DNA, 25 bp, Homo sapien
ggttgaagtcctagtaagaattact

SEQ ID NO: 13034 - DNA, 25 bp, Homo sapien
tcatatgtggagatattaagtccta

SEQ ID NO: 13035 - DNA, 25 bp, Homo sapien
ttaagtcctagtaagttgaagtcct

SEQ ID NO: 13036 - DNA, 25 bp, Homo sapien
actcagtatattggccaggcaccgt

SEQ ID NO: 13037 - DNA, 25 bp, Homo sapien
gaagtagaaaatgccatgatgagaa

SEQ ID NO: 13038 - DNA, 25 bp, Homo sapien
tagtaccttagcacatggttgctga

SEQ ID NO: 13039 - DNA, 25 bp, Homo sapien
agcacatggttgctgaatacatgaa

SEQ ID NO: 13040 - DNA, 25 bp, Homo sapien
gagtgagaaaccagaagctctgata

SEQ ID NO: 13041 - DNA, 25 bp, Homo sapien
agctctgatatttaactgccgtgat

SEQ ID NO: 13042 - DNA, 25 bp, Homo sapien
atttaactgccgtgataatgaattc

SEQ ID NO: 13043 - DNA, 25 bp, Homo sapien
gaattcaatgtgcaactatgggcaa

SEQ ID NO: 13044 - DNA, 25 bp, Homo sapien
gataaacttttcaacttatactgac

SEQ ID NO: 13045 - DNA, 25 bp, Homo sapien
actaggctattaacatgatattttg

SEQ ID NO: 13046 - DNA, 25 bp, Homo sapien
gatattttgtttcccattaaatgtg

SEQ ID NO: 13047 - DNA, 25 bp, Homo sapien
gtgacatgcaaagacgtttattaaa

SEQ ID NO: 13048 - DNA, 25 bp, Homo sapien
aggtaccccatcatacccagcttaa

SEQ ID NO: 13049 - DNA, 25 bp, Homo sapien
gattcccctgcgtgagcctccagag

SEQ ID NO: 13050 - DNA, 25 bp, Homo sapien
ttcccctgcgtgagcctccagagta

SEQ ID NO: 13051 - DNA, 25 bp, Homo sapien
taaaagttgtctatgtttatggtgc

SEQ ID NO: 13052 - DNA, 25 bp, Homo sapien
cattgccagtgagcaaacacttttt

SEQ ID NO: 13053 - DNA, 25 bp, Homo sapien
attgccagtgagcaaacacttttta

SEQ ID NO: 13054 - DNA, 25 bp, Homo sapien
tttgttatagaggtgaggacttgct

SEQ ID NO: 13055 - DNA, 25 bp, Homo sapien
ttgttatagaggtgaggacttgctc

SEQ ID NO: 13056 - DNA, 25 bp, Homo sapien
gttatagaggtgaggacttgctctg

SEQ ID NO: 13057 - DNA, 25 bp, Homo sapien
ttatagaggtgaggacttgctctgt

SEQ ID NO: 13058 - DNA, 25 bp, Homo sapien
tatagaggtgaggacttgctctgtt

SEQ ID NO: 13059 - DNA, 25 bp, Homo sapien
aaaactgagcaacataaaatctatg

SEQ ID NO: 13060 - DNA, 25 bp, Homo sapien
cattgtagtacttctttgagtctct

SEQ ID NO: 13061 - DNA, 25 bp, Homo sapien
ctttgagtctcttggcctaacagta

SEQ ID NO: 13062 - DNA, 25 bp, Homo sapien
gagtctcttggcctaacagtagtct

SEQ ID NO: 13063 - DNA, 25 bp, Homo sapien
gtctcttggcctaacagtagtctgg

SEQ ID NO: 13064 - DNA, 25 bp, Homo sapien
ttggcctaacagtagtctgggcaat

SEQ ID NO: 13065 - DNA, 25 bp, Homo sapien
taacagtagtctgggcaatgctact

SEQ ID NO: 13066 - DNA, 25 bp, Homo sapien
cagagatcgggtatcttcctgctct

SEQ ID NO: 13067 - DNA, 25 bp, Homo sapien
agatcgggtatcttcctgctctgcc

SEQ ID NO: 13068 - DNA, 25 bp, Homo sapien
tcctctcaggcctttcttttgtgtg

SEQ ID NO: 13069 - DNA, 25 bp, Homo sapien
agagagaatgaattagtggctaatc

SEQ ID NO: 13070 - DNA, 25 bp, Homo sapien
agacctttccacctgcatgttggat

SEQ ID NO: 13071 - DNA, 25 bp, Homo sapien
tgcatgttggatggccactggttgt

SEQ ID NO: 13072 - DNA, 25 bp, Homo sapien
ctggttgtgggctgctcctagaatg

SEQ ID NO: 13073 - DNA, 25 bp, Homo sapien
ggtgttgggcaaagcagctgtcttc

SEQ ID NO: 13074 - DNA, 25 bp, Homo sapien
ttcagcagaggcaattgttcattcc

SEQ ID NO: 13075 - DNA, 25 bp, Homo sapien
aagggaatccgaatgtggatcacaa

SEQ ID NO: 13076 - DNA, 25 bp, Homo sapien
cgaatgtggatcacaacatcccaga

SEQ ID NO: 13077 - DNA, 25 bp, Homo sapien
ggatcacaacatcccagaaacttcc

SEQ ID NO: 13078 - DNA, 25 bp, Homo sapien
gatgactgagatatataggtttgtt

SEQ ID NO: 13079 - DNA, 25 bp, Homo sapien
gactgagatatataggtttgttatt

SEQ ID NO: 13080 - DNA, 25 bp, Homo sapien
taaattttttgcattcacggccggg

SEQ ID NO: 13081 - DNA, 25 bp, Homo sapien
aactttatttggatcttcccacagc

SEQ ID NO: 13082 - DNA, 25 bp, Homo sapien
ttatttggatcttcccacagcccca

SEQ ID NO: 13083 - DNA, 25 bp, Homo sapien
agccccaagacgttcagtacacatt

SEQ ID NO: 13084 - DNA, 25 bp, Homo sapien
gacgttcagtacacattttatctcg

SEQ ID NO: 13085 - DNA, 25 bp, Homo sapien
agtacacattttatctcgtcctaga

SEQ ID NO: 13086 - DNA, 25 bp, Homo sapien
acattttatctcgtcctagatcacc

SEQ ID NO: 13087 - DNA, 25 bp, Homo sapien
tcgtcctagatcaccttctttttta

SEQ ID NO: 13088 - DNA, 25 bp, Homo sapien
gatcaccttcttttttagtatgtag

SEQ ID NO: 13089 - DNA, 25 bp, Homo sapien
gagactctttctcaacagaggtagg

SEQ ID NO: 13090 - DNA, 25 bp, Homo sapien
ggataagatttatcttaatcccaat

SEQ ID NO: 13091 - DNA, 25 bp, Homo sapien
taatcccaattaaacaatagtgaag

SEQ ID NO: 13092 - DNA, 25 bp, Homo sapien
actggcattagggatagatttgggc

SEQ ID NO: 13093 - DNA, 25 bp, Homo sapien
tgggcagttagcatggagatagttc

SEQ ID NO: 13094 - DNA, 25 bp, Homo sapien
gatctggtcaaacatgatgcaacta

SEQ ID NO: 13095 - DNA, 25 bp, Homo sapien
gcaactatcctgtgatggtgacttt

SEQ ID NO: 13096 - DNA, 25 bp, Homo sapien
ggtgacttttgggatcttagatgtt

SEQ ID NO: 13097 - DNA, 25 bp, Homo sapien
ttgctcttttgggatttcaacactg

SEQ ID NO: 13098 - DNA, 25 bp, Homo sapien
cactgaggattatggcgttcaaaat

SEQ ID NO: 13099 - DNA, 25 bp, Homo sapien
ggcgttcaaaattgtgtctcggtat

SEQ ID NO: 13100 - DNA, 25 bp, Homo sapien
gtgtctcggtattgtgatccaaact

SEQ ID NO: 13101 - DNA, 25 bp, Homo sapien
tgatccaaactgtaggtagaccttc

SEQ ID NO: 13102 - DNA, 25 bp, Homo sapien
cagtaagccgagagggagccaccac

SEQ ID NO: 13103 - DNA, 25 bp, Homo sapien
attagcctggcgtgatggtgaacgc

SEQ ID NO: 13104 - DNA, 25 bp, Homo sapien
ggtttccccagttcctcgaattgag

SEQ ID NO: 13105 - DNA, 25 bp, Homo sapien
tttccccagttcctcgaattgagag

SEQ ID NO: 13106 - DNA, 25 bp, Homo sapien
ccagttcctcgaattgagagggtat

SEQ ID NO: 13107 - DNA, 25 bp, Homo sapien
gggtattgagaatagcgccctaatg

SEQ ID NO: 13108 - DNA, 25 bp, Homo sapien
agaatagcgccctaatgccttccaa

SEQ ID NO: 13109 - DNA, 25 bp, Homo sapien
taatgccttccaacccttagatgtc

SEQ ID NO: 13110 - DNA, 25 bp, Homo sapien
gccttccaacccttagatgtcagct

SEQ ID NO: 13111 - DNA, 25 bp, Homo sapien
ttagatgtcagctcaccatggagtc

SEQ ID NO: 13112 - DNA, 25 bp, Homo sapien
gatgtcagctcaccatggagtctac

SEQ ID NO: 13113 - DNA, 25 bp, Homo sapien
atggagtctaccttctgatccacct

SEQ ID NO: 13114 - DNA, 25 bp, Homo sapien
gattcatagactttcaaatgatcct

SEQ ID NO: 13115 - DNA, 25 bp, Homo sapien
aatgatcctacttgtaactgtttag

SEQ ID NO: 13116 - DNA, 25 bp, Homo sapien
gaaactgtactcctctagcaagaaa

SEQ ID NO: 13117 - DNA, 25 bp, Homo sapien
tcctctagcaagaaagaaccttttg

SEQ ID NO: 13118 - DNA, 25 bp, Homo sapien
gaaaaggcttgttggacgatttgat

SEQ ID NO: 13119 - DNA, 25 bp, Homo sapien
ggacgatttgatttagctagctgct

SEQ ID NO: 13120 - DNA, 25 bp, Homo sapien
gatttagctagctgctttgtttgtt

SEQ ID NO: 13121 - DNA, 25 bp, Homo sapien
aggcaagagtttatattcacatatt

SEQ ID NO: 13122 - DNA, 25 bp, Homo sapien
gaaaaccacgtacggcctgtttgat

SEQ ID NO: 13123 - DNA, 25 bp, Homo sapien
gtacggcctgtttgatacatttctc

SEQ ID NO: 13124 - DNA, 25 bp, Homo sapien
tacatttctcagaaatcctcatttt

SEQ ID NO: 13125 - DNA, 25 bp, Homo sapien
gtgggactgttctagggcaatgtct

SEQ ID NO: 13126 - DNA, 25 bp, Homo sapien
tctagggcaatgtcttggagagatt

SEQ ID NO: 13127 - DNA, 25 bp, Homo sapien
gagagattgagaagtcctgcaagaa

SEQ ID NO: 13128 - DNA, 25 bp, Homo sapien
gagaagactgacacctgattcctca

SEQ ID NO: 13129 - DNA, 25 bp, Homo sapien
gactgacacctgattcctcaaatga

SEQ ID NO: 13130 - DNA, 25 bp, Homo sapien
gaatacttctttaattgcaggtgca

SEQ ID NO: 13131 - DNA, 25 bp, Homo sapien
gcaggtgcattttggcattgtccct

SEQ ID NO: 13132 - DNA, 25 bp, Homo sapien
ttttggcattgtcccttgagaaaga

SEQ ID NO: 13133 - DNA, 25 bp, Homo sapien
gatgatggctacatttctggagctt

SEQ ID NO: 13134 - DNA, 25 bp, Homo sapien
ttctggagatggaagtcttgctaat

SEQ ID NO: 13135 - DNA, 25 bp, Homo sapien
gtcttgctaatagaaagtcttgcta

SEQ ID NO: 13136 - DNA, 25 bp, Homo sapien
gaggctacaaggagtccaacgttct

SEQ ID NO: 13137 - DNA, 25 bp, Homo sapien
ggagtccaacgttctgagtcaagtc

SEQ ID NO: 13138 - DNA, 25 bp, Homo sapien
caacgttctgagtcaagtctgtgct

SEQ ID NO: 13139 - DNA, 25 bp, Homo sapien
tgagtcaagtctgtgctctgtcact

SEQ ID NO: 13140 - DNA, 25 bp, Homo sapien
caagtctgtgctctgtcacttactg

SEQ ID NO: 13141 - DNA, 25 bp, Homo sapien
cacttactggctggtaaccataagc

SEQ ID NO: 13142 - DNA, 25 bp, Homo sapien
ggctggtaaccataagcacatagct

SEQ ID NO: 13143 - DNA, 25 bp, Homo sapien
taagcacatagctcaaattcctgta

SEQ ID NO: 13144 - DNA, 25 bp, Homo sapien
atagctcaaattcctgtaacctcct

SEQ ID NO: 13145 - DNA, 25 bp, Homo sapien
gggattaataattgtcaggcctctg

SEQ ID NO: 13146 - DNA, 25 bp, Homo sapien
gtcactacacacttgaagaggctac

SEQ ID NO: 13147 - DNA, 25 bp, Homo sapien
tggcgcatgcctggaatctgagcaa

SEQ ID NO: 13148 - DNA, 25 bp, Homo sapien
catgcctggaatctgagcaactcag

SEQ ID NO: 13149 - DNA, 25 bp, Homo sapien
cacttgagcatggaagtcagaggct

SEQ ID NO: 13150 - DNA, 25 bp, Homo sapien
gccatgagccgacagcacaccagtg

SEQ ID NO: 13151 - DNA, 25 bp, Homo sapien
aaacaaacaccaacttaacatagat

SEQ ID NO: 13152 - DNA, 25 bp, Homo sapien
aaatttatttgctcatggtaccatg

SEQ ID NO: 13153 - DNA, 25 bp, Homo sapien
aggtggctaggtctttaactctgaa

SEQ ID NO: 13154 - DNA, 25 bp, Homo sapien
ggtctttaactctgaactcgatctg

SEQ ID NO: 13155 - DNA, 25 bp, Homo sapien
aactctgaactcgatctgctttaaa

SEQ ID NO: 13156 - DNA, 25 bp, Homo sapien
aattgttaatagcagttgggcacgc

SEQ ID NO: 13157 - DNA, 25 bp, Homo sapien
tagcagttgggcacgctggctcacg

SEQ ID NO: 13158 - DNA, 25 bp, Homo sapien
gaaagacattgtgctgctgatccca

SEQ ID NO: 13159 - DNA, 25 bp, Homo sapien
agacattgtgctgctgatcccacct

SEQ ID NO: 13160 - DNA, 25 bp, Homo sapien
attgtgctgctgatcccacctcctg

SEQ ID NO: 13161 - DNA, 25 bp, Homo sapien
aaatgagagcggtgccgcccatctg

SEQ ID NO: 13162 - DNA, 25 bp, Homo sapien
ggtgccgcccatctgtcaaggtagc

SEQ ID NO: 13163 - DNA, 25 bp, Homo sapien
gcccatctgtcaaggtagcccaggg

SEQ ID NO: 13164 - DNA, 25 bp, Homo sapien
atctgtcaaggtagcccagggcctg

SEQ ID NO: 13165 - DNA, 25 bp, Homo sapien
gcacctcctttctgtaggcgtagga

SEQ ID NO: 13166 - DNA, 25 bp, Homo sapien
ctttctgtaggcgtaggaccctgag

SEQ ID NO: 13167 - DNA, 25 bp, Homo sapien
tgtaggcgtaggaccctgagacctg

SEQ ID NO: 13168 - DNA, 25 bp, Homo sapien
taggaccctgagacctgtcccagct

SEQ ID NO: 13169 - DNA, 25 bp, Homo sapien
atgaattgttgagaatcaccaaata

SEQ ID NO: 13170 - DNA, 25 bp, Homo sapien
gttgagaatcaccaaatatttgagt

SEQ ID NO: 13171 - DNA, 25 bp, Homo sapien
aagcaagcaaattaaaagcactgag

SEQ ID NO: 13172 - DNA, 25 bp, Homo sapien
acacattatgtatacagcagaagta

SEQ ID NO: 13173 - DNA, 25 bp, Homo sapien
gtatacagcagaagtaaatctttaa

SEQ ID NO: 13174 - DNA, 25 bp, Homo sapien
gaaataaactaatattgcttccata

SEQ ID NO: 13175 - DNA, 25 bp, Homo sapien
aactaatattgcttccataattcag

SEQ ID NO: 13176 - DNA, 25 bp, Homo sapien
taatattgcttccataattcagaga

SEQ ID NO: 13177 - DNA, 25 bp, Homo sapien
tattgcttccataattcagagaatg

SEQ ID NO: 13178 - DNA, 25 bp, Homo sapien
tgcttccataattcagagaatgtgg

SEQ ID NO: 13179 - DNA, 25 bp, Homo sapien
gataaaagtaaagaattaggccaga

SEQ ID NO: 13180 - DNA, 25 bp, Homo sapien
gtgggcctgggtgctcagatggttg

SEQ ID NO: 13181 - DNA, 25 bp, Homo sapien
gctcagatggttgctggacgcaccg

SEQ ID NO: 13182 - DNA, 25 bp, Homo sapien
cagatggttgctggacgcaccgctg

SEQ ID NO: 13183 - DNA, 25 bp, Homo sapien
gcaccgctgggtgtgttgtgcagaa

SEQ ID NO: 13184 - DNA, 25 bp, Homo sapien
tgtgttgtgcagaaattcaaatcgg

SEQ ID NO: 13185 - DNA, 25 bp, Homo sapien
caggctgcaaaaaggtgagttaatg

SEQ ID NO: 13186 - DNA, 25 bp, Homo sapien
gtgtgcaagagggtctgacagcatc

SEQ ID NO: 13187 - DNA, 25 bp, Homo sapien
aagagggtctgacagcatcaccatg

SEQ ID NO: 13188 - DNA, 25 bp, Homo sapien
gcatcaccatgcatccacttaaagt

SEQ ID NO: 13189 - DNA, 25 bp, Homo sapien
atcaccatgcatccacttaaagtgg

SEQ ID NO: 13190 - DNA, 25 bp, Homo sapien
taaagtgggcaagaatgctctttga

SEQ ID NO: 13191 - DNA, 25 bp, Homo sapien
gacacttcagagtcccggccttggg

SEQ ID NO: 13192 - DNA, 25 bp, Homo sapien
agagtcccggccttgggctacctgg

SEQ ID NO: 13193 - DNA, 25 bp, Homo sapien
ttgggctacctggacgtgcgcatcg

SEQ ID NO: 13194 - DNA, 25 bp, Homo sapien
gctacctggacgtgcgcatcgtgga

SEQ ID NO: 13195 - DNA, 25 bp, Homo sapien
tggacgtgcgcatcgtggacacaga

SEQ ID NO: 13196 - DNA, 25 bp, Homo sapien
gtgcgcatcgtggacacagactaca

SEQ ID NO: 13197 - DNA, 25 bp, Homo sapien
atcgtggacacagactacagctcct

SEQ ID NO: 13198 - DNA, 25 bp, Homo sapien
tggacacagactacagctccttcgc

SEQ ID NO: 13199 - DNA, 25 bp, Homo sapien
ttcgccgtcctttacatctacaagg

SEQ ID NO: 13200 - DNA, 25 bp, Homo sapien
gtcctttacatctacaaggagctgg

SEQ ID NO: 13201 - DNA, 25 bp, Homo sapien
gacccaggatgtgagtccccaggct

SEQ ID NO: 13202 - DNA, 25 bp, Homo sapien
gagtagtgaggtattttaccttctt

SEQ ID NO: 13203 - DNA, 25 bp, Homo sapien
tgtgtgtttcactgacagcccgcct

SEQ ID NO: 13204 - DNA, 25 bp, Homo sapien
gtgtttcactgacagcccgcctcag

SEQ ID NO: 13205 - DNA, 25 bp, Homo sapien
agctgggaccctccacgttcaggag

SEQ ID NO: 13206 - DNA, 25 bp, Homo sapien
tgggaccctccacgttcaggagcct

SEQ ID NO: 13207 - DNA, 25 bp, Homo sapien
ctggcggctacctcactggacggca

SEQ ID NO: 13208 - DNA, 25 bp, Homo sapien
gcggctacctcactggacggcacat

SEQ ID NO: 13209 - DNA, 25 bp, Homo sapien
tcactggacggcacatcccggaggt

SEQ ID NO: 13210 - DNA, 25 bp, Homo sapien
ggaggtcgggccactcatggtctct

SEQ ID NO: 13211 - DNA, 25 bp, Homo sapien
gtcgggccactcatggtctctgtgt

SEQ ID NO: 13212 - DNA, 25 bp, Homo sapien
ggccactcatggtctctgtgtttct

SEQ ID NO: 13213 - DNA, 25 bp, Homo sapien
tcatggctgacaacccatcttggga

SEQ ID NO: 13214 - DNA, 25 bp, Homo sapien
attatcatcacatgcagcttcacgc

SEQ ID NO: 13215 - DNA, 25 bp, Homo sapien
gaatggggccgccagaacacagaca

SEQ ID NO: 13216 - DNA, 25 bp, Homo sapien
agtcctcgtggaactacaacttcat

SEQ ID NO: 13217 - DNA, 25 bp, Homo sapien
tcatgggtgttcggcatgaccccaa

SEQ ID NO: 13218 - DNA, 25 bp, Homo sapien
ctacagctggcgaaccccaaagagt

SEQ ID NO: 13219 - DNA, 25 bp, Homo sapien
agagttctaccacgaggtgcacagg

SEQ ID NO: 13220 - DNA, 25 bp, Homo sapien
tcaactttgctctcctgcaggaggg

SEQ ID NO: 13221 - DNA, 25 bp, Homo sapien
gagggggaggtttactctgcggatc

SEQ ID NO: 13222 - DNA, 25 bp, Homo sapien
gatcgggaggacctgtatgcctgac

SEQ ID NO: 13223 - DNA, 25 bp, Homo sapien
gacaggccgctgacattcagcagtt

SEQ ID NO: 13224 - DNA, 25 bp, Homo sapien
ttgtgccaaggaagtagctgcccca

SEQ ID NO: 13225 - DNA, 25 bp, Homo sapien
ccttctccgcgtcattgttggaaga

SEQ ID NO: 13226 - DNA, 25 bp, Homo sapien
aggagagatgcatcgagcagtccca

SEQ ID NO: 13227 - DNA, 25 bp, Homo sapien
gctgcttttcatttattacttcttc

SEQ ID NO: 13228 - DNA, 25 bp, Homo sapien
cttcttctttccaggacctgacaga

SEQ ID NO: 13229 - DNA, 25 bp, Homo sapien
ttatgtccaaacttagcacctgcaa

SEQ ID NO: 13230 - DNA, 25 bp, Homo sapien
tgtgcgtctgcgagcgcacacacat

SEQ ID NO: 13231 - DNA, 25 bp, Homo sapien
aggagttgcggttgctccatgttct

SEQ ID NO: 13232 - DNA, 25 bp, Homo sapien
gctccatgttctgacttagggcaat

SEQ ID NO: 13233 - DNA, 25 bp, Homo sapien
ctgcacttggggtctgtctgtacag

SEQ ID NO: 13234 - DNA, 25 bp, Homo sapien
gtctgtacagttactcatgtcattg

SEQ ID NO: 13235 - DNA, 25 bp, Homo sapien
gatagagactgaacagtccagtctt

SEQ ID NO: 13236 - DNA, 25 bp, Homo sapien
agtccagtcttaaaatgtatagcaa

SEQ ID NO: 13237 - DNA, 25 bp, Homo sapien
gtttgaatgctcttgttacagtgat

SEQ ID NO: 13238 - DNA, 25 bp, Homo sapien
gattttgtcatctaccaattttaag

SEQ ID NO: 13239 - DNA, 25 bp, Homo sapien
tgtcatctaccaattttaagtgtgt

SEQ ID NO: 13240 - DNA, 25 bp, Homo sapien
acattatttggcaatactttctgaa

SEQ ID NO: 13241 - DNA, 25 bp, Homo sapien
aaattaaaagtaaagccaggcgcag

SEQ ID NO: 13242 - DNA, 25 bp, Homo sapien
gctacacaaaaccaccaggatccta

SEQ ID NO: 13243 - DNA, 25 bp, Homo sapien
caccaggatcctagaagagtcacta

SEQ ID NO: 13244 - DNA, 25 bp, Homo sapien
gagtcactaggaaacgtagagtatt

SEQ ID NO: 13245 - DNA, 25 bp, Homo sapien
tatagctagataaacatcatcacat

SEQ ID NO: 13246 - DNA, 25 bp, Homo sapien
tattagataaaatggacctcactgc

SEQ ID NO: 13247 - DNA, 25 bp, Homo sapien
aatggacctcactgcaatgatactg

SEQ ID NO: 13248 - DNA, 25 bp, Homo sapien
aaccaggtggatatgtcataaatgt

SEQ ID NO: 13249 - DNA, 25 bp, Homo sapien
aaatgtctgcattacttttccatct

SEQ ID NO: 13250 - DNA, 25 bp, Homo sapien
tgtctgcattacttttccatctgtc

SEQ ID NO: 13251 - DNA, 25 bp, Homo sapien
ggtacctacaaatatatatgctgtt

SEQ ID NO: 13252 - DNA, 25 bp, Homo sapien
ttaaagaaggactaagggctaatga

SEQ ID NO: 13253 - DNA, 25 bp, Homo sapien
aaaaaatgccttatgataatcttga

SEQ ID NO: 13254 - DNA, 25 bp, Homo sapien
aattgagttatgtatcatcttgttt

SEQ ID NO: 13255 - DNA, 25 bp, Homo sapien
gtatcatcttgtttatattgggcta

SEQ ID NO: 13256 - DNA, 25 bp, Homo sapien
cttgtttatattgggctaagtctct

SEQ ID NO: 13257 - DNA, 25 bp, Homo sapien
gttccaatcttcgtgttcactttaa

SEQ ID NO: 13258 - DNA, 25 bp, Homo sapien
agaacactcgtgaaactgctcaggc

SEQ ID NO: 13259 - DNA, 25 bp, Homo sapien
actgctcaggccatcaagggtatgc

SEQ ID NO: 13260 - DNA, 25 bp, Homo sapien
aacagtgtgtaccattccgacgtta

SEQ ID NO: 13261 - DNA, 25 bp, Homo sapien
tggtggagttggcaggtgtgcgcag

SEQ ID NO: 13262 - DNA, 25 bp, Homo sapien
gtgtgcgcaggccaagcaatggggc

SEQ ID NO: 13263 - DNA, 25 bp, Homo sapien
tggacacaaggtcggtggcccaaaa

SEQ ID NO: 13264 - DNA, 25 bp, Homo sapien
gtcggtggcccaaaaagagtgctga

SEQ ID NO: 13265 - DNA, 25 bp, Homo sapien
gctgaatttttgctgcacatgctta

SEQ ID NO: 13266 - DNA, 25 bp, Homo sapien
ttagatgtagattctctggtcattg

SEQ ID NO: 13267 - DNA, 25 bp, Homo sapien
ggtcattgagcatatccaagtgaac

SEQ ID NO: 13268 - DNA, 25 bp, Homo sapien
gccgcctaaggacgacaagaagaag

SEQ ID NO: 13269 - DNA, 25 bp, Homo sapien
gacgctggaaagtcggccaagaaag

SEQ ID NO: 13270 - DNA, 25 bp, Homo sapien
gtgaacaaatccgggggcaaggcca

SEQ ID NO: 13271 - DNA, 25 bp, Homo sapien
aaggcaaagttcgggacaagctcaa

SEQ ID NO: 13272 - DNA, 25 bp, Homo sapien
gggacaagctcaataacttagtctt

SEQ ID NO: 13273 - DNA, 25 bp, Homo sapien
tagtcttgtttgacaaagctaccta

SEQ ID NO: 13274 - DNA, 25 bp, Homo sapien
caaagctacctatgataaactctgt

SEQ ID NO: 13275 - DNA, 25 bp, Homo sapien
actctgtaaggaagttcccaactat

SEQ ID NO: 13276 - DNA, 25 bp, Homo sapien
ctataaacttataaccccagctgtg

SEQ ID NO: 13277 - DNA, 25 bp, Homo sapien
aactggtttcaaagcacagagctca

SEQ ID NO: 13278 - DNA, 25 bp, Homo sapien
gcatgaataggtccaaccagctgta

SEQ ID NO: 13279 - DNA, 25 bp, Homo sapien
gcattggcagttaccacattctgtt

SEQ ID NO: 13280 - DNA, 25 bp, Homo sapien
gggataccgacacagacaacttgag

SEQ ID NO: 13281 - DNA, 25 bp, Homo sapien
tcagtgtagctatgtgctgctgctg

SEQ ID NO: 13282 - DNA, 25 bp, Homo sapien
ggatccatacaggttgtgtgtcatc

SEQ ID NO: 13283 - DNA, 25 bp, Homo sapien
gtgtcatctgtcctcttgaggttca

SEQ ID NO: 13284 - DNA, 25 bp, Homo sapien
tattccacggtttgggacagcatcc

SEQ ID NO: 13285 - DNA, 25 bp, Homo sapien
gacagcatccggaagttttccctat

SEQ ID NO: 13286 - DNA, 25 bp, Homo sapien
aattctaaccaaaccccagacatag

SEQ ID NO: 13287 - DNA, 25 bp, Homo sapien
ttttgtatctcaggcgtggcttctt

SEQ ID NO: 13288 - DNA, 25 bp, Homo sapien
gtattgacttgacagagcctctact

SEQ ID NO: 13289 - DNA, 25 bp, Homo sapien
tacttctgtctcaaaatggctccaa

SEQ ID NO: 13290 - DNA, 25 bp, Homo sapien
atcttttctaactctgcttagctgc

SEQ ID NO: 13291 - DNA, 25 bp, Homo sapien
agctgctaataatcctgaggcatag

SEQ ID NO: 13292 - DNA, 25 bp, Homo sapien
tagtgattcacagtatccctcttag

SEQ ID NO: 13293 - DNA, 25 bp, Homo sapien
agtatccctcttagcattaatttaa

SEQ ID NO: 13294 - DNA, 25 bp, Homo sapien
gaggcagattgattttccctctttc

SEQ ID NO: 13295 - DNA, 25 bp, Homo sapien
cccaccatgtccttagatctaatct

SEQ ID NO: 13296 - DNA, 25 bp, Homo sapien
tagatctaatctgtgctaccttatt

SEQ ID NO: 13297 - DNA, 25 bp, Homo sapien
gctaccttattaactcacagcaggc

SEQ ID NO: 13298 - DNA, 25 bp, Homo sapien
acagcaggcttactgaatggcttca

SEQ ID NO: 13299 - DNA, 25 bp, Homo sapien
cagatttagttgatttctccaccaa

SEQ ID NO: 13300 - DNA, 25 bp, Homo sapien
gcatgtcatgtattctcaataggct

SEQ ID NO: 13301 - DNA, 25 bp, Homo sapien
gctggcctgcaagcgtcgcgtgcag

SEQ ID NO: 13302 - DNA, 25 bp, Homo sapien
gcaagcgtcgcgtgcagccccggtt

SEQ ID NO: 13303 - DNA, 25 bp, Homo sapien
acctctcactagtagctatcctact

SEQ ID NO: 13304 - DNA, 25 bp, Homo sapien
ctctcactagtagctatcctacttt

SEQ ID NO: 13305 - DNA, 25 bp, Homo sapien
ctcactagtagctatcctactttta

SEQ ID NO: 13306 - DNA, 25 bp, Homo sapien
cactagtagctatcctacttttaaa

SEQ ID NO: 13307 - DNA, 25 bp, Homo sapien
tagtagctatcctacttttaaataa

SEQ ID NO: 13308 - DNA, 25 bp, Homo sapien
gagattgcaccacggtgcttcggcc

SEQ ID NO: 13309 - DNA, 25 bp, Homo sapien
gattgcaccacggtgcttcggcctg

SEQ ID NO: 13310 - DNA, 25 bp, Homo sapien
attgcaccacggtgcttcggcctgg

SEQ ID NO: 13311 - DNA, 25 bp, Homo sapien
caccacggtgcttcggcctgggcgg

SEQ ID NO: 13312 - DNA, 25 bp, Homo sapien
atttgtgtggcctagaagtcctctg

SEQ ID NO: 13313 - DNA, 25 bp, Homo sapien
gctgacctggcaaccattcaggcac

SEQ ID NO: 13314 - DNA, 25 bp, Homo sapien
aagacttgtttgttctgcttctctt

SEQ ID NO: 13315 - DNA, 25 bp, Homo sapien
taactgagctggccttatccttggc

SEQ ID NO: 13316 - DNA, 25 bp, Homo sapien
ttggcatccccctaaacaaacaaga

SEQ ID NO: 13317 - DNA, 25 bp, Homo sapien
ggtgaccaccttattgtgaggttcc

SEQ ID NO: 13318 - DNA, 25 bp, Homo sapien
ggttccatccagccaagtttatgtg

SEQ ID NO: 13319 - DNA, 25 bp, Homo sapien
tcagaagcctgcctctgatttaccc

SEQ ID NO: 13320 - DNA, 25 bp, Homo sapien
ctgatttaccctacagcttcaggcc

SEQ ID NO: 13321 - DNA, 25 bp, Homo sapien
gatttaatgctgactcactggtaca

SEQ ID NO: 13322 - DNA, 25 bp, Homo sapien
cctgcagcctcttgtctggttgagg

SEQ ID NO: 13323 - DNA, 25 bp, Homo sapien
atttccgtctgatctatgacaccaa

SEQ ID NO: 13324 - DNA, 25 bp, Homo sapien
tgacaccaagggtcgctttgctgta

SEQ ID NO: 13325 - DNA, 25 bp, Homo sapien
aatccctcatctggtgactcatgat

SEQ ID NO: 13326 - DNA, 25 bp, Homo sapien
cccgatcccctcatcaaggtgaatg

SEQ ID NO: 13327 - DNA, 25 bp, Homo sapien
atcaagttcgacactggtaacctgt

SEQ ID NO: 13328 - DNA, 25 bp, Homo sapien
agagaggcaccctggatcttttgac

SEQ ID NO: 13329 - DNA, 25 bp, Homo sapien
atggcaacagctttgccactcgact

SEQ ID NO: 13330 - DNA, 25 bp, Homo sapien
ccactcgactttccaacatttttgt

SEQ ID NO: 13331 - DNA, 25 bp, Homo sapien
ggcaacaaaccatggatttctcttc

SEQ ID NO: 13332 - DNA, 25 bp, Homo sapien
cgaggaaagggtatccgcctcacca

SEQ ID NO: 13333 - DNA, 25 bp, Homo sapien
tgggtccctgggtgacatgtcagat

SEQ ID NO: 13334 - DNA, 25 bp, Homo sapien
aagctgaagaatctgctcctccact

SEQ ID NO: 13335 - DNA, 25 bp, Homo sapien
agcaagtctacttaaccttttcaag

SEQ ID NO: 13336 - DNA, 25 bp, Homo sapien
tgaggaccaacttcatagcactgtt

SEQ ID NO: 13337 - DNA, 25 bp, Homo sapien
aagcatgtggcaatctgtccaacaa

SEQ ID NO: 13338 - DNA, 25 bp, Homo sapien
caacaaaactcatttcctcctgggt

SEQ ID NO: 13339 - DNA, 25 bp, Homo sapien
tgggtcacgtctacaccacatttcc

SEQ ID NO: 13340 - DNA, 25 bp, Homo sapien
atttcctggtctctctgtggctgag

SEQ ID NO: 13341 - DNA, 25 bp, Homo sapien
gagttataaccaacaccctatcagt

SEQ ID NO: 13342 - DNA, 25 bp, Homo sapien
aatgatgtgttcttctaggctggcc

SEQ ID NO: 13343 - DNA, 25 bp, Homo sapien
aggctggcctattaaaagcttccca

SEQ ID NO: 13344 - DNA, 25 bp, Homo sapien
taaaagcttcccacccggctgggtg

SEQ ID NO: 13345 - DNA, 25 bp, Homo sapien
cagatatctacgtctgcatgatctc

SEQ ID NO: 13346 - DNA, 25 bp, Homo sapien
tgatctcctttgcgcacaatgtagc

SEQ ID NO: 13347 - DNA, 25 bp, Homo sapien
gaccagctttggagctcttggaacc

SEQ ID NO: 13348 - DNA, 25 bp, Homo sapien
gttagcatcagtgacctcctggtac

SEQ ID NO: 13349 - DNA, 25 bp, Homo sapien
gatctttatttcccgcacatatgat

SEQ ID NO: 13350 - DNA, 25 bp, Homo sapien
atgatgccaccactcattttgagac

SEQ ID NO: 13351 - DNA, 25 bp, Homo sapien
gctcgctgtaagcagctcatctgtg

SEQ ID NO: 13352 - DNA, 25 bp, Homo sapien
tgtgaccccagctacgtaaaagatc

SEQ ID NO: 13353 - DNA, 25 bp, Homo sapien
agtgggccaggtgatcagagttatt

SEQ ID NO: 13354 - DNA, 25 bp, Homo sapien
cagagttatttgcatcctcagccac

SEQ ID NO: 13355 - DNA, 25 bp, Homo sapien
tattccacagaaccaagtcaatcga

SEQ ID NO: 13356 - DNA, 25 bp, Homo sapien
tcaaagaggtccacggttggccagg

SEQ ID NO: 13357 - DNA, 25 bp, Homo sapien
gagccagggcagcaaagcgagactc

SEQ ID NO: 13358 - DNA, 25 bp, Homo sapien
ctcttcaaagtaatggtctccaaat

SEQ ID NO: 13359 - DNA, 25 bp, Homo sapien
gtaatggtctccaaatcagtaacat

SEQ ID NO: 13360 - DNA, 25 bp, Homo sapien
ggtctccaaatcagtaacatcagca

SEQ ID NO: 13361 - DNA, 25 bp, Homo sapien
ccaaatcagtaacatcagcatcacc

SEQ ID NO: 13362 - DNA, 25 bp, Homo sapien
agcatcacctgacaatttactagaa

SEQ ID NO: 13363 - DNA, 25 bp, Homo sapien
tcacctgacaatttactagaaatgc

SEQ ID NO: 13364 - DNA, 25 bp, Homo sapien
tggtccccattctagacatagagaa

SEQ ID NO: 13365 - DNA, 25 bp, Homo sapien
tctgtagtctgtgttttaatattct

SEQ ID NO: 13366 - DNA, 25 bp, Homo sapien
ctgtgttttaatattctgcaagcaa

SEQ ID NO: 13367 - DNA, 25 bp, Homo sapien
ggaaccaagaagcgggtgctcaccc

SEQ ID NO: 13368 - DNA, 25 bp, Homo sapien
aagtccttgctggtgcagacgaagc

SEQ ID NO: 13369 - DNA, 25 bp, Homo sapien
ttaagttcattgacaccacctccaa

SEQ ID NO: 13370 - DNA, 25 bp, Homo sapien
caaaggggtcaccagtcgttggcac

SEQ ID NO: 13371 - DNA, 25 bp, Homo sapien
gcctgcgcaaggtggcctgtattgg

SEQ ID NO: 13372 - DNA, 25 bp, Homo sapien
tgtattggggcatggcatcctgctc

SEQ ID NO: 13373 - DNA, 25 bp, Homo sapien
taccatcaccgcactgagatcaaca

SEQ ID NO: 13374 - DNA, 25 bp, Homo sapien
gattggccagggctaccttatcaag

SEQ ID NO: 13375 - DNA, 25 bp, Homo sapien
gatcaagaacaatgcctccactgac

SEQ ID NO: 13376 - DNA, 25 bp, Homo sapien
ctccactgactatgacctatctgac

SEQ ID NO: 13377 - DNA, 25 bp, Homo sapien
tcaaccctctgggtggctttgtcca

SEQ ID NO: 13378 - DNA, 25 bp, Homo sapien
acttgtccacccggagttgagtcgg

SEQ ID NO: 13379 - DNA, 25 bp, Homo sapien
agtggcgagctggcagtacgggctc

SEQ ID NO: 13380 - DNA, 25 bp, Homo sapien
catcgacctctatgccatggtggtg

SEQ ID NO: 13381 - DNA, 25 bp, Homo sapien
ggttctctcgagggcctcaagatcc

SEQ ID NO: 13382 - DNA, 25 bp, Homo sapien
caagatccctgagtgagggccaccc

SEQ ID NO: 13383 - DNA, 25 bp, Homo sapien
tgacacctggtgtatcgaggctgca

SEQ ID NO: 13384 - DNA, 25 bp, Homo sapien
gctcggatccgagagggcatggccg

SEQ ID NO: 13385 - DNA, 25 bp, Homo sapien
taccgcaacttcaaaagcatctcca

SEQ ID NO: 13386 - DNA, 25 bp, Homo sapien
cagcaacccacttggcttctgaata

SEQ ID NO: 13387 - DNA, 25 bp, Homo sapien
cttccctcaagccaaagccgaagcc

SEQ ID NO: 13388 - DNA, 25 bp, Homo sapien
cactgtgcctgctctcaagagcact

SEQ ID NO: 13389 - DNA, 25 bp, Homo sapien
aaatggtcattgatgtccttcaccc

SEQ ID NO: 13390 - DNA, 25 bp, Homo sapien
tccttcaccccgggaaggcgacagt

SEQ ID NO: 13391 - DNA, 25 bp, Homo sapien
acaagaccacaccggatgtcatctt

SEQ ID NO: 13392 - DNA, 25 bp, Homo sapien
ttcagaactcattttggtggtggca

SEQ ID NO: 13393 - DNA, 25 bp, Homo sapien
ggtggcaagacaactggctttggca

SEQ ID NO: 13394 - DNA, 25 bp, Homo sapien
gcatgatttatgattccctggatta

SEQ ID NO: 13395 - DNA, 25 bp, Homo sapien
agatcgccatcatgaacgacaccgt

SEQ ID NO: 13396 - DNA, 25 bp, Homo sapien
gacttgcaagacatggcctgtatga

SEQ ID NO: 13397 - DNA, 25 bp, Homo sapien
tgaacgacaccgtaactatccgcac

SEQ ID NO: 13398 - DNA, 25 bp, Homo sapien
tggccactgtggatttttcgcaaga

SEQ ID NO: 13399 - DNA, 25 bp, Homo sapien
gaaagttcatgaccaaccgactact

SEQ ID NO: 13400 - DNA, 25 bp, Homo sapien
tcctagagaacctcccaggtgtgga

SEQ ID NO: 13401 - DNA, 25 bp, Homo sapien
ctagagaacctcccaggtgtggatc

SEQ ID NO: 13402 - DNA, 25 bp, Homo sapien
cccaggtgtggatcccaacaatgaa

SEQ ID NO: 13403 - DNA, 25 bp, Homo sapien
ggtgtggatcccaacaatgaagcca

SEQ ID NO: 13404 - DNA, 25 bp, Homo sapien
ggatcccaacaatgaagccattcga

SEQ ID NO: 13405 - DNA, 25 bp, Homo sapien
cattcgaaatgctatgggctccctg

SEQ ID NO: 13406 - DNA, 25 bp, Homo sapien
aggccaccaaggacggcaagaagga

SEQ ID NO: 13407 - DNA, 25 bp, Homo sapien
ccaccaaggacggcaagaaggacaa

SEQ ID NO: 13408 - DNA, 25 bp, Homo sapien
gaagtgagactggagggaaagggta

SEQ ID NO: 13409 - DNA, 25 bp, Homo sapien
gggaaagggtagctgagtctgctta

SEQ ID NO: 13410 - DNA, 25 bp, Homo sapien
aaagggtagctgagtctgcttaggg

SEQ ID NO: 13411 - DNA, 25 bp, Homo sapien
atgcaaagaccatgcgccggaacac

SEQ ID NO: 13412 - DNA, 25 bp, Homo sapien
tcgccaggccaggaatcacaagctc

SEQ ID NO: 13413 - DNA, 25 bp, Homo sapien
cagcagcggcactacaagccaaatc

SEQ ID NO: 13414 - DNA, 25 bp, Homo sapien
gatgagaaggcggcggttgcaggca

SEQ ID NO: 13415 - DNA, 25 bp, Homo sapien
ggcggcggttgcaggcaagaagcct

SEQ ID NO: 13416 - DNA, 25 bp, Homo sapien
ggcaagaagcctgtggtaggtaaga

SEQ ID NO: 13417 - DNA, 25 bp, Homo sapien
agaaggctgctgttggtgttaagaa

SEQ ID NO: 13418 - DNA, 25 bp, Homo sapien
cctgctgcataaactcttaaatttg

SEQ ID NO: 13419 - DNA, 25 bp, Homo sapien
ggtcaaatcattttggacagcttct

SEQ ID NO: 13420 - DNA, 25 bp, Homo sapien
actacaatcttcccatgcacaagat

SEQ ID NO: 13421 - DNA, 25 bp, Homo sapien
gaatcttgaaaagcccagagatcca

SEQ ID NO: 13422 - DNA, 25 bp, Homo sapien
ctctggttttgaccttcaggaaaca

SEQ ID NO: 13423 - DNA, 25 bp, Homo sapien
agaacattcagaatcaggtcagctt

SEQ ID NO: 13424 - DNA, 25 bp, Homo sapien
ggtcagcttgtgggtgtggacctga

SEQ ID NO: 13425 - DNA, 25 bp, Homo sapien
gtggacctgaacacaggtgagccaa

SEQ ID NO: 13426 - DNA, 25 bp, Homo sapien
gtggcagcagaagtaggcgtatggg

SEQ ID NO: 13427 - DNA, 25 bp, Homo sapien
ttcttcactcctgcactgtgattgc

SEQ ID NO: 13428 - DNA, 25 bp, Homo sapien
tctgtatctgaatcttgaagactgc

SEQ ID NO: 13429 - DNA, 25 bp, Homo sapien
gcaaagtgatcctgaggattacagc

SEQ ID NO: 13430 - DNA, 25 bp, Homo sapien
acactggcatctgttgaaatttgga

SEQ ID NO: 13431 - DNA, 25 bp, Homo sapien
agtgtatacacataaagcaggtctt

SEQ ID NO: 13432 - DNA, 25 bp, Homo sapien
agcatatgttacttaccttgttatt

SEQ ID NO: 13433 - DNA, 25 bp, Homo sapien
atcaggttcccacgccgaccctaat

SEQ ID NO: 13434 - DNA, 25 bp, Homo sapien
tcaggttcccacgccgaccctaatg

SEQ ID NO: 13435 - DNA, 25 bp, Homo sapien
caggttcccacgccgaccctaatgc

SEQ ID NO: 13436 - DNA, 25 bp, Homo sapien
acgccgaccctaatgccacttgaag

SEQ ID NO: 13437 - DNA, 25 bp, Homo sapien
gaccctaatgccacttgaagcagcc

SEQ ID NO: 13438 - DNA, 25 bp, Homo sapien
aaagaagtgaatatgccctgcctca

SEQ ID NO: 13439 - DNA, 25 bp, Homo sapien
agaagtgaatatgccctgcctcacc

SEQ ID NO: 13440 - DNA, 25 bp, Homo sapien
gcctcaccttagctgatgacattct

SEQ ID NO: 13441 - DNA, 25 bp, Homo sapien
cctcaccttagctgatgacattcta

SEQ ID NO: 13442 - DNA, 25 bp, Homo sapien
ctcaccttagctgatgacattctac

SEQ ID NO: 13443 - DNA, 25 bp, Homo sapien
tcaccttagctgatgacattctacc

SEQ ID NO: 13444 - DNA, 25 bp, Homo sapien
tcctaccacccggtgaaaggtgaag

SEQ ID NO: 13445 - DNA, 25 bp, Homo sapien
gttctcaggaggtagctgccaagcg

SEQ ID NO: 13446 - DNA, 25 bp, Homo sapien
agtctgccggccttctgagcaagga

SEQ ID NO: 13447 - DNA, 25 bp, Homo sapien
gagaccctcaatccaagccatgtgg

SEQ ID NO: 13448 - DNA, 25 bp, Homo sapien
gaagatgcttcttggacctttggct

SEQ ID NO: 13449 - DNA, 25 bp, Homo sapien
gacctttggctgtaagagaaatgtc

SEQ ID NO: 13450 - DNA, 25 bp, Homo sapien
agaaatgtcactgccgtgtcagaac

SEQ ID NO: 13451 - DNA, 25 bp, Homo sapien
ctgccgtgtcagaacatacagactt

SEQ ID NO: 13452 - DNA, 25 bp, Homo sapien
gacttaaagacacaacggttggcca

SEQ ID NO: 13453 - DNA, 25 bp, Homo sapien
aagacacaacggttggccaggcaca

SEQ ID NO: 13454 - DNA, 25 bp, Homo sapien
cagcctcggcaacggagacattgtc

SEQ ID NO: 13455 - DNA, 25 bp, Homo sapien
ttgaagtgagtcttgctgatttgca

SEQ ID NO: 13456 - DNA, 25 bp, Homo sapien
gagtcttgctgatttgcagaatgat

SEQ ID NO: 13457 - DNA, 25 bp, Homo sapien
tcaagctgattactgaagatgttca

SEQ ID NO: 13458 - DNA, 25 bp, Homo sapien
gtaaaaactgcctgactaacttcca

SEQ ID NO: 13459 - DNA, 25 bp, Homo sapien
aaactgcctgactaacttccatggc

SEQ ID NO: 13460 - DNA, 25 bp, Homo sapien
ggcagacaatgattgaagctcacgt

SEQ ID NO: 13461 - DNA, 25 bp, Homo sapien
ttgaagctcacgttgatgtcaagac

SEQ ID NO: 13462 - DNA, 25 bp, Homo sapien
tacggaagacctcttatgctcagca

SEQ ID NO: 13463 - DNA, 25 bp, Homo sapien
ggaaatcatgacccgagaggtgcag

SEQ ID NO: 13464 - DNA, 25 bp, Homo sapien
gacccgagaggtgcagacaaatgac

SEQ ID NO: 13465 - DNA, 25 bp, Homo sapien
gagaggtgcagacaaatgacttgaa

SEQ ID NO: 13466 - DNA, 25 bp, Homo sapien
tatgcccgtgtcaaccacaacaagt

SEQ ID NO: 13467 - DNA, 25 bp, Homo sapien
agtacatggtgactgaacgcgccac

SEQ ID NO: 13468 - DNA, 25 bp, Homo sapien
cctccaactggtctggcaactactt

SEQ ID NO: 13469 - DNA, 25 bp, Homo sapien
tctggcaactacttcacggagacgg

SEQ ID NO: 13470 - DNA, 25 bp, Homo sapien
cacctcgctgctggtgacgcagaat

SEQ ID NO: 13471 - DNA, 25 bp, Homo sapien
cattttcctgagggactgggactcc

SEQ ID NO: 13472 - DNA, 25 bp, Homo sapien
tccccttacattcatgaccttgaca

SEQ ID NO: 13473 - DNA, 25 bp, Homo sapien
gacacctcagctgacagcgtgggca

SEQ ID NO: 13474 - DNA, 25 bp, Homo sapien
ctctgaggcccgatccagtgggcag

SEQ ID NO: 13475 - DNA, 25 bp, Homo sapien
agggatcagcccccaaagaaatggg

SEQ ID NO: 13476 - DNA, 25 bp, Homo sapien
aagaaatgggggtgcatgctggcct

SEQ ID NO: 13477 - DNA, 25 bp, Homo sapien
agacctggtgctctaatgccaagtt

SEQ ID NO: 13478 - DNA, 25 bp, Homo sapien
gttatacacgggacagttgctggca

SEQ ID NO: 13479 - DNA, 25 bp, Homo sapien
acagttgctggcatgtcttcattgg

SEQ ID NO: 13480 - DNA, 25 bp, Homo sapien
gatggtgagcagtaactgtccctgc

SEQ ID NO: 13481 - DNA, 25 bp, Homo sapien
actgtccctgctttctggtataaag

SEQ ID NO: 13482 - DNA, 25 bp, Homo sapien
gtgaccatgtgaatctgggtgggat

SEQ ID NO: 13483 - DNA, 25 bp, Homo sapien
ggtgggataatggactcagctctgt

SEQ ID NO: 13484 - DNA, 25 bp, Homo sapien
tctgtctgctcaatgccattgtgca

SEQ ID NO: 13485 - DNA, 25 bp, Homo sapien
gcaccctaatgcataagctttttaa

SEQ ID NO: 13486 - DNA, 25 bp, Homo sapien
agtatgtaatttctgcacaggtctc

SEQ ID NO: 13487 - DNA, 25 bp, Homo sapien
ataccgatcaggaatcttgctccaa

SEQ ID NO: 13488 - DNA, 25 bp, Homo sapien
acttcgtactttctatgagaagcgt

SEQ ID NO: 13489 - DNA, 25 bp, Homo sapien
gagaagcgtatggccacagaagttg

SEQ ID NO: 13490 - DNA, 25 bp, Homo sapien
gcgtatggccacagaagttgctgct

SEQ ID NO: 13491 - DNA, 25 bp, Homo sapien
tgctgctgacgctctgggtgaagaa

SEQ ID NO: 13492 - DNA, 25 bp, Homo sapien
gaagggttatgtggtccgaatcagt

SEQ ID NO: 13493 - DNA, 25 bp, Homo sapien
ggtccgaatcagtggtgggaacgac

SEQ ID NO: 13494 - DNA, 25 bp, Homo sapien
aaacaaggtttccccatgaagcagg

SEQ ID NO: 13495 - DNA, 25 bp, Homo sapien
ggtttccccatgaagcagggtgtct

SEQ ID NO: 13496 - DNA, 25 bp, Homo sapien
aagcagggtgtcttgacccatggcc

SEQ ID NO: 13497 - DNA, 25 bp, Homo sapien
accaaagcacccaagattcagcgtc

SEQ ID NO: 13498 - DNA, 25 bp, Homo sapien
agcacccaagattcagcgtcttgtt

SEQ ID NO: 13499 - DNA, 25 bp, Homo sapien
agaatagagttgctgctgcagacac

SEQ ID NO: 13500 - DNA, 25 bp, Homo sapien
gcagacacatcagattccctactgg

SEQ ID NO: 13501 - DNA, 25 bp, Homo sapien
gacacatcagattccctactggtaa

SEQ ID NO: 13502 - DNA, 25 bp, Homo sapien
gattccctactggtaacagctggag

SEQ ID NO: 13503 - DNA, 25 bp, Homo sapien
actggtaacagctggagtgcgtcac

SEQ ID NO: 13504 - DNA, 25 bp, Homo sapien
aacagctggagtgcgtcacctctga

SEQ ID NO: 13505 - DNA, 25 bp, Homo sapien
ctggagtgcgtcacctctgacaaaa

SEQ ID NO: 13506 - DNA, 25 bp, Homo sapien
caaccagaggactttatcagctcag

SEQ ID NO: 13507 - DNA, 25 bp, Homo sapien
aggactttatcagctcagactccaa

SEQ ID NO: 13508 - DNA, 25 bp, Homo sapien
ccgggaacagtcagaatataaaaag

SEQ ID NO: 13509 - DNA, 25 bp, Homo sapien
ggaagccctgaccacagagacgcgt

SEQ ID NO: 13510 - DNA, 25 bp, Homo sapien
catcagtatggccgcctacgtgtca

SEQ ID NO: 13511 - DNA, 25 bp, Homo sapien
ccgcctacgtgtcaggggagctgga

SEQ ID NO: 13512 - DNA, 25 bp, Homo sapien
gcctacgtgtcaggggagctggagc

SEQ ID NO: 13513 - DNA, 25 bp, Homo sapien
gtgtcaggggagctggagcacgtga

SEQ ID NO: 13514 - DNA, 25 bp, Homo sapien
gcatggacaagggcttctgaggcca

SEQ ID NO: 13515 - DNA, 25 bp, Homo sapien
atggacaagggcttctgaggccagc

SEQ ID NO: 13516 - DNA, 25 bp, Homo sapien
tccggctggtgtcttgagaccagcc

SEQ ID NO: 13517 - DNA, 25 bp, Homo sapien
ggacagagtgccctggggcatccac

SEQ ID NO: 13518 - DNA, 25 bp, Homo sapien
tgctggcgcctaggttgtgttgaga

SEQ ID NO: 13519 - DNA, 25 bp, Homo sapien
ggcgcctaggttgtgttgagagggg

SEQ ID NO: 13520 - DNA, 25 bp, Homo sapien
aggttgtgttgagagggggatgccc

SEQ ID NO: 13521 - DNA, 25 bp, Homo sapien
gtggtggtggcgcagcagactgcga

SEQ ID NO: 13522 - DNA, 25 bp, Homo sapien
cgcagcagactgcgatcaattctgc

SEQ ID NO: 13523 - DNA, 25 bp, Homo sapien
tgcatggtcacagtagagatccccg

SEQ ID NO: 13524 - DNA, 25 bp, Homo sapien
cctgcattccatagccatgtgcttg

SEQ ID NO: 13525 - DNA, 25 bp, Homo sapien
tgcattccatagccatgtgcttgtc

SEQ ID NO: 13526 - DNA, 25 bp, Homo sapien
tgctcgctcagacactttggcagga

SEQ ID NO: 13527 - DNA, 25 bp, Homo sapien
cactttggcaggatgtctggggcct

SEQ ID NO: 13528 - DNA, 25 bp, Homo sapien
ccacctctgtgtgtgatgtagcttt

SEQ ID NO: 13529 - DNA, 25 bp, Homo sapien
gccatcgaaaaagacaacctctact

SEQ ID NO: 13530 - DNA, 25 bp, Homo sapien
gaacctcttactgctttcaatacac

SEQ ID NO: 13531 - DNA, 25 bp, Homo sapien
cttactgctttcaatacacgattag

SEQ ID NO: 13532 - DNA, 25 bp, Homo sapien
cagtgatgccaccagggagagcttc

SEQ ID NO: 13533 - DNA, 25 bp, Homo sapien
aagagccggggactgatgggttcag

SEQ ID NO: 13534 - DNA, 25 bp, Homo sapien
gactgatgggttcaggtgggagctg

SEQ ID NO: 13535 - DNA, 25 bp, Homo sapien
tgctgggtgaggcagggaacccttt

SEQ ID NO: 13536 - DNA, 25 bp, Homo sapien
tgaggcagggaacccttttcactcc

SEQ ID NO: 13537 - DNA, 25 bp, Homo sapien
ctcccattccttagctttagtctaa

SEQ ID NO: 13538 - DNA, 25 bp, Homo sapien
agctttagtctaatggagccaagga

SEQ ID NO: 13539 - DNA, 25 bp, Homo sapien
tctggccactgctttgtatcagggt

SEQ ID NO: 13540 - DNA, 25 bp, Homo sapien
gtatcagggtttttcacgcttttgt

SEQ ID NO: 13541 - DNA, 25 bp, Homo sapien
ggtttttcacgcttttgtagaactg

SEQ ID NO: 13542 - DNA, 25 bp, Homo sapien
cacgcttttgtagaactgaggtttc

SEQ ID NO: 13543 - DNA, 25 bp, Homo sapien
gttaggttggttagcgtgaacatca

SEQ ID NO: 13544 - DNA, 25 bp, Homo sapien
gaacatcaatatgtctcaccaatta

SEQ ID NO: 13545 - DNA, 25 bp, Homo sapien
tatgtctcaccaattaacatcatgg

SEQ ID NO: 13546 - DNA, 25 bp, Homo sapien
aattatccaagctaacaatgtatca

SEQ ID NO: 13547 - DNA, 25 bp, Homo sapien
gtatcaatagttacttatttggtct

SEQ ID NO: 13548 - DNA, 25 bp, Homo sapien
ttggtcttgcatggattttgtcttt

SEQ ID NO: 13549 - DNA, 25 bp, Homo sapien
gacaaggcttcaagcctagttctgt

SEQ ID NO: 13550 - DNA, 25 bp, Homo sapien
ctgtctcttaaagcagattttataa

SEQ ID NO: 13551 - DNA, 25 bp, Homo sapien
tatagttcggcttcaaagacttaga

SEQ ID NO: 13552 - DNA, 25 bp, Homo sapien
aagacttagaatcccatcactttat

SEQ ID NO: 13553 - DNA, 25 bp, Homo sapien
cttagaatcccatcactttatcttt

SEQ ID NO: 13554 - DNA, 25 bp, Homo sapien
tcactctggacccagggctgacatc

SEQ ID NO: 13555 - DNA, 25 bp, Homo sapien
ccgcatctgtgtgctggacgtggac

SEQ ID NO: 13556 - DNA, 25 bp, Homo sapien
ggacctgcagggtgtgcggaacatc

SEQ ID NO: 13557 - DNA, 25 bp, Homo sapien
gtgcggaacatcaaggccaccgatc

SEQ ID NO: 13558 - DNA, 25 bp, Homo sapien
gcggcagcgcaacactgaaaccgag

SEQ ID NO: 13559 - DNA, 25 bp, Homo sapien
tgcccaggccgacatggagagcagc

SEQ ID NO: 13560 - DNA, 25 bp, Homo sapien
gatgtggtcatcattaacgacagcc

SEQ ID NO: 13561 - DNA, 25 bp, Homo sapien
tcatcattaacgacagcctggacca

SEQ ID NO: 13562 - DNA, 25 bp, Homo sapien
gaaggaggcgctctctgaggaaatc

SEQ ID NO: 13563 - DNA, 25 bp, Homo sapien
aatcaagaaagctcaaaggaccggc

SEQ ID NO: 13564 - DNA, 25 bp, Homo sapien
cccttggccagcatgtggagtggag

SEQ ID NO: 13565 - DNA, 25 bp, Homo sapien
ggagttgtgggttggtaagctccca

SEQ ID NO: 13566 - DNA, 25 bp, Homo sapien
gtgggttggtaagctcccaggtact

SEQ ID NO: 13567 - DNA, 25 bp, Homo sapien
cgaggctatggtgtgagagcccccg

SEQ ID NO: 13568 - DNA, 25 bp, Homo sapien
ccctggcaaggccgatggctcagga

SEQ ID NO: 13569 - DNA, 25 bp, Homo sapien
aggccgatggctcaggatgatgggg

SEQ ID NO: 13570 - DNA, 25 bp, Homo sapien
gcctttgaacaatcatgcttcagaa

SEQ ID NO: 13571 - DNA, 25 bp, Homo sapien
acaatcatgcttcagaaatctgcct

SEQ ID NO: 13572 - DNA, 25 bp, Homo sapien
tggctttggtaggcatacttggaga

SEQ ID NO: 13573 - DNA, 25 bp, Homo sapien
tacttggagaacatatcccacatta

SEQ ID NO: 13574 - DNA, 25 bp, Homo sapien
cccacattaggaattgatttaagcc

SEQ ID NO: 13575 - DNA, 25 bp, Homo sapien
taatcctttaaaacttggagaagct

SEQ ID NO: 13576 - DNA, 25 bp, Homo sapien
agaggctttctcggtatcagcagtt

SEQ ID NO: 13577 - DNA, 25 bp, Homo sapien
gacgaattcttgtggctaccaacct

SEQ ID NO: 13578 - DNA, 25 bp, Homo sapien
gccgaggcatggacatcgagcgggt

SEQ ID NO: 13579 - DNA, 25 bp, Homo sapien
gacatgcctgaggattctgacacct

SEQ ID NO: 13580 - DNA, 25 bp, Homo sapien
aagggcttggctatcacatttgtgt

SEQ ID NO: 13581 - DNA, 25 bp, Homo sapien
gatgccaagatcctcaatgatgtgc

SEQ ID NO: 13582 - DNA, 25 bp, Homo sapien
atgtgcaggatcgctttgaggtcaa

SEQ ID NO: 13583 - DNA, 25 bp, Homo sapien
tagtgagctgcctgatgagatagac

SEQ ID NO: 13584 - DNA, 25 bp, Homo sapien
tgagatagacatctcctcctacatt

SEQ ID NO: 13585 - DNA, 25 bp, Homo sapien
tcctcctacattgaacagacacggt

SEQ ID NO: 13586 - DNA, 25 bp, Homo sapien
gaagactcgcccattttggaatgtg

SEQ ID NO: 13587 - DNA, 25 bp, Homo sapien
ccatcttcacggacgccaaggagtc

SEQ ID NO: 13588 - DNA, 25 bp, Homo sapien
aggagtccagcacggtgttcgaact

SEQ ID NO: 13589 - DNA, 25 bp, Homo sapien
gaactgaagcgcatcgtcgagggca

SEQ ID NO: 13590 - DNA, 25 bp, Homo sapien
catcgtcgagggcatcctcaagcgg

SEQ ID NO: 13591 - DNA, 25 bp, Homo sapien
gcagcggctgtacaaggatgaccaa

SEQ ID NO: 13592 - DNA, 25 bp, Homo sapien
ggatgaccaactcttggatgatggc

SEQ ID NO: 13593 - DNA, 25 bp, Homo sapien
ggatgatggcaagacactgggcgag

SEQ ID NO: 13594 - DNA, 25 bp, Homo sapien
agacactgggcgagtgtggcttcac

SEQ ID NO: 13595 - DNA, 25 bp, Homo sapien
acaggccccagccacagtggggctg

SEQ ID NO: 13596 - DNA, 25 bp, Homo sapien
cagagctgcccgatgtgatgaagcc

SEQ ID NO: 13597 - DNA, 25 bp, Homo sapien
gccccaggactcgggaagcagtgcc

SEQ ID NO: 13598 - DNA, 25 bp, Homo sapien
gcgacctgcgagactcacaagaggg

SEQ ID NO: 13599 - DNA, 25 bp, Homo sapien
gtatccagtatctccgtgattacct

SEQ ID NO: 13600 - DNA, 25 bp, Homo sapien
ctacagacggagtgctgtgccacct

SEQ ID NO: 13601 - DNA, 25 bp, Homo sapien
gccacctggtgccgacaagaaagcc

SEQ ID NO: 13602 - DNA, 25 bp, Homo sapien
gaaagccgaggctggggctgggtca

SEQ ID NO: 13603 - DNA, 25 bp, Homo sapien
ggctgggtcagcaaccgaattccag

SEQ ID NO: 13604 - DNA, 25 bp, Homo sapien
gcaaccgaattccagtttagaggcg

SEQ ID NO: 13605 - DNA, 25 bp, Homo sapien
agaggcggatttggtcgtggacgtg

SEQ ID NO: 13606 - DNA, 25 bp, Homo sapien
ttggtcgtggacgtggtcagccacc

SEQ ID NO: 13607 - DNA, 25 bp, Homo sapien
cgtggtcagccacctcagtaaaatt

SEQ ID NO: 13608 - DNA, 25 bp, Homo sapien
attggagaggattcttttgcattga

SEQ ID NO: 13609 - DNA, 25 bp, Homo sapien
atatgtatgggcattacctcttagt

SEQ ID NO: 13610 - DNA, 25 bp, Homo sapien
gggcattacctcttagtgatatttg

SEQ ID NO: 13611 - DNA, 25 bp, Homo sapien
gtcctttgttgctcatgctgtttaa

SEQ ID NO: 13612 - DNA, 25 bp, Homo sapien
gtttaagtgcaggctgagacccagc

SEQ ID NO: 13613 - DNA, 25 bp, Homo sapien
caggctgagacccagcctctttgta

SEQ ID NO: 13614 - DNA, 25 bp, Homo sapien
ccagcctctttgtaagtacagtaaa

SEQ ID NO: 13615 - DNA, 25 bp, Homo sapien
agattgctttccatgtttgaaattt

SEQ ID NO: 13616 - DNA, 25 bp, Homo sapien
ataagtgcaatttggatttcatgtt

SEQ ID NO: 13617 - DNA, 25 bp, Homo sapien
gtacagggattcaggtttcttattc

SEQ ID NO: 13618 - DNA, 25 bp, Homo sapien
tgtgaagcacatcttgctgttgcct

SEQ ID NO: 13619 - DNA, 25 bp, Homo sapien
tttgatgcttttattcatgacaaga

SEQ ID NO: 13620 - DNA, 25 bp, Homo sapien
agctgccagaaacgaacctctttga

SEQ ID NO: 13621 - DNA, 25 bp, Homo sapien
gtgacttgcatcaatcctacattca

SEQ ID NO: 13622 - DNA, 25 bp, Homo sapien
tcctacattcatctgtgatcaccca

SEQ ID NO: 13623 - DNA, 25 bp, Homo sapien
gagccctttggctaaatggcaccgc

SEQ ID NO: 13624 - DNA, 25 bp, Homo sapien
gactgagcgctttgagctgtttgtc

SEQ ID NO: 13625 - DNA, 25 bp, Homo sapien
tgcggcagcggcagctttttgaaga

SEQ ID NO: 13626 - DNA, 25 bp, Homo sapien
aaacttctgtactgccctggaatat

SEQ ID NO: 13627 - DNA, 25 bp, Homo sapien
gctggggcatgggcattgatcgagt

SEQ ID NO: 13628 - DNA, 25 bp, Homo sapien
ttgatcgagtcgccatgtttctcac

SEQ ID NO: 13629 - DNA, 25 bp, Homo sapien
gtttctcacggactccaacaacatc

SEQ ID NO: 13630 - DNA, 25 bp, Homo sapien
ttctgtttcctgccatgaaacccga

SEQ ID NO: 13631 - DNA, 25 bp, Homo sapien
ggcactgtaatggcgttgactggcg

SEQ ID NO: 13632 - DNA, 25 bp, Homo sapien
gaagctggactctcagcgaggggct

SEQ ID NO: 13633 - DNA, 25 bp, Homo sapien
caacagctacaagttggcccggtgg

SEQ ID NO: 13634 - DNA, 25 bp, Homo sapien
tgctggctggatctgagtacctcaa

SEQ ID NO: 13635 - DNA, 25 bp, Homo sapien
caagcttggttatgtgtctcggtac

SEQ ID NO: 13636 - DNA, 25 bp, Homo sapien
tcggtaccacgtgaaagactcctca

SEQ ID NO: 13637 - DNA, 25 bp, Homo sapien
atgagtttgccagccagatcaacct

SEQ ID NO: 13638 - DNA, 25 bp, Homo sapien
tacgctgcgtcattgacatctgcat

SEQ ID NO: 13639 - DNA, 25 bp, Homo sapien
ggcaaatacctcatcctcaaggacc

SEQ ID NO: 13640 - DNA, 25 bp, Homo sapien
caacaagcaggtcatccgtgtctac

SEQ ID NO: 13641 - DNA, 25 bp, Homo sapien
ggaatgtgtgtctaacttgctctct

SEQ ID NO: 13642 - DNA, 25 bp, Homo sapien
cctacttaggattttccactctatc

SEQ ID NO: 13643 - DNA, 25 bp, Homo sapien
tccctgactttctctagttagatgt

SEQ ID NO: 13644 - DNA, 25 bp, Homo sapien
taaataggttttcctcacttcaggc

SEQ ID NO: 13645 - DNA, 25 bp, Homo sapien
gctccagggaccaatctggggctgg

SEQ ID NO: 13646 - DNA, 25 bp, Homo sapien
agtgatcttggtagtatccctggct

SEQ ID NO: 13647 - DNA, 25 bp, Homo sapien
tcccattcacttaacagctcttttg

SEQ ID NO: 13648 - DNA, 25 bp, Homo sapien
ggattgggtgtttcattccatttct

SEQ ID NO: 13649 - DNA, 25 bp, Homo sapien
tcctctcctctctggtaggtttaat

SEQ ID NO: 13650 - DNA, 25 bp, Homo sapien
atagtggtaactgcagttcctcctc

SEQ ID NO: 13651 - DNA, 25 bp, Homo sapien
tgtttaataactcaccttctctatc

SEQ ID NO: 13652 - DNA, 25 bp, Homo sapien
ccttctctatccttgctcaaaatgt

SEQ ID NO: 13653 - DNA, 25 bp, Homo sapien
gacacccaaggaggctattgagggc

SEQ ID NO: 13654 - DNA, 25 bp, Homo sapien
attgacaagaaatgccccttcactg

SEQ ID NO: 13655 - DNA, 25 bp, Homo sapien
gccccttcactggtaatgtgtccat

SEQ ID NO: 13656 - DNA, 25 bp, Homo sapien
gatggcggacattcagactgagcgt

SEQ ID NO: 13657 - DNA, 25 bp, Homo sapien
cattgtcatccgccgagactatctg

SEQ ID NO: 13658 - DNA, 25 bp, Homo sapien
cgcaagtacaaccgcttcgagaagc

SEQ ID NO: 13659 - DNA, 25 bp, Homo sapien
caagaacatgtctgtacacctgtcc

SEQ ID NO: 13660 - DNA, 25 bp, Homo sapien
acatcgtcacagtgggcgagtgccg

SEQ ID NO: 13661 - DNA, 25 bp, Homo sapien
cagactgagcgtgcctaccaaaagc

SEQ ID NO: 13662 - DNA, 25 bp, Homo sapien
gcaagacagtgcgcttcaacgtgct

SEQ ID NO: 13663 - DNA, 25 bp, Homo sapien
ccaaaagcagccgaccatctttcaa

SEQ ID NO: 13664 - DNA, 25 bp, Homo sapien
agtggtcgccctggacaagaacttc

SEQ ID NO: 13665 - DNA, 25 bp, Homo sapien
tggtcgccctggacaagaacttcca

SEQ ID NO: 13666 - DNA, 25 bp, Homo sapien
tgttacaagtgtgaggactgcggga

SEQ ID NO: 13667 - DNA, 25 bp, Homo sapien
gtcgattgaggcagatgacaatggc

SEQ ID NO: 13668 - DNA, 25 bp, Homo sapien
gcagatgacaatggctgcttccccc

SEQ ID NO: 13669 - DNA, 25 bp, Homo sapien
tcggaagtgccacactgctagagcc

SEQ ID NO: 13670 - DNA, 25 bp, Homo sapien
ctgacccaggacccaacatggtcta

SEQ ID NO: 13671 - DNA, 25 bp, Homo sapien
tgacccaggacccaacatggtctag

SEQ ID NO: 13672 - DNA, 25 bp, Homo sapien
aggacccaacatggtctagggatgc

SEQ ID NO: 13673 - DNA, 25 bp, Homo sapien
acccaacatggtctagggatgcagg

SEQ ID NO: 13674 - DNA, 25 bp, Homo sapien
aacatggtctagggatgcaggatcc

SEQ ID NO: 13675 - DNA, 25 bp, Homo sapien
acagcctatggaggctccagtcatg

SEQ ID NO: 13676 - DNA, 25 bp, Homo sapien
ggctccagtcatgctgtgggatgag

SEQ ID NO: 13677 - DNA, 25 bp, Homo sapien
ctgtgggatgagtccagcttccctg

SEQ ID NO: 13678 - DNA, 25 bp, Homo sapien
ttccctgacatcccaggggctgtaa

SEQ ID NO: 13679 - DNA, 25 bp, Homo sapien
ggggctgtaagtgccaacatgactg

SEQ ID NO: 13680 - DNA, 25 bp, Homo sapien
agcggagtaaggagcgctccctact

SEQ ID NO: 13681 - DNA, 25 bp, Homo sapien
tccctactgcatggggacttccacg

SEQ ID NO: 13682 - DNA, 25 bp, Homo sapien
actgggaccagaatgagcgttttct

SEQ ID NO: 13683 - DNA, 25 bp, Homo sapien
gagcgttttctggtagtgcttaact

SEQ ID NO: 13684 - DNA, 25 bp, Homo sapien
taactttggggatgtgggcctctcg

SEQ ID NO: 13685 - DNA, 25 bp, Homo sapien
aactggagcctcacgaagggctgct

SEQ ID NO: 13686 - DNA, 25 bp, Homo sapien
atctggtgttcttgctaactttgcc

SEQ ID NO: 13687 - DNA, 25 bp, Homo sapien
tgcccttcactgttgcttaattgtg

SEQ ID NO: 13688 - DNA, 25 bp, Homo sapien
acatccatgcggagtccattatttg

SEQ ID NO: 13689 - DNA, 25 bp, Homo sapien
aagtttgctagtgactaagccccgc

SEQ ID NO: 13690 - DNA, 25 bp, Homo sapien
gactaagccccgcatatgtgagtga

SEQ ID NO: 13691 - DNA, 25 bp, Homo sapien
gtgaaagtacttcaggcacgctgcc

SEQ ID NO: 13692 - DNA, 25 bp, Homo sapien
cctcctggtaacagctatgcaggga

SEQ ID NO: 13693 - DNA, 25 bp, Homo sapien
tatgcagggagggaggacccacact

SEQ ID NO: 13694 - DNA, 25 bp, Homo sapien
gataactgctcttttactaagacat

SEQ ID NO: 13695 - DNA, 25 bp, Homo sapien
taagacatagtctctacctatagaa

SEQ ID NO: 13696 - DNA, 25 bp, Homo sapien
aacacttattttacacagcaatttt

SEQ ID NO: 13697 - DNA, 25 bp, Homo sapien
aactaacatgtcctgcctattatct

SEQ ID NO: 13698 - DNA, 25 bp, Homo sapien
attatctgtcagctgcaaggtactc

SEQ ID NO: 13699 - DNA, 25 bp, Homo sapien
gcaaggtactctggtgagtcaccac

SEQ ID NO: 13700 - DNA, 25 bp, Homo sapien
acttcagggctttactccgtaacag

SEQ ID NO: 13701 - DNA, 25 bp, Homo sapien
gttacagttctgtggtttcatgtta

SEQ ID NO: 13702 - DNA, 25 bp, Homo sapien
agtgccacttaatgtatgttaccaa

SEQ ID NO: 13703 - DNA, 25 bp, Homo sapien
gatttcctaatactgtcatcctcaa

SEQ ID NO: 13704 - DNA, 25 bp, Homo sapien
tattaacgatgtccaacccgtctgg

SEQ ID NO: 13705 - DNA, 25 bp, Homo sapien
gtccttttgacactgctctaacagc

SEQ ID NO: 13706 - DNA, 25 bp, Homo sapien
gacacaccaggcgctaattcaagga

SEQ ID NO: 13707 - DNA, 25 bp, Homo sapien
ggaatttcttaacttcttgcttctt

SEQ ID NO: 13708 - DNA, 25 bp, Homo sapien
ggcccaggccaatggttggggcgtc

SEQ ID NO: 13709 - DNA, 25 bp, Homo sapien
caatggttggggcgtcatggtgtct

SEQ ID NO: 13710 - DNA, 25 bp, Homo sapien
gactgaagataccttcatcgctgac

SEQ ID NO: 13711 - DNA, 25 bp, Homo sapien
cttcatcgctgacctggttgtgggg

SEQ ID NO: 13712 - DNA, 25 bp, Homo sapien
acaaccagctcctcagaattgaaga

SEQ ID NO: 13713 - DNA, 25 bp, Homo sapien
gctaagtttgccggcaggaacttca

SEQ ID NO: 13714 - DNA, 25 bp, Homo sapien
gccggcaggaacttcagaaacccct

SEQ ID NO: 13715 - DNA, 25 bp, Homo sapien
taagctgtgggcaggcaagccttcg

SEQ ID NO: 13716 - DNA, 25 bp, Homo sapien
ttgcaggggtccctgctagttagcg

SEQ ID NO: 13717 - DNA, 25 bp, Homo sapien
actttccaccaagtgtctagagtca

SEQ ID NO: 13718 - DNA, 25 bp, Homo sapien
caagtgtctagagtcatgtgagcct

SEQ ID NO: 13719 - DNA, 25 bp, Homo sapien
agtcgtggtggctagtgtctgtggt

SEQ ID NO: 13720 - DNA, 25 bp, Homo sapien
tcggccccttagtggtggattacag

SEQ ID NO: 13721 - DNA, 25 bp, Homo sapien
acaggtgtgagcctatattttcaat

SEQ ID NO: 13722 - DNA, 25 bp, Homo sapien
gtgagcctatattttcaattatcaa

SEQ ID NO: 13723 - DNA, 25 bp, Homo sapien
caattatcaatagccttttaagagt

SEQ ID NO: 13724 - DNA, 25 bp, Homo sapien
gggtgcagtggttaaacttacaaag

SEQ ID NO: 13725 - DNA, 25 bp, Homo sapien
aaactgagtcaaaccacagaatccc

SEQ ID NO: 13726 - DNA, 25 bp, Homo sapien
atcccagaaaggctcagaagttgaa

SEQ ID NO: 13727 - DNA, 25 bp, Homo sapien
gttgaaggtactggtatatatacat

SEQ ID NO: 13728 - DNA, 25 bp, Homo sapien
tgtatatatatatccctgaaggtgg

SEQ ID NO: 13729 - DNA, 25 bp, Homo sapien
ctgaaggtggatatataggtgtaac

SEQ ID NO: 13730 - DNA, 25 bp, Homo sapien
ttgatgatggcacctcagatcgccc

SEQ ID NO: 13731 - DNA, 25 bp, Homo sapien
ctggtggctggaattgaccgctacc

SEQ ID NO: 13732 - DNA, 25 bp, Homo sapien
acaaggtactctgtggatatcccct

SEQ ID NO: 13733 - DNA, 25 bp, Homo sapien
ctctgtggatatccccttggacaaa

SEQ ID NO: 13734 - DNA, 25 bp, Homo sapien
gatatccccttggacaaaactgtcg

SEQ ID NO: 13735 - DNA, 25 bp, Homo sapien
aactgtcgtcaataaggatgtcttc

SEQ ID NO: 13736 - DNA, 25 bp, Homo sapien
ggatgtcttcagagatcctgctctt

SEQ ID NO: 13737 - DNA, 25 bp, Homo sapien
tcagagatcctgctcttaaacgcaa

SEQ ID NO: 13738 - DNA, 25 bp, Homo sapien
acaagacaggcaagaacaagtggtt

SEQ ID NO: 13739 - DNA, 25 bp, Homo sapien
aagtggttcttccagaaactgcggt

SEQ ID NO: 13740 - DNA, 25 bp, Homo sapien
gaaactgcggttttagatgctttgt

SEQ ID NO: 13741 - DNA, 25 bp, Homo sapien
gtgagtcctccccagtttaatgaaa

SEQ ID NO: 13742 - DNA, 25 bp, Homo sapien
agtcctccccagtttaatgaaactg

SEQ ID NO: 13743 - DNA, 25 bp, Homo sapien
gtcctccccagtttaatgaaactgt

SEQ ID NO: 13744 - DNA, 25 bp, Homo sapien
tcctccccagtttaatgaaactgta

SEQ ID NO: 13745 - DNA, 25 bp, Homo sapien
gaaactgtaagtccatcaaacttct

SEQ ID NO: 13746 - DNA, 25 bp, Homo sapien
aaactgtaagtccatcaaacttctc

SEQ ID NO: 13747 - DNA, 25 bp, Homo sapien
actgtaagtccatcaaacttctctt

SEQ ID NO: 13748 - DNA, 25 bp, Homo sapien
tgtaagtccatcaaacttctctttc

SEQ ID NO: 13749 - DNA, 25 bp, Homo sapien
aaatagactaatcccggctgggcat

SEQ ID NO: 13750 - DNA, 25 bp, Homo sapien
atagactaatcccggctgggcatgg

SEQ ID NO: 13751 - DNA, 25 bp, Homo sapien
agactaatcccggctgggcatggtg

SEQ ID NO: 13752 - DNA, 25 bp, Homo sapien
gatcaaggctcatgtagcctcactg

SEQ ID NO: 13753 - DNA, 25 bp, Homo sapien
gtagcctcactggagggcattgccc

SEQ ID NO: 13754 - DNA, 25 bp, Homo sapien
cggaagatcaagtcgtgctcctggc

SEQ ID NO: 13755 - DNA, 25 bp, Homo sapien
gccctgactaccctggaagtagcag

SEQ ID NO: 13756 - DNA, 25 bp, Homo sapien
agtagcaggccgcatgcttggaggt

SEQ ID NO: 13757 - DNA, 25 bp, Homo sapien
gaggtcagactcctaaggtggccaa

SEQ ID NO: 13758 - DNA, 25 bp, Homo sapien
agaagacaggtcgggctaagcggcg

SEQ ID NO: 13759 - DNA, 25 bp, Homo sapien
agcggcggatgcagtacaaccggcg

SEQ ID NO: 13760 - DNA, 25 bp, Homo sapien
caaccggcgctttgtcaacgttgtg

SEQ ID NO: 13761 - DNA, 25 bp, Homo sapien
cgttgtgcccacctttggcaagaag

SEQ ID NO: 13762 - DNA, 25 bp, Homo sapien
ggagctacacaccttcgaggtgacc

SEQ ID NO: 13763 - DNA, 25 bp, Homo sapien
gagtggtttgtggattccctcaacc

SEQ ID NO: 13764 - DNA, 25 bp, Homo sapien
cgccggccctggttagtgaagtacg

SEQ ID NO: 13765 - DNA, 25 bp, Homo sapien
gccggcttcgtgaaggagttctccc

SEQ ID NO: 13766 - DNA, 25 bp, Homo sapien
cgcctttctcacgatcaagggcgcc

SEQ ID NO: 13767 - DNA, 25 bp, Homo sapien
aagcagccatactgatgaccacagc

SEQ ID NO: 13768 - DNA, 25 bp, Homo sapien
tcccgctaggagagtcctcttctaa

SEQ ID NO: 13769 - DNA, 25 bp, Homo sapien
tctaagcaaagtgcccctgcaggcg

SEQ ID NO: 13770 - DNA, 25 bp, Homo sapien
gcaagttagcactttattcccgcag

SEQ ID NO: 13771 - DNA, 25 bp, Homo sapien
tcccgcagcagttcctgaatggggt

SEQ ID NO: 13772 - DNA, 25 bp, Homo sapien
tgatgcactgattccatcccaggaa

SEQ ID NO: 13773 - DNA, 25 bp, Homo sapien
cccaggaacccaacagagctcagga

SEQ ID NO: 13774 - DNA, 25 bp, Homo sapien
tctctaccccttgaatctgagcagg

SEQ ID NO: 13775 - DNA, 25 bp, Homo sapien
agcagggctcgtgccttgctttggc

SEQ ID NO: 13776 - DNA, 25 bp, Homo sapien
ccttgctttggccactagaattcag

SEQ ID NO: 13777 - DNA, 25 bp, Homo sapien
cagctctgaagaccctctgtgtttc

SEQ ID NO: 13778 - DNA, 25 bp, Homo sapien
tctgtgtttcctctttgcctcatgc

SEQ ID NO: 13779 - DNA, 25 bp, Homo sapien
tgaggagaacacacccaagctaccg

SEQ ID NO: 13780 - DNA, 25 bp, Homo sapien
acacccaagctaccggaggatggaa

SEQ ID NO: 13781 - DNA, 25 bp, Homo sapien
tggagaagatccgagtcgtgccacc

SEQ ID NO: 13782 - DNA, 25 bp, Homo sapien
tgccaccaaggccagtctagatgag

SEQ ID NO: 13783 - DNA, 25 bp, Homo sapien
atgagccaagagctagtagagcccc

SEQ ID NO: 13784 - DNA, 25 bp, Homo sapien
aagagctagtagagccccggatatt

SEQ ID NO: 13785 - DNA, 25 bp, Homo sapien
cagactgctgtggatgtttttcgaa

SEQ ID NO: 13786 - DNA, 25 bp, Homo sapien
aaatggacggggcagcttcacaagg

SEQ ID NO: 13787 - DNA, 25 bp, Homo sapien
aaggcaagtcttcatgctcggtgat

SEQ ID NO: 13788 - DNA, 25 bp, Homo sapien
gctcggtgatgtgattctgctgcaa

SEQ ID NO: 13789 - DNA, 25 bp, Homo sapien
tctgctgcaaagcctgaggacactg

SEQ ID NO: 13790 - DNA, 25 bp, Homo sapien
tgaagaagcaaactgcccgttctcc

SEQ ID NO: 13791 - DNA, 25 bp, Homo sapien
ctgcccgttctccttgaagataaac

SEQ ID NO: 13792 - DNA, 25 bp, Homo sapien
aaactatgcttcttttttcttctgt

SEQ ID NO: 13793 - DNA, 25 bp, Homo sapien
tatcatttgggtcagagctcccctc

SEQ ID NO: 13794 - DNA, 25 bp, Homo sapien
tcccctcccttcagattatgttaac

SEQ ID NO: 13795 - DNA, 25 bp, Homo sapien
gtctgtccaaatgagttcacttcca

SEQ ID NO: 13796 - DNA, 25 bp, Homo sapien
agaagagtacttgagctccactccg

SEQ ID NO: 13797 - DNA, 25 bp, Homo sapien
tccactccgcagcgtctgaagttgc

SEQ ID NO: 13798 - DNA, 25 bp, Homo sapien
tctgaagttgctggacgcgtacctg

SEQ ID NO: 13799 - DNA, 25 bp, Homo sapien
gtacctgctgtatatactgctgacc

SEQ ID NO: 13800 - DNA, 25 bp, Homo sapien
ggcttcatctcttgtgtggggagtt

SEQ ID NO: 13801 - DNA, 25 bp, Homo sapien
ttcatcctagcggtttgcctgagaa

SEQ ID NO: 13802 - DNA, 25 bp, Homo sapien
atcctgcaccttgttgtcatgaact

SEQ ID NO: 13803 - DNA, 25 bp, Homo sapien
ggctgaatcattctcatttacttaa

SEQ ID NO: 13804 - DNA, 25 bp, Homo sapien
atgttcactctttgaatttcctgga

SEQ ID NO: 13805 - DNA, 25 bp, Homo sapien
tttgacacttactgctagctctgct

SEQ ID NO: 13806 - DNA, 25 bp, Homo sapien
aaagcccagagttcactgtgtgtca

SEQ ID NO: 13807 - DNA, 25 bp, Homo sapien
aatagacttgtgtcttcaccttgct

SEQ ID NO: 13808 - DNA, 25 bp, Homo sapien
gtcttcaccttgctgcattgtgacc

SEQ ID NO: 13809 - DNA, 25 bp, Homo sapien
gtgaccagcacctacggctggacag

SEQ ID NO: 13810 - DNA, 25 bp, Homo sapien
gagcggatcatgaaagcccaggcac

SEQ ID NO: 13811 - DNA, 25 bp, Homo sapien
aaaagcacctggagatcaaccctga

SEQ ID NO: 13812 - DNA, 25 bp, Homo sapien
tggtggtgctgctgtttgaaaccgc

SEQ ID NO: 13813 - DNA, 25 bp, Homo sapien
caaccgcatctatcgcatgatcaag

SEQ ID NO: 13814 - DNA, 25 bp, Homo sapien
gcagaggaacccaatgctgcagttc

SEQ ID NO: 13815 - DNA, 25 bp, Homo sapien
tcccccctctcgagggcgatgagga

SEQ ID NO: 13816 - DNA, 25 bp, Homo sapien
gggcgatgaggatgcgtctcgcatg

SEQ ID NO: 13817 - DNA, 25 bp, Homo sapien
aacttgtgcccttgtatagtgtccc

SEQ ID NO: 13818 - DNA, 25 bp, Homo sapien
gtatcgcttccctgaagaactcact

SEQ ID NO: 13819 - DNA, 25 bp, Homo sapien
gaactcactcagaccttcatgagct

SEQ ID NO: 13820 - DNA, 25 bp, Homo sapien
ttcgccagtgtcatcctttttggaa

SEQ ID NO: 13821 - DNA, 25 bp, Homo sapien
atttctggagtctgggtcttccgag

SEQ ID NO: 13822 - DNA, 25 bp, Homo sapien
gcctttccgctgagtccagattggc

SEQ ID NO: 13823 - DNA, 25 bp, Homo sapien
gacgctggttcgagagtacttttcc

SEQ ID NO: 13824 - DNA, 25 bp, Homo sapien
ggccttccagcatgtgggcaaagcc

SEQ ID NO: 13825 - DNA, 25 bp, Homo sapien
tgtgagcaggcgctggctgctgagc

SEQ ID NO: 13826 - DNA, 25 bp, Homo sapien
tcacctgcccaagagtacctttgtg

SEQ ID NO: 13827 - DNA, 25 bp, Homo sapien
gtggcactgccatatttctgggagc

SEQ ID NO: 13828 - DNA, 25 bp, Homo sapien
gataaggacggctggtccctgtggt

SEQ ID NO: 13829 - DNA, 25 bp, Homo sapien
gagaatcgcttggactttggtagca

SEQ ID NO: 13830 - DNA, 25 bp, Homo sapien
cttggactttggtagcagaggttgc

SEQ ID NO: 13831 - DNA, 25 bp, Homo sapien
aaaccgaagtgtcttcaccctgatc

SEQ ID NO: 13832 - DNA, 25 bp, Homo sapien
agtgtcttcaccctgatctttgtta

SEQ ID NO: 13833 - DNA, 25 bp, Homo sapien
caccctgatctttgttaccatctct

SEQ ID NO: 13834 - DNA, 25 bp, Homo sapien
atctctctgaagatcctagagccat

SEQ ID NO: 13835 - DNA, 25 bp, Homo sapien
gaagatcctagagccatgagttatt

SEQ ID NO: 13836 - DNA, 25 bp, Homo sapien
gagccatgagttatttctgcaactg

SEQ ID NO: 13837 - DNA, 25 bp, Homo sapien
ttctgcaactgatctaatggtttga

SEQ ID NO: 13838 - DNA, 25 bp, Homo sapien
ggtttgatcaacctagaaagacata

SEQ ID NO: 13839 - DNA, 25 bp, Homo sapien
aagacataaagttctgggccgggag

SEQ ID NO: 13840 - DNA, 25 bp, Homo sapien
taacttcacacgccgaaacctggct

SEQ ID NO: 13841 - DNA, 25 bp, Homo sapien
cgaaacctggctgactgtcttcgga

SEQ ID NO: 13842 - DNA, 25 bp, Homo sapien
gggccagcgctgtattacatggact

SEQ ID NO: 13843 - DNA, 25 bp, Homo sapien
actctcagtatcctcgaccgatact

SEQ ID NO: 13844 - DNA, 25 bp, Homo sapien
tacacaccgactatctcacgtgaga

SEQ ID NO: 13845 - DNA, 25 bp, Homo sapien
gtgagagggcagtggaactccttag

SEQ ID NO: 13846 - DNA, 25 bp, Homo sapien
gctccagaaacgcttcatcctgaat

SEQ ID NO: 13847 - DNA, 25 bp, Homo sapien
tgaatctgccaaccttcagtgttcg

SEQ ID NO: 13848 - DNA, 25 bp, Homo sapien
tgacctggataacatttccttcccc

SEQ ID NO: 13849 - DNA, 25 bp, Homo sapien
aacagggctcctaacatcatgtcct

SEQ ID NO: 13850 - DNA, 25 bp, Homo sapien
tcttttcaggcgcactcttgataaa

SEQ ID NO: 13851 - DNA, 25 bp, Homo sapien
tggaccccggtgagtagctgcccca

SEQ ID NO: 13852 - DNA, 25 bp, Homo sapien
ccggtgagtagctgccccatcttaa

SEQ ID NO: 13853 - DNA, 25 bp, Homo sapien
ttaagctctagagggacactcccgc

SEQ ID NO: 13854 - DNA, 25 bp, Homo sapien
caggctctctagattcttgtggcgt

SEQ ID NO: 13855 - DNA, 25 bp, Homo sapien
ctctagattcttgtggcgttgccaa

SEQ ID NO: 13856 - DNA, 25 bp, Homo sapien
acagtccactctccctgagcagagt

SEQ ID NO: 13857 - DNA, 25 bp, Homo sapien
cctgagcagagttcctggcttgaga

SEQ ID NO: 13858 - DNA, 25 bp, Homo sapien
cagagttcctggcttgagacagcag

SEQ ID NO: 13859 - DNA, 25 bp, Homo sapien
gcagaaaacaactgagggtgacacc

SEQ ID NO: 13860 - DNA, 25 bp, Homo sapien
atcacgtccacatgcccgtttgtga

SEQ ID NO: 13861 - DNA, 25 bp, Homo sapien
ccacatgcccgtttgtgagccaggg

SEQ ID NO: 13862 - DNA, 25 bp, Homo sapien
gagagatgcagttctgccacttcgt

SEQ ID NO: 13863 - DNA, 25 bp, Homo sapien
agatgcagttctgccacttcgtagg

SEQ ID NO: 13864 - DNA, 25 bp, Homo sapien
gcagttctgccacttcgtaggctgt

SEQ ID NO: 13865 - DNA, 25 bp, Homo sapien
tttgtgccccagtggagatcttcta

SEQ ID NO: 13866 - DNA, 25 bp, Homo sapien
ttgtgccccagtggagatcttctac

SEQ ID NO: 13867 - DNA, 25 bp, Homo sapien
aattttcggctgtcatctaaaatca

SEQ ID NO: 13868 - DNA, 25 bp, Homo sapien
tcggctgtcatctaaaatcatcaat

SEQ ID NO: 13869 - DNA, 25 bp, Homo sapien
taaaatcatcaatgtctcccaggaa

SEQ ID NO: 13870 - DNA, 25 bp, Homo sapien
aaatcatcaatgtctcccaggaaga

SEQ ID NO: 13871 - DNA, 25 bp, Homo sapien
gactggcaattgacaaatcatctta

SEQ ID NO: 13872 - DNA, 25 bp, Homo sapien
gacaaatcatcttagaaaggctttt

SEQ ID NO: 13873 - DNA, 25 bp, Homo sapien
tctggtctcggccgcagaagcgaga

SEQ ID NO: 13874 - DNA, 25 bp, Homo sapien
gtataactggagtgccaaggctaaa

SEQ ID NO: 13875 - DNA, 25 bp, Homo sapien
ggaactggtcgaatgaggcacctaa

SEQ ID NO: 13876 - DNA, 25 bp, Homo sapien
gaggcacctaaaaattgtataccgc

SEQ ID NO: 13877 - DNA, 25 bp, Homo sapien
tgtataccgcagattcaggcatgga

SEQ ID NO: 13878 - DNA, 25 bp, Homo sapien
gattcaggcatggattccgtgaagg

SEQ ID NO: 13879 - DNA, 25 bp, Homo sapien
ctaaacccaagagggcagctgttgc

SEQ ID NO: 13880 - DNA, 25 bp, Homo sapien
agctgttgcagcatccagttcatct

SEQ ID NO: 13881 - DNA, 25 bp, Homo sapien
gaatgtcaacgattagtcatgcaat

SEQ ID NO: 13882 - DNA, 25 bp, Homo sapien
gacgaagggaacgtcatcgtttgga

SEQ ID NO: 13883 - DNA, 25 bp, Homo sapien
ataagacgcacacgttgtgccgccg

SEQ ID NO: 13884 - DNA, 25 bp, Homo sapien
tcaccgccttgctataggagtcacc

SEQ ID NO: 13885 - DNA, 25 bp, Homo sapien
gcttttgttctctcagtacttgtta

SEQ ID NO: 13886 - DNA, 25 bp, Homo sapien
ttgttctctcagtacttgttaccca

SEQ ID NO: 13887 - DNA, 25 bp, Homo sapien
ctcaacatccagggcccaatttgcc

SEQ ID NO: 13888 - DNA, 25 bp, Homo sapien
atccagggcccaatttgccctgcct

SEQ ID NO: 13889 - DNA, 25 bp, Homo sapien
ccctggctctaggacactctaacaa

SEQ ID NO: 13890 - DNA, 25 bp, Homo sapien
cagtgcctttgtctatattctgctc

SEQ ID NO: 13891 - DNA, 25 bp, Homo sapien
ccgtgccttcaaatctcttgacaaa

SEQ ID NO: 13892 - DNA, 25 bp, Homo sapien
atccaggtgaacatccaggagtggc

SEQ ID NO: 13893 - DNA, 25 bp, Homo sapien
gtggctgcagctgactatgtattcc

SEQ ID NO: 13894 - DNA, 25 bp, Homo sapien
gtattcctgaactggagccccagac

SEQ ID NO: 13895 - DNA, 25 bp, Homo sapien
ggagttctaaacgtttgccagcttg

SEQ ID NO: 13896 - DNA, 25 bp, Homo sapien
aacgtttgccagcttgtattgcaca

SEQ ID NO: 13897 - DNA, 25 bp, Homo sapien
ttgtattgcacagctcccattcatt

SEQ ID NO: 13898 - DNA, 25 bp, Homo sapien
agctcccattcattccaattgtata

SEQ ID NO: 13899 - DNA, 25 bp, Homo sapien
gatagctacgtaacttcctcaaggt

SEQ ID NO: 13900 - DNA, 25 bp, Homo sapien
acttcctcaaggtcactcagcctga

SEQ ID NO: 13901 - DNA, 25 bp, Homo sapien
actcagcctgactctgagccaagaa

SEQ ID NO: 13902 - DNA, 25 bp, Homo sapien
aagctttggagcttagacccaagga

SEQ ID NO: 13903 - DNA, 25 bp, Homo sapien
gagtttgcctggtagtaaaagtgga

SEQ ID NO: 13904 - DNA, 25 bp, Homo sapien
tggacacatccacttataacgctca

SEQ ID NO: 13905 - DNA, 25 bp, Homo sapien
catccacttataacgctcacttgaa

SEQ ID NO: 13906 - DNA, 25 bp, Homo sapien
gttgctgtttattttttttggcctg

SEQ ID NO: 13907 - DNA, 25 bp, Homo sapien
ttttttggcctgttttgatgtatgt

SEQ ID NO: 13908 - DNA, 25 bp, Homo sapien
cacttcccgtctcagaatctaaacg

SEQ ID NO: 13909 - DNA, 25 bp, Homo sapien
gaatctaaacgttggtcaccttcga

SEQ ID NO: 13910 - DNA, 25 bp, Homo sapien
tcaccttcgagtagagaggcccgcc

SEQ ID NO: 13911 - DNA, 25 bp, Homo sapien
ccacccaacccaaaccatgagaatt

SEQ ID NO: 13912 - DNA, 25 bp, Homo sapien
gggtcagccatttttaatgatctcg

SEQ ID NO: 13913 - DNA, 25 bp, Homo sapien
tgatctcggatgaccaaaccagcct

SEQ ID NO: 13914 - DNA, 25 bp, Homo sapien
tcctacttctgactttacttgtggt

SEQ ID NO: 13915 - DNA, 25 bp, Homo sapien
aacaatcttattccgagcattccag

SEQ ID NO: 13916 - DNA, 25 bp, Homo sapien
attccgagcattccagtaactgttt

SEQ ID NO: 13917 - DNA, 25 bp, Homo sapien
aaccggggagttatcattaccatgt

SEQ ID NO: 13918 - DNA, 25 bp, Homo sapien
ttaccatgttggtgacctgttcagt

SEQ ID NO: 13919 - DNA, 25 bp, Homo sapien
gttggtgacctgttcagtttgctgc

SEQ ID NO: 13920 - DNA, 25 bp, Homo sapien
ccattagctgccttaaacgttaaca

SEQ ID NO: 13921 - DNA, 25 bp, Homo sapien
ctgccttaaacgttaacagcacatt

SEQ ID NO: 13922 - DNA, 25 bp, Homo sapien
aacagcacatttgaatgccttattc

SEQ ID NO: 13923 - DNA, 25 bp, Homo sapien
gaatgccttattctacaatgcagcg

SEQ ID NO: 13924 - DNA, 25 bp, Homo sapien
acaatgcagcgtgttttcctttgcc

SEQ ID NO: 13925 - DNA, 25 bp, Homo sapien
tggtgaattacgtgcctccataacc

SEQ ID NO: 13926 - DNA, 25 bp, Homo sapien
tgaactgtgccgactccacaaaacg

SEQ ID NO: 13927 - DNA, 25 bp, Homo sapien
ttctcacgtgggaatcagtgaagtg

SEQ ID NO: 13928 - DNA, 25 bp, Homo sapien
aggaggcattgatggccttccggga

SEQ ID NO: 13929 - DNA, 25 bp, Homo sapien
gcattgatggccttccgggatgtgg

SEQ ID NO: 13930 - DNA, 25 bp, Homo sapien
agtggaagctattgagttctgctca

SEQ ID NO: 13931 - DNA, 25 bp, Homo sapien
gaagctattgagttctgctcagagg

SEQ ID NO: 13932 - DNA, 25 bp, Homo sapien
ctattgagttctgctcagaggaccc

SEQ ID NO: 13933 - DNA, 25 bp, Homo sapien
caaaccaaaactcatcgaacagctg

SEQ ID NO: 13934 - DNA, 25 bp, Homo sapien
caaaactcatcgaacagctggagca

SEQ ID NO: 13935 - DNA, 25 bp, Homo sapien
gcaacttgactctcctctaggaaga

SEQ ID NO: 13936 - DNA, 25 bp, Homo sapien
aacttgactctcctctaggaagagt

SEQ ID NO: 13937 - DNA, 25 bp, Homo sapien
ttgactctcctctaggaagagtact

SEQ ID NO: 13938 - DNA, 25 bp, Homo sapien
tctcctctaggaagagtactccaga

SEQ ID NO: 13939 - DNA, 25 bp, Homo sapien
aggataaggaaggaattcctcctga

SEQ ID NO: 13940 - DNA, 25 bp, Homo sapien
ggcaagcagctagaagatggacgta

SEQ ID NO: 13941 - DNA, 25 bp, Homo sapien
agatggacgtactttgtctgactac

SEQ ID NO: 13942 - DNA, 25 bp, Homo sapien
gacgtactttgtctgactacaatat

SEQ ID NO: 13943 - DNA, 25 bp, Homo sapien
gaagaagaagtcttacaccactccc

SEQ ID NO: 13944 - DNA, 25 bp, Homo sapien
gcggtggagccgcaaccaaaatgca

SEQ ID NO: 13945 - DNA, 25 bp, Homo sapien
aatggcaaaattagtcgccttcgtc

SEQ ID NO: 13946 - DNA, 25 bp, Homo sapien
aattagtcgccttcgtcgagagtgc

SEQ ID NO: 13947 - DNA, 25 bp, Homo sapien
tgacttactgtttcaacaaaccaga

SEQ ID NO: 13948 - DNA, 25 bp, Homo sapien
caccctcgaggttgaaccctcggat

SEQ ID NO: 13949 - DNA, 25 bp, Homo sapien
ggttgaaccctcggatacgatagaa

SEQ ID NO: 13950 - DNA, 25 bp, Homo sapien
agactgggacacaggcggaagccta

SEQ ID NO: 13951 - DNA, 25 bp, Homo sapien
agacatacggtgatccaggaggctc

SEQ ID NO: 13952 - DNA, 25 bp, Homo sapien
tgggctgtgggtgggatactgggat

SEQ ID NO: 13953 - DNA, 25 bp, Homo sapien
acctgtaaccagctttgtgtctttt

SEQ ID NO: 13954 - DNA, 25 bp, Homo sapien
aagggagggcgagcccttgggatgc

SEQ ID NO: 13955 - DNA, 25 bp, Homo sapien
tctgatgccctgtccaatgtgagga

SEQ ID NO: 13956 - DNA, 25 bp, Homo sapien
agccctacactccacttggagtctg

SEQ ID NO: 13957 - DNA, 25 bp, Homo sapien
ggagtctggatggacacatgggcca

SEQ ID NO: 13958 - DNA, 25 bp, Homo sapien
catgggccaggggctctgaagcagc

SEQ ID NO: 13959 - DNA, 25 bp, Homo sapien
ctcactcttaacttcgtgttcacac

SEQ ID NO: 13960 - DNA, 25 bp, Homo sapien
tgttcacactccatggaaaccccag

SEQ ID NO: 13961 - DNA, 25 bp, Homo sapien
ttgatgaccagtacgctggctgtgc

SEQ ID NO: 13962 - DNA, 25 bp, Homo sapien
atgaccagtacgctggctgtgctgc

SEQ ID NO: 13963 - DNA, 25 bp, Homo sapien
tgtgctgctgccatgacagctgctc

SEQ ID NO: 13964 - DNA, 25 bp, Homo sapien
ggatctcaaccacacggagttccag

SEQ ID NO: 13965 - DNA, 25 bp, Homo sapien
tcaaccacacggagttccaggccaa

SEQ ID NO: 13966 - DNA, 25 bp, Homo sapien
ccaggccaaccaggtgtatgcagac

SEQ ID NO: 13967 - DNA, 25 bp, Homo sapien
gccaaccaggtgtatgcagacagct

SEQ ID NO: 13968 - DNA, 25 bp, Homo sapien
gtatgcagacagctggacactggca

SEQ ID NO: 13969 - DNA, 25 bp, Homo sapien
gcagacagctggacactggcaagca

SEQ ID NO: 13970 - DNA, 25 bp, Homo sapien
gacactggcaagcagccaatggcag

SEQ ID NO: 13971 - DNA, 25 bp, Homo sapien
agccaatggcaggagcgtcaggcca

SEQ ID NO: 13972 - DNA, 25 bp, Homo sapien
cagcaggggcctgtggtggtgagcc

SEQ ID NO: 13973 - DNA, 25 bp, Homo sapien
caaggacaagtacagccacctcatc

SEQ ID NO: 13974 - DNA, 25 bp, Homo sapien
cagcccacatgctacaggccaataa

SEQ ID NO: 13975 - DNA, 25 bp, Homo sapien
caataagacctacggctgtgtgccc

SEQ ID NO: 13976 - DNA, 25 bp, Homo sapien
gctgtgtgcccgtggccaataagag

SEQ ID NO: 13977 - DNA, 25 bp, Homo sapien
gggacacacgctccattgaagaggc

SEQ ID NO: 13978 - DNA, 25 bp, Homo sapien
gagtggggaagagttgccgccaacc

SEQ ID NO: 13979 - DNA, 25 bp, Homo sapien
ggctgctgctattagagcccatcct

SEQ ID NO: 13980 - DNA, 25 bp, Homo sapien
gatttgtcaccgttggagcttggat

SEQ ID NO: 13981 - DNA, 25 bp, Homo sapien
tctgtattattccccgttcttggaa

SEQ ID NO: 13982 - DNA, 25 bp, Homo sapien
atggggctggggtactttacattca

SEQ ID NO: 13983 - DNA, 25 bp, Homo sapien
ctctaggctccaactcgttatgaaa

SEQ ID NO: 13984 - DNA, 25 bp, Homo sapien
tacgtcctggggtacaagcagactc

SEQ ID NO: 13985 - DNA, 25 bp, Homo sapien
aggcaaagcgaaattggtcattctc

SEQ ID NO: 13986 - DNA, 25 bp, Homo sapien
ttggtcattctcgctaacaactgcc

SEQ ID NO: 13987 - DNA, 25 bp, Homo sapien
ctaacaactgcccagctttgaggaa

SEQ ID NO: 13988 - DNA, 25 bp, Homo sapien
aactggtgtccatcactacagtggc

SEQ ID NO: 13989 - DNA, 25 bp, Homo sapien
attgaactgggcacagcatgcggaa

SEQ ID NO: 13990 - DNA, 25 bp, Homo sapien
gcacactggctatcattgatccagg

SEQ ID NO: 13991 - DNA, 25 bp, Homo sapien
cccgctcctaaggcaggaagatggt

SEQ ID NO: 13992 - DNA, 25 bp, Homo sapien
aagtcgctggagtcgatcaactcta

SEQ ID NO: 13993 - DNA, 25 bp, Homo sapien
ggagtcgatcaactctaggctccaa

SEQ ID NO: 13994 - DNA, 25 bp, Homo sapien
aaccttaggatgagctcccttttct

SEQ ID NO: 13995 - DNA, 25 bp, Homo sapien
tgttttttccatttacggcagtggt

SEQ ID NO: 13996 - DNA, 25 bp, Homo sapien
acggcagtggtaccatgttttggat

SEQ ID NO: 13997 - DNA, 25 bp, Homo sapien
aaaagctgatgtatagccctgtata

SEQ ID NO: 13998 - DNA, 25 bp, Homo sapien
gtatttcttgtgcattaatctgacg

SEQ ID NO: 13999 - DNA, 25 bp, Homo sapien
taatctgacgataatttccctgtat

SEQ ID NO: 14000 - DNA, 25 bp, Homo sapien
aatttccctgtatattatgttcatt

SEQ ID NO: 14001 - DNA, 25 bp, Homo sapien
attagatcaggttgtctgcatttgt

SEQ ID NO: 14002 - DNA, 25 bp, Homo sapien
gaacatcatcacagttatcctgagt

SEQ ID NO: 14003 - DNA, 25 bp, Homo sapien
gttatcctgagttgagtttaagcca

SEQ ID NO: 14004 - DNA, 25 bp, Homo sapien
tagaaaagggtcttcctattaatgg

SEQ ID NO: 14005 - DNA, 25 bp, Homo sapien
caacagatcatgtaagatgtctcag

SEQ ID NO: 14006 - DNA, 25 bp, Homo sapien
gtaagatgtctcagatgccaagtga

SEQ ID NO: 14007 - DNA, 25 bp, Homo sapien
taaggacaaggaggcagtcaactgt

SEQ ID NO: 14008 - DNA, 25 bp, Homo sapien
caaggaggcagtcaactgtattata

SEQ ID NO: 14009 - DNA, 25 bp, Homo sapien
ctgtattatatgttgctaatcagca

SEQ ID NO: 14010 - DNA, 25 bp, Homo sapien
gctaatcagcaaaccaagatgagaa

SEQ ID NO: 14011 - DNA, 25 bp, Homo sapien
tttgacttttgtgtttagcaatgtg

SEQ ID NO: 14012 - DNA, 25 bp, Homo sapien
gtgtttagcaatgtgggtgtcaatc

SEQ ID NO: 14013 - DNA, 25 bp, Homo sapien
gcaatgtgggtgtcaatcattataa

SEQ ID NO: 14014 - DNA, 25 bp, Homo sapien
accttgataacaacaattttggtgg

SEQ ID NO: 14015 - DNA, 25 bp, Homo sapien
agttacagaacctcaaatcctccct

SEQ ID NO: 14016 - DNA, 25 bp, Homo sapien
cattgagcgcatgggcctggccatg

SEQ ID NO: 14017 - DNA, 25 bp, Homo sapien
gctttgaccgtgccatcgagatgga

SEQ ID NO: 14018 - DNA, 25 bp, Homo sapien
gagatggagcgtggcaacttcggag

SEQ ID NO: 14019 - DNA, 25 bp, Homo sapien
acttcggaggaagcttcgcaggttc

SEQ ID NO: 14020 - DNA, 25 bp, Homo sapien
aaggcctgccagatatttgtgagaa

SEQ ID NO: 14021 - DNA, 25 bp, Homo sapien
aaattcaacgagtgcggccacgtgc

SEQ ID NO: 14022 - DNA, 25 bp, Homo sapien
tgctgtacgccgacatcaagatgga

SEQ ID NO: 14023 - DNA, 25 bp, Homo sapien
ggtgtggtgtggttaagttcgagtc

SEQ ID NO: 14024 - DNA, 25 bp, Homo sapien
agttcgagtcgccagaggtggccga

SEQ ID NO: 14025 - DNA, 25 bp, Homo sapien
gccgagagagcctgccggatgatga

SEQ ID NO: 14026 - DNA, 25 bp, Homo sapien
gaagctgagtggccgagagattgac

SEQ ID NO: 14027 - DNA, 25 bp, Homo sapien
gacgttctcttcaaaacttcttgct

SEQ ID NO: 14028 - DNA, 25 bp, Homo sapien
atggtactcagatgtgcattcacat

SEQ ID NO: 14029 - DNA, 25 bp, Homo sapien
gaagtgggtgtaccttgctttacct

SEQ ID NO: 14030 - DNA, 25 bp, Homo sapien
tccagctgtgatgtgtcttcatttt

SEQ ID NO: 14031 - DNA, 25 bp, Homo sapien
agtttgacactggagcttttgagct

SEQ ID NO: 14032 - DNA, 25 bp, Homo sapien
agcttttttacctcacatcttttat

SEQ ID NO: 14033 - DNA, 25 bp, Homo sapien
gaagcttgctttattaagacactct

SEQ ID NO: 14034 - DNA, 25 bp, Homo sapien
aagacgtcagggaatccttgtatat

SEQ ID NO: 14035 - DNA, 25 bp, Homo sapien
atgtcgtgggaatcaactcctcatt

SEQ ID NO: 14036 - DNA, 25 bp, Homo sapien
actcctcatttatctgttgcgtaag

SEQ ID NO: 14037 - DNA, 25 bp, Homo sapien
tttgtgcatcagtcgggttttctat

SEQ ID NO: 14038 - DNA, 25 bp, Homo sapien
ctggatggggcgtgacatcctgccc

SEQ ID NO: 14039 - DNA, 25 bp, Homo sapien
atcctgcccccgagggtgtggcggg

SEQ ID NO: 14040 - DNA, 25 bp, Homo sapien
ggagtcgatgtcacacagctgagcc

SEQ ID NO: 14041 - DNA, 25 bp, Homo sapien
gagtcgatgtcacacagctgagcca

SEQ ID NO: 14042 - DNA, 25 bp, Homo sapien
agtcgatgtcacacagctgagccac

SEQ ID NO: 14043 - DNA, 25 bp, Homo sapien
gtcgatgtcacacagctgagccaca

SEQ ID NO: 14044 - DNA, 25 bp, Homo sapien
tcgatgtcacacagctgagccacag

SEQ ID NO: 14045 - DNA, 25 bp, Homo sapien
gatgtcacacagctgagccacaggg

SEQ ID NO: 14046 - DNA, 25 bp, Homo sapien
tgtggtgaaagctttccccaggtcc

SEQ ID NO: 14047 - DNA, 25 bp, Homo sapien
gacccagaaatgcagctcactctag

SEQ ID NO: 14048 - DNA, 25 bp, Homo sapien
acccagaaatgcagctcactctagc

SEQ ID NO: 14049 - DNA, 25 bp, Homo sapien
agcaatcaagatgatccaccctcag

SEQ ID NO: 14050 - DNA, 25 bp, Homo sapien
gatgatccaccctcagattctgagt

SEQ ID NO: 14051 - DNA, 25 bp, Homo sapien
attctgagtgttgatgacatgtgac

SEQ ID NO: 14052 - DNA, 25 bp, Homo sapien
gggatagctaggttgccatcatgaa

SEQ ID NO: 14053 - DNA, 25 bp, Homo sapien
agctaggttgccatcatgaatctgc

SEQ ID NO: 14054 - DNA, 25 bp, Homo sapien
tactggaagagttcccaggtctctg

SEQ ID NO: 14055 - DNA, 25 bp, Homo sapien
gttcccaggtctctgtagatttcag

SEQ ID NO: 14056 - DNA, 25 bp, Homo sapien
aatgatcaacttttctagcagtgcc

SEQ ID NO: 14057 - DNA, 25 bp, Homo sapien
tagcagtgccagttcttccactgta

SEQ ID NO: 14058 - DNA, 25 bp, Homo sapien
ttcttccactgtacaaatctctaaa

SEQ ID NO: 14059 - DNA, 25 bp, Homo sapien
acattaaatgttctttgggaggccg

SEQ ID NO: 14060 - DNA, 25 bp, Homo sapien
agaaagccatgttcagttcgagcgc

SEQ ID NO: 14061 - DNA, 25 bp, Homo sapien
tcgagcgccaagatcgtgaagccca

SEQ ID NO: 14062 - DNA, 25 bp, Homo sapien
gaagcccaatggcgagaagccggac

SEQ ID NO: 14063 - DNA, 25 bp, Homo sapien
cggacgagttcgagtccggcatctc

SEQ ID NO: 14064 - DNA, 25 bp, Homo sapien
ggagctggagatgaactcggacctc

SEQ ID NO: 14065 - DNA, 25 bp, Homo sapien
tggagatgaactcggacctcaaggc

SEQ ID NO: 14066 - DNA, 25 bp, Homo sapien
gaagttggtggtggtcggaaagcta

SEQ ID NO: 14067 - DNA, 25 bp, Homo sapien
gctatcataatctttgttcccgttc

SEQ ID NO: 14068 - DNA, 25 bp, Homo sapien
ttcccgttcctcaactgaaatcttt

SEQ ID NO: 14069 - DNA, 25 bp, Homo sapien
gttcagtgggaagcatgtcgtcttt

SEQ ID NO: 14070 - DNA, 25 bp, Homo sapien
gaagcatgtcgtctttatcgctcag

SEQ ID NO: 14071 - DNA, 25 bp, Homo sapien
accggtcaggacctccttgaggtgc

SEQ ID NO: 14072 - DNA, 25 bp, Homo sapien
tgaggtgcacaagcacggtctcctc

SEQ ID NO: 14073 - DNA, 25 bp, Homo sapien
tgccccttgctccgtaaaagtatca

SEQ ID NO: 14074 - DNA, 25 bp, Homo sapien
tgagacggaggctggccatccattc

SEQ ID NO: 14075 - DNA, 25 bp, Homo sapien
cagccctgagcgtgctgagttctgt

SEQ ID NO: 14076 - DNA, 25 bp, Homo sapien
aggtgtggaacctgaggggccagca

SEQ ID NO: 14077 - DNA, 25 bp, Homo sapien
tccatggagcaaacggagccacctc

SEQ ID NO: 14078 - DNA, 25 bp, Homo sapien
gtacccgatgtttacagatgctgtt

SEQ ID NO: 14079 - DNA, 25 bp, Homo sapien
ccattccagctggagtcgtggggct

SEQ ID NO: 14080 - DNA, 25 bp, Homo sapien
tttttccagagctgagcctgacgtc

SEQ ID NO: 14081 - DNA, 25 bp, Homo sapien
gcctgacgtctgctctgaagaatgc

SEQ ID NO: 14082 - DNA, 25 bp, Homo sapien
cctgtccattggtgatgttgcgaag

SEQ ID NO: 14083 - DNA, 25 bp, Homo sapien
gagatgtggaataacactgctgcag

SEQ ID NO: 14084 - DNA, 25 bp, Homo sapien
gcagatgacaagcagccttatgaaa

SEQ ID NO: 14085 - DNA, 25 bp, Homo sapien
ataagttggttctagcgcagttttt

SEQ ID NO: 14086 - DNA, 25 bp, Homo sapien
gtctataaagcatttaacccccctg

SEQ ID NO: 14087 - DNA, 25 bp, Homo sapien
taaactgtacagtgtctttttttgt

SEQ ID NO: 14088 - DNA, 25 bp, Homo sapien
aatgtgtctttagatagccctgtcc

SEQ ID NO: 14089 - DNA, 25 bp, Homo sapien
gccctgtcctggtggtattttcaat

SEQ ID NO: 14090 - DNA, 25 bp, Homo sapien
caatagccactaaccttgcctggta

SEQ ID NO: 14091 - DNA, 25 bp, Homo sapien
accttgcctggtacagtatgggggt

SEQ ID NO: 14092 - DNA, 25 bp, Homo sapien
aaagcaggttcttgttggtgcacag

SEQ ID NO: 14093 - DNA, 25 bp, Homo sapien
caagagtagcctcaacctgtgcttc

SEQ ID NO: 14094 - DNA, 25 bp, Homo sapien
cagggtggcagatgaagctttctac

SEQ ID NO: 14095 - DNA, 25 bp, Homo sapien
acaacccttcgctgacgtgattggt

SEQ ID NO: 14096 - DNA, 25 bp, Homo sapien
accatccttgctacagcctagaaca

SEQ ID NO: 14097 - DNA, 25 bp, Homo sapien
tgacattgacgagtcgtccccaggc

SEQ ID NO: 14098 - DNA, 25 bp, Homo sapien
taaccccaagtctagcaagcaggcc

SEQ ID NO: 14099 - DNA, 25 bp, Homo sapien
gcaagcaggccaaagatgtctcccg

SEQ ID NO: 14100 - DNA, 25 bp, Homo sapien
gccaccctgtggaaacactacatct

SEQ ID NO: 14101 - DNA, 25 bp, Homo sapien
atctgcaatatcttaatcctactca

SEQ ID NO: 14102 - DNA, 25 bp, Homo sapien
gaagctcttcacagtcattggatta

SEQ ID NO: 14103 - DNA, 25 bp, Homo sapien
tgtttgtgattgcatgtttccttcc

SEQ ID NO: 14104 - DNA, 25 bp, Homo sapien
gtaaagttacaacacaccctcttgc

SEQ ID NO: 14105 - DNA, 25 bp, Homo sapien
ggtcattacacctactctgagaatc

SEQ ID NO: 14106 - DNA, 25 bp, Homo sapien
ggcctgattcttacaagccgggggc

SEQ ID NO: 14107 - DNA, 25 bp, Homo sapien
cagcttcgagtttgcgcttgcaatt

SEQ ID NO: 14108 - DNA, 25 bp, Homo sapien
gtggcggctcaagtgaaggctccac

SEQ ID NO: 14109 - DNA, 25 bp, Homo sapien
gaaggctccacttgttcttaaagac

SEQ ID NO: 14110 - DNA, 25 bp, Homo sapien
gcagcgaactgcgacgatcacttag

SEQ ID NO: 14111 - DNA, 25 bp, Homo sapien
taggaatccattctcactgtgttcg

SEQ ID NO: 14112 - DNA, 25 bp, Homo sapien
atgtgttcagaagtcgctgtcctta

SEQ ID NO: 14113 - DNA, 25 bp, Homo sapien
gatttctcagcctacaaattgtgtc

SEQ ID NO: 14114 - DNA, 25 bp, Homo sapien
tgtgtctatacatttctaagccttg

SEQ ID NO: 14115 - DNA, 25 bp, Homo sapien
gaaggggatgaggacgacgatgaag

SEQ ID NO: 14116 - DNA, 25 bp, Homo sapien
ggacgacgatgaagtcagtgaggag

SEQ ID NO: 14117 - DNA, 25 bp, Homo sapien
gaggaggaagaaggtgggaaaggtg

SEQ ID NO: 14118 - DNA, 25 bp, Homo sapien
gaagatgattaagaccccagatgac

SEQ ID NO: 14119 - DNA, 25 bp, Homo sapien
aagaccccagatgacctgcagaaac

SEQ ID NO: 14120 - DNA, 25 bp, Homo sapien
atgacctgcagaaacagaactgttc

SEQ ID NO: 14121 - DNA, 25 bp, Homo sapien
agaactgttcagtattggttggact

SEQ ID NO: 14122 - DNA, 25 bp, Homo sapien
gtattggttggactgctcatggatt

SEQ ID NO: 14123 - DNA, 25 bp, Homo sapien
ggttggactgctcatggattttgta

SEQ ID NO: 14124 - DNA, 25 bp, Homo sapien
gactgctcatggattttgtagctgt

SEQ ID NO: 14125 - DNA, 25 bp, Homo sapien
gttaccaacctgaatgactaccgag

SEQ ID NO: 14126 - DNA, 25 bp, Homo sapien
cctccctcacagtgcagggcggtat

SEQ ID NO: 14127 - DNA, 25 bp, Homo sapien
gggcggtatgccgcaaacgctttcc

SEQ ID NO: 14128 - DNA, 25 bp, Homo sapien
aacgctttccgcaaagctcagtgtc

SEQ ID NO: 14129 - DNA, 25 bp, Homo sapien
gctcagtgtcccattgtggagcgcc

SEQ ID NO: 14130 - DNA, 25 bp, Homo sapien
cgcctcactaactccatgatgatgc

SEQ ID NO: 14131 - DNA, 25 bp, Homo sapien
tgcacggccgcaacaacggcaagaa

SEQ ID NO: 14132 - DNA, 25 bp, Homo sapien
catcgtcaagcatgccttcgagatc

SEQ ID NO: 14133 - DNA, 25 bp, Homo sapien
cttcgagatcatacacctgctcacg

SEQ ID NO: 14134 - DNA, 25 bp, Homo sapien
gaacgccatcatcaacagtggtccc

SEQ ID NO: 14135 - DNA, 25 bp, Homo sapien
tccggaacattaagaccattgctga

SEQ ID NO: 14136 - DNA, 25 bp, Homo sapien
aagtccaaccgctgattttccagct

SEQ ID NO: 14137 - DNA, 25 bp, Homo sapien
gacaaagagtgggtggccaagcaga

SEQ ID NO: 14138 - DNA, 25 bp, Homo sapien
catccagggcttagcctccaagtgg

SEQ ID NO: 14139 - DNA, 25 bp, Homo sapien
gcttagcctccaagtgggactacga

SEQ ID NO: 14140 - DNA, 25 bp, Homo sapien
gcaactccatgcctatttactggaa

SEQ ID NO: 14141 - DNA, 25 bp, Homo sapien
tatgccaaacagttgtaccactgct

SEQ ID NO: 14142 - DNA, 25 bp, Homo sapien
gttgtaccactgctaataaatgacc

SEQ ID NO: 14143 - DNA, 25 bp, Homo sapien
gagcgaagacttttcgctcccagct

SEQ ID NO: 14144 - DNA, 25 bp, Homo sapien
gctcccagcttatatggatcggcgt

SEQ ID NO: 14145 - DNA, 25 bp, Homo sapien
ctgccagccagaaggcactgaagga

SEQ ID NO: 14146 - DNA, 25 bp, Homo sapien
tggagcagcctctccatggatgaga

SEQ ID NO: 14147 - DNA, 25 bp, Homo sapien
taagttcaaggagagctttgctgag

SEQ ID NO: 14148 - DNA, 25 bp, Homo sapien
atgggaattgcgatccgtgttgcct

SEQ ID NO: 14149 - DNA, 25 bp, Homo sapien
ttgcctcacccaaactggttatgga

SEQ ID NO: 14150 - DNA, 25 bp, Homo sapien
ggaagaggctcctgagtcctataag

SEQ ID NO: 14151 - DNA, 25 bp, Homo sapien
gaaccttggacagcagggctgcctg

SEQ ID NO: 14152 - DNA, 25 bp, Homo sapien
gactgacatgctcttctgacatcag

SEQ ID NO: 14153 - DNA, 25 bp, Homo sapien
gtgtgcagctgtaactgctcacgcc

SEQ ID NO: 14154 - DNA, 25 bp, Homo sapien
ttcaggggcccgtgcttgtaaaata

SEQ ID NO: 14155 - DNA, 25 bp, Homo sapien
aggaagaggcacattgcccaccttt

SEQ ID NO: 14156 - DNA, 25 bp, Homo sapien
ggtagatgtcaaactgccttacgca

SEQ ID NO: 14157 - DNA, 25 bp, Homo sapien
atcagattgatcttcttcacaccaa

SEQ ID NO: 14158 - DNA, 25 bp, Homo sapien
caccaagctctgtttacattccgag

SEQ ID NO: 14159 - DNA, 25 bp, Homo sapien
aagctcaggcgctgcgcgtgagagg

SEQ ID NO: 14160 - DNA, 25 bp, Homo sapien
ctcaggcgctgcgcgtgagaggtcc

SEQ ID NO: 14161 - DNA, 25 bp, Homo sapien
gcgcgtgagaggtcccagatacgtc

SEQ ID NO: 14162 - DNA, 25 bp, Homo sapien
cgtgagaggtcccagatacgtctgc

SEQ ID NO: 14163 - DNA, 25 bp, Homo sapien
tgagaggtcccagatacgtctgcgg

SEQ ID NO: 14164 - DNA, 25 bp, Homo sapien
caggtctgggagccgagtgcggaag

SEQ ID NO: 14165 - DNA, 25 bp, Homo sapien
ggtctgggagccgagtgcggaagga

SEQ ID NO: 14166 - DNA, 25 bp, Homo sapien
tgggagccgagtgcggaaggaggga

SEQ ID NO: 14167 - DNA, 25 bp, Homo sapien
ctttgggaagccagaggacacccct

SEQ ID NO: 14168 - DNA, 25 bp, Homo sapien
gcaggggccgagagagctcggtgcc

SEQ ID NO: 14169 - DNA, 25 bp, Homo sapien
caggggccgagagagctcggtgccc

SEQ ID NO: 14170 - DNA, 25 bp, Homo sapien
cgaatcctctcacatggtggcttta

SEQ ID NO: 14171 - DNA, 25 bp, Homo sapien
aatcctctcacatggtggctttagg

SEQ ID NO: 14172 - DNA, 25 bp, Homo sapien
ggtggctttaggaagatccttggcc

SEQ ID NO: 14173 - DNA, 25 bp, Homo sapien
tgatgccagctatcttgcttctgaa

SEQ ID NO: 14174 - DNA, 25 bp, Homo sapien
cttgcttctgaaatatctacctggg

SEQ ID NO: 14175 - DNA, 25 bp, Homo sapien
aaatatctacctgggatggagtgat

SEQ ID NO: 14176 - DNA, 25 bp, Homo sapien
ggagtgatagtaacaccttcagaaa

SEQ ID NO: 14177 - DNA, 25 bp, Homo sapien
tggaaactcaggagtgacattccct

SEQ ID NO: 14178 - DNA, 25 bp, Homo sapien
atattctataatctccaactcctga

SEQ ID NO: 14179 - DNA, 25 bp, Homo sapien
ggacatggtctgctatacagctcag

SEQ ID NO: 14180 - DNA, 25 bp, Homo sapien
ctgctatacagctcagactctcgtc

SEQ ID NO: 14181 - DNA, 25 bp, Homo sapien
ctccctttcactgggcgactggagg

SEQ ID NO: 14182 - DNA, 25 bp, Homo sapien
ctttcactgggcgactggaggacag

SEQ ID NO: 14183 - DNA, 25 bp, Homo sapien
ctggcagggtatgtgtttctggttc

SEQ ID NO: 14184 - DNA, 25 bp, Homo sapien
tctggttctgttgagtgatgcttgg

SEQ ID NO: 14185 - DNA, 25 bp, Homo sapien
agtgatgcttggaagatcgttctga

SEQ ID NO: 14186 - DNA, 25 bp, Homo sapien
cttggaagatcgttctgagaggtca

SEQ ID NO: 14187 - DNA, 25 bp, Homo sapien
aagatcgttctgagaggtcagggca

SEQ ID NO: 14188 - DNA, 25 bp, Homo sapien
taggaggccggcttttatcagctca

SEQ ID NO: 14189 - DNA, 25 bp, Homo sapien
ggaggccggcttttatcagctcatg

SEQ ID NO: 14190 - DNA, 25 bp, Homo sapien
ttatcagctcatgagcttttaaaaa

SEQ ID NO: 14191 - DNA, 25 bp, Homo sapien
aagtaaaataacagtcagccaggca

SEQ ID NO: 14192 - DNA, 25 bp, Homo sapien
tgcggagccttctcaggcagtgaca

SEQ ID NO: 14193 - DNA, 25 bp, Homo sapien
tagcaagtcccagggcggagtccaa

SEQ ID NO: 14194 - DNA, 25 bp, Homo sapien
ccaacctataccttctcagggaggc

SEQ ID NO: 14195 - DNA, 25 bp, Homo sapien
gtggttggccattgggctgggagca

SEQ ID NO: 14196 - DNA, 25 bp, Homo sapien
ggtggtttctgtcggaggaccagct

SEQ ID NO: 14197 - DNA, 25 bp, Homo sapien
caagaggagttatttccaccccagt

SEQ ID NO: 14198 - DNA, 25 bp, Homo sapien
aattcagggcagacctccttatgct

SEQ ID NO: 14199 - DNA, 25 bp, Homo sapien
gggaatcgaagtcctctgctatgtc

SEQ ID NO: 14200 - DNA, 25 bp, Homo sapien
tctgctatgtcttcagacgggtccc

SEQ ID NO: 14201 - DNA, 25 bp, Homo sapien
atgaacgggagcacgggtgacgcca

SEQ ID NO: 14202 - DNA, 25 bp, Homo sapien
cccagccactctgaaagtgccttga

SEQ ID NO: 14203 - DNA, 25 bp, Homo sapien
gcaccaggagacacaatgctctgag

SEQ ID NO: 14204 - DNA, 25 bp, Homo sapien
caccaggagacacaatgctctgaga

SEQ ID NO: 14205 - DNA, 25 bp, Homo sapien
aagaagagatcagcacgtgggctgc

SEQ ID NO: 14206 - DNA, 25 bp, Homo sapien
gggatgaaacttgagccttgaaaga

SEQ ID NO: 14207 - DNA, 25 bp, Homo sapien
gatgaaacttgagccttgaaagagg

SEQ ID NO: 14208 - DNA, 25 bp, Homo sapien
atggctgagaactgctatgagtgcc

SEQ ID NO: 14209 - DNA, 25 bp, Homo sapien
gtaactggactaagggcaatgagga

SEQ ID NO: 14210 - DNA, 25 bp, Homo sapien
gaggtgtcaactacatcaagctgca

SEQ ID NO: 14211 - DNA, 25 bp, Homo sapien
ggtgtcaactacatcaagctgcata

SEQ ID NO: 14212 - DNA, 25 bp, Homo sapien
gtcaactacatcaagctgcatagag

SEQ ID NO: 14213 - DNA, 25 bp, Homo sapien
actacatcaagctgcatagagagat

SEQ ID NO: 14214 - DNA, 25 bp, Homo sapien
ggttgtactttaattcttggcatgt

SEQ ID NO: 14215 - DNA, 25 bp, Homo sapien
aattcttggcatgttgcctctatgt

SEQ ID NO: 14216 - DNA, 25 bp, Homo sapien
atacattctcattaactttagatgg

SEQ ID NO: 14217 - DNA, 25 bp, Homo sapien
tctttattgattagcactgaggatt

SEQ ID NO: 14218 - DNA, 25 bp, Homo sapien
ttaccatctcttgatgagactctta

SEQ ID NO: 14219 - DNA, 25 bp, Homo sapien
gactcttatttctttatataggtca

SEQ ID NO: 14220 - DNA, 25 bp, Homo sapien
aggtcagtcttgcaagtaccatttt

SEQ ID NO: 14221 - DNA, 25 bp, Homo sapien
gtaccattttataagcagctgtgaa

SEQ ID NO: 14222 - DNA, 25 bp, Homo sapien
gaccttatgaagtatgctatctgta

SEQ ID NO: 14223 - DNA, 25 bp, Homo sapien
gtatgctatctgtaggctgaaatta

SEQ ID NO: 14224 - DNA, 25 bp, Homo sapien
aaattataggtacatctgttttcac

SEQ ID NO: 14225 - DNA, 25 bp, Homo sapien
tggcaggttggcattttccggtgtc

SEQ ID NO: 14226 - DNA, 25 bp, Homo sapien
cattttccggtgtcctatctatgaa

SEQ ID NO: 14227 - DNA, 25 bp, Homo sapien
cctgggccagactcttggaaacata

SEQ ID NO: 14228 - DNA, 25 bp, Homo sapien
aacataaaggcttgggtgcccagct

SEQ ID NO: 14229 - DNA, 25 bp, Homo sapien
tctaaaacacgggactgggccaagg

SEQ ID NO: 14230 - DNA, 25 bp, Homo sapien
tgtctcattaggtcccctgaaacgt

SEQ ID NO: 14231 - DNA, 25 bp, Homo sapien
ggtcccctgaaacgtgtggaagcta

SEQ ID NO: 14232 - DNA, 25 bp, Homo sapien
acgtgtggaagctaaaatggcattc

SEQ ID NO: 14233 - DNA, 25 bp, Homo sapien
aatggcattcacgtgattcttgatc

SEQ ID NO: 14234 - DNA, 25 bp, Homo sapien
gattctgatctgatactacactgag

SEQ ID NO: 14235 - DNA, 25 bp, Homo sapien
tggcaggcgcctctagtactagcta

SEQ ID NO: 14236 - DNA, 25 bp, Homo sapien
cgaaatgcgagtcggctttcctttc

SEQ ID NO: 14237 - DNA, 25 bp, Homo sapien
gaggaatcctcggcagataaactgg

SEQ ID NO: 14238 - DNA, 25 bp, Homo sapien
gataaactggactgtcctctacaga

SEQ ID NO: 14239 - DNA, 25 bp, Homo sapien
atcttttgtctttccgtggagctgt

SEQ ID NO: 14240 - DNA, 25 bp, Homo sapien
aaagaacccgccgagcagtcaaatt

SEQ ID NO: 14241 - DNA, 25 bp, Homo sapien
agtcaaattccagagggccattact

SEQ ID NO: 14242 - DNA, 25 bp, Homo sapien
attactggtgcatctcttgctgata

SEQ ID NO: 14243 - DNA, 25 bp, Homo sapien
acgagaacaagctatcagggctgct

SEQ ID NO: 14244 - DNA, 25 bp, Homo sapien
ggagctgtcgccatgaaggtcgagc

SEQ ID NO: 14245 - DNA, 25 bp, Homo sapien
ggtcgagctgtgcagttttagcggg

SEQ ID NO: 14246 - DNA, 25 bp, Homo sapien
gcgggtacaagatctaccccggaca

SEQ ID NO: 14247 - DNA, 25 bp, Homo sapien
cccagaggaaccctgcggagggact

SEQ ID NO: 14248 - DNA, 25 bp, Homo sapien
gcggagggacttcaatcacatcaat

SEQ ID NO: 14249 - DNA, 25 bp, Homo sapien
tcacatcaatgtagaactcagcctt

SEQ ID NO: 14250 - DNA, 25 bp, Homo sapien
gaggctccgggttgacaaatggtgg

SEQ ID NO: 14251 - DNA, 25 bp, Homo sapien
actggctaccgttcggactatttgt

SEQ ID NO: 14252 - DNA, 25 bp, Homo sapien
ttacactgggcttccgttacaagat

SEQ ID NO: 14253 - DNA, 25 bp, Homo sapien
tccccatcaacgttgttatccagga

SEQ ID NO: 14254 - DNA, 25 bp, Homo sapien
ttgttcagtatctcaagcccagaaa

SEQ ID NO: 14255 - DNA, 25 bp, Homo sapien
ttgattcagcaagccacaacagtta

SEQ ID NO: 14256 - DNA, 25 bp, Homo sapien
gatctaagagttacctggctacaga

SEQ ID NO: 14257 - DNA, 25 bp, Homo sapien
gccagatgacacttaagacctactt

SEQ ID NO: 14258 - DNA, 25 bp, Homo sapien
aatgaaatcgccaatgccaactccc

SEQ ID NO: 14259 - DNA, 25 bp, Homo sapien
gatcatccgcaagcctgtgacggtc

SEQ ID NO: 14260 - DNA, 25 bp, Homo sapien
cattcccgggctcgatgccggaaaa

SEQ ID NO: 14261 - DNA, 25 bp, Homo sapien
ccgccggaagggcaggcacatgggc

SEQ ID NO: 14262 - DNA, 25 bp, Homo sapien
ggaagggtacagccaatgcccgaat

SEQ ID NO: 14263 - DNA, 25 bp, Homo sapien
agaatgaggattttgcgccggctgc

SEQ ID NO: 14264 - DNA, 25 bp, Homo sapien
tgcgccggctgctcagaagataccg

SEQ ID NO: 14265 - DNA, 25 bp, Homo sapien
gaagatcgatcgccacatgtatcac

SEQ ID NO: 14266 - DNA, 25 bp, Homo sapien
tgaggcccgcaggtctaagaccaag

SEQ ID NO: 14267 - DNA, 25 bp, Homo sapien
cgcaagcgccgtgaagagcgcctcc

SEQ ID NO: 14268 - DNA, 25 bp, Homo sapien
cactttgtctgtacatactggcctc

SEQ ID NO: 14269 - DNA, 25 bp, Homo sapien
cctcccaactacgagatgctcaagg

SEQ ID NO: 14270 - DNA, 25 bp, Homo sapien
aggaagtggctatgctgggggggcc

SEQ ID NO: 14271 - DNA, 25 bp, Homo sapien
gttcaacaccctcttcatgaacacc

SEQ ID NO: 14272 - DNA, 25 bp, Homo sapien
attcgcctactccgtgaagtctagg

SEQ ID NO: 14273 - DNA, 25 bp, Homo sapien
gaagatggttggcgacgtgaccggg

SEQ ID NO: 14274 - DNA, 25 bp, Homo sapien
gccaagtgcctgaacatctgggccc

SEQ ID NO: 14275 - DNA, 25 bp, Homo sapien
ctgggccctgattttgggcatcttc

SEQ ID NO: 14276 - DNA, 25 bp, Homo sapien
tcatgaccattctgctcgtcatcat

SEQ ID NO: 14277 - DNA, 25 bp, Homo sapien
tcgtcatcatcccagtgttggtcgt

SEQ ID NO: 14278 - DNA, 25 bp, Homo sapien
ccaggcccagcgatagatcaggagg

SEQ ID NO: 14279 - DNA, 25 bp, Homo sapien
atcattgaggccaggagctctgccc

SEQ ID NO: 14280 - DNA, 25 bp, Homo sapien
atatttacgcgttgggttcaggaat

SEQ ID NO: 14281 - DNA, 25 bp, Homo sapien
cccatctggctgtgaaattcaggaa

SEQ ID NO: 14282 - DNA, 25 bp, Homo sapien
aatcaccccatgtaggtgtacattg

SEQ ID NO: 14283 - DNA, 25 bp, Homo sapien
tgaccactaaggggcccccttggtg

SEQ ID NO: 14284 - DNA, 25 bp, Homo sapien
aaatggcctgcattttggagatgct

SEQ ID NO: 14285 - DNA, 25 bp, Homo sapien
gatgcctgaagggagtgctttgagg

SEQ ID NO: 14286 - DNA, 25 bp, Homo sapien
gggcttcgtggtgagcactgcagcc

SEQ ID NO: 14287 - DNA, 25 bp, Homo sapien
agcaccactgcaacatatagacctg

SEQ ID NO: 14288 - DNA, 25 bp, Homo sapien
tgagtgctattgtattttggcttgg

SEQ ID NO: 14289 - DNA, 25 bp, Homo sapien
tttggcttggtgtgtatgctcttca

SEQ ID NO: 14290 - DNA, 25 bp, Homo sapien
gtgattgttttgtttactgtaagtt

SEQ ID NO: 14291 - DNA, 25 bp, Homo sapien
ccctccctgggttcagaaatgctgc

SEQ ID NO: 14292 - DNA, 25 bp, Homo sapien
tctctccatctgtttggtgggggta

SEQ ID NO: 14293 - DNA, 25 bp, Homo sapien
ggtgggggtagagctgatccagagc

SEQ ID NO: 14294 - DNA, 25 bp, Homo sapien
atccagagcacagatctgtttcgtg

SEQ ID NO: 14295 - DNA, 25 bp, Homo sapien
atctgtttcgtgcattggaagaccc

SEQ ID NO: 14296 - DNA, 25 bp, Homo sapien
tcccgggcccgttgaggatgaggcc

SEQ ID NO: 14297 - DNA, 25 bp, Homo sapien
cccgttgaggatgaggccgctagag

SEQ ID NO: 14298 - DNA, 25 bp, Homo sapien
ggatgaggccgctagaggcctgagg

SEQ ID NO: 14299 - DNA, 25 bp, Homo sapien
gccgctagaggcctgaggatgagct

SEQ ID NO: 14300 - DNA, 25 bp, Homo sapien
tggaaggagtgagaggggacaaaac

SEQ ID NO: 14301 - DNA, 25 bp, Homo sapien
ggtgctgggactgagccagtcccag

SEQ ID NO: 14302 - DNA, 25 bp, Homo sapien
cagagaagagagcacaatgtatgga

SEQ ID NO: 14303 - DNA, 25 bp, Homo sapien
caatgtatggagtaaggtggcctta

SEQ ID NO: 14304 - DNA, 25 bp, Homo sapien
aaggtggccttattttgaagtcaag

SEQ ID NO: 14305 - DNA, 25 bp, Homo sapien
ggtgagagaggataggccagatcat

SEQ ID NO: 14306 - DNA, 25 bp, Homo sapien
aaaacttaggaaggcctagcacagt

SEQ ID NO: 14307 - DNA, 25 bp, Homo sapien
cttaggaaggcctagcacagtggct

SEQ ID NO: 14308 - DNA, 25 bp, Homo sapien
gcctggtggtaggtgtccgtaatcc

SEQ ID NO: 14309 - DNA, 25 bp, Homo sapien
attccagaatagagcaacagactaa

SEQ ID NO: 14310 - DNA, 25 bp, Homo sapien
agagcaacagactaagttatgacct

SEQ ID NO: 14311 - DNA, 25 bp, Homo sapien
cagactaagttatgacctgggtggg

SEQ ID NO: 14312 - DNA, 25 bp, Homo sapien
gttagcatgactggtgggaaagaca

SEQ ID NO: 14313 - DNA, 25 bp, Homo sapien
tgccgtggtatatacctgcagcctg

SEQ ID NO: 14314 - DNA, 25 bp, Homo sapien
ctgagatcctggactttgccctcag

SEQ ID NO: 14315 - DNA, 25 bp, Homo sapien
ctccctggtggtgaccacgtcagga

SEQ ID NO: 14316 - DNA, 25 bp, Homo sapien
ggtgaccacgtcaggagaccacaaa

SEQ ID NO: 14317 - DNA, 25 bp, Homo sapien
gtattttgtgtccaaaggcctgacc

SEQ ID NO: 14318 - DNA, 25 bp, Homo sapien
aggcctgaccgttaatggctgcagc

SEQ ID NO: 14319 - DNA, 25 bp, Homo sapien
cctgcctgtgtgtctggtgttgagg

SEQ ID NO: 14320 - DNA, 25 bp, Homo sapien
tgcccctgtctgccagcagaggcag

SEQ ID NO: 14321 - DNA, 25 bp, Homo sapien
gcagaggcagtagggcacagaggga

SEQ ID NO: 14322 - DNA, 25 bp, Homo sapien
gctggtgtgagccatggggtgtgta

SEQ ID NO: 14323 - DNA, 25 bp, Homo sapien
gagccatggggtgtgtatttgtatg

SEQ ID NO: 14324 - DNA, 25 bp, Homo sapien
cagcttgaagaactatgatccccag

SEQ ID NO: 14325 - DNA, 25 bp, Homo sapien
ctatgatccccagaaggacaagcgc

SEQ ID NO: 14326 - DNA, 25 bp, Homo sapien
gaccagcagcactgtgacgaggcta

SEQ ID NO: 14327 - DNA, 25 bp, Homo sapien
cgaggctaaggccgtggatatcccc

SEQ ID NO: 14328 - DNA, 25 bp, Homo sapien
catcgaggcgctgaaaaaactcaac

SEQ ID NO: 14329 - DNA, 25 bp, Homo sapien
gtatgatgcgtttttggcctcagag

SEQ ID NO: 14330 - DNA, 25 bp, Homo sapien
gtttttggcctcagagtctctgatc

SEQ ID NO: 14331 - DNA, 25 bp, Homo sapien
gagtctctgatcaagcagattccac

SEQ ID NO: 14332 - DNA, 25 bp, Homo sapien
caagcagattccacgaatcctcggc

SEQ ID NO: 14333 - DNA, 25 bp, Homo sapien
ctcggcccaggtttaaataaggcag

SEQ ID NO: 14334 - DNA, 25 bp, Homo sapien
ccctgctcacacacaacgaaaacat

SEQ ID NO: 14335 - DNA, 25 bp, Homo sapien
gcatcctcaaacatggcgccaagga

SEQ ID NO: 14336 - DNA, 25 bp, Homo sapien
cctcaaacatggcgccaaggataaa

SEQ ID NO: 14337 - DNA, 25 bp, Homo sapien
tcccagttcccagtggaagaaacag

SEQ ID NO: 14338 - DNA, 25 bp, Homo sapien
agtgcgtgccgagctgaggcagatg

SEQ ID NO: 14339 - DNA, 25 bp, Homo sapien
gcgtgccgagctgaggcagatgttc

SEQ ID NO: 14340 - DNA, 25 bp, Homo sapien
tgccgagctgaggcagatgttccca

SEQ ID NO: 14341 - DNA, 25 bp, Homo sapien
ccccagagccctgggctatagtctc

SEQ ID NO: 14342 - DNA, 25 bp, Homo sapien
cagagccctgggctatagtctctga

SEQ ID NO: 14343 - DNA, 25 bp, Homo sapien
cccacacaaatgcaagctcaccaag

SEQ ID NO: 14344 - DNA, 25 bp, Homo sapien
acacaaatgcaagctcaccaaggtc

SEQ ID NO: 14345 - DNA, 25 bp, Homo sapien
acaaatgcaagctcaccaaggtccc

SEQ ID NO: 14346 - DNA, 25 bp, Homo sapien
tacaatggccaagtggtttatgaaa

SEQ ID NO: 14347 - DNA, 25 bp, Homo sapien
ccaagtggtttatgaaaagatgctc

SEQ ID NO: 14348 - DNA, 25 bp, Homo sapien
agatattaccttatacctgttggga

SEQ ID NO: 14349 - DNA, 25 bp, Homo sapien
ttaccttatacctgttgggatggct

SEQ ID NO: 14350 - DNA, 25 bp, Homo sapien
atacctgttgggatggctgttgcca

SEQ ID NO: 14351 - DNA, 25 bp, Homo sapien
ttgggatggctgttgccaaaaaatc

SEQ ID NO: 14352 - DNA, 25 bp, Homo sapien
caagattggtgtggatgtggataaa

SEQ ID NO: 14353 - DNA, 25 bp, Homo sapien
taaagggaacctttacatactgttg

SEQ ID NO: 14354 - DNA, 25 bp, Homo sapien
ggaacctttacatactgttggtggg

SEQ ID NO: 14355 - DNA, 25 bp, Homo sapien
gtgaattggtacatctattatggaa

SEQ ID NO: 14356 - DNA, 25 bp, Homo sapien
tctgtgtatatatcgaaagcaaata

SEQ ID NO: 14357 - DNA, 25 bp, Homo sapien
acatggagttgttcctttggccaca

SEQ ID NO: 14358 - DNA, 25 bp, Homo sapien
ggaatgccccacaagtgttaccatg

SEQ ID NO: 14359 - DNA, 25 bp, Homo sapien
ccatcttccagtaattcgccaaaat

SEQ ID NO: 14360 - DNA, 25 bp, Homo sapien
gagtctacaatgttacccagcatgc

SEQ ID NO: 14361 - DNA, 25 bp, Homo sapien
agcacattaagcactctaagagccg

SEQ ID NO: 14362 - DNA, 25 bp, Homo sapien
gagccgagataacttcctgaaacgt

SEQ ID NO: 14363 - DNA, 25 bp, Homo sapien
gtacctgggttcaactaaagcgcca

SEQ ID NO: 14364 - DNA, 25 bp, Homo sapien
ctccacccagagaagcacactttgt

SEQ ID NO: 14365 - DNA, 25 bp, Homo sapien
ggaaggagcctgagctgctggaacc

SEQ ID NO: 14366 - DNA, 25 bp, Homo sapien
gctggaacctattccctatgaattc

SEQ ID NO: 14367 - DNA, 25 bp, Homo sapien
ggcacccgatatatgttctctaggc

SEQ ID NO: 14368 - DNA, 25 bp, Homo sapien
tatcaagtacctaggactctaacaa

SEQ ID NO: 14369 - DNA, 25 bp, Homo sapien
atctctagagggaagactgaaactt

SEQ ID NO: 14370 - DNA, 25 bp, Homo sapien
ggagaaatatgccatgttcagactc

SEQ ID NO: 14371 - DNA, 25 bp, Homo sapien
atgttcagactcactgtctccttca

SEQ ID NO: 14372 - DNA, 25 bp, Homo sapien
gctctggatatagtaccctacctgg

SEQ ID NO: 14373 - DNA, 25 bp, Homo sapien
tatagtaccctacctggaacccaag

SEQ ID NO: 14374 - DNA, 25 bp, Homo sapien
taccctacctggaacccaagtactg

SEQ ID NO: 14375 - DNA, 25 bp, Homo sapien
tccagttcttccacgtggaggatca

SEQ ID NO: 14376 - DNA, 25 bp, Homo sapien
ccacgtggaggatcagtcagctaca

SEQ ID NO: 14377 - DNA, 25 bp, Homo sapien
ggaggatcagtcagctacaaacaaa

SEQ ID NO: 14378 - DNA, 25 bp, Homo sapien
gtcagctacaaacaaatgtcagtat

SEQ ID NO: 14379 - DNA, 25 bp, Homo sapien
gctgcgcgtcgccaaagtgacaggc

SEQ ID NO: 14380 - DNA, 25 bp, Homo sapien
gcgcgtcgccaaagtgacaggcggt

SEQ ID NO: 14381 - DNA, 25 bp, Homo sapien
ctccaagctctctaagatccgagtc

SEQ ID NO: 14382 - DNA, 25 bp, Homo sapien
attgcccgtgttctcacagttatta

SEQ ID NO: 14383 - DNA, 25 bp, Homo sapien
gcccgtgttctcacagttattaacc

SEQ ID NO: 14384 - DNA, 25 bp, Homo sapien
gttctcacagttattaaccagactc

SEQ ID NO: 14385 - DNA, 25 bp, Homo sapien
gttattaaccagactcagaaagaaa

SEQ ID NO: 14386 - DNA, 25 bp, Homo sapien
gcggcttgtgcagcaatggccaaga

SEQ ID NO: 14387 - DNA, 25 bp, Homo sapien
gcttgtgcagcaatggccaagatca

SEQ ID NO: 14388 - DNA, 25 bp, Homo sapien
atcaaggctcgagatcttcgcggga

SEQ ID NO: 14389 - DNA, 25 bp, Homo sapien
ggctcgagatcttcgcgggaagaag

SEQ ID NO: 14390 - DNA, 25 bp, Homo sapien
tcttcccgtccctgatgacaaagat

SEQ ID NO: 14391 - DNA, 25 bp, Homo sapien
gacaaagatcttgccttacagactt

SEQ ID NO: 14392 - DNA, 25 bp, Homo sapien
tacagactttacaggcttggctttg

SEQ ID NO: 14393 - DNA, 25 bp, Homo sapien
aggcttggctttgagattctgtaac

SEQ ID NO: 14394 - DNA, 25 bp, Homo sapien
gtaactgcagacttcattagcacac

SEQ ID NO: 14395 - DNA, 25 bp, Homo sapien
gagggggctattaacacccagtaca

SEQ ID NO: 14396 - DNA, 25 bp, Homo sapien
cacccagtacagacatatccacaag

SEQ ID NO: 14397 - DNA, 25 bp, Homo sapien
agggctggatcttatcactgccctg

SEQ ID NO: 14398 - DNA, 25 bp, Homo sapien
ttctctgtgccagatcttcagtgcc

SEQ ID NO: 14399 - DNA, 25 bp, Homo sapien
tcagtgcccctttccatacagggat

SEQ ID NO: 14400 - DNA, 25 bp, Homo sapien
gtttttatgacctccttttggtctg

SEQ ID NO: 14401 - DNA, 25 bp, Homo sapien
gagagcgcgtgcagagacttggtgg

SEQ ID NO: 14402 - DNA, 25 bp, Homo sapien
tggcgagatgtgtctctcaatcctg

SEQ ID NO: 14403 - DNA, 25 bp, Homo sapien
tctctcaatcctgtggctttggtga

SEQ ID NO: 14404 - DNA, 25 bp, Homo sapien
gtttttgttcttagataacccacat

SEQ ID NO: 14405 - DNA, 25 bp, Homo sapien
tgaaatgatacttgtactcccccta

SEQ ID NO: 14406 - DNA, 25 bp, Homo sapien
ctttgtcaactgctgtgaatgctgt

SEQ ID NO: 14407 - DNA, 25 bp, Homo sapien
gaatgctgtatggtgtgtgttctct

SEQ ID NO: 14408 - DNA, 25 bp, Homo sapien
ggactgagcttgtggtgtgctttgc

SEQ ID NO: 14409 - DNA, 25 bp, Homo sapien
gcagagttcaccagtgagctcaggt

SEQ ID NO: 14410 - DNA, 25 bp, Homo sapien
gttctaatgtctgttagctacccat

SEQ ID NO: 14411 - DNA, 25 bp, Homo sapien
aagaatgctgtttgctgcagttctg

SEQ ID NO: 14412 - DNA, 25 bp, Homo sapien
aagggttcctgctttcacagaatta

SEQ ID NO: 14413 - DNA, 25 bp, Homo sapien
tcagggtggtgacttcacacgccat

SEQ ID NO: 14414 - DNA, 25 bp, Homo sapien
ggcactggtggcaagtccatctatg

SEQ ID NO: 14415 - DNA, 25 bp, Homo sapien
taaagcatacgggtcctggcatctt

SEQ ID NO: 14416 - DNA, 25 bp, Homo sapien
cctggcatcttgtccatggcaaatg

SEQ ID NO: 14417 - DNA, 25 bp, Homo sapien
ggacccaacacaaatggttcccagt

SEQ ID NO: 14418 - DNA, 25 bp, Homo sapien
gtttttcatctgcactgccaagact

SEQ ID NO: 14419 - DNA, 25 bp, Homo sapien
ggagcgctttgggtccaggaatggc

SEQ ID NO: 14420 - DNA, 25 bp, Homo sapien
tcttaaccaccagatcattccttct

SEQ ID NO: 14421 - DNA, 25 bp, Homo sapien
atcctagaatctttgtgctctcgct

SEQ ID NO: 14422 - DNA, 25 bp, Homo sapien
ctcccatgcctagctggattgcaga

SEQ ID NO: 14423 - DNA, 25 bp, Homo sapien
atttcctcatctttttgttgttgtc

SEQ ID NO: 14424 - DNA, 25 bp, Homo sapien
gaggacaggtcagctgtctggctca

SEQ ID NO: 14425 - DNA, 25 bp, Homo sapien
atgctgtgagtttccaacctcagcc

SEQ ID NO: 14426 - DNA, 25 bp, Homo sapien
gaaggtctagtttgtccatcaccat

SEQ ID NO: 14427 - DNA, 25 bp, Homo sapien
ggtctaggagatctgtcccttttag

SEQ ID NO: 14428 - DNA, 25 bp, Homo sapien
tcccttttagagacaccttacttat

SEQ ID NO: 14429 - DNA, 25 bp, Homo sapien
tttatcatttattaatcctccctgc

SEQ ID NO: 14430 - DNA, 25 bp, Homo sapien
tccctgcctgtgtctattattatat

SEQ ID NO: 14431 - DNA, 25 bp, Homo sapien
tttactgtgcctttgtttttactag

SEQ ID NO: 14432 - DNA, 25 bp, Homo sapien
gtttttactagtgtctgctgttgca

SEQ ID NO: 14433 - DNA, 25 bp, Homo sapien
aacattctctgcctgagttttaatt

SEQ ID NO: 14434 - DNA, 25 bp, Homo sapien
aagttgacatctgacgacgtgaagg

SEQ ID NO: 14435 - DNA, 25 bp, Homo sapien
actggccaagaagggccttactcct

SEQ ID NO: 14436 - DNA, 25 bp, Homo sapien
ccttactccttcacagatcggtgta

SEQ ID NO: 14437 - DNA, 25 bp, Homo sapien
tcttcctgaagatctctaccattta

SEQ ID NO: 14438 - DNA, 25 bp, Homo sapien
gatgctaaattccgtctgattctaa

SEQ ID NO: 14439 - DNA, 25 bp, Homo sapien
gccatcatgggtcgcatgcatgctc

SEQ ID NO: 14440 - DNA, 25 bp, Homo sapien
tagagagccggattcaccgtttggc

SEQ ID NO: 14441 - DNA, 25 bp, Homo sapien
ttcaccgtttggctcgatattataa

SEQ ID NO: 14442 - DNA, 25 bp, Homo sapien
ttataagaccaagcgagtcctccct

SEQ ID NO: 14443 - DNA, 25 bp, Homo sapien
aatatgaatcatctacagcctctgc

SEQ ID NO: 14444 - DNA, 25 bp, Homo sapien
cctctgccctggtcgcataaatttg

SEQ ID NO: 14445 - DNA, 25 bp, Homo sapien
aaggcacggaaggctatgtccaaac

SEQ ID NO: 14446 - DNA, 25 bp, Homo sapien
atgtccaaactgggtcttcggcagg

SEQ ID NO: 14447 - DNA, 25 bp, Homo sapien
gtcttcggcaggttacaggagttac

SEQ ID NO: 14448 - DNA, 25 bp, Homo sapien
ggagttactagagtcactatccgga

SEQ ID NO: 14449 - DNA, 25 bp, Homo sapien
accagatgtctacaagagccctgct

SEQ ID NO: 14450 - DNA, 25 bp, Homo sapien
gagccctgcttcagatacttacata

SEQ ID NO: 14451 - DNA, 25 bp, Homo sapien
cgaagatttatcccagcaagcacaa

SEQ ID NO: 14452 - DNA, 25 bp, Homo sapien
gcaagcacaactagcagctgctgag

SEQ ID NO: 14453 - DNA, 25 bp, Homo sapien
gcagtccgagccctgaagaacaaca

SEQ ID NO: 14454 - DNA, 25 bp, Homo sapien
ggaagcaactttttttggtgtctca

SEQ ID NO: 14455 - DNA, 25 bp, Homo sapien
aaggagtaactgcagcttggtttga

SEQ ID NO: 14456 - DNA, 25 bp, Homo sapien
ctggtggcgacacgatctttgggaa

SEQ ID NO: 14457 - DNA, 25 bp, Homo sapien
ttttgaggatgaccggtgccttgct

SEQ ID NO: 14458 - DNA, 25 bp, Homo sapien
ctcaagcaccaacacattttctggt

SEQ ID NO: 14459 - DNA, 25 bp, Homo sapien
acacattttctggtgatacccaaga

SEQ ID NO: 14460 - DNA, 25 bp, Homo sapien
acccaagaaacatatatcccagatt

SEQ ID NO: 14461 - DNA, 25 bp, Homo sapien
agaaatgtgctgctgatctgggcct

SEQ ID NO: 14462 - DNA, 25 bp, Homo sapien
gatctgggcctgaataagggttatc

SEQ ID NO: 14463 - DNA, 25 bp, Homo sapien
atgaaggttcagatggtggacagtc

SEQ ID NO: 14464 - DNA, 25 bp, Homo sapien
atgttcttggaggtcggcaaatgca

SEQ ID NO: 14465 - DNA, 25 bp, Homo sapien
caaatgcattggcctcctggttaag

SEQ ID NO: 14466 - DNA, 25 bp, Homo sapien
tcctggttaagcacgttttggggat

SEQ ID NO: 14467 - DNA, 25 bp, Homo sapien
cagagctcagaatccaggagcaggg

SEQ ID NO: 14468 - DNA, 25 bp, Homo sapien
gggcctccagcaagaccagggaaga

SEQ ID NO: 14469 - DNA, 25 bp, Homo sapien
cagggaagaaacagccctcttgggt

SEQ ID NO: 14470 - DNA, 25 bp, Homo sapien
ccccaggaagggtcccaggagctgc

SEQ ID NO: 14471 - DNA, 25 bp, Homo sapien
caggagctgcaagcaggccaggatc

SEQ ID NO: 14472 - DNA, 25 bp, Homo sapien
tgcaagcaggccaggatcagagtga

SEQ ID NO: 14473 - DNA, 25 bp, Homo sapien
aagcaggccaggatcagagtgagct

SEQ ID NO: 14474 - DNA, 25 bp, Homo sapien
ggttgctgccttcctgggttcctga

SEQ ID NO: 14475 - DNA, 25 bp, Homo sapien
agctgggctccggaaaggagatcaa

SEQ ID NO: 14476 - DNA, 25 bp, Homo sapien
ctccggaaaggagatcaagggccag

SEQ ID NO: 14477 - DNA, 25 bp, Homo sapien
ctgagagctgccaggccgggcatgg

SEQ ID NO: 14478 - DNA, 25 bp, Homo sapien
gagcgttacaagcgcacctttgacc

SEQ ID NO: 14479 - DNA, 25 bp, Homo sapien
ctggctccgcaacggtagcagtggg

SEQ ID NO: 14480 - DNA, 25 bp, Homo sapien
agcagtgggtggctcaagggccagc

SEQ ID NO: 14481 - DNA, 25 bp, Homo sapien
cgctgctctttctgtaggttattta

SEQ ID NO: 14482 - DNA, 25 bp, Homo sapien
aggcgaaggctgggagtgtctttcc

SEQ ID NO: 14483 - DNA, 25 bp, Homo sapien
tggtggggaggacatctggtttgag

SEQ ID NO: 14484 - DNA, 25 bp, Homo sapien
gtcagagatctgtgcacacttttta

SEQ ID NO: 14485 - DNA, 25 bp, Homo sapien
gagcctattgtgttacttgacctta

SEQ ID NO: 14486 - DNA, 25 bp, Homo sapien
gaaccaggggtatgtcatcactttt

SEQ ID NO: 14487 - DNA, 25 bp, Homo sapien
cttttttcatatcaagtcctcaccc

SEQ ID NO: 14488 - DNA, 25 bp, Homo sapien
cctccttccacataatgctttatcc

SEQ ID NO: 14489 - DNA, 25 bp, Homo sapien
ctgctgctactcagactagctctaa

SEQ ID NO: 14490 - DNA, 25 bp, Homo sapien
aatctaatcccttagcatcagctcc

SEQ ID NO: 14491 - DNA, 25 bp, Homo sapien
tcagtggtacatgcgtcaagatttg

SEQ ID NO: 14492 - DNA, 25 bp, Homo sapien
cagtaataactgcaggtcacttgta

SEQ ID NO: 14493 - DNA, 25 bp, Homo sapien
gaggtagccgaagtttggttcagta

SEQ ID NO: 14494 - DNA, 25 bp, Homo sapien
gcagggaatacagtcgttccatcag

SEQ ID NO: 14495 - DNA, 25 bp, Homo sapien
gtcgttccatcagagctggtctgca

SEQ ID NO: 14496 - DNA, 25 bp, Homo sapien
cacactcacattatcttgctatcac

SEQ ID NO: 14497 - DNA, 25 bp, Homo sapien
atcttgctatcactgtaaccaacta

SEQ ID NO: 14498 - DNA, 25 bp, Homo sapien
tccctttgcctgtggtgtaaaagtg

SEQ ID NO: 14499 - DNA, 25 bp, Homo sapien
ctttttaacaagaactgatgctcct

SEQ ID NO: 14500 - DNA, 25 bp, Homo sapien
aactcgaggactgtatttgtgacta

SEQ ID NO: 14501 - DNA, 25 bp, Homo sapien
ggttattttagtttctgttctgtgg

SEQ ID NO: 14502 - DNA, 25 bp, Homo sapien
ttgcaccccatgctgttgattgcta

SEQ ID NO: 14503 - DNA, 25 bp, Homo sapien
gtaacagtctgatcgtgacgctgaa

SEQ ID NO: 14504 - DNA, 25 bp, Homo sapien
agttagtctactcttaagccatctt

SEQ ID NO: 14505 - DNA, 25 bp, Homo sapien
gccatcttggtaaatttccccaaca

SEQ ID NO: 14506 - DNA, 25 bp, Homo sapien
gaattccttcagggtgatgccaggt

SEQ ID NO: 14507 - DNA, 25 bp, Homo sapien
aagccattgtcttcggaaaccttgg

SEQ ID NO: 14508 - DNA, 25 bp, Homo sapien
ctgatagttactgttgtgacctgaa

SEQ ID NO: 14509 - DNA, 25 bp, Homo sapien
gtgattgttggcacatcctatgcaa

SEQ ID NO: 14510 - DNA, 25 bp, Homo sapien
gaagcttgtgtatccattatcatgt

SEQ ID NO: 14511 - DNA, 25 bp, Homo sapien
gatgaagctgcagaaccaacgaggt

SEQ ID NO: 14512 - DNA, 25 bp, Homo sapien
gctgcagaaccaacgaggtggccga

SEQ ID NO: 14513 - DNA, 25 bp, Homo sapien
gaaccaacgaggtggccgaatcttc

SEQ ID NO: 14514 - DNA, 25 bp, Homo sapien
accaacgaggtggccgaatcttcct

SEQ ID NO: 14515 - DNA, 25 bp, Homo sapien
tggccgaatcttccttcaggatatc

SEQ ID NO: 14516 - DNA, 25 bp, Homo sapien
gactgtgatgactgggagagcgggc

SEQ ID NO: 14517 - DNA, 25 bp, Homo sapien
tgtgatgactgggagagcgggctga

SEQ ID NO: 14518 - DNA, 25 bp, Homo sapien
tgactgggagagcgggctgaatgca

SEQ ID NO: 14519 - DNA, 25 bp, Homo sapien
ccacgtgaccaacttgcgcaagatg

SEQ ID NO: 14520 - DNA, 25 bp, Homo sapien
acttgcgcaagatgggagcgcccga

SEQ ID NO: 14521 - DNA, 25 bp, Homo sapien
ttgcgcaagatgggagcgcccgaat

SEQ ID NO: 14522 - DNA, 25 bp, Homo sapien
gagccaccatgtcccgtcagggatg

SEQ ID NO: 14523 - DNA, 25 bp, Homo sapien
caccatgtcccgtcagggatgattt

SEQ ID NO: 14524 - DNA, 25 bp, Homo sapien
ccatgtcccgtcagggatgatttta

SEQ ID NO: 14525 - DNA, 25 bp, Homo sapien
ttttctaacacaaaacctctcctct

SEQ ID NO: 14526 - DNA, 25 bp, Homo sapien
cctgtagcctcatttcctatatagt

SEQ ID NO: 14527 - DNA, 25 bp, Homo sapien
ttcatactgattatctctgaagaca

SEQ ID NO: 14528 - DNA, 25 bp, Homo sapien
atctctgaagacattgccaggtcgt

SEQ ID NO: 14529 - DNA, 25 bp, Homo sapien
gaagacattgccaggtcgtttttgt

SEQ ID NO: 14530 - DNA, 25 bp, Homo sapien
gacattgccaggtcgtttttgtttg

SEQ ID NO: 14531 - DNA, 25 bp, Homo sapien
gggcatgcctccacacctagctaat

SEQ ID NO: 14532 - DNA, 25 bp, Homo sapien
ccagccgacattcccaggttttctt

SEQ ID NO: 14533 - DNA, 25 bp, Homo sapien
ttaaacatttggttctggatacatg

SEQ ID NO: 14534 - DNA, 25 bp, Homo sapien
catttggttctggatacatgttgaa

SEQ ID NO: 14535 - DNA, 25 bp, Homo sapien
ttggttctggatacatgttgaactt

SEQ ID NO: 14536 - DNA, 25 bp, Homo sapien
ttctggatacatgttgaacttagtt

SEQ ID NO: 14537 - DNA, 25 bp, Homo sapien
ggatacatgttgaacttagttgaat

SEQ ID NO: 14538 - DNA, 25 bp, Homo sapien
aaaagtgtgtttaccatactgtata

SEQ ID NO: 14539 - DNA, 25 bp, Homo sapien
aagtgtgtttaccatactgtataat

SEQ ID NO: 14540 - DNA, 25 bp, Homo sapien
gtgtgtttaccatactgtataattc

SEQ ID NO: 14541 - DNA, 25 bp, Homo sapien
gtttaccatactgtataattccatt

SEQ ID NO: 14542 - DNA, 25 bp, Homo sapien
atttacatgaagcatccagaaaaga

SEQ ID NO: 14543 - DNA, 25 bp, Homo sapien
ttacatgaagcatccagaaaagata

SEQ ID NO: 14544 - DNA, 25 bp, Homo sapien
aagtttaattttcagctcctctgtt

SEQ ID NO: 14545 - DNA, 25 bp, Homo sapien
tttcagctcctctgttggacatata

SEQ ID NO: 14546 - DNA, 25 bp, Homo sapien
tggacatataagtgcatctcttgtt

SEQ ID NO: 14547 - DNA, 25 bp, Homo sapien
agtgcatctcttgttggacataggc

SEQ ID NO: 14548 - DNA, 25 bp, Homo sapien
tctggtgatttcttgatggtttgga

SEQ ID NO: 14549 - DNA, 25 bp, Homo sapien
ggtttggaagtctattgctgggaag

SEQ ID NO: 14550 - DNA, 25 bp, Homo sapien
gaaattccatcatacatattcatgc

SEQ ID NO: 14551 - DNA, 25 bp, Homo sapien
aagaactaaggtggggagcagtact

SEQ ID NO: 14552 - DNA, 25 bp, Homo sapien
cagaattctgattggcagcaagttt

SEQ ID NO: 14553 - DNA, 25 bp, Homo sapien
gtcaatttgctctagtgtcttatta

SEQ ID NO: 14554 - DNA, 25 bp, Homo sapien
tttctctgttgtatgttggattatg

SEQ ID NO: 14555 - DNA, 25 bp, Homo sapien
acaattgaggatttccacaacacgt

SEQ ID NO: 14556 - DNA, 25 bp, Homo sapien
agcgcgagagcaagttcttcgagca

SEQ ID NO: 14557 - DNA, 25 bp, Homo sapien
gttcttcgagcacttcatcgagggt

SEQ ID NO: 14558 - DNA, 25 bp, Homo sapien
ttcatcgagggtggacggactgtca

SEQ ID NO: 14559 - DNA, 25 bp, Homo sapien
gactgtcaaggagttctgccagcag

SEQ ID NO: 14560 - DNA, 25 bp, Homo sapien
agcaggaggtggagcccatgtgcaa

SEQ ID NO: 14561 - DNA, 25 bp, Homo sapien
gagcccatgtgcaaggagagcgacc

SEQ ID NO: 14562 - DNA, 25 bp, Homo sapien
tcagcgtgtccatccaggtggagta

SEQ ID NO: 14563 - DNA, 25 bp, Homo sapien
cctggacactacgatatcctctaca

SEQ ID NO: 14564 - DNA, 25 bp, Homo sapien
ctctacaaatagggctggctccagc

SEQ ID NO: 14565 - DNA, 25 bp, Homo sapien
gccaggcgctagacatgtacagagg

SEQ ID NO: 14566 - DNA, 25 bp, Homo sapien
tggagacccctgaactcattgagct

SEQ ID NO: 14567 - DNA, 25 bp, Homo sapien
cggaagtgagacacctcagctcttc

SEQ ID NO: 14568 - DNA, 25 bp, Homo sapien
aacagccactgttggaggggccatg

SEQ ID NO: 14569 - DNA, 25 bp, Homo sapien
gacatgtccacggttatgagccgga

SEQ ID NO: 14570 - DNA, 25 bp, Homo sapien
tgagccggaagggcccggctcctga

SEQ ID NO: 14571 - DNA, 25 bp, Homo sapien
ggctcctgagctgcaaggtgtggaa

SEQ ID NO: 14572 - DNA, 25 bp, Homo sapien
gcgctggcgcctgaagagttggagc

SEQ ID NO: 14573 - DNA, 25 bp, Homo sapien
agttggagctggatcctatggccat

SEQ ID NO: 14574 - DNA, 25 bp, Homo sapien
ttttttggccctacgtctggatgcc

SEQ ID NO: 14575 - DNA, 25 bp, Homo sapien
ctggatgcctgggcttcacacaaga

SEQ ID NO: 14576 - DNA, 25 bp, Homo sapien
ccgcagttcccaaggacttgtcatt

SEQ ID NO: 14577 - DNA, 25 bp, Homo sapien
attttccgtcttatttcatttctgt

SEQ ID NO: 14578 - DNA, 25 bp, Homo sapien
ttttccgtcttatttcatttctgta

SEQ ID NO: 14579 - DNA, 25 bp, Homo sapien
tgcagagtgagaactttccctaccg

SEQ ID NO: 14580 - DNA, 25 bp, Homo sapien
aaatgttgtccaggttctattgcca

SEQ ID NO: 14581 - DNA, 25 bp, Homo sapien
tgttgtccaggttctattgccaaga

SEQ ID NO: 14582 - DNA, 25 bp, Homo sapien
gtccaggttctattgccaagaatgt

SEQ ID NO: 14583 - DNA, 25 bp, Homo sapien
gccaagaatgtgttgtccaaaatgc

SEQ ID NO: 14584 - DNA, 25 bp, Homo sapien
aaagatggaactccaccctttgctt

SEQ ID NO: 14585 - DNA, 25 bp, Homo sapien
aagtggaagccaaattcatcaatta

SEQ ID NO: 14586 - DNA, 25 bp, Homo sapien
gatgactgaccaagaggctattcaa

SEQ ID NO: 14587 - DNA, 25 bp, Homo sapien
caagaggctattcaagatctctggc

SEQ ID NO: 14588 - DNA, 25 bp, Homo sapien
agtccctgaatggaagtatgacgtt

SEQ ID NO: 14589 - DNA, 25 bp, Homo sapien
gtatgacgttgggtccctctgaagt

SEQ ID NO: 14590 - DNA, 25 bp, Homo sapien
gggtccctctgaagtttaattctga

SEQ ID NO: 14591 - DNA, 25 bp, Homo sapien
gaagtttaattctgagttctcatta

SEQ ID NO: 14592 - DNA, 25 bp, Homo sapien
agaaatttgctttcattgttttatt

SEQ ID NO: 14593 - DNA, 25 bp, Homo sapien
ggaagagctcgtggaagaggtggtg

SEQ ID NO: 14594 - DNA, 25 bp, Homo sapien
gagtggttatgggaaggtatccagg

SEQ ID NO: 14595 - DNA, 25 bp, Homo sapien
ggtggtcatcaaaatagctacaaac

SEQ ID NO: 14596 - DNA, 25 bp, Homo sapien
tattccatttgcaacttatccccaa

SEQ ID NO: 14597 - DNA, 25 bp, Homo sapien
aggtggtgaagcagtattttccaat

SEQ ID NO: 14598 - DNA, 25 bp, Homo sapien
aattttttgtatcaagtccctgaat

SEQ ID NO: 14599 - DNA, 25 bp, Homo sapien
agggctttgagcccgcagacaacaa

SEQ ID NO: 14600 - DNA, 25 bp, Homo sapien
gtctgttaagagctaccgatgggaa

SEQ ID NO: 14601 - DNA, 25 bp, Homo sapien
gatcagcactgtggtgagctccaag

SEQ ID NO: 14602 - DNA, 25 bp, Homo sapien
cagatggcttattcaaacctcctta

SEQ ID NO: 14603 - DNA, 25 bp, Homo sapien
gcaacagcagcacagtaaagggcat

SEQ ID NO: 14604 - DNA, 25 bp, Homo sapien
aaagggcatacatttcctgctttca

SEQ ID NO: 14605 - DNA, 25 bp, Homo sapien
cctgctttcaccaattaaccactga

SEQ ID NO: 14606 - DNA, 25 bp, Homo sapien
cagatagctaggtttctggttcccc

SEQ ID NO: 14607 - DNA, 25 bp, Homo sapien
ttttgcatttggctaattggtctgt

SEQ ID NO: 14608 - DNA, 25 bp, Homo sapien
gcatggttatatactcctggattat

SEQ ID NO: 14609 - DNA, 25 bp, Homo sapien
aaagtctctgtagacatctctgtga

SEQ ID NO: 14610 - DNA, 25 bp, Homo sapien
cgatgatctggcagacctcagctgc

SEQ ID NO: 14611 - DNA, 25 bp, Homo sapien
agctgcctggtttaccgagctgata

SEQ ID NO: 14612 - DNA, 25 bp, Homo sapien
gctgatacccagacataccagcctt

SEQ ID NO: 14613 - DNA, 25 bp, Homo sapien
tcggcaggcccaacaggctgggaaa

SEQ ID NO: 14614 - DNA, 25 bp, Homo sapien
catagtaatcctgtttccactttgt

SEQ ID NO: 14615 - DNA, 25 bp, Homo sapien
gaggatcttgttcaatcggaaaccc

SEQ ID NO: 14616 - DNA, 25 bp, Homo sapien
gttgttcttcgtcacttaatgttgg

SEQ ID NO: 14617 - DNA, 25 bp, Homo sapien
cttaatgttggttccagtccttcaa

SEQ ID NO: 14618 - DNA, 25 bp, Homo sapien
agtccttcaactgttcatatctact

SEQ ID NO: 14619 - DNA, 25 bp, Homo sapien
ttcacatactaacccttcttcaaga

SEQ ID NO: 14620 - DNA, 25 bp, Homo sapien
tgcagtttagccatgtcctcaagat

SEQ ID NO: 14621 - DNA, 25 bp, Homo sapien
cagatctttcacaaccatcatatcc

SEQ ID NO: 14622 - DNA, 25 bp, Homo sapien
aaaactgcacacatcatcttttacc

SEQ ID NO: 14623 - DNA, 25 bp, Homo sapien
tacctccacccattattgcatactt

SEQ ID NO: 14624 - DNA, 25 bp, Homo sapien
gcatactttcattaatggtctcact

SEQ ID NO: 14625 - DNA, 25 bp, Homo sapien
tggtctcactagctacctaactggt

SEQ ID NO: 14626 - DNA, 25 bp, Homo sapien
cagaaatcctgtggtcctattgctc

SEQ ID NO: 14627 - DNA, 25 bp, Homo sapien
atctggcttaaatacagctcttgga

SEQ ID NO: 14628 - DNA, 25 bp, Homo sapien
gctcttggactgcttaactggtatt

SEQ ID NO: 14629 - DNA, 25 bp, Homo sapien
gcttaactggtattctttggcatgt

SEQ ID NO: 14630 - DNA, 25 bp, Homo sapien
tgatcttcaagttcctcttctataa

SEQ ID NO: 14631 - DNA, 25 bp, Homo sapien
gtgacgctatgatgtagtcccagtt

SEQ ID NO: 14632 - DNA, 25 bp, Homo sapien
ggcacctggggctcatggattggcc

SEQ ID NO: 14633 - DNA, 25 bp, Homo sapien
tggggctcatggattggccccgacc

SEQ ID NO: 14634 - DNA, 25 bp, Homo sapien
cccgaccacgacaagttcagtgcca

SEQ ID NO: 14635 - DNA, 25 bp, Homo sapien
atgagcaaggcacgggctgctggca

SEQ ID NO: 14636 - DNA, 25 bp, Homo sapien
gcgcctcctgtgcgggaaagagacc

SEQ ID NO: 14637 - DNA, 25 bp, Homo sapien
gaaagagaccatggtgaccagcacc

SEQ ID NO: 14638 - DNA, 25 bp, Homo sapien
tcgctgcgagtacctcatggagctg

SEQ ID NO: 14639 - DNA, 25 bp, Homo sapien
cccaccgaagacgaccatgacgagc

SEQ ID NO: 14640 - DNA, 25 bp, Homo sapien
aagacgaccatgacgagctctagct

SEQ ID NO: 14641 - DNA, 25 bp, Homo sapien
gagctctagctggatgggcgcagag

SEQ ID NO: 14642 - DNA, 25 bp, Homo sapien
ggatgggcgcagagaacctcaagaa

SEQ ID NO: 14643 - DNA, 25 bp, Homo sapien
ttccccatgggaagacgaggccctc

SEQ ID NO: 14644 - DNA, 25 bp, Homo sapien
cccatgggaagacgaggccctcggg

SEQ ID NO: 14645 - DNA, 25 bp, Homo sapien
catgggaagacgaggccctcgggcc

SEQ ID NO: 14646 - DNA, 25 bp, Homo sapien
cccccacagtgctgtctgatctgtg

SEQ ID NO: 14647 - DNA, 25 bp, Homo sapien
acagtgctgtctgatctgtgctttc

SEQ ID NO: 14648 - DNA, 25 bp, Homo sapien
tgctgtctgatctgtgctttccagc

SEQ ID NO: 14649 - DNA, 25 bp, Homo sapien
ctagtaagtgccttccatgtcggcc

SEQ ID NO: 14650 - DNA, 25 bp, Homo sapien
cccagacccagtggggaggcggacg

SEQ ID NO: 14651 - DNA, 25 bp, Homo sapien
cagacccagtggggaggcggacgtt

SEQ ID NO: 14652 - DNA, 25 bp, Homo sapien
ggtggcaggtggaggtgtcaggctg

SEQ ID NO: 14653 - DNA, 25 bp, Homo sapien
caggtggaggtgtcaggctgctggc

SEQ ID NO: 14654 - DNA, 25 bp, Homo sapien
attctactccgatgatcggctgaat

SEQ ID NO: 14655 - DNA, 25 bp, Homo sapien
ctccgaaccttcagctttttgggct

SEQ ID NO: 14656 - DNA, 25 bp, Homo sapien
gaaccttcagctttttgggctttga

SEQ ID NO: 14657 - DNA, 25 bp, Homo sapien
ttcatggcctacacgttcgagagag

SEQ ID NO: 14658 - DNA, 25 bp, Homo sapien
ggcctacacgttcgagagagagtct

SEQ ID NO: 14659 - DNA, 25 bp, Homo sapien
gttcgagagagagtcttcgggagag

SEQ ID NO: 14660 - DNA, 25 bp, Homo sapien
tgggtaggaaccgtagactcgctca

SEQ ID NO: 14661 - DNA, 25 bp, Homo sapien
gggtttgtccgcatgttgtaatcgt

SEQ ID NO: 14662 - DNA, 25 bp, Homo sapien
ttgtccgcatgttgtaatcgtgcaa

SEQ ID NO: 14663 - DNA, 25 bp, Homo sapien
aatcgtgcaaataaacgctcactcc

SEQ ID NO: 14664 - DNA, 25 bp, Homo sapien
attagcggtgtatttcttgaagttt

SEQ ID NO: 14665 - DNA, 25 bp, Homo sapien
gggtactgaccatcagtgtcagcat

SEQ ID NO: 14666 - DNA, 25 bp, Homo sapien
gtgtcagcattagggttttggtttt

SEQ ID NO: 14667 - DNA, 25 bp, Homo sapien
ttggcacatgtgaatcttgttttgt

SEQ ID NO: 14668 - DNA, 25 bp, Homo sapien
aaattactttctcttgttctctgat

SEQ ID NO: 14669 - DNA, 25 bp, Homo sapien
tttctcttgttctctgatgatgggt

SEQ ID NO: 14670 - DNA, 25 bp, Homo sapien
gatgatccaggattatgttgtgact

SEQ ID NO: 14671 - DNA, 25 bp, Homo sapien
taaaccatacttccaccttgggtga

SEQ ID NO: 14672 - DNA, 25 bp, Homo sapien
gggtgagaacacttgcaacagttta

SEQ ID NO: 14673 - DNA, 25 bp, Homo sapien
ggtgactttcaccttaggacaactg

SEQ ID NO: 14674 - DNA, 25 bp, Homo sapien
aggacaactgttgcatgccaagttt

SEQ ID NO: 14675 - DNA, 25 bp, Homo sapien
ttggttgtatctaatatgccccagg

SEQ ID NO: 14676 - DNA, 25 bp, Homo sapien
gacatgatcaagaatgaggctctgg

SEQ ID NO: 14677 - DNA, 25 bp, Homo sapien
ctgaggtgccatagaggaggctact

SEQ ID NO: 14678 - DNA, 25 bp, Homo sapien
agacagcaaggaaccaagaagccag

SEQ ID NO: 14679 - DNA, 25 bp, Homo sapien
aatattcatggctagtgacgtcacc

SEQ ID NO: 14680 - DNA, 25 bp, Homo sapien
gtgacgtcaccaagtgtgattttta

SEQ ID NO: 14681 - DNA, 25 bp, Homo sapien
gagaggaaaactgtgagccaccagc

SEQ ID NO: 14682 - DNA, 25 bp, Homo sapien
tgtgagccaccagccaaaggtttag

SEQ ID NO: 14683 - DNA, 25 bp, Homo sapien
cagccaaaggtttagcattgctaga

SEQ ID NO: 14684 - DNA, 25 bp, Homo sapien
gataatatccagagcatgagagcct

SEQ ID NO: 14685 - DNA, 25 bp, Homo sapien
agcatgagagcctcagtggagcaag

SEQ ID NO: 14686 - DNA, 25 bp, Homo sapien
atacaggaagacaaggtcgggtgca

SEQ ID NO: 14687 - DNA, 25 bp, Homo sapien
aggagggctcactcaaagcctcctg

SEQ ID NO: 14688 - DNA, 25 bp, Homo sapien
caaagcctcctgcctatacgggcag

SEQ ID NO: 14689 - DNA, 25 bp, Homo sapien
agctccccaagttccaggacggaga

SEQ ID NO: 14690 - DNA, 25 bp, Homo sapien
cgcacccttgggctctatgggaagg

SEQ ID NO: 14691 - DNA, 25 bp, Homo sapien
tctacaccaactatgaggcgggcaa

SEQ ID NO: 14692 - DNA, 25 bp, Homo sapien
gaggcgggcaaggatgactatgtga

SEQ ID NO: 14693 - DNA, 25 bp, Homo sapien
tatgtgaaggcactgcccgggcaac

SEQ ID NO: 14694 - DNA, 25 bp, Homo sapien
ggcaactgaagccttttgagaccct

SEQ ID NO: 14695 - DNA, 25 bp, Homo sapien
tgctgtcccagaaccagggaggcaa

SEQ ID NO: 14696 - DNA, 25 bp, Homo sapien
gctgctgatccatgaggtcctagcc

SEQ ID NO: 14697 - DNA, 25 bp, Homo sapien
cctgctctcagcatatgtggggcgc

SEQ ID NO: 14698 - DNA, 25 bp, Homo sapien
acgaccgcgccggtggagatgatac

SEQ ID NO: 14699 - DNA, 25 bp, Homo sapien
gagatgatacccgagacaacagaat

SEQ ID NO: 14700 - DNA, 25 bp, Homo sapien
agactccaactctgcagctccataa

SEQ ID NO: 14701 - DNA, 25 bp, Homo sapien
tgcagctccataaatcccgctgggt

SEQ ID NO: 14702 - DNA, 25 bp, Homo sapien
aaatcccgctgggtcctcgcaaatt

SEQ ID NO: 14703 - DNA, 25 bp, Homo sapien
ctcgcaaattccctggctgataaca

SEQ ID NO: 14704 - DNA, 25 bp, Homo sapien
ggctgataacagtaccggcaaccaa

SEQ ID NO: 14705 - DNA, 25 bp, Homo sapien
tacagtggaatactgtgcagccatt

SEQ ID NO: 14706 - DNA, 25 bp, Homo sapien
tactgtgcagccattaagacgaaca

SEQ ID NO: 14707 - DNA, 25 bp, Homo sapien
atatgcactaatgtagggtgacttc

SEQ ID NO: 14708 - DNA, 25 bp, Homo sapien
taaaaacagcgttgggccggttgcg

SEQ ID NO: 14709 - DNA, 25 bp, Homo sapien
atatgcctgttagaccttagctgtg

SEQ ID NO: 14710 - DNA, 25 bp, Homo sapien
gctgtggggttcctttactattggg

SEQ ID NO: 14711 - DNA, 25 bp, Homo sapien
tttgcttcctagctgatgtcatccc

SEQ ID NO: 14712 - DNA, 25 bp, Homo sapien
ggtgggaccagtgtgtctgtcatga

SEQ ID NO: 14713 - DNA, 25 bp, Homo sapien
tgaaaccactaactgcattcctgac

SEQ ID NO: 14714 - DNA, 25 bp, Homo sapien
ggaaggtcttcagttgagctctcag

SEQ ID NO: 14715 - DNA, 25 bp, Homo sapien
cttgctgggcatgcttcgtagaggg

SEQ ID NO: 14716 - DNA, 25 bp, Homo sapien
tcatgtgcacatgccgttgcagcac

SEQ ID NO: 14717 - DNA, 25 bp, Homo sapien
agcacaagcttatgcttcccgtagc

SEQ ID NO: 14718 - DNA, 25 bp, Homo sapien
ccgtagccgtggcttttcattctgc

SEQ ID NO: 14719 - DNA, 25 bp, Homo sapien
gtcacctgcagatttctcgtgggaa

SEQ ID NO: 14720 - DNA, 25 bp, Homo sapien
gttgaggggggatcaagttgcagaa

SEQ ID NO: 14721 - DNA, 25 bp, Homo sapien
cataaaactcagtactatctattgg

SEQ ID NO: 14722 - DNA, 25 bp, Homo sapien
gaaggatacagaccaaactcttgat

SEQ ID NO: 14723 - DNA, 25 bp, Homo sapien
aactcttgatagtggtcacctgtga

SEQ ID NO: 14724 - DNA, 25 bp, Homo sapien
taaaggggacttcagctttttatat

SEQ ID NO: 14725 - DNA, 25 bp, Homo sapien
gatactgattgattctggattgtgg

SEQ ID NO: 14726 - DNA, 25 bp, Homo sapien
ggtatagggatatcttgtcttattt

SEQ ID NO: 14727 - DNA, 25 bp, Homo sapien
gaggatgggaatgctgtatctgtgg

SEQ ID NO: 14728 - DNA, 25 bp, Homo sapien
gtcatgttatactggattcatttcc

SEQ ID NO: 14729 - DNA, 25 bp, Homo sapien
atggatggacttgctctctatgtaa

SEQ ID NO: 14730 - DNA, 25 bp, Homo sapien
ggacttgctctctatgtaatatgaa

SEQ ID NO: 14731 - DNA, 25 bp, Homo sapien
ggttttgtttgctatcttaattttg

SEQ ID NO: 14732 - DNA, 25 bp, Homo sapien
attttggttgtattctttgatgtta

SEQ ID NO: 14733 - DNA, 25 bp, Homo sapien
ataattgtatcgtatagctgtattg

SEQ ID NO: 14734 - DNA, 25 bp, Homo sapien
agctgtattgaatcatgtagtatca

SEQ ID NO: 14735 - DNA, 25 bp, Homo sapien
aatactgccagatgctgatgttcag

SEQ ID NO: 14736 - DNA, 25 bp, Homo sapien
gatgttcagtgtaatttctttgcct

SEQ ID NO: 14737 - DNA, 25 bp, Homo sapien
tttctttgcctgttcagttacagaa

SEQ ID NO: 14738 - DNA, 25 bp, Homo sapien
gttacagaaagtggtgctcagttgt

SEQ ID NO: 14739 - DNA, 25 bp, Homo sapien
ggtgctcagttgtagaatgtattgt

SEQ ID NO: 14740 - DNA, 25 bp, Homo sapien
gtattgtaccttttaacacctgatg

SEQ ID NO: 14741 - DNA, 25 bp, Homo sapien
acacctgatgtgtacatcccatgta

SEQ ID NO: 14742 - DNA, 25 bp, Homo sapien
ccttcgtccggcgagagctaggccg

SEQ ID NO: 14743 - DNA, 25 bp, Homo sapien
ttcgtccggcgagagctaggccgag

SEQ ID NO: 14744 - DNA, 25 bp, Homo sapien
cgtccggcgagagctaggccgagga

SEQ ID NO: 14745 - DNA, 25 bp, Homo sapien
tccggcgagagctaggccgaggacc

SEQ ID NO: 14746 - DNA, 25 bp, Homo sapien
cggcgagagctaggccgaggacccg

SEQ ID NO: 14747 - DNA, 25 bp, Homo sapien
gaaagagcgagagaaggggaaagac

SEQ ID NO: 14748 - DNA, 25 bp, Homo sapien
gggaaagacaagtcgggagaggccg

SEQ ID NO: 14749 - DNA, 25 bp, Homo sapien
gacaagtcgggagaggccggtaggc

SEQ ID NO: 14750 - DNA, 25 bp, Homo sapien
gaggccggtaggcgtgaggcgggcc

SEQ ID NO: 14751 - DNA, 25 bp, Homo sapien
aggccggtaggcgtgaggcgggcct

SEQ ID NO: 14752 - DNA, 25 bp, Homo sapien
ggtaggcgtgaggcgggcctgaagc

SEQ ID NO: 14753 - DNA, 25 bp, Homo sapien
gccccagagaaactgccacatacac

SEQ ID NO: 14754 - DNA, 25 bp, Homo sapien
gctccattcactcccaggtgagaat

SEQ ID NO: 14755 - DNA, 25 bp, Homo sapien
ggcaaacgtccacaaaggtcacagg

SEQ ID NO: 14756 - DNA, 25 bp, Homo sapien
aggtcacaggcagcgtacatacggt

SEQ ID NO: 14757 - DNA, 25 bp, Homo sapien
catacggttctgttataccccatat

SEQ ID NO: 14758 - DNA, 25 bp, Homo sapien
tattaccccttcatgtcctaaagaa

SEQ ID NO: 14759 - DNA, 25 bp, Homo sapien
aaatcttgtgttaacttgcctccat

SEQ ID NO: 14760 - DNA, 25 bp, Homo sapien
ggaatgacccttttgtgtctatgat

SEQ ID NO: 14761 - DNA, 25 bp, Homo sapien
cacagcttttcttgataggcctagt

SEQ ID NO: 14762 - DNA, 25 bp, Homo sapien
tgacagtagctcttagactcgccta

SEQ ID NO: 14763 - DNA, 25 bp, Homo sapien
ggtgtactgtgtttgatttgtctca

SEQ ID NO: 14764 - DNA, 25 bp, Homo sapien
gaaaagtttgctgggtctgctggct

SEQ ID NO: 14765 - DNA, 25 bp, Homo sapien
ggctgggaaggcacagaatcgctga

SEQ ID NO: 14766 - DNA, 25 bp, Homo sapien
aaagcagctgggagatttctttggc

SEQ ID NO: 14767 - DNA, 25 bp, Homo sapien
agttatgcagagtgctacccagcca

SEQ ID NO: 14768 - DNA, 25 bp, Homo sapien
gctacccagccacgatggatgacat

SEQ ID NO: 14769 - DNA, 25 bp, Homo sapien
gggactttgatacccaggaagaata

SEQ ID NO: 14770 - DNA, 25 bp, Homo sapien
gaagggcggaaaaccaggcgcttca

SEQ ID NO: 14771 - DNA, 25 bp, Homo sapien
aaagcagagcttgatcgccagtgga

SEQ ID NO: 14772 - DNA, 25 bp, Homo sapien
gaagatggaagctgatggggttgaa

SEQ ID NO: 14773 - DNA, 25 bp, Homo sapien
ctagttacaaccagagatgctccac

SEQ ID NO: 14774 - DNA, 25 bp, Homo sapien
gatgctccacaaggatatgctcccc

SEQ ID NO: 14775 - DNA, 25 bp, Homo sapien
gttcattatggatatttctgctgcc

SEQ ID NO: 14776 - DNA, 25 bp, Homo sapien
ctgctgccagtcacaatctaaatta

SEQ ID NO: 14777 - DNA, 25 bp, Homo sapien
cctgttactgagttagctctactct

SEQ ID NO: 14778 - DNA, 25 bp, Homo sapien
agctctactcttttggaccaaagca

SEQ ID NO: 14779 - DNA, 25 bp, Homo sapien
catgagagcaagtacttttcacact

SEQ ID NO: 14780 - DNA, 25 bp, Homo sapien
tatgatcccaagtagtctttttata

SEQ ID NO: 14781 - DNA, 25 bp, Homo sapien
aattctctgatcatttagttctatc

SEQ ID NO: 14782 - DNA, 25 bp, Homo sapien
acttcctttcatattagcatcatca

SEQ ID NO: 14783 - DNA, 25 bp, Homo sapien
tagcatcatcaaccctctaattcac

SEQ ID NO: 14784 - DNA, 25 bp, Homo sapien
caaccctctaattcaccttatgggg

SEQ ID NO: 14785 - DNA, 25 bp, Homo sapien
tcaccttatgggggaaatgcttctt

SEQ ID NO: 14786 - DNA, 25 bp, Homo sapien
aggcacagtcattcagtcttaggta

SEQ ID NO: 14787 - DNA, 25 bp, Homo sapien
gagttgtttctatgttaagtgtcaa

SEQ ID NO: 14788 - DNA, 25 bp, Homo sapien
ggtggggacatatgcattaagaatc

SEQ ID NO: 14789 - DNA, 25 bp, Homo sapien
gaatcttgttagtgttgcaatctaa

SEQ ID NO: 14790 - DNA, 25 bp, Homo sapien
gtagtatggtattctgtaaacttga

SEQ ID NO: 14791 - DNA, 25 bp, Homo sapien
ttgaaaacttgatctactctttgta

SEQ ID NO: 14792 - DNA, 25 bp, Homo sapien
tactctttgtaggtatcatttgaaa

SEQ ID NO: 14793 - DNA, 25 bp, Homo sapien
tacatacttgtatagtcctgtgaga

SEQ ID NO: 14794 - DNA, 25 bp, Homo sapien
gaagtatggctatcagaccaaagga

SEQ ID NO: 14795 - DNA, 25 bp, Homo sapien
aggataagccaaactgtaggtagca

SEQ ID NO: 14796 - DNA, 25 bp, Homo sapien
taaacttgacaaaaaccctgtatga

SEQ ID NO: 14797 - DNA, 25 bp, Homo sapien
tctttcccccttttaatttgtgatg

SEQ ID NO: 14798 - DNA, 25 bp, Homo sapien
atttgtgatgtcacttgaccccatt

SEQ ID NO: 14799 - DNA, 25 bp, Homo sapien
tgaccccatttatgtgtaggagcac

SEQ ID NO: 14800 - DNA, 25 bp, Homo sapien
gtaggagcactacaccattggtttc

SEQ ID NO: 14801 - DNA, 25 bp, Homo sapien
attggtttccaatactgcacacata

SEQ ID NO: 14802 - DNA, 25 bp, Homo sapien
gtgcagaaagtatcttcctccaggc

SEQ ID NO: 14803 - DNA, 25 bp, Homo sapien
cctccaggcttgtaatacccttcac

SEQ ID NO: 14804 - DNA, 25 bp, Homo sapien
atatacttctcattcctgtaactcc

SEQ ID NO: 14805 - DNA, 25 bp, Homo sapien
gtaactccattccctttaaacagtg

SEQ ID NO: 14806 - DNA, 25 bp, Homo sapien
caaatatacttccatccattgaatg

SEQ ID NO: 14807 - DNA, 25 bp, Homo sapien
gaaaactgctttataatctcattta

SEQ ID NO: 14808 - DNA, 25 bp, Homo sapien
ccttttgatggtgacctacctggcc

SEQ ID NO: 14809 - DNA, 25 bp, Homo sapien
cttgtaaacctgtgaatggacccca

SEQ ID NO: 14810 - DNA, 25 bp, Homo sapien
atggaccccaagcagtacacttgct

SEQ ID NO: 14811 - DNA, 25 bp, Homo sapien
gcagtacacttgctggtctaggtat

SEQ ID NO: 14812 - DNA, 25 bp, Homo sapien
cacttgctggtctaggtattaaccc

SEQ ID NO: 14813 - DNA, 25 bp, Homo sapien
ggaggaccatgggagtgatgttcac

SEQ ID NO: 14814 - DNA, 25 bp, Homo sapien
atgggagtgatgttcacgcctctga

SEQ ID NO: 14815 - DNA, 25 bp, Homo sapien
cgtactacgacactgaacgcatcgg

SEQ ID NO: 14816 - DNA, 25 bp, Homo sapien
gaacgcatcggagttgacctgatca

SEQ ID NO: 14817 - DNA, 25 bp, Homo sapien
gatgccctgagtacagtgttgcaat

SEQ ID NO: 14818 - DNA, 25 bp, Homo sapien
tatgcagaggatgtactgtctggaa

SEQ ID NO: 14819 - DNA, 25 bp, Homo sapien
aaacatttatttgaacatgactcca

SEQ ID NO: 14820 - DNA, 25 bp, Homo sapien
actccagcataccttaagttgtatt

SEQ ID NO: 14821 - DNA, 25 bp, Homo sapien
tttccaaacgtcaccttttatatat

SEQ ID NO: 14822 - DNA, 25 bp, Homo sapien
acgtcaccttttatatatcacacaa

SEQ ID NO: 14823 - DNA, 25 bp, Homo sapien
aattaaacagttccattagccatgc

SEQ ID NO: 14824 - DNA, 25 bp, Homo sapien
aacagttccattagccatgctgaga

SEQ ID NO: 14825 - DNA, 25 bp, Homo sapien
gccatgctgagattcgacttacact

SEQ ID NO: 14826 - DNA, 25 bp, Homo sapien
gattcgacttacactcaaaactaat

SEQ ID NO: 14827 - DNA, 25 bp, Homo sapien
tagctgtgagactagttcaggagca

SEQ ID NO: 14828 - DNA, 25 bp, Homo sapien
tcaggagcaaatattccatttatat

SEQ ID NO: 14829 - DNA, 25 bp, Homo sapien
taaggccgggcacggcgtctcacac

SEQ ID NO: 14830 - DNA, 25 bp, Homo sapien
ggtgctcacgacgattgtgttttac

SEQ ID NO: 14831 - DNA, 25 bp, Homo sapien
gattgtgttttactgttggctgcaa

SEQ ID NO: 14832 - DNA, 25 bp, Homo sapien
tgttggctgcaatatgtcatgactt

SEQ ID NO: 14833 - DNA, 25 bp, Homo sapien
gacttatcatgtgtgatccctgagt

SEQ ID NO: 14834 - DNA, 25 bp, Homo sapien
tgagcggactcctatgaaccagtct

SEQ ID NO: 14835 - DNA, 25 bp, Homo sapien
tgaaccagtcttctccagcaataga

SEQ ID NO: 14836 - DNA, 25 bp, Homo sapien
atagaccctccttcaactcgtggta

SEQ ID NO: 14837 - DNA, 25 bp, Homo sapien
actcgtggtagcctgtacgccaagg

SEQ ID NO: 14838 - DNA, 25 bp, Homo sapien
ggatccaccggttcatctatgggaa

SEQ ID NO: 14839 - DNA, 25 bp, Homo sapien
aaagcagtccttctggtactggctg

SEQ ID NO: 14840 - DNA, 25 bp, Homo sapien
tggatgaacggtggacgctcctgcc

SEQ ID NO: 14841 - DNA, 25 bp, Homo sapien
tggtttctttcactttgcgtaatgc

SEQ ID NO: 14842 - DNA, 25 bp, Homo sapien
ctttgcgtaatgctttgagattctt

SEQ ID NO: 14843 - DNA, 25 bp, Homo sapien
gattcttctgtattacatagagcaa

SEQ ID NO: 14844 - DNA, 25 bp, Homo sapien
gagcaatagtttgttaccaagtagt

SEQ ID NO: 14845 - DNA, 25 bp, Homo sapien
accacaatttgttatccagtcactt

SEQ ID NO: 14846 - DNA, 25 bp, Homo sapien
atccagtcacttgttgatagaggta

SEQ ID NO: 14847 - DNA, 25 bp, Homo sapien
taagtttttctgaggtttgtttctg

SEQ ID NO: 14848 - DNA, 25 bp, Homo sapien
tttttccccatgtaaccgagatggc

SEQ ID NO: 14849 - DNA, 25 bp, Homo sapien
tgtaaccgagatggccttcagttct

SEQ ID NO: 14850 - DNA, 25 bp, Homo sapien
gataccttttcatctctatactagt

SEQ ID NO: 14851 - DNA, 25 bp, Homo sapien
tcatctctatactagtccttttcat

SEQ ID NO: 14852 - DNA, 25 bp, Homo sapien
catctccctggagggcaagcctttg

SEQ ID NO: 14853 - DNA, 25 bp, Homo sapien
ggggatcccagcagggggaggcaat

SEQ ID NO: 14854 - DNA, 25 bp, Homo sapien
ccagcagggggaggcaatcccttca

SEQ ID NO: 14855 - DNA, 25 bp, Homo sapien
atcttttgattcctcttgggctgaa

SEQ ID NO: 14856 - DNA, 25 bp, Homo sapien
gattcctcttgggctgaagcagacc

SEQ ID NO: 14857 - DNA, 25 bp, Homo sapien
atgctgccaacttctaaccgcaata

SEQ ID NO: 14858 - DNA, 25 bp, Homo sapien
gctgccaacttctaaccgcaatagt

SEQ ID NO: 14859 - DNA, 25 bp, Homo sapien
gccaacttctaaccgcaatagtgac

SEQ ID NO: 14860 - DNA, 25 bp, Homo sapien
accgcaatagtgactctgtgcttgt

SEQ ID NO: 14861 - DNA, 25 bp, Homo sapien
aatagtgactctgtgcttgtctgtt

SEQ ID NO: 14862 - DNA, 25 bp, Homo sapien
agtgactctgtgcttgtctgtttag

SEQ ID NO: 14863 - DNA, 25 bp, Homo sapien
atcccacctgtgagaatatgaactt

SEQ ID NO: 14864 - DNA, 25 bp, Homo sapien
ggaggaatgaatgcaaccagtgtaa

SEQ ID NO: 14865 - DNA, 25 bp, Homo sapien
ccagtgtaaggcccctaaaccagat

SEQ ID NO: 14866 - DNA, 25 bp, Homo sapien
taaggcccctaaaccagatggccca

SEQ ID NO: 14867 - DNA, 25 bp, Homo sapien
tggctctcacatggggggtaactac

SEQ ID NO: 14868 - DNA, 25 bp, Homo sapien
tctcacatggggggtaactacgggg

SEQ ID NO: 14869 - DNA, 25 bp, Homo sapien
gggtaactacggggatgatcgtcgt

SEQ ID NO: 14870 - DNA, 25 bp, Homo sapien
tacggggatgatcgtcgtggtggca

SEQ ID NO: 14871 - DNA, 25 bp, Homo sapien
atgatcgtcgtggtggcagaggagg

SEQ ID NO: 14872 - DNA, 25 bp, Homo sapien
ggaggctatgatcgaggcggctacc

SEQ ID NO: 14873 - DNA, 25 bp, Homo sapien
gacaggatcgcagggagaggccgta

SEQ ID NO: 14874 - DNA, 25 bp, Homo sapien
gaagaccaacaagaatccctaaaca

SEQ ID NO: 14875 - DNA, 25 bp, Homo sapien
aatggaagtcaaaaggtcgtagatt

SEQ ID NO: 14876 - DNA, 25 bp, Homo sapien
aagggtaataaagctgcccagcctg

SEQ ID NO: 14877 - DNA, 25 bp, Homo sapien
cagcctgggtctggtaaaggaaaag

SEQ ID NO: 14878 - DNA, 25 bp, Homo sapien
ggaaaagtacagtttcagggcaaga

SEQ ID NO: 14879 - DNA, 25 bp, Homo sapien
gaaaatggtgcaactggacctgtga

SEQ ID NO: 14880 - DNA, 25 bp, Homo sapien
ggacctgtgaaaagagcaagagaag

SEQ ID NO: 14881 - DNA, 25 bp, Homo sapien
aagaagaacctgcatccaaacaaca

SEQ ID NO: 14882 - DNA, 25 bp, Homo sapien
gaacctgcatccaaacaacagaaaa

SEQ ID NO: 14883 - DNA, 25 bp, Homo sapien
gctggagaccagtagtttagtaaac

SEQ ID NO: 14884 - DNA, 25 bp, Homo sapien
ggaagattcttccattaaattgcct

SEQ ID NO: 14885 - DNA, 25 bp, Homo sapien
ttctgagtgtagtgtggtaggaccc

SEQ ID NO: 14886 - DNA, 25 bp, Homo sapien
cgccccacagtagacgtgcagacgt

SEQ ID NO: 14887 - DNA, 25 bp, Homo sapien
cagtagacgtgcagacgtccctgag

SEQ ID NO: 14888 - DNA, 25 bp, Homo sapien
gacgtgcagacgtccctgagaggtt

SEQ ID NO: 14889 - DNA, 25 bp, Homo sapien
gcagacgtccctgagaggttcttga

SEQ ID NO: 14890 - DNA, 25 bp, Homo sapien
gacgtccctgagaggttcttgaaga

SEQ ID NO: 14891 - DNA, 25 bp, Homo sapien
gagaggttcttgaagatgtttattt

SEQ ID NO: 14892 - DNA, 25 bp, Homo sapien
tattgtccttttttactggaagacg

SEQ ID NO: 14893 - DNA, 25 bp, Homo sapien
tggaagacgtacgcatactccatcg

SEQ ID NO: 14894 - DNA, 25 bp, Homo sapien
ttgcagtggctgaggaattcttgta

SEQ ID NO: 14895 - DNA, 25 bp, Homo sapien
agtggctgaggaattcttgtacgca

SEQ ID NO: 14896 - DNA, 25 bp, Homo sapien
ggagatgcatccgtaagaaagaaca

SEQ ID NO: 14897 - DNA, 25 bp, Homo sapien
gaacaagattcctttaccacctcct

SEQ ID NO: 14898 - DNA, 25 bp, Homo sapien
ggcctctcataacacttccgaagaa

SEQ ID NO: 14899 - DNA, 25 bp, Homo sapien
gcctctcataacacttccgaagaag

SEQ ID NO: 14900 - DNA, 25 bp, Homo sapien
cataacacttccgaagaagtaccaa

SEQ ID NO: 14901 - DNA, 25 bp, Homo sapien
gagccggagagcagcaggccacctt

SEQ ID NO: 14902 - DNA, 25 bp, Homo sapien
agagcagcaggccacctttatctca

SEQ ID NO: 14903 - DNA, 25 bp, Homo sapien
agcaggccacctttatctcagagac

SEQ ID NO: 14904 - DNA, 25 bp, Homo sapien
aggccacctttatctcagagacaca

SEQ ID NO: 14905 - DNA, 25 bp, Homo sapien
gaatgcccagtcagataagcttaag

SEQ ID NO: 14906 - DNA, 25 bp, Homo sapien
gcccagtcagataagcttaagggac

SEQ ID NO: 14907 - DNA, 25 bp, Homo sapien
tgaacatttaaaagtttccctagcg

SEQ ID NO: 14908 - DNA, 25 bp, Homo sapien
tagcgggccattccttagcaaaatg

SEQ ID NO: 14909 - DNA, 25 bp, Homo sapien
gaatccctgttgctacattgactaa

SEQ ID NO: 14910 - DNA, 25 bp, Homo sapien
ggttagaggtgttggcagtttagga

SEQ ID NO: 14911 - DNA, 25 bp, Homo sapien
gcagtttaggacctgctgtcataaa

SEQ ID NO: 14912 - DNA, 25 bp, Homo sapien
tgtgtgaacaaccttttgtaaccta

SEQ ID NO: 14913 - DNA, 25 bp, Homo sapien
taacctaacctattgacctgcatgt

SEQ ID NO: 14914 - DNA, 25 bp, Homo sapien
ttttctttaccccaattcattacat

SEQ ID NO: 14915 - DNA, 25 bp, Homo sapien
attacatggaggctcaatcttgagt

SEQ ID NO: 14916 - DNA, 25 bp, Homo sapien
aatcttgagtttgctttactggttc

SEQ ID NO: 14917 - DNA, 25 bp, Homo sapien
gttatccaactgtatattgtttact

SEQ ID NO: 14918 - DNA, 25 bp, Homo sapien
gtccagcacgcctttggtggacttc

SEQ ID NO: 14919 - DNA, 25 bp, Homo sapien
tggtggacttcttgatgcagctgga

SEQ ID NO: 14920 - DNA, 25 bp, Homo sapien
tggaagattacacgcctacgatccc

SEQ ID NO: 14921 - DNA, 25 bp, Homo sapien
acctgaaccgtgctggctttgaggc

SEQ ID NO: 14922 - DNA, 25 bp, Homo sapien
tcagacccacgcataattcggctca

SEQ ID NO: 14923 - DNA, 25 bp, Homo sapien
tcatctccttagctgcccagaaatt

SEQ ID NO: 14924 - DNA, 25 bp, Homo sapien
attgccaatgatgccctacagcact

SEQ ID NO: 14925 - DNA, 25 bp, Homo sapien
agcaaggaccgcaagtacactctaa

SEQ ID NO: 14926 - DNA, 25 bp, Homo sapien
taaccatggaggacttgacccctgc

SEQ ID NO: 14927 - DNA, 25 bp, Homo sapien
tgaagaagccgcactacttcacctg

SEQ ID NO: 14928 - DNA, 25 bp, Homo sapien
tgagccacccaacctaaatgtactt

SEQ ID NO: 14929 - DNA, 25 bp, Homo sapien
gggcaaggattctctgtacgcccag

SEQ ID NO: 14930 - DNA, 25 bp, Homo sapien
gattctctgtacgcccagggaaagc

SEQ ID NO: 14931 - DNA, 25 bp, Homo sapien
tctctgtacgcccagggaaagcggc

SEQ ID NO: 14932 - DNA, 25 bp, Homo sapien
gtacgcccagggaaagcggcgttat

SEQ ID NO: 14933 - DNA, 25 bp, Homo sapien
gtgggcaaactaagccgattttccg

SEQ ID NO: 14934 - DNA, 25 bp, Homo sapien
gccgatagcgctcacgcaagcatgg

SEQ ID NO: 14935 - DNA, 25 bp, Homo sapien
gatagcgctcacgcaagcatggtta

SEQ ID NO: 14936 - DNA, 25 bp, Homo sapien
gcgctcacgcaagcatggttaacgt

SEQ ID NO: 14937 - DNA, 25 bp, Homo sapien
acgcaagcatggttaacgtccctaa

SEQ ID NO: 14938 - DNA, 25 bp, Homo sapien
gcaagcaccaaccccataaagtgac

SEQ ID NO: 14939 - DNA, 25 bp, Homo sapien
aagcaccaaccccataaagtgacac

SEQ ID NO: 14940 - DNA, 25 bp, Homo sapien
aataacttgaaggcccgcaattcct

SEQ ID NO: 14941 - DNA, 25 bp, Homo sapien
caattccttccgctacaacggactg

SEQ ID NO: 14942 - DNA, 25 bp, Homo sapien
ttccgctacaacggactgattcacc

SEQ ID NO: 14943 - DNA, 25 bp, Homo sapien
gattcaccgcaagactgtgggcgtg

SEQ ID NO: 14944 - DNA, 25 bp, Homo sapien
caagactgtgggcgtggagccggca

SEQ ID NO: 14945 - DNA, 25 bp, Homo sapien
agccgacggcaaaggtgtcgtggtg

SEQ ID NO: 14946 - DNA, 25 bp, Homo sapien
ggtgtcgtggtggtcattaagcgga

SEQ ID NO: 14947 - DNA, 25 bp, Homo sapien
ggtggtcattaagcggagatccggc

SEQ ID NO: 14948 - DNA, 25 bp, Homo sapien
ttaagcggagatccggccagcggaa

SEQ ID NO: 14949 - DNA, 25 bp, Homo sapien
cctgcgcatggcagccatccgcagg

SEQ ID NO: 14950 - DNA, 25 bp, Homo sapien
aatggatggtcgtgcggaactgctc

SEQ ID NO: 14951 - DNA, 25 bp, Homo sapien
gtgtctgcatgagcatgtggcctcc

SEQ ID NO: 14952 - DNA, 25 bp, Homo sapien
aacccagtgacccagggacacgtgg

SEQ ID NO: 14953 - DNA, 25 bp, Homo sapien
ggacagggctgtggagatggctccg

SEQ ID NO: 14954 - DNA, 25 bp, Homo sapien
gcgaaattgccaacactcaagtcac

SEQ ID NO: 14955 - DNA, 25 bp, Homo sapien
gtcacctcagtaccatccaggaggc

SEQ ID NO: 14956 - DNA, 25 bp, Homo sapien
ggaggctgggtattgtcctgcctct

SEQ ID NO: 14957 - DNA, 25 bp, Homo sapien
tctgccttttctgtctcagcggcag

SEQ ID NO: 14958 - DNA, 25 bp, Homo sapien
caagagccctcgatggacaggcctg

SEQ ID NO: 14959 - DNA, 25 bp, Homo sapien
gggccatcagtatttattgcctccg

SEQ ID NO: 14960 - DNA, 25 bp, Homo sapien
ttccctgacccagccaggacaaaca

SEQ ID NO: 14961 - DNA, 25 bp, Homo sapien
tgctgagagccgtctcctataggtc

SEQ ID NO: 14962 - DNA, 25 bp, Homo sapien
ttgagtgaaaagactgctacatttt

SEQ ID NO: 14963 - DNA, 25 bp, Homo sapien
ctgctacattttttattccctagct

SEQ ID NO: 14964 - DNA, 25 bp, Homo sapien
tttattccctagcttttttctctct

SEQ ID NO: 14965 - DNA, 25 bp, Homo sapien
ggaaatcttttctgaagtcataaac

SEQ ID NO: 14966 - DNA, 25 bp, Homo sapien
agtcataaactatcgattccataat

SEQ ID NO: 14967 - DNA, 25 bp, Homo sapien
gattccataattcagttccataaag

SEQ ID NO: 14968 - DNA, 25 bp, Homo sapien
taccttccttttaggaattcagaat

SEQ ID NO: 14969 - DNA, 25 bp, Homo sapien
atattatatcaatggaccctcatgg

SEQ ID NO: 14970 - DNA, 25 bp, Homo sapien
gaccctcatggaagtgtttttatta

SEQ ID NO: 14971 - DNA, 25 bp, Homo sapien
ttcattgttattgtcctatgaacaa

SEQ ID NO: 14972 - DNA, 25 bp, Homo sapien
tgaacaaatatctatctccaaatcc

SEQ ID NO: 14973 - DNA, 25 bp, Homo sapien
cgctgacctgaggtccaacacgggc

SEQ ID NO: 14974 - DNA, 25 bp, Homo sapien
gtgtgtttgaccactggcagatcct

SEQ ID NO: 14975 - DNA, 25 bp, Homo sapien
gggcctgaaagaaggcatccctgcc

SEQ ID NO: 14976 - DNA, 25 bp, Homo sapien
caccacgtcctcgaattctcagacg

SEQ ID NO: 14977 - DNA, 25 bp, Homo sapien
tcagacgacacctggagactgtccc

SEQ ID NO: 14978 - DNA, 25 bp, Homo sapien
ttcagagggaaactcagatgtccaa

SEQ ID NO: 14979 - DNA, 25 bp, Homo sapien
tatttgggtacatggcccgcagtgg

SEQ ID NO: 14980 - DNA, 25 bp, Homo sapien
ggggaaaggaacacgcgggtagatg

SEQ ID NO: 14981 - DNA, 25 bp, Homo sapien
gcgggtagatgatttctagcaggca

SEQ ID NO: 14982 - DNA, 25 bp, Homo sapien
gcaggcaggaagtcctgtgcggtgt

SEQ ID NO: 14983 - DNA, 25 bp, Homo sapien
cagctgtactagtgccattggaata

SEQ ID NO: 14984 - DNA, 25 bp, Homo sapien
gactgacgcgagcagccaaggtgtt

SEQ ID NO: 14985 - DNA, 25 bp, Homo sapien
cccctgtgttttccaaagctagata

SEQ ID NO: 14986 - DNA, 25 bp, Homo sapien
agatcctttggcatccggagaaatg

SEQ ID NO: 14987 - DNA, 25 bp, Homo sapien
tgaaaagattgctgtccactgcgca

SEQ ID NO: 14988 - DNA, 25 bp, Homo sapien
gggtctaaaggtgcgggagttggag

SEQ ID NO: 14989 - DNA, 25 bp, Homo sapien
gtgaaaaggagaaccccatgcggga

SEQ ID NO: 14990 - DNA, 25 bp, Homo sapien
gagaaccccatgcgggaacttcgca

SEQ ID NO: 14991 - DNA, 25 bp, Homo sapien
caagcattggtatctacggcctgga

SEQ ID NO: 14992 - DNA, 25 bp, Homo sapien
tgcgggaacttcgcatccgcaaact

SEQ ID NO: 14993 - DNA, 25 bp, Homo sapien
aactctgtctcaacatctgtgttgg

SEQ ID NO: 14994 - DNA, 25 bp, Homo sapien
gggagagtggaggcagactgacgcg

SEQ ID NO: 14995 - DNA, 25 bp, Homo sapien
agcaaaaagctctagctcacgtggt

SEQ ID NO: 14996 - DNA, 25 bp, Homo sapien
aaagctctagctcacgtggtgtata

SEQ ID NO: 14997 - DNA, 25 bp, Homo sapien
ctcacgtggtgtatattcagcctat

SEQ ID NO: 14998 - DNA, 25 bp, Homo sapien
gtggtgtatattcagcctatcaagc

SEQ ID NO: 14999 - DNA, 25 bp, Homo sapien
attccagaagaaattaccaacggcg

SEQ ID NO: 15000 - DNA, 25 bp, Homo sapien
taccaacggcgggactatttcagtg

SEQ ID NO: 15001 - DNA, 25 bp, Homo sapien
aacggcgggactatttcagtgctcc

SEQ ID NO: 15002 - DNA, 25 bp, Homo sapien
ggactatttcagtgctccgagaagt

SEQ ID NO: 15003 - DNA, 25 bp, Homo sapien
gctccgagaagtatcaccagtaacc

SEQ ID NO: 15004 - DNA, 25 bp, Homo sapien
gaagtatcaccagtaaccaatcagc

SEQ ID NO: 15005 - DNA, 25 bp, Homo sapien
gtatcaccagtaaccaatcagcaaa

SEQ ID NO: 15006 - DNA, 25 bp, Homo sapien
cagggaaaagtgaggctcttggggg

SEQ ID NO: 15007 - DNA, 25 bp, Homo sapien
ttacctgggagcacacttttccctt

SEQ ID NO: 15008 - DNA, 25 bp, Homo sapien
ccttccccgatgacctgggatggtg

SEQ ID NO: 15009 - DNA, 25 bp, Homo sapien
ccccgatgacctgggatggtggcca

SEQ ID NO: 15010 - DNA, 25 bp, Homo sapien
cccaccactgtactctgaaattggc

SEQ ID NO: 15011 - DNA, 25 bp, Homo sapien
cactgtactctgaaattggcgagtg

SEQ ID NO: 15012 - DNA, 25 bp, Homo sapien
ccgttcatggtggtctttcaggtta

SEQ ID NO: 15013 - DNA, 25 bp, Homo sapien
ggtggtctttcaggttatcttggca

SEQ ID NO: 15014 - DNA, 25 bp, Homo sapien
ggtctttcaggttatcttggcaaca

SEQ ID NO: 15015 - DNA, 25 bp, Homo sapien
tcaggttatcttggcaacatgtaca

SEQ ID NO: 15016 - DNA, 25 bp, Homo sapien
atgacattgtgtttgtactttgttg

SEQ ID NO: 15017 - DNA, 25 bp, Homo sapien
tactggagtggttaatcagattttc

SEQ ID NO: 15018 - DNA, 25 bp, Homo sapien
gtcattatggagatcactagtaacc

SEQ ID NO: 15019 - DNA, 25 bp, Homo sapien
ggagatcactagtaaccaaagatat

SEQ ID NO: 15020 - DNA, 25 bp, Homo sapien
aagataaatgcctagttgatgtgat

SEQ ID NO: 15021 - DNA, 25 bp, Homo sapien
gatgtgatttcagacaccaggaaag

SEQ ID NO: 15022 - DNA, 25 bp, Homo sapien
gacaccaggaaagcttaatgacact

SEQ ID NO: 15023 - DNA, 25 bp, Homo sapien
ggaaagcttaatgacactaaatgat

SEQ ID NO: 15024 - DNA, 25 bp, Homo sapien
atgattaatgagtgcaatgagctta

SEQ ID NO: 15025 - DNA, 25 bp, Homo sapien
gtgcaatgagcttaatcacactaaa

SEQ ID NO: 15026 - DNA, 25 bp, Homo sapien
acaaatgcggttgagcattcctttt

SEQ ID NO: 15027 - DNA, 25 bp, Homo sapien
tgcggttgagcattccttttttctt

SEQ ID NO: 15028 - DNA, 25 bp, Homo sapien
gtgtgtgcccaggcaaacttcgagg

SEQ ID NO: 15029 - DNA, 25 bp, Homo sapien
gcccaggcaaacttcgaggggttcg

SEQ ID NO: 15030 - DNA, 25 bp, Homo sapien
tgcaggcactcagaatggtccagcg

SEQ ID NO: 15031 - DNA, 25 bp, Homo sapien
tcgaggggttcgtcctgtaagacct

SEQ ID NO: 15032 - DNA, 25 bp, Homo sapien
tcgtcctgtaagacctaaagttctt

SEQ ID NO: 15033 - DNA, 25 bp, Homo sapien
gaaacatgtcagcagggcctatggt

SEQ ID NO: 15034 - DNA, 25 bp, Homo sapien
atggtggttccatgtgtgctaaatg

SEQ ID NO: 15035 - DNA, 25 bp, Homo sapien
gtgtgctaaatgtgttcgtgacagg

SEQ ID NO: 15036 - DNA, 25 bp, Homo sapien
gttcgtgacaggatcaagcgtgctt

SEQ ID NO: 15037 - DNA, 25 bp, Homo sapien
gacaggatcaagcgtgctttcctta

SEQ ID NO: 15038 - DNA, 25 bp, Homo sapien
atggtccagcgtttgacataccgac

SEQ ID NO: 15039 - DNA, 25 bp, Homo sapien
ttactgtgactgagtcggcccattc

SEQ ID NO: 15040 - DNA, 25 bp, Homo sapien
gagtggggatggtcgagtatctcag

SEQ ID NO: 15041 - DNA, 25 bp, Homo sapien
tatgccctgcgtaaactggatgaca

SEQ ID NO: 15042 - DNA, 25 bp, Homo sapien
ctggatgacaccaaattccgctctc

SEQ ID NO: 15043 - DNA, 25 bp, Homo sapien
aattccgctctcatgagggtgaaac

SEQ ID NO: 15044 - DNA, 25 bp, Homo sapien
ttttaggttaactgagctgctttgt

SEQ ID NO: 15045 - DNA, 25 bp, Homo sapien
gctttgtgctcagaatctacattcc

SEQ ID NO: 15046 - DNA, 25 bp, Homo sapien
actacataatttctaccagggccat

SEQ ID NO: 15047 - DNA, 25 bp, Homo sapien
tgtatatttttcacccctgattatg

SEQ ID NO: 15048 - DNA, 25 bp, Homo sapien
aatcgttctgtctttgtggggttcg

SEQ ID NO: 15049 - DNA, 25 bp, Homo sapien
gtggggttcgctctactatggagat

SEQ ID NO: 15050 - DNA, 25 bp, Homo sapien
caaggagacagtatctcagcgccct

SEQ ID NO: 15051 - DNA, 25 bp, Homo sapien
cagcaggatgacacagtctacatgg

SEQ ID NO: 15052 - DNA, 25 bp, Homo sapien
gcaggatgacacagtctacatgggc

SEQ ID NO: 15053 - DNA, 25 bp, Homo sapien
gatgacacagtctacatgggcaaag

SEQ ID NO: 15054 - DNA, 25 bp, Homo sapien
tacatgggcaaagtgaccttctcat

SEQ ID NO: 15055 - DNA, 25 bp, Homo sapien
cttctcatgtgcggctggttttgga

SEQ ID NO: 15056 - DNA, 25 bp, Homo sapien
tctcatgtgcggctggttttggaca

SEQ ID NO: 15057 - DNA, 25 bp, Homo sapien
tgtgcggctggttttggacagcgac

SEQ ID NO: 15058 - DNA, 25 bp, Homo sapien
gcggctggttttggacagcgacacc

SEQ ID NO: 15059 - DNA, 25 bp, Homo sapien
gctggttttggacagcgacaccggc

SEQ ID NO: 15060 - DNA, 25 bp, Homo sapien
tggttttggacagcgacaccggctg

SEQ ID NO: 15061 - DNA, 25 bp, Homo sapien
cgagcccatcttggctgacggggct

SEQ ID NO: 15062 - DNA, 25 bp, Homo sapien
cctggacaaaggtcgtgccatgttc

SEQ ID NO: 15063 - DNA, 25 bp, Homo sapien
ccatgttcttagtggccaagtgcca

SEQ ID NO: 15064 - DNA, 25 bp, Homo sapien
agctctggaggctgccatcgagaac

SEQ ID NO: 15065 - DNA, 25 bp, Homo sapien
aaaggttgactgcaaagagcgcatc

SEQ ID NO: 15066 - DNA, 25 bp, Homo sapien
aagagcgcatcagggacgtcgttta

SEQ ID NO: 15067 - DNA, 25 bp, Homo sapien
ccctctcatggggtacccttgataa

SEQ ID NO: 15068 - DNA, 25 bp, Homo sapien
gtacccttgataaaccatctctaga

SEQ ID NO: 15069 - DNA, 25 bp, Homo sapien
tgctgggctgctgtgcagagtataa

SEQ ID NO: 15070 - DNA, 25 bp, Homo sapien
gatgtatttgtgacaccctatcttg

SEQ ID NO: 15071 - DNA, 25 bp, Homo sapien
acaccctatcttgtcaataaacagc

SEQ ID NO: 15072 - DNA, 25 bp, Homo sapien
atcatacagtagattccatccattc

SEQ ID NO: 15073 - DNA, 25 bp, Homo sapien
cattcactatacttttctaactgag

SEQ ID NO: 15074 - DNA, 25 bp, Homo sapien
ttctaactgagttgtcctacatgca

SEQ ID NO: 15075 - DNA, 25 bp, Homo sapien
tgagttgtcctacatgcaagtacat

SEQ ID NO: 15076 - DNA, 25 bp, Homo sapien
ctgtgctgttcctgtaagtttgcta

SEQ ID NO: 15077 - DNA, 25 bp, Homo sapien
tctcttcttcctgttattggtagtt

SEQ ID NO: 15078 - DNA, 25 bp, Homo sapien
atcaggtattggcagtttttccatt

SEQ ID NO: 15079 - DNA, 25 bp, Homo sapien
gcggagacgtaaagcattaatgcaa

SEQ ID NO: 15080 - DNA, 25 bp, Homo sapien
acaagtttcagcggttcaactttat

SEQ ID NO: 15081 - DNA, 25 bp, Homo sapien
gtaaatttcttattgatggcaacta

SEQ ID NO: 15082 - DNA, 25 bp, Homo sapien
ggcaactaaatggtgtttgtagcat

SEQ ID NO: 15083 - DNA, 25 bp, Homo sapien
gaccgagtcagtggacatgcagcat

SEQ ID NO: 15084 - DNA, 25 bp, Homo sapien
acatgcagcatcctcgggaagagct

SEQ ID NO: 15085 - DNA, 25 bp, Homo sapien
tcgggaagagctcgccctccggact

SEQ ID NO: 15086 - DNA, 25 bp, Homo sapien
tacggttgtggttggccggcacatc

SEQ ID NO: 15087 - DNA, 25 bp, Homo sapien
tggagccagacacctcagccacaga

SEQ ID NO: 15088 - DNA, 25 bp, Homo sapien
agctctgccatttctgacagcgtgg

SEQ ID NO: 15089 - DNA, 25 bp, Homo sapien
atttctgacagcgtggccccgggtg

SEQ ID NO: 15090 - DNA, 25 bp, Homo sapien
tggccccgggtgtgttactgcttgt

SEQ ID NO: 15091 - DNA, 25 bp, Homo sapien
cgggtgtgttactgcttgtctctgg

SEQ ID NO: 15092 - DNA, 25 bp, Homo sapien
ctcagcttcccctcgataaaaagag

SEQ ID NO: 15093 - DNA, 25 bp, Homo sapien
aaaaatagcacttgccagccgggcg

SEQ ID NO: 15094 - DNA, 25 bp, Homo sapien
aattgaaatcagccagcacgccaag

SEQ ID NO: 15095 - DNA, 25 bp, Homo sapien
tggcactgtggttcctgcatgaaga

SEQ ID NO: 15096 - DNA, 25 bp, Homo sapien
gcactgtggttcctgcatgaagaca

SEQ ID NO: 15097 - DNA, 25 bp, Homo sapien
tgcatgaagacagtggctggcggtg

SEQ ID NO: 15098 - DNA, 25 bp, Homo sapien
ggcgacatggccaaacgtaccaaga

SEQ ID NO: 15099 - DNA, 25 bp, Homo sapien
ccacttccgctgtcacggtaaagtc

SEQ ID NO: 15100 - DNA, 25 bp, Homo sapien
tccgctgtcacggtaaagtccgcca

SEQ ID NO: 15101 - DNA, 25 bp, Homo sapien
gctgtcacggtaaagtccgccatca

SEQ ID NO: 15102 - DNA, 25 bp, Homo sapien
gtcacggtaaagtccgccatcagaa

SEQ ID NO: 15103 - DNA, 25 bp, Homo sapien
ggtaaagtccgccatcagaagactg

SEQ ID NO: 15104 - DNA, 25 bp, Homo sapien
gtaccaagaaagtcgggatcgtcgg

SEQ ID NO: 15105 - DNA, 25 bp, Homo sapien
tattaaagatctcgcctgttcctgc

SEQ ID NO: 15106 - DNA, 25 bp, Homo sapien
gtctcccagctatctataaccttag

SEQ ID NO: 15107 - DNA, 25 bp, Homo sapien
ataaccttagcttgtgtgtcgcctt

SEQ ID NO: 15108 - DNA, 25 bp, Homo sapien
gctgagacttttcctggatggagcc

SEQ ID NO: 15109 - DNA, 25 bp, Homo sapien
gcagccccgactattcgtgggcatg

SEQ ID NO: 15110 - DNA, 25 bp, Homo sapien
cgtgggcatgatcctgattctcatc

SEQ ID NO: 15111 - DNA, 25 bp, Homo sapien
tcatcttcgccgaggtgctcggcct

SEQ ID NO: 15112 - DNA, 25 bp, Homo sapien
cctcctcattccagaacgaacagcc

SEQ ID NO: 15113 - DNA, 25 bp, Homo sapien
acgaacagcctgacacatacgcagc

SEQ ID NO: 15114 - DNA, 25 bp, Homo sapien
gtacatgcgcagtatcctagtgccc

SEQ ID NO: 15115 - DNA, 25 bp, Homo sapien
caccccctaaagtgctctagtatgc

SEQ ID NO: 15116 - DNA, 25 bp, Homo sapien
tcctgctgtgtcctgaggtgcattt

SEQ ID NO: 15117 - DNA, 25 bp, Homo sapien
gtcctgaggtgcatttcctgtttgt

SEQ ID NO: 15118 - DNA, 25 bp, Homo sapien
tgccacagcctcgtctggaaaaagg

SEQ ID NO: 15119 - DNA, 25 bp, Homo sapien
acagcctcgtctggaaaaaggacca

SEQ ID NO: 15120 - DNA, 25 bp, Homo sapien
ccatttgtgctctgcttggacagca

SEQ ID NO: 15121 - DNA, 25 bp, Homo sapien
ctctgcttggacagcaggcctggca

SEQ ID NO: 15122 - DNA, 25 bp, Homo sapien
gcctcccattgcccaagagagaggg

SEQ ID NO: 15123 - DNA, 25 bp, Homo sapien
agggaacaggctactgtccttccct

SEQ ID NO: 15124 - DNA, 25 bp, Homo sapien
gtccttccctgtggaattgccgaga

SEQ ID NO: 15125 - DNA, 25 bp, Homo sapien
atctagcaccttgcatgctggatct

SEQ ID NO: 15126 - DNA, 25 bp, Homo sapien
agcaccttgcatgctggatctgggc

SEQ ID NO: 15127 - DNA, 25 bp, Homo sapien
gtcttcaaacatagcaagaggcttt

SEQ ID NO: 15128 - DNA, 25 bp, Homo sapien
gaggctttaaatactgggtatccaa

SEQ ID NO: 15129 - DNA, 25 bp, Homo sapien
cagttacctacctatcatccaagac

SEQ ID NO: 15130 - DNA, 25 bp, Homo sapien
aagacctcgcttgagtccttttggg

SEQ ID NO: 15131 - DNA, 25 bp, Homo sapien
cttgagtccttttgggtgctcccaa

SEQ ID NO: 15132 - DNA, 25 bp, Homo sapien
ggtgctcccaacattagtgtcgtaa

SEQ ID NO: 15133 - DNA, 25 bp, Homo sapien
tgatgtgagcagttgttcactgatg

SEQ ID NO: 15134 - DNA, 25 bp, Homo sapien
agttgttcactgatgattctaatgc

SEQ ID NO: 15135 - DNA, 25 bp, Homo sapien
ttcattgtttctctgttagggtgtt

SEQ ID NO: 15136 - DNA, 25 bp, Homo sapien
ctctgttagggtgtttcatagtctt

SEQ ID NO: 15137 - DNA, 25 bp, Homo sapien
aatagcattgcatcattaaaagtat

SEQ ID NO: 15138 - DNA, 25 bp, Homo sapien
tcagaacagggctttggtcgatgga

SEQ ID NO: 15139 - DNA, 25 bp, Homo sapien
ggctttggtcgatggaccttgcact

SEQ ID NO: 15140 - DNA, 25 bp, Homo sapien
tgcctttcaagtgcatgcagctcac

SEQ ID NO: 15141 - DNA, 25 bp, Homo sapien
atgcagctcactgatttcatcctca

SEQ ID NO: 15142 - DNA, 25 bp, Homo sapien
aaatgggcagccacacgatgggcca

SEQ ID NO: 15143 - DNA, 25 bp, Homo sapien
ggcagccacacgatgggccaagaag

SEQ ID NO: 15144 - DNA, 25 bp, Homo sapien
aagatgacagattttgatcgtttta

SEQ ID NO: 15145 - DNA, 25 bp, Homo sapien
gaagcttcaaaaggcagctctcctg

SEQ ID NO: 15146 - DNA, 25 bp, Homo sapien
tcccaaaaaagcacctggtactaag

SEQ ID NO: 15147 - DNA, 25 bp, Homo sapien
gcacctggtactaagggtactgctg

SEQ ID NO: 15148 - DNA, 25 bp, Homo sapien
tgctgctgctaaagttccagcaaaa

SEQ ID NO: 15149 - DNA, 25 bp, Homo sapien
tcctgaggaacatgcgctttgccaa

SEQ ID NO: 15150 - DNA, 25 bp, Homo sapien
gccaaggccatgagtgcacgtgccg

SEQ ID NO: 15151 - DNA, 25 bp, Homo sapien
tgcacgtgccgaggctatcaaggcc

SEQ ID NO: 15152 - DNA, 25 bp, Homo sapien
tcaaggccctcgtaaagcccaagga

SEQ ID NO: 15153 - DNA, 25 bp, Homo sapien
agccgcaagctcgatcgacttgcct

SEQ ID NO: 15154 - DNA, 25 bp, Homo sapien
caagcttgggaagcgtgctcgtgcc

SEQ ID NO: 15155 - DNA, 25 bp, Homo sapien
tcgtgcccgtattgccaaggggctc

SEQ ID NO: 15156 - DNA, 25 bp, Homo sapien
ctgtgccggccaaaggccaaggcca

SEQ ID NO: 15157 - DNA, 25 bp, Homo sapien
atcaaaccaaggcccaggctgcagc

SEQ ID NO: 15158 - DNA, 25 bp, Homo sapien
ccaggcccctacaaaggcttcagag

SEQ ID NO: 15159 - DNA, 25 bp, Homo sapien
taccatctgcatggggctggggtcc

SEQ ID NO: 15160 - DNA, 25 bp, Homo sapien
gaatacaatagttagcttggcgtgg

SEQ ID NO: 15161 - DNA, 25 bp, Homo sapien
aggcaggtgaatcccgtgggcccag

SEQ ID NO: 15162 - DNA, 25 bp, Homo sapien
agtgaggttggaatttcatgactgc

SEQ ID NO: 15163 - DNA, 25 bp, Homo sapien
atgactgcctggacatgtcacttgc

SEQ ID NO: 15164 - DNA, 25 bp, Homo sapien
tgtcacttgcctcacacttggacag

SEQ ID NO: 15165 - DNA, 25 bp, Homo sapien
ggacagccctgattcgttctcaggg

SEQ ID NO: 15166 - DNA, 25 bp, Homo sapien
tgattcgttctcagggtttccccac

SEQ ID NO: 15167 - DNA, 25 bp, Homo sapien
accagggccgactttgtgcccttgc

SEQ ID NO: 15168 - DNA, 25 bp, Homo sapien
gctaagctgacccagacttgcagat

SEQ ID NO: 15169 - DNA, 25 bp, Homo sapien
tgacccagacttgcagatgtgattc

SEQ ID NO: 15170 - DNA, 25 bp, Homo sapien
gcctgcgatcccgacagtttgggag

SEQ ID NO: 15171 - DNA, 25 bp, Homo sapien
taccacctgtaacccaataacttat

SEQ ID NO: 15172 - DNA, 25 bp, Homo sapien
taataagggttttggccatggaaag

SEQ ID NO: 15173 - DNA, 25 bp, Homo sapien
gaaaaagggaagtgcatctccaaaa

SEQ ID NO: 15174 - DNA, 25 bp, Homo sapien
gtgcatctccaaaaggttaacagaa

SEQ ID NO: 15175 - DNA, 25 bp, Homo sapien
agatcaactttgtttatgtcatgca

SEQ ID NO: 15176 - DNA, 25 bp, Homo sapien
tatgtcatgcattttccgaaatcgg

SEQ ID NO: 15177 - DNA, 25 bp, Homo sapien
gcattttccgaaatcgggctccatc

SEQ ID NO: 15178 - DNA, 25 bp, Homo sapien
gctccatctctcttttgcttaattg

SEQ ID NO: 15179 - DNA, 25 bp, Homo sapien
ctctcttttgcttaattgcacttag

SEQ ID NO: 15180 - DNA, 25 bp, Homo sapien
attgcacttagggtgtgggtgtatt

SEQ ID NO: 15181 - DNA, 25 bp, Homo sapien
gagtctgggcatgtctgtatttaaa

SEQ ID NO: 15182 - DNA, 25 bp, Homo sapien
cctctcccacaccactatagtgtaa

SEQ ID NO: 15183 - DNA, 25 bp, Homo sapien
ttcttgctgttcagtgctttttcct

SEQ ID NO: 15184 - DNA, 25 bp, Homo sapien
ttttccttttcatctgttgttctgt

SEQ ID NO: 15185 - DNA, 25 bp, Homo sapien
gtcacagtgaccttagctacatagc

SEQ ID NO: 15186 - DNA, 25 bp, Homo sapien
agctacatagcagactttcccaaat

SEQ ID NO: 15187 - DNA, 25 bp, Homo sapien
atgtctgcaggtttctccttgaagc

SEQ ID NO: 15188 - DNA, 25 bp, Homo sapien
ttgcatttccagaaatctgcctcct

SEQ ID NO: 15189 - DNA, 25 bp, Homo sapien
cttcaccctccgttgacagtatatg

SEQ ID NO: 15190 - DNA, 25 bp, Homo sapien
cagtatatgtcatgcctcactttct

SEQ ID NO: 15191 - DNA, 25 bp, Homo sapien
ctcactttcttctagctgagcttta

SEQ ID NO: 15192 - DNA, 25 bp, Homo sapien
attgtcagatcgttcattgcctttc

SEQ ID NO: 15193 - DNA, 25 bp, Homo sapien
tggctacgacgacttcaactgcaac

SEQ ID NO: 15194 - DNA, 25 bp, Homo sapien
tcaactgcaacatctgggatgccat

SEQ ID NO: 15195 - DNA, 25 bp, Homo sapien
gggatgccatgaagggcgaccgtgc

SEQ ID NO: 15196 - DNA, 25 bp, Homo sapien
gtcaccgacgatggcatggctgtgg

SEQ ID NO: 15197 - DNA, 25 bp, Homo sapien
ggactccttcctcaagatctggaac

SEQ ID NO: 15198 - DNA, 25 bp, Homo sapien
aagatctggaactaatggccccacc

SEQ ID NO: 15199 - DNA, 25 bp, Homo sapien
cactgggcccaggccaggaggggcc

SEQ ID NO: 15200 - DNA, 25 bp, Homo sapien
catgcccacactacaggccagggct

SEQ ID NO: 15201 - DNA, 25 bp, Homo sapien
tggagggccggacagggaggtggaa

SEQ ID NO: 15202 - DNA, 25 bp, Homo sapien
gaggtggaaaccccaggggctggct

SEQ ID NO: 15203 - DNA, 25 bp, Homo sapien
caacatcatctgtggcatcacctct

SEQ ID NO: 15204 - DNA, 25 bp, Homo sapien
agaatggtgtttacagtgctgcaaa

SEQ ID NO: 15205 - DNA, 25 bp, Homo sapien
cagtgctgcaaattacaccaatggg

SEQ ID NO: 15206 - DNA, 25 bp, Homo sapien
gaagtaattttgtgtctgctggtat

SEQ ID NO: 15207 - DNA, 25 bp, Homo sapien
aggactggtaatccaacagggactt

SEQ ID NO: 15208 - DNA, 25 bp, Homo sapien
gaatggttatgatagcactcagcaa

SEQ ID NO: 15209 - DNA, 25 bp, Homo sapien
tgcatatcctgctactgcagctgca

SEQ ID NO: 15210 - DNA, 25 bp, Homo sapien
gcagctgcacctatgattggttatc

SEQ ID NO: 15211 - DNA, 25 bp, Homo sapien
tccaatgccaacaggatattcccaa

SEQ ID NO: 15212 - DNA, 25 bp, Homo sapien
gtctgtttttcataattgctcttta

SEQ ID NO: 15213 - DNA, 25 bp, Homo sapien
tatggtgcactttttcgctatttaa

SEQ ID NO: 15214 - DNA, 25 bp, Homo sapien
agttggatatttctctacattcctg

SEQ ID NO: 15215 - DNA, 25 bp, Homo sapien
ccaaggccatcggccatcggaacta

SEQ ID NO: 15216 - DNA, 25 bp, Homo sapien
atcggaactaccatgcaggctactc

SEQ ID NO: 15217 - DNA, 25 bp, Homo sapien
tgcaggctactccatgtttggggct

SEQ ID NO: 15218 - DNA, 25 bp, Homo sapien
gtctaacctcttctgtggagtctgc

SEQ ID NO: 15219 - DNA, 25 bp, Homo sapien
agtctgcgtgggcatcgtgggcagt

SEQ ID NO: 15220 - DNA, 25 bp, Homo sapien
catcgtggagatctttggcagcgcc

SEQ ID NO: 15221 - DNA, 25 bp, Homo sapien
gtcatcgtcgcaattcttcagacct

SEQ ID NO: 15222 - DNA, 25 bp, Homo sapien
ccctcttgctgcgtgttgatttgga

SEQ ID NO: 15223 - DNA, 25 bp, Homo sapien
gatttggaggcactgcagtccaggc

SEQ ID NO: 15224 - DNA, 25 bp, Homo sapien
tgctgctgactctgtgcagctgcgc

SEQ ID NO: 15225 - DNA, 25 bp, Homo sapien
tcaacccatcttcctagtgtttgtg

SEQ ID NO: 15226 - DNA, 25 bp, Homo sapien
accaccatcctggacgaggaaccga

SEQ ID NO: 15227 - DNA, 25 bp, Homo sapien
gatcgtgaatagggggctggcagct

SEQ ID NO: 15228 - DNA, 25 bp, Homo sapien
ccctcagccgtgtactgcatcgagg

SEQ ID NO: 15229 - DNA, 25 bp, Homo sapien
agggaggaataccgaggcttcacac

SEQ ID NO: 15230 - DNA, 25 bp, Homo sapien
gagaaggacggctacaaacccgacg

SEQ ID NO: 15231 - DNA, 25 bp, Homo sapien
gaaactcacacccaaggaggctttc

SEQ ID NO: 15232 - DNA, 25 bp, Homo sapien
cttccatggcaagggctcaggcaag

SEQ ID NO: 15233 - DNA, 25 bp, Homo sapien
aagaagatgagctccagcgacacgc

SEQ ID NO: 15234 - DNA, 25 bp, Homo sapien
ctcagcggcagcggcaagagcatga

SEQ ID NO: 15235 - DNA, 25 bp, Homo sapien
agagcatgaacgcgaacaccatcac

SEQ ID NO: 15236 - DNA, 25 bp, Homo sapien
aacaccatcaccaagtgacagcgcc

SEQ ID NO: 15237 - DNA, 25 bp, Homo sapien
gaagttcgaccccaacgagatcaaa

SEQ ID NO: 15238 - DNA, 25 bp, Homo sapien
agtcgtatacctgaggtgcaccgga

SEQ ID NO: 15239 - DNA, 25 bp, Homo sapien
gcaacgggtgactggaagggcctga

SEQ ID NO: 15240 - DNA, 25 bp, Homo sapien
gaccattcagaacagacaggcccag

SEQ ID NO: 15241 - DNA, 25 bp, Homo sapien
ggcccagattgaggtggtgccttct

SEQ ID NO: 15242 - DNA, 25 bp, Homo sapien
tcgacagatgcggcaccgatcctta

SEQ ID NO: 15243 - DNA, 25 bp, Homo sapien
accgatccttagccagagaactctc

SEQ ID NO: 15244 - DNA, 25 bp, Homo sapien
agatcctggggactgcccagtcagt

SEQ ID NO: 15245 - DNA, 25 bp, Homo sapien
ggctgtaatgttgatggccgccatc

SEQ ID NO: 15246 - DNA, 25 bp, Homo sapien
cgccatcctcatgacatcatcgatg

SEQ ID NO: 15247 - DNA, 25 bp, Homo sapien
gtggtgctgtggaatgcccagccag

SEQ ID NO: 15248 - DNA, 25 bp, Homo sapien
cctgccaaagtttgcttctcttttc

SEQ ID NO: 15249 - DNA, 25 bp, Homo sapien
ctcaccctccctctaggattaaagt

SEQ ID NO: 15250 - DNA, 25 bp, Homo sapien
tcctccatttcctttttgggatttg

SEQ ID NO: 15251 - DNA, 25 bp, Homo sapien
tattctctggtcttctatttttggt

SEQ ID NO: 15252 - DNA, 25 bp, Homo sapien
agagatgttccctctaatttctctc

SEQ ID NO: 15253 - DNA, 25 bp, Homo sapien
atttctctctagcccattataacct

SEQ ID NO: 15254 - DNA, 25 bp, Homo sapien
taacctgctatcttggggcaacttt

SEQ ID NO: 15255 - DNA, 25 bp, Homo sapien
tgatgtatgacatgtcacccttccc

SEQ ID NO: 15256 - DNA, 25 bp, Homo sapien
cttgtcatctctgtacactacttat

SEQ ID NO: 15257 - DNA, 25 bp, Homo sapien
ttaagcatgttcagtggcagctccc

SEQ ID NO: 15258 - DNA, 25 bp, Homo sapien
taaacccttccccacatgtggtaga

SEQ ID NO: 15259 - DNA, 25 bp, Homo sapien
gttaagggcatgatgagtgtgtcat

SEQ ID NO: 15260 - DNA, 25 bp, Homo sapien
ttcagaatatgacctcaagccagga

SEQ ID NO: 15261 - DNA, 25 bp, Homo sapien
aatatgacctcaagccaggaggagg

SEQ ID NO: 15262 - DNA, 25 bp, Homo sapien
tcctctccaggtaacttcagtctct

SEQ ID NO: 15263 - DNA, 25 bp, Homo sapien
tccaggtaacttcagtctctcttgg

SEQ ID NO: 15264 - DNA, 25 bp, Homo sapien
tcagtctctcttggccacagataaa

SEQ ID NO: 15265 - DNA, 25 bp, Homo sapien
gtctctcttggccacagataaagca

SEQ ID NO: 15266 - DNA, 25 bp, Homo sapien
cagataaagcagaccatcttggtga

SEQ ID NO: 15267 - DNA, 25 bp, Homo sapien
gagaaatggaatgagccctctgtta

SEQ ID NO: 15268 - DNA, 25 bp, Homo sapien
atggaatgagccctctgttactttg

SEQ ID NO: 15269 - DNA, 25 bp, Homo sapien
aatgagccctctgttactttgtaaa

SEQ ID NO: 15270 - DNA, 25 bp, Homo sapien
ctttcaccttaaagctctgccaagc

SEQ ID NO: 15271 - DNA, 25 bp, Homo sapien
cagaggctcccgtgcaggaagagaa

SEQ ID NO: 15272 - DNA, 25 bp, Homo sapien
gcacctcaaatttgccatgctggct

SEQ ID NO: 15273 - DNA, 25 bp, Homo sapien
catgctctaatttccgggctaaaac

SEQ ID NO: 15274 - DNA, 25 bp, Homo sapien
aaatcacatgcagctcatctaagag

SEQ ID NO: 15275 - DNA, 25 bp, Homo sapien
atgagttcaaaagctgccgctcagc

SEQ ID NO: 15276 - DNA, 25 bp, Homo sapien
gccgctcagctttgatggaacaacg

SEQ ID NO: 15277 - DNA, 25 bp, Homo sapien
tcattcgtcagcgacaattggacag

SEQ ID NO: 15278 - DNA, 25 bp, Homo sapien
aaatcgagtccatatagctacattc

SEQ ID NO: 15279 - DNA, 25 bp, Homo sapien
ccacccttgtatcctgggtcttaga

SEQ ID NO: 15280 - DNA, 25 bp, Homo sapien
tgaaatggactgatttgcactcttg

SEQ ID NO: 15281 - DNA, 25 bp, Homo sapien
gtagctgatgaagtatgtcgcattt

SEQ ID NO: 15282 - DNA, 25 bp, Homo sapien
aagtgcatcattgtagaagaaggca

SEQ ID NO: 15283 - DNA, 25 bp, Homo sapien
ggtgtaaccataactgatcctttca

SEQ ID NO: 15284 - DNA, 25 bp, Homo sapien
ccataactgatcctttcaagcattt

SEQ ID NO: 15285 - DNA, 25 bp, Homo sapien
gcttcctgaaaaagattgtcgctat

SEQ ID NO: 15286 - DNA, 25 bp, Homo sapien
aaagattgtcgctatgctttgtatg

SEQ ID NO: 15287 - DNA, 25 bp, Homo sapien
tttttttgtgggcaccagaactagc

SEQ ID NO: 15288 - DNA, 25 bp, Homo sapien
gcaccagaactagcacctctgaaaa

SEQ ID NO: 15289 - DNA, 25 bp, Homo sapien
gaatgtcaagcaaatggaccagaag

SEQ ID NO: 15290 - DNA, 25 bp, Homo sapien
ttaatgttatcctcttgctatataa

SEQ ID NO: 15291 - DNA, 25 bp, Homo sapien
gttatcctcttgctatataaataaa

SEQ ID NO: 15292 - DNA, 25 bp, Homo sapien
tcatcatgattggtaccctgactgc

SEQ ID NO: 15293 - DNA, 25 bp, Homo sapien
gtaccctgactgcactacagtggtt

SEQ ID NO: 15294 - DNA, 25 bp, Homo sapien
gtggtttatctatgactccgtgaag

SEQ ID NO: 15295 - DNA, 25 bp, Homo sapien
gtgaaggtctacttcagacttcctc

SEQ ID NO: 15296 - DNA, 25 bp, Homo sapien
acaccatgatgaagttcgcctgctt

SEQ ID NO: 15297 - DNA, 25 bp, Homo sapien
tcgcctgctttgaacgtactgttga

SEQ ID NO: 15298 - DNA, 25 bp, Homo sapien
tgtacaagtttgtggttcctaagcc

SEQ ID NO: 15299 - DNA, 25 bp, Homo sapien
tcctaagccccgcagtgaatgttca

SEQ ID NO: 15300 - DNA, 25 bp, Homo sapien
accctgctgattctgtggtatctgt

SEQ ID NO: 15301 - DNA, 25 bp, Homo sapien
aaaggtagcagtgcttctctggtcc

SEQ ID NO: 15302 - DNA, 25 bp, Homo sapien
gtgcttctctggtcctcaagagact

SEQ ID NO: 15303 - DNA, 25 bp, Homo sapien
gttctaggaccccagattagcctct

SEQ ID NO: 15304 - DNA, 25 bp, Homo sapien
aggaccccagattagcctctgttaa

SEQ ID NO: 15305 - DNA, 25 bp, Homo sapien
gattagcctctgttaactttgtatg

SEQ ID NO: 15306 - DNA, 25 bp, Homo sapien
gcctctgttaactttgtatgcgtgt

SEQ ID NO: 15307 - DNA, 25 bp, Homo sapien
ctttgtatgcgtgtgttggtgtgta

SEQ ID NO: 15308 - DNA, 25 bp, Homo sapien
gaagaataaaagctgctaacctgtt

SEQ ID NO: 15309 - DNA, 25 bp, Homo sapien
ctctttctccaaaaacaacgccata

SEQ ID NO: 15310 - DNA, 25 bp, Homo sapien
aacaacgccataacatctggtgtgt

SEQ ID NO: 15311 - DNA, 25 bp, Homo sapien
aacgccataacatctggtgtgtgta

SEQ ID NO: 15312 - DNA, 25 bp, Homo sapien
ccataacatctggtgtgtgtagaaa

SEQ ID NO: 15313 - DNA, 25 bp, Homo sapien
tgtagaaaaaagatggcgggccggg

SEQ ID NO: 15314 - DNA, 25 bp, Homo sapien
attacatcataagttctcaagcaga

SEQ ID NO: 15315 - DNA, 25 bp, Homo sapien
gaggcagtctattgcaaggaccttc

SEQ ID NO: 15316 - DNA, 25 bp, Homo sapien
tattgcaaggaccttctttgctgcc

SEQ ID NO: 15317 - DNA, 25 bp, Homo sapien
tgctgccagttatcataggctgttt

SEQ ID NO: 15318 - DNA, 25 bp, Homo sapien
aatgcactttgctcagtaatacttg

SEQ ID NO: 15319 - DNA, 25 bp, Homo sapien
gtatattgcctgtatttctacctct

SEQ ID NO: 15320 - DNA, 25 bp, Homo sapien
atttctacctctagtaatgggcttt

SEQ ID NO: 15321 - DNA, 25 bp, Homo sapien
aatgggctttatgtgctagatttta

SEQ ID NO: 15322 - DNA, 25 bp, Homo sapien
tatccttgagcctgggcaagtgcac

SEQ ID NO: 15323 - DNA, 25 bp, Homo sapien
agaaacatggtttacttgcacaaaa

SEQ ID NO: 15324 - DNA, 25 bp, Homo sapien
gagagatcgttaatgcccttgaagt

SEQ ID NO: 15325 - DNA, 25 bp, Homo sapien
aataatctcttgttatgcagggagt

SEQ ID NO: 15326 - DNA, 25 bp, Homo sapien
tatgcagggagtacagttcttttca

SEQ ID NO: 15327 - DNA, 25 bp, Homo sapien
tcttttcattcatacataagttcag

SEQ ID NO: 15328 - DNA, 25 bp, Homo sapien
taagttcagtagttgcttccctaac

SEQ ID NO: 15329 - DNA, 25 bp, Homo sapien
gttgcttccctaactgcaaaggcaa

SEQ ID NO: 15330 - DNA, 25 bp, Homo sapien
actgcaaaggcaatctcatttagtt

SEQ ID NO: 15331 - DNA, 25 bp, Homo sapien
gagtagctcttgaaagcagctttga

SEQ ID NO: 15332 - DNA, 25 bp, Homo sapien
agaagtatgtgtgttacaccctcac

SEQ ID NO: 15333 - DNA, 25 bp, Homo sapien
tgctgtgtggggcagttcaacacaa

SEQ ID NO: 15334 - DNA, 25 bp, Homo sapien
gttggcatgtcaaatgcatcctcta

SEQ ID NO: 15335 - DNA, 25 bp, Homo sapien
acagcctgatgtttgggaccttttt

SEQ ID NO: 15336 - DNA, 25 bp, Homo sapien
gaagtcacaggccctgtcattgcgc

SEQ ID NO: 15337 - DNA, 25 bp, Homo sapien
gatgccaagtccaatagcctcatct

SEQ ID NO: 15338 - DNA, 25 bp, Homo sapien
cccacaactacactctgtacttcat

SEQ ID NO: 15339 - DNA, 25 bp, Homo sapien
ggagtacaaattcagcgtggatgtg

SEQ ID NO: 15340 - DNA, 25 bp, Homo sapien
gattcagattgagtcctgaggcatt

SEQ ID NO: 15341 - DNA, 25 bp, Homo sapien
gtaggaatcctggttgtggggacca

SEQ ID NO: 15342 - DNA, 25 bp, Homo sapien
actctggatccagtgacagcaggtg

SEQ ID NO: 15343 - DNA, 25 bp, Homo sapien
acagcaggtgtcatgggtcaagcat

SEQ ID NO: 15344 - DNA, 25 bp, Homo sapien
aatcatatatagcattttcaggcat

SEQ ID NO: 15345 - DNA, 25 bp, Homo sapien
ggcatgttcctggtagttcttttga

SEQ ID NO: 15346 - DNA, 25 bp, Homo sapien
ctggtagttcttttgagtctgacat

SEQ ID NO: 15347 - DNA, 25 bp, Homo sapien
gtttctggccagaagaaccaactcc

SEQ ID NO: 15348 - DNA, 25 bp, Homo sapien
aaccaactccacattcaaccaggtt

SEQ ID NO: 15349 - DNA, 25 bp, Homo sapien
gttgtttatgagtcgcaccaaccgg

SEQ ID NO: 15350 - DNA, 25 bp, Homo sapien
tgtccctttcccggatgatccggaa

SEQ ID NO: 15351 - DNA, 25 bp, Homo sapien
gaagcttcctggccgggaaaacaag

SEQ ID NO: 15352 - DNA, 25 bp, Homo sapien
gatgatgtgcgggttcaggaggtac

SEQ ID NO: 15353 - DNA, 25 bp, Homo sapien
aactgaaggtatgtgcactgcgcgt

SEQ ID NO: 15354 - DNA, 25 bp, Homo sapien
ggtcctcgcaagggccgagaggtgt

SEQ ID NO: 15355 - DNA, 25 bp, Homo sapien
aggtgtaccggcatttcggcaaggc

SEQ ID NO: 15356 - DNA, 25 bp, Homo sapien
gaaaggttcggcgcaaggagcccaa

SEQ ID NO: 15357 - DNA, 25 bp, Homo sapien
ggatatctacctgaggctgttggtc

SEQ ID NO: 15358 - DNA, 25 bp, Homo sapien
tgactttttcattacgtgggttttg

SEQ ID NO: 15359 - DNA, 25 bp, Homo sapien
aatctagccccagacatactgtgtt

SEQ ID NO: 15360 - DNA, 25 bp, Homo sapien
aggcctcctgaattgagtttgatgc

SEQ ID NO: 15361 - DNA, 25 bp, Homo sapien
gatgcagagctttttagccatgaag

SEQ ID NO: 15362 - DNA, 25 bp, Homo sapien
gtccatttgagattctgcactccat

SEQ ID NO: 15363 - DNA, 25 bp, Homo sapien
gaaaagttcacttggacgctggggc

SEQ ID NO: 15364 - DNA, 25 bp, Homo sapien
ttgtcaatatatcgaactgttccca

SEQ ID NO: 15365 - DNA, 25 bp, Homo sapien
gtcaagtatgtctcaacactagcat

SEQ ID NO: 15366 - DNA, 25 bp, Homo sapien
taattggatttgtaccgtcctccca

SEQ ID NO: 15367 - DNA, 25 bp, Homo sapien
cctcccattttgttctcggaagatt

SEQ ID NO: 15368 - DNA, 25 bp, Homo sapien
gctacatgtgtaagtctgcctaaat

SEQ ID NO: 15369 - DNA, 25 bp, Homo sapien
gaaaagccatctttgcattgttcct

SEQ ID NO: 15370 - DNA, 25 bp, Homo sapien
tgaactctcgctttctttttaatcc

SEQ ID NO: 15371 - DNA, 25 bp, Homo sapien
caccatgtcagacgcagccgtagac

SEQ ID NO: 15372 - DNA, 25 bp, Homo sapien
atgtcagacgcagccgtagacacca

SEQ ID NO: 15373 - DNA, 25 bp, Homo sapien
agctccgaaatcaccaccaaggact

SEQ ID NO: 15374 - DNA, 25 bp, Homo sapien
atcaccaccaaggacttaaaggaga

SEQ ID NO: 15375 - DNA, 25 bp, Homo sapien
aagctgagtcagctacgggcaagcg

SEQ ID NO: 15376 - DNA, 25 bp, Homo sapien
cagctacgggcaagcgggcagctga

SEQ ID NO: 15377 - DNA, 25 bp, Homo sapien
gatgaggatgacgatgtcgatacca

SEQ ID NO: 15378 - DNA, 25 bp, Homo sapien
gaagcagaagaccgacgaggatgac

SEQ ID NO: 15379 - DNA, 25 bp, Homo sapien
agaccgacgaggatgactagacagc

SEQ ID NO: 15380 - DNA, 25 bp, Homo sapien
gcaaaatgcctagatattatcctac

SEQ ID NO: 15381 - DNA, 25 bp, Homo sapien
gtgcctcgaaagctgttgagccacg

SEQ ID NO: 15382 - DNA, 25 bp, Homo sapien
tgagccacggcaaaaaacccttcag

SEQ ID NO: 15383 - DNA, 25 bp, Homo sapien
aaacccttcagtcagcacgtgagaa

SEQ ID NO: 15384 - DNA, 25 bp, Homo sapien
agaaaactgcgagccagcattaccc

SEQ ID NO: 15385 - DNA, 25 bp, Homo sapien
ctcactggacgccacaggggcaaga

SEQ ID NO: 15386 - DNA, 25 bp, Homo sapien
gcagctggctagtggcttattactt

SEQ ID NO: 15387 - DNA, 25 bp, Homo sapien
aaaacatcttactgatgcttacttc

SEQ ID NO: 15388 - DNA, 25 bp, Homo sapien
gagattacggagcagcgcaagattg

SEQ ID NO: 15389 - DNA, 25 bp, Homo sapien
gtttgctctgacgaatggaatttat

SEQ ID NO: 15390 - DNA, 25 bp, Homo sapien
ttatcctcacaaattggtgttctaa

SEQ ID NO: 15391 - DNA, 25 bp, Homo sapien
ttttagaacctacaagagagctcag

SEQ ID NO: 15392 - DNA, 25 bp, Homo sapien
ttagaacctacaagagagctcagca

SEQ ID NO: 15393 - DNA, 25 bp, Homo sapien
tacaagagagctcagcaaggatgct

SEQ ID NO: 15394 - DNA, 25 bp, Homo sapien
agctcagcaaggatgctggatacaa

SEQ ID NO: 15395 - DNA, 25 bp, Homo sapien
ggatacaaatgaatacccagaaatc

SEQ ID NO: 15396 - DNA, 25 bp, Homo sapien
gaatacccagaaatcaccaaatttt

SEQ ID NO: 15397 - DNA, 25 bp, Homo sapien
ttaatattcaactacagatgattat

SEQ ID NO: 15398 - DNA, 25 bp, Homo sapien
ttgtggtgacaaaagataaatctat

SEQ ID NO: 15399 - DNA, 25 bp, Homo sapien
aaaaatttcgctgggcataatggca

SEQ ID NO: 15400 - DNA, 25 bp, Homo sapien
atttcgctgggcataatggcacgca

SEQ ID NO: 15401 - DNA, 25 bp, Homo sapien
tttcgctgggcataatggcacgcac

SEQ ID NO: 15402 - DNA, 25 bp, Homo sapien
gtcacatagtagcttctgttcatct

SEQ ID NO: 15403 - DNA, 25 bp, Homo sapien
tgttcatcttccaggcacagtgcta

SEQ ID NO: 15404 - DNA, 25 bp, Homo sapien
agcgtttctgccttgagtagcttgc

SEQ ID NO: 15405 - DNA, 25 bp, Homo sapien
gccttgagtagcttgcagtctagtg

SEQ ID NO: 15406 - DNA, 25 bp, Homo sapien
gcagtctagtggtgcaaacttgaaa

SEQ ID NO: 15407 - DNA, 25 bp, Homo sapien
gggccacagagatagcagagattat

SEQ ID NO: 15408 - DNA, 25 bp, Homo sapien
gggttgaccccatcaggaggtccga

SEQ ID NO: 15409 - DNA, 25 bp, Homo sapien
gaggtccgagttgtgactgttagct

SEQ ID NO: 15410 - DNA, 25 bp, Homo sapien
gactgttagctgagagccgaaggat

SEQ ID NO: 15411 - DNA, 25 bp, Homo sapien
aaacagccagcgaggctcagtggcc

SEQ ID NO: 15412 - DNA, 25 bp, Homo sapien
attaaccagacatgatggtgggctc

SEQ ID NO: 15413 - DNA, 25 bp, Homo sapien
gctgcccacctagaactcaggataa

SEQ ID NO: 15414 - DNA, 25 bp, Homo sapien
agaactcaggataaggccacccatc

SEQ ID NO: 15415 - DNA, 25 bp, Homo sapien
tggtgaaggtgcccagtagtgccac

SEQ ID NO: 15416 - DNA, 25 bp, Homo sapien
ggcagacctgtgacatcgaaggcct

SEQ ID NO: 15417 - DNA, 25 bp, Homo sapien
tgaaccgggtgcagagcagcggggc

SEQ ID NO: 15418 - DNA, 25 bp, Homo sapien
cacgaccagaggggccttctgagga

SEQ ID NO: 15419 - DNA, 25 bp, Homo sapien
ggacctggtacttccagaatttctg

SEQ ID NO: 15420 - DNA, 25 bp, Homo sapien
agctacccaacagtccaggacagct

SEQ ID NO: 15421 - DNA, 25 bp, Homo sapien
tcctgccatgggcaggcccgcagga

SEQ ID NO: 15422 - DNA, 25 bp, Homo sapien
ggcccgcaggaagagccggtagggg

SEQ ID NO: 15423 - DNA, 25 bp, Homo sapien
agatctccaaagcccgtgacaaatc

SEQ ID NO: 15424 - DNA, 25 bp, Homo sapien
taaggaaggccagaactatcccgac

SEQ ID NO: 15425 - DNA, 25 bp, Homo sapien
cctgctcggagctggagtgctggat

SEQ ID NO: 15426 - DNA, 25 bp, Homo sapien
cctggccccttaacatagaaccacg

SEQ ID NO: 15427 - DNA, 25 bp, Homo sapien
ctggccccttaacatagaaccacgc

SEQ ID NO: 15428 - DNA, 25 bp, Homo sapien
ggccccttaacatagaaccacgcct

SEQ ID NO: 15429 - DNA, 25 bp, Homo sapien
ccttaacatagaaccacgcctgcta

SEQ ID NO: 15430 - DNA, 25 bp, Homo sapien
taacatagaaccacgcctgctaacc

SEQ ID NO: 15431 - DNA, 25 bp, Homo sapien
ctgcctagggaagaggacaggtggg

SEQ ID NO: 15432 - DNA, 25 bp, Homo sapien
ttccccctcactttgcagagtattt

SEQ ID NO: 15433 - DNA, 25 bp, Homo sapien
tccccctcactttgcagagtatttt

SEQ ID NO: 15434 - DNA, 25 bp, Homo sapien
ccccctcactttgcagagtattttt

SEQ ID NO: 15435 - DNA, 25 bp, Homo sapien
gaccagatatgggctacttgtgact

SEQ ID NO: 15436 - DNA, 25 bp, Homo sapien
tgtgactagacttttaaactttgct

SEQ ID NO: 15437 - DNA, 25 bp, Homo sapien
tttgctctttcaagcagaagcctgg

SEQ ID NO: 15438 - DNA, 25 bp, Homo sapien
gaagcctggtttctgggagaacact

SEQ ID NO: 15439 - DNA, 25 bp, Homo sapien
gaacactgcacagcgatttctttcc

SEQ ID NO: 15440 - DNA, 25 bp, Homo sapien
tcccaggatttacacaactttaaag

SEQ ID NO: 15441 - DNA, 25 bp, Homo sapien
actggtgtttgtttcttagactcat

SEQ ID NO: 15442 - DNA, 25 bp, Homo sapien
tttgccacttctgcattatttagaa

SEQ ID NO: 15443 - DNA, 25 bp, Homo sapien
gaaacatacgttattgtacatttgt

SEQ ID NO: 15444 - DNA, 25 bp, Homo sapien
tgggcaatagtgactccgtttaata

SEQ ID NO: 15445 - DNA, 25 bp, Homo sapien
aaagcttccgtagtgcattggtatg

SEQ ID NO: 15446 - DNA, 25 bp, Homo sapien
gaaatactcagcttaggcattttta

SEQ ID NO: 15447 - DNA, 25 bp, Homo sapien
tgcatagaattgttaccaacctcca

SEQ ID NO: 15448 - DNA, 25 bp, Homo sapien
tgttaccaacctccaaagggctctt

SEQ ID NO: 15449 - DNA, 25 bp, Homo sapien
caaagggctctttaaaatcatattt

SEQ ID NO: 15450 - DNA, 25 bp, Homo sapien
tattcatttgaggatgtcttataaa

SEQ ID NO: 15451 - DNA, 25 bp, Homo sapien
aggtcagaatgcttacgggtgttat

SEQ ID NO: 15452 - DNA, 25 bp, Homo sapien
cagaatgcttacgggtgttattttt

SEQ ID NO: 15453 - DNA, 25 bp, Homo sapien
taagttgttgaattccttaatttag

SEQ ID NO: 15454 - DNA, 25 bp, Homo sapien
gctcattattttttgcacactcaca

SEQ ID NO: 15455 - DNA, 25 bp, Homo sapien
ttctctctcagaaatcaatggcatt

SEQ ID NO: 15456 - DNA, 25 bp, Homo sapien
tcaatggcatttgaaccaccaaaaa

SEQ ID NO: 15457 - DNA, 25 bp, Homo sapien
tacttcctgcggttactgcgtgatt

SEQ ID NO: 15458 - DNA, 25 bp, Homo sapien
gttactgcgtgattctaaagctgcc

SEQ ID NO: 15459 - DNA, 25 bp, Homo sapien
gctgccactcggaacagcgagtcct

SEQ ID NO: 15460 - DNA, 25 bp, Homo sapien
gccgtcgagagcagggaggggtagg

SEQ ID NO: 15461 - DNA, 25 bp, Homo sapien
gtagggtggacaggcgatgccgtgg

SEQ ID NO: 15462 - DNA, 25 bp, Homo sapien
ggcgatgccgtggaaagacgtctcg

SEQ ID NO: 15463 - DNA, 25 bp, Homo sapien
gaaagacgtctcggtggaaactgcc

SEQ ID NO: 15464 - DNA, 25 bp, Homo sapien
gtctcggtggaaactgccatggtgg

SEQ ID NO: 15465 - DNA, 25 bp, Homo sapien
catggtggaaaggtggcgcgcttct

SEQ ID NO: 15466 - DNA, 25 bp, Homo sapien
ggcagagctgcttggatgtgtgagt

SEQ ID NO: 15467 - DNA, 25 bp, Homo sapien
ttggatgtgtgagtcatgaagccag

SEQ ID NO: 15468 - DNA, 25 bp, Homo sapien
ggtgcaacaggaccaatgggccagc

SEQ ID NO: 15469 - DNA, 25 bp, Homo sapien
gaccaatgggccagcaaggcatccc

SEQ ID NO: 15470 - DNA, 25 bp, Homo sapien
caggcaaggctggccactgtaatcc

SEQ ID NO: 15471 - DNA, 25 bp, Homo sapien
ctttggggccatgccgatggagcag

SEQ ID NO: 15472 - DNA, 25 bp, Homo sapien
catgccgatggagcagcagtaccca

SEQ ID NO: 15473 - DNA, 25 bp, Homo sapien
aaccatgaaggggccttttggctga

SEQ ID NO: 15474 - DNA, 25 bp, Homo sapien
agactccgttgggaataaatggcca

SEQ ID NO: 15475 - DNA, 25 bp, Homo sapien
ggccaaagcttataggactctgtga

SEQ ID NO: 15476 - DNA, 25 bp, Homo sapien
gactctgtgacaggttgtgaatgtt

SEQ ID NO: 15477 - DNA, 25 bp, Homo sapien
aagggcatttgggtacaggggcata

SEQ ID NO: 15478 - DNA, 25 bp, Homo sapien
aatcctagctattcaaggggctgag

SEQ ID NO: 15479 - DNA, 25 bp, Homo sapien
gtttgttttattgatgcatttggat

SEQ ID NO: 15480 - DNA, 25 bp, Homo sapien
atacgcaggctttcctatttctaca

SEQ ID NO: 15481 - DNA, 25 bp, Homo sapien
ggctttcctatttctacaactgatt

SEQ ID NO: 15482 - DNA, 25 bp, Homo sapien
ttatgcattttgtaccagtggaact

SEQ ID NO: 15483 - DNA, 25 bp, Homo sapien
atggaaatttttgtggcttgctctg

SEQ ID NO: 15484 - DNA, 25 bp, Homo sapien
aatttttgtggcttgctctggtggg

SEQ ID NO: 15485 - DNA, 25 bp, Homo sapien
ggcccctgacaatgactgatttcaa

SEQ ID NO: 15486 - DNA, 25 bp, Homo sapien
aagtttgatttcgggttgattgatt

SEQ ID NO: 15487 - DNA, 25 bp, Homo sapien
atctagcattagaattttgtcttaa

SEQ ID NO: 15488 - DNA, 25 bp, Homo sapien
taaaataacagcggtaagtttcact

SEQ ID NO: 15489 - DNA, 25 bp, Homo sapien
tttattctgtattgtgcagttacac

SEQ ID NO: 15490 - DNA, 25 bp, Homo sapien
agagcattaaatatctgcactcatc

SEQ ID NO: 15491 - DNA, 25 bp, Homo sapien
aatatctgcactcatcaaagggaat

SEQ ID NO: 15492 - DNA, 25 bp, Homo sapien
tcatctgtcagcagttttgcatgtg

SEQ ID NO: 15493 - DNA, 25 bp, Homo sapien
tcagcagttttgcatgtgacacctt

SEQ ID NO: 15494 - DNA, 25 bp, Homo sapien
ttttgctctatgtaatgggtcacca

SEQ ID NO: 15495 - DNA, 25 bp, Homo sapien
aactgtaagacttggcaaatgctat

SEQ ID NO: 15496 - DNA, 25 bp, Homo sapien
aggttcaggtttcagtattctctct

SEQ ID NO: 15497 - DNA, 25 bp, Homo sapien
gtattctctctgaaggcatcattcc

SEQ ID NO: 15498 - DNA, 25 bp, Homo sapien
ttctctctgaaggcatcattcctgg

SEQ ID NO: 15499 - DNA, 25 bp, Homo sapien
aatgtaatgtggggttctgttcaga

SEQ ID NO: 15500 - DNA, 25 bp, Homo sapien
ttggtcccctaccaacaattggtat

SEQ ID NO: 15501 - DNA, 25 bp, Homo sapien
aaggctgcaaaacggtgttcaccaa

SEQ ID NO: 15502 - DNA, 25 bp, Homo sapien
gattgacagtcatgattggcagccg

SEQ ID NO: 15503 - DNA, 25 bp, Homo sapien
attggcagccggagtcactgcctgg

SEQ ID NO: 15504 - DNA, 25 bp, Homo sapien
ggagtcactgcctggagttggaaaa

SEQ ID NO: 15505 - DNA, 25 bp, Homo sapien
ccagctcctttccctggaagaggaa

SEQ ID NO: 15506 - DNA, 25 bp, Homo sapien
agtgaatgttcctgtttgatgtgac

SEQ ID NO: 15507 - DNA, 25 bp, Homo sapien
tgtgacaggaattctccctggcatt

SEQ ID NO: 15508 - DNA, 25 bp, Homo sapien
ggaccacgggcgaggacgtgaagcc

SEQ ID NO: 15509 - DNA, 25 bp, Homo sapien
gcccactcatcgcagggctcatgat

SEQ ID NO: 15510 - DNA, 25 bp, Homo sapien
gtatccgagtggaaatgcagtcccg

SEQ ID NO: 15511 - DNA, 25 bp, Homo sapien
aatgcagtcccgaggctatgaaatt

SEQ ID NO: 15512 - DNA, 25 bp, Homo sapien
gggcaagagaggaccgtctggcacc

SEQ ID NO: 15513 - DNA, 25 bp, Homo sapien
agactggcctgaacatggctgtcca

SEQ ID NO: 15514 - DNA, 25 bp, Homo sapien
gaagagatccagtctgttcgacgcc

SEQ ID NO: 15515 - DNA, 25 bp, Homo sapien
tgtcggagatcatgatcgcctgcct

SEQ ID NO: 15516 - DNA, 25 bp, Homo sapien
gacatcccgagagtgctggacatgc

SEQ ID NO: 15517 - DNA, 25 bp, Homo sapien
aatgatgctggtgcagactctctgc

SEQ ID NO: 15518 - DNA, 25 bp, Homo sapien
gactctctgccagtacacatttgtg

SEQ ID NO: 15519 - DNA, 25 bp, Homo sapien
taagctcccacaatttcttacgggg

SEQ ID NO: 15520 - DNA, 25 bp, Homo sapien
aaaagcgcttgcctaactcatactt

SEQ ID NO: 15521 - DNA, 25 bp, Homo sapien
tcatactttcccgttgacacttgat

SEQ ID NO: 15522 - DNA, 25 bp, Homo sapien
gtggcgcagtctgaatggcggcacg

SEQ ID NO: 15523 - DNA, 25 bp, Homo sapien
acagttatgttgattcttaaatggg

SEQ ID NO: 15524 - DNA, 25 bp, Homo sapien
ggtgagttagaaattcccagacatg

SEQ ID NO: 15525 - DNA, 25 bp, Homo sapien
aattcccagacatgggcgatgggga

SEQ ID NO: 15526 - DNA, 25 bp, Homo sapien
gaaaatatgacaaactctgagggaa

SEQ ID NO: 15527 - DNA, 25 bp, Homo sapien
cttaattttaattccatctccagag

SEQ ID NO: 15528 - DNA, 25 bp, Homo sapien
gcctaggcaagatggcaacatcccg

SEQ ID NO: 15529 - DNA, 25 bp, Homo sapien
caacatcccgtctctacaaaataat

SEQ ID NO: 15530 - DNA, 25 bp, Homo sapien
gaagtgggaagatcacttgagccca

SEQ ID NO: 15531 - DNA, 25 bp, Homo sapien
gcccaggagttcaaggcttcagtga

SEQ ID NO: 15532 - DNA, 25 bp, Homo sapien
gcttcagtgagccatgatggtgcca

SEQ ID NO: 15533 - DNA, 25 bp, Homo sapien
gagaccctgtctcttaaaaagcaag

SEQ ID NO: 15534 - DNA, 25 bp, Homo sapien
agaagtattcgttcctgcatgactc

SEQ ID NO: 15535 - DNA, 25 bp, Homo sapien
ttctgcttctcagactctattccga

SEQ ID NO: 15536 - DNA, 25 bp, Homo sapien
aaatccaatctagagctgctccgca

SEQ ID NO: 15537 - DNA, 25 bp, Homo sapien
gttcctcaggagtatgttcgccaac

SEQ ID NO: 15538 - DNA, 25 bp, Homo sapien
gacacctcggacagcgatgactatc

SEQ ID NO: 15539 - DNA, 25 bp, Homo sapien
gcagatcctcaagcagacctacagc

SEQ ID NO: 15540 - DNA, 25 bp, Homo sapien
gacgcactgctcaagaactacgggc

SEQ ID NO: 15541 - DNA, 25 bp, Homo sapien
gctgctctactgcttcaggaaggac

SEQ ID NO: 15542 - DNA, 25 bp, Homo sapien
gacaaggtcgagacattcctgcgca

SEQ ID NO: 15543 - DNA, 25 bp, Homo sapien
agggcagctgtggcttctaggtgcc

SEQ ID NO: 15544 - DNA, 25 bp, Homo sapien
ttctaggtgcccgagtagcatcctg

SEQ ID NO: 15545 - DNA, 25 bp, Homo sapien
tccctccctcaggggctgtaaggga

SEQ ID NO: 15546 - DNA, 25 bp, Homo sapien
tcaggggctgtaagggaaggcccac

SEQ ID NO: 15547 - DNA, 25 bp, Homo sapien
actcctccaacagacaacggacgga

SEQ ID NO: 15548 - DNA, 25 bp, Homo sapien
gacaacggacggacggatgccgctg

SEQ ID NO: 15549 - DNA, 25 bp, Homo sapien
atgccgctggtgctcaggaagagct

SEQ ID NO: 15550 - DNA, 25 bp, Homo sapien
gctcaggaagagctagtgccttagg

SEQ ID NO: 15551 - DNA, 25 bp, Homo sapien
ggaagagctagtgccttaggtgggg

SEQ ID NO: 15552 - DNA, 25 bp, Homo sapien
agagctagtgccttaggtgggggaa

SEQ ID NO: 15553 - DNA, 25 bp, Homo sapien
ggaaggcaggactcacgactgagag

SEQ ID NO: 15554 - DNA, 25 bp, Homo sapien
ggcaggactcacgactgagagagag

SEQ ID NO: 15555 - DNA, 25 bp, Homo sapien
gcccccagactgtggggttgggacg

SEQ ID NO: 15556 - DNA, 25 bp, Homo sapien
cctcccatcactggaagtctgcagt

SEQ ID NO: 15557 - DNA, 25 bp, Homo sapien
ctctccccctgagccattgtggggg

SEQ ID NO: 15558 - DNA, 25 bp, Homo sapien
tgtgggggtcgatcatgaatgtccg

SEQ ID NO: 15559 - DNA, 25 bp, Homo sapien
gaatgtccgaagagtggccttttcc

SEQ ID NO: 15560 - DNA, 25 bp, Homo sapien
ccccctttctgtggctggatgggga

SEQ ID NO: 15561 - DNA, 25 bp, Homo sapien
caaatgactactgcacctggacagc

SEQ ID NO: 15562 - DNA, 25 bp, Homo sapien
tcattttataacactctagcccctg

SEQ ID NO: 15563 - DNA, 25 bp, Homo sapien
cctgcccttattgggggacagatgg

SEQ ID NO: 15564 - DNA, 25 bp, Homo sapien
ccctggcagaaccactgcctgaaga

SEQ ID NO: 15565 - DNA, 25 bp, Homo sapien
ctgaagaaccaggttcctgcccggt

SEQ ID NO: 15566 - DNA, 25 bp, Homo sapien
ccctgcctcgagttagttttacaat

SEQ ID NO: 15567 - DNA, 25 bp, Homo sapien
agccatttgaagacgcctcgtttgc

SEQ ID NO: 15568 - DNA, 25 bp, Homo sapien
atttgaagacgcctcgtttgcgctg

SEQ ID NO: 15569 - DNA, 25 bp, Homo sapien
tattgttcccacaatggctgggagg

SEQ ID NO: 15570 - DNA, 25 bp, Homo sapien
ccgccagattctcccttaaggaatt

SEQ ID NO: 15571 - DNA, 25 bp, Homo sapien
gattctcccttaaggaattgacttc

SEQ ID NO: 15572 - DNA, 25 bp, Homo sapien
aaggaattgacttcagcaggggtgg

SEQ ID NO: 15573 - DNA, 25 bp, Homo sapien
ggtgctggaggcagactcgagggcc

SEQ ID NO: 15574 - DNA, 25 bp, Homo sapien
ggaggcagactcgagggccgaattg

SEQ ID NO: 15575 - DNA, 25 bp, Homo sapien
cagactcgagggccgaattgtttct

SEQ ID NO: 15576 - DNA, 25 bp, Homo sapien
tcagtcgcaaaggtgaacactcatg

SEQ ID NO: 15577 - DNA, 25 bp, Homo sapien
aaaggtgaacactcatgcggcagcc

SEQ ID NO: 15578 - DNA, 25 bp, Homo sapien
gtcataaccactcccttgggtatac

SEQ ID NO: 15579 - DNA, 25 bp, Homo sapien
ccaccgcagcccagtagggatgcag

SEQ ID NO: 15580 - DNA, 25 bp, Homo sapien
cgccccagagggctcatgtgggccc

SEQ ID NO: 15581 - DNA, 25 bp, Homo sapien
catgtgggccccagatggcaatgcc

SEQ ID NO: 15582 - DNA, 25 bp, Homo sapien
attgttgatgtgactccagagccag

SEQ ID NO: 15583 - DNA, 25 bp, Homo sapien
aagccacagcggtctggctgttggg

SEQ ID NO: 15584 - DNA, 25 bp, Homo sapien
gactcataccattggcacattaggc

SEQ ID NO: 15585 - DNA, 25 bp, Homo sapien
aagtgttcccactagaactgaccta

SEQ ID NO: 15586 - DNA, 25 bp, Homo sapien
gaactgacctaagccactgattaat

SEQ ID NO: 15587 - DNA, 25 bp, Homo sapien
ctgaagtagcctcacatgtggtccc

SEQ ID NO: 15588 - DNA, 25 bp, Homo sapien
tccccctgcagttcagcagttaaca

SEQ ID NO: 15589 - DNA, 25 bp, Homo sapien
caaaaaagtgccctttttgtcactg

SEQ ID NO: 15590 - DNA, 25 bp, Homo sapien
ttctcctagcattcatgattttttt

SEQ ID NO: 15591 - DNA, 25 bp, Homo sapien
gctaaaatcatggactggctttctg

SEQ ID NO: 15592 - DNA, 25 bp, Homo sapien
ggttggatttcaggtaagatgtgtt

SEQ ID NO: 15593 - DNA, 25 bp, Homo sapien
gtaagatgtgtttaaggccagagct

SEQ ID NO: 15594 - DNA, 25 bp, Homo sapien
ggccagagcttttctcagtatttga

SEQ ID NO: 15595 - DNA, 25 bp, Homo sapien
gagcttttctcagtatttgattttt

SEQ ID NO: 15596 - DNA, 25 bp, Homo sapien
atttcacttctagccttttagtatg

SEQ ID NO: 15597 - DNA, 25 bp, Homo sapien
ttcacttctagccttttagtatggc

SEQ ID NO: 15598 - DNA, 25 bp, Homo sapien
agcatttgtaatttggagtatctgg

SEQ ID NO: 15599 - DNA, 25 bp, Homo sapien
tggagtatctggtactagctaagaa

SEQ ID NO: 15600 - DNA, 25 bp, Homo sapien
accaggagaccaggtcaagcccgac

SEQ ID NO: 15601 - DNA, 25 bp, Homo sapien
caagcccgaccaatacactgaggcc

SEQ ID NO: 15602 - DNA, 25 bp, Homo sapien
aggccctggcccagagggacaagat

SEQ ID NO: 15603 - DNA, 25 bp, Homo sapien
aatgctgggaagtcctaaccacatc

SEQ ID NO: 15604 - DNA, 25 bp, Homo sapien
aagaatgcctcagatcagtgaccca

SEQ ID NO: 15605 - DNA, 25 bp, Homo sapien
tcagtgacccaaggaccttccagaa

SEQ ID NO: 15606 - DNA, 25 bp, Homo sapien
tgaagctgagctccgacggcagttt

SEQ ID NO: 15607 - DNA, 25 bp, Homo sapien
gacggcagtttgaggagcgacagca

SEQ ID NO: 15608 - DNA, 25 bp, Homo sapien
gcagcttctgcaggaggaatccagg

SEQ ID NO: 15609 - DNA, 25 bp, Homo sapien
gcggatggcagctctggtggaagca

SEQ ID NO: 15610 - DNA, 25 bp, Homo sapien
ggagtgtaacctggagctctcagag

SEQ ID NO: 15611 - DNA, 25 bp, Homo sapien
tatgagtcaggctctgtttattgtt

SEQ ID NO: 15612 - DNA, 25 bp, Homo sapien
tattgtttcaattctttacaccaaa

SEQ ID NO: 15613 - DNA, 25 bp, Homo sapien
gtatgaactggagagggtacctcag

SEQ ID NO: 15614 - DNA, 25 bp, Homo sapien
gggtacctcagttataaggagtctg

SEQ ID NO: 15615 - DNA, 25 bp, Homo sapien
ggagtctgagaatattggccctttc

SEQ ID NO: 15616 - DNA, 25 bp, Homo sapien
gccctttctaacctatgtgcataat

SEQ ID NO: 15617 - DNA, 25 bp, Homo sapien
aaaccagcttcatttgttgctccga

SEQ ID NO: 15618 - DNA, 25 bp, Homo sapien
gttgctccgagagtgtttctccaag

SEQ ID NO: 15619 - DNA, 25 bp, Homo sapien
atctgccctgtgttatccagttatg

SEQ ID NO: 15620 - DNA, 25 bp, Homo sapien
gaatacttgcaggctttgtatgtga

SEQ ID NO: 15621 - DNA, 25 bp, Homo sapien
aattctagcgggggacctgggagat

SEQ ID NO: 15622 - DNA, 25 bp, Homo sapien
gctggcagaaccagttcctggcatc

SEQ ID NO: 15623 - DNA, 25 bp, Homo sapien
gcaacgcccgttattttcatgtggt

SEQ ID NO: 15624 - DNA, 25 bp, Homo sapien
ctcaggattccccctttgagggagg

SEQ ID NO: 15625 - DNA, 25 bp, Homo sapien
agaagaatacccaatggcagcccct

SEQ ID NO: 15626 - DNA, 25 bp, Homo sapien
cagcccctaaagtacgtttcatgac

SEQ ID NO: 15627 - DNA, 25 bp, Homo sapien
gatccgcacagttctgctatcgatc

SEQ ID NO: 15628 - DNA, 25 bp, Homo sapien
gctatcgatccaggccttgttaagt

SEQ ID NO: 15629 - DNA, 25 bp, Homo sapien
taagtgctcccaatccagatgatcc

SEQ ID NO: 15630 - DNA, 25 bp, Homo sapien
gaccaacgaagcccaagccatagaa

SEQ ID NO: 15631 - DNA, 25 bp, Homo sapien
tcaagtgtgcatcacttctcctgtt

SEQ ID NO: 15632 - DNA, 25 bp, Homo sapien
ttcctcctctttgtttgcatttaat

SEQ ID NO: 15633 - DNA, 25 bp, Homo sapien
aaagtcacttcagccaagttttcat

SEQ ID NO: 15634 - DNA, 25 bp, Homo sapien
cacccatgagctcctatcaagaagt

SEQ ID NO: 15635 - DNA, 25 bp, Homo sapien
agaagtgatcaacgtgacccctttt

SEQ ID NO: 15636 - DNA, 25 bp, Homo sapien
aacgtgaccccttttcacagattga

SEQ ID NO: 15637 - DNA, 25 bp, Homo sapien
gtgtaatcacactgctgcttggata

SEQ ID NO: 15638 - DNA, 25 bp, Homo sapien
ctgctgcttggataactgggtactt

SEQ ID NO: 15639 - DNA, 25 bp, Homo sapien
tcactttgggactgggatcccttgc

SEQ ID NO: 15640 - DNA, 25 bp, Homo sapien
gggatcccttgctgattgacaaaca

SEQ ID NO: 15641 - DNA, 25 bp, Homo sapien
gacaaacagactttctgggaccttg

SEQ ID NO: 15642 - DNA, 25 bp, Homo sapien
ctgggaccttgatggagtggggaac

SEQ ID NO: 15643 - DNA, 25 bp, Homo sapien
ctaccttcagagactctagcccagc

SEQ ID NO: 15644 - DNA, 25 bp, Homo sapien
attgggccccaggtgtgtatgaggc

SEQ ID NO: 15645 - DNA, 25 bp, Homo sapien
ggccccaggtgtgtatgaggcgctc

SEQ ID NO: 15646 - DNA, 25 bp, Homo sapien
caggtgtgtatgaggcgctctggta

SEQ ID NO: 15647 - DNA, 25 bp, Homo sapien
tgtgtatgaggcgctctggtaaggt

SEQ ID NO: 15648 - DNA, 25 bp, Homo sapien
cttccttggcatttgcatcactgcc

SEQ ID NO: 15649 - DNA, 25 bp, Homo sapien
ccttggcatttgcatcactgccttc

SEQ ID NO: 15650 - DNA, 25 bp, Homo sapien
ccttctgttcccgggggagcatgga

SEQ ID NO: 15651 - DNA, 25 bp, Homo sapien
tgtcctcactgctttctaatgggga

SEQ ID NO: 15652 - DNA, 25 bp, Homo sapien
tcactgctttctaatggggagggct

SEQ ID NO: 15653 - DNA, 25 bp, Homo sapien
ccccacagcaggtatgtttgctctg

SEQ ID NO: 15654 - DNA, 25 bp, Homo sapien
cacagcaggtatgtttgctctgccc

SEQ ID NO: 15655 - DNA, 25 bp, Homo sapien
accaagctgggcctgcagaggaggg

SEQ ID NO: 15656 - DNA, 25 bp, Homo sapien
gaggaggggcacagtaggacacagt

SEQ ID NO: 15657 - DNA, 25 bp, Homo sapien
gacacagtgactgcccaggtgtcca

SEQ ID NO: 15658 - DNA, 25 bp, Homo sapien
caggtgtccacacacctgtaggcct

SEQ ID NO: 15659 - DNA, 25 bp, Homo sapien
gtacaggtgcgggtggtggggatga

SEQ ID NO: 15660 - DNA, 25 bp, Homo sapien
caggtttggagaggaccctgtgccc

SEQ ID NO: 15661 - DNA, 25 bp, Homo sapien
cacattcaagtcccccattggtggg

SEQ ID NO: 15662 - DNA, 25 bp, Homo sapien
catccttggctccagagctcgaaga

SEQ ID NO: 15663 - DNA, 25 bp, Homo sapien
aggaccaagggctggcggtgtggcc

SEQ ID NO: 15664 - DNA, 25 bp, Homo sapien
cggtgtggccagggcaggggacagg

SEQ ID NO: 15665 - DNA, 25 bp, Homo sapien
gacaggccaccaaggacctttggca

SEQ ID NO: 15666 - DNA, 25 bp, Homo sapien
ggaacgcttggaagcccttgatgcc

SEQ ID NO: 15667 - DNA, 25 bp, Homo sapien
acgcttggaagcccttgatgccaat

SEQ ID NO: 15668 - DNA, 25 bp, Homo sapien
ttggaagcccttgatgccaattctc

SEQ ID NO: 15669 - DNA, 25 bp, Homo sapien
cccttgatgccaattctcggaagca

SEQ ID NO: 15670 - DNA, 25 bp, Homo sapien
gccaattctcggaagcaagaagcag

SEQ ID NO: 15671 - DNA, 25 bp, Homo sapien
gaatggtatgcaagacaggacgagc

SEQ ID NO: 15672 - DNA, 25 bp, Homo sapien
gcaagacaggacgagcagctacaga

SEQ ID NO: 15673 - DNA, 25 bp, Homo sapien
gacaggacgagcagctacagaaaac

SEQ ID NO: 15674 - DNA, 25 bp, Homo sapien
ggaagcttcccaagagtagcctcaa

SEQ ID NO: 15675 - DNA, 25 bp, Homo sapien
cttcccaagagtagcctcaacctgt

SEQ ID NO: 15676 - DNA, 25 bp, Homo sapien
caagagtagcctcaacctgtgcttc

SEQ ID NO: 15677 - DNA, 25 bp, Homo sapien
ctgatggatgtgagcctggtgggcg

SEQ ID NO: 15678 - DNA, 25 bp, Homo sapien
ccctccggactcggatgactggagg

SEQ ID NO: 15679 - DNA, 25 bp, Homo sapien
gactcggatgactggaggtcgtcca

SEQ ID NO: 15680 - DNA, 25 bp, Homo sapien
ctcggatgactggaggtcgtccacc

SEQ ID NO: 15681 - DNA, 25 bp, Homo sapien
gctgctacccagctggggtgggtga

SEQ ID NO: 15682 - DNA, 25 bp, Homo sapien
gctacccagctggggtgggtgaggc

SEQ ID NO: 15683 - DNA, 25 bp, Homo sapien
ggtcaaggagagggttttggccgct

SEQ ID NO: 15684 - DNA, 25 bp, Homo sapien
tcaaggagagggttttggccgctcc

SEQ ID NO: 15685 - DNA, 25 bp, Homo sapien
gtaccaaagacagtggtggtccggt

SEQ ID NO: 15686 - DNA, 25 bp, Homo sapien
aagacagtggtggtccggtggaggg

SEQ ID NO: 15687 - DNA, 25 bp, Homo sapien
cagtggtggtccggtggagggaaga

SEQ ID NO: 15688 - DNA, 25 bp, Homo sapien
caccgggaagctgatccagggagcc

SEQ ID NO: 15689 - DNA, 25 bp, Homo sapien
catccggggggaccccgagtgtcat

SEQ ID NO: 15690 - DNA, 25 bp, Homo sapien
gagtgtcatctcttctacaatgagc

SEQ ID NO: 15691 - DNA, 25 bp, Homo sapien
gcacacccagcggatgcagtagacc

SEQ ID NO: 15692 - DNA, 25 bp, Homo sapien
gaaaacggagagtgcttgggtggtg

SEQ ID NO: 15693 - DNA, 25 bp, Homo sapien
atccccaactgtgacaagcatggcc

SEQ ID NO: 15694 - DNA, 25 bp, Homo sapien
tgacaagcatggcctgtacaacctc

SEQ ID NO: 15695 - DNA, 25 bp, Homo sapien
gtacaacctcaaacagtgcaagatg

SEQ ID NO: 15696 - DNA, 25 bp, Homo sapien
gcaagatgtctctgaacgggcagcg

SEQ ID NO: 15697 - DNA, 25 bp, Homo sapien
acgggcagcgtggggagtgctggtg

SEQ ID NO: 15698 - DNA, 25 bp, Homo sapien
gaaccccaacaccgggaagctgatc

SEQ ID NO: 15699 - DNA, 25 bp, Homo sapien
gaaaagaggctgcttcaggcaccac

SEQ ID NO: 15700 - DNA, 25 bp, Homo sapien
aggcctcagtggtgaaggtcctgac

SEQ ID NO: 15701 - DNA, 25 bp, Homo sapien
cagtggtgaaggtcctgactgagct

SEQ ID NO: 15702 - DNA, 25 bp, Homo sapien
ggtggacaccaccaaggagagcagc

SEQ ID NO: 15703 - DNA, 25 bp, Homo sapien
gacaccaccaaggagagcagcagga

SEQ ID NO: 15704 - DNA, 25 bp, Homo sapien
gagccgcaagcggaagctatcggga

SEQ ID NO: 15705 - DNA, 25 bp, Homo sapien
gaagctatcgggagaccagccagct

SEQ ID NO: 15706 - DNA, 25 bp, Homo sapien
ctccacgacttccaaggggaaagca

SEQ ID NO: 15707 - DNA, 25 bp, Homo sapien
ggctcccaaggggccaaggacgagc

SEQ ID NO: 15708 - DNA, 25 bp, Homo sapien
gggatggggacggttgaaggtggag

SEQ ID NO: 15709 - DNA, 25 bp, Homo sapien
gaaggtggagatcaaagcaacccaa

SEQ ID NO: 15710 - DNA, 25 bp, Homo sapien
taaaacattctcctaggaccaggga

SEQ ID NO: 15711 - DNA, 25 bp, Homo sapien
attctcctaggaccagggaagcctg

SEQ ID NO: 15712 - DNA, 25 bp, Homo sapien
cctggcttacagtgccatttctgct

SEQ ID NO: 15713 - DNA, 25 bp, Homo sapien
gcttacagtgccatttctgctgggc

SEQ ID NO: 15714 - DNA, 25 bp, Homo sapien
tacagtgccatttctgctgggcacc

SEQ ID NO: 15715 - DNA, 25 bp, Homo sapien
cttctctggaatgtttatggtggtt

SEQ ID NO: 15716 - DNA, 25 bp, Homo sapien
atgtttatggtggttcagaagaatg

SEQ ID NO: 15717 - DNA, 25 bp, Homo sapien
gaagaatgatgactcctctttgctg

SEQ ID NO: 15718 - DNA, 25 bp, Homo sapien
atgatgactcctctttgctgagaac

SEQ ID NO: 15719 - DNA, 25 bp, Homo sapien
tgctgagaactgttcatccttcttc

SEQ ID NO: 15720 - DNA, 25 bp, Homo sapien
gaactgttcatccttcttcaagaag

SEQ ID NO: 15721 - DNA, 25 bp, Homo sapien
ggctcatgttgctcacaggcagagt

SEQ ID NO: 15722 - DNA, 25 bp, Homo sapien
gagtgtctctggcacagtttgcctt

SEQ ID NO: 15723 - DNA, 25 bp, Homo sapien
ccttcgtgacggacacgtgcgtggc

SEQ ID NO: 15724 - DNA, 25 bp, Homo sapien
gcctggggatgggatcaccttccag

SEQ ID NO: 15725 - DNA, 25 bp, Homo sapien
caccttccagaccacagcagatgtg

SEQ ID NO: 15726 - DNA, 25 bp, Homo sapien
agcagatgtgggacacacagcctcc

SEQ ID NO: 15727 - DNA, 25 bp, Homo sapien
cacagcctcctgactccaggaagag

SEQ ID NO: 15728 - DNA, 25 bp, Homo sapien
cccccacacctagactcagtaagga

SEQ ID NO: 15729 - DNA, 25 bp, Homo sapien
gtcgggttggaccttaacatctgca

SEQ ID NO: 15730 - DNA, 25 bp, Homo sapien
acatctgcattggacaactccaccc

SEQ ID NO: 15731 - DNA, 25 bp, Homo sapien
ggcttgggccgtgacttaggcagag

SEQ ID NO: 15732 - DNA, 25 bp, Homo sapien
gaagtattcattcctgcagaacccc

SEQ ID NO: 15733 - DNA, 25 bp, Homo sapien
gtttctcagagtctattccgacacc

SEQ ID NO: 15734 - DNA, 25 bp, Homo sapien
gctcatccagtcgtggctggagccc

SEQ ID NO: 15735 - DNA, 25 bp, Homo sapien
tgcagttcctcaggagtgtcttcgc

SEQ ID NO: 15736 - DNA, 25 bp, Homo sapien
cttcgccaacagcctggtgtacggc

SEQ ID NO: 15737 - DNA, 25 bp, Homo sapien
tgacagcaacgtctatgacctccta

SEQ ID NO: 15738 - DNA, 25 bp, Homo sapien
gcagacctacagcaagttcgacaca

SEQ ID NO: 15739 - DNA, 25 bp, Homo sapien
gacgcactactcaagaactacgggc

SEQ ID NO: 15740 - DNA, 25 bp, Homo sapien
gctgctctactgcttcaggaaggac

SEQ ID NO: 15741 - DNA, 25 bp, Homo sapien
gacaaggtcgagacattcctgcgca

SEQ ID NO: 15742 - DNA, 25 bp, Homo sapien
gccttggaagttgccactccagtgc

SEQ ID NO: 15743 - DNA, 25 bp, Homo sapien
agccattgttttgtgccattcagga

SEQ ID NO: 15744 - DNA, 25 bp, Homo sapien
gttttgtgccattcaggagaggaaa

SEQ ID NO: 15745 - DNA, 25 bp, Homo sapien
tatgctgtacatttcagttcagtgt

SEQ ID NO: 15746 - DNA, 25 bp, Homo sapien
ttcagttcagtgtatgaccaaaagc

SEQ ID NO: 15747 - DNA, 25 bp, Homo sapien
gatgtttgacatactaattatttta

SEQ ID NO: 15748 - DNA, 25 bp, Homo sapien
atttaaaccatactgtagcaacata

SEQ ID NO: 15749 - DNA, 25 bp, Homo sapien
tgtagaattatttttacgatttcca

SEQ ID NO: 15750 - DNA, 25 bp, Homo sapien
acgatttccaaacaaatgtactgta

SEQ ID NO: 15751 - DNA, 25 bp, Homo sapien
gtactgtactgttatataatttatt

SEQ ID NO: 15752 - DNA, 25 bp, Homo sapien
gaattcagaaaaccacttaagcaag

SEQ ID NO: 15753 - DNA, 25 bp, Homo sapien
cacttaagcaagacccttctgaaat

SEQ ID NO: 15754 - DNA, 25 bp, Homo sapien
agatgcaccatgcatgctcacagtc

SEQ ID NO: 15755 - DNA, 25 bp, Homo sapien
cacagtcccttgcctatgtgtggca

SEQ ID NO: 15756 - DNA, 25 bp, Homo sapien
ctatgtgtggcagagtgtcccagcc

SEQ ID NO: 15757 - DNA, 25 bp, Homo sapien
cccaccccatgtccatttacatgtc

SEQ ID NO: 15758 - DNA, 25 bp, Homo sapien
aatgcccacctcaaaaggtacctct

SEQ ID NO: 15759 - DNA, 25 bp, Homo sapien
caaaaggtacctcttctgtaaagct

SEQ ID NO: 15760 - DNA, 25 bp, Homo sapien
ttctgtaaagctttccctggtatca

SEQ ID NO: 15761 - DNA, 25 bp, Homo sapien
atcagggatcttttcacactgctgt

SEQ ID NO: 15762 - DNA, 25 bp, Homo sapien
tttggtccttctatcactaaaactc

SEQ ID NO: 15763 - DNA, 25 bp, Homo sapien
ctcatctcattcagccttacagcat

SEQ ID NO: 15764 - DNA, 25 bp, Homo sapien
atttgttttcctcactacattgtac

SEQ ID NO: 15765 - DNA, 25 bp, Homo sapien
cctcctccagactcgagagggctga

SEQ ID NO: 15766 - DNA, 25 bp, Homo sapien
ctcctccagactcgagagggctgag

SEQ ID NO: 15767 - DNA, 25 bp, Homo sapien
tcctccagactcgagagggctgagc

SEQ ID NO: 15768 - DNA, 25 bp, Homo sapien
cctccagactcgagagggctgagcc

SEQ ID NO: 15769 - DNA, 25 bp, Homo sapien
ctccagactcgagagggctgagccc

SEQ ID NO: 15770 - DNA, 25 bp, Homo sapien
ccagactcgagagggctgagcccct

SEQ ID NO: 15771 - DNA, 25 bp, Homo sapien
cagactcgagagggctgagcccctc

SEQ ID NO: 15772 - DNA, 25 bp, Homo sapien
agactcgagagggctgagcccctcc

SEQ ID NO: 15773 - DNA, 25 bp, Homo sapien
ggagaagggggttgctttcatttga

SEQ ID NO: 15774 - DNA, 25 bp, Homo sapien
tttttcatccccacgttgagttgga

SEQ ID NO: 15775 - DNA, 25 bp, Homo sapien
tggaggaatagtctcttctcttcac

SEQ ID NO: 15776 - DNA, 25 bp, Homo sapien
tcttctcttcacctcaatatagctt

SEQ ID NO: 15777 - DNA, 25 bp, Homo sapien
aaacaatctttcagggatcacgtca

SEQ ID NO: 15778 - DNA, 25 bp, Homo sapien
gatcacgtcaatggcctacaaccaa

SEQ ID NO: 15779 - DNA, 25 bp, Homo sapien
gcctacaaccaagctatttgtcccc

SEQ ID NO: 15780 - DNA, 25 bp, Homo sapien
ttgtcccctactttgagtcttaact

SEQ ID NO: 15781 - DNA, 25 bp, Homo sapien
gagtcttaactgtggtttttcttca

SEQ ID NO: 15782 - DNA, 25 bp, Homo sapien
tgggaaagggcttcaaggcaccacc

SEQ ID NO: 15783 - DNA, 25 bp, Homo sapien
tttaatattcatacttggggccagg

SEQ ID NO: 15784 - DNA, 25 bp, Homo sapien
agctgcagcagcacaacctggagat

SEQ ID NO: 15785 - DNA, 25 bp, Homo sapien
tccccagcccttagcacagagaggg

SEQ ID NO: 15786 - DNA, 25 bp, Homo sapien
acagagagggacacatgcccctccc

SEQ ID NO: 15787 - DNA, 25 bp, Homo sapien
ccccagctgcgtttttttatagtag

SEQ ID NO: 15788 - DNA, 25 bp, Homo sapien
tttctgtggatacagtgcccaccgc

SEQ ID NO: 15789 - DNA, 25 bp, Homo sapien
ccacttggaaacggtatcctccctg

SEQ ID NO: 15790 - DNA, 25 bp, Homo sapien
cacttctagtggtctcacctggagg

SEQ ID NO: 15791 - DNA, 25 bp, Homo sapien
gagggagggtacagagcctctgcca

SEQ ID NO: 15792 - DNA, 25 bp, Homo sapien
gcctcctgctctctggaggtactga

SEQ ID NO: 15793 - DNA, 25 bp, Homo sapien
ctggacctatgcagggaggccacgt

SEQ ID NO: 15794 - DNA, 25 bp, Homo sapien
ctgctcccctttgggggtgtgtgtg

SEQ ID NO: 15795 - DNA, 25 bp, Homo sapien
gaatctgaaaacaatggaaccatgc

SEQ ID NO: 15796 - DNA, 25 bp, Homo sapien
ggaaccatgccttcataattctaga

SEQ ID NO: 15797 - DNA, 25 bp, Homo sapien
caactgataaatctatattcaccca

SEQ ID NO: 15798 - DNA, 25 bp, Homo sapien
aaatctatattcacccaaataatca

SEQ ID NO: 15799 - DNA, 25 bp, Homo sapien
gcaaagactcaggggttacctccat

SEQ ID NO: 15800 - DNA, 25 bp, Homo sapien
tacctccatgtgccctttttaggga

SEQ ID NO: 15801 - DNA, 25 bp, Homo sapien
gccctttttagggaagctgttggag

SEQ ID NO: 15802 - DNA, 25 bp, Homo sapien
atgaaggagtacacaaaccagagaa

SEQ ID NO: 15803 - DNA, 25 bp, Homo sapien
agagaatgacatgaatccagcaaat

SEQ ID NO: 15804 - DNA, 25 bp, Homo sapien
aatcggttagctgggtggaatggcc

SEQ ID NO: 15805 - DNA, 25 bp, Homo sapien
aggctcagcagcaggacgacttgag

SEQ ID NO: 15806 - DNA, 25 bp, Homo sapien
agcctttgcttctggataactcact

SEQ ID NO: 15807 - DNA, 25 bp, Homo sapien
agagctcttcacgtttcttgagaat

SEQ ID NO: 15808 - DNA, 25 bp, Homo sapien
gtttcttgagaattatctgaagcca

SEQ ID NO: 15809 - DNA, 25 bp, Homo sapien
aagccagttgcattctgtgatatca

SEQ ID NO: 15810 - DNA, 25 bp, Homo sapien
gttgcattctgtgatatcagttttg

SEQ ID NO: 15811 - DNA, 25 bp, Homo sapien
atatcagttttgaaggcacatggtt

SEQ ID NO: 15812 - DNA, 25 bp, Homo sapien
tctgctttagatttatcccatatgc

SEQ ID NO: 15813 - DNA, 25 bp, Homo sapien
tgctattgtttaatactggatgtat

SEQ ID NO: 15814 - DNA, 25 bp, Homo sapien
gtatgtaagtgttttactgcactgt

SEQ ID NO: 15815 - DNA, 25 bp, Homo sapien
actgcactgtattgaattggtgtct

SEQ ID NO: 15816 - DNA, 25 bp, Homo sapien
aattggtgtcttttgcacagttagc

SEQ ID NO: 15817 - DNA, 25 bp, Homo sapien
ggacagactgatagtttctttcttt

SEQ ID NO: 15818 - DNA, 25 bp, Homo sapien
cagaaactcacaaacctagacatgg

SEQ ID NO: 15819 - DNA, 25 bp, Homo sapien
gaaaaacagattactgtctattgtc

SEQ ID NO: 15820 - DNA, 25 bp, Homo sapien
gtctattgtcagcatcattttcatc

SEQ ID NO: 15821 - DNA, 25 bp, Homo sapien
gcatcattttcatctgtaagtcact

SEQ ID NO: 15822 - DNA, 25 bp, Homo sapien
ttcatctgtaagtcactactggaat

SEQ ID NO: 15823 - DNA, 25 bp, Homo sapien
tacacacagtttttccgacttttca

SEQ ID NO: 15824 - DNA, 25 bp, Homo sapien
taatattgggaccccataccgttag

SEQ ID NO: 15825 - DNA, 25 bp, Homo sapien
ccccataccgttagcccttgtatgt

SEQ ID NO: 15826 - DNA, 25 bp, Homo sapien
gcccttgtatgtataccaacactgc

SEQ ID NO: 15827 - DNA, 25 bp, Homo sapien
gtataccaacactgccaaagtaaaa

SEQ ID NO: 15828 - DNA, 25 bp, Homo sapien
ctgcctgtttcctcccaatggaggg

SEQ ID NO: 15829 - DNA, 25 bp, Homo sapien
ccccgctgccattttgatagtataa

SEQ ID NO: 15830 - DNA, 25 bp, Homo sapien
ggggagagggagtcatctcttccta

SEQ ID NO: 15831 - DNA, 25 bp, Homo sapien
gtcatctcttcctatatttggtggg

SEQ ID NO: 15832 - DNA, 25 bp, Homo sapien
gatttgggggggaatcttctgcctc

SEQ ID NO: 15833 - DNA, 25 bp, Homo sapien
aacatgaattttcagttccctccct

SEQ ID NO: 15834 - DNA, 25 bp, Homo sapien
caaaggaccctttcaatgtccctgg

SEQ ID NO: 15835 - DNA, 25 bp, Homo sapien
gacataaagcctgtcctgtctctat

SEQ ID NO: 15836 - DNA, 25 bp, Homo sapien
ctgtcctgtctctattctaggcaag

SEQ ID NO: 15837 - DNA, 25 bp, Homo sapien
ggttcaaaagactcctgggctcacc

SEQ ID NO: 15838 - DNA, 25 bp, Homo sapien
gatttgggggacagtgctacactcg

SEQ ID NO: 15839 - DNA, 25 bp, Homo sapien
aagtattcattcctgcatgactccc

SEQ ID NO: 15840 - DNA, 25 bp, Homo sapien
ttctgcttctcagactctattccga

SEQ ID NO: 15841 - DNA, 25 bp, Homo sapien
aaatccaatctagagctgctccgca

SEQ ID NO: 15842 - DNA, 25 bp, Homo sapien
gctcatcgagtcgtggctggagccc

SEQ ID NO: 15843 - DNA, 25 bp, Homo sapien
gttcctcaggagtatgttcgccaac

SEQ ID NO: 15844 - DNA, 25 bp, Homo sapien
gacacctcggacagcgatgactatc

SEQ ID NO: 15845 - DNA, 25 bp, Homo sapien
gcagatcctcaagcagacctacagc

SEQ ID NO: 15846 - DNA, 25 bp, Homo sapien
gacgcactgctcaagaactacgggc

SEQ ID NO: 15847 - DNA, 25 bp, Homo sapien
gctgctctactgcttcaggaaggac

SEQ ID NO: 15848 - DNA, 25 bp, Homo sapien
gacaaggtcgagacattcctgcgca

SEQ ID NO: 15849 - DNA, 25 bp, Homo sapien
agggtagctgtggcttctaggtgcc

SEQ ID NO: 15850 - DNA, 25 bp, Homo sapien
ccgcctctgcaactacaaggccaag

SEQ ID NO: 15851 - DNA, 25 bp, Homo sapien
gttccaggtggtcaagcacgtacgc

SEQ ID NO: 15852 - DNA, 25 bp, Homo sapien
ccaagccgacccaaaccagggtgtg

SEQ ID NO: 15853 - DNA, 25 bp, Homo sapien
cccacagtgcacctgcatgatgtgc

SEQ ID NO: 15854 - DNA, 25 bp, Homo sapien
tccccacactggacctgagggctga

SEQ ID NO: 15855 - DNA, 25 bp, Homo sapien
tgccccacctcctgtataggaagag

SEQ ID NO: 15856 - DNA, 25 bp, Homo sapien
gagatgtgcagactgggaccagcgc

SEQ ID NO: 15857 - DNA, 25 bp, Homo sapien
cttcctgggactctggctatagtac

SEQ ID NO: 15858 - DNA, 25 bp, Homo sapien
gctgtacattgcgtttttaacctgc

SEQ ID NO: 15859 - DNA, 25 bp, Homo sapien
agatctggattttacccactccatc

SEQ ID NO: 15860 - DNA, 25 bp, Homo sapien
ttccttcttactgtgtcaattccta

SEQ ID NO: 15861 - DNA, 25 bp, Homo sapien
gtgtgttgggaagttctgttgaggc

SEQ ID NO: 15862 - DNA, 25 bp, Homo sapien
gggaagttctgttgaggcttagttt

SEQ ID NO: 15863 - DNA, 25 bp, Homo sapien
gttgaggcttagtttgatcttccat

SEQ ID NO: 15864 - DNA, 25 bp, Homo sapien
cttagtttgatcttccatggtggac

SEQ ID NO: 15865 - DNA, 25 bp, Homo sapien
tttccacagtccttgtgctctgaga

SEQ ID NO: 15866 - DNA, 25 bp, Homo sapien
cacagtccttgtgctctgagatggc

SEQ ID NO: 15867 - DNA, 25 bp, Homo sapien
gtccttgtgctctgagatggctgtt

SEQ ID NO: 15868 - DNA, 25 bp, Homo sapien
tgagatggctgttgagctctgctca

SEQ ID NO: 15869 - DNA, 25 bp, Homo sapien
cacacaggcagagtgccttggcagg

SEQ ID NO: 15870 - DNA, 25 bp, Homo sapien
accccttggcgagccagaactggga

SEQ ID NO: 15871 - DNA, 25 bp, Homo sapien
tttgtacatatgccctaggaaaatt

SEQ ID NO: 15872 - DNA, 25 bp, Homo sapien
atctgggagccccaagagggcgtgg

SEQ ID NO: 15873 - DNA, 25 bp, Homo sapien
gagggcgtgggaaggggggccatag

SEQ ID NO: 15874 - DNA, 25 bp, Homo sapien
ggaaggggggccatagcccatcaag

SEQ ID NO: 15875 - DNA, 25 bp, Homo sapien
ggctgggcccctagactagagggca

SEQ ID NO: 15876 - DNA, 25 bp, Homo sapien
cagaggtaaatgagtccctgtcccc

SEQ ID NO: 15877 - DNA, 25 bp, Homo sapien
tcacccctgtggtgggctttttaag

SEQ ID NO: 15878 - DNA, 25 bp, Homo sapien
gaggattttaactggttgtggggag

SEQ ID NO: 15879 - DNA, 25 bp, Homo sapien
tgttggggggatgaggacctcctac

SEQ ID NO: 15880 - DNA, 25 bp, Homo sapien
cctcctgtgtcccttgtaaatagaa

SEQ ID NO: 15881 - DNA, 25 bp, Homo sapien
ctggcccccgggtgtaaatagattg

SEQ ID NO: 15882 - DNA, 25 bp, Homo sapien
gagagctcctgatgtcttagtttcc

SEQ ID NO: 15883 - DNA, 25 bp, Homo sapien
gggcatcgggtgctatatgttccgc

SEQ ID NO: 15884 - DNA, 25 bp, Homo sapien
gttccgcatggatgactttgatgta

SEQ ID NO: 15885 - DNA, 25 bp, Homo sapien
ggacgccacgatgcatggcaatgcc

SEQ ID NO: 15886 - DNA, 25 bp, Homo sapien
tccacgtggagggccagaaacacat

SEQ ID NO: 15887 - DNA, 25 bp, Homo sapien
agaaacacattgttatcttcgccct

SEQ ID NO: 15888 - DNA, 25 bp, Homo sapien
gcatcctgcgtggtgaggagctcac

SEQ ID NO: 15889 - DNA, 25 bp, Homo sapien
ctgccgtcggttccttaactgaggc

SEQ ID NO: 15890 - DNA, 25 bp, Homo sapien
ttccttaactgaggccgtggctgcc

SEQ ID NO: 15891 - DNA, 25 bp, Homo sapien
acccccaccctcatgttcagggtgg

SEQ ID NO: 15892 - DNA, 25 bp, Homo sapien
gggtggatgtgggcatgcaggtgac

SEQ ID NO: 15893 - DNA, 25 bp, Homo sapien
gggggcccaggatgtagatattgta

SEQ ID NO: 15894 - DNA, 25 bp, Homo sapien
tgtgttaatcacacagtatgctctc

SEQ ID NO: 15895 - DNA, 25 bp, Homo sapien
tgagctggagaactggctttgcact

SEQ ID NO: 15896 - DNA, 25 bp, Homo sapien
gagctggagaactggctttgcactt

SEQ ID NO: 15897 - DNA, 25 bp, Homo sapien
gctggagaactggctttgcactttg

SEQ ID NO: 15898 - DNA, 25 bp, Homo sapien
tggagaactggctttgcactttggt

SEQ ID NO: 15899 - DNA, 25 bp, Homo sapien
aaaatagctcatatatctcatcttt

SEQ ID NO: 15900 - DNA, 25 bp, Homo sapien
tcatctttcctcctgtcttagaaga

SEQ ID NO: 15901 - DNA, 25 bp, Homo sapien
atctttcctcctgtcttagaagaac

SEQ ID NO: 15902 - DNA, 25 bp, Homo sapien
tttgaaatatagtctctgcttacga

SEQ ID NO: 15903 - DNA, 25 bp, Homo sapien
gaaatatagtctctgcttacgaatg

SEQ ID NO: 15904 - DNA, 25 bp, Homo sapien
atatagtctctgcttacgaatgtca

SEQ ID NO: 15905 - DNA, 25 bp, Homo sapien
gatgatgcagattgactgtcaggtg

SEQ ID NO: 15906 - DNA, 25 bp, Homo sapien
gacaccaggatcctccatatcaaaa

SEQ ID NO: 15907 - DNA, 25 bp, Homo sapien
tatcaaaagttcgtcggttcctcct

SEQ ID NO: 15908 - DNA, 25 bp, Homo sapien
ctccttacctccgagatcagcagag

SEQ ID NO: 15909 - DNA, 25 bp, Homo sapien
tcaaaccaacaccttctttggctcc

SEQ ID NO: 15910 - DNA, 25 bp, Homo sapien
gcaccatccctgagtcattacaata

SEQ ID NO: 15911 - DNA, 25 bp, Homo sapien
agcacccgcagctatgtggaaaact

SEQ ID NO: 15912 - DNA, 25 bp, Homo sapien
gggacccccagactgaagagcaggt

SEQ ID NO: 15913 - DNA, 25 bp, Homo sapien
gtgagcaaaatgctgcttttccttg

SEQ ID NO: 15914 - DNA, 25 bp, Homo sapien
gtggcaggcagagaactgttcgtac

SEQ ID NO: 15915 - DNA, 25 bp, Homo sapien
caatgtttcttcagtggcaaatgta

SEQ ID NO: 15916 - DNA, 25 bp, Homo sapien
agaggagccatggggcactacgtct

SEQ ID NO: 15917 - DNA, 25 bp, Homo sapien
tgagtgacacgcagcctgcagactc

SEQ ID NO: 15918 - DNA, 25 bp, Homo sapien
gttttggaccaacaagtgcctcctt

SEQ ID NO: 15919 - DNA, 25 bp, Homo sapien
tcatgtgacctcttcagtgaccact

SEQ ID NO: 15920 - DNA, 25 bp, Homo sapien
tacggtgtcgggccttgaactacta

SEQ ID NO: 15921 - DNA, 25 bp, Homo sapien
tacccccagaacatcaccatgaagt

SEQ ID NO: 15922 - DNA, 25 bp, Homo sapien
gggctggataaccttggctgtaccc

SEQ ID NO: 15923 - DNA, 25 bp, Homo sapien
ggctgtaccccctggggaagagcag

SEQ ID NO: 15924 - DNA, 25 bp, Homo sapien
agcccctcattgtgatctgggagcc

SEQ ID NO: 15925 - DNA, 25 bp, Homo sapien
ggcaccctagtcattggagtcatca

SEQ ID NO: 15926 - DNA, 25 bp, Homo sapien
gaattgctgtttttgtcgtcatctt

SEQ ID NO: 15927 - DNA, 25 bp, Homo sapien
ctggtcttacggcttgtgggcgacc

SEQ ID NO: 15928 - DNA, 25 bp, Homo sapien
gaccgcaacgagtggcatggcagat

SEQ ID NO: 15929 - DNA, 25 bp, Homo sapien
cgcaacgagtggcatggcagattcc

SEQ ID NO: 15930 - DNA, 25 bp, Homo sapien
caacgagtggcatggcagattcctg

SEQ ID NO: 15931 - DNA, 25 bp, Homo sapien
ggctgccaaccagcagggtgatctt

SEQ ID NO: 15932 - DNA, 25 bp, Homo sapien
gccaaccagcagggtgatctttgcg

SEQ ID NO: 15933 - DNA, 25 bp, Homo sapien
accagcagggtgatctttgcgaggt

SEQ ID NO: 15934 - DNA, 25 bp, Homo sapien
cagggtgatctttgcgaggtgagcc

SEQ ID NO: 15935 - DNA, 25 bp, Homo sapien
agggtgatctttgcgaggtgagcct

SEQ ID NO: 15936 - DNA, 25 bp, Homo sapien
tctttgcgaggtgagcctcgccggc

SEQ ID NO: 15937 - DNA, 25 bp, Homo sapien
tttgcgaggtgagcctcgccggcag

SEQ ID NO: 15938 - DNA, 25 bp, Homo sapien
caatttcaatggtgttggcttcccc

SEQ ID NO: 15939 - DNA, 25 bp, Homo sapien
ccaccccacgcgtgcataaaaactg

SEQ ID NO: 15940 - DNA, 25 bp, Homo sapien
acgcgtgcataaaaactggttctac

SEQ ID NO: 15941 - DNA, 25 bp, Homo sapien
tggttctacaaatttttacttgaag

SEQ ID NO: 15942 - DNA, 25 bp, Homo sapien
acttgaagtaccaggccgtttgctt

SEQ ID NO: 15943 - DNA, 25 bp, Homo sapien
aatgcacagttctatttgctatctg

SEQ ID NO: 15944 - DNA, 25 bp, Homo sapien
tctatttgctatctgaactaattca

SEQ ID NO: 15945 - DNA, 25 bp, Homo sapien
aagctaaggctcgagttaaaacaat

SEQ ID NO: 15946 - DNA, 25 bp, Homo sapien
catagtttaattggtctcccaagta

SEQ ID NO: 15947 - DNA, 25 bp, Homo sapien
tggtctcccaagtaagacatctcaa

SEQ ID NO: 15948 - DNA, 25 bp, Homo sapien
ataaattaacaaagtgtcactccat

SEQ ID NO: 15949 - DNA, 25 bp, Homo sapien
tgcgaggagatcgccattatcccca

SEQ ID NO: 15950 - DNA, 25 bp, Homo sapien
tatccccagcaaaaagctccgcaac

SEQ ID NO: 15951 - DNA, 25 bp, Homo sapien
agcaggttacgtcacgcatctgatg

SEQ ID NO: 15952 - DNA, 25 bp, Homo sapien
gtaagaggtatctccatcaagctgc

SEQ ID NO: 15953 - DNA, 25 bp, Homo sapien
tcctgaggtctcagccttggatcag

SEQ ID NO: 15954 - DNA, 25 bp, Homo sapien
gcttttggacttcggcagtctgtcc

SEQ ID NO: 15955 - DNA, 25 bp, Homo sapien
gtcactcagcctacagttgggatga

SEQ ID NO: 15956 - DNA, 25 bp, Homo sapien
gatgaatttcaaaacgcctcgggga

SEQ ID NO: 15957 - DNA, 25 bp, Homo sapien
tcggggacctgtttgattttttctg

SEQ ID NO: 15958 - DNA, 25 bp, Homo sapien
cgcgttcgcaccaaaaccgtgaaga

SEQ ID NO: 15959 - DNA, 25 bp, Homo sapien
tagaaaagtactacacgcgcctggg

SEQ ID NO: 15960 - DNA, 25 bp, Homo sapien
gacccaagggtctcatcttattaac

SEQ ID NO: 15961 - DNA, 25 bp, Homo sapien
attaaccatttcttgcctctaaata

SEQ ID NO: 15962 - DNA, 25 bp, Homo sapien
tcaaagacttcgtgattatccccct

SEQ ID NO: 15963 - DNA, 25 bp, Homo sapien
caccccagagacatccgttaaggag

SEQ ID NO: 15964 - DNA, 25 bp, Homo sapien
tgagttggttgaggtctacacggac

SEQ ID NO: 15965 - DNA, 25 bp, Homo sapien
tacacggacgtgaaacaccgctgga

SEQ ID NO: 15966 - DNA, 25 bp, Homo sapien
agaacatccgcttgaggactgaccc

SEQ ID NO: 15967 - DNA, 25 bp, Homo sapien
ccccaggtttgtttggctgatcggg

SEQ ID NO: 15968 - DNA, 25 bp, Homo sapien
gatcggggaccaagaggacaccacg

SEQ ID NO: 15969 - DNA, 25 bp, Homo sapien
tcagttctgttgttcccaagtcaaa

SEQ ID NO: 15970 - DNA, 25 bp, Homo sapien
aaactacagtcttcaagggccttca

SEQ ID NO: 15971 - DNA, 25 bp, Homo sapien
aagtatttagtcaacaaacagggtg

SEQ ID NO: 15972 - DNA, 25 bp, Homo sapien
ttttgactaagaaagctcgttgtag

SEQ ID NO: 15973 - DNA, 25 bp, Homo sapien
agctcgttgtagtagaaagggtgga

SEQ ID NO: 15974 - DNA, 25 bp, Homo sapien
gaagcagggaagtattgttagtcta

SEQ ID NO: 15975 - DNA, 25 bp, Homo sapien
tgttagtctagcttatttcctttca

SEQ ID NO: 15976 - DNA, 25 bp, Homo sapien
gtacttactgaatttagttctgtgc

SEQ ID NO: 15977 - DNA, 25 bp, Homo sapien
tgaatttagttctgtgctcttcctt

SEQ ID NO: 15978 - DNA, 25 bp, Homo sapien
ttcagtggcttcataatatttcatc

SEQ ID NO: 15979 - DNA, 25 bp, Homo sapien
ggcttcataatatttcatcatttgg

SEQ ID NO: 15980 - DNA, 25 bp, Homo sapien
ctgagtagctgggcacggtgttgta

SEQ ID NO: 15981 - DNA, 25 bp, Homo sapien
agtagctgggcacggtgttgtacct

SEQ ID NO: 15982 - DNA, 25 bp, Homo sapien
ctgccctccaagatgctggtgatag

SEQ ID NO: 15983 - DNA, 25 bp, Homo sapien
tgagggacaacagacttcacttccc

SEQ ID NO: 15984 - DNA, 25 bp, Homo sapien
atcaggaaaaatacaccccatcgcc

SEQ ID NO: 15985 - DNA, 25 bp, Homo sapien
ccctgctgataccaccagacagaga

SEQ ID NO: 15986 - DNA, 25 bp, Homo sapien
gagagagagcacttgattcttcccg

SEQ ID NO: 15987 - DNA, 25 bp, Homo sapien
ttcttcccgagatagccacctggaa

SEQ ID NO: 15988 - DNA, 25 bp, Homo sapien
ctggaaacactaggtgcctgcccag

SEQ ID NO: 15989 - DNA, 25 bp, Homo sapien
ccaccttttgctccaccggaggtgg

SEQ ID NO: 15990 - DNA, 25 bp, Homo sapien
gaaaatctgggcacgatcgggcccc

SEQ ID NO: 15991 - DNA, 25 bp, Homo sapien
gcagtgcaggacaacatcagctcac

SEQ ID NO: 15992 - DNA, 25 bp, Homo sapien
ggggaacagcaggtgccagagctaa

SEQ ID NO: 15993 - DNA, 25 bp, Homo sapien
ctctcaggctgcagtcactgacagt

SEQ ID NO: 15994 - DNA, 25 bp, Homo sapien
cactgacagtgcccagggctctggg

SEQ ID NO: 15995 - DNA, 25 bp, Homo sapien
gtgagacagcttccttgtgtgggac

SEQ ID NO: 15996 - DNA, 25 bp, Homo sapien
cagatcctccaaaggcacacgttgc

SEQ ID NO: 15997 - DNA, 25 bp, Homo sapien
tctaccctgcggagatcacgctgac

SEQ ID NO: 15998 - DNA, 25 bp, Homo sapien
ggaacagacccaggacacagagctt

SEQ ID NO: 15999 - DNA, 25 bp, Homo sapien
cagagcttgtggagaccaggcctgc

SEQ ID NO: 16000 - DNA, 25 bp, Homo sapien
aggcctgcaggggatggaaccttcc

SEQ ID NO: 16001 - DNA, 25 bp, Homo sapien
cagcccctcatcctgagatgggagc

SEQ ID NO: 16002 - DNA, 25 bp, Homo sapien
tgttgtccttggagctgtggtcact

SEQ ID NO: 16003 - DNA, 25 bp, Homo sapien
ctgtggtcgctgctgtgatgtggag

SEQ ID NO: 16004 - DNA, 25 bp, Homo sapien
ggcctttcacagcggaatgcagttg

SEQ ID NO: 16005 - DNA, 25 bp, Homo sapien
gcagttgtacctcacattacttttg

SEQ ID NO: 16006 - DNA, 25 bp, Homo sapien
aacttcactcgttccagttggtaca

SEQ ID NO: 16007 - DNA, 25 bp, Homo sapien
gtatttgccaaagccatttcctatg

SEQ ID NO: 16008 - DNA, 25 bp, Homo sapien
agccatttcctatgttcaccgtggc

SEQ ID NO: 16009 - DNA, 25 bp, Homo sapien
ctcctgatgtggctgtcagcgcagc

SEQ ID NO: 16010 - DNA, 25 bp, Homo sapien
gtcagcgcagcgttgttgaacaggg

SEQ ID NO: 16011 - DNA, 25 bp, Homo sapien
aggtgtgaagtgtggctcttcgctt

SEQ ID NO: 16012 - DNA, 25 bp, Homo sapien
cgcttcgtctttgccatggcattaa

SEQ ID NO: 16013 - DNA, 25 bp, Homo sapien
ccctgtcttctttcaatattagtta

SEQ ID NO: 16014 - DNA, 25 bp, Homo sapien
tagctgcgatttggcaaacagccct

SEQ ID NO: 16015 - DNA, 25 bp, Homo sapien
tcagtctctcaaagaccccatggtc

SEQ ID NO: 16016 - DNA, 25 bp, Homo sapien
cccgttccgtgggatgccataaaag

SEQ ID NO: 16017 - DNA, 25 bp, Homo sapien
cataaaagccgcccagtgggaccca

SEQ ID NO: 16018 - DNA, 25 bp, Homo sapien
gccccaaagatcccacgggagaggg

SEQ ID NO: 16019 - DNA, 25 bp, Homo sapien
ctgccaagcgagaatgcaggccccg

SEQ ID NO: 16020 - DNA, 25 bp, Homo sapien
cacctctttctacagcctaatttat

SEQ ID NO: 16021 - DNA, 25 bp, Homo sapien
tattggattccctattcgtagccat

SEQ ID NO: 16022 - DNA, 25 bp, Homo sapien
ccgtggccaatgtgactaccgtgcc

SEQ ID NO: 16023 - DNA, 25 bp, Homo sapien
agccaggagtgcggacaccatgttc

SEQ ID NO: 16024 - DNA, 25 bp, Homo sapien
tgttcccagctcagtgccaaagagg

SEQ ID NO: 16025 - DNA, 25 bp, Homo sapien
aagaggggtcaccagggggagctgt

SEQ ID NO: 16026 - DNA, 25 bp, Homo sapien
catcctgaaccgctgcagcgagagc

SEQ ID NO: 16027 - DNA, 25 bp, Homo sapien
tcctgaaccgctgcagcgagagcac

SEQ ID NO: 16028 - DNA, 25 bp, Homo sapien
tctgccgtctgaggctggagcgcag

SEQ ID NO: 16029 - DNA, 25 bp, Homo sapien
ctgccgtctgaggctggagcgcagt

SEQ ID NO: 16030 - DNA, 25 bp, Homo sapien
tctatagagcctggcgtctggacgc

SEQ ID NO: 16031 - DNA, 25 bp, Homo sapien
tatagagcctggcgtctggacgccg

SEQ ID NO: 16032 - DNA, 25 bp, Homo sapien
agcctggcgtctggacgccgagggc

SEQ ID NO: 16033 - DNA, 25 bp, Homo sapien
gtgtccctgctcgagggtgaagctg

SEQ ID NO: 16034 - DNA, 25 bp, Homo sapien
ccctgctcgagggtgaagctgttga

SEQ ID NO: 16035 - DNA, 25 bp, Homo sapien
ctgctcgagggtgaagctgttgagg

SEQ ID NO: 16036 - DNA, 25 bp, Homo sapien
ggaaagacgacgtcacaggctactt

SEQ ID NO: 16037 - DNA, 25 bp, Homo sapien
ggaaacctctcagtgtcttgacatc

SEQ ID NO: 16038 - DNA, 25 bp, Homo sapien
ttagccaagatattcctctgttccc

SEQ ID NO: 16039 - DNA, 25 bp, Homo sapien
ctctgttccctctgctgagataaag

SEQ ID NO: 16040 - DNA, 25 bp, Homo sapien
taatccacccatgcaaatagctact

SEQ ID NO: 16041 - DNA, 25 bp, Homo sapien
aaatagctactggcccagctaccat

SEQ ID NO: 16042 - DNA, 25 bp, Homo sapien
ctaccatttaccatttgcctacaga

SEQ ID NO: 16043 - DNA, 25 bp, Homo sapien
ttcagtctacactttggcattctct

SEQ ID NO: 16044 - DNA, 25 bp, Homo sapien
ggcattctctctggcgatggagtgt

SEQ ID NO: 16045 - DNA, 25 bp, Homo sapien
ggctgggctgaccgcaaaaggtgcc

SEQ ID NO: 16046 - DNA, 25 bp, Homo sapien
gcaaaaggtgccttacacactgccc

SEQ ID NO: 16047 - DNA, 25 bp, Homo sapien
ttaccccccatgttgcatatcaggg

SEQ ID NO: 16048 - DNA, 25 bp, Homo sapien
ccctgagtgagcacctggttaccac

SEQ ID NO: 16049 - DNA, 25 bp, Homo sapien
ctccactggcctcgtggtgtatgac

SEQ ID NO: 16050 - DNA, 25 bp, Homo sapien
gtgtatgactaccagcagctgctga

SEQ ID NO: 16051 - DNA, 25 bp, Homo sapien
gcacctgctgctacatcatgaagat

SEQ ID NO: 16052 - DNA, 25 bp, Homo sapien
gatagctccagagagcatccccagt

SEQ ID NO: 16053 - DNA, 25 bp, Homo sapien
cagtgcctacgtctaagctgggcca

SEQ ID NO: 16054 - DNA, 25 bp, Homo sapien
ggccttcttgggcatggccgtgaac

SEQ ID NO: 16055 - DNA, 25 bp, Homo sapien
tgaacaccctgtgtggcgaggtgcc

SEQ ID NO: 16056 - DNA, 25 bp, Homo sapien
cctccggtgagcagggtcagtggaa

SEQ ID NO: 16057 - DNA, 25 bp, Homo sapien
gggtcttttgcagcttttgcagacg

SEQ ID NO: 16058 - DNA, 25 bp, Homo sapien
gggcaagaagctgcttctgcccaca

SEQ ID NO: 16059 - DNA, 25 bp, Homo sapien
ttctcctgcctcagcgattacagga

SEQ ID NO: 16060 - DNA, 25 bp, Homo sapien
cagcgattacaggaatgcaccacca

SEQ ID NO: 16061 - DNA, 25 bp, Homo sapien
cacctcggccttgcaaaatgctggg

SEQ ID NO: 16062 - DNA, 25 bp, Homo sapien
cacctgcccagccatgtttggggct

SEQ ID NO: 16063 - DNA, 25 bp, Homo sapien
tcaccaggggcaagaatgtacattt

SEQ ID NO: 16064 - DNA, 25 bp, Homo sapien
tagcttcatttatgttattccttac

SEQ ID NO: 16065 - DNA, 25 bp, Homo sapien
gattcttacttaaacttggtcttct

SEQ ID NO: 16066 - DNA, 25 bp, Homo sapien
ttggtcttctttcaagttgtttgta

SEQ ID NO: 16067 - DNA, 25 bp, Homo sapien
gtatgaagatgctgtacccacttga

SEQ ID NO: 16068 - DNA, 25 bp, Homo sapien
acccacttgaacagtcctcaggtgt

SEQ ID NO: 16069 - DNA, 25 bp, Homo sapien
acagtcctcaggtgtttacataaat

SEQ ID NO: 16070 - DNA, 25 bp, Homo sapien
taggttgtaattccttatatttctt

SEQ ID NO: 16071 - DNA, 25 bp, Homo sapien
ttctttcttccacagtgtatcggat

SEQ ID NO: 16072 - DNA, 25 bp, Homo sapien
gtgtatcggatctgtcgttctggaa

SEQ ID NO: 16073 - DNA, 25 bp, Homo sapien
tctgtcgttctggaaagaagaccct

SEQ ID NO: 16074 - DNA, 25 bp, Homo sapien
gaaacttctaaggtatcatctgtgt

SEQ ID NO: 16075 - DNA, 25 bp, Homo sapien
tgagaccatatttctttgatgtttc

SEQ ID NO: 16076 - DNA, 25 bp, Homo sapien
acatcaaagctgattcagtactggt

SEQ ID NO: 16077 - DNA, 25 bp, Homo sapien
tactggtagatgtgctcattctccc

SEQ ID NO: 16078 - DNA, 25 bp, Homo sapien
aacatacccatcatattgtcctatt

SEQ ID NO: 16079 - DNA, 25 bp, Homo sapien
gtcctattataattacatctcattg

SEQ ID NO: 16080 - DNA, 25 bp, Homo sapien
acatctcattgtcctgtggaggtgg

SEQ ID NO: 16081 - DNA, 25 bp, Homo sapien
cacagacatccctaaaagtgccccc

SEQ ID NO: 16082 - DNA, 25 bp, Homo sapien
tagtttgtctcctgggactggggga

SEQ ID NO: 16083 - DNA, 25 bp, Homo sapien
gggactgggggaggagtccgaggtg

SEQ ID NO: 16084 - DNA, 25 bp, Homo sapien
tccgggtccttgctcggagagtacg

SEQ ID NO: 16085 - DNA, 25 bp, Homo sapien
tccttgctcggagagtacggcctga

SEQ ID NO: 16086 - DNA, 25 bp, Homo sapien
ctcggagagtacggcctgatggctc

SEQ ID NO: 16087 - DNA, 25 bp, Homo sapien
cctgatggctctgtgcagtacctgg

SEQ ID NO: 16088 - DNA, 25 bp, Homo sapien
gctctgtgcagtacctggttgagtg

SEQ ID NO: 16089 - DNA, 25 bp, Homo sapien
gtacctggttgagtggggaggaggg

SEQ ID NO: 16090 - DNA, 25 bp, Homo sapien
ctcacctacagctgggatgtacctg

SEQ ID NO: 16091 - DNA, 25 bp, Homo sapien
ggctggaatccaagagtggggagtg

SEQ ID NO: 16092 - DNA, 25 bp, Homo sapien
aaagcatgaggggctttatttgcct

SEQ ID NO: 16093 - DNA, 25 bp, Homo sapien
tatttgcctttacctcatatgagtc

SEQ ID NO: 16094 - DNA, 25 bp, Homo sapien
gagtctttgatcttgaaccgatact

SEQ ID NO: 16095 - DNA, 25 bp, Homo sapien
gaaccgatacttttggatctcattg

SEQ ID NO: 16096 - DNA, 25 bp, Homo sapien
ggatctcattgttgatatacctgaa

SEQ ID NO: 16097 - DNA, 25 bp, Homo sapien
gatatacctgaatttactttgtaag

SEQ ID NO: 16098 - DNA, 25 bp, Homo sapien
agagattttaacttcacttcatgct

SEQ ID NO: 16099 - DNA, 25 bp, Homo sapien
ttcacttcatgctgatgatgtatca

SEQ ID NO: 16100 - DNA, 25 bp, Homo sapien
gtcaaattacatttcctactgcagt

SEQ ID NO: 16101 - DNA, 25 bp, Homo sapien
acatttcctactgcagtatttgagc

SEQ ID NO: 16102 - DNA, 25 bp, Homo sapien
gtatttgagcagggacagtcatttt

SEQ ID NO: 16103 - DNA, 25 bp, Homo sapien
tcacgatgtttcccttggtcaaaag

SEQ ID NO: 16104 - DNA, 25 bp, Homo sapien
gtttcccttggtcaaaagcgcacta

SEQ ID NO: 16105 - DNA, 25 bp, Homo sapien
aaagcgcactaaatcgtctccaagt

SEQ ID NO: 16106 - DNA, 25 bp, Homo sapien
gagccactttctgtattgttacatg

SEQ ID NO: 16107 - DNA, 25 bp, Homo sapien
tcagctcacttcaagggtacctgaa

SEQ ID NO: 16108 - DNA, 25 bp, Homo sapien
ggaggaatcagtaatcatcccagct

SEQ ID NO: 16109 - DNA, 25 bp, Homo sapien
gtaatcatcccagctggtgtaataa

SEQ ID NO: 16110 - DNA, 25 bp, Homo sapien
aaaacagctcataattgatgccaaa

SEQ ID NO: 16111 - DNA, 25 bp, Homo sapien
aaagcactgtgtacccattaagata

SEQ ID NO: 16112 - DNA, 25 bp, Homo sapien
gtacctgaagcgaattggcaccaaa

SEQ ID NO: 16113 - DNA, 25 bp, Homo sapien
ctgtattgccgcagttctagcttca

SEQ ID NO: 16114 - DNA, 25 bp, Homo sapien
gttgagtcgtcatcacttttcagtg

SEQ ID NO: 16115 - DNA, 25 bp, Homo sapien
gaaggatggcacctaaaccaccagt

SEQ ID NO: 16116 - DNA, 25 bp, Homo sapien
aaccaccagtgcccaaagtctgtgt

SEQ ID NO: 16117 - DNA, 25 bp, Homo sapien
tttctcttcatactttttttcacag

SEQ ID NO: 16118 - DNA, 25 bp, Homo sapien
ctagactttctgttggtgtatcccc

SEQ ID NO: 16119 - DNA, 25 bp, Homo sapien
tcccccccctgtatagttaggatag

SEQ ID NO: 16120 - DNA, 25 bp, Homo sapien
gttgtgccttttatagctattactg

SEQ ID NO: 16121 - DNA, 25 bp, Homo sapien
gaactacgcttgctcattttttctt

SEQ ID NO: 16122 - DNA, 25 bp, Homo sapien
gggcagctagttcgtagctttccca

SEQ ID NO: 16123 - DNA, 25 bp, Homo sapien
gggttggtgcttctaacctgatggc

SEQ ID NO: 16124 - DNA, 25 bp, Homo sapien
ttgactcaaatctccagtattcttg

SEQ ID NO: 16125 - DNA, 25 bp, Homo sapien
tgatgaggtatcaggtgggtggagg

SEQ ID NO: 16126 - DNA, 25 bp, Homo sapien
gaggggagacgctcaggaggtggga

SEQ ID NO: 16127 - DNA, 25 bp, Homo sapien
ggaaaggcggaggtgcacaggcttg

SEQ ID NO: 16128 - DNA, 25 bp, Homo sapien
gtgcacaggcttggttccaggtaca

SEQ ID NO: 16129 - DNA, 25 bp, Homo sapien
tccaggtacaaataacgttactagg

SEQ ID NO: 16130 - DNA, 25 bp, Homo sapien
gttactaggagcacacagtacctgg

SEQ ID NO: 16131 - DNA, 25 bp, Homo sapien
acctggattttgatgaatacattgt

SEQ ID NO: 16132 - DNA, 25 bp, Homo sapien
acatttctgtcctgtatgtatccag

SEQ ID NO: 16133 - DNA, 25 bp, Homo sapien
gtatccagggttataggacgtgatt

SEQ ID NO: 16134 - DNA, 25 bp, Homo sapien
aggacgtgattataggacacgcata

SEQ ID NO: 16135 - DNA, 25 bp, Homo sapien
ggacacgcatatatgtttggtttta

SEQ ID NO: 16136 - DNA, 25 bp, Homo sapien
tccagccagagaggagtccctcctg

SEQ ID NO: 16137 - DNA, 25 bp, Homo sapien
cccatgacgcagaactcctggaggt

SEQ ID NO: 16138 - DNA, 25 bp, Homo sapien
ctgccccagagtggtgtcctctggc

SEQ ID NO: 16139 - DNA, 25 bp, Homo sapien
ccccaggctctgtgacagcctagtg

SEQ ID NO: 16140 - DNA, 25 bp, Homo sapien
cctgcccggaccacagaaggagagt

SEQ ID NO: 16141 - DNA, 25 bp, Homo sapien
agagttggcggtcacagagggctcc

SEQ ID NO: 16142 - DNA, 25 bp, Homo sapien
agaagcatggggcgtagccagctcg

SEQ ID NO: 16143 - DNA, 25 bp, Homo sapien
caaaggccacgactgcctgttgggg

SEQ ID NO: 16144 - DNA, 25 bp, Homo sapien
gatgcatggacagtgtgctcaagct

SEQ ID NO: 16145 - DNA, 25 bp, Homo sapien
aagctgtgggcatgtgcttgcctgc

SEQ ID NO: 16146 - DNA, 25 bp, Homo sapien
gcaagagcatgtgtgtgccacttcc

SEQ ID NO: 16147 - DNA, 25 bp, Homo sapien
cttgcccaccctgactgaaagtagg

SEQ ID NO: 16148 - DNA, 25 bp, Homo sapien
ccaccctgactgaaagtagggggct

SEQ ID NO: 16149 - DNA, 25 bp, Homo sapien
ccatcagggttctcttatcaactca

SEQ ID NO: 16150 - DNA, 25 bp, Homo sapien
cagggttctcttatcaactcagaga

SEQ ID NO: 16151 - DNA, 25 bp, Homo sapien
tcagagaaaaatgctccccacagcg

SEQ ID NO: 16152 - DNA, 25 bp, Homo sapien
cgcaggtgggctggacttctacctg

SEQ ID NO: 16153 - DNA, 25 bp, Homo sapien
ttctacctgccctcaagggtgtgta

SEQ ID NO: 16154 - DNA, 25 bp, Homo sapien
tgccctcaagggtgtgtatattgta

SEQ ID NO: 16155 - DNA, 25 bp, Homo sapien
gggtgtgtatattgtataggggcaa

SEQ ID NO: 16156 - DNA, 25 bp, Homo sapien
attgtataggggcaactgtatgaaa

SEQ ID NO: 16157 - DNA, 25 bp, Homo sapien
gaatggtgtgaacccgggagcggag

SEQ ID NO: 16158 - DNA, 25 bp, Homo sapien
atcctcctaaattccctgattggca

SEQ ID NO: 16159 - DNA, 25 bp, Homo sapien
ttccctgattggcatattcaaccat

SEQ ID NO: 16160 - DNA, 25 bp, Homo sapien
ggaacctactgtatacctaagctag

SEQ ID NO: 16161 - DNA, 25 bp, Homo sapien
aaatatacccaatatcactgccctg

SEQ ID NO: 16162 - DNA, 25 bp, Homo sapien
atatcactgccctgtgtgctaaata

SEQ ID NO: 16163 - DNA, 25 bp, Homo sapien
aataatgctcattactgacaactcc

SEQ ID NO: 16164 - DNA, 25 bp, Homo sapien
tttagtttgcatactgctaccctat

SEQ ID NO: 16165 - DNA, 25 bp, Homo sapien
actgctaccctatacaatcaggcaa

SEQ ID NO: 16166 - DNA, 25 bp, Homo sapien
gtactggcttcacttagatgtaaac

SEQ ID NO: 16167 - DNA, 25 bp, Homo sapien
gagactcagttcaaacaatctgcat

SEQ ID NO: 16168 - DNA, 25 bp, Homo sapien
gagacttggactctgattatacaat

SEQ ID NO: 16169 - DNA, 25 bp, Homo sapien
gctctggcatctgccctgaaaaata

SEQ ID NO: 16170 - DNA, 25 bp, Homo sapien
gaaacgtgcagataaaatcgccagc

SEQ ID NO: 16171 - DNA, 25 bp, Homo sapien
agataaaatcgccagcaagctgtct

SEQ ID NO: 16172 - DNA, 25 bp, Homo sapien
atcgccagcaagctgtctgattcca

SEQ ID NO: 16173 - DNA, 25 bp, Homo sapien
gatggtgttggtgactaatcgactg

SEQ ID NO: 16174 - DNA, 25 bp, Homo sapien
ggtgttggtgactaatcgactgatc

SEQ ID NO: 16175 - DNA, 25 bp, Homo sapien
gtgactaatcgactgatctcacttc

SEQ ID NO: 16176 - DNA, 25 bp, Homo sapien
ccaagcaccagttccggtggtacgg

SEQ ID NO: 16177 - DNA, 25 bp, Homo sapien
gtacgggggaataccagtgaaatag

SEQ ID NO: 16178 - DNA, 25 bp, Homo sapien
aagcatctgcatattgaaagaacgc

SEQ ID NO: 16179 - DNA, 25 bp, Homo sapien
attgaaagaacgctttccccactgt

SEQ ID NO: 16180 - DNA, 25 bp, Homo sapien
gcaggggacgcaccaaggatggaga

SEQ ID NO: 16181 - DNA, 25 bp, Homo sapien
ggggacgcaccaaggatggagatgt

SEQ ID NO: 16182 - DNA, 25 bp, Homo sapien
ctcaggtggtgtgcaactaccgcga

SEQ ID NO: 16183 - DNA, 25 bp, Homo sapien
tcaggtggtgtgcaactaccgcgat

SEQ ID NO: 16184 - DNA, 25 bp, Homo sapien
gacgcaccaaggatggagatgttcc

SEQ ID NO: 16185 - DNA, 25 bp, Homo sapien
acgcaccaaggatggagatgttcca

SEQ ID NO: 16186 - DNA, 25 bp, Homo sapien
tctcagctgtcaatgtgcactctgc

SEQ ID NO: 16187 - DNA, 25 bp, Homo sapien
ccgcagcaccactgactgcgggggt

SEQ ID NO: 16188 - DNA, 25 bp, Homo sapien
tgactgcgggggtcccaaggaccac

SEQ ID NO: 16189 - DNA, 25 bp, Homo sapien
gcgggacatgggcatccaaggagcc

SEQ ID NO: 16190 - DNA, 25 bp, Homo sapien
cgggacatgggcatccaaggagccg

SEQ ID NO: 16191 - DNA, 25 bp, Homo sapien
ccaccagggaggaggcctccacgtc

SEQ ID NO: 16192 - DNA, 25 bp, Homo sapien
gcccctccaaagccagcagaggaca

SEQ ID NO: 16193 - DNA, 25 bp, Homo sapien
gattagtcgagactggtcctcacct

SEQ ID NO: 16194 - DNA, 25 bp, Homo sapien
ccctttccctggacagatcaggccg

SEQ ID NO: 16195 - DNA, 25 bp, Homo sapien
cccagcgtgtgacgtaggggccggg

SEQ ID NO: 16196 - DNA, 25 bp, Homo sapien
tgtgacgtaggggccggggcaggcc

SEQ ID NO: 16197 - DNA, 25 bp, Homo sapien
gggcaggccagggtttgtttgtgga

SEQ ID NO: 16198 - DNA, 25 bp, Homo sapien
cagggtttgtttgtggaggcgctgt

SEQ ID NO: 16199 - DNA, 25 bp, Homo sapien
ccagcccagcaccactgggaatcat

SEQ ID NO: 16200 - DNA, 25 bp, Homo sapien
gaagctgatgcagcgttgccgaggg

SEQ ID NO: 16201 - DNA, 25 bp, Homo sapien
ccgccctttaacacagtctggattt

SEQ ID NO: 16202 - DNA, 25 bp, Homo sapien
gatctatttattagcttggtgaccc

SEQ ID NO: 16203 - DNA, 25 bp, Homo sapien
ttggtgacccagagcaagttattct

SEQ ID NO: 16204 - DNA, 25 bp, Homo sapien
tattctgcctgtgactcaatttcct

SEQ ID NO: 16205 - DNA, 25 bp, Homo sapien
tcaatttcctcacctttaaactggg

SEQ ID NO: 16206 - DNA, 25 bp, Homo sapien
aacacttcatcagtgcttagcatat

SEQ ID NO: 16207 - DNA, 25 bp, Homo sapien
aggagagttggctgttcacatgatt

SEQ ID NO: 16208 - DNA, 25 bp, Homo sapien
tcacatgattattcagtcctttagt

SEQ ID NO: 16209 - DNA, 25 bp, Homo sapien
gtcctttagttttgtccagaactca

SEQ ID NO: 16210 - DNA, 25 bp, Homo sapien
catttttgtccctagctttctatat

SEQ ID NO: 16211 - DNA, 25 bp, Homo sapien
caaacccagggccaagtatgctact

SEQ ID NO: 16212 - DNA, 25 bp, Homo sapien
gtatgctactgtctccagaacacga

SEQ ID NO: 16213 - DNA, 25 bp, Homo sapien
cgcctgctatgccatcgggaaggac

SEQ ID NO: 16214 - DNA, 25 bp, Homo sapien
tcgggaaggacgtgcaggccatgaa

SEQ ID NO: 16215 - DNA, 25 bp, Homo sapien
tagttggggaggaggcgctcacctc

SEQ ID NO: 16216 - DNA, 25 bp, Homo sapien
gaagaacttcatcaatcagggcccc

SEQ ID NO: 16217 - DNA, 25 bp, Homo sapien
tcaatcagggcccctacgagaaccg

SEQ ID NO: 16218 - DNA, 25 bp, Homo sapien
gaaccgctcgatgttcgagtcgctg

SEQ ID NO: 16219 - DNA, 25 bp, Homo sapien
gagtcgctggaccttagctggaagc

SEQ ID NO: 16220 - DNA, 25 bp, Homo sapien
ggagatgctgaagcgcattccgcag

SEQ ID NO: 16221 - DNA, 25 bp, Homo sapien
cgtgatcgacgagttctattcccgc

SEQ ID NO: 16222 - DNA, 25 bp, Homo sapien
gctcccggtgctgcggaagaactga

SEQ ID NO: 16223 - DNA, 25 bp, Homo sapien
tgcctactctgacgggagcatctgt

SEQ ID NO: 16224 - DNA, 25 bp, Homo sapien
ccagacaggatcccacatagcagca

SEQ ID NO: 16225 - DNA, 25 bp, Homo sapien
agctctgtggcgttgtgttattggt

SEQ ID NO: 16226 - DNA, 25 bp, Homo sapien
tgttattggtagacaccctcagcct

SEQ ID NO: 16227 - DNA, 25 bp, Homo sapien
ctcagcctcatcatttgactaccta

SEQ ID NO: 16228 - DNA, 25 bp, Homo sapien
tgactacctatgtactactctaccc

SEQ ID NO: 16229 - DNA, 25 bp, Homo sapien
gccttagagcaccttccagagaagc

SEQ ID NO: 16230 - DNA, 25 bp, Homo sapien
agaagctattccaggtctcaacata

SEQ ID NO: 16231 - DNA, 25 bp, Homo sapien
cagcttcaggacttctgccaatttt

SEQ ID NO: 16232 - DNA, 25 bp, Homo sapien
atatagctgcaccaacaatatcccg

SEQ ID NO: 16233 - DNA, 25 bp, Homo sapien
ccgcctcctctaattacatatgatg

SEQ ID NO: 16234 - DNA, 25 bp, Homo sapien
aggggggcggatcgtgaagtcagga

SEQ ID NO: 16235 - DNA, 25 bp, Homo sapien
caggcccgccagacttaagggacct

SEQ ID NO: 16236 - DNA, 25 bp, Homo sapien
gcccgccagacttaagggacctggt

SEQ ID NO: 16237 - DNA, 25 bp, Homo sapien
acttaagggacctggtcaccacgct

SEQ ID NO: 16238 - DNA, 25 bp, Homo sapien
ccttggccgcttcgagcggatgctg

SEQ ID NO: 16239 - DNA, 25 bp, Homo sapien
ccgcttcgagcggatgctggcggcg

SEQ ID NO: 16240 - DNA, 25 bp, Homo sapien
tggcccgagccctgtgctcgggaag

SEQ ID NO: 16241 - DNA, 25 bp, Homo sapien
ccgagccctgtgctcgggaagtccc

SEQ ID NO: 16242 - DNA, 25 bp, Homo sapien
cctgtgctcgggaagtcccgcagaa

SEQ ID NO: 16243 - DNA, 25 bp, Homo sapien
tgctcgggaagtcccgcagaacgcc

SEQ ID NO: 16244 - DNA, 25 bp, Homo sapien
ctgctggtcgacgtgggtcagaggc

SEQ ID NO: 16245 - DNA, 25 bp, Homo sapien
ctggtcgacgtgggtcagaggctgc

SEQ ID NO: 16246 - DNA, 25 bp, Homo sapien
tccaccagcagggggcgcaagatga

SEQ ID NO: 16247 - DNA, 25 bp, Homo sapien
agggggcgcaagatgactgtcaacg

SEQ ID NO: 16248 - DNA, 25 bp, Homo sapien
gcaagatgactgtcaacggcgctcc

SEQ ID NO: 16249 - DNA, 25 bp, Homo sapien
ttaacttgaggccagggaccctctc

SEQ ID NO: 16250 - DNA, 25 bp, Homo sapien
cagctcttcccaccttgggggtggg

SEQ ID NO: 16251 - DNA, 25 bp, Homo sapien
cgtccgagtgtgagtcagtcagcga

SEQ ID NO: 16252 - DNA, 25 bp, Homo sapien
tgagtcagtcagcgacaaggctccc

SEQ ID NO: 16253 - DNA, 25 bp, Homo sapien
ccacagctgccaacgggggtagctt

SEQ ID NO: 16254 - DNA, 25 bp, Homo sapien
caacgggggtagcttgaactgcctg

SEQ ID NO: 16255 - DNA, 25 bp, Homo sapien
ggtagcttgaactgcctgcagacac

SEQ ID NO: 16256 - DNA, 25 bp, Homo sapien
cttgaactgcctgcagacaccatcc

SEQ ID NO: 16257 - DNA, 25 bp, Homo sapien
tccagccacattctcatagcaggta

SEQ ID NO: 16258 - DNA, 25 bp, Homo sapien
catagcaggtaggacttcagccttc

SEQ ID NO: 16259 - DNA, 25 bp, Homo sapien
gacactgcccttagaatctggaaca

SEQ ID NO: 16260 - DNA, 25 bp, Homo sapien
agacttcagactcaccataattgct

SEQ ID NO: 16261 - DNA, 25 bp, Homo sapien
attgctgataattacccactcttaa

SEQ ID NO: 16262 - DNA, 25 bp, Homo sapien
tgtcgagtgatttttagcctctgaa

SEQ ID NO: 16263 - DNA, 25 bp, Homo sapien
aaactctatgctggccactgattcc

SEQ ID NO: 16264 - DNA, 25 bp, Homo sapien
cactgattcctttgagtctcacaaa

SEQ ID NO: 16265 - DNA, 25 bp, Homo sapien
gtctcacaaaaccctacttaggtca

SEQ ID NO: 16266 - DNA, 25 bp, Homo sapien
acttaggtcatcagggcaggagttc

SEQ ID NO: 16267 - DNA, 25 bp, Homo sapien
gagaatactgaggcctggacaggtg

SEQ ID NO: 16268 - DNA, 25 bp, Homo sapien
tcagccactggcatggaaagctcca

SEQ ID NO: 16269 - DNA, 25 bp, Homo sapien
gaaagctccaaatccatgacagtca

SEQ ID NO: 16270 - DNA, 25 bp, Homo sapien
tgacagtcaaagtctctgctccttc

SEQ ID NO: 16271 - DNA, 25 bp, Homo sapien
gtctctgctccttcaggaacaggac

SEQ ID NO: 16272 - DNA, 25 bp, Homo sapien
ggaacaggacatcttcctggcctta

SEQ ID NO: 16273 - DNA, 25 bp, Homo sapien
ggccttaatccattatagcagccgt

SEQ ID NO: 16274 - DNA, 25 bp, Homo sapien
tagcagccgtgatgtcatttctgta

SEQ ID NO: 16275 - DNA, 25 bp, Homo sapien
ggcagacagttgctttcattcttcc

SEQ ID NO: 16276 - DNA, 25 bp, Homo sapien
gtatttaccatcagctacagtccaa

SEQ ID NO: 16277 - DNA, 25 bp, Homo sapien
gatttatgcactttttttcttcagc

SEQ ID NO: 16278 - DNA, 25 bp, Homo sapien
ttgaaacatttgcttttgctcccta

SEQ ID NO: 16279 - DNA, 25 bp, Homo sapien
cttctggggcagaacctctgctggt

SEQ ID NO: 16280 - DNA, 25 bp, Homo sapien
cattagccgggactggcacggtgtg

SEQ ID NO: 16281 - DNA, 25 bp, Homo sapien
gtgtgccagggcaagtggacgcagc

SEQ ID NO: 16282 - DNA, 25 bp, Homo sapien
aaggtttaggcatcgcaaccgcaaa

SEQ ID NO: 16283 - DNA, 25 bp, Homo sapien
cgcaaaggctaccgttcacaacgag

SEQ ID NO: 16284 - DNA, 25 bp, Homo sapien
ctgtccttgttctccagtgaggaga

SEQ ID NO: 16285 - DNA, 25 bp, Homo sapien
cagagtgtcttcttcttctctggag

SEQ ID NO: 16286 - DNA, 25 bp, Homo sapien
taccgagtcaatcttcgcacacggc

SEQ ID NO: 16287 - DNA, 25 bp, Homo sapien
cacggcgagtggacactgtggaccc

SEQ ID NO: 16288 - DNA, 25 bp, Homo sapien
ccagctcctggccatctgtaggagt

SEQ ID NO: 16289 - DNA, 25 bp, Homo sapien
ctgtaggagtcagagcccacatggc

SEQ ID NO: 16290 - DNA, 25 bp, Homo sapien
aaaagctgtctctgcttggaggtgc

SEQ ID NO: 16291 - DNA, 25 bp, Homo sapien
ccctgcccatgtttgagctggtgga

SEQ ID NO: 16292 - DNA, 25 bp, Homo sapien
tgagctggtggagcagcagccttca

SEQ ID NO: 16293 - DNA, 25 bp, Homo sapien
cctgtccctagattcttctgatgta

SEQ ID NO: 16294 - DNA, 25 bp, Homo sapien
gcgactggaaagattcttcgactca

SEQ ID NO: 16295 - DNA, 25 bp, Homo sapien
gaagactttgaaatcctgtcccttt

SEQ ID NO: 16296 - DNA, 25 bp, Homo sapien
tcctgtccctttgaaaatcctgggg

SEQ ID NO: 16297 - DNA, 25 bp, Homo sapien
acctgtgagagcctggggctcctgg

SEQ ID NO: 16298 - DNA, 25 bp, Homo sapien
ttactgcttggtgtcagactgccca

SEQ ID NO: 16299 - DNA, 25 bp, Homo sapien
ttaggagcttccagagcgttctctc

SEQ ID NO: 16300 - DNA, 25 bp, Homo sapien
gccggttctgtggttggtttggaat

SEQ ID NO: 16301 - DNA, 25 bp, Homo sapien
actctagtgggaccttgactggaga

SEQ ID NO: 16302 - DNA, 25 bp, Homo sapien
ctggagaaactccacgatcttcctg

SEQ ID NO: 16303 - DNA, 25 bp, Homo sapien
aaactccacgatcttcctgaagaag

SEQ ID NO: 16304 - DNA, 25 bp, Homo sapien
gtttccaaattccacaataagcaat

SEQ ID NO: 16305 - DNA, 25 bp, Homo sapien
agaatgattcagtcttgacggtgaa

SEQ ID NO: 16306 - DNA, 25 bp, Homo sapien
gacggtgaatggaagacacttacct

SEQ ID NO: 16307 - DNA, 25 bp, Homo sapien
gacacttacctaacaagtactgctc

SEQ ID NO: 16308 - DNA, 25 bp, Homo sapien
ttacctaacaagtactgctcattta

SEQ ID NO: 16309 - DNA, 25 bp, Homo sapien
tttgtatacagagaaccggatgaat

SEQ ID NO: 16310 - DNA, 25 bp, Homo sapien
ttctacatacaagacttcaccataa

SEQ ID NO: 16311 - DNA, 25 bp, Homo sapien
gtagtcgcagcctttcgggaggctg

SEQ ID NO: 16312 - DNA, 25 bp, Homo sapien
tccccgggaacagaggaacctgctg

SEQ ID NO: 16313 - DNA, 25 bp, Homo sapien
gaacctgctggcgacaccaagaaaa

SEQ ID NO: 16314 - DNA, 25 bp, Homo sapien
gacattttgctaaaggctgtgggag

SEQ ID NO: 16315 - DNA, 25 bp, Homo sapien
ggctgtgggagacactcctattatg

SEQ ID NO: 16316 - DNA, 25 bp, Homo sapien
tagagcgaacacgaaccatccaagg

SEQ ID NO: 16317 - DNA, 25 bp, Homo sapien
ccatccaaggactcattgacttcat

SEQ ID NO: 16318 - DNA, 25 bp, Homo sapien
acttgtggcctcagaacagttgttt

SEQ ID NO: 16319 - DNA, 25 bp, Homo sapien
tgttgcagcttcctacttcaattgc

SEQ ID NO: 16320 - DNA, 25 bp, Homo sapien
gcttcctacttcaattgctgctgga

SEQ ID NO: 16321 - DNA, 25 bp, Homo sapien
gaggggaaggacttacggatgtctc

SEQ ID NO: 16322 - DNA, 25 bp, Homo sapien
ttacggatgtctccccagaaacaac

SEQ ID NO: 16323 - DNA, 25 bp, Homo sapien
cggggcccttggaggaggatgatct

SEQ ID NO: 16324 - DNA, 25 bp, Homo sapien
ggaggaggatgatctggagcccctg

SEQ ID NO: 16325 - DNA, 25 bp, Homo sapien
gcgactggcccaggagaaggcctta

SEQ ID NO: 16326 - DNA, 25 bp, Homo sapien
gaaggccttaaagcggcagctggag

SEQ ID NO: 16327 - DNA, 25 bp, Homo sapien
gaagccatggatttccgggaggagg

SEQ ID NO: 16328 - DNA, 25 bp, Homo sapien
ccgggcatcttcatcagcatggatg

SEQ ID NO: 16329 - DNA, 25 bp, Homo sapien
tgttggactctagtctcgagggccc

SEQ ID NO: 16330 - DNA, 25 bp, Homo sapien
gaccctcgcacctgttggagaagat

SEQ ID NO: 16331 - DNA, 25 bp, Homo sapien
aagatgctatgaagactcccagccc

SEQ ID NO: 16332 - DNA, 25 bp, Homo sapien
gaacccgaggccaaggggaacagct

SEQ ID NO: 16333 - DNA, 25 bp, Homo sapien
caaggggaacagctgacggggctcg

SEQ ID NO: 16334 - DNA, 25 bp, Homo sapien
aaagcatttatatcatcctcaaccc

SEQ ID NO: 16335 - DNA, 25 bp, Homo sapien
catttatatcatcctcaaccctaaa

SEQ ID NO: 16336 - DNA, 25 bp, Homo sapien
atatcatcctcaaccctaaatggac

SEQ ID NO: 16337 - DNA, 25 bp, Homo sapien
catcctcaaccctaaatggacataa

SEQ ID NO: 16338 - DNA, 25 bp, Homo sapien
gccaatcttcaaccctaactagaca

SEQ ID NO: 16339 - DNA, 25 bp, Homo sapien
aatcttcaaccctaactagacataa

SEQ ID NO: 16340 - DNA, 25 bp, Homo sapien
actagacataagaggttgcacaccg

SEQ ID NO: 16341 - DNA, 25 bp, Homo sapien
acataagaggttgcacaccggagag

SEQ ID NO: 16342 - DNA, 25 bp, Homo sapien
aaagcctttaaagagtcctcagctc

SEQ ID NO: 16343 - DNA, 25 bp, Homo sapien
agaaaattcatactatcacacctgt

SEQ ID NO: 16344 - DNA, 25 bp, Homo sapien
aaaattcatactatcacacctgtaa

SEQ ID NO: 16345 - DNA, 25 bp, Homo sapien
gtaagttatacttgtgagcccacag

SEQ ID NO: 16346 - DNA, 25 bp, Homo sapien
agagtggcagacagcatggctctca

SEQ ID NO: 16347 - DNA, 25 bp, Homo sapien
gtacacagaggtacctcagaagctc

SEQ ID NO: 16348 - DNA, 25 bp, Homo sapien
cctcagaagctctggatgtctttgg

SEQ ID NO: 16349 - DNA, 25 bp, Homo sapien
tgggggttttgctaagtgtatcttg

SEQ ID NO: 16350 - DNA, 25 bp, Homo sapien
acaacagtgttaaatggccatttgc

SEQ ID NO: 16351 - DNA, 25 bp, Homo sapien
ccatttgcacaggcctttgccacaa

SEQ ID NO: 16352 - DNA, 25 bp, Homo sapien
acaggcctttgccacaacagagaag

SEQ ID NO: 16353 - DNA, 25 bp, Homo sapien
ggtcagctaaaactcagctgcagcc

SEQ ID NO: 16354 - DNA, 25 bp, Homo sapien
cctggacagtagagcgagaccccat

SEQ ID NO: 16355 - DNA, 25 bp, Homo sapien
cctggcgtaatggcaggcgcctata

SEQ ID NO: 16356 - DNA, 25 bp, Homo sapien
gaacttgttgctgattttgaccttg

SEQ ID NO: 16357 - DNA, 25 bp, Homo sapien
tgaagttaactgttccccttggtat

SEQ ID NO: 16358 - DNA, 25 bp, Homo sapien
tagtacgtgtggcttggtcacttcg

SEQ ID NO: 16359 - DNA, 25 bp, Homo sapien
ttggtgagtctgtgtggccagcagc

SEQ ID NO: 16360 - DNA, 25 bp, Homo sapien
cagcctctgatctgtgcagggtatt

SEQ ID NO: 16361 - DNA, 25 bp, Homo sapien
gaaccagttgttttgtcttgcgggt

SEQ ID NO: 16362 - DNA, 25 bp, Homo sapien
agtttcctttcttagctgatgtctt

SEQ ID NO: 16363 - DNA, 25 bp, Homo sapien
ctgatgtctttggccagaacaccgt

SEQ ID NO: 16364 - DNA, 25 bp, Homo sapien
agaacaccgtgggctgttacttgct

SEQ ID NO: 16365 - DNA, 25 bp, Homo sapien
gaagcggtttgcatttacgcctgta

SEQ ID NO: 16366 - DNA, 25 bp, Homo sapien
tgagaacattaggccccagcaacac

SEQ ID NO: 16367 - DNA, 25 bp, Homo sapien
ggcaccaataacaaggagctcaccc

SEQ ID NO: 16368 - DNA, 25 bp, Homo sapien
tctgttcacaaactacctctggaca

SEQ ID NO: 16369 - DNA, 25 bp, Homo sapien
caaactacctctggacagttgtgtt

SEQ ID NO: 16370 - DNA, 25 bp, Homo sapien
gtgttgttttttgttcaatgttcca

SEQ ID NO: 16371 - DNA, 25 bp, Homo sapien
ctgctgctaccagcgccaaatgttc

SEQ ID NO: 16372 - DNA, 25 bp, Homo sapien
cctcccccaagatactctttgtggg

SEQ ID NO: 16373 - DNA, 25 bp, Homo sapien
gcagcagagtgagcaagggggcccg

SEQ ID NO: 16374 - DNA, 25 bp, Homo sapien
tgagcaagggggcccgaatcgacca

SEQ ID NO: 16375 - DNA, 25 bp, Homo sapien
gggcccgaatcgaccataaagggtg

SEQ ID NO: 16376 - DNA, 25 bp, Homo sapien
ctcctccccctgttctgttggggag

SEQ ID NO: 16377 - DNA, 25 bp, Homo sapien
ggggtagccatgatttgtcccagcc

SEQ ID NO: 16378 - DNA, 25 bp, Homo sapien
tattgctgccgggagactacactgc

SEQ ID NO: 16379 - DNA, 25 bp, Homo sapien
gcttacttcacaatgtgcccaggtc

SEQ ID NO: 16380 - DNA, 25 bp, Homo sapien
aagtgttgcacagtcttccagcagt

SEQ ID NO: 16381 - DNA, 25 bp, Homo sapien
gtcttccagcagttcggcagtatct

SEQ ID NO: 16382 - DNA, 25 bp, Homo sapien
tgaatgccgttactctgttttcttc

SEQ ID NO: 16383 - DNA, 25 bp, Homo sapien
gttttcttccaatcattagcggttg

SEQ ID NO: 16384 - DNA, 25 bp, Homo sapien
tttgcccctcattatcgatactatg

SEQ ID NO: 16385 - DNA, 25 bp, Homo sapien
gaattcatgcatacagtcagctgct

SEQ ID NO: 16386 - DNA, 25 bp, Homo sapien
gtcagctgctggaatcatataggtc

SEQ ID NO: 16387 - DNA, 25 bp, Homo sapien
ggtcattaacccttggctatatggc

SEQ ID NO: 16388 - DNA, 25 bp, Homo sapien
ggcagaagcgtttggtgttggtgtg

SEQ ID NO: 16389 - DNA, 25 bp, Homo sapien
tggcgagtatggtgcggaggccctg

SEQ ID NO: 16390 - DNA, 25 bp, Homo sapien
ctggagaggatgttcctgtccttcc

SEQ ID NO: 16391 - DNA, 25 bp, Homo sapien
cacggctctgcccaggttaagggcc

SEQ ID NO: 16392 - DNA, 25 bp, Homo sapien
ggtccccacagactcagagagaacc

SEQ ID NO: 16393 - DNA, 25 bp, Homo sapien
cgcacaagcttcgggtggacccggt

SEQ ID NO: 16394 - DNA, 25 bp, Homo sapien
tcaacttcaagctcctaagccactg

SEQ ID NO: 16395 - DNA, 25 bp, Homo sapien
agagaacccaccatggtgctgtctc

SEQ ID NO: 16396 - DNA, 25 bp, Homo sapien
gacaagttcctggcttctgtgagca

SEQ ID NO: 16397 - DNA, 25 bp, Homo sapien
ctgacctccaaataccgttaagctg

SEQ ID NO: 16398 - DNA, 25 bp, Homo sapien
tcctgccgacaagaccaacgtcaag

SEQ ID NO: 16399 - DNA, 25 bp, Homo sapien
tcaaggccgcctggggtaaggtcgg

SEQ ID NO: 16400 - DNA, 25 bp, Homo sapien
gacttggggagatggagttcttgtg

SEQ ID NO: 16401 - DNA, 25 bp, Homo sapien
tggagttcttgtgccatagtcacat

SEQ ID NO: 16402 - DNA, 25 bp, Homo sapien
tatggactctgcacatgaatcccac

SEQ ID NO: 16403 - DNA, 25 bp, Homo sapien
aatcccacccacatgtgacacatat

SEQ ID NO: 16404 - DNA, 25 bp, Homo sapien
acatatgcaccttgtgtctgtacac

SEQ ID NO: 16405 - DNA, 25 bp, Homo sapien
tgtgtagcctgtgcatgtatgtctt

SEQ ID NO: 16406 - DNA, 25 bp, Homo sapien
gcatgtatgtcttggacactgtaca

SEQ ID NO: 16407 - DNA, 25 bp, Homo sapien
cactgtacaaggtacccctttctgg

SEQ ID NO: 16408 - DNA, 25 bp, Homo sapien
gcctgggattgacagaagcttctgc

SEQ ID NO: 16409 - DNA, 25 bp, Homo sapien
gggccaggactttatctaatacctc

SEQ ID NO: 16410 - DNA, 25 bp, Homo sapien
ctttatctaatacctctgtgtgctc

SEQ ID NO: 16411 - DNA, 25 bp, Homo sapien
cccttgactgtggagctcatgggca

SEQ ID NO: 16412 - DNA, 25 bp, Homo sapien
gcaccgtggccaaacagctggtgcc

SEQ ID NO: 16413 - DNA, 25 bp, Homo sapien
aacagctggtgcccagctgcgtgac

SEQ ID NO: 16414 - DNA, 25 bp, Homo sapien
ctgcgtgactgtgcagcgctgtggt

SEQ ID NO: 16415 - DNA, 25 bp, Homo sapien
gtccggatgcagatcctcatgatcc

SEQ ID NO: 16416 - DNA, 25 bp, Homo sapien
catgatccggtacccgagcagtcag

SEQ ID NO: 16417 - DNA, 25 bp, Homo sapien
ggagatgtccctggaagaacacagc

SEQ ID NO: 16418 - DNA, 25 bp, Homo sapien
gccaagggcggggcttagagctcaa

SEQ ID NO: 16419 - DNA, 25 bp, Homo sapien
ggtgccggaagctgcgaaggtgaca

SEQ ID NO: 16420 - DNA, 25 bp, Homo sapien
gaaggtgacacatggcttttcagac

SEQ ID NO: 16421 - DNA, 25 bp, Homo sapien
ctcagcagggtgacttgcctcagag

SEQ ID NO: 16422 - DNA, 25 bp, Homo sapien
gcactgggccacggaggagggatgc

SEQ ID NO: 16423 - DNA, 25 bp, Homo sapien
cactgggccacggaggagggatgct

SEQ ID NO: 16424 - DNA, 25 bp, Homo sapien
ccgcagtgctgggaccagagccaga

SEQ ID NO: 16425 - DNA, 25 bp, Homo sapien
gcagtgctgggaccagagccagatg

SEQ ID NO: 16426 - DNA, 25 bp, Homo sapien
acagggcaccagaggccgaaggtgc

SEQ ID NO: 16427 - DNA, 25 bp, Homo sapien
gcaccagaggccgaaggtgcctcag

SEQ ID NO: 16428 - DNA, 25 bp, Homo sapien
agaggccgaaggtgcctcagactcc

SEQ ID NO: 16429 - DNA, 25 bp, Homo sapien
cagcgggcagatgggcggacggctg

SEQ ID NO: 16430 - DNA, 25 bp, Homo sapien
ctgagtcccctccaggaagaagcag

SEQ ID NO: 16431 - DNA, 25 bp, Homo sapien
gagtcccctccaggaagaagcaggg

SEQ ID NO: 16432 - DNA, 25 bp, Homo sapien
gtcccctccaggaagaagcaggggg

SEQ ID NO: 16433 - DNA, 25 bp, Homo sapien
cacactggagggcacacacgtaccc

SEQ ID NO: 16434 - DNA, 25 bp, Homo sapien
caactcctgacagaaagctcctccc

SEQ ID NO: 16435 - DNA, 25 bp, Homo sapien
gcatgatcctgaaatctgcatccgc

SEQ ID NO: 16436 - DNA, 25 bp, Homo sapien
tgcatccgccgtggtttgtattcat

SEQ ID NO: 16437 - DNA, 25 bp, Homo sapien
gccaggggctcgctgtgaggaatag

SEQ ID NO: 16438 - DNA, 25 bp, Homo sapien
aaaacttttcaccagcctttgagag

SEQ ID NO: 16439 - DNA, 25 bp, Homo sapien
tttgagagactagactgaccccacc

SEQ ID NO: 16440 - DNA, 25 bp, Homo sapien
acccttccttcagtgagcagaatca

SEQ ID NO: 16441 - DNA, 25 bp, Homo sapien
gcagaatcactgtggtcagtctcct

SEQ ID NO: 16442 - DNA, 25 bp, Homo sapien
cagttcatgaatactcctgttcctc

SEQ ID NO: 16443 - DNA, 25 bp, Homo sapien
ctggtatacatgcggcttcattgcc

SEQ ID NO: 16444 - DNA, 25 bp, Homo sapien
cactcccatgactttggtgttcggc

SEQ ID NO: 16445 - DNA, 25 bp, Homo sapien
tttggtgttcggctgccgatgctcc

SEQ ID NO: 16446 - DNA, 25 bp, Homo sapien
aggacatcctgaggacggagctggc

SEQ ID NO: 16447 - DNA, 25 bp, Homo sapien
gtttgtctgcggcgatgttaccatg

SEQ ID NO: 16448 - DNA, 25 bp, Homo sapien
tcctggcgacggagggcgacatgga

SEQ ID NO: 16449 - DNA, 25 bp, Homo sapien
gcgtgctgcgggatcagcaacgcta

SEQ ID NO: 16450 - DNA, 25 bp, Homo sapien
gcaacgctaccacgaagacattttc

SEQ ID NO: 16451 - DNA, 25 bp, Homo sapien
cgaagacattttcgggctcacgctg

SEQ ID NO: 16452 - DNA, 25 bp, Homo sapien
ggaggtgacaagccgcatacgcacc

SEQ ID NO: 16453 - DNA, 25 bp, Homo sapien
cccagagcttttccttgcaggagcg

SEQ ID NO: 16454 - DNA, 25 bp, Homo sapien
cttgcaggagcgtcagttgcggggc

SEQ ID NO: 16455 - DNA, 25 bp, Homo sapien
gattccacagaatttcatagctgac

SEQ ID NO: 16456 - DNA, 25 bp, Homo sapien
tcatagctgactactttgagacgag

SEQ ID NO: 16457 - DNA, 25 bp, Homo sapien
ttgagacgagcagccagtgctccaa

SEQ ID NO: 16458 - DNA, 25 bp, Homo sapien
gagtgcctgaggggtccagaagctt

SEQ ID NO: 16459 - DNA, 25 bp, Homo sapien
ctgaggggtccagaagcttcgaggc

SEQ ID NO: 16460 - DNA, 25 bp, Homo sapien
acagctacctcttctatggactggt

SEQ ID NO: 16461 - DNA, 25 bp, Homo sapien
cacactgtgggactcttcttaactt

SEQ ID NO: 16462 - DNA, 25 bp, Homo sapien
tgtgggactcttcttaacttaaatt

SEQ ID NO: 16463 - DNA, 25 bp, Homo sapien
acagtgtgtttgtgattgtttgctc

SEQ ID NO: 16464 - DNA, 25 bp, Homo sapien
gcctgtgtaggcagtcatggcacca

SEQ ID NO: 16465 - DNA, 25 bp, Homo sapien
gccaccagactgacaaatgtgtatc

SEQ ID NO: 16466 - DNA, 25 bp, Homo sapien
ctagggggccaactgtagctcagga

SEQ ID NO: 16467 - DNA, 25 bp, Homo sapien
actgtagctcaggagcctcgttctc

SEQ ID NO: 16468 - DNA, 25 bp, Homo sapien
gcccctgccacagggcactggaatg

SEQ ID NO: 16469 - DNA, 25 bp, Homo sapien
cagatgcagggttcccggtggtgtg

SEQ ID NO: 16470 - DNA, 25 bp, Homo sapien
tcccggtggtgtgctgtgaagatgt

SEQ ID NO: 16471 - DNA, 25 bp, Homo sapien
tgtgaagatgtcttcctctcggacc

SEQ ID NO: 16472 - DNA, 25 bp, Homo sapien
gctgcagatgagccagggggagcct

SEQ ID NO: 16473 - DNA, 25 bp, Homo sapien
agatgagccagggggagcctaggcc

SEQ ID NO: 16474 - DNA, 25 bp, Homo sapien
agccccagcagttctcagggtgctg

SEQ ID NO: 16475 - DNA, 25 bp, Homo sapien
cattgtccatagccttctcagggca

SEQ ID NO: 16476 - DNA, 25 bp, Homo sapien
atagccttctcagggcagagtgggc

SEQ ID NO: 16477 - DNA, 25 bp, Homo sapien
gttggggctgcgggggagtggagcc

SEQ ID NO: 16478 - DNA, 25 bp, Homo sapien
ttatcctctattcttcactttgggg

SEQ ID NO: 16479 - DNA, 25 bp, Homo sapien
tcctctattcttcactttggggtca

SEQ ID NO: 16480 - DNA, 25 bp, Homo sapien
tcactttggggtcagaacttcgggg

SEQ ID NO: 16481 - DNA, 25 bp, Homo sapien
gggtcagaacttcgggggtgtggag

SEQ ID NO: 16482 - DNA, 25 bp, Homo sapien
tcagaacttcgggggtgtggaggag

SEQ ID NO: 16483 - DNA, 25 bp, Homo sapien
tgtggaggaggtgcggctctaggga

SEQ ID NO: 16484 - DNA, 25 bp, Homo sapien
gtgcggctctagggacaggtaatgt

SEQ ID NO: 16485 - DNA, 25 bp, Homo sapien
gacaggtaatgtcggcttccaagtg

SEQ ID NO: 16486 - DNA, 25 bp, Homo sapien
aatgtcggcttccaagtgatgccct

SEQ ID NO: 16487 - DNA, 25 bp, Homo sapien
gccactcccctgcgatttataaggg

SEQ ID NO: 16488 - DNA, 25 bp, Homo sapien
ccgtggagcttcatcggggtggtgc

SEQ ID NO: 16489 - DNA, 25 bp, Homo sapien
gctttttgcaaaagggcttgcctaa

SEQ ID NO: 16490 - DNA, 25 bp, Homo sapien
aaagggcttgcctaaggccagccat

SEQ ID NO: 16491 - DNA, 25 bp, Homo sapien
gtggactacaggacaaggggcattg

SEQ ID NO: 16492 - DNA, 25 bp, Homo sapien
aggacaaggggcattgttgcttgtt

SEQ ID NO: 16493 - DNA, 25 bp, Homo sapien
ttgttgcttgttgggtaaaaatgaa

SEQ ID NO: 16494 - DNA, 25 bp, Homo sapien
aaatgaagcagaagccccaaagttc

SEQ ID NO: 16495 - DNA, 25 bp, Homo sapien
gaagcagaagccccaaagttcacat

SEQ ID NO: 16496 - DNA, 25 bp, Homo sapien
gcagaagccccaaagttcacattaa

SEQ ID NO: 16497 - DNA, 25 bp, Homo sapien
gaagccccaaagttcacattaactc

SEQ ID NO: 16498 - DNA, 25 bp, Homo sapien
agccccaaagttcacattaactcag

SEQ ID NO: 16499 - DNA, 25 bp, Homo sapien
tagagaccgtgtggtttttgttcac

SEQ ID NO: 16500 - DNA, 25 bp, Homo sapien
ctcccacctttttggtacattggtg

SEQ ID NO: 16501 - DNA, 25 bp, Homo sapien
ttatgaactaactgtggtgtgtgaa

SEQ ID NO: 16502 - DNA, 25 bp, Homo sapien
gaaatcttattccgtgtgtgtttgg

SEQ ID NO: 16503 - DNA, 25 bp, Homo sapien
cgtgtgtgtttgggagttgcttggg

SEQ ID NO: 16504 - DNA, 25 bp, Homo sapien
tgtttgggagttgcttggggttggg

SEQ ID NO: 16505 - DNA, 25 bp, Homo sapien
tgggggtcgtggggacaggggacag

SEQ ID NO: 16506 - DNA, 25 bp, Homo sapien
gacaggggacagctctgggagcaga

SEQ ID NO: 16507 - DNA, 25 bp, Homo sapien
ctctgggagcagaggtggccctcgg

SEQ ID NO: 16508 - DNA, 25 bp, Homo sapien
gccaggtgcttttctgtcaatttct

SEQ ID NO: 16509 - DNA, 25 bp, Homo sapien
tttctgtcaatttctatggaatgca

SEQ ID NO: 16510 - DNA, 25 bp, Homo sapien
gttgtctggaaacctgctgaggaaa

SEQ ID NO: 16511 - DNA, 25 bp, Homo sapien
aaaaacagcaacgggtggcagaagc

SEQ ID NO: 16512 - DNA, 25 bp, Homo sapien
tgggtggtgttcacaaacttctgcc

SEQ ID NO: 16513 - DNA, 25 bp, Homo sapien
gttcttctacaaatcacaccaggac

SEQ ID NO: 16514 - DNA, 25 bp, Homo sapien
aatcacaccaggacaatcatcccct

SEQ ID NO: 16515 - DNA, 25 bp, Homo sapien
ccctctgagtccgagaacatccaga

SEQ ID NO: 16516 - DNA, 25 bp, Homo sapien
aagactacgtgttcaagctgcactt

SEQ ID NO: 16517 - DNA, 25 bp, Homo sapien
cccacgtctactacttcagggcgga

SEQ ID NO: 16518 - DNA, 25 bp, Homo sapien
gggcggaaagcgagtacacgttcga

SEQ ID NO: 16519 - DNA, 25 bp, Homo sapien
ggatggaagtgatccgcagtgccac

SEQ ID NO: 16520 - DNA, 25 bp, Homo sapien
aattaacacctgtctgaaaatcaaa

SEQ ID NO: 16521 - DNA, 25 bp, Homo sapien
ggaccagggcgtgaaggtcttcctg

SEQ ID NO: 16522 - DNA, 25 bp, Homo sapien
gtcagttgtatgcagccctgcacca

SEQ ID NO: 16523 - DNA, 25 bp, Homo sapien
cagccccatccaacgaggaggacga

SEQ ID NO: 16524 - DNA, 25 bp, Homo sapien
ggaggacgacagcgacgatgacgat

SEQ ID NO: 16525 - DNA, 25 bp, Homo sapien
agcgacgatgacgatgtcctggctc

SEQ ID NO: 16526 - DNA, 25 bp, Homo sapien
cagctggtgctggtgacgaagggga

SEQ ID NO: 16527 - DNA, 25 bp, Homo sapien
gacgaaggggacgggcagacgaccg

SEQ ID NO: 16528 - DNA, 25 bp, Homo sapien
agacgaccgggagcacatagcggcc

SEQ ID NO: 16529 - DNA, 25 bp, Homo sapien
cccgcacgtcctgttcaaaagcaga

SEQ ID NO: 16530 - DNA, 25 bp, Homo sapien
aagcagactcgggaactgcctgaat

SEQ ID NO: 16531 - DNA, 25 bp, Homo sapien
gtggtttgggacacgagacctcatc

SEQ ID NO: 16532 - DNA, 25 bp, Homo sapien
tctttttccatacttatatctaaga

SEQ ID NO: 16533 - DNA, 25 bp, Homo sapien
aaaaggcatcataggtttctgaaag

SEQ ID NO: 16534 - DNA, 25 bp, Homo sapien
agagataactatataacagcttttt

SEQ ID NO: 16535 - DNA, 25 bp, Homo sapien
cagctttttaactatccagtcaact

SEQ ID NO: 16536 - DNA, 25 bp, Homo sapien
atccagtcaactttcagcttttcta

SEQ ID NO: 16537 - DNA, 25 bp, Homo sapien
tttcagcttttctacatttaggtaa

SEQ ID NO: 16538 - DNA, 25 bp, Homo sapien
taactcatggtgtggctaatctaca

SEQ ID NO: 16539 - DNA, 25 bp, Homo sapien
gtgtggctaatctacatttatcaat

SEQ ID NO: 16540 - DNA, 25 bp, Homo sapien
gaatataagatttaaccatgtttga

SEQ ID NO: 16541 - DNA, 25 bp, Homo sapien
atttcactagaactgtgtacttgat

SEQ ID NO: 16542 - DNA, 25 bp, Homo sapien
tatataaaacaatttgggggccagg

SEQ ID NO: 16543 - DNA, 25 bp, Homo sapien
ccggctatgggctcgagccgagttc

SEQ ID NO: 16544 - DNA, 25 bp, Homo sapien
gggcgccaaggagcagagggactcg

SEQ ID NO: 16545 - DNA, 25 bp, Homo sapien
ggactcggacttggcggccgagagt

SEQ ID NO: 16546 - DNA, 25 bp, Homo sapien
ggccgagagtaacttccggatctac

SEQ ID NO: 16547 - DNA, 25 bp, Homo sapien
tctacccctggatgcgaagctcagg

SEQ ID NO: 16548 - DNA, 25 bp, Homo sapien
caggaactgaccgcaaacgaggccg

SEQ ID NO: 16549 - DNA, 25 bp, Homo sapien
cgctaccagaccctggagctggaga

SEQ ID NO: 16550 - DNA, 25 bp, Homo sapien
agaatttcactacaatcgctacctg

SEQ ID NO: 16551 - DNA, 25 bp, Homo sapien
acgctctgcctcacggaaagacaga

SEQ ID NO: 16552 - DNA, 25 bp, Homo sapien
accaccggccaagacagggctgaag

SEQ ID NO: 16553 - DNA, 25 bp, Homo sapien
gcccagctctgggaactgaatcagg

SEQ ID NO: 16554 - DNA, 25 bp, Homo sapien
gaagctggaatttgcccttctgttt

SEQ ID NO: 16555 - DNA, 25 bp, Homo sapien
caaaacatactctgatcaccccgag

SEQ ID NO: 16556 - DNA, 25 bp, Homo sapien
tgtttggaaacctacaaggcctcac

SEQ ID NO: 16557 - DNA, 25 bp, Homo sapien
aaggcctcacaatgcacgtgggaga

SEQ ID NO: 16558 - DNA, 25 bp, Homo sapien
gatgaagtcaactggtatctgatgg

SEQ ID NO: 16559 - DNA, 25 bp, Homo sapien
tacacactgtacattttcacggcca

SEQ ID NO: 16560 - DNA, 25 bp, Homo sapien
ttcacggccatagcttccaatacaa

SEQ ID NO: 16561 - DNA, 25 bp, Homo sapien
ggggagtttatagttctgatgtctt

SEQ ID NO: 16562 - DNA, 25 bp, Homo sapien
atgtctttgacattttccctggaac

SEQ ID NO: 16563 - DNA, 25 bp, Homo sapien
ttccctggaacataccaaaccctag

SEQ ID NO: 16564 - DNA, 25 bp, Homo sapien
tggaatttggttactccactgccat

SEQ ID NO: 16565 - DNA, 25 bp, Homo sapien
agaaggggacaggcagtccgcggtc

SEQ ID NO: 16566 - DNA, 25 bp, Homo sapien
gtccgcggtctctggacaatcaact

SEQ ID NO: 16567 - DNA, 25 bp, Homo sapien
caatcaactcaaggtacgcccactg

SEQ ID NO: 16568 - DNA, 25 bp, Homo sapien
caccagggtgacaaggggtcctcgt

SEQ ID NO: 16569 - DNA, 25 bp, Homo sapien
cagggccagtcctaaggagctgagg

SEQ ID NO: 16570 - DNA, 25 bp, Homo sapien
ggagctgagggtctgaggacgcagg

SEQ ID NO: 16571 - DNA, 25 bp, Homo sapien
gggtctgaggacgcagggagggtgg

SEQ ID NO: 16572 - DNA, 25 bp, Homo sapien
gtggaggtgtcctgaggctgatgga

SEQ ID NO: 16573 - DNA, 25 bp, Homo sapien
tgaggctgatggacagtgaccgcca

SEQ ID NO: 16574 - DNA, 25 bp, Homo sapien
cccccaacatgaccacacgtgggtg

SEQ ID NO: 16575 - DNA, 25 bp, Homo sapien
aaatgtaaagccatctgtccggcgt

SEQ ID NO: 16576 - DNA, 25 bp, Homo sapien
aacttcagaatatgagccaatgagt

SEQ ID NO: 16577 - DNA, 25 bp, Homo sapien
gaagactaaagattttactctctcc

SEQ ID NO: 16578 - DNA, 25 bp, Homo sapien
gtgtgaacaggaaactttagggtag

SEQ ID NO: 16579 - DNA, 25 bp, Homo sapien
gttatcagagtggaagaccatggcc

SEQ ID NO: 16580 - DNA, 25 bp, Homo sapien
tttcctttgtaagacccagggatca

SEQ ID NO: 16581 - DNA, 25 bp, Homo sapien
gacccagggatcacttagccatagc

SEQ ID NO: 16582 - DNA, 25 bp, Homo sapien
ggatcacttagccatagcctgaatc

SEQ ID NO: 16583 - DNA, 25 bp, Homo sapien
gccatagcctgaatcttttaggggt

SEQ ID NO: 16584 - DNA, 25 bp, Homo sapien
aggggtattaaggtcagcctctcac

SEQ ID NO: 16585 - DNA, 25 bp, Homo sapien
tctcactcttccttcaggttactaa

SEQ ID NO: 16586 - DNA, 25 bp, Homo sapien
gtagctaaagaatgccatggccggg

SEQ ID NO: 16587 - DNA, 25 bp, Homo sapien
gagtgtgtaaaactttccaaatggc

SEQ ID NO: 16588 - DNA, 25 bp, Homo sapien
ggaaattggatacactcacatgaaa

SEQ ID NO: 16589 - DNA, 25 bp, Homo sapien
gagtgaactctcttttgcagatggc

SEQ ID NO: 16590 - DNA, 25 bp, Homo sapien
cttttgcagatggcaggcctcctgg

SEQ ID NO: 16591 - DNA, 25 bp, Homo sapien
tcagaagacaatggccccggtggcc

SEQ ID NO: 16592 - DNA, 25 bp, Homo sapien
ccccggtggccagttagagcagaga

SEQ ID NO: 16593 - DNA, 25 bp, Homo sapien
agagcagagacttcactgactgact

SEQ ID NO: 16594 - DNA, 25 bp, Homo sapien
cactgactgacttacaggtgcccta

SEQ ID NO: 16595 - DNA, 25 bp, Homo sapien
acaggtgccctattctgaggtacag

SEQ ID NO: 16596 - DNA, 25 bp, Homo sapien
tgaggtacaggagccgcggctttct

SEQ ID NO: 16597 - DNA, 25 bp, Homo sapien
tacaggagccgcggctttctgatgg

SEQ ID NO: 16598 - DNA, 25 bp, Homo sapien
aatggactgatgacgacctggtaga

SEQ ID NO: 16599 - DNA, 25 bp, Homo sapien
gacgacctggtagaatctctctaac

SEQ ID NO: 16600 - DNA, 25 bp, Homo sapien
gaatctctctaaccatttgaagttg

SEQ ID NO: 16601 - DNA, 25 bp, Homo sapien
acagctgatgactttcttaatagaa

SEQ ID NO: 16602 - DNA, 25 bp, Homo sapien
ggatgcttaccttttatacacacct

SEQ ID NO: 16603 - DNA, 25 bp, Homo sapien
gccctgactgccattttatctagtg

SEQ ID NO: 16604 - DNA, 25 bp, Homo sapien
ttttatctagtgcctccagggctgg

SEQ ID NO: 16605 - DNA, 25 bp, Homo sapien
agaacttgcctgtcacagttactag

SEQ ID NO: 16606 - DNA, 25 bp, Homo sapien
aagtatgaaccacccagatctgaag

SEQ ID NO: 16607 - DNA, 25 bp, Homo sapien
ggagcgatgtcattctgctgagctt

SEQ ID NO: 16608 - DNA, 25 bp, Homo sapien
gagcttgcacttaacgtaatcacga

SEQ ID NO: 16609 - DNA, 25 bp, Homo sapien
ggtggaagtccaagtcaaacgcaga

SEQ ID NO: 16610 - DNA, 25 bp, Homo sapien
acgcagaaggactgcctcactgagc

SEQ ID NO: 16611 - DNA, 25 bp, Homo sapien
caagagtgtcagttgtacccgaggc

SEQ ID NO: 16612 - DNA, 25 bp, Homo sapien
ggcgttctcagcagcagcaagtacc

SEQ ID NO: 16613 - DNA, 25 bp, Homo sapien
gcaagtacctgtggtggatttccag

SEQ ID NO: 16614 - DNA, 25 bp, Homo sapien
ggatttccaggctgaactgaggcag

SEQ ID NO: 16615 - DNA, 25 bp, Homo sapien
ggcaggcattcttagctgagacacc

SEQ ID NO: 16616 - DNA, 25 bp, Homo sapien
atgcctgacgcatctgtctgaggag

SEQ ID NO: 16617 - DNA, 25 bp, Homo sapien
gaggagcggtcagtgacgcgatgga

SEQ ID NO: 16618 - DNA, 25 bp, Homo sapien
gacgcgatggagcgggcaagggatc

SEQ ID NO: 16619 - DNA, 25 bp, Homo sapien
gggatcgcttacacctgagacgaac

SEQ ID NO: 16620 - DNA, 25 bp, Homo sapien
gcacattgctgaagatgccgaccgc

SEQ ID NO: 16621 - DNA, 25 bp, Homo sapien
ttgctgaagatgccgaccgcaaata

SEQ ID NO: 16622 - DNA, 25 bp, Homo sapien
tggcccgtaagctggtcatcattga

SEQ ID NO: 16623 - DNA, 25 bp, Homo sapien
gtcatcattgagagcgacctggaac

SEQ ID NO: 16624 - DNA, 25 bp, Homo sapien
gcgacctggaacgtgcagaggagcg

SEQ ID NO: 16625 - DNA, 25 bp, Homo sapien
agaggagcgggctgagctctcagaa

SEQ ID NO: 16626 - DNA, 25 bp, Homo sapien
ggaagagatcaaggtcctttccgac

SEQ ID NO: 16627 - DNA, 25 bp, Homo sapien
caaggtcctttccgacaagctgaag

SEQ ID NO: 16628 - DNA, 25 bp, Homo sapien
aaggaggctgagactcgggctgagt

SEQ ID NO: 16629 - DNA, 25 bp, Homo sapien
gagactcgggctgagtttgcggaga

SEQ ID NO: 16630 - DNA, 25 bp, Homo sapien
gtttgcggagaggtcagtaactaaa

SEQ ID NO: 16631 - DNA, 25 bp, Homo sapien
agggcactaaggcacagtatctggc

SEQ ID NO: 16632 - DNA, 25 bp, Homo sapien
agccaaggccctaaagaagcagtca

SEQ ID NO: 16633 - DNA, 25 bp, Homo sapien
agaagcagtcatggcgattccacac

SEQ ID NO: 16634 - DNA, 25 bp, Homo sapien
gtcatggcgattccacaccaagtac

SEQ ID NO: 16635 - DNA, 25 bp, Homo sapien
gcgattccacaccaagtacatgatg

SEQ ID NO: 16636 - DNA, 25 bp, Homo sapien
gatgtggttccagaggcacgaggag

SEQ ID NO: 16637 - DNA, 25 bp, Homo sapien
ggttccagaggcacgaggagcccaa

SEQ ID NO: 16638 - DNA, 25 bp, Homo sapien
caagaccatcactgacgagtttgag

SEQ ID NO: 16639 - DNA, 25 bp, Homo sapien
accatcactgacgagtttgagcagg

SEQ ID NO: 16640 - DNA, 25 bp, Homo sapien
ggggccagcggaagaaggaaggctt

SEQ ID NO: 16641 - DNA, 25 bp, Homo sapien
aggaaggcttcacctttgagtaccg

SEQ ID NO: 16642 - DNA, 25 bp, Homo sapien
tatgagcctggctacagctggcagc

SEQ ID NO: 16643 - DNA, 25 bp, Homo sapien
gcctcgccttgtgttacgatatttc

SEQ ID NO: 16644 - DNA, 25 bp, Homo sapien
tctctcctggactggttatcttgtt

SEQ ID NO: 16645 - DNA, 25 bp, Homo sapien
ttattattattttccttccatgctc

SEQ ID NO: 16646 - DNA, 25 bp, Homo sapien
tcccaaatccgccagtgtttctgaa

SEQ ID NO: 16647 - DNA, 25 bp, Homo sapien
ttgtgtctgtggttgcagtctttcc

SEQ ID NO: 16648 - DNA, 25 bp, Homo sapien
gaggaagcttcacatcagccatgat

SEQ ID NO: 16649 - DNA, 25 bp, Homo sapien
agccatgatatgaccgggccggacg

SEQ ID NO: 16650 - DNA, 25 bp, Homo sapien
ccgctaccagaccctggagctggaa

SEQ ID NO: 16651 - DNA, 25 bp, Homo sapien
gaaaaggagttccacttcaaccgct

SEQ ID NO: 16652 - DNA, 25 bp, Homo sapien
ctgtccgagcgccagatcaagatct

SEQ ID NO: 16653 - DNA, 25 bp, Homo sapien
ctgctttgaaataaacggacgtttg

SEQ ID NO: 16654 - DNA, 25 bp, Homo sapien
ggacgactacgcgctgggtgagcgt

SEQ ID NO: 16655 - DNA, 25 bp, Homo sapien
acgactacgcgctgggtgagcgtgt

SEQ ID NO: 16656 - DNA, 25 bp, Homo sapien
gactacgcgctgggtgagcgtgtgc

SEQ ID NO: 16657 - DNA, 25 bp, Homo sapien
ctacgcgctgggtgagcgtgtgcgg

SEQ ID NO: 16658 - DNA, 25 bp, Homo sapien
ggctggagcagcacgacagctgccc

SEQ ID NO: 16659 - DNA, 25 bp, Homo sapien
cccgtctgccgaaaaagcctcacgg

SEQ ID NO: 16660 - DNA, 25 bp, Homo sapien
gtctgccgaaaaagcctcacgggac

SEQ ID NO: 16661 - DNA, 25 bp, Homo sapien
ctgccgaaaaagcctcacgggacag

SEQ ID NO: 16662 - DNA, 25 bp, Homo sapien
gaaaaagcctcacgggacagaacac

SEQ ID NO: 16663 - DNA, 25 bp, Homo sapien
aagcctcacgggacagaacacggcc

SEQ ID NO: 16664 - DNA, 25 bp, Homo sapien
gaagtaactcttggggacaatatat

SEQ ID NO: 16665 - DNA, 25 bp, Homo sapien
gcattaccttgaaatatgaagtgcc

SEQ ID NO: 16666 - DNA, 25 bp, Homo sapien
agtgccatttgaatgtcccagggct

SEQ ID NO: 16667 - DNA, 25 bp, Homo sapien
gccatttgaatgtcccagggcttat

SEQ ID NO: 16668 - DNA, 25 bp, Homo sapien
ttgaatgtcccagggcttattaata

SEQ ID NO: 16669 - DNA, 25 bp, Homo sapien
aagattttcaacccctgaactgctt

SEQ ID NO: 16670 - DNA, 25 bp, Homo sapien
tctgcctctgtggaaaactactttg

SEQ ID NO: 16671 - DNA, 25 bp, Homo sapien
gaaaactactttgggattcttcagt

SEQ ID NO: 16672 - DNA, 25 bp, Homo sapien
tactttgggattcttcagtatttgt

SEQ ID NO: 16673 - DNA, 25 bp, Homo sapien
attcattctaggcattgtttatatt

SEQ ID NO: 16674 - DNA, 25 bp, Homo sapien
ctaggcattgtttatatttgaagtt

SEQ ID NO: 16675 - DNA, 25 bp, Homo sapien
gaagcgggagaagtacctgtaccag

SEQ ID NO: 16676 - DNA, 25 bp, Homo sapien
acgatgaggcggtgaggtctgagaa

SEQ ID NO: 16677 - DNA, 25 bp, Homo sapien
aggccggagtgagtgcctgcggccc

SEQ ID NO: 16678 - DNA, 25 bp, Homo sapien
cccctcacagggctgaggccagccc

SEQ ID NO: 16679 - DNA, 25 bp, Homo sapien
agcccctagcagctggatgtggcag

SEQ ID NO: 16680 - DNA, 25 bp, Homo sapien
tgatggaccagagtcacttctcctc

SEQ ID NO: 16681 - DNA, 25 bp, Homo sapien
ctctctggctgggccagtgggcagc

SEQ ID NO: 16682 - DNA, 25 bp, Homo sapien
cctgctggtgcctggtcagagaaga

SEQ ID NO: 16683 - DNA, 25 bp, Homo sapien
ggagccagtgacatgaggtgcagag

SEQ ID NO: 16684 - DNA, 25 bp, Homo sapien
ccacacagttggacccgtgattctc

SEQ ID NO: 16685 - DNA, 25 bp, Homo sapien
gacccgtgattctcagggtgctgtg

SEQ ID NO: 16686 - DNA, 25 bp, Homo sapien
ccctcctgtgacctcagggtttggc

SEQ ID NO: 16687 - DNA, 25 bp, Homo sapien
tctgcccagataatcgtgtctcctg

SEQ ID NO: 16688 - DNA, 25 bp, Homo sapien
actcagctgcttctcagtcatgaat

SEQ ID NO: 16689 - DNA, 25 bp, Homo sapien
ctccctgtccctgggcaagaatgct

SEQ ID NO: 16690 - DNA, 25 bp, Homo sapien
ttgaggggggcttccctcaactgtt

SEQ ID NO: 16691 - DNA, 25 bp, Homo sapien
tcaactgtttccccacactgggggg

SEQ ID NO: 16692 - DNA, 25 bp, Homo sapien
aggcctggagcctgtagggctggac

SEQ ID NO: 16693 - DNA, 25 bp, Homo sapien
ggctggactgaggttcaggtctccc

SEQ ID NO: 16694 - DNA, 25 bp, Homo sapien
ctttgtccccactctagagcaggga

SEQ ID NO: 16695 - DNA, 25 bp, Homo sapien
tcttctgtctccatgtggtttttgg

SEQ ID NO: 16696 - DNA, 25 bp, Homo sapien
gtttttcttgttgtgtcctggattc

SEQ ID NO: 16697 - DNA, 25 bp, Homo sapien
gcatgaggtctgccagaaggccctg

SEQ ID NO: 16698 - DNA, 25 bp, Homo sapien
aggccctgcgtgtggatggtgacac

SEQ ID NO: 16699 - DNA, 25 bp, Homo sapien
agaggatggctctatgctggtgact

SEQ ID NO: 16700 - DNA, 25 bp, Homo sapien
cacatcgcctctggttaaatctctc

SEQ ID NO: 16701 - DNA, 25 bp, Homo sapien
atctctcctgcttggtgatttcagc

SEQ ID NO: 16702 - DNA, 25 bp, Homo sapien
gctacagcaaagcccattggccaga

SEQ ID NO: 16703 - DNA, 25 bp, Homo sapien
tctggttgcctatagtgctctggga

SEQ ID NO: 16704 - DNA, 25 bp, Homo sapien
gctaccagctacagcgtggggttgt

SEQ ID NO: 16705 - DNA, 25 bp, Homo sapien
tgtggtcctggccaagagctacaat

SEQ ID NO: 16706 - DNA, 25 bp, Homo sapien
tgacccttgatatttttgctggccc

SEQ ID NO: 16707 - DNA, 25 bp, Homo sapien
cccccctaattatccattttctgat

SEQ ID NO: 16708 - DNA, 25 bp, Homo sapien
tcatctgaggaggcctcgtctctga

SEQ ID NO: 16709 - DNA, 25 bp, Homo sapien
tctgaacttgggttgtgccgagaga

SEQ ID NO: 16710 - DNA, 25 bp, Homo sapien
gtgccgagagagtttgttctgtgtt

SEQ ID NO: 16711 - DNA, 25 bp, Homo sapien
cctctactcccttaacagtgttgaa

SEQ ID NO: 16712 - DNA, 25 bp, Homo sapien
gctgagttcaggactcggtggaccc

SEQ ID NO: 16713 - DNA, 25 bp, Homo sapien
gactcggtggaccctttgggaatgg

SEQ ID NO: 16714 - DNA, 25 bp, Homo sapien
gaggacaatgactattgcatcttca

SEQ ID NO: 16715 - DNA, 25 bp, Homo sapien
attgcaaaagcactggctcatccgc

SEQ ID NO: 16716 - DNA, 25 bp, Homo sapien
gagtacttttgggggcacaactgtt

SEQ ID NO: 16717 - DNA, 25 bp, Homo sapien
ggggcacaactgttttctgtttgct

SEQ ID NO: 16718 - DNA, 25 bp, Homo sapien
aagctctgaggcacgtcatgcaggt

SEQ ID NO: 16719 - DNA, 25 bp, Homo sapien
gatgaatatgagtccacctccaggc

SEQ ID NO: 16720 - DNA, 25 bp, Homo sapien
gcccggtgatcatgtccattgagga

SEQ ID NO: 16721 - DNA, 25 bp, Homo sapien
gaagatggaggctgatgcccgttcc

SEQ ID NO: 16722 - DNA, 25 bp, Homo sapien
atgcccgttccatctatgttggcaa

SEQ ID NO: 16723 - DNA, 25 bp, Homo sapien
ggaagctcactttcatggctgtggt

SEQ ID NO: 16724 - DNA, 25 bp, Homo sapien
gtcaaccgtgttaccatactgtgtg

SEQ ID NO: 16725 - DNA, 25 bp, Homo sapien
gtgtgacaaatttagtggccatccc

SEQ ID NO: 16726 - DNA, 25 bp, Homo sapien
cttccttggccttagatgagtccct

SEQ ID NO: 16727 - DNA, 25 bp, Homo sapien
gaaccaacagaccaggcatcagcac

SEQ ID NO: 16728 - DNA, 25 bp, Homo sapien
cgctctcgattctacagtggtttta

SEQ ID NO: 16729 - DNA, 25 bp, Homo sapien
tagagcgacatcatggtattcccct

SEQ ID NO: 16730 - DNA, 25 bp, Homo sapien
agcgcaccaggttcaaggcatttgt

SEQ ID NO: 16731 - DNA, 25 bp, Homo sapien
ggcatttgttgctatcggggactac

SEQ ID NO: 16732 - DNA, 25 bp, Homo sapien
acgtcggtctgggtgttaagtgctc

SEQ ID NO: 16733 - DNA, 25 bp, Homo sapien
cccgtgcgcagaggctactggggga

SEQ ID NO: 16734 - DNA, 25 bp, Homo sapien
tcccctgcaaggtgacaggccgctg

SEQ ID NO: 16735 - DNA, 25 bp, Homo sapien
tccgcacctgtgcctaagaagctgc

SEQ ID NO: 16736 - DNA, 25 bp, Homo sapien
gaagctgctcatgatggctggtatc

SEQ ID NO: 16737 - DNA, 25 bp, Homo sapien
ggctggtatcgatgactgctacacc

SEQ ID NO: 16738 - DNA, 25 bp, Homo sapien
aaggccacctttgatgccatttcta

SEQ ID NO: 16739 - DNA, 25 bp, Homo sapien
tctaagacctacagctacctgaccc

SEQ ID NO: 16740 - DNA, 25 bp, Homo sapien
tatcaggagttcactgaccacctcg

SEQ ID NO: 16741 - DNA, 25 bp, Homo sapien
gactctcaggacaaaacgacaccag

SEQ ID NO: 16742 - DNA, 25 bp, Homo sapien
acagccacgaagatcctaccaaaat

SEQ ID NO: 16743 - DNA, 25 bp, Homo sapien
gcatccagcagcatgagcggaggca

SEQ ID NO: 16744 - DNA, 25 bp, Homo sapien
gtggccaatgccataatccacctct

SEQ ID NO: 16745 - DNA, 25 bp, Homo sapien
agttgaggtgacacgtctcagcctt

SEQ ID NO: 16746 - DNA, 25 bp, Homo sapien
gccaccatcactcgcaagagaatcc

SEQ ID NO: 16747 - DNA, 25 bp, Homo sapien
ttgggaggggttgatgccagacatc

SEQ ID NO: 16748 - DNA, 25 bp, Homo sapien
ccaaaatgaagcgcttcctcttcct

SEQ ID NO: 16749 - DNA, 25 bp, Homo sapien
gggggtaatgatgtaggggccaagc

SEQ ID NO: 16750 - DNA, 25 bp, Homo sapien
catcagcctcctggttatggtacag

SEQ ID NO: 16751 - DNA, 25 bp, Homo sapien
ggtacagatacaaactggactctca

SEQ ID NO: 16752 - DNA, 25 bp, Homo sapien
tatctcctgaggatcactccaagaa

SEQ ID NO: 16753 - DNA, 25 bp, Homo sapien
gagatccacataccattctcaatcc

SEQ ID NO: 16754 - DNA, 25 bp, Homo sapien
taccattctcaatcccactgaaatt

SEQ ID NO: 16755 - DNA, 25 bp, Homo sapien
gctggcattctcaaaggcagggcag

SEQ ID NO: 16756 - DNA, 25 bp, Homo sapien
gagggagggttctgtctaatctttt

SEQ ID NO: 16757 - DNA, 25 bp, Homo sapien
agctttcatacttcagcccttaagt

SEQ ID NO: 16758 - DNA, 25 bp, Homo sapien
tagtggtgttaactgctccaactct

SEQ ID NO: 16759 - DNA, 25 bp, Homo sapien
ccaactcttgtcttgcttagtttct

SEQ ID NO: 16760 - DNA, 25 bp, Homo sapien
agatgctgttcatcagtcccaacaa

SEQ ID NO: 16761 - DNA, 25 bp, Homo sapien
caagttctatttcttcccttatagt

SEQ ID NO: 16762 - DNA, 25 bp, Homo sapien
gatacaggaaacaccctatctcctc

SEQ ID NO: 16763 - DNA, 25 bp, Homo sapien
gctacaaaagaggccttgcagaaat

SEQ ID NO: 16764 - DNA, 25 bp, Homo sapien
gagccaagttaacaagtacttcagg

SEQ ID NO: 16765 - DNA, 25 bp, Homo sapien
gctagttttatgcagggcattctgt

SEQ ID NO: 16766 - DNA, 25 bp, Homo sapien
atggatacaatccgacatatataaa

SEQ ID NO: 16767 - DNA, 25 bp, Homo sapien
gaaacagattcttaactattgactc

SEQ ID NO: 16768 - DNA, 25 bp, Homo sapien
aactattgactcttatttagcaaat

SEQ ID NO: 16769 - DNA, 25 bp, Homo sapien
gcaacctgtcaattaatatatacta

SEQ ID NO: 16770 - DNA, 25 bp, Homo sapien
gattagccatcataaatgcccattg

SEQ ID NO: 16771 - DNA, 25 bp, Homo sapien
tgcccattgcttggcctttaagaat

SEQ ID NO: 16772 - DNA, 25 bp, Homo sapien
atacaaatttgttgcagaagtgcct

SEQ ID NO: 16773 - DNA, 25 bp, Homo sapien
ttttttgtctgactcatctgagtta

SEQ ID NO: 16774 - DNA, 25 bp, Homo sapien
ccgttcctggagctggacacgaatt

SEQ ID NO: 16775 - DNA, 25 bp, Homo sapien
tggagctggacacgaatttgcccgc

SEQ ID NO: 16776 - DNA, 25 bp, Homo sapien
gtgcccgcggggctggagaaacgac

SEQ ID NO: 16777 - DNA, 25 bp, Homo sapien
ggggctggagaaacgactctgcgcc

SEQ ID NO: 16778 - DNA, 25 bp, Homo sapien
gcaaacctgcggaccgcgtgaacgt

SEQ ID NO: 16779 - DNA, 25 bp, Homo sapien
gaccgcgtgaacgtgacggtacggc

SEQ ID NO: 16780 - DNA, 25 bp, Homo sapien
ctagccctgggccaggaccggatac

SEQ ID NO: 16781 - DNA, 25 bp, Homo sapien
caggaccggatacttatccgctttt

SEQ ID NO: 16782 - DNA, 25 bp, Homo sapien
agtcctggcagattggcaagatagg

SEQ ID NO: 16783 - DNA, 25 bp, Homo sapien
gatagggacggtcatgactttttta

SEQ ID NO: 16784 - DNA, 25 bp, Homo sapien
gattgggcacggagggatccagggc

SEQ ID NO: 16785 - DNA, 25 bp, Homo sapien
gttcgtaactcagccactggcaagg

SEQ ID NO: 16786 - DNA, 25 bp, Homo sapien
gaaagctccaaatccatgacagtcg

SEQ ID NO: 16787 - DNA, 25 bp, Homo sapien
catgacagtcgaagtctctgctcct

SEQ ID NO: 16788 - DNA, 25 bp, Homo sapien
tcaggaataggacgtcttcctctcc

SEQ ID NO: 16789 - DNA, 25 bp, Homo sapien
cttcctctccttaatccaatatagc

SEQ ID NO: 16790 - DNA, 25 bp, Homo sapien
ccaatatagcagccgtgaagtcatt

SEQ ID NO: 16791 - DNA, 25 bp, Homo sapien
aggagaaaacctctacttgtcctgc

SEQ ID NO: 16792 - DNA, 25 bp, Homo sapien
ctaacccaccggcagagtatttttg

SEQ ID NO: 16793 - DNA, 25 bp, Homo sapien
tcaggacaaaagctctctatccccc

SEQ ID NO: 16794 - DNA, 25 bp, Homo sapien
tctctatcccccaaattactacaaa

SEQ ID NO: 16795 - DNA, 25 bp, Homo sapien
tagagggctctatacttgctctgtt

SEQ ID NO: 16796 - DNA, 25 bp, Homo sapien
tccccaagactttactagtgccgat

SEQ ID NO: 16797 - DNA, 25 bp, Homo sapien
actagtgccgataaactttctcaaa

SEQ ID NO: 16798 - DNA, 25 bp, Homo sapien
aaagagcaaccagtatcacttccct

SEQ ID NO: 16799 - DNA, 25 bp, Homo sapien
ataaaacctctaaccatctctttgt

SEQ ID NO: 16800 - DNA, 25 bp, Homo sapien
atctctttgttctttgaacatgctg

SEQ ID NO: 16801 - DNA, 25 bp, Homo sapien
gaacatgctgaaaaccacctggtct

SEQ ID NO: 16802 - DNA, 25 bp, Homo sapien
aaaaccacctggtctgcatgtatgc

SEQ ID NO: 16803 - DNA, 25 bp, Homo sapien
acctggtctgcatgtatgcccgaat

SEQ ID NO: 16804 - DNA, 25 bp, Homo sapien
ctgcatgtatgcccgaatttgtaat

SEQ ID NO: 16805 - DNA, 25 bp, Homo sapien
ggaagcagctgtctaaaatgcagtg

SEQ ID NO: 16806 - DNA, 25 bp, Homo sapien
aaaatgcagtggggtttgttttgca

SEQ ID NO: 16807 - DNA, 25 bp, Homo sapien
caactacgagcaggcccggaagtga

SEQ ID NO: 16808 - DNA, 25 bp, Homo sapien
aagacaggatcaggtgccagcggac

SEQ ID NO: 16809 - DNA, 25 bp, Homo sapien
gccagcggaccatcggctggcagag

SEQ ID NO: 16810 - DNA, 25 bp, Homo sapien
ctggcccagctctttatctgggtcc

SEQ ID NO: 16811 - DNA, 25 bp, Homo sapien
caatgaagtggagcccatcatcctc

SEQ ID NO: 16812 - DNA, 25 bp, Homo sapien
atcatcctctccgtgggcgaggaag

SEQ ID NO: 16813 - DNA, 25 bp, Homo sapien
caaggaggcagccgaggcggtggtg

SEQ ID NO: 16814 - DNA, 25 bp, Homo sapien
ggggaagtcacctttgatacaacca

SEQ ID NO: 16815 - DNA, 25 bp, Homo sapien
aacagcaagctgaggacctacctgc

SEQ ID NO: 16816 - DNA, 25 bp, Homo sapien
gttcacacccttcaagcaggcggtg

SEQ ID NO: 16817 - DNA, 25 bp, Homo sapien
gacctgtgcttggttcactgacaac

SEQ ID NO: 16818 - DNA, 25 bp, Homo sapien
ttgccaaaaattcatgccccagtat

SEQ ID NO: 16819 - DNA, 25 bp, Homo sapien
aattcatgccccagtattagcaatg

SEQ ID NO: 16820 - DNA, 25 bp, Homo sapien
gagaaaggcacatattggagggaaa

SEQ ID NO: 16821 - DNA, 25 bp, Homo sapien
tggagggaaatcttggtgtaactta

SEQ ID NO: 16822 - DNA, 25 bp, Homo sapien
aatgttttaatgccagggcctgctg

SEQ ID NO: 16823 - DNA, 25 bp, Homo sapien
ctgagttgcttcttcttgtggagat

SEQ ID NO: 16824 - DNA, 25 bp, Homo sapien
taatctcctgagttgtataaaagtt

SEQ ID NO: 16825 - DNA, 25 bp, Homo sapien
aaagttgtactgcatcttagtttac

SEQ ID NO: 16826 - DNA, 25 bp, Homo sapien
actgcatcttagtttactggataaa

SEQ ID NO: 16827 - DNA, 25 bp, Homo sapien
aatacaaaactatcctatgccttca

SEQ ID NO: 16828 - DNA, 25 bp, Homo sapien
ctatcctatgccttcaaatagtata

SEQ ID NO: 16829 - DNA, 25 bp, Homo sapien
cagcactctggttataattgcccca

SEQ ID NO: 16830 - DNA, 25 bp, Homo sapien
aattgccccagggcctgattcagga

SEQ ID NO: 16831 - DNA, 25 bp, Homo sapien
gactgactctccaccataaaactgg

SEQ ID NO: 16832 - DNA, 25 bp, Homo sapien
actggaagctgcttcccctgtagtc

SEQ ID NO: 16833 - DNA, 25 bp, Homo sapien
catttcagtaccagttctgccagcc

SEQ ID NO: 16834 - DNA, 25 bp, Homo sapien
gtgagcccctattattactttcaga

SEQ ID NO: 16835 - DNA, 25 bp, Homo sapien
cctccacctctgagatggacactta

SEQ ID NO: 16836 - DNA, 25 bp, Homo sapien
gatccaagaaaccagggccatgacc

SEQ ID NO: 16837 - DNA, 25 bp, Homo sapien
gccatgaccaggtccactgtggagc

SEQ ID NO: 16838 - DNA, 25 bp, Homo sapien
actgtggagcagccatctatctacc

SEQ ID NO: 16839 - DNA, 25 bp, Homo sapien
ttctccacattatctttgttcctgg

SEQ ID NO: 16840 - DNA, 25 bp, Homo sapien
ccgtgcttcctcagttacacaaagg

SEQ ID NO: 16841 - DNA, 25 bp, Homo sapien
tacacaaaggacctcagctgcttct

SEQ ID NO: 16842 - DNA, 25 bp, Homo sapien
ttctcccacttggccaagcagggag

SEQ ID NO: 16843 - DNA, 25 bp, Homo sapien
agaagcttaggcagggctctctttc

SEQ ID NO: 16844 - DNA, 25 bp, Homo sapien
aaggcaggtgagcaaccagttggct

SEQ ID NO: 16845 - DNA, 25 bp, Homo sapien
gggcccaccagagctgtggagaggg

SEQ ID NO: 16846 - DNA, 25 bp, Homo sapien
ggagaggggaccctaagactcctcg

SEQ ID NO: 16847 - DNA, 25 bp, Homo sapien
tcagggatggccgttggccacgtct

SEQ ID NO: 16848 - DNA, 25 bp, Homo sapien
aaagcagcccttggccagaagtcaa

SEQ ID NO: 16849 - DNA, 25 bp, Homo sapien
ccagccacgtggagcctagagtgag

SEQ ID NO: 16850 - DNA, 25 bp, Homo sapien
ttctgcctctcaacatcacttgaat

SEQ ID NO: 16851 - DNA, 25 bp, Homo sapien
taaggacttgagtgactttgaggcc

SEQ ID NO: 16852 - DNA, 25 bp, Homo sapien
tgaggccttaccttatgaagcagtg

SEQ ID NO: 16853 - DNA, 25 bp, Homo sapien
aagccagctgttactaagccatgtg

SEQ ID NO: 16854 - DNA, 25 bp, Homo sapien
ggctccgcgtcggtagacattgttc

SEQ ID NO: 16855 - DNA, 25 bp, Homo sapien
tgtggaaggctagcttgccagggcc

SEQ ID NO: 16856 - DNA, 25 bp, Homo sapien
accctctgctattctgttgccagag

SEQ ID NO: 16857 - DNA, 25 bp, Homo sapien
ttgtgcattgtccacaacctgctca

SEQ ID NO: 16858 - DNA, 25 bp, Homo sapien
caacctgctcaaaatacagttctgc

SEQ ID NO: 16859 - DNA, 25 bp, Homo sapien
acagttctgcttatgcacgtatatt

SEQ ID NO: 16860 - DNA, 25 bp, Homo sapien
gaacctaccacagagaatctatccc

SEQ ID NO: 16861 - DNA, 25 bp, Homo sapien
gaagtccatattgggccaggtgcgg

SEQ ID NO: 16862 - DNA, 25 bp, Homo sapien
agatggaataatccatttccctggt

SEQ ID NO: 16863 - DNA, 25 bp, Homo sapien
gcctgtgcgggactggtgcagaaac

SEQ ID NO: 16864 - DNA, 25 bp, Homo sapien
gtgcgggactggtgcagaaactact

SEQ ID NO: 16865 - DNA, 25 bp, Homo sapien
gggactggtgcagaaactactcgtc

SEQ ID NO: 16866 - DNA, 25 bp, Homo sapien
actggtgcagaaactactcgtctcc

SEQ ID NO: 16867 - DNA, 25 bp, Homo sapien
ccagggaggtggaagatcgatgctt

SEQ ID NO: 16868 - DNA, 25 bp, Homo sapien
aggtggaagatcgatgcttccagct

SEQ ID NO: 16869 - DNA, 25 bp, Homo sapien
ttttttggagaaggcgtcttgcttt

SEQ ID NO: 16870 - DNA, 25 bp, Homo sapien
tggagaaggcgtcttgctttgtcac

SEQ ID NO: 16871 - DNA, 25 bp, Homo sapien
aggggaaactcttgtgggaggagca

SEQ ID NO: 16872 - DNA, 25 bp, Homo sapien
aactcttgtgggaggagcagagggg

SEQ ID NO: 16873 - DNA, 25 bp, Homo sapien
tccaagtgccgcaagcgcaagctgg

SEQ ID NO: 16874 - DNA, 25 bp, Homo sapien
agcgcatctcgcgcctggaagagaa

SEQ ID NO: 16875 - DNA, 25 bp, Homo sapien
gagtcagaacacggagctggcgtcc

SEQ ID NO: 16876 - DNA, 25 bp, Homo sapien
cgcagctcaagcagaaagtcctcag

SEQ ID NO: 16877 - DNA, 25 bp, Homo sapien
tcagccacgtcaacagcggctgcca

SEQ ID NO: 16878 - DNA, 25 bp, Homo sapien
gtgcccaggactcggaaggggcgcc

SEQ ID NO: 16879 - DNA, 25 bp, Homo sapien
ctcaaggacgagccacagacggtgc

SEQ ID NO: 16880 - DNA, 25 bp, Homo sapien
cgacgtgccgagcttcggcgagagc

SEQ ID NO: 16881 - DNA, 25 bp, Homo sapien
gttgtcgcccatcgacatggacacg

SEQ ID NO: 16882 - DNA, 25 bp, Homo sapien
ggacacgcaggagcgcatcaaggcg

SEQ ID NO: 16883 - DNA, 25 bp, Homo sapien
atcaaggcggagcgcaagcggctgc

SEQ ID NO: 16884 - DNA, 25 bp, Homo sapien
gttgttgtgcaggtagagccggcgc

SEQ ID NO: 16885 - DNA, 25 bp, Homo sapien
caggtagagccggcgcagagcggcg

SEQ ID NO: 16886 - DNA, 25 bp, Homo sapien
gctctaggcgggcgatgttgttgtc

SEQ ID NO: 16887 - DNA, 25 bp, Homo sapien
gatgttgttgtcctgcaggaacagt

SEQ ID NO: 16888 - DNA, 25 bp, Homo sapien
tgcaggaacagtgtctgcaggccgg

SEQ ID NO: 16889 - DNA, 25 bp, Homo sapien
caccgtggcgctgtagcagcggcag

SEQ ID NO: 16890 - DNA, 25 bp, Homo sapien
cgtgccctcctgaaacacaggttgg

SEQ ID NO: 16891 - DNA, 25 bp, Homo sapien
acacaggttggcaggccagtctcgg

SEQ ID NO: 16892 - DNA, 25 bp, Homo sapien
aggccagtctcggcagtcgagagcc

SEQ ID NO: 16893 - DNA, 25 bp, Homo sapien
gcagtcgagagccagccaatagatg

SEQ ID NO: 16894 - DNA, 25 bp, Homo sapien
gcacctgcgtctaacttttgacact

SEQ ID NO: 16895 - DNA, 25 bp, Homo sapien
ccagttcctttagaattcatgaaaa

SEQ ID NO: 16896 - DNA, 25 bp, Homo sapien
gcaatgcgggaaagcttacagtcat

SEQ ID NO: 16897 - DNA, 25 bp, Homo sapien
gggaaagcttacagtcatccccgtt

SEQ ID NO: 16898 - DNA, 25 bp, Homo sapien
tccccgttcacttcgaagacatgaa

SEQ ID NO: 16899 - DNA, 25 bp, Homo sapien
gacatgaacaaattcactagtgaga

SEQ ID NO: 16900 - DNA, 25 bp, Homo sapien
actagtgagaaactgtccatgtaat

SEQ ID NO: 16901 - DNA, 25 bp, Homo sapien
gtgagaaactgtccatgtaataaat

SEQ ID NO: 16902 - DNA, 25 bp, Homo sapien
atgtgggaaagctctcatttgttcc

SEQ ID NO: 16903 - DNA, 25 bp, Homo sapien
ctcatttgttccagttcactttaaa

SEQ ID NO: 16904 - DNA, 25 bp, Homo sapien
agacatgaatgaactcactctggag

SEQ ID NO: 16905 - DNA, 25 bp, Homo sapien
tgaaaattacttaattcctgtaatc

SEQ ID NO: 16906 - DNA, 25 bp, Homo sapien
gcccagcgcggcaaggagcgagtgt

SEQ ID NO: 16907 - DNA, 25 bp, Homo sapien
gcgcggcaaggagcgagtgtgtgca

SEQ ID NO: 16908 - DNA, 25 bp, Homo sapien
agcgagtgtgtgcacgcagagggcc

SEQ ID NO: 16909 - DNA, 25 bp, Homo sapien
ggccggcgttgaccgggaagagcgg

SEQ ID NO: 16910 - DNA, 25 bp, Homo sapien
cgttgaccgggaagagcgggcaccg

SEQ ID NO: 16911 - DNA, 25 bp, Homo sapien
cgccctgagaggaggctccaggcag

SEQ ID NO: 16912 - DNA, 25 bp, Homo sapien
tgagaggaggctccaggcagggcgg

SEQ ID NO: 16913 - DNA, 25 bp, Homo sapien
tgtaccaaccaccttctcaagttgt

SEQ ID NO: 16914 - DNA, 25 bp, Homo sapien
aaccaccttctcaagttgtagcggt

SEQ ID NO: 16915 - DNA, 25 bp, Homo sapien
ccttctcaagttgtagcggtcgctc

SEQ ID NO: 16916 - DNA, 25 bp, Homo sapien
tctcaagttgtagcggtcgctcgcc

SEQ ID NO: 16917 - DNA, 25 bp, Homo sapien
tcgggtcgtggggcggagggaagag

SEQ ID NO: 16918 - DNA, 25 bp, Homo sapien
tcgtggggcggagggaagagcgggc

SEQ ID NO: 16919 - DNA, 25 bp, Homo sapien
gcgccagacgcggagggaaggagct

SEQ ID NO: 16920 - DNA, 25 bp, Homo sapien
gacgcggagggaaggagctacgagt

SEQ ID NO: 16921 - DNA, 25 bp, Homo sapien
aggagctacgagtagccgccgagag

SEQ ID NO: 16922 - DNA, 25 bp, Homo sapien
gggcgggccggacaatgagagtgtc

SEQ ID NO: 16923 - DNA, 25 bp, Homo sapien
cggacaatgagagtgtccgcctcct

SEQ ID NO: 16924 - DNA, 25 bp, Homo sapien
tccgcctcctgagccaataaagctg

SEQ ID NO: 16925 - DNA, 25 bp, Homo sapien
gccaataaagctgtactggttttga

SEQ ID NO: 16926 - DNA, 25 bp, Homo sapien
ctgtactggttttgaatcgcggcgc

SEQ ID NO: 16927 - DNA, 25 bp, Homo sapien
gttttgaatcgcggcgcgtttcccg

SEQ ID NO: 16928 - DNA, 25 bp, Homo sapien
accctcttccacacatgtatgtgat

SEQ ID NO: 16929 - DNA, 25 bp, Homo sapien
aaaggatcttgttcccgatttgagc

SEQ ID NO: 16930 - DNA, 25 bp, Homo sapien
gttcccgatttgagcaacttctatg

SEQ ID NO: 16931 - DNA, 25 bp, Homo sapien
tttgagcaacttctatgcacagtac

SEQ ID NO: 16932 - DNA, 25 bp, Homo sapien
aggatgaatctcaggaaggcaagca

SEQ ID NO: 16933 - DNA, 25 bp, Homo sapien
gcagtccatagaagagcgtgagaaa

SEQ ID NO: 16934 - DNA, 25 bp, Homo sapien
aagagcgtgagaaactggacgggct

SEQ ID NO: 16935 - DNA, 25 bp, Homo sapien
ggaacggagacaaatatctggggcc

SEQ ID NO: 16936 - DNA, 25 bp, Homo sapien
atatctggggcctgcagttcttatg

SEQ ID NO: 16937 - DNA, 25 bp, Homo sapien
ctgcagttcttatgcaggcctatcg

SEQ ID NO: 16938 - DNA, 25 bp, Homo sapien
gatgacttcacagaggagcgcctgg

SEQ ID NO: 16939 - DNA, 25 bp, Homo sapien
gtgccgggaaagcccatgtgtgtgg

SEQ ID NO: 16940 - DNA, 25 bp, Homo sapien
gccgggaaagcccatgtgtgtggag

SEQ ID NO: 16941 - DNA, 25 bp, Homo sapien
cgtgcgcgacatgaggcagacggtg

SEQ ID NO: 16942 - DNA, 25 bp, Homo sapien
gcgacatgaggcagacggtggccgt

SEQ ID NO: 16943 - DNA, 25 bp, Homo sapien
tgaggcagacggtggccgtaggcgt

SEQ ID NO: 16944 - DNA, 25 bp, Homo sapien
cggtggccgtaggcgtcatcaagaa

SEQ ID NO: 16945 - DNA, 25 bp, Homo sapien
ggccgtaggcgtcatcaagaacgtg

SEQ ID NO: 16946 - DNA, 25 bp, Homo sapien
gtaggcgtcatcaagaacgtggaaa

SEQ ID NO: 16947 - DNA, 25 bp, Homo sapien
aacgtggaaaagaagagcggcggcg

SEQ ID NO: 16948 - DNA, 25 bp, Homo sapien
cgactggatgctcgccatcaaggtc

SEQ ID NO: 16949 - DNA, 25 bp, Homo sapien
ctggatgctcgccatcaaggtccag

SEQ ID NO: 16950 - DNA, 25 bp, Homo sapien
ggaagctgaaagtccccgaatgggt

SEQ ID NO: 16951 - DNA, 25 bp, Homo sapien
atgggtggataccgtcaagctggcc

SEQ ID NO: 16952 - DNA, 25 bp, Homo sapien
gagcttgctccctacgatgagaact

SEQ ID NO: 16953 - DNA, 25 bp, Homo sapien
tgagaactggttctacacgcgagct

SEQ ID NO: 16954 - DNA, 25 bp, Homo sapien
gggttggctccatgaccaagatcta

SEQ ID NO: 16955 - DNA, 25 bp, Homo sapien
ccgcacgatgcctggagttactgta

SEQ ID NO: 16956 - DNA, 25 bp, Homo sapien
tcagagaaacggcgtcatgcccagc

SEQ ID NO: 16957 - DNA, 25 bp, Homo sapien
agccgaggctccaagagtgtggccc

SEQ ID NO: 16958 - DNA, 25 bp, Homo sapien
aagatggcggccgcaaactgacacc

SEQ ID NO: 16959 - DNA, 25 bp, Homo sapien
agaatcgccggacaggtggcagctg

SEQ ID NO: 16960 - DNA, 25 bp, Homo sapien
gcaggagttcgtcagagctctggca

SEQ ID NO: 16961 - DNA, 25 bp, Homo sapien
aatttgttcaaattgaccactgtct

SEQ ID NO: 16962 - DNA, 25 bp, Homo sapien
ttgaccactgtctaaggagcctagt

SEQ ID NO: 16963 - DNA, 25 bp, Homo sapien
ggagcctagtaatcggcgtgcctta

SEQ ID NO: 16964 - DNA, 25 bp, Homo sapien
aatcggcgtgccttagtgtgtttat

SEQ ID NO: 16965 - DNA, 25 bp, Homo sapien
cgtgccttagtgtgtttatgtggta

SEQ ID NO: 16966 - DNA, 25 bp, Homo sapien
agggagaagtcttggagggttgctt

SEQ ID NO: 16967 - DNA, 25 bp, Homo sapien
gaagtcttggagggttgcttctgca

SEQ ID NO: 16968 - DNA, 25 bp, Homo sapien
gggagggaatttgaggggaggctga

SEQ ID NO: 16969 - DNA, 25 bp, Homo sapien
ggaatttgaggggaggctgaggtgc

SEQ ID NO: 16970 - DNA, 25 bp, Homo sapien
tgaggtgccgtcaggactttttttt

SEQ ID NO: 16971 - DNA, 25 bp, Homo sapien
tggccatcagaacttgtaatcaaga

SEQ ID NO: 16972 - DNA, 25 bp, Homo sapien
tatttttgccttacagtggatcatt

SEQ ID NO: 16973 - DNA, 25 bp, Homo sapien
ttgccttacagtggatcattctagt

SEQ ID NO: 16974 - DNA, 25 bp, Homo sapien
tacagtggatcattctagtaggaaa

SEQ ID NO: 16975 - DNA, 25 bp, Homo sapien
tttatcaaaatgtgtcatgccagta

SEQ ID NO: 16976 - DNA, 25 bp, Homo sapien
gtgtcatgccagtaagagatgttat

SEQ ID NO: 16977 - DNA, 25 bp, Homo sapien
tccccacccaaaaataagctaccat

SEQ ID NO: 16978 - DNA, 25 bp, Homo sapien
agcttataagtctcaaatttttgcc

SEQ ID NO: 16979 - DNA, 25 bp, Homo sapien
ttctgttcattgtgtatgcttcatc

SEQ ID NO: 16980 - DNA, 25 bp, Homo sapien
attgtgtatgcttcatcacctatat

SEQ ID NO: 16981 - DNA, 25 bp, Homo sapien
gtatgcttcatcacctatattaggc

SEQ ID NO: 16982 - DNA, 25 bp, Homo sapien
cacctatattaggcaaattccattt

SEQ ID NO: 16983 - DNA, 25 bp, Homo sapien
ccatgggcttcactgtataaatagg

SEQ ID NO: 16984 - DNA, 25 bp, Homo sapien
gaggatgagagcccagaggtaacag

SEQ ID NO: 16985 - DNA, 25 bp, Homo sapien
gcccagaggtaacagaacagcttca

SEQ ID NO: 16986 - DNA, 25 bp, Homo sapien
aacagaacagcttcaggttatcgaa

SEQ ID NO: 16987 - DNA, 25 bp, Homo sapien
gaacagcttcaggttatcgaaataa

SEQ ID NO: 16988 - DNA, 25 bp, Homo sapien
aggaaactcttatctcagtcatgca

SEQ ID NO: 16989 - DNA, 25 bp, Homo sapien
actcttatctcagtcatgcataaat

SEQ ID NO: 16990 - DNA, 25 bp, Homo sapien
atgcagtgatatggcagaagacacc

SEQ ID NO: 16991 - DNA, 25 bp, Homo sapien
caccagagcagatgcagagagccat

SEQ ID NO: 16992 - DNA, 25 bp, Homo sapien
gatgcagagagccattttgtgaatg

SEQ ID NO: 16993 - DNA, 25 bp, Homo sapien
ataacattaccttactgtggaggaa

SEQ ID NO: 16994 - DNA, 25 bp, Homo sapien
atatcatattttctatcatcatgtt

SEQ ID NO: 16995 - DNA, 25 bp, Homo sapien
tgtgcaaacctgtacttccatgatg

SEQ ID NO: 16996 - DNA, 25 bp, Homo sapien
gctgccaaggagaagtacttaccag

SEQ ID NO: 16997 - DNA, 25 bp, Homo sapien
gtacttaccaggactcttcaaaatg

SEQ ID NO: 16998 - DNA, 25 bp, Homo sapien
gaagaatctcctgcagaagtctgat

SEQ ID NO: 16999 - DNA, 25 bp, Homo sapien
atgttaattccctcttgcaagggag

SEQ ID NO: 17000 - DNA, 25 bp, Homo sapien
ggagacatatcctagatcactttgc

SEQ ID NO: 17001 - DNA, 25 bp, Homo sapien
atcctagatcactttgctttttctt

SEQ ID NO: 17002 - DNA, 25 bp, Homo sapien
aaggagctgatgttgcacctaaaca

SEQ ID NO: 17003 - DNA, 25 bp, Homo sapien
atatacaattgttccctaggcaacc

SEQ ID NO: 17004 - DNA, 25 bp, Homo sapien
tccctaggcaaccaacttttgctta

SEQ ID NO: 17005 - DNA, 25 bp, Homo sapien
catacccaagtccttcatgatcagc

SEQ ID NO: 17006 - DNA, 25 bp, Homo sapien
agcgcagacatggcccatgctgtgc

SEQ ID NO: 17007 - DNA, 25 bp, Homo sapien
aagcatgaggagaaccaccggcctt

SEQ ID NO: 17008 - DNA, 25 bp, Homo sapien
ttattccacaagggccccgtgatca

SEQ ID NO: 17009 - DNA, 25 bp, Homo sapien
gcttcaaacgcggtgtcagaggccc

SEQ ID NO: 17010 - DNA, 25 bp, Homo sapien
cagaggccctgatccgagaggtggc

SEQ ID NO: 17011 - DNA, 25 bp, Homo sapien
cctgcaggatctcatggtccggaat

SEQ ID NO: 17012 - DNA, 25 bp, Homo sapien
gaaccaccattggacctatcttggc

SEQ ID NO: 17013 - DNA, 25 bp, Homo sapien
cgggtgctggatttaggcagccccc

SEQ ID NO: 17014 - DNA, 25 bp, Homo sapien
gcactctatccgggagatggcctgc

SEQ ID NO: 17015 - DNA, 25 bp, Homo sapien
tcaccctcttcaagggcttctttga

SEQ ID NO: 17016 - DNA, 25 bp, Homo sapien
ggggtcctcaagattcgagatggca

SEQ ID NO: 17017 - DNA, 25 bp, Homo sapien
gatggcagcaaggaacccaggtcga

SEQ ID NO: 17018 - DNA, 25 bp, Homo sapien
gatgggacattgtgcggctcatccc

SEQ ID NO: 17019 - DNA, 25 bp, Homo sapien
cacctcagacgtacctgcaagctga

SEQ ID NO: 17020 - DNA, 25 bp, Homo sapien
gagggtgaagacggccagaacttgg

SEQ ID NO: 17021 - DNA, 25 bp, Homo sapien
gcacattgaccagcttgtctgtctg

SEQ ID NO: 17022 - DNA, 25 bp, Homo sapien
gtcagcagccttggtaaggggtctg

SEQ ID NO: 17023 - DNA, 25 bp, Homo sapien
gggtctgcatgcagcagcactgacg

SEQ ID NO: 17024 - DNA, 25 bp, Homo sapien
caagggcacgctgagacgccatgac

SEQ ID NO: 17025 - DNA, 25 bp, Homo sapien
gcagtccctgtgactgtcatggagc

SEQ ID NO: 17026 - DNA, 25 bp, Homo sapien
tccggtagccctagacttggggtca

SEQ ID NO: 17027 - DNA, 25 bp, Homo sapien
caccatcccagcaagtcaggatatc

SEQ ID NO: 17028 - DNA, 25 bp, Homo sapien
cctcccccttgtagatatcaattcc

SEQ ID NO: 17029 - DNA, 25 bp, Homo sapien
agatatcaattcccaaacagagcca

SEQ ID NO: 17030 - DNA, 25 bp, Homo sapien
gagccaaatactctatatctatagt

SEQ ID NO: 17031 - DNA, 25 bp, Homo sapien
atatctatagtcacagccctgtaca

SEQ ID NO: 17032 - DNA, 25 bp, Homo sapien
tggtctgcatgatttgtgcttctag

SEQ ID NO: 17033 - DNA, 25 bp, Homo sapien
tgcttctagtgctctcatttggaaa

SEQ ID NO: 17034 - DNA, 25 bp, Homo sapien
caggcttcttctatgaaatgtaaag

SEQ ID NO: 17035 - DNA, 25 bp, Homo sapien
ccgtctttgtactctggtgattttt

SEQ ID NO: 17036 - DNA, 25 bp, Homo sapien
ctttgtacttgcattgattgtataa

SEQ ID NO: 17037 - DNA, 25 bp, Homo sapien
gagaaataaaatcatcaaaccccaa

SEQ ID NO: 17038 - DNA, 25 bp, Homo sapien
cgctacgccctacagatggagcagc

SEQ ID NO: 17039 - DNA, 25 bp, Homo sapien
agcagctcaacgggatcctgctgca

SEQ ID NO: 17040 - DNA, 25 bp, Homo sapien
tcctgctgcaccttgagtcagagct

SEQ ID NO: 17041 - DNA, 25 bp, Homo sapien
gaggccctgctgaacatcaaggtca

SEQ ID NO: 17042 - DNA, 25 bp, Homo sapien
aagctggaggctgagatcgccacct

SEQ ID NO: 17043 - DNA, 25 bp, Homo sapien
tgatgccttggacagcagcaactcc

SEQ ID NO: 17044 - DNA, 25 bp, Homo sapien
ccaccacccgccggatagtggatgg

SEQ ID NO: 17045 - DNA, 25 bp, Homo sapien
gagagcaccacagtggtcaccacac

SEQ ID NO: 17046 - DNA, 25 bp, Homo sapien
gtcaccacacagtctgctgaggttg

SEQ ID NO: 17047 - DNA, 25 bp, Homo sapien
gagctgctgagacgacgctcacaga

SEQ ID NO: 17048 - DNA, 25 bp, Homo sapien
tgagacgtacagtccagtccttgga

SEQ ID NO: 17049 - DNA, 25 bp, Homo sapien
gagggacgccaataggcatgccgcc

SEQ ID NO: 17050 - DNA, 25 bp, Homo sapien
ccaccaggcattagaggtccacctc

SEQ ID NO: 17051 - DNA, 25 bp, Homo sapien
gaccttagcatactgttgatccatc

SEQ ID NO: 17052 - DNA, 25 bp, Homo sapien
tttcccctgcaatgcgtcttgtgaa

SEQ ID NO: 17053 - DNA, 25 bp, Homo sapien
agtgtttgtgagctttttgttccct

SEQ ID NO: 17054 - DNA, 25 bp, Homo sapien
ttgttccctcattctgcattaataa

SEQ ID NO: 17055 - DNA, 25 bp, Homo sapien
agatactggcattgctcgggtacca

SEQ ID NO: 17056 - DNA, 25 bp, Homo sapien
taccacttgctggagctgctggagg

SEQ ID NO: 17057 - DNA, 25 bp, Homo sapien
ggaccatcccagcaggtaatgactc

SEQ ID NO: 17058 - DNA, 25 bp, Homo sapien
aagaggcactgtagcagctgctgct

SEQ ID NO: 17059 - DNA, 25 bp, Homo sapien
tattgctggagccccaacacagtac

SEQ ID NO: 17060 - DNA, 25 bp, Homo sapien
ggtaagtttcagtggagctcagagg

SEQ ID NO: 17061 - DNA, 25 bp, Homo sapien
ggacggggagatagaactgtggcac

SEQ ID NO: 17062 - DNA, 25 bp, Homo sapien
gaactgtggcacttaggggagatga

SEQ ID NO: 17063 - DNA, 25 bp, Homo sapien
agatgacatttgctttgggcagagg

SEQ ID NO: 17064 - DNA, 25 bp, Homo sapien
ctagccaggacacatttccactata

SEQ ID NO: 17065 - DNA, 25 bp, Homo sapien
aagtccagctcccttgctaaaaata

SEQ ID NO: 17066 - DNA, 25 bp, Homo sapien
aattggtattcaggtaactcattta

SEQ ID NO: 17067 - DNA, 25 bp, Homo sapien
tatgtgggtctgtgaatttctttaa

SEQ ID NO: 17068 - DNA, 25 bp, Homo sapien
aatccagcttcataatttccatgat

SEQ ID NO: 17069 - DNA, 25 bp, Homo sapien
ctttgttccttttgctctgatagac

SEQ ID NO: 17070 - DNA, 25 bp, Homo sapien
tgtatttcaaaatcacccaaaactt

SEQ ID NO: 17071 - DNA, 25 bp, Homo sapien
aagctgaagtcagccatcctttctg

SEQ ID NO: 17072 - DNA, 25 bp, Homo sapien
ccagtctgctgccaacgtgaggaag

SEQ ID NO: 17073 - DNA, 25 bp, Homo sapien
ccagccctggaggtcctggagacat

SEQ ID NO: 17074 - DNA, 25 bp, Homo sapien
aggacgacgactacatggacatttg

SEQ ID NO: 17075 - DNA, 25 bp, Homo sapien
ggacatttgaggggccactgcagcc

SEQ ID NO: 17076 - DNA, 25 bp, Homo sapien
accagaggcccacatggatgccact

SEQ ID NO: 17077 - DNA, 25 bp, Homo sapien
tccacaccacatgggagcccagagg

SEQ ID NO: 17078 - DNA, 25 bp, Homo sapien
gcccgccttagccatgtgaaggtgg

SEQ ID NO: 17079 - DNA, 25 bp, Homo sapien
tgaaggtggattggtcgccatctgc

SEQ ID NO: 17080 - DNA, 25 bp, Homo sapien
ctcgacgccgggatgagccggctct

SEQ ID NO: 17081 - DNA, 25 bp, Homo sapien
cagtggaggggtcctttagggccag

SEQ ID NO: 17082 - DNA, 25 bp, Homo sapien
aaatgttttgctcaatagattgctc

SEQ ID NO: 17083 - DNA, 25 bp, Homo sapien
tagattgctcaaatcaggttttctt

SEQ ID NO: 17084 - DNA, 25 bp, Homo sapien
gaatcaatcatgtcagtctgcttag

SEQ ID NO: 17085 - DNA, 25 bp, Homo sapien
attattctataatttccatttactt

SEQ ID NO: 17086 - DNA, 25 bp, Homo sapien
gcattttttaacctcctaagtatca

SEQ ID NO: 17087 - DNA, 25 bp, Homo sapien
tttaacctcctaagtatcaagtata

SEQ ID NO: 17088 - DNA, 25 bp, Homo sapien
gaaaatcttcatggaattcacaaag

SEQ ID NO: 17089 - DNA, 25 bp, Homo sapien
ggttgaaacatatctcttatcttac

SEQ ID NO: 17090 - DNA, 25 bp, Homo sapien
acatatctcttatcttacgaaaaaa

SEQ ID NO: 17091 - DNA, 25 bp, Homo sapien
taaaagagcaggccaggcgcggtgg

SEQ ID NO: 17092 - DNA, 25 bp, Homo sapien
ggaggcggaccttgtagtgagccga

SEQ ID NO: 17093 - DNA, 25 bp, Homo sapien
aaactctaccattcattatgtggta

SEQ ID NO: 17094 - DNA, 25 bp, Homo sapien
gtggtaactgtattgaacttacttt

SEQ ID NO: 17095 - DNA, 25 bp, Homo sapien
tgactagatgtcaccacttcaaaaa

SEQ ID NO: 17096 - DNA, 25 bp, Homo sapien
tgagacggagtcttgctctgttgcc

SEQ ID NO: 17097 - DNA, 25 bp, Homo sapien
cctcagcttcccaagcagctgggac

SEQ ID NO: 17098 - DNA, 25 bp, Homo sapien
gtttcaccgtgttagccaggaaggt

SEQ ID NO: 17099 - DNA, 25 bp, Homo sapien
aggaaggtctcaatctcctgacctc

SEQ ID NO: 17100 - DNA, 25 bp, Homo sapien
caccatgcccggcccaaatattttt

SEQ ID NO: 17101 - DNA, 25 bp, Homo sapien
ggatggtataacctaactgataata

SEQ ID NO: 17102 - DNA, 25 bp, Homo sapien
tttacaaatatcatacactgctggt

SEQ ID NO: 17103 - DNA, 25 bp, Homo sapien
tacactgctggtgttaccatatgaa

SEQ ID NO: 17104 - DNA, 25 bp, Homo sapien
taatacttcctacatgtcctgactt

SEQ ID NO: 17105 - DNA, 25 bp, Homo sapien
gagagtaggtaacaggcatcccgag

SEQ ID NO: 17106 - DNA, 25 bp, Homo sapien
aacaggcatcccgagttcaggaact

SEQ ID NO: 17107 - DNA, 25 bp, Homo sapien
ttcaggaactacctcagaacacccc

SEQ ID NO: 17108 - DNA, 25 bp, Homo sapien
ttagcccccggcaagtgtgagtgaa

SEQ ID NO: 17109 - DNA, 25 bp, Homo sapien
gagcgcctgcgcagggtaaggtgcc

SEQ ID NO: 17110 - DNA, 25 bp, Homo sapien
aaggtgccacctggcagtggggcac

SEQ ID NO: 17111 - DNA, 25 bp, Homo sapien
gtctgacaggaaatgcttgtggtcg

SEQ ID NO: 17112 - DNA, 25 bp, Homo sapien
atttggtttgagagcccttgttcct

SEQ ID NO: 17113 - DNA, 25 bp, Homo sapien
tgttcctccatctagtggagtcctt

SEQ ID NO: 17114 - DNA, 25 bp, Homo sapien
gcaattgagtgccagtagcttaatt

SEQ ID NO: 17115 - DNA, 25 bp, Homo sapien
cagagcccgagaggaagtttggcgt

SEQ ID NO: 17116 - DNA, 25 bp, Homo sapien
agaggaagtttggcgtggtggtggt

SEQ ID NO: 17117 - DNA, 25 bp, Homo sapien
ccggctccgtgcggatgagggactt

SEQ ID NO: 17118 - DNA, 25 bp, Homo sapien
ggatgagggacttgcggaatccaca

SEQ ID NO: 17119 - DNA, 25 bp, Homo sapien
ctgaacctgattggcttcgtgtcga

SEQ ID NO: 17120 - DNA, 25 bp, Homo sapien
ggcttcgtgtcgagaagggagctcg

SEQ ID NO: 17121 - DNA, 25 bp, Homo sapien
ggagctcgggagcattgatggagtc

SEQ ID NO: 17122 - DNA, 25 bp, Homo sapien
gcattgatggagtccagcagatttc

SEQ ID NO: 17123 - DNA, 25 bp, Homo sapien
gatttctttggaggatgctctttcc

SEQ ID NO: 17124 - DNA, 25 bp, Homo sapien
gatgctctttccagccaagaggtgg

SEQ ID NO: 17125 - DNA, 25 bp, Homo sapien
atatctgcagtgagagctccagcca

SEQ ID NO: 17126 - DNA, 25 bp, Homo sapien
ttttaatagtaccagccatcgctca

SEQ ID NO: 17127 - DNA, 25 bp, Homo sapien
gtaccagccatcgctcagagaaaag

SEQ ID NO: 17128 - DNA, 25 bp, Homo sapien
taccagtgataagcttgatgacctc

SEQ ID NO: 17129 - DNA, 25 bp, Homo sapien
gatgacctcacacaagatctgactg

SEQ ID NO: 17130 - DNA, 25 bp, Homo sapien
caagatctgactgtatcccagctca

SEQ ID NO: 17131 - DNA, 25 bp, Homo sapien
tcccagctcagtgatgttgcggatt

SEQ ID NO: 17132 - DNA, 25 bp, Homo sapien
gacagaggactgaccggttccattt

SEQ ID NO: 17133 - DNA, 25 bp, Homo sapien
ttttttccagacaatcactcagctg

SEQ ID NO: 17134 - DNA, 25 bp, Homo sapien
actcagctggaatgtctgctctcta

SEQ ID NO: 17135 - DNA, 25 bp, Homo sapien
tacttcctatttgagcccatgtgtg

SEQ ID NO: 17136 - DNA, 25 bp, Homo sapien
tctacactcagtttcattacaggga

SEQ ID NO: 17137 - DNA, 25 bp, Homo sapien
agagtggaacatgccttttccgcac

SEQ ID NO: 17138 - DNA, 25 bp, Homo sapien
gaacatgccttttccgcacaatatt

SEQ ID NO: 17139 - DNA, 25 bp, Homo sapien
gccttttccgcacaatattaattcc

SEQ ID NO: 17140 - DNA, 25 bp, Homo sapien
atattaattcctttttgtatcagaa

SEQ ID NO: 17141 - DNA, 25 bp, Homo sapien
ggagttatgctaccatacttacttc

SEQ ID NO: 17142 - DNA, 25 bp, Homo sapien
atgctaccatacttacttcaaaccc

SEQ ID NO: 17143 - DNA, 25 bp, Homo sapien
ctaccatacttacttcaaacccaat

SEQ ID NO: 17144 - DNA, 25 bp, Homo sapien
cttcaaacccaatgactactgtcaa

SEQ ID NO: 17145 - DNA, 25 bp, Homo sapien
gtcaaggtcatattttcagtacata

SEQ ID NO: 17146 - DNA, 25 bp, Homo sapien
tttcttaaagtcttatgtttcactc

SEQ ID NO: 17147 - DNA, 25 bp, Homo sapien
tcactctttaactcaaatgtattct

SEQ ID NO: 17148 - DNA, 25 bp, Homo sapien
gctcagcctgtagaacttttaaccc

SEQ ID NO: 17149 - DNA, 25 bp, Homo sapien
taacccaagtctcatttcttttttg

SEQ ID NO: 17150 - DNA, 25 bp, Homo sapien
agcccttctccaaccataagattat

SEQ ID NO: 17151 - DNA, 25 bp, Homo sapien
cctgctacttcttgtatttgtctac

SEQ ID NO: 17152 - DNA, 25 bp, Homo sapien
tgtatttgtctactgacagcccctt

SEQ ID NO: 17153 - DNA, 25 bp, Homo sapien
tagactttaacatttcccttgggtg

SEQ ID NO: 17154 - DNA, 25 bp, Homo sapien
gtaaggtcaccccaatcggtagatt

SEQ ID NO: 17155 - DNA, 25 bp, Homo sapien
ggggatggttaaggtgaatgccgaa

SEQ ID NO: 17156 - DNA, 25 bp, Homo sapien
gccgaaattcattaagtccttaggg

SEQ ID NO: 17157 - DNA, 25 bp, Homo sapien
aaggatgtagcttcttttatctaag

SEQ ID NO: 17158 - DNA, 25 bp, Homo sapien
ggccaaaaggcagatttactggtta

SEQ ID NO: 17159 - DNA, 25 bp, Homo sapien
ccgcggtaatgctggtggtctgcat

SEQ ID NO: 17160 - DNA, 25 bp, Homo sapien
gcggtaatgctggtggtctgcatca

SEQ ID NO: 17161 - DNA, 25 bp, Homo sapien
caccaccggatcaacttcgacaaat

SEQ ID NO: 17162 - DNA, 25 bp, Homo sapien
caccggatcaacttcgacaaatacc

SEQ ID NO: 17163 - DNA, 25 bp, Homo sapien
ccggatcaacttcgacaaataccac

SEQ ID NO: 17164 - DNA, 25 bp, Homo sapien
taccacttaaagaggaaccagagct

SEQ ID NO: 17165 - DNA, 25 bp, Homo sapien
tctgcccaactgtcaaccttgacaa

SEQ ID NO: 17166 - DNA, 25 bp, Homo sapien
gcccaactgtcaaccttgacaaatt

SEQ ID NO: 17167 - DNA, 25 bp, Homo sapien
gtgaacagacacgggtgaatgctgc

SEQ ID NO: 17168 - DNA, 25 bp, Homo sapien
aacagacacgggtgaatgctgctaa

SEQ ID NO: 17169 - DNA, 25 bp, Homo sapien
gactgaggaagacccggaaacttag

SEQ ID NO: 17170 - DNA, 25 bp, Homo sapien
gacggtcaagaccaaggatggcgtg

SEQ ID NO: 17171 - DNA, 25 bp, Homo sapien
ggatggcgtggtggagatcaccggc

SEQ ID NO: 17172 - DNA, 25 bp, Homo sapien
ggcgtggtggagatcaccggcaagc

SEQ ID NO: 17173 - DNA, 25 bp, Homo sapien
agatcaccggcaagcacgaggagcg

SEQ ID NO: 17174 - DNA, 25 bp, Homo sapien
caccggcaagcacgaggagcggcag

SEQ ID NO: 17175 - DNA, 25 bp, Homo sapien
acgaggagcggcaggacgagcatgg

SEQ ID NO: 17176 - DNA, 25 bp, Homo sapien
ggagcggcaggacgagcatggctac

SEQ ID NO: 17177 - DNA, 25 bp, Homo sapien
gcaggacgagcatggctacatctcc

SEQ ID NO: 17178 - DNA, 25 bp, Homo sapien
tcccggtgcttcacgcggaaataca

SEQ ID NO: 17179 - DNA, 25 bp, Homo sapien
ggtgcttcacgcggaaatacacgct

SEQ ID NO: 17180 - DNA, 25 bp, Homo sapien
ttcacgcggaaatacacgctgcccc

SEQ ID NO: 17181 - DNA, 25 bp, Homo sapien
ccccgtctctataatgcagctgtgc

SEQ ID NO: 17182 - DNA, 25 bp, Homo sapien
cgtctctataatgcagctgtgctct

SEQ ID NO: 17183 - DNA, 25 bp, Homo sapien
ggggctcatttcaaacttattttct

SEQ ID NO: 17184 - DNA, 25 bp, Homo sapien
tgtgctgtccacttgggaagctaag

SEQ ID NO: 17185 - DNA, 25 bp, Homo sapien
gaagctaaggctctcaaaacgggca

SEQ ID NO: 17186 - DNA, 25 bp, Homo sapien
taaggctctcaaaacgggcatcacc

SEQ ID NO: 17187 - DNA, 25 bp, Homo sapien
caaaacgggcatcacccagttgacc

SEQ ID NO: 17188 - DNA, 25 bp, Homo sapien
gcttggaagaagcctgttctgagcc

SEQ ID NO: 17189 - DNA, 25 bp, Homo sapien
atggtagcaggtgtctgttatccca

SEQ ID NO: 17190 - DNA, 25 bp, Homo sapien
gcaggtgtctgttatcccagttagg

SEQ ID NO: 17191 - DNA, 25 bp, Homo sapien
gtgtctgttatcccagttaggaggc

SEQ ID NO: 17192 - DNA, 25 bp, Homo sapien
ggaatctatccattgaactaaaata

SEQ ID NO: 17193 - DNA, 25 bp, Homo sapien
attatgcaaccagtttatccaccaa

SEQ ID NO: 17194 - DNA, 25 bp, Homo sapien
gcaaccagtttatccaccaagaaca

SEQ ID NO: 17195 - DNA, 25 bp, Homo sapien
gtagaaagaattggccaggcatggt

SEQ ID NO: 17196 - DNA, 25 bp, Homo sapien
aacatggcaaaaccccatctttact

SEQ ID NO: 17197 - DNA, 25 bp, Homo sapien
gcaatgagccgagatcacgtcactg

SEQ ID NO: 17198 - DNA, 25 bp, Homo sapien
ctccagcttgggcaacagagcaaga

SEQ ID NO: 17199 - DNA, 25 bp, Homo sapien
tattgtcataggattaagcagttta

SEQ ID NO: 17200 - DNA, 25 bp, Homo sapien
agcagtttaaagattgttggatgaa

SEQ ID NO: 17201 - DNA, 25 bp, Homo sapien
gttggatgaaattatttgtcattca

SEQ ID NO: 17202 - DNA, 25 bp, Homo sapien
tttgtcattcattcaagtaataaat

SEQ ID NO: 17203 - DNA, 25 bp, Homo sapien
tggacttcagttctgctagcatgta

SEQ ID NO: 17204 - DNA, 25 bp, Homo sapien
gctagcatgtaaagagtggtggact

SEQ ID NO: 17205 - DNA, 25 bp, Homo sapien
gtatcattacaagtcacctggaaca

SEQ ID NO: 17206 - DNA, 25 bp, Homo sapien
gaacaggttctttgggcaacagaca

SEQ ID NO: 17207 - DNA, 25 bp, Homo sapien
ctgtcccgtgagtgtgtctgagtac

SEQ ID NO: 17208 - DNA, 25 bp, Homo sapien
gtgtgtctgagtaccattcactgga

SEQ ID NO: 17209 - DNA, 25 bp, Homo sapien
ttcactggagttgctgcttaggtct

SEQ ID NO: 17210 - DNA, 25 bp, Homo sapien
tgtgactcttaacaattgctgtctg

SEQ ID NO: 17211 - DNA, 25 bp, Homo sapien
gcacattgtgttcataatgtactcc

SEQ ID NO: 17212 - DNA, 25 bp, Homo sapien
taatgtactccacaatggccagtcc

SEQ ID NO: 17213 - DNA, 25 bp, Homo sapien
gccagtccaattgctatctattttt

SEQ ID NO: 17214 - DNA, 25 bp, Homo sapien
agctgtgagccttggctgttggcag

SEQ ID NO: 17215 - DNA, 25 bp, Homo sapien
gtgagccttggctgttggcagtgag

SEQ ID NO: 17216 - DNA, 25 bp, Homo sapien
gagccttggctgttggcagtgagtg

SEQ ID NO: 17217 - DNA, 25 bp, Homo sapien
ccttggctgttggcagtgagtgagc

SEQ ID NO: 17218 - DNA, 25 bp, Homo sapien
gcctggctcttgtgctggatggagc

SEQ ID NO: 17219 - DNA, 25 bp, Homo sapien
agccccagagcagggtgttgggata

SEQ ID NO: 17220 - DNA, 25 bp, Homo sapien
agggtgttgggatactgcagggcca

SEQ ID NO: 17221 - DNA, 25 bp, Homo sapien
gtgttgggatactgcagggccagga

SEQ ID NO: 17222 - DNA, 25 bp, Homo sapien
gttgggatactgcagggccaggact

SEQ ID NO: 17223 - DNA, 25 bp, Homo sapien
ggatactgcagggccaggactgagc

SEQ ID NO: 17224 - DNA, 25 bp, Homo sapien
tactgcagggccaggactgagcccc

SEQ ID NO: 17225 - DNA, 25 bp, Homo sapien
tggatccagcacttatcagaccagg

SEQ ID NO: 17226 - DNA, 25 bp, Homo sapien
agaccaggccgcattgacaggaaga

SEQ ID NO: 17227 - DNA, 25 bp, Homo sapien
acaggaagattgagttccccctgcc

SEQ ID NO: 17228 - DNA, 25 bp, Homo sapien
tccccctgcctgatgaaaagacgaa

SEQ ID NO: 17229 - DNA, 25 bp, Homo sapien
gaagcgcatctttcagattcacaca

SEQ ID NO: 17230 - DNA, 25 bp, Homo sapien
atgatgtaaccctggacgacctgat

SEQ ID NO: 17231 - DNA, 25 bp, Homo sapien
aaagatgacctctctggtgctgaca

SEQ ID NO: 17232 - DNA, 25 bp, Homo sapien
ggggctgtatctctaatgaaccatg

SEQ ID NO: 17233 - DNA, 25 bp, Homo sapien
gggagttgcccagaggaatccctgt

SEQ ID NO: 17234 - DNA, 25 bp, Homo sapien
tccctgttcccactgatttttatta

SEQ ID NO: 17235 - DNA, 25 bp, Homo sapien
gtaagtgcccattgggtggcctgtt

SEQ ID NO: 17236 - DNA, 25 bp, Homo sapien
cagagacatcagcccttgggggtcc

SEQ ID NO: 17237 - DNA, 25 bp, Homo sapien
cctccagggacagcaactatcagac

SEQ ID NO: 17238 - DNA, 25 bp, Homo sapien
gggacagcaactatcagactaagcc

SEQ ID NO: 17239 - DNA, 25 bp, Homo sapien
cagcaactatcagactaagccagca

SEQ ID NO: 17240 - DNA, 25 bp, Homo sapien
cacttgcggttccggcatggacaat

SEQ ID NO: 17241 - DNA, 25 bp, Homo sapien
gcggttccggcatggacaatggacc

SEQ ID NO: 17242 - DNA, 25 bp, Homo sapien
ggcatggacaatggaccggagagtg

SEQ ID NO: 17243 - DNA, 25 bp, Homo sapien
gacaatggaccggagagtgggggtg

SEQ ID NO: 17244 - DNA, 25 bp, Homo sapien
gtggggggtcccaaagagtttgatg

SEQ ID NO: 17245 - DNA, 25 bp, Homo sapien
ggtcccaaagagtttgatgaggccc

SEQ ID NO: 17246 - DNA, 25 bp, Homo sapien
ctgcggcccaatccaaggtggggtg

SEQ ID NO: 17247 - DNA, 25 bp, Homo sapien
ctgagctccagggccagaatgcctg

SEQ ID NO: 17248 - DNA, 25 bp, Homo sapien
gatgcctgggtagccagtttgggga

SEQ ID NO: 17249 - DNA, 25 bp, Homo sapien
gtttggggagtgggctgcaaggggc

SEQ ID NO: 17250 - DNA, 25 bp, Homo sapien
acctcctgttcgtgacctgacaggg

SEQ ID NO: 17251 - DNA, 25 bp, Homo sapien
gtgacctgacagggtgacacagccc

SEQ ID NO: 17252 - DNA, 25 bp, Homo sapien
cctcctatcttcctgggtagatgcc

SEQ ID NO: 17253 - DNA, 25 bp, Homo sapien
cctgggtagatgccctggtgtaggg

SEQ ID NO: 17254 - DNA, 25 bp, Homo sapien
gtgtagggctgagtactgaatggtc

SEQ ID NO: 17255 - DNA, 25 bp, Homo sapien
ttttcagagcacttcatccacttgc

SEQ ID NO: 17256 - DNA, 25 bp, Homo sapien
cattttcttacctcacccaagaaag

SEQ ID NO: 17257 - DNA, 25 bp, Homo sapien
aagaggtcgtcacttttgctgtggc

SEQ ID NO: 17258 - DNA, 25 bp, Homo sapien
gagctggtcagctgatcacagagtt

SEQ ID NO: 17259 - DNA, 25 bp, Homo sapien
gatggtgctacaatgtcacgcttct

SEQ ID NO: 17260 - DNA, 25 bp, Homo sapien
atgtcacgcttctccaatttgtgga

SEQ ID NO: 17261 - DNA, 25 bp, Homo sapien
gaaaacccagcttttatgctactag

SEQ ID NO: 17262 - DNA, 25 bp, Homo sapien
attcttgaactttttgagcttccaa

SEQ ID NO: 17263 - DNA, 25 bp, Homo sapien
gagtatgtaaaccctagctgtgcca

SEQ ID NO: 17264 - DNA, 25 bp, Homo sapien
gtgccagcacatgttcatctttaca

SEQ ID NO: 17265 - DNA, 25 bp, Homo sapien
atggtgtaatggttctcctggggct

SEQ ID NO: 17266 - DNA, 25 bp, Homo sapien
tctcctggggctgtcacattttata

SEQ ID NO: 17267 - DNA, 25 bp, Homo sapien
gtgtgacttcttaatatggtgctga

SEQ ID NO: 17268 - DNA, 25 bp, Homo sapien
tgggaggcccaggtggggcgatcac

SEQ ID NO: 17269 - DNA, 25 bp, Homo sapien
accgacgctcggtgcgtaggtgtgg

SEQ ID NO: 17270 - DNA, 25 bp, Homo sapien
ggtgcgtaggtgtggaactagcgag

SEQ ID NO: 17271 - DNA, 25 bp, Homo sapien
gaactagcgagggatttcttgctgg

SEQ ID NO: 17272 - DNA, 25 bp, Homo sapien
gagggatttcttgctggattgtcac

SEQ ID NO: 17273 - DNA, 25 bp, Homo sapien
tcactccctgatgttttccatgtgg

SEQ ID NO: 17274 - DNA, 25 bp, Homo sapien
ttccatgtggactgggagtcatccc

SEQ ID NO: 17275 - DNA, 25 bp, Homo sapien
ggagtcatcccaagctactgtgaca

SEQ ID NO: 17276 - DNA, 25 bp, Homo sapien
cccaagctactgtgacaaggacgaa

SEQ ID NO: 17277 - DNA, 25 bp, Homo sapien
aaggacgaagacttcatgccatgca

SEQ ID NO: 17278 - DNA, 25 bp, Homo sapien
tcatgccatgcaaacacggggaaaa

SEQ ID NO: 17279 - DNA, 25 bp, Homo sapien
tactcttgacaaatgattacctttt

SEQ ID NO: 17280 - DNA, 25 bp, Homo sapien
cccagcatgggaacagtgatctgcc

SEQ ID NO: 17281 - DNA, 25 bp, Homo sapien
agtgatctgcccacatgacagggtg

SEQ ID NO: 17282 - DNA, 25 bp, Homo sapien
tgacagggtggtatgccaggcatag

SEQ ID NO: 17283 - DNA, 25 bp, Homo sapien
tatgccaggcatagttaactgcttt

SEQ ID NO: 17284 - DNA, 25 bp, Homo sapien
ggttgtgaggtactcatcttccttt

SEQ ID NO: 17285 - DNA, 25 bp, Homo sapien
tgaggtactcatcttcctttagtta

SEQ ID NO: 17286 - DNA, 25 bp, Homo sapien
tcctttagttacccttagttatgtg

SEQ ID NO: 17287 - DNA, 25 bp, Homo sapien
gttacccttagttatgtggcacaca

SEQ ID NO: 17288 - DNA, 25 bp, Homo sapien
gtggcacacatgtccttattgccta

SEQ ID NO: 17289 - DNA, 25 bp, Homo sapien
atgtccttattgcctagttcgtcat

SEQ ID NO: 17290 - DNA, 25 bp, Homo sapien
aaatgctgttagtatccaaccttaa

SEQ ID NO: 17291 - DNA, 25 bp, Homo sapien
gggaagagcttcagatggtcctcat

SEQ ID NO: 17292 - DNA, 25 bp, Homo sapien
tggtcctcatatcttttgatccatc

SEQ ID NO: 17293 - DNA, 25 bp, Homo sapien
ttgatccatcagcgaatccacagtg

SEQ ID NO: 17294 - DNA, 25 bp, Homo sapien
gtcttaacttgcacccagagggtca

SEQ ID NO: 17295 - DNA, 25 bp, Homo sapien
tgcacccagagggtcatactggaga

SEQ ID NO: 17296 - DNA, 25 bp, Homo sapien
tgggaagagctttagccgggcttca

SEQ ID NO: 17297 - DNA, 25 bp, Homo sapien
gaatcataagaaactccactgccgg

SEQ ID NO: 17298 - DNA, 25 bp, Homo sapien
gcttgtacaccggtctttctgtaaa

SEQ ID NO: 17299 - DNA, 25 bp, Homo sapien
atgtgaggactgtgggaagcgctac

SEQ ID NO: 17300 - DNA, 25 bp, Homo sapien
caagaggcgcttgaatctggatata

SEQ ID NO: 17301 - DNA, 25 bp, Homo sapien
attcaaatccattgttctagcgatt

SEQ ID NO: 17302 - DNA, 25 bp, Homo sapien
aagcctatcaaacatgggagccctg

SEQ ID NO: 17303 - DNA, 25 bp, Homo sapien
gtatcacggagccatcagcagagga

SEQ ID NO: 17304 - DNA, 25 bp, Homo sapien
cagaggagacgccgagaacctgctg

SEQ ID NO: 17305 - DNA, 25 bp, Homo sapien
aacctgctgcgactctgcaaggagt

SEQ ID NO: 17306 - DNA, 25 bp, Homo sapien
aaggagtgtagctaccttgtccgga

SEQ ID NO: 17307 - DNA, 25 bp, Homo sapien
ggaacagccagaccagcaagcatga

SEQ ID NO: 17308 - DNA, 25 bp, Homo sapien
tcgacagtgtcccggaagtcatcca

SEQ ID NO: 17309 - DNA, 25 bp, Homo sapien
caaaggggctgagcacttgtccctc

SEQ ID NO: 17310 - DNA, 25 bp, Homo sapien
ctcctctatcccgtggctgtgagga

SEQ ID NO: 17311 - DNA, 25 bp, Homo sapien
cacaccactgcatgtctctagaatg

SEQ ID NO: 17312 - DNA, 25 bp, Homo sapien
tagaatgctgttgccacttacgggg

SEQ ID NO: 17313 - DNA, 25 bp, Homo sapien
ataacacttcaccttctgtaatact

SEQ ID NO: 17314 - DNA, 25 bp, Homo sapien
gtaatactaagtcctcagagctcca

SEQ ID NO: 17315 - DNA, 25 bp, Homo sapien
ctgaaagggatggccacaagttctt

SEQ ID NO: 17316 - DNA, 25 bp, Homo sapien
ccatcccgatgaacctgcatcattc

SEQ ID NO: 17317 - DNA, 25 bp, Homo sapien
ctgccaagccaaccctggaaaagga

SEQ ID NO: 17318 - DNA, 25 bp, Homo sapien
aaaaggagttcgctggccattggct

SEQ ID NO: 17319 - DNA, 25 bp, Homo sapien
ggccattggctagaatcagggtgga

SEQ ID NO: 17320 - DNA, 25 bp, Homo sapien
ttcctgtctcccagggacatgtatg

SEQ ID NO: 17321 - DNA, 25 bp, Homo sapien
ggacatgtatgcttccagggacaag

SEQ ID NO: 17322 - DNA, 25 bp, Homo sapien
gggacaagcttaggtcatgaacatg

SEQ ID NO: 17323 - DNA, 25 bp, Homo sapien
gaacatggtcagaacctttggacaa

SEQ ID NO: 17324 - DNA, 25 bp, Homo sapien
cagactatcaggcccatttgtctcc

SEQ ID NO: 17325 - DNA, 25 bp, Homo sapien
tcccctgcaccgagggaacaactcg

SEQ ID NO: 17326 - DNA, 25 bp, Homo sapien
gaacaactcgagctttgaggcttcc

SEQ ID NO: 17327 - DNA, 25 bp, Homo sapien
caactaccacttgccagcaacaaaa

SEQ ID NO: 17328 - DNA, 25 bp, Homo sapien
ccctgcacaggatatcaaagctctg

SEQ ID NO: 17329 - DNA, 25 bp, Homo sapien
gctctgtttgtgtctgaggaggaga

SEQ ID NO: 17330 - DNA, 25 bp, Homo sapien
actcggaaggaggtctacatcaaga

SEQ ID NO: 17331 - DNA, 25 bp, Homo sapien
gaagtcgtttcattcaagttggtgt

SEQ ID NO: 17332 - DNA, 25 bp, Homo sapien
aagttggtgtaatcagctggggagt

SEQ ID NO: 17333 - DNA, 25 bp, Homo sapien
gctggggagtagtggatgtctgcaa

SEQ ID NO: 17334 - DNA, 25 bp, Homo sapien
actttcacatcaacctctttcaagt

SEQ ID NO: 17335 - DNA, 25 bp, Homo sapien
ttggggaatggaagcctatatcaca

SEQ ID NO: 17336 - DNA, 25 bp, Homo sapien
aagtattcattcctgcatgactccc

SEQ ID NO: 17337 - DNA, 25 bp, Homo sapien
ttctgcttctcagactctattccga

SEQ ID NO: 17338 - DNA, 25 bp, Homo sapien
gaaatccaacttagagctgctccac

SEQ ID NO: 17339 - DNA, 25 bp, Homo sapien
ttcctcaggagtaccttcaccaaca

SEQ ID NO: 17340 - DNA, 25 bp, Homo sapien
gacacctcggacagcgatgactatc

SEQ ID NO: 17341 - DNA, 25 bp, Homo sapien
gatgactatcacctcctaaaggacc

SEQ ID NO: 17342 - DNA, 25 bp, Homo sapien
ctgactgggcagaccctcaagcaga

SEQ ID NO: 17343 - DNA, 25 bp, Homo sapien
gtttgacacaaactcgcacaaccat

SEQ ID NO: 17344 - DNA, 25 bp, Homo sapien
gacgcactgctcaagaactacgggc

SEQ ID NO: 17345 - DNA, 25 bp, Homo sapien
gacaaggtcgagacattcctgcgca

SEQ ID NO: 17346 - DNA, 25 bp, Homo sapien
atcatcgacgtctaccacaagtact

SEQ ID NO: 17347 - DNA, 25 bp, Homo sapien
gaatttccatgccgtctacagggat

SEQ ID NO: 17348 - DNA, 25 bp, Homo sapien
tttccatgccgtctacagggatgac

SEQ ID NO: 17349 - DNA, 25 bp, Homo sapien
caggaaaaagggtgcagacgtctgg

SEQ ID NO: 17350 - DNA, 25 bp, Homo sapien
ggcatcatgttgaccgagctggaga

SEQ ID NO: 17351 - DNA, 25 bp, Homo sapien
gttgaccgagctggagaaagccttg

SEQ ID NO: 17352 - DNA, 25 bp, Homo sapien
ggagaaagccttgaactctatcatc

SEQ ID NO: 17353 - DNA, 25 bp, Homo sapien
gaaagccttgaactctatcatcgac

SEQ ID NO: 17354 - DNA, 25 bp, Homo sapien
agccttgaactctatcatcgacgtc

SEQ ID NO: 17355 - DNA, 25 bp, Homo sapien
tgaactctatcatcgacgtctacca

SEQ ID NO: 17356 - DNA, 25 bp, Homo sapien
tctatcatcgacgtctaccacaagt

SEQ ID NO: 17357 - DNA, 25 bp, Homo sapien
tggtggtgttcttgtcttaacccta

SEQ ID NO: 17358 - DNA, 25 bp, Homo sapien
tcgcctctttagggtccatggtggc

SEQ ID NO: 17359 - DNA, 25 bp, Homo sapien
cagtgaaggatggttcctggcccct

SEQ ID NO: 17360 - DNA, 25 bp, Homo sapien
tccagtccatgctcttctggacgtg

SEQ ID NO: 17361 - DNA, 25 bp, Homo sapien
tctggacgtggactctctgaggcag

SEQ ID NO: 17362 - DNA, 25 bp, Homo sapien
ggcagaactgagcttttccaggcct

SEQ ID NO: 17363 - DNA, 25 bp, Homo sapien
ggcctcttatggaatcctgcagatc

SEQ ID NO: 17364 - DNA, 25 bp, Homo sapien
aatcccagtgctgcaatcacacatc

SEQ ID NO: 17365 - DNA, 25 bp, Homo sapien
cctacttgtgcgctttgcatttcat

SEQ ID NO: 17366 - DNA, 25 bp, Homo sapien
tgcatttcattgattgacgcctccc

SEQ ID NO: 17367 - DNA, 25 bp, Homo sapien
gagcgcctactatgtactaatgcta

SEQ ID NO: 17368 - DNA, 25 bp, Homo sapien
gagacgggtcaggaactagcggaat

SEQ ID NO: 17369 - DNA, 25 bp, Homo sapien
aaactaagttgtgtgccagtgctca

SEQ ID NO: 17370 - DNA, 25 bp, Homo sapien
aataagcaggatttgctcacagcag

SEQ ID NO: 17371 - DNA, 25 bp, Homo sapien
gaaggactgaacctgcataccatcc

SEQ ID NO: 17372 - DNA, 25 bp, Homo sapien
gcgaccgagtctggcagatccagtc

SEQ ID NO: 17373 - DNA, 25 bp, Homo sapien
ctcacaggagagggcgttcaggatg

SEQ ID NO: 17374 - DNA, 25 bp, Homo sapien
caggatggcatgaactgggtctgca

SEQ ID NO: 17375 - DNA, 25 bp, Homo sapien
gctgctttctgaccaaatgtttttc

SEQ ID NO: 17376 - DNA, 25 bp, Homo sapien
atctgtgtacactccagctgtttga

SEQ ID NO: 17377 - DNA, 25 bp, Homo sapien
gaatccccattccagcagtagattt

SEQ ID NO: 17378 - DNA, 25 bp, Homo sapien
agatttaactgatctctgaggttca

SEQ ID NO: 17379 - DNA, 25 bp, Homo sapien
gaccctaatttgtatcattctgagt

SEQ ID NO: 17380 - DNA, 25 bp, Homo sapien
cagtcaccgactgcttttgataagt

SEQ ID NO: 17381 - DNA, 25 bp, Homo sapien
gagtcccactcggtaagagttgctt

SEQ ID NO: 17382 - DNA, 25 bp, Homo sapien
gacactgttgacatttgggctggat

SEQ ID NO: 17383 - DNA, 25 bp, Homo sapien
aaacccctgtggtggggtctgtgct

SEQ ID NO: 17384 - DNA, 25 bp, Homo sapien
ggtctgtgctgtgcattgcaggatg

SEQ ID NO: 17385 - DNA, 25 bp, Homo sapien
ttgcaggatggtgagcagcgtccct

SEQ ID NO: 17386 - DNA, 25 bp, Homo sapien
tgacacccacagttatgccggatgt

SEQ ID NO: 17387 - DNA, 25 bp, Homo sapien
ttatgccggatgttgccagatgccc

SEQ ID NO: 17388 - DNA, 25 bp, Homo sapien
gccagatgcccctagggacagagtc

SEQ ID NO: 17389 - DNA, 25 bp, Homo sapien
cccaactgaggaccactgtctacag

SEQ ID NO: 17390 - DNA, 25 bp, Homo sapien
tggttcacaccccggaaacaagtgt

SEQ ID NO: 17391 - DNA, 25 bp, Homo sapien
cccggaaacaagtgtctgagtggct

SEQ ID NO: 17392 - DNA, 25 bp, Homo sapien
aggaggtacagaagccggcaacgct

SEQ ID NO: 17393 - DNA, 25 bp, Homo sapien
ggcaacgcttgctatttattttaca

SEQ ID NO: 17394 - DNA, 25 bp, Homo sapien
gatcgtcgcccgatcagtgttttga

SEQ ID NO: 17395 - DNA, 25 bp, Homo sapien
cagtgttttgagggggaaggtggcg

SEQ ID NO: 17396 - DNA, 25 bp, Homo sapien
tggcggggtgggaaccgtgtcattc

SEQ ID NO: 17397 - DNA, 25 bp, Homo sapien
gaaccgtgtcattccagagtggatc

SEQ ID NO: 17398 - DNA, 25 bp, Homo sapien
gagtggatctgcggtgaagccaagc

SEQ ID NO: 17399 - DNA, 25 bp, Homo sapien
ggtgaagccaagccgcaaggttaca

SEQ ID NO: 17400 - DNA, 25 bp, Homo sapien
aagccgcaaggttacaaggcatcct

SEQ ID NO: 17401 - DNA, 25 bp, Homo sapien
tgtgtgtggacatctctgaccatcc

SEQ ID NO: 17402 - DNA, 25 bp, Homo sapien
tgaccatccatcgctgtattcaaat

SEQ ID NO: 17403 - DNA, 25 bp, Homo sapien
gttctattccattctggtctcaggc

SEQ ID NO: 17404 - DNA, 25 bp, Homo sapien
aggcatgaccacgtccagtgaagac

SEQ ID NO: 17405 - DNA, 25 bp, Homo sapien
ttgaggcagcacatctcaggaccca

SEQ ID NO: 17406 - DNA, 25 bp, Homo sapien
ggacccaggcaatagactggcccca

SEQ ID NO: 17407 - DNA, 25 bp, Homo sapien
ttgtgtggaacagctcaccttgtca

SEQ ID NO: 17408 - DNA, 25 bp, Homo sapien
gacattcatcttttgagtcctcatc

SEQ ID NO: 17409 - DNA, 25 bp, Homo sapien
atggagtgctgtgtttggggggctg

SEQ ID NO: 17410 - DNA, 25 bp, Homo sapien
gggctgcatctgctgaagcgagaac

SEQ ID NO: 17411 - DNA, 25 bp, Homo sapien
caggacttctccaacttactattag

SEQ ID NO: 17412 - DNA, 25 bp, Homo sapien
gagagggggagtagcacccgaggct

SEQ ID NO: 17413 - DNA, 25 bp, Homo sapien
agcaacagaggtgccaggcctcagc

SEQ ID NO: 17414 - DNA, 25 bp, Homo sapien
gcagccccatcgccaaaggatggaa

SEQ ID NO: 17415 - DNA, 25 bp, Homo sapien
tgaatagctcaggtgtgctgacccc

SEQ ID NO: 17416 - DNA, 25 bp, Homo sapien
tgctgaccccagtgaagacaccaga

SEQ ID NO: 17417 - DNA, 25 bp, Homo sapien
gacaccagataggacctctgagagg

SEQ ID NO: 17418 - DNA, 25 bp, Homo sapien
gaggggactggcatggggggatctc

SEQ ID NO: 17419 - DNA, 25 bp, Homo sapien
tggggggatctcagagcttacaggc

SEQ ID NO: 17420 - DNA, 25 bp, Homo sapien
agcttacaggctgagccaagcccac

SEQ ID NO: 17421 - DNA, 25 bp, Homo sapien
tgcacagggacactcacacaggcac

SEQ ID NO: 17422 - DNA, 25 bp, Homo sapien
aagaggggtggcgcagaagggttgg

SEQ ID NO: 17423 - DNA, 25 bp, Homo sapien
tgaggctttggccttaacacccagg

SEQ ID NO: 17424 - DNA, 25 bp, Homo sapien
cacccaggaacttttctattacaat

SEQ ID NO: 17425 - DNA, 25 bp, Homo sapien
ggaacttttctattacaatcgctta

SEQ ID NO: 17426 - DNA, 25 bp, Homo sapien
atcgcttaggaagtaaagccttgtc

SEQ ID NO: 17427 - DNA, 25 bp, Homo sapien
tgcccctccagggggccatgagtgc

SEQ ID NO: 17428 - DNA, 25 bp, Homo sapien
ggggccatgagtgcctaggtttctc

SEQ ID NO: 17429 - DNA, 25 bp, Homo sapien
atgagtgcctaggtttctcataccc

SEQ ID NO: 17430 - DNA, 25 bp, Homo sapien
cataccccacaaggtcacagcaggg

SEQ ID NO: 17431 - DNA, 25 bp, Homo sapien
caaggtcacagcaggggagggaggg

SEQ ID NO: 17432 - DNA, 25 bp, Homo sapien
ggggggctgtggtcaagccttattc

SEQ ID NO: 17433 - DNA, 25 bp, Homo sapien
tgtggtcaagccttattctgtattg

SEQ ID NO: 17434 - DNA, 25 bp, Homo sapien
catgaccagctgaggctacgcatag

SEQ ID NO: 17435 - DNA, 25 bp, Homo sapien
tgaggctacgcataggggtccatac

SEQ ID NO: 17436 - DNA, 25 bp, Homo sapien
gtgctggggttgttggcctgaagat

SEQ ID NO: 17437 - DNA, 25 bp, Homo sapien
gaacactgcttctcgaatggagtct

SEQ ID NO: 17438 - DNA, 25 bp, Homo sapien
aatggagtctaatggtcaagcgctg

SEQ ID NO: 17439 - DNA, 25 bp, Homo sapien
tcaagcgctgaagatccatgtctcc

SEQ ID NO: 17440 - DNA, 25 bp, Homo sapien
ctctaccaccaaggatgccctagat

SEQ ID NO: 17441 - DNA, 25 bp, Homo sapien
ctagatgagctaggatgcttccagc

SEQ ID NO: 17442 - DNA, 25 bp, Homo sapien
atgcttccagctagagcttcggggg

SEQ ID NO: 17443 - DNA, 25 bp, Homo sapien
agctagagcttcggggggatgtgga

SEQ ID NO: 17444 - DNA, 25 bp, Homo sapien
gatgcgaacatactggctcttagga

SEQ ID NO: 17445 - DNA, 25 bp, Homo sapien
agcataatacactgtttttctcaac

SEQ ID NO: 17446 - DNA, 25 bp, Homo sapien
ataatgatgtgactgcttagcccct

SEQ ID NO: 17447 - DNA, 25 bp, Homo sapien
gtgactgcttagcccctaaatatgg

SEQ ID NO: 17448 - DNA, 25 bp, Homo sapien
agcccctaaatatggtaactactct

SEQ ID NO: 17449 - DNA, 25 bp, Homo sapien
gtaactactctgggacaatatggga

SEQ ID NO: 17450 - DNA, 25 bp, Homo sapien
gctaatcctcatctgtcatatccag

SEQ ID NO: 17451 - DNA, 25 bp, Homo sapien
taggagggatggggcaggggactgt

SEQ ID NO: 17452 - DNA, 25 bp, Homo sapien
gaatgaaaagtatttgcctctggaa

SEQ ID NO: 17453 - DNA, 25 bp, Homo sapien
ctggcaggactgttgttttcattgt

SEQ ID NO: 17454 - DNA, 25 bp, Homo sapien
attgtaagacttttggagccattta

SEQ ID NO: 17455 - DNA, 25 bp, Homo sapien
gtacttaaccattttcatctatttc

SEQ ID NO: 17456 - DNA, 25 bp, Homo sapien
gtgtatttaacttaagctattgctc

SEQ ID NO: 17457 - DNA, 25 bp, Homo sapien
taagctattgctcttaaaaccaggg

SEQ ID NO: 17458 - DNA, 25 bp, Homo sapien
gtgaacagcttggccttttttgggt

SEQ ID NO: 17459 - DNA, 25 bp, Homo sapien
ttggccttttttgggtgtcttgaca

SEQ ID NO: 17460 - DNA, 25 bp, Homo sapien
tttttgggtgtcttgacaggccaag

SEQ ID NO: 17461 - DNA, 25 bp, Homo sapien
gccaagaagaacaaatgactcagaa

SEQ ID NO: 17462 - DNA, 25 bp, Homo sapien
aacatgaaagttatccaggcgcaga

SEQ ID NO: 17463 - DNA, 25 bp, Homo sapien
gttatccaggcgcagagttgaagaa

SEQ ID NO: 17464 - DNA, 25 bp, Homo sapien
aaaacagtggagctctgtattagaa

SEQ ID NO: 17465 - DNA, 25 bp, Homo sapien
tgggaaggccaggtaactctagtta

SEQ ID NO: 17466 - DNA, 25 bp, Homo sapien
aagtcaactgacatctatgctacat

SEQ ID NO: 17467 - DNA, 25 bp, Homo sapien
gatgtaaattggagtcaaccaggtg

SEQ ID NO: 17468 - DNA, 25 bp, Homo sapien
taactgggggatctaactgcgaacc

SEQ ID NO: 17469 - DNA, 25 bp, Homo sapien
ggggatctaactgcgaaccaaaggt

SEQ ID NO: 17470 - DNA, 25 bp, Homo sapien
actgcgaaccaaaggttgcaccaac

SEQ ID NO: 17471 - DNA, 25 bp, Homo sapien
gttgcaccaacaaccgcttggaatg

SEQ ID NO: 17472 - DNA, 25 bp, Homo sapien
caacaaccgcttggaatgctgcaac

SEQ ID NO: 17473 - DNA, 25 bp, Homo sapien
ttggaatgctgcaacaatggcaccc

SEQ ID NO: 17474 - DNA, 25 bp, Homo sapien
ctcttcttccattaggatgctacaa

SEQ ID NO: 17475 - DNA, 25 bp, Homo sapien
ctcagtgaaggcccatgaagggaat

SEQ ID NO: 17476 - DNA, 25 bp, Homo sapien
tgaagggaattggggactagtttat

SEQ ID NO: 17477 - DNA, 25 bp, Homo sapien
gaacgtattcattacagtttataaa

SEQ ID NO: 17478 - DNA, 25 bp, Homo sapien
gccagggtttctctaaaggagcttt

SEQ ID NO: 17479 - DNA, 25 bp, Homo sapien
ttctctaaaggagctttgttttgtc

SEQ ID NO: 17480 - DNA, 25 bp, Homo sapien
ttgttttgtctaaagtgtggcaaga

SEQ ID NO: 17481 - DNA, 25 bp, Homo sapien
gtggcaagacatagtgcacaacaca

SEQ ID NO: 17482 - DNA, 25 bp, Homo sapien
gcacaacacagggacaaaggcaggt

SEQ ID NO: 17483 - DNA, 25 bp, Homo sapien
aaaggcaggtttcctgcagctcgct

SEQ ID NO: 17484 - DNA, 25 bp, Homo sapien
gcagctcgctacctaagtgtttctg

SEQ ID NO: 17485 - DNA, 25 bp, Homo sapien
agctcgctacctaagtgtttctgta

SEQ ID NO: 17486 - DNA, 25 bp, Homo sapien
agtgtttctgtaggggaaggagcca

SEQ ID NO: 17487 - DNA, 25 bp, Homo sapien
agtgttggtacagattcatgtttct

SEQ ID NO: 17488 - DNA, 25 bp, Homo sapien
ggtacagattcatgtttctgattta

SEQ ID NO: 17489 - DNA, 25 bp, Homo sapien
gcatggagagccaagcctacagcgg

SEQ ID NO: 17490 - DNA, 25 bp, Homo sapien
tacagcgggtcccagtagccaagat

SEQ ID NO: 17491 - DNA, 25 bp, Homo sapien
cctgccccctgaatggtatgtggtg

SEQ ID NO: 17492 - DNA, 25 bp, Homo sapien
gtgcctccagggaccaagtgtgaga

SEQ ID NO: 17493 - DNA, 25 bp, Homo sapien
ggcctttctgaatgttatctccaac

SEQ ID NO: 17494 - DNA, 25 bp, Homo sapien
tgcactgagggactgttggcccctg

SEQ ID NO: 17495 - DNA, 25 bp, Homo sapien
tgtgagggtgactacgggggcccac

SEQ ID NO: 17496 - DNA, 25 bp, Homo sapien
gctttacccacaactgctgggtcct

SEQ ID NO: 17497 - DNA, 25 bp, Homo sapien
taatccccaaccgagtatgcgcaag

SEQ ID NO: 17498 - DNA, 25 bp, Homo sapien
tcacgcgtgtctctgtgtttgtgga

SEQ ID NO: 17499 - DNA, 25 bp, Homo sapien
ttaggcccagccttgatgccatatg

SEQ ID NO: 17500 - DNA, 25 bp, Homo sapien
cccttcctggctaggactgtggagg

SEQ ID NO: 17501 - DNA, 25 bp, Homo sapien
ggctaggactgtggaggggagctgc

SEQ ID NO: 17502 - DNA, 25 bp, Homo sapien
tggccatggctgctttgtagtttgc

SEQ ID NO: 17503 - DNA, 25 bp, Homo sapien
gctttgtagtttgcccagagttggg

SEQ ID NO: 17504 - DNA, 25 bp, Homo sapien
gagttcccaaagggagggtggcaga

SEQ ID NO: 17505 - DNA, 25 bp, Homo sapien
gggtggcagagacagtgggcactaa

SEQ ID NO: 17506 - DNA, 25 bp, Homo sapien
agggtggagagttgggggccagcac

SEQ ID NO: 17507 - DNA, 25 bp, Homo sapien
aggtactggtgagggcaagaggtgc

SEQ ID NO: 17508 - DNA, 25 bp, Homo sapien
gaggagtggccctgatccaggaaaa

SEQ ID NO: 17509 - DNA, 25 bp, Homo sapien
gaggggaatctggaacgctctaggc

SEQ ID NO: 17510 - DNA, 25 bp, Homo sapien
ggaacgctctaggcagaagaagctg

SEQ ID NO: 17511 - DNA, 25 bp, Homo sapien
cttactgtgttttcagtcacttcct

SEQ ID NO: 17512 - DNA, 25 bp, Homo sapien
ttttcagtcacttcctttctgtgaa

SEQ ID NO: 17513 - DNA, 25 bp, Homo sapien
gaaattctctgaaaatcccattagg

SEQ ID NO: 17514 - DNA, 25 bp, Homo sapien
atcccattaggaaaccaggtgtgaa

SEQ ID NO: 17515 - DNA, 25 bp, Homo sapien
tgaaaagggctcagtagcttctctg

SEQ ID NO: 17516 - DNA, 25 bp, Homo sapien
gtagcttctctgagtggcgttttta

SEQ ID NO: 17517 - DNA, 25 bp, Homo sapien
gtggcgtttttagctgactggaagt

SEQ ID NO: 17518 - DNA, 25 bp, Homo sapien
ggaagtgcttaatctggatcgtctt

SEQ ID NO: 17519 - DNA, 25 bp, Homo sapien
aaatactgtgcttactgtgaaatat

SEQ ID NO: 17520 - DNA, 25 bp, Homo sapien
tatatcagttggtgagccgggcgtg

SEQ ID NO: 17521 - DNA, 25 bp, Homo sapien
ggtgaaagcctgtatctattaaaag

SEQ ID NO: 17522 - DNA, 25 bp, Homo sapien
agggcctggagaataagccggtggc

SEQ ID NO: 17523 - DNA, 25 bp, Homo sapien
gcctggagaataagccggtggccga

SEQ ID NO: 17524 - DNA, 25 bp, Homo sapien
tggagaataagccggtggccgagag

SEQ ID NO: 17525 - DNA, 25 bp, Homo sapien
ccctgctctatggggacccagagct

SEQ ID NO: 17526 - DNA, 25 bp, Homo sapien
ctatggggacccagagcttgaacac

SEQ ID NO: 17527 - DNA, 25 bp, Homo sapien
gacccagagcttgaacacgcgtaga

SEQ ID NO: 17528 - DNA, 25 bp, Homo sapien
cccagagcttgaacacgcgtagact

SEQ ID NO: 17529 - DNA, 25 bp, Homo sapien
cttgaacacgcgtagactggggtcc

SEQ ID NO: 17530 - DNA, 25 bp, Homo sapien
ccgcccgacgtgtctacgtcggctg

SEQ ID NO: 17531 - DNA, 25 bp, Homo sapien
acgtgtctacgtcggctgaagagac

SEQ ID NO: 17532 - DNA, 25 bp, Homo sapien
gtcggctgaagagacagcgggggcg

SEQ ID NO: 17533 - DNA, 25 bp, Homo sapien
aaggatgtcttaggcatttagtaaa

SEQ ID NO: 17534 - DNA, 25 bp, Homo sapien
taaaaattcagtggttccccgctat

SEQ ID NO: 17535 - DNA, 25 bp, Homo sapien
agatgaagtttcattctatcgccca

SEQ ID NO: 17536 - DNA, 25 bp, Homo sapien
ccacacctggcccatggtgggggat

SEQ ID NO: 17537 - DNA, 25 bp, Homo sapien
acacctggcccatggtgggggatat

SEQ ID NO: 17538 - DNA, 25 bp, Homo sapien
ggcccatggtgggggatatgtttta

SEQ ID NO: 17539 - DNA, 25 bp, Homo sapien
tatgttttaagacccccagttaatg

SEQ ID NO: 17540 - DNA, 25 bp, Homo sapien
cctgaaaccgctgctagtaccaaac

SEQ ID NO: 17541 - DNA, 25 bp, Homo sapien
gagactaacaacagctcacagccaa

SEQ ID NO: 17542 - DNA, 25 bp, Homo sapien
aacaacagctcacagccaaatagag

SEQ ID NO: 17543 - DNA, 25 bp, Homo sapien
cacagccaaatagagcaattataac

SEQ ID NO: 17544 - DNA, 25 bp, Homo sapien
tgtcctgggaaagtatctttgcccc

SEQ ID NO: 17545 - DNA, 25 bp, Homo sapien
tatctttgccccactaggaaatgta

SEQ ID NO: 17546 - DNA, 25 bp, Homo sapien
tctcatgagcagctactgcggcgtt

SEQ ID NO: 17547 - DNA, 25 bp, Homo sapien
agctactgcggcgttggcaggactc

SEQ ID NO: 17548 - DNA, 25 bp, Homo sapien
gccggacagtcggcactgaccggcc

SEQ ID NO: 17549 - DNA, 25 bp, Homo sapien
acctggtagcagaggacacccccag

SEQ ID NO: 17550 - DNA, 25 bp, Homo sapien
agccccccaagcattgaagacatag

SEQ ID NO: 17551 - DNA, 25 bp, Homo sapien
ttctcccttgggtgtagttggggtg

SEQ ID NO: 17552 - DNA, 25 bp, Homo sapien
atgtgtgggacaccttgaccaaagg

SEQ ID NO: 17553 - DNA, 25 bp, Homo sapien
gaccaaaggggagctttgtctcgtg

SEQ ID NO: 17554 - DNA, 25 bp, Homo sapien
ttgtctcgtgtgttttgaaaaaggc

SEQ ID NO: 17555 - DNA, 25 bp, Homo sapien
ctgctacacagcacggctttttcaa

SEQ ID NO: 17556 - DNA, 25 bp, Homo sapien
tgtgctgggctaaccagcccacaga

SEQ ID NO: 17557 - DNA, 25 bp, Homo sapien
cacattcctgtcccttgggtgaaaa

SEQ ID NO: 17558 - DNA, 25 bp, Homo sapien
aatacatgtccatcctgatatctcc

SEQ ID NO: 17559 - DNA, 25 bp, Homo sapien
agaaattagcctccacatgtgcaat

SEQ ID NO: 17560 - DNA, 25 bp, Homo sapien
ccaggtgtggtctcggttaccaaat

SEQ ID NO: 17561 - DNA, 25 bp, Homo sapien
ggttacctgcagctttttagtcctt

SEQ ID NO: 17562 - DNA, 25 bp, Homo sapien
tcccatctgcccaaaggtcttgaag

SEQ ID NO: 17563 - DNA, 25 bp, Homo sapien
acatccaatcactgtttgcacttat

SEQ ID NO: 17564 - DNA, 25 bp, Homo sapien
cacttatctgaaatcttccctcttg

SEQ ID NO: 17565 - DNA, 25 bp, Homo sapien
ctgcccccaggtatttactgtggag

SEQ ID NO: 17566 - DNA, 25 bp, Homo sapien
gttgaaatgatcctaccagtgatta

SEQ ID NO: 17567 - DNA, 25 bp, Homo sapien
gatcctaccagtgattagtggctat

SEQ ID NO: 17568 - DNA, 25 bp, Homo sapien
gtggctattgagagttttacagggt

SEQ ID NO: 17569 - DNA, 25 bp, Homo sapien
gagagttttacagggttatacattg

SEQ ID NO: 17570 - DNA, 25 bp, Homo sapien
ggttatacattgttaagggaccaag

SEQ ID NO: 17571 - DNA, 25 bp, Homo sapien
taagggaccaagaatcaagtacaaa

SEQ ID NO: 17572 - DNA, 25 bp, Homo sapien
aactgtaaaatcccttggtcattca

SEQ ID NO: 17573 - DNA, 25 bp, Homo sapien
tttctattattttcatatgttaaga

SEQ ID NO: 17574 - DNA, 25 bp, Homo sapien
gtatgtataaattggcattaggata

SEQ ID NO: 17575 - DNA, 25 bp, Homo sapien
ttttaacatagttttctatttgtct

SEQ ID NO: 17576 - DNA, 25 bp, Homo sapien
gtctttatttcaagtaccagaatta

SEQ ID NO: 17577 - DNA, 25 bp, Homo sapien
gagaaccaggctatggacgtctcca

SEQ ID NO: 17578 - DNA, 25 bp, Homo sapien
caggctatggacgtctccaatcagc

SEQ ID NO: 17579 - DNA, 25 bp, Homo sapien
ctatggacgtctccaatcagctggc

SEQ ID NO: 17580 - DNA, 25 bp, Homo sapien
ctccaatcagctggccagagtctgc

SEQ ID NO: 17581 - DNA, 25 bp, Homo sapien
tctgctacagccctgactttgagaa

SEQ ID NO: 17582 - DNA, 25 bp, Homo sapien
gctacagccctgactttgagaaact

SEQ ID NO: 17583 - DNA, 25 bp, Homo sapien
atacttggaggaacttcctacaatg

SEQ ID NO: 17584 - DNA, 25 bp, Homo sapien
gaggaacttcctacaatgatgcagc

SEQ ID NO: 17585 - DNA, 25 bp, Homo sapien
ggaacttcctacaatgatgcagcac

SEQ ID NO: 17586 - DNA, 25 bp, Homo sapien
acttcctacaatgatgcagcacttc

SEQ ID NO: 17587 - DNA, 25 bp, Homo sapien
gaagaggccatggtttgttggagac

SEQ ID NO: 17588 - DNA, 25 bp, Homo sapien
ccttttggcaaacagtgtctatttt

SEQ ID NO: 17589 - DNA, 25 bp, Homo sapien
ggcaaacagtgtctattttacagag

SEQ ID NO: 17590 - DNA, 25 bp, Homo sapien
aggcaaaccaagcctccttagtgcc

SEQ ID NO: 17591 - DNA, 25 bp, Homo sapien
ctggggctgatggtcacccagagcc

SEQ ID NO: 17592 - DNA, 25 bp, Homo sapien
gctgggttatcatggttggcttagg

SEQ ID NO: 17593 - DNA, 25 bp, Homo sapien
ttggcttaggtacctcaggtggccc

SEQ ID NO: 17594 - DNA, 25 bp, Homo sapien
ggccagtgttcctagtgtgggccca

SEQ ID NO: 17595 - DNA, 25 bp, Homo sapien
tgtttttttttgcatccatcagaga

SEQ ID NO: 17596 - DNA, 25 bp, Homo sapien
tgtgtggcaggcagggcatgggttt

SEQ ID NO: 17597 - DNA, 25 bp, Homo sapien
ggcaggcagggcatgggttttagtc

SEQ ID NO: 17598 - DNA, 25 bp, Homo sapien
cagggcatgggttttagtcctggcc

SEQ ID NO: 17599 - DNA, 25 bp, Homo sapien
gcgtgcagagttctctatttcagat

SEQ ID NO: 17600 - DNA, 25 bp, Homo sapien
cagagttctctatttcagataattg

SEQ ID NO: 17601 - DNA, 25 bp, Homo sapien
agacccaggtcaaaaggttctgaga

SEQ ID NO: 17602 - DNA, 25 bp, Homo sapien
attttatatctttttacatgtgggg

SEQ ID NO: 17603 - DNA, 25 bp, Homo sapien
tatatctttttacatgtggggggca

SEQ ID NO: 17604 - DNA, 25 bp, Homo sapien
ggcagaaggtaaagcatgtttgact

SEQ ID NO: 17605 - DNA, 25 bp, Homo sapien
ggtaaagcatgtttgacttgtgaaa

SEQ ID NO: 17606 - DNA, 25 bp, Homo sapien
gacttgtgaaaatgggatgtcaaac

SEQ ID NO: 17607 - DNA, 25 bp, Homo sapien
gatgtcaaacagccataagttccct

SEQ ID NO: 17608 - DNA, 25 bp, Homo sapien
aacagccataagttccctggtattc

SEQ ID NO: 17609 - DNA, 25 bp, Homo sapien
cataagttccctggtattcaccttc

SEQ ID NO: 17610 - DNA, 25 bp, Homo sapien
gagcatcagtcacgggtaggtggag

SEQ ID NO: 17611 - DNA, 25 bp, Homo sapien
agaggctggttacagcttcagtccc

SEQ ID NO: 17612 - DNA, 25 bp, Homo sapien
taggtaggttatggtgcctcacacc

SEQ ID NO: 17613 - DNA, 25 bp, Homo sapien
gttatggtgcctcacacctgtaatc

SEQ ID NO: 17614 - DNA, 25 bp, Homo sapien
gccaacaaggcgaaaccctgtctct

SEQ ID NO: 17615 - DNA, 25 bp, Homo sapien
gcatggtagtgcacgcctgtaatcc

SEQ ID NO: 17616 - DNA, 25 bp, Homo sapien
gaggcacgagacttgcttgaaccca

SEQ ID NO: 17617 - DNA, 25 bp, Homo sapien
agctcttgcaacgtttactggacat

SEQ ID NO: 17618 - DNA, 25 bp, Homo sapien
atgggagagactgacctcatgctgg

SEQ ID NO: 17619 - DNA, 25 bp, Homo sapien
tctgcgtacgctggttggcatttgc

SEQ ID NO: 17620 - DNA, 25 bp, Homo sapien
gctggttggcatttgctctgagcat

SEQ ID NO: 17621 - DNA, 25 bp, Homo sapien
taaacagttctcacaccttgctata

SEQ ID NO: 17622 - DNA, 25 bp, Homo sapien
tctcacaccttgctatacataatat

SEQ ID NO: 17623 - DNA, 25 bp, Homo sapien
ggcaaagcttttaactcatcctcaa

SEQ ID NO: 17624 - DNA, 25 bp, Homo sapien
tcatcctcaaaccttactgcacata

SEQ ID NO: 17625 - DNA, 25 bp, Homo sapien
gcaaagctaacctatcatcaaccct

SEQ ID NO: 17626 - DNA, 25 bp, Homo sapien
caacccttactccacataagacaat

SEQ ID NO: 17627 - DNA, 25 bp, Homo sapien
aatgcttgtaactaaatctcaaact

SEQ ID NO: 17628 - DNA, 25 bp, Homo sapien
gcggcaaagcttttaaccgatcctc

SEQ ID NO: 17629 - DNA, 25 bp, Homo sapien
accgatcctcaaaacttactgaaca

SEQ ID NO: 17630 - DNA, 25 bp, Homo sapien
gtgacaaggcctttaacctgtcctc

SEQ ID NO: 17631 - DNA, 25 bp, Homo sapien
cctgtcctcaacgcttactaaacat

SEQ ID NO: 17632 - DNA, 25 bp, Homo sapien
aacgcagccgcaaggagagctactc

SEQ ID NO: 17633 - DNA, 25 bp, Homo sapien
gagagctactccgtatacgtttaca

SEQ ID NO: 17634 - DNA, 25 bp, Homo sapien
caaggtgctgaagcaagtccacccc

SEQ ID NO: 17635 - DNA, 25 bp, Homo sapien
catctcctccaaagccatggggatc

SEQ ID NO: 17636 - DNA, 25 bp, Homo sapien
ggatcatgaattcctttgtcaacga

SEQ ID NO: 17637 - DNA, 25 bp, Homo sapien
caacgatatcttcgagcgcatcgcc

SEQ ID NO: 17638 - DNA, 25 bp, Homo sapien
gcctggctcattacaacaagcgttc

SEQ ID NO: 17639 - DNA, 25 bp, Homo sapien
acaacaagcgttcgaccattacctc

SEQ ID NO: 17640 - DNA, 25 bp, Homo sapien
cctccagggagatccagacagccgt

SEQ ID NO: 17641 - DNA, 25 bp, Homo sapien
tgtccgagggcactaaggccgtcac

SEQ ID NO: 17642 - DNA, 25 bp, Homo sapien
gaagggctccaagaaggcggtgacc

SEQ ID NO: 17643 - DNA, 25 bp, Homo sapien
ggtatgcgactgggatcttaagctt

SEQ ID NO: 17644 - DNA, 25 bp, Homo sapien
ccggaagcccttgcctgaaagcaag

SEQ ID NO: 17645 - DNA, 25 bp, Homo sapien
aaagcaagatttcagcctggaagag

SEQ ID NO: 17646 - DNA, 25 bp, Homo sapien
gtggacgggagtggacaggagtgga

SEQ ID NO: 17647 - DNA, 25 bp, Homo sapien
gtggatgcgataagatgtggtttga

SEQ ID NO: 17648 - DNA, 25 bp, Homo sapien
gtttgaagctgatgggtgccagccc

SEQ ID NO: 17649 - DNA, 25 bp, Homo sapien
agggcgtgtgggttatgtttctggc

SEQ ID NO: 17650 - DNA, 25 bp, Homo sapien
gttatgtttctggctgggggcgaaa

SEQ ID NO: 17651 - DNA, 25 bp, Homo sapien
ggctgggggcgaaatgccaatttta

SEQ ID NO: 17652 - DNA, 25 bp, Homo sapien
tgaccaagaccaatgcataaggcat

SEQ ID NO: 17653 - DNA, 25 bp, Homo sapien
gaaaagaagacaccgaagagccctg

SEQ ID NO: 17654 - DNA, 25 bp, Homo sapien
acgcccctgctgacgaggaaaatgg

SEQ ID NO: 17655 - DNA, 25 bp, Homo sapien
atgtcagacgcagccgtagacacca

SEQ ID NO: 17656 - DNA, 25 bp, Homo sapien
ggagcaagaggctgacaatgaagta

SEQ ID NO: 17657 - DNA, 25 bp, Homo sapien
ggtggggaggaagaaggtgatggtg

SEQ ID NO: 17658 - DNA, 25 bp, Homo sapien
gaagatgagggagctgagtcagcta

SEQ ID NO: 17659 - DNA, 25 bp, Homo sapien
agtcagctacggacaagcgggcagc

SEQ ID NO: 17660 - DNA, 25 bp, Homo sapien
agcgggcagctgaagatgatgagga

SEQ ID NO: 17661 - DNA, 25 bp, Homo sapien
aacgatgtcgataccaagaagcaga

SEQ ID NO: 17662 - DNA, 25 bp, Homo sapien
gcagaagaccgacgaggatgactag

SEQ ID NO: 17663 - DNA, 25 bp, Homo sapien
ctccgaaatcaccaccgaggactta

SEQ ID NO: 17664 - DNA, 25 bp, Homo sapien
gaaaatggaagagacgcccctgctg

SEQ ID NO: 17665 - DNA, 25 bp, Homo sapien
cttttgagaccctatttggtttgct

SEQ ID NO: 17666 - DNA, 25 bp, Homo sapien
atttggtttgcttacatatgtgaaa

SEQ ID NO: 17667 - DNA, 25 bp, Homo sapien
tatccaaataattgcgattgctatc

SEQ ID NO: 17668 - DNA, 25 bp, Homo sapien
aataattgcgattgctatcaaataa

SEQ ID NO: 17669 - DNA, 25 bp, Homo sapien
atttcaataatatcagttacttctt

SEQ ID NO: 17670 - DNA, 25 bp, Homo sapien
atatcagttacttcttttggtctag

SEQ ID NO: 17671 - DNA, 25 bp, Homo sapien
cagttacttcttttggtctagagtc

SEQ ID NO: 17672 - DNA, 25 bp, Homo sapien
acttcttttggtctagagtcttctc

SEQ ID NO: 17673 - DNA, 25 bp, Homo sapien
tcttttggtctagagtcttctcctc

SEQ ID NO: 17674 - DNA, 25 bp, Homo sapien
aacctctttctttttggcgagacag

SEQ ID NO: 17675 - DNA, 25 bp, Homo sapien
caatggagtgatcactgcccctttg

SEQ ID NO: 17676 - DNA, 25 bp, Homo sapien
attgcacccaccctgtagaagatgg

SEQ ID NO: 17677 - DNA, 25 bp, Homo sapien
agctgggaaccttggtggaggggtg

SEQ ID NO: 17678 - DNA, 25 bp, Homo sapien
gggtggtgaccatcgaaaggagcaa

SEQ ID NO: 17679 - DNA, 25 bp, Homo sapien
ggagcaagagcaagatcaccgtgac

SEQ ID NO: 17680 - DNA, 25 bp, Homo sapien
gatcaccgtgacatccgaggtgcct

SEQ ID NO: 17681 - DNA, 25 bp, Homo sapien
tccgaggtgcctttctccaaaaggt

SEQ ID NO: 17682 - DNA, 25 bp, Homo sapien
gccgccatggctcctgtgaaaaagc

SEQ ID NO: 17683 - DNA, 25 bp, Homo sapien
gaataatctacgtgactggttgcgc

SEQ ID NO: 17684 - DNA, 25 bp, Homo sapien
ctggttgcgcgtagttgctaacagc

SEQ ID NO: 17685 - DNA, 25 bp, Homo sapien
tacgaattacgttacttccagatta

SEQ ID NO: 17686 - DNA, 25 bp, Homo sapien
tgaagttcactcttgattgcaccca

SEQ ID NO: 17687 - DNA, 25 bp, Homo sapien
tctacaacctaagatgttctgcctt

SEQ ID NO: 17688 - DNA, 25 bp, Homo sapien
ttctgccttatcggggcgaaccttt

SEQ ID NO: 17689 - DNA, 25 bp, Homo sapien
ggggcgaaccttttaggattccatg

SEQ ID NO: 17690 - DNA, 25 bp, Homo sapien
tagaatcccattagaggtacttttt

SEQ ID NO: 17691 - DNA, 25 bp, Homo sapien
acttttttttgatggcatgctgcct

SEQ ID NO: 17692 - DNA, 25 bp, Homo sapien
ggcatgctgccttaaaagagccatt

SEQ ID NO: 17693 - DNA, 25 bp, Homo sapien
atgaaagttctgggctatcttagct

SEQ ID NO: 17694 - DNA, 25 bp, Homo sapien
tcttagctaacttatcctaaaccct

SEQ ID NO: 17695 - DNA, 25 bp, Homo sapien
atttaacttgagccccagtctcaga

SEQ ID NO: 17696 - DNA, 25 bp, Homo sapien
agccccagtctcagaaattaacatg

SEQ ID NO: 17697 - DNA, 25 bp, Homo sapien
cctggccaacactatctgtactaaa

SEQ ID NO: 17698 - DNA, 25 bp, Homo sapien
acctcgcggcggaacccgaggagag

SEQ ID NO: 17699 - DNA, 25 bp, Homo sapien
gccaaactgcaggcacaagtgcgca

SEQ ID NO: 17700 - DNA, 25 bp, Homo sapien
acagtgatccactttaacaacccta

SEQ ID NO: 17701 - DNA, 25 bp, Homo sapien
ttcaggcatctctggcagcgaacac

SEQ ID NO: 17702 - DNA, 25 bp, Homo sapien
gcgaacactttcaccattacaggcc

SEQ ID NO: 17703 - DNA, 25 bp, Homo sapien
gctacccagcatcttaaaccagctt

SEQ ID NO: 17704 - DNA, 25 bp, Homo sapien
agcttggtgcggatagtctgactag

SEQ ID NO: 17705 - DNA, 25 bp, Homo sapien
ttaaggagactggccgaagctctgc

SEQ ID NO: 17706 - DNA, 25 bp, Homo sapien
gaagctctgcccaaacaatctgtgg

SEQ ID NO: 17707 - DNA, 25 bp, Homo sapien
tgactctcgggggcgaggtcgagcc

SEQ ID NO: 17708 - DNA, 25 bp, Homo sapien
agcaccacttgctactggagaggat

SEQ ID NO: 17709 - DNA, 25 bp, Homo sapien
ggagaattagtagatgcagagttat

SEQ ID NO: 17710 - DNA, 25 bp, Homo sapien
atattataaccatagcaagctttgt

SEQ ID NO: 17711 - DNA, 25 bp, Homo sapien
ataatttctattgatgtcttggcta

SEQ ID NO: 17712 - DNA, 25 bp, Homo sapien
gatgtcttggctaaattttgatttg

SEQ ID NO: 17713 - DNA, 25 bp, Homo sapien
tgggtaattataggcttgttttctt

SEQ ID NO: 17714 - DNA, 25 bp, Homo sapien
ggcttgttttcttaatatgcttctt

SEQ ID NO: 17715 - DNA, 25 bp, Homo sapien
ttcattttctgcattgactgcattt

SEQ ID NO: 17716 - DNA, 25 bp, Homo sapien
gcattttttttgagtgatctgcaca

SEQ ID NO: 17717 - DNA, 25 bp, Homo sapien
agtgatctgcacacacaaatataga

SEQ ID NO: 17718 - DNA, 25 bp, Homo sapien
gatgtaacttaggtgttggtataac

SEQ ID NO: 17719 - DNA, 25 bp, Homo sapien
ttaaagaaaattgaccaggcgtggt

SEQ ID NO: 17720 - DNA, 25 bp, Homo sapien
tcgcctttaccacctagttgatagt

SEQ ID NO: 17721 - DNA, 25 bp, Homo sapien
cctagttgatagttaatctcatgca

SEQ ID NO: 17722 - DNA, 25 bp, Homo sapien
atctcatgcagttttggggcacctc

SEQ ID NO: 17723 - DNA, 25 bp, Homo sapien
gcagttttggggcacctcttaattc

SEQ ID NO: 17724 - DNA, 25 bp, Homo sapien
tttggggcacctcttaattcatttt

SEQ ID NO: 17725 - DNA, 25 bp, Homo sapien
tcatattgttctacacctgttttgt

SEQ ID NO: 17726 - DNA, 25 bp, Homo sapien
ttgttctacacctgttttgttatgt

SEQ ID NO: 17727 - DNA, 25 bp, Homo sapien
atgtttgttttgtgtccgtatccag

SEQ ID NO: 17728 - DNA, 25 bp, Homo sapien
gttttgtgtccgtatccagaaggat

SEQ ID NO: 17729 - DNA, 25 bp, Homo sapien
cagaaggatagtgatcatgtctagt

SEQ ID NO: 17730 - DNA, 25 bp, Homo sapien
tgtctagtaaatttgtgatcttccc

SEQ ID NO: 17731 - DNA, 25 bp, Homo sapien
gatgaagattgagcggcctgtaaca

SEQ ID NO: 17732 - DNA, 25 bp, Homo sapien
gagcggcctgtaacagtgtttctgc

SEQ ID NO: 17733 - DNA, 25 bp, Homo sapien
ggcctgtaacagtgtttctgcaact

SEQ ID NO: 17734 - DNA, 25 bp, Homo sapien
ttctgcaactgaaacgcaagcgagg

SEQ ID NO: 17735 - DNA, 25 bp, Homo sapien
gcaagcgaggaggggacgtgtctga

SEQ ID NO: 17736 - DNA, 25 bp, Homo sapien
ggaggggacgtgtctgattccaaac

SEQ ID NO: 17737 - DNA, 25 bp, Homo sapien
ttccaaacagttcacctattaccct

SEQ ID NO: 17738 - DNA, 25 bp, Homo sapien
caaacagttcacctattaccctctg

SEQ ID NO: 17739 - DNA, 25 bp, Homo sapien
gttcacctattaccctctggtggaa

SEQ ID NO: 17740 - DNA, 25 bp, Homo sapien
cacctattaccctctggtggaagac

SEQ ID NO: 17741 - DNA, 25 bp, Homo sapien
gaagaggtgcagcggaagcggagga

SEQ ID NO: 17742 - DNA, 25 bp, Homo sapien
gggacagatctgatgatcccaggag

SEQ ID NO: 17743 - DNA, 25 bp, Homo sapien
gatctgatgatcccaggaggctctg

SEQ ID NO: 17744 - DNA, 25 bp, Homo sapien
gaggctctggaggacaatctaggac

SEQ ID NO: 17745 - DNA, 25 bp, Homo sapien
tggaggacaatctaggacctacatt

SEQ ID NO: 17746 - DNA, 25 bp, Homo sapien
ctaggacctacattatctggactgt

SEQ ID NO: 17747 - DNA, 25 bp, Homo sapien
atctggactgtatgctggtcatttc

SEQ ID NO: 17748 - DNA, 25 bp, Homo sapien
gactgtatgctggtcatttctagag

SEQ ID NO: 17749 - DNA, 25 bp, Homo sapien
tggtcatttctagagacagcaatca

SEQ ID NO: 17750 - DNA, 25 bp, Homo sapien
gagacagcaatcaatatttgagtgt

SEQ ID NO: 17751 - DNA, 25 bp, Homo sapien
gtgtaaggaaactgtctggggtgat

SEQ ID NO: 17752 - DNA, 25 bp, Homo sapien
gaaactgtctggggtgattcctaga

SEQ ID NO: 17753 - DNA, 25 bp, Homo sapien
gattttttcctccctaagggcacag

SEQ ID NO: 17754 - DNA, 25 bp, Homo sapien
ggcacagaagtgttccctatgctgg

SEQ ID NO: 17755 - DNA, 25 bp, Homo sapien
tgagagacctcaggttcttctccaa

SEQ ID NO: 17756 - DNA, 25 bp, Homo sapien
tcaatccccagcacttcctgggtga

SEQ ID NO: 17757 - DNA, 25 bp, Homo sapien
gaagcgtgatgcttttgtgcccttc

SEQ ID NO: 17758 - DNA, 25 bp, Homo sapien
tgcccttctccatcagaaagcggaa

SEQ ID NO: 17759 - DNA, 25 bp, Homo sapien
cagaatggagctctttctcttcttc

SEQ ID NO: 17760 - DNA, 25 bp, Homo sapien
agtcctcccagtcacctaaggacat

SEQ ID NO: 17761 - DNA, 25 bp, Homo sapien
aacacgtggtctttgccacgatccc

SEQ ID NO: 17762 - DNA, 25 bp, Homo sapien
cgaaactacaccatgagcttcctgc

SEQ ID NO: 17763 - DNA, 25 bp, Homo sapien
aacagaagcggctcagttcaccttg

SEQ ID NO: 17764 - DNA, 25 bp, Homo sapien
cctttgagccctgaaagtcgaggtt

SEQ ID NO: 17765 - DNA, 25 bp, Homo sapien
tgagccctgaaagtcgaggttgcag

SEQ ID NO: 17766 - DNA, 25 bp, Homo sapien
gctgcgtacctatgcaagtgcctag

SEQ ID NO: 17767 - DNA, 25 bp, Homo sapien
gtacctatgcaagtgcctagctatg

SEQ ID NO: 17768 - DNA, 25 bp, Homo sapien
caagtgcctagctatgaagtcccag

SEQ ID NO: 17769 - DNA, 25 bp, Homo sapien
ctagctatgaagtcccaggcgtaaa

SEQ ID NO: 17770 - DNA, 25 bp, Homo sapien
aggcgtaaagggggatgttctatgc

SEQ ID NO: 17771 - DNA, 25 bp, Homo sapien
atgttctatgccggctgagcgagaa

SEQ ID NO: 17772 - DNA, 25 bp, Homo sapien
ctatgccggctgagcgagaaaaaga

SEQ ID NO: 17773 - DNA, 25 bp, Homo sapien
aacaatctggggaaatggccataca

SEQ ID NO: 17774 - DNA, 25 bp, Homo sapien
aatggccatacatggtggctgacgc

SEQ ID NO: 17775 - DNA, 25 bp, Homo sapien
gtacctggactatgccagagtcccc

SEQ ID NO: 17776 - DNA, 25 bp, Homo sapien
atgccagagtccccaatagcaatcc

SEQ ID NO: 17777 - DNA, 25 bp, Homo sapien
gcctgcgctcttactatgagaccag

SEQ ID NO: 17778 - DNA, 25 bp, Homo sapien
ggcagctcagtaccgagaggcgatg

SEQ ID NO: 17779 - DNA, 25 bp, Homo sapien
ggctgcagctgaagccaaggctagg

SEQ ID NO: 17780 - DNA, 25 bp, Homo sapien
agctcgaatgggcattgggctcggc

SEQ ID NO: 17781 - DNA, 25 bp, Homo sapien
ctgatatcggaccctgggccaaagc

SEQ ID NO: 17782 - DNA, 25 bp, Homo sapien
ccaaagcccggatccaggcgggagc

SEQ ID NO: 17783 - DNA, 25 bp, Homo sapien
gtaccaataacagtgccagtgccag

SEQ ID NO: 17784 - DNA, 25 bp, Homo sapien
agtgccagcaccagtggtggcttca

SEQ ID NO: 17785 - DNA, 25 bp, Homo sapien
caccagtggcagctctggtgcctgt

SEQ ID NO: 17786 - DNA, 25 bp, Homo sapien
atggcatatcaagggtcagatttcc

SEQ ID NO: 17787 - DNA, 25 bp, Homo sapien
gggtcagatttcctgagtttccaag

SEQ ID NO: 17788 - DNA, 25 bp, Homo sapien
ttccaaggaatttcctgggagccat

SEQ ID NO: 17789 - DNA, 25 bp, Homo sapien
gtaaagtgctcaatcgctacctaga

SEQ ID NO: 17790 - DNA, 25 bp, Homo sapien
tgccctcgatttctagcggggctca

SEQ ID NO: 17791 - DNA, 25 bp, Homo sapien
ttctagcggggctcatggaagcagg

SEQ ID NO: 17792 - DNA, 25 bp, Homo sapien
gacgtcctgcctaatgctgacgaga

SEQ ID NO: 17793 - DNA, 25 bp, Homo sapien
gaaacacagcagtctagggggccat

SEQ ID NO: 17794 - DNA, 25 bp, Homo sapien
gggggccatgatctaatcatccatt

SEQ ID NO: 17795 - DNA, 25 bp, Homo sapien
agttaccctggtcatattggttgta

SEQ ID NO: 17796 - DNA, 25 bp, Homo sapien
attggttgtagttgactcacggtta

SEQ ID NO: 17797 - DNA, 25 bp, Homo sapien
agggtagctgtggcttctaggtgcc

SEQ ID NO: 17798 - DNA, 25 bp, Homo sapien
gccaggggtcgccaatcctggaacc

SEQ ID NO: 17799 - DNA, 25 bp, Homo sapien
cctggaaccccactggcttagaggg

SEQ ID NO: 17800 - DNA, 25 bp, Homo sapien
aacatgctgccctctttgtagcagt

SEQ ID NO: 17801 - DNA, 25 bp, Homo sapien
ttattcttcatttcgcctggtaatc

SEQ ID NO: 17802 - DNA, 25 bp, Homo sapien
ttctcttccttcactttgcagaggc

SEQ ID NO: 17803 - DNA, 25 bp, Homo sapien
gcagatcctcaagcagacctacagc

SEQ ID NO: 17804 - DNA, 25 bp, Homo sapien
gacgcactgctcaagaactacgggc

SEQ ID NO: 17805 - DNA, 25 bp, Homo sapien
gctgctctactgcttcaggaaggac

SEQ ID NO: 17806 - DNA, 25 bp, Homo sapien
gacaaggtcgagacattcctgcgca

SEQ ID NO: 17807 - DNA, 25 bp, Homo sapien
gcagtgccgctctgtagagggtagc

SEQ ID NO: 17808 - DNA, 25 bp, Homo sapien
aagcatgatcttgtgtatttgtata

SEQ ID NO: 17809 - DNA, 25 bp, Homo sapien
gagcagcacaccttgaagagtttca

SEQ ID NO: 17810 - DNA, 25 bp, Homo sapien
agatcctgcatagccttcacagaga

SEQ ID NO: 17811 - DNA, 25 bp, Homo sapien
agccttcacagagagtccagttgcc

SEQ ID NO: 17812 - DNA, 25 bp, Homo sapien
tccagttgccaaggtgtgccacagg

SEQ ID NO: 17813 - DNA, 25 bp, Homo sapien
ccacaggcttggaccacgtggttca

SEQ ID NO: 17814 - DNA, 25 bp, Homo sapien
ggaccacgtggttcacagtgggact

SEQ ID NO: 17815 - DNA, 25 bp, Homo sapien
ggactgtgcagtctagctcatgctt

SEQ ID NO: 17816 - DNA, 25 bp, Homo sapien
tgcagtctagctcatgcttatttga

SEQ ID NO: 17817 - DNA, 25 bp, Homo sapien
tgagacggagtttcgctcttgttgc

SEQ ID NO: 17818 - DNA, 25 bp, Homo sapien
cctgctgttttattcatttcctaat

SEQ ID NO: 17819 - DNA, 25 bp, Homo sapien
gattgtgttttattcgtgtcccata

SEQ ID NO: 17820 - DNA, 25 bp, Homo sapien
tccctatcctagcttttaacctgag

SEQ ID NO: 17821 - DNA, 25 bp, Homo sapien
agctcactacacaggttcctggcta

SEQ ID NO: 17822 - DNA, 25 bp, Homo sapien
gttcctggctatcgagtctgaatct

SEQ ID NO: 17823 - DNA, 25 bp, Homo sapien
gtctgaatctgcactactcaactta

SEQ ID NO: 17824 - DNA, 25 bp, Homo sapien
ggcggcaggatctgaactcgcttta

SEQ ID NO: 17825 - DNA, 25 bp, Homo sapien
actcgctttaccttcttgtttggag

SEQ ID NO: 17826 - DNA, 25 bp, Homo sapien
ggtgcggaggatttgttctcggtgc

SEQ ID NO: 17827 - DNA, 25 bp, Homo sapien
tctctgctcctacacacacaaaaga

SEQ ID NO: 17828 - DNA, 25 bp, Homo sapien
aagttgtggaattttctcagcccct

SEQ ID NO: 17829 - DNA, 25 bp, Homo sapien
gatttggtgaagtcggcctcaagtc

SEQ ID NO: 17830 - DNA, 25 bp, Homo sapien
gtgtggccgtggagggcaatgtccg

SEQ ID NO: 17831 - DNA, 25 bp, Homo sapien
gcaatgtccgcaggatggagcgtct

SEQ ID NO: 17832 - DNA, 25 bp, Homo sapien
ggagcgtctgcgggtggagacggac

SEQ ID NO: 17833 - DNA, 25 bp, Homo sapien
cctgtccccaatcagcaagtggtcg

SEQ ID NO: 17834 - DNA, 25 bp, Homo sapien
aatcagcaagtggtcgtgcctggct

SEQ ID NO: 17835 - DNA, 25 bp, Homo sapien
tggggagctggtctcaaggacccag

SEQ ID NO: 17836 - DNA, 25 bp, Homo sapien
tcaaggacccagcatggttccctgg

SEQ ID NO: 17837 - DNA, 25 bp, Homo sapien
ggctccagacacttcacggaaggaa

SEQ ID NO: 17838 - DNA, 25 bp, Homo sapien
gaaggaagatcacatgtccccagag

SEQ ID NO: 17839 - DNA, 25 bp, Homo sapien
gcacccccaggcaagctcgaggggg

SEQ ID NO: 17840 - DNA, 25 bp, Homo sapien
cccagcctattcccgttggctggct

SEQ ID NO: 17841 - DNA, 25 bp, Homo sapien
catggtggcatgcttctgtaatccc

SEQ ID NO: 17842 - DNA, 25 bp, Homo sapien
atggtggcatgcttctgtaatccca

SEQ ID NO: 17843 - DNA, 25 bp, Homo sapien
gctactcaggaggccgagattagag

SEQ ID NO: 17844 - DNA, 25 bp, Homo sapien
gaggccgagattagagaatcacttg

SEQ ID NO: 17845 - DNA, 25 bp, Homo sapien
gaatcacttgaatgtgggagtcgga

SEQ ID NO: 17846 - DNA, 25 bp, Homo sapien
cttgaatgtgggagtcggaggttgt

SEQ ID NO: 17847 - DNA, 25 bp, Homo sapien
gaatgtgggagtcggaggttgtaat

SEQ ID NO: 17848 - DNA, 25 bp, Homo sapien
gtgggagtcggaggttgtaatgagc

SEQ ID NO: 17849 - DNA, 25 bp, Homo sapien
ggagtcggaggttgtaatgagctga

SEQ ID NO: 17850 - DNA, 25 bp, Homo sapien
gtcggaggttgtaatgagctgagat

SEQ ID NO: 17851 - DNA, 25 bp, Homo sapien
gaggttgtaatgagctgagatcaca

SEQ ID NO: 17852 - DNA, 25 bp, Homo sapien
aatatagtggtgatccctcaattgg

SEQ ID NO: 17853 - DNA, 25 bp, Homo sapien
gtggtgatccctcaattggtaacat

SEQ ID NO: 17854 - DNA, 25 bp, Homo sapien
atccctcaattggtaacatatcaga

SEQ ID NO: 17855 - DNA, 25 bp, Homo sapien
aaaactgcacagtggaaggcacttt

SEQ ID NO: 17856 - DNA, 25 bp, Homo sapien
gaaggcactttccatgaatactgag

SEQ ID NO: 17857 - DNA, 25 bp, Homo sapien
gaatgccaaagtaaccagatctaac

SEQ ID NO: 17858 - DNA, 25 bp, Homo sapien
agtaaccagatctaacatgagtcct

SEQ ID NO: 17859 - DNA, 25 bp, Homo sapien
gatctaacatgagtcctgataaacc

SEQ ID NO: 17860 - DNA, 25 bp, Homo sapien
acgtggagctgaaacttcatataga

SEQ ID NO: 17861 - DNA, 25 bp, Homo sapien
gtaagggtgcgatcatggcactata

SEQ ID NO: 17862 - DNA, 25 bp, Homo sapien
gcgatcatggcactatatatagaat

SEQ ID NO: 17863 - DNA, 25 bp, Homo sapien
tcctgcagtcggtgctggaggactt

SEQ ID NO: 17864 - DNA, 25 bp, Homo sapien
gccaccgagcggcagtacgagctgc

SEQ ID NO: 17865 - DNA, 25 bp, Homo sapien
ccgagcggcagtacgagctgcagcc

SEQ ID NO: 17866 - DNA, 25 bp, Homo sapien
ttctcagacccggaatccagtgggc

SEQ ID NO: 17867 - DNA, 25 bp, Homo sapien
agacccggaatccagtgggcagagg

SEQ ID NO: 17868 - DNA, 25 bp, Homo sapien
ctcgcacggtcatccggagtactaa

SEQ ID NO: 17869 - DNA, 25 bp, Homo sapien
cacggtcatccggagtactaagccc

SEQ ID NO: 17870 - DNA, 25 bp, Homo sapien
aggactggtaagcgactgtcatcaa

SEQ ID NO: 17871 - DNA, 25 bp, Homo sapien
gtaagcgactgtcatcaagtaaggc

SEQ ID NO: 17872 - DNA, 25 bp, Homo sapien
ccccgctacagaagccagactgggt

SEQ ID NO: 17873 - DNA, 25 bp, Homo sapien
tacagaagccagactgggtcccgcg

SEQ ID NO: 17874 - DNA, 25 bp, Homo sapien
agggcagctgtggcttctaggtgcc

SEQ ID NO: 17875 - DNA, 25 bp, Homo sapien
ttctaggtgcccgagtagcatcctg

SEQ ID NO: 17876 - DNA, 25 bp, Homo sapien
gctgggggagagaaatactgctgcc

SEQ ID NO: 17877 - DNA, 25 bp, Homo sapien
gtaaggcgctgacccaagagaactc

SEQ ID NO: 17878 - DNA, 25 bp, Homo sapien
gagaactcaccttattcttcatttc

SEQ ID NO: 17879 - DNA, 25 bp, Homo sapien
tcatttcgcctggtgaatcctccag

SEQ ID NO: 17880 - DNA, 25 bp, Homo sapien
ttctcttccttcactttgcagaggc

SEQ ID NO: 17881 - DNA, 25 bp, Homo sapien
gcagatcctcaagcagacctacagc

SEQ ID NO: 17882 - DNA, 25 bp, Homo sapien
gacgcactgctcaagaactacgggc

SEQ ID NO: 17883 - DNA, 25 bp, Homo sapien
gctgctctactgcttcaggaaggac

SEQ ID NO: 17884 - DNA, 25 bp, Homo sapien
gacaaggtcgagacattcctgcgca

SEQ ID NO: 17885 - DNA, 25 bp, Homo sapien
tgaaaatggaccagccgcagtgctc

SEQ ID NO: 17886 - DNA, 25 bp, Homo sapien
gtttgaaactagcctggccaacgtg

SEQ ID NO: 17887 - DNA, 25 bp, Homo sapien
ggccaacgtggcaaaactccatctc

SEQ ID NO: 17888 - DNA, 25 bp, Homo sapien
cccagctacttgggatgccgaggca

SEQ ID NO: 17889 - DNA, 25 bp, Homo sapien
tgtagggtttcaccagtctttccca

SEQ ID NO: 17890 - DNA, 25 bp, Homo sapien
ctttcccagggaactccgatgaagt

SEQ ID NO: 17891 - DNA, 25 bp, Homo sapien
ggagataatctccaggatgcctgtg

SEQ ID NO: 17892 - DNA, 25 bp, Homo sapien
gcctgtgaagaaagatccctggatc

SEQ ID NO: 17893 - DNA, 25 bp, Homo sapien
aagttgttcataatccagcaggcca

SEQ ID NO: 17894 - DNA, 25 bp, Homo sapien
tccagcaggccagaagacttccagg

SEQ ID NO: 17895 - DNA, 25 bp, Homo sapien
gacttccagggaaactcattcaagg

SEQ ID NO: 17896 - DNA, 25 bp, Homo sapien
aagcgcagccgcaaggagagctact

SEQ ID NO: 17897 - DNA, 25 bp, Homo sapien
gagagctactccgtatacgtgtaca

SEQ ID NO: 17898 - DNA, 25 bp, Homo sapien
atgcctgagccagcgaaatccgctc

SEQ ID NO: 17899 - DNA, 25 bp, Homo sapien
gcatctcctctaaagccatggggat

SEQ ID NO: 17900 - DNA, 25 bp, Homo sapien
tgtcaacgacatcttcgagcgcatc

SEQ ID NO: 17901 - DNA, 25 bp, Homo sapien
gcattacaacaagcgctcgaccatc

SEQ ID NO: 17902 - DNA, 25 bp, Homo sapien
tcgaccatcacctccagggagatcc

SEQ ID NO: 17903 - DNA, 25 bp, Homo sapien
ggccaagcacgctgtgtcagagggc

SEQ ID NO: 17904 - DNA, 25 bp, Homo sapien
gtcagagggcaccaaggccgttacc

SEQ ID NO: 17905 - DNA, 25 bp, Homo sapien
ttaccaagtacaccagctccaagta

SEQ ID NO: 17906 - DNA, 25 bp, Homo sapien
gaagggctccaagaaggccgtgacc

SEQ ID NO: 17907 - DNA, 25 bp, Homo sapien
gagcgcaaaggatagtggacacact

SEQ ID NO: 17908 - DNA, 25 bp, Homo sapien
tctttgtgcgttgcttttccaagga

SEQ ID NO: 17909 - DNA, 25 bp, Homo sapien
gtttgaagtctaatgtccctacagc

SEQ ID NO: 17910 - DNA, 25 bp, Homo sapien
cctacagccctctaagtctttgagg

SEQ ID NO: 17911 - DNA, 25 bp, Homo sapien
gtctttgagggctttagggtcaggc

SEQ ID NO: 17912 - DNA, 25 bp, Homo sapien
agggtcaggcctttggtatcagtct

SEQ ID NO: 17913 - DNA, 25 bp, Homo sapien
accacggtcagtttactcaacatac

SEQ ID NO: 17914 - DNA, 25 bp, Homo sapien
aggaactggatgtgactgtcattgc

SEQ ID NO: 17915 - DNA, 25 bp, Homo sapien
gtcattgctggagcctgtttgcagt

SEQ ID NO: 17916 - DNA, 25 bp, Homo sapien
aataaaattgctcactgggcacggt

SEQ ID NO: 17917 - DNA, 25 bp, Homo sapien
gatggcttgagcccataatcatgcc

SEQ ID NO: 17918 - DNA, 25 bp, Homo sapien
aattcataccaaacagaagccctac

SEQ ID NO: 17919 - DNA, 25 bp, Homo sapien
ctataacaagttctcaattcctttt

SEQ ID NO: 17920 - DNA, 25 bp, Homo sapien
tcactcttgtcaccgaggctggagt

SEQ ID NO: 17921 - DNA, 25 bp, Homo sapien
gtgcaatgacatgatctccgttcac

SEQ ID NO: 17922 - DNA, 25 bp, Homo sapien
ctgggtttaagccattcttctgcct

SEQ ID NO: 17923 - DNA, 25 bp, Homo sapien
aaccaatctgcaaaccttactacac

SEQ ID NO: 17924 - DNA, 25 bp, Homo sapien
ggcaaagcttttaactggtcctcag

SEQ ID NO: 17925 - DNA, 25 bp, Homo sapien
aatgttcctccacttttaattagca

SEQ ID NO: 17926 - DNA, 25 bp, Homo sapien
tgtgggaaagcctttaaccagccct

SEQ ID NO: 17927 - DNA, 25 bp, Homo sapien
cagccctcgactcttagtaaatttg

SEQ ID NO: 17928 - DNA, 25 bp, Homo sapien
ggaagttctcaacccttattacaca

SEQ ID NO: 17929 - DNA, 25 bp, Homo sapien
ccgcaggaagccggagctggtcctg

SEQ ID NO: 17930 - DNA, 25 bp, Homo sapien
gcaggaagccggagctggtcctgcg

SEQ ID NO: 17931 - DNA, 25 bp, Homo sapien
gcccctgagctgagttctgcagaga

SEQ ID NO: 17932 - DNA, 25 bp, Homo sapien
agctgagttctgcagagacccactc

SEQ ID NO: 17933 - DNA, 25 bp, Homo sapien
gagttctgcagagacccactctgac

SEQ ID NO: 17934 - DNA, 25 bp, Homo sapien
actaaaatgacccctgattcatcaa

SEQ ID NO: 17935 - DNA, 25 bp, Homo sapien
atgacccctgattcatcaaaagtga

SEQ ID NO: 17936 - DNA, 25 bp, Homo sapien
cctagatatctactcaaaataattg

SEQ ID NO: 17937 - DNA, 25 bp, Homo sapien
gttcaaacagaaagacgcttgtgcg

SEQ ID NO: 17938 - DNA, 25 bp, Homo sapien
ccttgaatgcatgatactgaatgaa

SEQ ID NO: 17939 - DNA, 25 bp, Homo sapien
agatgcaaaaggtcacatagtgtac

SEQ ID NO: 17940 - DNA, 25 bp, Homo sapien
gttgcgagacgttgagctgcggaag

SEQ ID NO: 17941 - DNA, 25 bp, Homo sapien
ggggctgcgacaaagatggcggccg

SEQ ID NO: 17942 - DNA, 25 bp, Homo sapien
cagtgagcgaggggacccagcacga

SEQ ID NO: 17943 - DNA, 25 bp, Homo sapien
cccgagtcaggaggccgagctggag

SEQ ID NO: 17944 - DNA, 25 bp, Homo sapien
gatgagtccaaagccgagagcctcg

SEQ ID NO: 17945 - DNA, 25 bp, Homo sapien
tgactgtgtggatggccagcttttc

SEQ ID NO: 17946 - DNA, 25 bp, Homo sapien
agagcagcgactaagttcaggccca

SEQ ID NO: 17947 - DNA, 25 bp, Homo sapien
agagatctcaccagcggggtgcttg

SEQ ID NO: 17948 - DNA, 25 bp, Homo sapien
ggggtgcttgccattctgaagataa

SEQ ID NO: 17949 - DNA, 25 bp, Homo sapien
gacctccggccaaggccacggaggc

SEQ ID NO: 17950 - DNA, 25 bp, Homo sapien
gaaagaggaagtcctcctctcagcc

SEQ ID NO: 17951 - DNA, 25 bp, Homo sapien
tcctatccacagacggacgtcttcc

SEQ ID NO: 17952 - DNA, 25 bp, Homo sapien
atccacagacggacgtcttcctcat

SEQ ID NO: 17953 - DNA, 25 bp, Homo sapien
tcagcccagcctcttatgagaacgt

SEQ ID NO: 17954 - DNA, 25 bp, Homo sapien
cccagcctcttatgagaacgtccgc

SEQ ID NO: 17955 - DNA, 25 bp, Homo sapien
gcgccaagtggttcccagaagtgcg

SEQ ID NO: 17956 - DNA, 25 bp, Homo sapien
caagtggttcccagaagtgcggcac

SEQ ID NO: 17957 - DNA, 25 bp, Homo sapien
gtggttcccagaagtgcggcaccac

SEQ ID NO: 17958 - DNA, 25 bp, Homo sapien
ggacctgcgggacgacaaggacacc

SEQ ID NO: 17959 - DNA, 25 bp, Homo sapien
gacaaggacaccatcgagaaactga

SEQ ID NO: 17960 - DNA, 25 bp, Homo sapien
cactggccaaggagattgactcggt

SEQ ID NO: 17961 - DNA, 25 bp, Homo sapien
gattgactcggtgaaatacctggag

SEQ ID NO: 17962 - DNA, 25 bp, Homo sapien
cccacatcatgtatcacttttttct

SEQ ID NO: 17963 - DNA, 25 bp, Homo sapien
aacccacactgcagcagatcagcca

SEQ ID NO: 17964 - DNA, 25 bp, Homo sapien
atcgcccagcagcttgggctcgaga

SEQ ID NO: 17965 - DNA, 25 bp, Homo sapien
gatgtggtccgagtgtggttctgta

SEQ ID NO: 17966 - DNA, 25 bp, Homo sapien
gtaaccggcgccagaagggcaagcg

SEQ ID NO: 17967 - DNA, 25 bp, Homo sapien
gggcaagcgatcaagcagcgactat

SEQ ID NO: 17968 - DNA, 25 bp, Homo sapien
aggattttgaggctgctgggtctcc

SEQ ID NO: 17969 - DNA, 25 bp, Homo sapien
tctcagggggaccagtgtcctttcc

SEQ ID NO: 17970 - DNA, 25 bp, Homo sapien
tttggtgccccaggctatgggagcc

SEQ ID NO: 17971 - DNA, 25 bp, Homo sapien
gctctcccttgcattcaaactgagg

SEQ ID NO: 17972 - DNA, 25 bp, Homo sapien
ctgcctgcccttctaggaatggggg

SEQ ID NO: 17973 - DNA, 25 bp, Homo sapien
cagatccaaagctgtcttctgtcca

SEQ ID NO: 17974 - DNA, 25 bp, Homo sapien
tgcagggcccaaggtcaacggaaca

SEQ ID NO: 17975 - DNA, 25 bp, Homo sapien
atgactctccctacgagtggtcaaa

SEQ ID NO: 17976 - DNA, 25 bp, Homo sapien
gtgacccactgcttgtttctgtcac

SEQ ID NO: 17977 - DNA, 25 bp, Homo sapien
ttcaaatagttggccttcacccact

SEQ ID NO: 17978 - DNA, 25 bp, Homo sapien
ccactgaaccaagctccaaaaccgg

SEQ ID NO: 17979 - DNA, 25 bp, Homo sapien
gacacctacacgttctgattgggac

SEQ ID NO: 17980 - DNA, 25 bp, Homo sapien
tgggacctcagtggtcaaactccct

SEQ ID NO: 17981 - DNA, 25 bp, Homo sapien
tcatcgctggtgctccgacaaaaaa

SEQ ID NO: 17982 - DNA, 25 bp, Homo sapien
taatggaccaagggcctgcggggaa

SEQ ID NO: 17983 - DNA, 25 bp, Homo sapien
acacccccaacagatagcagcatgt

SEQ ID NO: 17984 - DNA, 25 bp, Homo sapien
aaattggatctgtgtaccgactccc

SEQ ID NO: 17985 - DNA, 25 bp, Homo sapien
aaaaggtgaggtgctgccacttcct

SEQ ID NO: 17986 - DNA, 25 bp, Homo sapien
gcaccacaaacatcctctaaagcca

SEQ ID NO: 17987 - DNA, 25 bp, Homo sapien
taaagccagacaatcagccctttcc

SEQ ID NO: 17988 - DNA, 25 bp, Homo sapien
atcagtctctgaatcatgtccaggg

SEQ ID NO: 17989 - DNA, 25 bp, Homo sapien
gttcttttcaacctactttcatact

SEQ ID NO: 17990 - DNA, 25 bp, Homo sapien
agtagttaattctgtcactcaccac

SEQ ID NO: 17991 - DNA, 25 bp, Homo sapien
cactcaccactacatcacttgagac

SEQ ID NO: 17992 - DNA, 25 bp, Homo sapien
aatctatgccactcagaatctcctt

SEQ ID NO: 17993 - DNA, 25 bp, Homo sapien
ctagagtctctgttactgcttgggc

SEQ ID NO: 17994 - DNA, 25 bp, Homo sapien
ttgggctatacctgggcatactaat

SEQ ID NO: 17995 - DNA, 25 bp, Homo sapien
ggacatctggtgtaagagccctctc

SEQ ID NO: 17996 - DNA, 25 bp, Homo sapien
gcacctgcaggaatttacactccac

SEQ ID NO: 17997 - DNA, 25 bp, Homo sapien
caggaatttacactccactggtctc

SEQ ID NO: 17998 - DNA, 25 bp, Homo sapien
cctgggccgagctggttaggtgagc

SEQ ID NO: 17999 - DNA, 25 bp, Homo sapien
ggtgagctccataaaacccaaaggg

SEQ ID NO: 18000 - DNA, 25 bp, Homo sapien
acccaaagggacttggtgtcaggag

SEQ ID NO: 18001 - DNA, 25 bp, Homo sapien
gagggggctgagtgacagagatggt

SEQ ID NO: 18002 - DNA, 25 bp, Homo sapien
gagatggttcagctggtaccagagt

SEQ ID NO: 18003 - DNA, 25 bp, Homo sapien
gaaacaaggtgcatcctggggttgg

SEQ ID NO: 18004 - DNA, 25 bp, Homo sapien
gggcagattgtaaacgtcgtctcaa

SEQ ID NO: 18005 - DNA, 25 bp, Homo sapien
tgaaatgctgccgggtgcggtgact

SEQ ID NO: 18006 - DNA, 25 bp, Homo sapien
atagtggatacttcggatctgcccg

SEQ ID NO: 18007 - DNA, 25 bp, Homo sapien
tgcccgatccctgataagtagctgg

SEQ ID NO: 18008 - DNA, 25 bp, Homo sapien
agaaggcaactcctctgggggattt

SEQ ID NO: 18009 - DNA, 25 bp, Homo sapien
ctctgggggatttgaaccggtctgt

SEQ ID NO: 18010 - DNA, 25 bp, Homo sapien
ctcgcgctcagaaaaggaccttgtg

SEQ ID NO: 18011 - DNA, 25 bp, Homo sapien
aagcggcagaaggcggacgcgtgcc

SEQ ID NO: 18012 - DNA, 25 bp, Homo sapien
tgagcacacctgacacgttttataa

SEQ ID NO: 18013 - DNA, 25 bp, Homo sapien
ataatagactagccacacttcactc

SEQ ID NO: 18014 - DNA, 25 bp, Homo sapien
acatgatttttcttccttaaacttg

SEQ ID NO: 18015 - DNA, 25 bp, Homo sapien
cacacacacgtggggatagctggac

SEQ ID NO: 18016 - DNA, 25 bp, Homo sapien
atgcaattctgatatcttctttcta

SEQ ID NO: 18017 - DNA, 25 bp, Homo sapien
ggacagctcacctagtggcaatggc

SEQ ID NO: 18018 - DNA, 25 bp, Homo sapien
gcagatcctcaagcagacctacagc

SEQ ID NO: 18019 - DNA, 25 bp, Homo sapien
gtttgacacaaactcacacaaccat

SEQ ID NO: 18020 - DNA, 25 bp, Homo sapien
cacaaccatgacgcactgctcaaga

SEQ ID NO: 18021 - DNA, 25 bp, Homo sapien
tgctcaagaactacgggctgctcta

SEQ ID NO: 18022 - DNA, 25 bp, Homo sapien
gctgctctactgcttcaggaaggac

SEQ ID NO: 18023 - DNA, 25 bp, Homo sapien
gacaaggtcgagacattcctgcgca

SEQ ID NO: 18024 - DNA, 25 bp, Homo sapien
gcagtgccgctctgtagagggtagc

SEQ ID NO: 18025 - DNA, 25 bp, Homo sapien
agggtagctgtggcttctaggtgcc

SEQ ID NO: 18026 - DNA, 25 bp, Homo sapien
acaagagaccggctctaggatccca

SEQ ID NO: 18027 - DNA, 25 bp, Homo sapien
gaaccactcagggtcctgtggacag

SEQ ID NO: 18028 - DNA, 25 bp, Homo sapien
gggccatgggaatctcacaggaaaa

SEQ ID NO: 18029 - DNA, 25 bp, Homo sapien
tattcttggcaaaagatgaccttac

SEQ ID NO: 18030 - DNA, 25 bp, Homo sapien
aagcaacaggctgggcagcggctca

SEQ ID NO: 18031 - DNA, 25 bp, Homo sapien
ggcgggtggattacctgaagtcagg

SEQ ID NO: 18032 - DNA, 25 bp, Homo sapien
tggtgtggtggcaggcgcacgaaat

SEQ ID NO: 18033 - DNA, 25 bp, Homo sapien
gccgaagcgtgtggatcacctgaag

SEQ ID NO: 18034 - DNA, 25 bp, Homo sapien
gagaatcacttgaactccggaggtg

SEQ ID NO: 18035 - DNA, 25 bp, Homo sapien
ccggaggtggaagttgcagtgaggt

SEQ ID NO: 18036 - DNA, 25 bp, Homo sapien
caaatgcaaaactatactctagaga

SEQ ID NO: 18037 - DNA, 25 bp, Homo sapien
ctctagagaagtatccacacccagg

SEQ ID NO: 18038 - DNA, 25 bp, Homo sapien
tccacacccagggccatgggaatct

SEQ ID NO: 18039 - DNA, 25 bp, Homo sapien
tttcaaacccagtagagttacctca

SEQ ID NO: 18040 - DNA, 25 bp, Homo sapien
aacccagtagagttacctcaaagat

SEQ ID NO: 18041 - DNA, 25 bp, Homo sapien
tttcagaagatggcaccgaaagtga

SEQ ID NO: 18042 - DNA, 25 bp, Homo sapien
gcaccgaaagtgaagaaggaagctc

SEQ ID NO: 18043 - DNA, 25 bp, Homo sapien
ccactgagtttgctatgaagaagat

SEQ ID NO: 18044 - DNA, 25 bp, Homo sapien
gctctgtgacattgatggggccaag

SEQ ID NO: 18045 - DNA, 25 bp, Homo sapien
ctgtgacattgatggggccaaggtc

SEQ ID NO: 18046 - DNA, 25 bp, Homo sapien
gatgaaggcatatgttccactggct

SEQ ID NO: 18047 - DNA, 25 bp, Homo sapien
gatcatccaaactgagtccatctgg

SEQ ID NO: 18048 - DNA, 25 bp, Homo sapien
aactgagtccatctggctaattcta

SEQ ID NO: 18049 - DNA, 25 bp, Homo sapien
gtccatctggctaattctaaatata

SEQ ID NO: 18050 - DNA, 25 bp, Homo sapien
agtttcttggcgatgaacagagacc

SEQ ID NO: 18051 - DNA, 25 bp, Homo sapien
tggcatggttgctctattggactac

SEQ ID NO: 18052 - DNA, 25 bp, Homo sapien
ctaccgtgaggatggtgtgacccca

SEQ ID NO: 18053 - DNA, 25 bp, Homo sapien
ggatctatcacctgtcatcataact

SEQ ID NO: 18054 - DNA, 25 bp, Homo sapien
tcataactggcttctgcttgtcatc

SEQ ID NO: 18055 - DNA, 25 bp, Homo sapien
tcatccacacaacaccaggacttaa

SEQ ID NO: 18056 - DNA, 25 bp, Homo sapien
gactgatgtcatcttgagctcttca

SEQ ID NO: 18057 - DNA, 25 bp, Homo sapien
tctcttctcttttttataccatctg

SEQ ID NO: 18058 - DNA, 25 bp, Homo sapien
tataccatctggccagctacgatgc

SEQ ID NO: 18059 - DNA, 25 bp, Homo sapien
gctacgatgctggtggtgaagcctt

SEQ ID NO: 18060 - DNA, 25 bp, Homo sapien
aagccttggtctcctgtggaatgat

SEQ ID NO: 18061 - DNA, 25 bp, Homo sapien
tcggctgctacgaacctatctgaga

SEQ ID NO: 18062 - DNA, 25 bp, Homo sapien
tgctacgaacctatctgagagacaa

SEQ ID NO: 18063 - DNA, 25 bp, Homo sapien
gagagacaagtgaccatttggtttc

SEQ ID NO: 18064 - DNA, 25 bp, Homo sapien
acaagaaaattgtctccaagctcaa

SEQ ID NO: 18065 - DNA, 25 bp, Homo sapien
gtctccaagctcaaagatactgtct

SEQ ID NO: 18066 - DNA, 25 bp, Homo sapien
gatgtggctctaaatcagccggaca

SEQ ID NO: 18067 - DNA, 25 bp, Homo sapien
ccggacatgtgcgtctaccgaagag

SEQ ID NO: 18068 - DNA, 25 bp, Homo sapien
gtgcgtctaccgaagagggaggaag

SEQ ID NO: 18069 - DNA, 25 bp, Homo sapien
agagagtgccttacaccaaactgca

SEQ ID NO: 18070 - DNA, 25 bp, Homo sapien
caaactgcagcttaaagaactggag

SEQ ID NO: 18071 - DNA, 25 bp, Homo sapien
gaactggagaacgagtatgccatta

SEQ ID NO: 18072 - DNA, 25 bp, Homo sapien
aaatgagcagaatctctccttcctc

SEQ ID NO: 18073 - DNA, 25 bp, Homo sapien
ctccttcctcctgtctgatggacag

SEQ ID NO: 18074 - DNA, 25 bp, Homo sapien
gacagacatgactttggatttcccc

SEQ ID NO: 18075 - DNA, 25 bp, Homo sapien
tggcaaccagttccagaaggctcca

SEQ ID NO: 18076 - DNA, 25 bp, Homo sapien
gctgatccagcagatcttcaacctc

SEQ ID NO: 18077 - DNA, 25 bp, Homo sapien
ggacctcctagacaaattctgcacc

SEQ ID NO: 18078 - DNA, 25 bp, Homo sapien
aactcccctgatgaatgcggactcc

SEQ ID NO: 18079 - DNA, 25 bp, Homo sapien
acttccgaagaatcactctctatct

SEQ ID NO: 18080 - DNA, 25 bp, Homo sapien
agaaatacagcccttgtgcctggga

SEQ ID NO: 18081 - DNA, 25 bp, Homo sapien
tgagatccctctctttatcaacaaa

SEQ ID NO: 18082 - DNA, 25 bp, Homo sapien
tgcaatatctatgatggcctcgccc

SEQ ID NO: 18083 - DNA, 25 bp, Homo sapien
acctagtggcaatggctccaggctc

SEQ ID NO: 18084 - DNA, 25 bp, Homo sapien
gccctggcttcaagaggctggtgcc

SEQ ID NO: 18085 - DNA, 25 bp, Homo sapien
tccgttatccaggctttttgaccac

SEQ ID NO: 18086 - DNA, 25 bp, Homo sapien
gcagatcctcaagcagacctacagc

SEQ ID NO: 18087 - DNA, 25 bp, Homo sapien
gacgcactgctcaagaactacgggc

SEQ ID NO: 18088 - DNA, 25 bp, Homo sapien
gctgctctactgcttcaggaaggac

SEQ ID NO: 18089 - DNA, 25 bp, Homo sapien
gacaaggtcgagacattcctgcgca

SEQ ID NO: 18090 - DNA, 25 bp, Homo sapien
agggcagctgtggcttctaggtgcc

SEQ ID NO: 18091 - DNA, 25 bp, Homo sapien
ttctaggtgcccgagtagcatcctg

SEQ ID NO: 18092 - DNA, 25 bp, Homo sapien
acaagagaccggctctaggatccca

SEQ ID NO: 18093 - DNA, 25 bp, Homo sapien
gaaccactcagggtcctgtggacag

SEQ ID NO: 18094 - DNA, 25 bp, Homo sapien
cacaggggcctgaacggctctagtg

SEQ ID NO: 18095 - DNA, 25 bp, Homo sapien
tagtgagcttatgtggctggccagc

SEQ ID NO: 18096 - DNA, 25 bp, Homo sapien
agccctgaacgaattcctgctgtgt

SEQ ID NO: 18097 - DNA, 25 bp, Homo sapien
cctgctgtgtatcaggcctggggac

SEQ ID NO: 18098 - DNA, 25 bp, Homo sapien
gacacagtgatgaccaagacaggcc

SEQ ID NO: 18099 - DNA, 25 bp, Homo sapien
gacagccaacaaggacctcttttaa

SEQ ID NO: 18100 - DNA, 25 bp, Homo sapien
taaaagatgcaccctgccacaaagc

SEQ ID NO: 18101 - DNA, 25 bp, Homo sapien
tgttcactgctgtagcccagcttac

SEQ ID NO: 18102 - DNA, 25 bp, Homo sapien
ataatggtcgccacacagtaagcac

SEQ ID NO: 18103 - DNA, 25 bp, Homo sapien
gaggtcacgagttcaggactagcct

SEQ ID NO: 18104 - DNA, 25 bp, Homo sapien
tgttgaacctgggcagctgatgctg

SEQ ID NO: 18105 - DNA, 25 bp, Homo sapien
aaagaggctatgctccaagcccatc

SEQ ID NO: 18106 - DNA, 25 bp, Homo sapien
ttggggaatggactctattccgaca

SEQ ID NO: 18107 - DNA, 25 bp, Homo sapien
gaaatccaacttagagctgctccac

SEQ ID NO: 18108 - DNA, 25 bp, Homo sapien
ttcctcaggagtaccttcaccaaca

SEQ ID NO: 18109 - DNA, 25 bp, Homo sapien
gacacctcggacagcgatgactatc

SEQ ID NO: 18110 - DNA, 25 bp, Homo sapien
gatgactatcacctcctaaaggacc

SEQ ID NO: 18111 - DNA, 25 bp, Homo sapien
ctgactgggcagaccctcaagcaga

SEQ ID NO: 18112 - DNA, 25 bp, Homo sapien
agcagacctacagcaagtttgacac

SEQ ID NO: 18113 - DNA, 25 bp, Homo sapien
gtttgacacaaactcgcacaaccat

SEQ ID NO: 18114 - DNA, 25 bp, Homo sapien
gacgcactgctcaagaactacgggc

SEQ ID NO: 18115 - DNA, 25 bp, Homo sapien
gacaaggtcgagacattcctgcgca

SEQ ID NO: 18116 - DNA, 25 bp, Homo sapien
gggttcaggccaggtcttttgatgg

SEQ ID NO: 18117 - DNA, 25 bp, Homo sapien
ccaggtcttttgatggccaggagta

SEQ ID NO: 18118 - DNA, 25 bp, Homo sapien
ggccaggagtagatgacagggagtt

SEQ ID NO: 18119 - DNA, 25 bp, Homo sapien
tgccttggggaacctttggtgtgcc

SEQ ID NO: 18120 - DNA, 25 bp, Homo sapien
tggggaacctttggtgtgccaagag

SEQ ID NO: 18121 - DNA, 25 bp, Homo sapien
ggtagatgggagtggggctcggtcc

SEQ ID NO: 18122 - DNA, 25 bp, Homo sapien
tagatgggagtggggctcggtcccc

SEQ ID NO: 18123 - DNA, 25 bp, Homo sapien
gtggtttgaatgtttgagtcccaac

SEQ ID NO: 18124 - DNA, 25 bp, Homo sapien
gagtcccaacaaaattcatatcaaa

SEQ ID NO: 18125 - DNA, 25 bp, Homo sapien
acataatcccaactgggtgcagtgg

SEQ ID NO: 18126 - DNA, 25 bp, Homo sapien
taggtcaggaaatccagaccgtcct

SEQ ID NO: 18127 - DNA, 25 bp, Homo sapien
gaacctatgagacctacatgtgctg

SEQ ID NO: 18128 - DNA, 25 bp, Homo sapien
tacatgtgctgcagagggctctttc

SEQ ID NO: 18129 - DNA, 25 bp, Homo sapien
gagggctctttcagagtacttctct

SEQ ID NO: 18130 - DNA, 25 bp, Homo sapien
ttcagtgctatggcccttactaact

SEQ ID NO: 18131 - DNA, 25 bp, Homo sapien
gcccttactaactgctgtggattct

SEQ ID NO: 18132 - DNA, 25 bp, Homo sapien
gtggattctacaacaataccgtctg

SEQ ID NO: 18133 - DNA, 25 bp, Homo sapien
ataccgtctgtgcctaaggctgctt

SEQ ID NO: 18134 - DNA, 25 bp, Homo sapien
aaggctgcttgatctatttctataa

SEQ ID NO: 18135 - DNA, 25 bp, Homo sapien
ggtgtttatgtactcagggtgccca

SEQ ID NO: 18136 - DNA, 25 bp, Homo sapien
gattcattttgggccgggctcagtg

SEQ ID NO: 18137 - DNA, 25 bp, Homo sapien
gggagtggtgtcgggcgactgtagt

SEQ ID NO: 18138 - DNA, 25 bp, Homo sapien
gagacagcagattcttgccttggtg

SEQ ID NO: 18139 - DNA, 25 bp, Homo sapien
aggtcattgctgtgccatatgtcct

SEQ ID NO: 18140 - DNA, 25 bp, Homo sapien
tacccccctgtcttcatgcagggaa

SEQ ID NO: 18141 - DNA, 25 bp, Homo sapien
aaatgggggctacatatgccctctc

SEQ ID NO: 18142 - DNA, 25 bp, Homo sapien
tcctccccgtctacaagagttgtgg

SEQ ID NO: 18143 - DNA, 25 bp, Homo sapien
gagttgtggttttccatctgatcct

SEQ ID NO: 18144 - DNA, 25 bp, Homo sapien
gggggcctggtatctcaggcagatt

SEQ ID NO: 18145 - DNA, 25 bp, Homo sapien
ttgttgaattcctgttctatccctt

SEQ ID NO: 18146 - DNA, 25 bp, Homo sapien
cccaccctgccttgataatatgtta

SEQ ID NO: 18147 - DNA, 25 bp, Homo sapien
tatgttagcccataccccaaataac

SEQ ID NO: 18148 - DNA, 25 bp, Homo sapien
tgagggagggctgggtcttagggaa

SEQ ID NO: 18149 - DNA, 25 bp, Homo sapien
tggagaccacctgactgaggctagt

SEQ ID NO: 18150 - DNA, 25 bp, Homo sapien
aggctagtgggaagcttcacctgct

SEQ ID NO: 18151 - DNA, 25 bp, Homo sapien
ttcacctgctggataagctactagc

SEQ ID NO: 18152 - DNA, 25 bp, Homo sapien
tagcattcctgtattctgggggcca

SEQ ID NO: 18153 - DNA, 25 bp, Homo sapien
ttacttttctcccaaatgacccaga

SEQ ID NO: 18154 - DNA, 25 bp, Homo sapien
gaccttgtcagagttctcagtagtc

SEQ ID NO: 18155 - DNA, 25 bp, Homo sapien
cagaacagcctccaagagctctact

SEQ ID NO: 18156 - DNA, 25 bp, Homo sapien
gaactgcacaaactcttgcagccat

SEQ ID NO: 18157 - DNA, 25 bp, Homo sapien
gctgaggtagctacagagcttccca

SEQ ID NO: 18158 - DNA, 25 bp, Homo sapien
tacagaacattttgtcccagcttcg

SEQ ID NO: 18159 - DNA, 25 bp, Homo sapien
tgtggagccggagccttttgaagtt

SEQ ID NO: 18160 - DNA, 25 bp, Homo sapien
ttccaacatcctgcaggggctgtgg

SEQ ID NO: 18161 - DNA, 25 bp, Homo sapien
gacagaggcctgcagtggaggtcca

SEQ ID NO: 18162 - DNA, 25 bp, Homo sapien
gaaaacctctatgctgccgtgaagc

SEQ ID NO: 18163 - DNA, 25 bp, Homo sapien
cactcggagcccacacgatgaagac

SEQ ID NO: 18164 - DNA, 25 bp, Homo sapien
acccccaggcagtgacgtatgccga

SEQ ID NO: 18165 - DNA, 25 bp, Homo sapien
atgccgaggtgaaacactccagacc

SEQ ID NO: 18166 - DNA, 25 bp, Homo sapien
ggagagaaatggcctctcctccttc

SEQ ID NO: 18167 - DNA, 25 bp, Homo sapien
cccactgtctggggaattcctggac

SEQ ID NO: 18168 - DNA, 25 bp, Homo sapien
gatggacactgaggctgctgcatct

SEQ ID NO: 18169 - DNA, 25 bp, Homo sapien
agacggaaggcaactgagcctcctc

SEQ ID NO: 18170 - DNA, 25 bp, Homo sapien
gtctggaatgcatgggagctgcccc

SEQ ID NO: 18171 - DNA, 25 bp, Homo sapien
tgaagctaaactatgaggtcatgac

SEQ ID NO: 18172 - DNA, 25 bp, Homo sapien
actatgaggtcatgactaaactagg

SEQ ID NO: 18173 - DNA, 25 bp, Homo sapien
tttcatgcgtagtaaacgggctgca

SEQ ID NO: 18174 - DNA, 25 bp, Homo sapien
tagtaaacgggctgcagacttccac

SEQ ID NO: 18175 - DNA, 25 bp, Homo sapien
ggctgcagacttccacgggaatgat

SEQ ID NO: 18176 - DNA, 25 bp, Homo sapien
acgggaatgattttggtaacgatcg

SEQ ID NO: 18177 - DNA, 25 bp, Homo sapien
ggtaacgatcgaaaccacaggaatc

SEQ ID NO: 18178 - DNA, 25 bp, Homo sapien
tgactttcggcagcctccagagaat

SEQ ID NO: 18179 - DNA, 25 bp, Homo sapien
tttcggcagcctccagagaatcttc

SEQ ID NO: 18180 - DNA, 25 bp, Homo sapien
cccagggatgatgctcaaatatcag

SEQ ID NO: 18181 - DNA, 25 bp, Homo sapien
gagaagttacgaaaggccttcgatg

SEQ ID NO: 18182 - DNA, 25 bp, Homo sapien
caccactggttaaacgcacaacttc

SEQ ID NO: 18183 - DNA, 25 bp, Homo sapien
ttaaacgcacaacttcattctctac

SEQ ID NO: 18184 - DNA, 25 bp, Homo sapien
ttctctaccccacttgcgttaagaa

SEQ ID NO: 18185 - DNA, 25 bp, Homo sapien
ctctaccccacttgcgttaagaagc

SEQ ID NO: 18186 - DNA, 25 bp, Homo sapien
taccccacttgcgttaagaagcagt

SEQ ID NO: 18187 - DNA, 25 bp, Homo sapien
ccccacttgcgttaagaagcagtga

SEQ ID NO: 18188 - DNA, 25 bp, Homo sapien
gaagcagtgaataagcggtaggttg

SEQ ID NO: 18189 - DNA, 25 bp, Homo sapien
gcagtgaataagcggtaggttgaca

SEQ ID NO: 18190 - DNA, 25 bp, Homo sapien
taggttgacagagctaccgtcttcc

SEQ ID NO: 18191 - DNA, 25 bp, Homo sapien
ctcctgccccgaagaaaggctccaa

SEQ ID NO: 18192 - DNA, 25 bp, Homo sapien
agaaggcagtgacaaaggcccagaa

SEQ ID NO: 18193 - DNA, 25 bp, Homo sapien
taattttagacattgctttaacttt

SEQ ID NO: 18194 - DNA, 25 bp, Homo sapien
aaaacctatgtttggcgcttaagct

SEQ ID NO: 18195 - DNA, 25 bp, Homo sapien
gtttggcgcttaagctttcagctca

SEQ ID NO: 18196 - DNA, 25 bp, Homo sapien
gcgcttaagctttcagctcagctta

SEQ ID NO: 18197 - DNA, 25 bp, Homo sapien
agctttcagctcagcttaatgaagt

SEQ ID NO: 18198 - DNA, 25 bp, Homo sapien
tgtttagcatagtacctctgctatt

SEQ ID NO: 18199 - DNA, 25 bp, Homo sapien
gcatagtacctctgctatttgctgt

SEQ ID NO: 18200 - DNA, 25 bp, Homo sapien
tattatttttccaagaaatatccct

SEQ ID NO: 18201 - DNA, 25 bp, Homo sapien
gagaaggctgggggtttaatgtgga

SEQ ID NO: 18202 - DNA, 25 bp, Homo sapien
gaatcctgtgatggaaatacaactg

SEQ ID NO: 18203 - DNA, 25 bp, Homo sapien
atacaactggtatcttcactttttt

SEQ ID NO: 18204 - DNA, 25 bp, Homo sapien
tcatcatcccttttgcttatggtag

SEQ ID NO: 18205 - DNA, 25 bp, Homo sapien
gggctaacataacagcccctttctc

SEQ ID NO: 18206 - DNA, 25 bp, Homo sapien
cccctttctcaagcagagacctggc

SEQ ID NO: 18207 - DNA, 25 bp, Homo sapien
ggcctatcttagccagctggagctt

SEQ ID NO: 18208 - DNA, 25 bp, Homo sapien
ccagccatctttgctcacatggaaa

SEQ ID NO: 18209 - DNA, 25 bp, Homo sapien
tgccattcaaaggccactggtgctt

SEQ ID NO: 18210 - DNA, 25 bp, Homo sapien
tcccaaccaccactgtaattttcaa

SEQ ID NO: 18211 - DNA, 25 bp, Homo sapien
cacacacgcatttgcacagacacac

SEQ ID NO: 18212 - DNA, 25 bp, Homo sapien
taatctctggtgggggcaagtgtct

SEQ ID NO: 18213 - DNA, 25 bp, Homo sapien
aaggcctgaggggcacttcagatga

SEQ ID NO: 18214 - DNA, 25 bp, Homo sapien
gagaggtagggagccaggtgcagca

SEQ ID NO: 18215 - DNA, 25 bp, Homo sapien
aaagatctcaacctgtggacgggaa

SEQ ID NO: 18216 - DNA, 25 bp, Homo sapien
agagtccccactggcacagtggctc

SEQ ID NO: 18217 - DNA, 25 bp, Homo sapien
agcacttctagaggctgaggcgggt

SEQ ID NO: 18218 - DNA, 25 bp, Homo sapien
aggcgggtgtattgcttgagcccag

SEQ ID NO: 18219 - DNA, 25 bp, Homo sapien
gagcccagaagtttgagagcagcct

SEQ ID NO: 18220 - DNA, 25 bp, Homo sapien
catgagggtacacacctgtagtccc

SEQ ID NO: 18221 - DNA, 25 bp, Homo sapien
gctgcagtgagcctaggtggtgcca

SEQ ID NO: 18222 - DNA, 25 bp, Homo sapien
gcactccaacctgggggacagagga

SEQ ID NO: 18223 - DNA, 25 bp, Homo sapien
gggacagaggaggccctgtcccgag

SEQ ID NO: 18224 - DNA, 25 bp, Homo sapien
gagttgtcagaaaggtttccctgca

SEQ ID NO: 18225 - DNA, 25 bp, Homo sapien
gaaaggtttccctgcagataaactt

SEQ ID NO: 18226 - DNA, 25 bp, Homo sapien
gcactgcaactttcttcatgtgttc

SEQ ID NO: 18227 - DNA, 25 bp, Homo sapien
catctacttgtctccagatcggact

SEQ ID NO: 18228 - DNA, 25 bp, Homo sapien
ctggctcctcctttgggaagaactc

SEQ ID NO: 18229 - DNA, 25 bp, Homo sapien
caccacgacgactactacagcaggc

SEQ ID NO: 18230 - DNA, 25 bp, Homo sapien
gaaggagaaaccctagtccagacca

SEQ ID NO: 18231 - DNA, 25 bp, Homo sapien
gtccagaccactcctacaaaagaaa

SEQ ID NO: 18232 - DNA, 25 bp, Homo sapien
gaagaaatctcacaaacgcacatca

SEQ ID NO: 18233 - DNA, 25 bp, Homo sapien
gaaatagggaccgcagcagggaccg

SEQ ID NO: 18234 - DNA, 25 bp, Homo sapien
ctctaggtcccgaagtcgtggcagg

SEQ ID NO: 18235 - DNA, 25 bp, Homo sapien
tgcagtgtgaattctgccccgtgac

SEQ ID NO: 18236 - DNA, 25 bp, Homo sapien
tgccccgtgacccggtggaaaatgg

SEQ ID NO: 18237 - DNA, 25 bp, Homo sapien
ggttgaagagcaatgtgtggctgaa

SEQ ID NO: 18238 - DNA, 25 bp, Homo sapien
gaagacttttgttatgaggagctgc

SEQ ID NO: 18239 - DNA, 25 bp, Homo sapien
ggagctgcagattagctaggggaca

SEQ ID NO: 18240 - DNA, 25 bp, Homo sapien
ggacagctggaattatgctggcttc

SEQ ID NO: 18241 - DNA, 25 bp, Homo sapien
ttatgctggcttctgataattattt

SEQ ID NO: 18242 - DNA, 25 bp, Homo sapien
aaggggtctgaaatttgtgatggaa

SEQ ID NO: 18243 - DNA, 25 bp, Homo sapien
ggaatcagattttaacagctctctt

SEQ ID NO: 18244 - DNA, 25 bp, Homo sapien
ttaacagctctcttcaatgacatag

SEQ ID NO: 18245 - DNA, 25 bp, Homo sapien
aagttcatggaactcatgtttttaa

SEQ ID NO: 18246 - DNA, 25 bp, Homo sapien
aggaaggtactgtcatgggctaggc

SEQ ID NO: 18247 - DNA, 25 bp, Homo sapien
gtactgtcatgggctaggcatggtg

SEQ ID NO: 18248 - DNA, 25 bp, Homo sapien
gggctgcgtccaaagaggactctgc

SEQ ID NO: 18249 - DNA, 25 bp, Homo sapien
ggagttggtgccttccagtattatc

SEQ ID NO: 18250 - DNA, 25 bp, Homo sapien
gatggagtctgacgcaggaaccttc

SEQ ID NO: 18251 - DNA, 25 bp, Homo sapien
actgggctgcaattcactggcagtg

SEQ ID NO: 18252 - DNA, 25 bp, Homo sapien
ggaggaggttatgagcctgctgcag

SEQ ID NO: 18253 - DNA, 25 bp, Homo sapien
gcctggagccagtctacttgatgac

SEQ ID NO: 18254 - DNA, 25 bp, Homo sapien
atcactcccacggagacaccatgac

SEQ ID NO: 18255 - DNA, 25 bp, Homo sapien
gtttgggctgttgtttcttatgttg

SEQ ID NO: 18256 - DNA, 25 bp, Homo sapien
ggaagaaatgctgcctaggtcctag

SEQ ID NO: 18257 - DNA, 25 bp, Homo sapien
ggcggtggagcctttatatcatggg

SEQ ID NO: 18258 - DNA, 25 bp, Homo sapien
atcatgggaagcactctcacttatt

SEQ ID NO: 18259 - DNA, 25 bp, Homo sapien
cctgtcccatggagagggacccagc

SEQ ID NO: 18260 - DNA, 25 bp, Homo sapien
gggacccagcataggaaagccacat

SEQ ID NO: 18261 - DNA, 25 bp, Homo sapien
taggaaagccacatactcagcctgg

SEQ ID NO: 18262 - DNA, 25 bp, Homo sapien
gccacatactcagcctggatgggtg

SEQ ID NO: 18263 - DNA, 25 bp, Homo sapien
cctggatgggtggagaggctgaggg

SEQ ID NO: 18264 - DNA, 25 bp, Homo sapien
gctgagcactgggaatgtcagccca

SEQ ID NO: 18265 - DNA, 25 bp, Homo sapien
gtcagcccagtaagtattggccagt

SEQ ID NO: 18266 - DNA, 25 bp, Homo sapien
taagtattggccagtcaggcgcctc

SEQ ID NO: 18267 - DNA, 25 bp, Homo sapien
ctggaacagttttcgttaagtatag

SEQ ID NO: 18268 - DNA, 25 bp, Homo sapien
gtgtgttggggatggtaaattactc

SEQ ID NO: 18269 - DNA, 25 bp, Homo sapien
gtaggtcttgtgttctaataatgtt

SEQ ID NO: 18270 - DNA, 25 bp, Homo sapien
caaggcgctatgtacagcctcctga

SEQ ID NO: 18271 - DNA, 25 bp, Homo sapien
tgattgggcctatgcggcccgagca

SEQ ID NO: 18272 - DNA, 25 bp, Homo sapien
ggaaccagcaactcaacgtcaggat

SEQ ID NO: 18273 - DNA, 25 bp, Homo sapien
caacgtcaggatcctgcagctgctc

SEQ ID NO: 18274 - DNA, 25 bp, Homo sapien
gcatctgcaggtcaagggccgaagc

SEQ ID NO: 18275 - DNA, 25 bp, Homo sapien
ggccgaagcctgaagctcatagcca

SEQ ID NO: 18276 - DNA, 25 bp, Homo sapien
catagccaggaacagggtcacccac

SEQ ID NO: 18277 - DNA, 25 bp, Homo sapien
gactctttttcctctactgagattc

SEQ ID NO: 18278 - DNA, 25 bp, Homo sapien
ggacccgccaaatccagaggaggtg

SEQ ID NO: 18279 - DNA, 25 bp, Homo sapien
atgcaggctgctcctatgttggaaa

SEQ ID NO: 18280 - DNA, 25 bp, Homo sapien
gatcgacctattattggcctagacc

SEQ ID NO: 18281 - DNA, 25 bp, Homo sapien
ggaaatgaatcctcctgataacatc

SEQ ID NO: 18282 - DNA, 25 bp, Homo sapien
tattctttcagagaagtgtcccagg

SEQ ID NO: 18283 - DNA, 25 bp, Homo sapien
gtgtcccaggacatgataataagat

SEQ ID NO: 18284 - DNA, 25 bp, Homo sapien
gatgcaatttgaatcttcatcatac

SEQ ID NO: 18285 - DNA, 25 bp, Homo sapien
catcatacgaaggatactttctagc

SEQ ID NO: 18286 - DNA, 25 bp, Homo sapien
gatagatctataatgttcactgttc

SEQ ID NO: 18287 - DNA, 25 bp, Homo sapien
gttcaaaacgaagactagctattaa

SEQ ID NO: 18288 - DNA, 25 bp, Homo sapien
ctattaaaatttcatgccgggcgca

SEQ ID NO: 18289 - DNA, 25 bp, Homo sapien
tgagtgtagtgacgcatgccctcaa

SEQ ID NO: 18290 - DNA, 25 bp, Homo sapien
gaatcacttgcactccggaggtaga

SEQ ID NO: 18291 - DNA, 25 bp, Homo sapien
cacttgcactccggaggtagaggtt

SEQ ID NO: 18292 - DNA, 25 bp, Homo sapien
aggtccctcccacaacaatgggaat

SEQ ID NO: 18293 - DNA, 25 bp, Homo sapien
tgggtggagacacggccaaactgta

SEQ ID NO: 18294 - DNA, 25 bp, Homo sapien
gacacggccaaactgtatcacattg

SEQ ID NO: 18295 - DNA, 25 bp, Homo sapien
cagatgttaattcctgtgactgact

SEQ ID NO: 18296 - DNA, 25 bp, Homo sapien
gaaaggtaacctaaggctgggcacg

SEQ ID NO: 18297 - DNA, 25 bp, Homo sapien
gggcacggtggctcgtgcctatagt

SEQ ID NO: 18298 - DNA, 25 bp, Homo sapien
gcctatagtcctggcactttgagtg

SEQ ID NO: 18299 - DNA, 25 bp, Homo sapien
ggtgggtggattgcttgaaaccagg

SEQ ID NO: 18300 - DNA, 25 bp, Homo sapien
gaaacctcatccctacagaaaatac

SEQ ID NO: 18301 - DNA, 25 bp, Homo sapien
cacacctgtagtctcagctactcgg

SEQ ID NO: 18302 - DNA, 25 bp, Homo sapien
gagctcaggaggtcgaggcttcagt

SEQ ID NO: 18303 - DNA, 25 bp, Homo sapien
tccctgtctaaaacacatcagtgta

SEQ ID NO: 18304 - DNA, 25 bp, Homo sapien
taaattcaggcttcagcacgccgtc

SEQ ID NO: 18305 - DNA, 25 bp, Homo sapien
ggataagagaccacttagccttccc

SEQ ID NO: 18306 - DNA, 25 bp, Homo sapien
aagaagcgtgtatgtagtcaccatt

SEQ ID NO: 18307 - DNA, 25 bp, Homo sapien
attccagaacctctcttttctaaga

SEQ ID NO: 18308 - DNA, 25 bp, Homo sapien
tagtttagactttatacccttagct

SEQ ID NO: 18309 - DNA, 25 bp, Homo sapien
tttatacccttagctttcccataag

SEQ ID NO: 18310 - DNA, 25 bp, Homo sapien
tttcccataagagctccctttgtgg

SEQ ID NO: 18311 - DNA, 25 bp, Homo sapien
tccctttgtggggaacttgccctct

SEQ ID NO: 18312 - DNA, 25 bp, Homo sapien
ttgccctcttctgcgaaataagcct

SEQ ID NO: 18313 - DNA, 25 bp, Homo sapien
tccttaaagagaagtcaccggccgg

SEQ ID NO: 18314 - DNA, 25 bp, Homo sapien
tggactcgtcattggtgctgtctac

SEQ ID NO: 18315 - DNA, 25 bp, Homo sapien
caccgtggagacctcatcacggagc

SEQ ID NO: 18316 - DNA, 25 bp, Homo sapien
ccgtggagacctcatcacggagccc

SEQ ID NO: 18317 - DNA, 25 bp, Homo sapien
tggtggctgtggttgtcaagtacgc

SEQ ID NO: 18318 - DNA, 25 bp, Homo sapien
tggctgtggttgtcaagtacgctga

SEQ ID NO: 18319 - DNA, 25 bp, Homo sapien
tcaagtacgctgacaatatcctcaa

SEQ ID NO: 18320 - DNA, 25 bp, Homo sapien
gtacgctgacaatatcctcaagggc

SEQ ID NO: 18321 - DNA, 25 bp, Homo sapien
acgctgacaatatcctcaagggctt

SEQ ID NO: 18322 - DNA, 25 bp, Homo sapien
gacaatatcctcaagggctttgcca

SEQ ID NO: 18323 - DNA, 25 bp, Homo sapien
aatatcctcaagggctttgccacct

SEQ ID NO: 18324 - DNA, 25 bp, Homo sapien
cttccacgtggacccattatttgcc

SEQ ID NO: 18325 - DNA, 25 bp, Homo sapien
tctcttctctcatctagcactgagt

SEQ ID NO: 18326 - DNA, 25 bp, Homo sapien
catctagcactgagtcaagcaatca

SEQ ID NO: 18327 - DNA, 25 bp, Homo sapien
caagcaatcagcaggctgggcaccc

SEQ ID NO: 18328 - DNA, 25 bp, Homo sapien
gcaccccttagccataagttttcag

SEQ ID NO: 18329 - DNA, 25 bp, Homo sapien
ttccttgagggcattgactttacaa

SEQ ID NO: 18330 - DNA, 25 bp, Homo sapien
gggagcagcaatggcctagagtctc

SEQ ID NO: 18331 - DNA, 25 bp, Homo sapien
aatggcctagagtctcaggaacaag

SEQ ID NO: 18332 - DNA, 25 bp, Homo sapien
caggaacaagacaggtgcactgagg

SEQ ID NO: 18333 - DNA, 25 bp, Homo sapien
caacctgtatggcgggtctgtactt

SEQ ID NO: 18334 - DNA, 25 bp, Homo sapien
atggcgggtctgtacttattttgtt

SEQ ID NO: 18335 - DNA, 25 bp, Homo sapien
aaatcttatctagaattgtaatcag

SEQ ID NO: 18336 - DNA, 25 bp, Homo sapien
aatactcggagaaaatcagctatgt

SEQ ID NO: 18337 - DNA, 25 bp, Homo sapien
gaagagaaactataaggccatgact

SEQ ID NO: 18338 - DNA, 25 bp, Homo sapien
agaaactataaggccatgactaaac

SEQ ID NO: 18339 - DNA, 25 bp, Homo sapien
aataaacaggccacagacttccagg

SEQ ID NO: 18340 - DNA, 25 bp, Homo sapien
gataatgaccataaccgcaggattc

SEQ ID NO: 18341 - DNA, 25 bp, Homo sapien
atgaccataaccgcaggattcaggt

SEQ ID NO: 18342 - DNA, 25 bp, Homo sapien
accgcaggattcaggttgaacatcc

SEQ ID NO: 18343 - DNA, 25 bp, Homo sapien
cacagaatcatcccgaagatcatgc

SEQ ID NO: 18344 - DNA, 25 bp, Homo sapien
gaagccagcagaggacgaaaatgat

SEQ ID NO: 18345 - DNA, 25 bp, Homo sapien
ttcgaagggagtgtcagaagcatct

SEQ ID NO: 18346 - DNA, 25 bp, Homo sapien
aagattaataagagatctggaccca

SEQ ID NO: 18347 - DNA, 25 bp, Homo sapien
ctccatttgctgtactctttgctag

SEQ ID NO: 18348 - DNA, 25 bp, Homo sapien
ggggtgtgtaaccgtgtaacacgtg

SEQ ID NO: 18349 - DNA, 25 bp, Homo sapien
acacgtgaaggcagtgctcacctct

SEQ ID NO: 18350 - DNA, 25 bp, Homo sapien
tcacctcttctttaccagaacggtt

SEQ ID NO: 18351 - DNA, 25 bp, Homo sapien
gcacattaacttctggactgccggc

SEQ ID NO: 18352 - DNA, 25 bp, Homo sapien
cggctctagtaccttttcagtaaag

SEQ ID NO: 18353 - DNA, 25 bp, Homo sapien
cagtaaagtggttctctgccttttt

SEQ ID NO: 18354 - DNA, 25 bp, Homo sapien
ctctgcctttttactatacagcata

SEQ ID NO: 18355 - DNA, 25 bp, Homo sapien
gcataccacgccacagggttagaac

SEQ ID NO: 18356 - DNA, 25 bp, Homo sapien
atgagggtgcccagcttataagaat

SEQ ID NO: 18357 - DNA, 25 bp, Homo sapien
tatctgttttgctgtggcgttgggg

SEQ ID NO: 18358 - DNA, 25 bp, Homo sapien
ctgggcggggacgagtagcacaccg

SEQ ID NO: 18359 - DNA, 25 bp, Homo sapien
gcggggacgagtagcacaccgaggc

SEQ ID NO: 18360 - DNA, 25 bp, Homo sapien
gtccccagcagcagcagtagtggca

SEQ ID NO: 18361 - DNA, 25 bp, Homo sapien
cagcagtagtggcagcagcggcagc

SEQ ID NO: 18362 - DNA, 25 bp, Homo sapien
cgtcgccatctcatggtgcgaggtg

SEQ ID NO: 18363 - DNA, 25 bp, Homo sapien
catctcatggtgcgaggtgcgtgcg

SEQ ID NO: 18364 - DNA, 25 bp, Homo sapien
ttttatttatttattgggggtgcag

SEQ ID NO: 18365 - DNA, 25 bp, Homo sapien
gggtgcaggggtaggagagttgttt

SEQ ID NO: 18366 - DNA, 25 bp, Homo sapien
gagttgtttatgggaggaggagggg

SEQ ID NO: 18367 - DNA, 25 bp, Homo sapien
ggaggagggggaagaagtggatgga

SEQ ID NO: 18368 - DNA, 25 bp, Homo sapien
ggatggaaccacagaaaggcgaaga

SEQ ID NO: 18369 - DNA, 25 bp, Homo sapien
ccccttaggatagctcattgttttt

SEQ ID NO: 18370 - DNA, 25 bp, Homo sapien
ggatagctcattgtttttattcaga

SEQ ID NO: 18371 - DNA, 25 bp, Homo sapien
tagctcattgtttttattcagattt

SEQ ID NO: 18372 - DNA, 25 bp, Homo sapien
tattcagatttccctaattagtggt

SEQ ID NO: 18373 - DNA, 25 bp, Homo sapien
gatttccctaattagtggtgtgtga

SEQ ID NO: 18374 - DNA, 25 bp, Homo sapien
agtggtgtgtgaacatcttatctgt

SEQ ID NO: 18375 - DNA, 25 bp, Homo sapien
acatcttatctgttgattggctatt

SEQ ID NO: 18376 - DNA, 25 bp, Homo sapien
tgttgattggctatttgggtttttt

SEQ ID NO: 18377 - DNA, 25 bp, Homo sapien
tcaaatgggctgttcatctcttgct

SEQ ID NO: 18378 - DNA, 25 bp, Homo sapien
ttttttcagtcatatgtgttgcaaa

SEQ ID NO: 18379 - DNA, 25 bp, Homo sapien
gtcatatgtgttgcaaatatcttct

SEQ ID NO: 18380 - DNA, 25 bp, Homo sapien
tgagttacaacgggaccacgtcggc

SEQ ID NO: 18381 - DNA, 25 bp, Homo sapien
ctacagctccgtgttgactcaaaac

SEQ ID NO: 18382 - DNA, 25 bp, Homo sapien
gactcaaaactcgctgggcaacaac

SEQ ID NO: 18383 - DNA, 25 bp, Homo sapien
cacccgtcaatgacttcgcagagca

SEQ ID NO: 18384 - DNA, 25 bp, Homo sapien
tcgcagagcagcacgtccatgagcg

SEQ ID NO: 18385 - DNA, 25 bp, Homo sapien
cctgccctgtgagtctttaagaccc

SEQ ID NO: 18386 - DNA, 25 bp, Homo sapien
tctttaagaccctctttgccaagtt

SEQ ID NO: 18387 - DNA, 25 bp, Homo sapien
ttacgacgggactgtctgggggact

SEQ ID NO: 18388 - DNA, 25 bp, Homo sapien
gggggactgtctgattatttcacac

SEQ ID NO: 18389 - DNA, 25 bp, Homo sapien
tcaaaatcaggggtcttcttccaac

SEQ ID NO: 18390 - DNA, 25 bp, Homo sapien
gaacgttttacacacatttgcattg

SEQ ID NO: 18391 - DNA, 25 bp, Homo sapien
gggtggaagagactcccctgatgaa

SEQ ID NO: 18392 - DNA, 25 bp, Homo sapien
tgaatgaggactccatcctggctgt

SEQ ID NO: 18393 - DNA, 25 bp, Homo sapien
aggaaatacagcccttgtgcctggg

SEQ ID NO: 18394 - DNA, 25 bp, Homo sapien
agatccctctcgttttcaacaaact

SEQ ID NO: 18395 - DNA, 25 bp, Homo sapien
ctaatacattatctcacactttcat

SEQ ID NO: 18396 - DNA, 25 bp, Homo sapien
acactttcatgagttcttccatttc

SEQ ID NO: 18397 - DNA, 25 bp, Homo sapien
cacttctataaccacgacgcgttga

SEQ ID NO: 18398 - DNA, 25 bp, Homo sapien
aagtgtcgtgtatacctgtgcaggc

SEQ ID NO: 18399 - DNA, 25 bp, Homo sapien
gtgcaggcactagtcctttacagat

SEQ ID NO: 18400 - DNA, 25 bp, Homo sapien
gatgaccattctgatgtctctgttc

SEQ ID NO: 18401 - DNA, 25 bp, Homo sapien
tgtctctgttcatcttttgtttaaa

SEQ ID NO: 18402 - DNA, 25 bp, Homo sapien
ctttttctcaaaccagggactatca

SEQ ID NO: 18403 - DNA, 25 bp, Homo sapien
caaaccagggactatcatctaagat

SEQ ID NO: 18404 - DNA, 25 bp, Homo sapien
tgcgtatacgtaactgctcaaagat

SEQ ID NO: 18405 - DNA, 25 bp, Homo sapien
tatgaatgttaacctttccgtttat

SEQ ID NO: 18406 - DNA, 25 bp, Homo sapien
tttccgtttattacaagcaagtact

SEQ ID NO: 18407 - DNA, 25 bp, Homo sapien
agcaagtactattatttctgatttt

SEQ ID NO: 18408 - DNA, 25 bp, Homo sapien
atgtttaatcaactgaggcctctca

SEQ ID NO: 18409 - DNA, 25 bp, Homo sapien
gaggcctctcaaccaaataacatct

SEQ ID NO: 18410 - DNA, 25 bp, Homo sapien
aatgttgcaggattatactttattg

SEQ ID NO: 18411 - DNA, 25 bp, Homo sapien
aatttcttttgttccagagattgtt

SEQ ID NO: 18412 - DNA, 25 bp, Homo sapien
tatatcttaattctagtatctgttt

SEQ ID NO: 18413 - DNA, 25 bp, Homo sapien
cgtttctccgaagcatgtggggcgt

SEQ ID NO: 18414 - DNA, 25 bp, Homo sapien
gtttctccgaagcatgtggggcgtg

SEQ ID NO: 18415 - DNA, 25 bp, Homo sapien
tctccgaagcatgtggggcgtgctg

SEQ ID NO: 18416 - DNA, 25 bp, Homo sapien
gaagcatgtggggcgtgctgactgc

SEQ ID NO: 18417 - DNA, 25 bp, Homo sapien
tgctgactgccctgggaaggtctgg

SEQ ID NO: 18418 - DNA, 25 bp, Homo sapien
tgactgccctgggaaggtctggagc

SEQ ID NO: 18419 - DNA, 25 bp, Homo sapien
gccctgggaaggtctggagcagagc

SEQ ID NO: 18420 - DNA, 25 bp, Homo sapien
gggaaggtctggagcagagctgtgc

SEQ ID NO: 18421 - DNA, 25 bp, Homo sapien
aggtctggagcagagctgtgcaccg

SEQ ID NO: 18422 - DNA, 25 bp, Homo sapien
tgtgcaccggctgtggaagtcgact

SEQ ID NO: 18423 - DNA, 25 bp, Homo sapien
tgcaccggctgtggaagtcgactgc

SEQ ID NO: 18424 - DNA, 25 bp, Homo sapien
cttctttttgtcaatcggcacagac

SEQ ID NO: 18425 - DNA, 25 bp, Homo sapien
ctttttgtcaatcggcacagaccac

SEQ ID NO: 18426 - DNA, 25 bp, Homo sapien
ttgtcaatcggcacagaccactgta

SEQ ID NO: 18427 - DNA, 25 bp, Homo sapien
caatcggcacagaccactgtaagga

SEQ ID NO: 18428 - DNA, 25 bp, Homo sapien
ggcacagaccactgtaaggaaatgc

SEQ ID NO: 18429 - DNA, 25 bp, Homo sapien
ccctcaccttctaaggtcagctcta

SEQ ID NO: 18430 - DNA, 25 bp, Homo sapien
caccttctaaggtcagctctagctg

SEQ ID NO: 18431 - DNA, 25 bp, Homo sapien
ggtcagctctagctgagcatcagtg

SEQ ID NO: 18432 - DNA, 25 bp, Homo sapien
atcagtgctctcttaaggaggaaaa

SEQ ID NO: 18433 - DNA, 25 bp, Homo sapien
gaaaaaaacggtgcggctgggagcg

SEQ ID NO: 18434 - DNA, 25 bp, Homo sapien
aaaaacggtgcggctgggagcggtg

SEQ ID NO: 18435 - DNA, 25 bp, Homo sapien
acacttagtcctccacagtgggtgg

SEQ ID NO: 18436 - DNA, 25 bp, Homo sapien
aagagtgcaaggtctgccaggtcag

SEQ ID NO: 18437 - DNA, 25 bp, Homo sapien
cagaacctgctggtgcaagctgggc

SEQ ID NO: 18438 - DNA, 25 bp, Homo sapien
tgggcaggtcctgaccaacctgcat

SEQ ID NO: 18439 - DNA, 25 bp, Homo sapien
cacaggtcttcatgggcaggggttg

SEQ ID NO: 18440 - DNA, 25 bp, Homo sapien
atcctcaggcctgggctgtagcaag

SEQ ID NO: 18441 - DNA, 25 bp, Homo sapien
gctgtctgcccttgggttcaagaac

SEQ ID NO: 18442 - DNA, 25 bp, Homo sapien
acaaggataccctcactttgcatga

SEQ ID NO: 18443 - DNA, 25 bp, Homo sapien
ttagcccccacatggggctgctctt

SEQ ID NO: 18444 - DNA, 25 bp, Homo sapien
ggctgctcttgcttctactaaaaga

SEQ ID NO: 18445 - DNA, 25 bp, Homo sapien
taaaaccagacccccagtggatgtc

SEQ ID NO: 18446 - DNA, 25 bp, Homo sapien
gtaccaacgtagaccagctatagca

SEQ ID NO: 18447 - DNA, 25 bp, Homo sapien
taataatccatatgtgcctcgcaca

SEQ ID NO: 18448 - DNA, 25 bp, Homo sapien
gcctcgcacatattatgcaaaccca

SEQ ID NO: 18449 - DNA, 25 bp, Homo sapien
gcaaacccagctgtagttaggccac

SEQ ID NO: 18450 - DNA, 25 bp, Homo sapien
gttaggccacatgcccaaattcctc

SEQ ID NO: 18451 - DNA, 25 bp, Homo sapien
aaattcctcagcggcaatacctgcc

SEQ ID NO: 18452 - DNA, 25 bp, Homo sapien
aaaataatcatccctaccatcaata

SEQ ID NO: 18453 - DNA, 25 bp, Homo sapien
ataccattgctactgttgaacctac

SEQ ID NO: 18454 - DNA, 25 bp, Homo sapien
ctcctgccactgaaccaacggtgga

SEQ ID NO: 18455 - DNA, 25 bp, Homo sapien
gtgtagtcactccagaagctttttc

SEQ ID NO: 18456 - DNA, 25 bp, Homo sapien
ctctccttacattttacattcatgc

SEQ ID NO: 18457 - DNA, 25 bp, Homo sapien
acattacttcatattgtcttcccca

SEQ ID NO: 18458 - DNA, 25 bp, Homo sapien
tcatattgtcttccccaataactcc

SEQ ID NO: 18459 - DNA, 25 bp, Homo sapien
caataactcccaaaccataaatcca

SEQ ID NO: 18460 - DNA, 25 bp, Homo sapien
accataaatccagtctgtttttagg

SEQ ID NO: 18461 - DNA, 25 bp, Homo sapien
gaaattgcacataccttcatggtgt

SEQ ID NO: 18462 - DNA, 25 bp, Homo sapien
ggagttggaaacctgactttatatt

SEQ ID NO: 18463 - DNA, 25 bp, Homo sapien
gagctgtggaactttagatacattc

SEQ ID NO: 18464 - DNA, 25 bp, Homo sapien
acattccttaacattactgtatctc

SEQ ID NO: 18465 - DNA, 25 bp, Homo sapien
tactgtatctcagtttgcctttctg

SEQ ID NO: 18466 - DNA, 25 bp, Homo sapien
gtttgtgtgagaccatatgactaat

SEQ ID NO: 18467 - DNA, 25 bp, Homo sapien
atgaaataccctgtttggccgggcg

SEQ ID NO: 18468 - DNA, 25 bp, Homo sapien
ctaggggttaggcttttgagcttga

SEQ ID NO: 18469 - DNA, 25 bp, Homo sapien
cttttgagcttgaacgcctgcgtgt

SEQ ID NO: 18470 - DNA, 25 bp, Homo sapien
tgaaaaatccttcagtacccaagtc

SEQ ID NO: 18471 - DNA, 25 bp, Homo sapien
ccagtctgtcctatggggagcagtt

SEQ ID NO: 18472 - DNA, 25 bp, Homo sapien
gcctggggcacccagcggaatgtgc

SEQ ID NO: 18473 - DNA, 25 bp, Homo sapien
gcggaatgtgcttagtatttggtca

SEQ ID NO: 18474 - DNA, 25 bp, Homo sapien
tagtatttggtcaccagccgtcatc

SEQ ID NO: 18475 - DNA, 25 bp, Homo sapien
tttcctactgtgtcttgttacaagg

SEQ ID NO: 18476 - DNA, 25 bp, Homo sapien
ttgttacaaggcctcagcaatccac

SEQ ID NO: 18477 - DNA, 25 bp, Homo sapien
tgctttcagatgacctacttacatc

SEQ ID NO: 18478 - DNA, 25 bp, Homo sapien
actgctgggcaatccagttgacttt

SEQ ID NO: 18479 - DNA, 25 bp, Homo sapien
gtgctctcagagtagtagtgtttgt

SEQ ID NO: 18480 - DNA, 25 bp, Homo sapien
gaggtcagatggcctggacacacaa

SEQ ID NO: 18481 - DNA, 25 bp, Homo sapien
gaaactgagtctgccatgatatttt

SEQ ID NO: 18482 - DNA, 25 bp, Homo sapien
aagggagctatgtcaaaatgtggtt

SEQ ID NO: 18483 - DNA, 25 bp, Homo sapien
catagaactgcctggagggctccct

SEQ ID NO: 18484 - DNA, 25 bp, Homo sapien
gagggctccctgacaaaacaaaaga

SEQ ID NO: 18485 - DNA, 25 bp, Homo sapien
agaccagcgtggccaacatgatgaa

SEQ ID NO: 18486 - DNA, 25 bp, Homo sapien
acatgatgaaacccagtctctacta

SEQ ID NO: 18487 - DNA, 25 bp, Homo sapien
caggcatggtggcaggcctctgtat

SEQ ID NO: 18488 - DNA, 25 bp, Homo sapien
gcctctgtattcccagctatttggg

SEQ ID NO: 18489 - DNA, 25 bp, Homo sapien
aatcgcttgaattcgggaggcagag

SEQ ID NO: 18490 - DNA, 25 bp, Homo sapien
gagtcactccgttctaaggttgatg

SEQ ID NO: 18491 - DNA, 25 bp, Homo sapien
gctgtagctgtactacaagcccacc

SEQ ID NO: 18492 - DNA, 25 bp, Homo sapien
gcccaccaagctaaagaggctaccc

SEQ ID NO: 18493 - DNA, 25 bp, Homo sapien
gaggctacccagaaagcagttaaca

SEQ ID NO: 18494 - DNA, 25 bp, Homo sapien
gcagttaacagtgctaccggtgttc

SEQ ID NO: 18495 - DNA, 25 bp, Homo sapien
tgctaccggtgttccaactgtttaa

SEQ ID NO: 18496 - DNA, 25 bp, Homo sapien
aagaaatttgtgcttcaccgaagaa

SEQ ID NO: 18497 - DNA, 25 bp, Homo sapien
aactttgaaccttatgtaccgagca

SEQ ID NO: 18498 - DNA, 25 bp, Homo sapien
gtaccgagcaaatgcaaggtctagc

SEQ ID NO: 18499 - DNA, 25 bp, Homo sapien
atgctagtcctagattacttattga

SEQ ID NO: 18500 - DNA, 25 bp, Homo sapien
cagttaatgttttgtagaccctggg

SEQ ID NO: 18501 - DNA, 25 bp, Homo sapien
cagatccaaagctgtcttctgtcca

SEQ ID NO: 18502 - DNA, 25 bp, Homo sapien
caccacagtcaggccttgaggggat

SEQ ID NO: 18503 - DNA, 25 bp, Homo sapien
cagccctgtctcaaaaccgggttgc

SEQ ID NO: 18504 - DNA, 25 bp, Homo sapien
atgtacctgcggctggaatctgaag

SEQ ID NO: 18505 - DNA, 25 bp, Homo sapien
aggcatcagtcttcatcttagggga

SEQ ID NO: 18506 - DNA, 25 bp, Homo sapien
aaccacgaatctgaacatgcctctc

SEQ ID NO: 18507 - DNA, 25 bp, Homo sapien
tacaaatgtctaaggtccccactgc

SEQ ID NO: 18508 - DNA, 25 bp, Homo sapien
tccccactgcctgctggagagaaaa

SEQ ID NO: 18509 - DNA, 25 bp, Homo sapien
gagagaaaacacactcctttgctta

SEQ ID NO: 18510 - DNA, 25 bp, Homo sapien
ccaacctaactggcttacttcctgg

SEQ ID NO: 18511 - DNA, 25 bp, Homo sapien
tacttcctggtctacttgaggctgc

SEQ ID NO: 18512 - DNA, 25 bp, Homo sapien
aacgactgtgtcactttgcttgggg

SEQ ID NO: 18513 - DNA, 25 bp, Homo sapien
ggcaggtgacccaagacagagctga

SEQ ID NO: 18514 - DNA, 25 bp, Homo sapien
tgactccagctatcaggtattaagt

SEQ ID NO: 18515 - DNA, 25 bp, Homo sapien
tcaggtattaagtcccgggcagcga

SEQ ID NO: 18516 - DNA, 25 bp, Homo sapien
taagtcccgggcagcgataagcccc

SEQ ID NO: 18517 - DNA, 25 bp, Homo sapien
cccccccacaacagtgtgttagctc

SEQ ID NO: 18518 - DNA, 25 bp, Homo sapien
gtgttagctctgtcttagcaacctg

SEQ ID NO: 18519 - DNA, 25 bp, Homo sapien
ctctgtcttagcaacctgataggtt

SEQ ID NO: 18520 - DNA, 25 bp, Homo sapien
ggctgcaaatgttgttccgccacac

SEQ ID NO: 18521 - DNA, 25 bp, Homo sapien
gccacaccaaatccctgtttttgtc

SEQ ID NO: 18522 - DNA, 25 bp, Homo sapien
aatccctgtttttgtccatgaacta

SEQ ID NO: 18523 - DNA, 25 bp, Homo sapien
aagtattcattcctgcatgactccc

SEQ ID NO: 18524 - DNA, 25 bp, Homo sapien
ttctgcttctcagactctattccga

SEQ ID NO: 18525 - DNA, 25 bp, Homo sapien
gaaatccaacttagagctgctccac

SEQ ID NO: 18526 - DNA, 25 bp, Homo sapien
ttcctcaggagtaccttcaccaaca

SEQ ID NO: 18527 - DNA, 25 bp, Homo sapien
gacacctcggacagcgatgactatc

SEQ ID NO: 18528 - DNA, 25 bp, Homo sapien
gatgactatcacctcctaaaggacc

SEQ ID NO: 18529 - DNA, 25 bp, Homo sapien
ctgactgggcagaccctcaagcaga

SEQ ID NO: 18530 - DNA, 25 bp, Homo sapien
agcagacctacagcaagtttgacac

SEQ ID NO: 18531 - DNA, 25 bp, Homo sapien
gtttgacacaaactcgcacaaccat

SEQ ID NO: 18532 - DNA, 25 bp, Homo sapien
gacgcactgctcaagaactacgggc

SEQ ID NO: 18533 - DNA, 25 bp, Homo sapien
gacaaggtcgagacattcctgcgca

SEQ ID NO: 18534 - DNA, 25 bp, Homo sapien
ctctttatccctcagattactccaa

SEQ ID NO: 18535 - DNA, 25 bp, Homo sapien
tatccctcagattactccaaagcat

SEQ ID NO: 18536 - DNA, 25 bp, Homo sapien
actccaaagcataatgggctctatg

SEQ ID NO: 18537 - DNA, 25 bp, Homo sapien
agctccacatccttgacaatcagag

SEQ ID NO: 18538 - DNA, 25 bp, Homo sapien
gacaatcagagtcattgctcctcca

SEQ ID NO: 18539 - DNA, 25 bp, Homo sapien
cctccaggattaggaactttttgct

SEQ ID NO: 18540 - DNA, 25 bp, Homo sapien
ttcaataatccaagtagcagccctg

SEQ ID NO: 18541 - DNA, 25 bp, Homo sapien
atccaagtagcagccctgatgtcat

SEQ ID NO: 18542 - DNA, 25 bp, Homo sapien
gtagcagccctgatgtcatttttgt

SEQ ID NO: 18543 - DNA, 25 bp, Homo sapien
gcagccctgatgtcatttttgtatt

SEQ ID NO: 18544 - DNA, 25 bp, Homo sapien
ctccatttcattggactaaataaca

SEQ ID NO: 18545 - DNA, 25 bp, Homo sapien
gcaggaaggatcactcggtgaacaa

SEQ ID NO: 18546 - DNA, 25 bp, Homo sapien
tcctcctgtgacttcgttaagcgac

SEQ ID NO: 18547 - DNA, 25 bp, Homo sapien
gttaagcgacactttttctcagact

SEQ ID NO: 18548 - DNA, 25 bp, Homo sapien
gcgacactttttctcagactatctg

SEQ ID NO: 18549 - DNA, 25 bp, Homo sapien
gatggggtttattaactctgggatc

SEQ ID NO: 18550 - DNA, 25 bp, Homo sapien
aactctgggatcttaaaggtcgacg

SEQ ID NO: 18551 - DNA, 25 bp, Homo sapien
taaaggtcgacgtggactgctgcga

SEQ ID NO: 18552 - DNA, 25 bp, Homo sapien
ggactgctgcgagaaggatttgtgc

SEQ ID NO: 18553 - DNA, 25 bp, Homo sapien
ttgtgcaatggggcggcaggggcag

SEQ ID NO: 18554 - DNA, 25 bp, Homo sapien
ccagcctggcgtggctggggctggg

SEQ ID NO: 18555 - DNA, 25 bp, Homo sapien
gctggacatctccaggaaaccaggc

SEQ ID NO: 18556 - DNA, 25 bp, Homo sapien
aaatcagtcgggcgtggtggtgtgc

SEQ ID NO: 18557 - DNA, 25 bp, Homo sapien
tgtccacaggcctgatccagaatgg

SEQ ID NO: 18558 - DNA, 25 bp, Homo sapien
accttccagaccctggtgatgctgg

SEQ ID NO: 18559 - DNA, 25 bp, Homo sapien
ggtttacacctgccaagtggagcac

SEQ ID NO: 18560 - DNA, 25 bp, Homo sapien
cgagccctctcacagtggaatggag

SEQ ID NO: 18561 - DNA, 25 bp, Homo sapien
gagagcacggtctgaatctgcacag

SEQ ID NO: 18562 - DNA, 25 bp, Homo sapien
gggctgttcatctacttcaggaatc

SEQ ID NO: 18563 - DNA, 25 bp, Homo sapien
gaaaggacactctggacttcagcca

SEQ ID NO: 18564 - DNA, 25 bp, Homo sapien
gtaataccttttcatcctctttaag

SEQ ID NO: 18565 - DNA, 25 bp, Homo sapien
gaaacagatttggaggccaggcgca

SEQ ID NO: 18566 - DNA, 25 bp, Homo sapien
gccgaggcgggcgaatcatgaggtc

SEQ ID NO: 18567 - DNA, 25 bp, Homo sapien
gagatgatccagcagaccttcaatc

SEQ ID NO: 18568 - DNA, 25 bp, Homo sapien
gaccttcaatctcttcagcacagag

SEQ ID NO: 18569 - DNA, 25 bp, Homo sapien
gcacagaggactcatctgctgcttg

SEQ ID NO: 18570 - DNA, 25 bp, Homo sapien
ctgcttgggaacagagcctcctaga

SEQ ID NO: 18571 - DNA, 25 bp, Homo sapien
tgaatgaggactccatcctggctgt

SEQ ID NO: 18572 - DNA, 25 bp, Homo sapien
agaaatacagcccttgtgcctggga

SEQ ID NO: 18573 - DNA, 25 bp, Homo sapien
agatccctctcgttttcaacaaact

SEQ ID NO: 18574 - DNA, 25 bp, Homo sapien
acactttcatgagttcttccatttc

SEQ ID NO: 18575 - DNA, 25 bp, Homo sapien
aaagactcacttctataaccaccac

SEQ ID NO: 18576 - DNA, 25 bp, Homo sapien
gaagcttggtgtataccttgcaggc

SEQ ID NO: 18577 - DNA, 25 bp, Homo sapien
ccttgcaggcactagtcctttacag

SEQ ID NO: 18578 - DNA, 25 bp, Homo sapien
gggataggagggacacttagcaatg

SEQ ID NO: 18579 - DNA, 25 bp, Homo sapien
gggacacttagcaatgtttacgggc

SEQ ID NO: 18580 - DNA, 25 bp, Homo sapien
gcaatgtttacgggctaagaaggaa

SEQ ID NO: 18581 - DNA, 25 bp, Homo sapien
ctggaggagaggctgactacagaca

SEQ ID NO: 18582 - DNA, 25 bp, Homo sapien
gctgactacagacagtggctttaga

SEQ ID NO: 18583 - DNA, 25 bp, Homo sapien
tccctaactcaggaaggacacacag

SEQ ID NO: 18584 - DNA, 25 bp, Homo sapien
gacacacagggacaaatggacagac

SEQ ID NO: 18585 - DNA, 25 bp, Homo sapien
gaggaagagaggcctcgtgtcttta

SEQ ID NO: 18586 - DNA, 25 bp, Homo sapien
aagagaggcctcgtgtctttatttt

SEQ ID NO: 18587 - DNA, 25 bp, Homo sapien
gaagtgagggtaggagctgggttgg

SEQ ID NO: 18588 - DNA, 25 bp, Homo sapien
ggagctgggttggaaacttaaacag

SEQ ID NO: 18589 - DNA, 25 bp, Homo sapien
ttctttcccaacttattgcctgtag

SEQ ID NO: 18590 - DNA, 25 bp, Homo sapien
ttattgcctgtagtcagacctgctg

SEQ ID NO: 18591 - DNA, 25 bp, Homo sapien
tcttcctcttgaatgtctttccagt

SEQ ID NO: 18592 - DNA, 25 bp, Homo sapien
tcttgaatgtctttccagtggctgg

SEQ ID NO: 18593 - DNA, 25 bp, Homo sapien
tccagtggctggaaaggtccctctg

SEQ ID NO: 18594 - DNA, 25 bp, Homo sapien
aaaggtccctctgtggttatctgtt

SEQ ID NO: 18595 - DNA, 25 bp, Homo sapien
gtccctctgtggttatctgttagaa

SEQ ID NO: 18596 - DNA, 25 bp, Homo sapien
gaacagtctctgtacacaattcctc

SEQ ID NO: 18597 - DNA, 25 bp, Homo sapien
cacaattcctcctaaaaacatcctt

SEQ ID NO: 18598 - DNA, 25 bp, Homo sapien
gaggccattatccttcataaactat

SEQ ID NO: 18599 - DNA, 25 bp, Homo sapien
ccccatgacacacctttatgtatgt

SEQ ID NO: 18600 - DNA, 25 bp, Homo sapien
ttttagtttgagctcttaggtttat

SEQ ID NO: 18601 - DNA, 25 bp, Homo sapien
ctcttaggtttattggagctagcaa

SEQ ID NO: 18602 - DNA, 25 bp, Homo sapien
ttggagctagcaataattggttctg

SEQ ID NO: 18603 - DNA, 25 bp, Homo sapien
ggttctggcaagtttggccagactg

SEQ ID NO: 18604 - DNA, 25 bp, Homo sapien
gcaagtttggccagactgacttcaa

SEQ ID NO: 18605 - DNA, 25 bp, Homo sapien
aattaatgtgtatccagggacattt

SEQ ID NO: 18606 - DNA, 25 bp, Homo sapien
tcccaatgtacctataagaaatgtg

SEQ ID NO: 18607 - DNA, 25 bp, Homo sapien
agaaatgtgcatcaagccagcctga

SEQ ID NO: 18608 - DNA, 25 bp, Homo sapien
ggtattttctaattcagatcatcaa

SEQ ID NO: 18609 - DNA, 25 bp, Homo sapien
attatgggacgtttgtagaacctga

SEQ ID NO: 18610 - DNA, 25 bp, Homo sapien
ggacgtttgtagaacctgagtattt

SEQ ID NO: 18611 - DNA, 25 bp, Homo sapien
gagaccgccttgtaccggaaaatgc

SEQ ID NO: 18612 - DNA, 25 bp, Homo sapien
gaaaatgctgggcaaccccagccgg

SEQ ID NO: 18613 - DNA, 25 bp, Homo sapien
tgctaagtgccctggcaagggtgcc

SEQ ID NO: 18614 - DNA, 25 bp, Homo sapien
gcctggtccatcccatggaagtggc

SEQ ID NO: 18615 - DNA, 25 bp, Homo sapien
tgttgccttggggggtgtggcactc

SEQ ID NO: 18616 - DNA, 25 bp, Homo sapien
gccaggaactgaccacctaggtggc

SEQ ID NO: 18617 - DNA, 25 bp, Homo sapien
actgaccacctaggtggctgccacc

SEQ ID NO: 18618 - DNA, 25 bp, Homo sapien
gcaaggattgggggtcgtgcagccc

SEQ ID NO: 18619 - DNA, 25 bp, Homo sapien
ggagggactgaggccctctaggagg

SEQ ID NO: 18620 - DNA, 25 bp, Homo sapien
ggccctctaggaggaaagcccagag

SEQ ID NO: 18621 - DNA, 25 bp, Homo sapien
gcccagagggagggggccctcattc

SEQ ID NO: 18622 - DNA, 25 bp, Homo sapien
tcgtggctctggaatgtgtctggac

SEQ ID NO: 18623 - DNA, 25 bp, Homo sapien
ggctctggaatgtgtctggacttgc

SEQ ID NO: 18624 - DNA, 25 bp, Homo sapien
gagcagatgctaaaccgtcacagct

SEQ ID NO: 18625 - DNA, 25 bp, Homo sapien
gtcacagctgtaaattgtgtgctta

SEQ ID NO: 18626 - DNA, 25 bp, Homo sapien
tgtgtgcttaatgcaacatgccctt

SEQ ID NO: 18627 - DNA, 25 bp, Homo sapien
atcaccaataaataatctgcacttc

SEQ ID NO: 18628 - DNA, 25 bp, Homo sapien
aataatctgcacttccagagctcgg

SEQ ID NO: 18629 - DNA, 25 bp, Homo sapien
gttgggtctgaacaccccaacatcc

SEQ ID NO: 18630 - DNA, 25 bp, Homo sapien
ctggcttgtctgttcctatattagt

SEQ ID NO: 18631 - DNA, 25 bp, Homo sapien
gtctgttcctatattagtttcctat

SEQ ID NO: 18632 - DNA, 25 bp, Homo sapien
attagtttcctattactgctgtaat

SEQ ID NO: 18633 - DNA, 25 bp, Homo sapien
gaaggtggttcccatgtctatacat

SEQ ID NO: 18634 - DNA, 25 bp, Homo sapien
ggagcgtatctgctgaggagccact

SEQ ID NO: 18635 - DNA, 25 bp, Homo sapien
gagccactgtgcccatttttggctc

SEQ ID NO: 18636 - DNA, 25 bp, Homo sapien
gctccttcaattccacctaatggtg

SEQ ID NO: 18637 - DNA, 25 bp, Homo sapien
aaggtgtcttgagcatctgtccttt

SEQ ID NO: 18638 - DNA, 25 bp, Homo sapien
ctcaggcactactgatgctccagtc

SEQ ID NO: 18639 - DNA, 25 bp, Homo sapien
ggggaggccaaataagccctcactc

SEQ ID NO: 18640 - DNA, 25 bp, Homo sapien
aacgctctacttcgtaaaagcatta

SEQ ID NO: 18641 - DNA, 25 bp, Homo sapien
gtcctatggttcacatcttgtttcc

SEQ ID NO: 18642 - DNA, 25 bp, Homo sapien
tcctcttcgtagaccgcaagttaca

SEQ ID NO: 18643 - DNA, 25 bp, Homo sapien
agaacgtttccttttttgatgctga

SEQ ID NO: 18644 - DNA, 25 bp, Homo sapien
ttctttgacgcactgtatgacgagg

SEQ ID NO: 18645 - DNA, 25 bp, Homo sapien
gacgcactgtatgacgaggacgtgg

SEQ ID NO: 18646 - DNA, 25 bp, Homo sapien
tgccttctacagttgggagagtagc

SEQ ID NO: 18647 - DNA, 25 bp, Homo sapien
tgggagagtagcaaggaccccgctg

SEQ ID NO: 18648 - DNA, 25 bp, Homo sapien
cccgctgagcagcagggcaagggtg

SEQ ID NO: 18649 - DNA, 25 bp, Homo sapien
cagggcaagggtgtggcccttaaat

SEQ ID NO: 18650 - DNA, 25 bp, Homo sapien
gaggaggagtctgaccacaactgag

SEQ ID NO: 18651 - DNA, 25 bp, Homo sapien
gagtctgaccacaactgagggctgg

SEQ ID NO: 18652 - DNA, 25 bp, Homo sapien
ctgaccacaactgagggctggtggg

SEQ ID NO: 18653 - DNA, 25 bp, Homo sapien
tgggtgcctgtagtgtgatgtgtct

SEQ ID NO: 18654 - DNA, 25 bp, Homo sapien
gtgtgatgtgtctgaactaataaag

SEQ ID NO: 18655 - DNA, 25 bp, Homo sapien
ttccaacatcctgcaggggctgtgg

SEQ ID NO: 18656 - DNA, 25 bp, Homo sapien
gacagaggcctgcagtggaggtcca

SEQ ID NO: 18657 - DNA, 25 bp, Homo sapien
agctgccgacgcccaggaagaaaac

SEQ ID NO: 18658 - DNA, 25 bp, Homo sapien
gaaaacctctatgctgccgtgaagg

SEQ ID NO: 18659 - DNA, 25 bp, Homo sapien
actcgggctgctgcatctgaagccc

SEQ ID NO: 18660 - DNA, 25 bp, Homo sapien
acagcttgaccctcagacggaaggc

SEQ ID NO: 18661 - DNA, 25 bp, Homo sapien
aggaaagggaacctccagctgagcc

SEQ ID NO: 18662 - DNA, 25 bp, Homo sapien
tccactagcccggagggtacgcaga

SEQ ID NO: 18663 - DNA, 25 bp, Homo sapien
ggactgctgaaggcacgggagctgc

SEQ ID NO: 18664 - DNA, 25 bp, Homo sapien
gatgctgggaactttgggactcact

SEQ ID NO: 18665 - DNA, 25 bp, Homo sapien
gggactcacttgattctgcagtcga

SEQ ID NO: 18666 - DNA, 25 bp, Homo sapien
tgtggcaaagcttttaaccgaccct

SEQ ID NO: 18667 - DNA, 25 bp, Homo sapien
ccgaccctcaaaccttattgaacat

SEQ ID NO: 18668 - DNA, 25 bp, Homo sapien
actggagagcaaccctacaaatgtg

SEQ ID NO: 18669 - DNA, 25 bp, Homo sapien
gcaaagcatttaactattcctcaca

SEQ ID NO: 18670 - DNA, 25 bp, Homo sapien
ctattcctcacaccttaatacacat

SEQ ID NO: 18671 - DNA, 25 bp, Homo sapien
gaatgtggcaaagctttcaaccaat

SEQ ID NO: 18672 - DNA, 25 bp, Homo sapien
caaccaatattcaaaccttactaca

SEQ ID NO: 18673 - DNA, 25 bp, Homo sapien
tgacagtgattttgacaacacctca

SEQ ID NO: 18674 - DNA, 25 bp, Homo sapien
caacacctcaaactttttcaaacat

SEQ ID NO: 18675 - DNA, 25 bp, Homo sapien
aaggctttacatggttgtcacactt

SEQ ID NO: 18676 - DNA, 25 bp, Homo sapien
aatgctcataccttattgcacagga

SEQ ID NO: 18677 - DNA, 25 bp, Homo sapien
gggcagatcttcaagcagacctaca

SEQ ID NO: 18678 - DNA, 25 bp, Homo sapien
gcagacctacagcaagttcgacaca

SEQ ID NO: 18679 - DNA, 25 bp, Homo sapien
aactcacacaacgatgacgcactac

SEQ ID NO: 18680 - DNA, 25 bp, Homo sapien
gacgcactactcaagaactacgggc

SEQ ID NO: 18681 - DNA, 25 bp, Homo sapien
gctgctctactgcttcaggaaggac

SEQ ID NO: 18682 - DNA, 25 bp, Homo sapien
gacaaggtcgagacattcctgcgca

SEQ ID NO: 18683 - DNA, 25 bp, Homo sapien
ggcagctgtggcttctagctgcccg

SEQ ID NO: 18684 - DNA, 25 bp, Homo sapien
gccttggaagttgccactccagtgc

SEQ ID NO: 18685 - DNA, 25 bp, Homo sapien
cgaaccactcagggtcctgtggacg

SEQ ID NO: 18686 - DNA, 25 bp, Homo sapien
cgctcacctagctgcaatggctaca

SEQ ID NO: 18687 - DNA, 25 bp, Homo sapien
agaggctggaagatggcagcccccg

SEQ ID NO: 18688 - DNA, 25 bp, Homo sapien
gcctgggggctatctggatgtgggc

SEQ ID NO: 18689 - DNA, 25 bp, Homo sapien
tgggggctatctggatgtgggctcc

SEQ ID NO: 18690 - DNA, 25 bp, Homo sapien
gggctatctggatgtgggctccaaa

SEQ ID NO: 18691 - DNA, 25 bp, Homo sapien
ggatgtgggctccaaacccatgtac

SEQ ID NO: 18692 - DNA, 25 bp, Homo sapien
gggctccaaacccatgtactgaacc

SEQ ID NO: 18693 - DNA, 25 bp, Homo sapien
caaacccatgtactgaaccactgct

SEQ ID NO: 18694 - DNA, 25 bp, Homo sapien
cacaccaaatggccgccttgggcct

SEQ ID NO: 18695 - DNA, 25 bp, Homo sapien
cctcaacttcacaccttgatttcac

SEQ ID NO: 18696 - DNA, 25 bp, Homo sapien
tcaacttcacaccttgatttcactc

SEQ ID NO: 18697 - DNA, 25 bp, Homo sapien
cccctctggcttcaaagcctaacca

SEQ ID NO: 18698 - DNA, 25 bp, Homo sapien
caaagcctaaccaaggctgctggga

SEQ ID NO: 18699 - DNA, 25 bp, Homo sapien
ataaacgggtcgcagacttccaggg

SEQ ID NO: 18700 - DNA, 25 bp, Homo sapien
gacgcctttgtacggagacctaggg

SEQ ID NO: 18701 - DNA, 25 bp, Homo sapien
atgaccctaaccgtgggaatcaggt

SEQ ID NO: 18702 - DNA, 25 bp, Homo sapien
acatcctcagatgactttcggcagg

SEQ ID NO: 18703 - DNA, 25 bp, Homo sapien
tttcggcaggctccagggaatcttc

SEQ ID NO: 18704 - DNA, 25 bp, Homo sapien
gggaatcttcccgaagatcacgccc

SEQ ID NO: 18705 - DNA, 25 bp, Homo sapien
ggagacctagggttggttctcaaat

SEQ ID NO: 18706 - DNA, 25 bp, Homo sapien
agcatctggcccacagaacaatggg

SEQ ID NO: 18707 - DNA, 25 bp, Homo sapien
aacaatgggaaacagctgcgcccct

SEQ ID NO: 18708 - DNA, 25 bp, Homo sapien
cctggacccacagagtgcgtgagag

SEQ ID NO: 18709 - DNA, 25 bp, Homo sapien
gcgaccctccggaagatgacgagta

SEQ ID NO: 18710 - DNA, 25 bp, Homo sapien
ctggcctttgacacctaccaggagt

SEQ ID NO: 18711 - DNA, 25 bp, Homo sapien
gtttctcagagtctattccgacacc

SEQ ID NO: 18712 - DNA, 25 bp, Homo sapien
gctcatccagtcgtggctggagccc

SEQ ID NO: 18713 - DNA, 25 bp, Homo sapien
tgcagttcctcaggagtgtcttcgc

SEQ ID NO: 18714 - DNA, 25 bp, Homo sapien
cttcgccaacagcctggtgtacggc

SEQ ID NO: 18715 - DNA, 25 bp, Homo sapien
tgacagcaacgtctatgacctccta

SEQ ID NO: 18716 - DNA, 25 bp, Homo sapien
gcagacctacagcaagttcgacaca

SEQ ID NO: 18717 - DNA, 25 bp, Homo sapien
gacgcactactcaagaactacgggc

SEQ ID NO: 18718 - DNA, 25 bp, Homo sapien
gctgctctactgcttcaggaaggac

SEQ ID NO: 18719 - DNA, 25 bp, Homo sapien
gacaaggtcgagacattcctgcgca

SEQ ID NO: 18720 - DNA, 25 bp, Homo sapien
gccttggaagttgccactccagtgc

SEQ ID NO: 18721 - DNA, 25 bp, Homo sapien
ctcccagcatcaccaacgagtttgg

SEQ ID NO: 18722 - DNA, 25 bp, Homo sapien
gacgatcatggtgggccaggacggc

SEQ ID NO: 18723 - DNA, 25 bp, Homo sapien
gccaggtccggatggtggtgggagc

SEQ ID NO: 18724 - DNA, 25 bp, Homo sapien
tcatctacaacctctggttcggcta

SEQ ID NO: 18725 - DNA, 25 bp, Homo sapien
tctgcccaacgtcacgacagtggag

SEQ ID NO: 18726 - DNA, 25 bp, Homo sapien
gaccaggcagtgactgcagccctgg

SEQ ID NO: 18727 - DNA, 25 bp, Homo sapien
tcatcgctgtggtgcaagccatcgt

SEQ ID NO: 18728 - DNA, 25 bp, Homo sapien
agctgcctcggactccaggaaaggc

SEQ ID NO: 18729 - DNA, 25 bp, Homo sapien
cggctactgagtgctccaggaggac

SEQ ID NO: 18730 - DNA, 25 bp, Homo sapien
gggacaagatactcaccaggaccag

SEQ ID NO: 18731 - DNA, 25 bp, Homo sapien
cttcccctgtgagcagcagagcagc

SEQ ID NO: 18732 - DNA, 25 bp, Homo sapien
tgaaaagtctcccatgtctacttct

SEQ ID NO: 18733 - DNA, 25 bp, Homo sapien
ctacttctttctacacagacacggc

SEQ ID NO: 18734 - DNA, 25 bp, Homo sapien
agacacggcaaccatccgatttctc

SEQ ID NO: 18735 - DNA, 25 bp, Homo sapien
aaccgccattgtcatcatggcccgt

SEQ ID NO: 18736 - DNA, 25 bp, Homo sapien
atggcccgttctcaatgagctgttg

SEQ ID NO: 18737 - DNA, 25 bp, Homo sapien
tacacctcccagacggggtggtggc

SEQ ID NO: 18738 - DNA, 25 bp, Homo sapien
ggcgctcccatctcagacgatgggc

SEQ ID NO: 18739 - DNA, 25 bp, Homo sapien
gctcctcacttcctagatgggatgg

SEQ ID NO: 18740 - DNA, 25 bp, Homo sapien
ctcctcactttccagactgggcagc

SEQ ID NO: 18741 - DNA, 25 bp, Homo sapien
tcctcacttcccagacggggtagcg

SEQ ID NO: 18742 - DNA, 25 bp, Homo sapien
tgcaatctcggcactttggggggcc

SEQ ID NO: 18743 - DNA, 25 bp, Homo sapien
gaatgcagctgaagacctgttatgt

SEQ ID NO: 18744 - DNA, 25 bp, Homo sapien
ggggtggtgctagaagacagacatc

SEQ ID NO: 18745 - DNA, 25 bp, Homo sapien
ggaatgattcacatcctctcaagtt

SEQ ID NO: 18746 - DNA, 25 bp, Homo sapien
aggatggaggcctgcttcattaaga

SEQ ID NO: 18747 - DNA, 25 bp, Homo sapien
gagaacacttaacaacatggggacc

SEQ ID NO: 18748 - DNA, 25 bp, Homo sapien
acatggggaccagtcaggggaatcc

SEQ ID NO: 18749 - DNA, 25 bp, Homo sapien
tcaggggaatccccttatttctgtt

SEQ ID NO: 18750 - DNA, 25 bp, Homo sapien
gaaccctagagcagccaggtgaggc

SEQ ID NO: 18751 - DNA, 25 bp, Homo sapien
aagactcttaatgcagactcttctt

SEQ ID NO: 18752 - DNA, 25 bp, Homo sapien
tgttgaggtaatctttcccaccttc

SEQ ID NO: 18753 - DNA, 25 bp, Homo sapien
ttcccaaacctaattcttgtagatg

SEQ ID NO: 18754 - DNA, 25 bp, Homo sapien
tcctcaagggggcagaccttccaga

SEQ ID NO: 18755 - DNA, 25 bp, Homo sapien
cctccccagtcatctaggattcaat

SEQ ID NO: 18756 - DNA, 25 bp, Homo sapien
ggaggcaacagacctcaaggtcccc

SEQ ID NO: 18757 - DNA, 25 bp, Homo sapien
cacccccacaaggagacaagtcccg

SEQ ID NO: 18758 - DNA, 25 bp, Homo sapien
aggaggcaaccagcctcaaggtccc

SEQ ID NO: 18759 - DNA, 25 bp, Homo sapien
cacctcctccaggaaagccacaagg

SEQ ID NO: 18760 - DNA, 25 bp, Homo sapien
cccacctccaggaaagccacaagga

SEQ ID NO: 18761 - DNA, 25 bp, Homo sapien
ccacccgcacaaggaggcagcaagt

SEQ ID NO: 18762 - DNA, 25 bp, Homo sapien
gaggcagcaagtcccaaagtgcccg

SEQ ID NO: 18763 - DNA, 25 bp, Homo sapien
ggaccaccccaacaagaaggcaaca

SEQ ID NO: 18764 - DNA, 25 bp, Homo sapien
gaaggcaacaatcctcaaggtcccc

SEQ ID NO: 18765 - DNA, 25 bp, Homo sapien
gtccaagcccgactgagtgaagctg

SEQ ID NO: 18766 - DNA, 25 bp, Homo sapien
gtgaagctgagtctcagtgtgcatt

SEQ ID NO: 18767 - DNA, 25 bp, Homo sapien
gaagaggaataactcccttcctgat

SEQ ID NO: 18768 - DNA, 25 bp, Homo sapien
gaataatattgcaaggcttcaggaa

SEQ ID NO: 18769 - DNA, 25 bp, Homo sapien
ggaagaactcattgctgtgaaactt

SEQ ID NO: 18770 - DNA, 25 bp, Homo sapien
gaagcagaagccattatgggtttga

SEQ ID NO: 18771 - DNA, 25 bp, Homo sapien
ttagaggaacactggcagcgccact

SEQ ID NO: 18772 - DNA, 25 bp, Homo sapien
cgccacttagctcgtactactggga

SEQ ID NO: 18773 - DNA, 25 bp, Homo sapien
tggaaagacccacccaagaaaaatg

SEQ ID NO: 18774 - DNA, 25 bp, Homo sapien
tgaactgatgaccattcgacttaga

SEQ ID NO: 18775 - DNA, 25 bp, Homo sapien
tgaccattcgacttagagaagctga

SEQ ID NO: 18776 - DNA, 25 bp, Homo sapien
tgaaatggacgacttcagctctccc

SEQ ID NO: 18777 - DNA, 25 bp, Homo sapien
ctcccagcatcaccaacgagtttgg

SEQ ID NO: 18778 - DNA, 25 bp, Homo sapien
gacgatcatggtgggccaggacggc

SEQ ID NO: 18779 - DNA, 25 bp, Homo sapien
gccaggtccggatggtggtgggagc

SEQ ID NO: 18780 - DNA, 25 bp, Homo sapien
tcatctacaacctctggttcggcta

SEQ ID NO: 18781 - DNA, 25 bp, Homo sapien
tctgcccaacgtcacgacagtggag

SEQ ID NO: 18782 - DNA, 25 bp, Homo sapien
gaccaggcagtgactgcagccctgg

SEQ ID NO: 18783 - DNA, 25 bp, Homo sapien
tcatcgctgtggtgcaagccatcgt

SEQ ID NO: 18784 - DNA, 25 bp, Homo sapien
agctgcctcggactccaggaaaggc

SEQ ID NO: 18785 - DNA, 25 bp, Homo sapien
cggctactgagtgctccaggaggac

SEQ ID NO: 18786 - DNA, 25 bp, Homo sapien
gggacaagatactcaccaggaccag

SEQ ID NO: 18787 - DNA, 25 bp, Homo sapien
aggccagggtacgtgagcttgaagg

SEQ ID NO: 18788 - DNA, 25 bp, Homo sapien
tgcagaggctgttaaaggtttacgg

SEQ ID NO: 18789 - DNA, 25 bp, Homo sapien
cctaccagactgaagaagatcgcaa

SEQ ID NO: 18790 - DNA, 25 bp, Homo sapien
agatcgcaagaatgttctcaggctg

SEQ ID NO: 18791 - DNA, 25 bp, Homo sapien
ggaacaatccaatgctaatctatct

SEQ ID NO: 18792 - DNA, 25 bp, Homo sapien
atctatctaaattccgcaaactcca

SEQ ID NO: 18793 - DNA, 25 bp, Homo sapien
gtcccaggtcaacaaattgcgagtg

SEQ ID NO: 18794 - DNA, 25 bp, Homo sapien
attgcgagtgaagagccgagaggtt

SEQ ID NO: 18795 - DNA, 25 bp, Homo sapien
agtgcagagtaaacacacctgcctg

SEQ ID NO: 18796 - DNA, 25 bp, Homo sapien
acacctgcctgatgctatcaagagg

SEQ ID NO: 18797 - DNA, 25 bp, Homo sapien
gctttatgacgtttattttcctgtt

SEQ ID NO: 18798 - DNA, 25 bp, Homo sapien
caacgtgcagcctattgacgatggc

SEQ ID NO: 18799 - DNA, 25 bp, Homo sapien
tgacgatggctggatgtacggcaca

SEQ ID NO: 18800 - DNA, 25 bp, Homo sapien
ggaatgctcccagcgaattacattg

SEQ ID NO: 18801 - DNA, 25 bp, Homo sapien
ctgccctttgagctttattctaatg

SEQ ID NO: 18802 - DNA, 25 bp, Homo sapien
aatgatgtatccttcctttgacaat

SEQ ID NO: 18803 - DNA, 25 bp, Homo sapien
aggaatgacctctgggctgaaaaca

SEQ ID NO: 18804 - DNA, 25 bp, Homo sapien
agcagcattttcagtaattcctaca

SEQ ID NO: 18805 - DNA, 25 bp, Homo sapien
cctggtgctgctaattgtgttcatg

SEQ ID NO: 18806 - DNA, 25 bp, Homo sapien
atggtttcctttgattggctattga

SEQ ID NO: 18807 - DNA, 25 bp, Homo sapien
gaaacttcttagctgtcactttgga

SEQ ID NO: 18808 - DNA, 25 bp, Homo sapien
tcactttggaatcaccccaagccaa

SEQ ID NO: 18809 - DNA, 25 bp, Homo sapien
gaagagctgatctgctggctgtata

SEQ ID NO: 18810 - DNA, 25 bp, Homo sapien
agatgttactgaccacgggactgca

SEQ ID NO: 18811 - DNA, 25 bp, Homo sapien
ctgcagccaggtccaatcttacaag

SEQ ID NO: 18812 - DNA, 25 bp, Homo sapien
ggtccaatcttacaagtctcaagtc

SEQ ID NO: 18813 - DNA, 25 bp, Homo sapien
gcagctttaccggcaatttaagaaa

SEQ ID NO: 18814 - DNA, 25 bp, Homo sapien
gatgaacatcagtctctgacggaga

SEQ ID NO: 18815 - DNA, 25 bp, Homo sapien
agggggagattcttcttcagtgcct

SEQ ID NO: 18816 - DNA, 25 bp, Homo sapien
ggagaacaccccagttttagaggat

SEQ ID NO: 18817 - DNA, 25 bp, Homo sapien
ggaggatcgcaaagcagtctggtga

SEQ ID NO: 18818 - DNA, 25 bp, Homo sapien
gcacccttatccctgacaaaaagcc

SEQ ID NO: 18819 - DNA, 25 bp, Homo sapien
tgtgaaggggtttaacctggcatct

SEQ ID NO: 18820 - DNA, 25 bp, Homo sapien
ggacagctcacctagtggcaatggc

SEQ ID NO: 18821 - DNA, 25 bp, Homo sapien
gccctggcttcaagaggctggtgcc

SEQ ID NO: 18822 - DNA, 25 bp, Homo sapien
tccgttatccaggctttttgaccac

SEQ ID NO: 18823 - DNA, 25 bp, Homo sapien
gcagatcctcaagcagacctacagc

SEQ ID NO: 18824 - DNA, 25 bp, Homo sapien
gacgcactgctcaagaactacgggc

SEQ ID NO: 18825 - DNA, 25 bp, Homo sapien
gctgctctactgcttcaggaaggac

SEQ ID NO: 18826 - DNA, 25 bp, Homo sapien
gacaaggtcgagacattcctgcgca

SEQ ID NO: 18827 - DNA, 25 bp, Homo sapien
gcagtgccgctctgtagagggtagc

SEQ ID NO: 18828 - DNA, 25 bp, Homo sapien
agggtagctgtggcttctaggtgcc

SEQ ID NO: 18829 - DNA, 25 bp, Homo sapien
acaagagaccggctctaggatccca

SEQ ID NO: 18830 - DNA, 25 bp, Homo sapien
gaaccactcagggtcctgtggacag

SEQ ID NO: 18831 - DNA, 25 bp, Homo sapien
agaatcacctgagagctcgtttaaa

SEQ ID NO: 18832 - DNA, 25 bp, Homo sapien
gagagctcgtttaaaatgccctttt

SEQ ID NO: 18833 - DNA, 25 bp, Homo sapien
aaatgcccttttaagacctgcagca

SEQ ID NO: 18834 - DNA, 25 bp, Homo sapien
taagacctgcagcagtgactctcaa

SEQ ID NO: 18835 - DNA, 25 bp, Homo sapien
ggttgatttggcgatctctggagac

SEQ ID NO: 18836 - DNA, 25 bp, Homo sapien
ctgctgaacatcccacagtgcgcag

SEQ ID NO: 18837 - DNA, 25 bp, Homo sapien
cagcccctcacaaaaagaaaccctg

SEQ ID NO: 18838 - DNA, 25 bp, Homo sapien
ggaagggctcactgggaatcttcgt

SEQ ID NO: 18839 - DNA, 25 bp, Homo sapien
gaatcttcgtttgtcatgagccagt

SEQ ID NO: 18840 - DNA, 25 bp, Homo sapien
catgagccagtggaatgttttttgg

SEQ ID NO: 18841 - DNA, 25 bp, Homo sapien
gtttcatgtttcaccgtgttgtcca

SEQ ID NO: 18842 - DNA, 25 bp, Homo sapien
acttggctactatctttgtatcact

SEQ ID NO: 18843 - DNA, 25 bp, Homo sapien
aataggctacaacatccatgctctt

SEQ ID NO: 18844 - DNA, 25 bp, Homo sapien
tgaaagggggaggcacactccctcc

SEQ ID NO: 18845 - DNA, 25 bp, Homo sapien
tgcaggattaccttcttatgaacag

SEQ ID NO: 18846 - DNA, 25 bp, Homo sapien
cttcttatgaacaggcagtggcgct

SEQ ID NO: 18847 - DNA, 25 bp, Homo sapien
gcagtggcgctgaccagaaaacaca

SEQ ID NO: 18848 - DNA, 25 bp, Homo sapien
ccaccatatcctgggcacacaaaag

SEQ ID NO: 18849 - DNA, 25 bp, Homo sapien
taaaaaatctatgtctctcccatct

SEQ ID NO: 18850 - DNA, 25 bp, Homo sapien
gtgttatttgataggccgggcatgg

SEQ ID NO: 18851 - DNA, 25 bp, Homo sapien
attacctaggcgtcatggggcatgc

SEQ ID NO: 18852 - DNA, 25 bp, Homo sapien
ctaggcgtcatggggcatgcctgta

SEQ ID NO: 18853 - DNA, 25 bp, Homo sapien
gacgacgtgatagggcaggtgcggc

SEQ ID NO: 18854 - DNA, 25 bp, Homo sapien
ggtgcggcgaccagagatgggtgac

SEQ ID NO: 18855 - DNA, 25 bp, Homo sapien
agatgggtgaccaggctcacatgcc

SEQ ID NO: 18856 - DNA, 25 bp, Homo sapien
atgacatcccgtgacatcgaagtac

SEQ ID NO: 18857 - DNA, 25 bp, Homo sapien
atcgaagtacagggcttccgcatcc

SEQ ID NO: 18858 - DNA, 25 bp, Homo sapien
ggcttccgcatccctaagggaacga

SEQ ID NO: 18859 - DNA, 25 bp, Homo sapien
taagggaacgacactcatcaccaac

SEQ ID NO: 18860 - DNA, 25 bp, Homo sapien
accaacctgtcatcggtgctgaagg

SEQ ID NO: 18861 - DNA, 25 bp, Homo sapien
gctgtgccccgctagaatggggtac

SEQ ID NO: 18862 - DNA, 25 bp, Homo sapien
gctagaatggggtacctagtcccca

SEQ ID NO: 18863 - DNA, 25 bp, Homo sapien
ccgtgtccaacaggagatcgacgac

SEQ ID NO: 18864 - DNA, 25 bp, Homo sapien
ccggcgaagacgcctcgccggagga

SEQ ID NO: 18865 - DNA, 25 bp, Homo sapien
gtcacccggcagcggtatgggaaaa

SEQ ID NO: 18866 - DNA, 25 bp, Homo sapien
ccggcagcggtatgggaaaagagac

SEQ ID NO: 18867 - DNA, 25 bp, Homo sapien
gcggtatgggaaaagagacggcccg

SEQ ID NO: 18868 - DNA, 25 bp, Homo sapien
tcgtctgcttcacaagctatcgcta

SEQ ID NO: 18869 - DNA, 25 bp, Homo sapien
gtctgcttcacaagctatcgctatg

SEQ ID NO: 18870 - DNA, 25 bp, Homo sapien
ctgcttcacaagctatcgctatggt

SEQ ID NO: 18871 - DNA, 25 bp, Homo sapien
gcttcacaagctatcgctatggtgt

SEQ ID NO: 18872 - DNA, 25 bp, Homo sapien
caagctatcgctatggtgttcgtgc

SEQ ID NO: 18873 - DNA, 25 bp, Homo sapien
gctatcgctatggtgttcgtgcgca

SEQ ID NO: 18874 - DNA, 25 bp, Homo sapien
atcgctatggtgttcgtgcgcaggc

SEQ ID NO: 18875 - DNA, 25 bp, Homo sapien
cccaggaccctgaagacgaaattgc

SEQ ID NO: 18876 - DNA, 25 bp, Homo sapien
aagacgaaattgcggtgctggcctt

SEQ ID NO: 18877 - DNA, 25 bp, Homo sapien
gctggaacccaggtgaacgagggct

SEQ ID NO: 18878 - DNA, 25 bp, Homo sapien
cccaggtgaacgagggcttccagcc

SEQ ID NO: 18879 - DNA, 25 bp, Homo sapien
cagccactggtggaggcactgtcta

SEQ ID NO: 18880 - DNA, 25 bp, Homo sapien
tggaggcactgtctaatatccccaa

SEQ ID NO: 18881 - DNA, 25 bp, Homo sapien
ccaaacctgagatgagcactacgat

SEQ ID NO: 18882 - DNA, 25 bp, Homo sapien
gatgagcactacgatggcagagagc

SEQ ID NO: 18883 - DNA, 25 bp, Homo sapien
atggcagagagcagcctgttggacc

SEQ ID NO: 18884 - DNA, 25 bp, Homo sapien
cagagagcagcctgttggacctgct

SEQ ID NO: 18885 - DNA, 25 bp, Homo sapien
tgaaggacaatgtcaggcccctgca

SEQ ID NO: 18886 - DNA, 25 bp, Homo sapien
ccctagaggggcaccttttcatggt

SEQ ID NO: 18887 - DNA, 25 bp, Homo sapien
tagaggggcaccttttcatggtctc

SEQ ID NO: 18888 - DNA, 25 bp, Homo sapien
tttactctagaggcatcacctggga

SEQ ID NO: 18889 - DNA, 25 bp, Homo sapien
tagaggcatcacctgggaccttact

SEQ ID NO: 18890 - DNA, 25 bp, Homo sapien
tcctctttcttcattcagatctata

SEQ ID NO: 18891 - DNA, 25 bp, Homo sapien
cttcattcagatctatatggcaaat

SEQ ID NO: 18892 - DNA, 25 bp, Homo sapien
tagccacaattatataaatcatttc

SEQ ID NO: 18893 - DNA, 25 bp, Homo sapien
atattactccacaccttttatgaat

SEQ ID NO: 18894 - DNA, 25 bp, Homo sapien
actccacaccttttatgaatcaaat

SEQ ID NO: 18895 - DNA, 25 bp, Homo sapien
tattttcgtggagacggggcctcac

SEQ ID NO: 18896 - DNA, 25 bp, Homo sapien
ggctggaaataggattttgaaccca

SEQ ID NO: 18897 - DNA, 25 bp, Homo sapien
ggtgggaggactgcttaagctcagg

SEQ ID NO: 18898 - DNA, 25 bp, Homo sapien
ctgggcaacatagcaagacccccac

SEQ ID NO: 18899 - DNA, 25 bp, Homo sapien
tggtggtgtgcacctgagaatccca

SEQ ID NO: 18900 - DNA, 25 bp, Homo sapien
gagacaaaggggatcgcttgagccc

SEQ ID NO: 18901 - DNA, 25 bp, Homo sapien
gagagctatgactgcatcactgcac

SEQ ID NO: 18902 - DNA, 25 bp, Homo sapien
ggcaacacagcaagatcctgtctaa

SEQ ID NO: 18903 - DNA, 25 bp, Homo sapien
gaaagagacggggctctgaggccga

SEQ ID NO: 18904 - DNA, 25 bp, Homo sapien
ctgaggccgagcacagtggcccatg

SEQ ID NO: 18905 - DNA, 25 bp, Homo sapien
agcacagtggcccatgcctataatc

SEQ ID NO: 18906 - DNA, 25 bp, Homo sapien
tgcagtgagccgacatcatgccact

SEQ ID NO: 18907 - DNA, 25 bp, Homo sapien
gcctggggctgacagagcaagacac

SEQ ID NO: 18908 - DNA, 25 bp, Homo sapien
ctgggattacaggcttgagcccccg

SEQ ID NO: 18909 - DNA, 25 bp, Homo sapien
gcgcccagccatcaaaatgcttttt

SEQ ID NO: 18910 - DNA, 25 bp, Homo sapien
gctttttatttctgcatatgtttga

SEQ ID NO: 18911 - DNA, 25 bp, Homo sapien
tcacaaacttttatactctttctgt

SEQ ID NO: 18912 - DNA, 25 bp, Homo sapien
tctgtatatacattttttttcttta

SEQ ID NO: 18913 - DNA, 25 bp, Homo sapien
aatagccacatttagaacacttttt

SEQ ID NO: 18914 - DNA, 25 bp, Homo sapien
aacactttttgttatcagtcaatat

SEQ ID NO: 18915 - DNA, 25 bp, Homo sapien
gatagttagaacctggtcctaagcc

SEQ ID NO: 18916 - DNA, 25 bp, Homo sapien
gaacctggtcctaagcctaaaagtg

SEQ ID NO: 18917 - DNA, 25 bp, Homo sapien
aagtgggcttgattctgcagtaaat

SEQ ID NO: 18918 - DNA, 25 bp, Homo sapien
taaatcttttacaactgcctcgaca

SEQ ID NO: 18919 - DNA, 25 bp, Homo sapien
taagggtccaccagtatgcatagta

SEQ ID NO: 18920 - DNA, 25 bp, Homo sapien
accagtatgcatagtactttttctt

SEQ ID NO: 18921 - DNA, 25 bp, Homo sapien
actttttcttctagatgctaaatca

SEQ ID NO: 18922 - DNA, 25 bp, Homo sapien
gttttagaatgggcagtgagttgaa

SEQ ID NO: 18923 - DNA, 25 bp, Homo sapien
gagattctcaactctgttgtccata

SEQ ID NO: 18924 - DNA, 25 bp, Homo sapien
caaaattaataactgtgctcacatt

SEQ ID NO: 18925 - DNA, 25 bp, Homo sapien
gaaaaaaatggcccaggcgcggcgg

SEQ ID NO: 18926 - DNA, 25 bp, Homo sapien
cgcggcggcacatgcttgtaatatc

SEQ ID NO: 18927 - DNA, 25 bp, Homo sapien
ttgtaatatcagcacgttgggaagc

SEQ ID NO: 18928 - DNA, 25 bp, Homo sapien
acgttgggaagctgaggcgggtgga

SEQ ID NO: 18929 - DNA, 25 bp, Homo sapien
attaacaaggcatggtggcgcgtgc

SEQ ID NO: 18930 - DNA, 25 bp, Homo sapien
ccttcctagagggccgcaagaagca

SEQ ID NO: 18931 - DNA, 25 bp, Homo sapien
gccgcactgcgagccaagcagaaaa

SEQ ID NO: 18932 - DNA, 25 bp, Homo sapien
gaaaaacgacgtggagggtgccaag

SEQ ID NO: 18933 - DNA, 25 bp, Homo sapien
ggagggtgccaagatgcacctgcgc

SEQ ID NO: 18934 - DNA, 25 bp, Homo sapien
actggagcctatgctggaggcctcg

SEQ ID NO: 18935 - DNA, 25 bp, Homo sapien
gtcaacaaggacgactttgccctgg

SEQ ID NO: 18936 - DNA, 25 bp, Homo sapien
cccggcgctatggtgaactcaccaa

SEQ ID NO: 18937 - DNA, 25 bp, Homo sapien
tcaccaagctcatacggcagcagca

SEQ ID NO: 18938 - DNA, 25 bp, Homo sapien
ggcagcagcacgagatgtgcctgaa

SEQ ID NO: 18939 - DNA, 25 bp, Homo sapien
atgtgcctgaaccactcaaaccaat

SEQ ID NO: 18940 - DNA, 25 bp, Homo sapien
cctgaaccactcaaaccaattcacc

SEQ ID NO: 18941 - DNA, 25 bp, Homo sapien
gaagccaggagaggatcaggttcca

SEQ ID NO: 18942 - DNA, 25 bp, Homo sapien
ggagaggatcaggttccaaagggga

SEQ ID NO: 18943 - DNA, 25 bp, Homo sapien
ggatcaggttccaaaggggaatgct

SEQ ID NO: 18944 - DNA, 25 bp, Homo sapien
ggggaatgctatgaaagggcagtga

SEQ ID NO: 18945 - DNA, 25 bp, Homo sapien
gggcagtgagacaagacctcatcct

SEQ ID NO: 18946 - DNA, 25 bp, Homo sapien
agtgagacaagacctcatcctacct

SEQ ID NO: 18947 - DNA, 25 bp, Homo sapien
cccctggccattggtgactagtggg

SEQ ID NO: 18948 - DNA, 25 bp, Homo sapien
ggccattggtgactagtggggccaa

SEQ ID NO: 18949 - DNA, 25 bp, Homo sapien
gactagtggggccaagagaagctgg

SEQ ID NO: 18950 - DNA, 25 bp, Homo sapien
ggcatgagtatagggaaggaggaag

SEQ ID NO: 18951 - DNA, 25 bp, Homo sapien
gcctgtagctcaatccaaatttgtg

SEQ ID NO: 18952 - DNA, 25 bp, Homo sapien
ctgactgggcagaccctcaagcaga

SEQ ID NO: 18953 - DNA, 25 bp, Homo sapien
agcagacctacagcaagtttgacac

SEQ ID NO: 18954 - DNA, 25 bp, Homo sapien
gtttgacacaaactcgcacaaccat

SEQ ID NO: 18955 - DNA, 25 bp, Homo sapien
cacaaccatgacgcactgctcaaga

SEQ ID NO: 18956 - DNA, 25 bp, Homo sapien
gcactgctcaagaactacgggctgc

SEQ ID NO: 18957 - DNA, 25 bp, Homo sapien
ctgctccactgcttcaggaaggaca

SEQ ID NO: 18958 - DNA, 25 bp, Homo sapien
ggacaaggtcgagacattcctgcgc

SEQ ID NO: 18959 - DNA, 25 bp, Homo sapien
gagacattcctgcgcatggtgcagt

SEQ ID NO: 18960 - DNA, 25 bp, Homo sapien
caccactcagggtcctgtggacagc

SEQ ID NO: 18961 - DNA, 25 bp, Homo sapien
ctcacctagcggcaatggctgcaga

SEQ ID NO: 18962 - DNA, 25 bp, Homo sapien
ggctggaagacggcagccacctgac

SEQ ID NO: 18963 - DNA, 25 bp, Homo sapien
caaacagcctcgcagacgtgggcag

SEQ ID NO: 18964 - DNA, 25 bp, Homo sapien
gctgcaggtgttcctagcagcctct

SEQ ID NO: 18965 - DNA, 25 bp, Homo sapien
agcagcctcttcgggatggctggcc

SEQ ID NO: 18966 - DNA, 25 bp, Homo sapien
gcccggctttgggatgagcagtgct

SEQ ID NO: 18967 - DNA, 25 bp, Homo sapien
ccccgcttgttcagcagcagaatgg

SEQ ID NO: 18968 - DNA, 25 bp, Homo sapien
tcagcagcagaatggctcttccttc

SEQ ID NO: 18969 - DNA, 25 bp, Homo sapien
gctcttccttcggggacttaggatc

SEQ ID NO: 18970 - DNA, 25 bp, Homo sapien
aagttggggcagaggccactgagcc

SEQ ID NO: 18971 - DNA, 25 bp, Homo sapien
tgagccagccagctgggatctccac

SEQ ID NO: 18972 - DNA, 25 bp, Homo sapien
cttcatgactggaccctcatcaagc

SEQ ID NO: 18973 - DNA, 25 bp, Homo sapien
cccttcttgtagcactgtgtttttg

SEQ ID NO: 18974 - DNA, 25 bp, Homo sapien
gaactggcggagcggaacgctgcgc

SEQ ID NO: 18975 - DNA, 25 bp, Homo sapien
tcccttacaatgtgcctttggggct

SEQ ID NO: 18976 - DNA, 25 bp, Homo sapien
ttcctatgcagctttaatgtccccg

SEQ ID NO: 18977 - DNA, 25 bp, Homo sapien
cccggggtgggagttcaaggctcag

SEQ ID NO: 18978 - DNA, 25 bp, Homo sapien
aaggctcagtaatggcctggtcccc

SEQ ID NO: 18979 - DNA, 25 bp, Homo sapien
atggaggagggagggcttcaggacg

SEQ ID NO: 18980 - DNA, 25 bp, Homo sapien
caggacggggcgtcagagggagccc

SEQ ID NO: 18981 - DNA, 25 bp, Homo sapien
ccagcagtagacggcttgggggagt

SEQ ID NO: 18982 - DNA, 25 bp, Homo sapien
gcttgggggagtcggaggctccccg

SEQ ID NO: 18983 - DNA, 25 bp, Homo sapien
gagtgtggacagtatctggaagttc

SEQ ID NO: 18984 - DNA, 25 bp, Homo sapien
ggaagttctgggattcaggttgtta

SEQ ID NO: 18985 - DNA, 25 bp, Homo sapien
gaacaggagagttcccaggccagta

SEQ ID NO: 18986 - DNA, 25 bp, Homo sapien
caggccagtacggaagaatgtgaga

SEQ ID NO: 18987 - DNA, 25 bp, Homo sapien
taagcaggacacaattacaactaaa

SEQ ID NO: 18988 - DNA, 25 bp, Homo sapien
ctaagcatttgcaaaggcgacaata

SEQ ID NO: 18989 - DNA, 25 bp, Homo sapien
caataaattattgacgcttaacctt

SEQ ID NO: 18990 - DNA, 25 bp, Homo sapien
atttcaaaccacacattagtactta

SEQ ID NO: 18991 - DNA, 25 bp, Homo sapien
caaatttacctcagcgtttgtgtat

SEQ ID NO: 18992 - DNA, 25 bp, Homo sapien
aatcgttttgcccgattccgtattg

SEQ ID NO: 18993 - DNA, 25 bp, Homo sapien
ttgcccgattccgtattggtatact

SEQ ID NO: 18994 - DNA, 25 bp, Homo sapien
atacttttgcttcagttgcatatct

SEQ ID NO: 18995 - DNA, 25 bp, Homo sapien
atctttggatttgatcactacaagt

SEQ ID NO: 18996 - DNA, 25 bp, Homo sapien
tctgcagtggtgctgaaacgaccgg

SEQ ID NO: 18997 - DNA, 25 bp, Homo sapien
gtggtgctgaaacgaccggagatac

SEQ ID NO: 18998 - DNA, 25 bp, Homo sapien
aacgaccggagatactgacagatga

SEQ ID NO: 18999 - DNA, 25 bp, Homo sapien
tgacagatgagagcctcagcagctt

SEQ ID NO: 19000 - DNA, 25 bp, Homo sapien
tccaaaccagcgccatttcaaggga

SEQ ID NO: 19001 - DNA, 25 bp, Homo sapien
tcaagggacatcgacacagcagcca

SEQ ID NO: 19002 - DNA, 25 bp, Homo sapien
caagttcattggagctggggctgcc

SEQ ID NO: 19003 - DNA, 25 bp, Homo sapien
ctcttttgtctgatggtagcctttc

SEQ ID NO: 19004 - DNA, 25 bp, Homo sapien
ctggggaacgtggttggctcagggt

SEQ ID NO: 19005 - DNA, 25 bp, Homo sapien
gaacgtggttggctcagggtttgac

SEQ ID NO: 19006 - DNA, 25 bp, Homo sapien
cgtggttggctcagggtttgacaga

SEQ ID NO: 19007 - DNA, 25 bp, Homo sapien
gaagaactctttctcagtatccctt

SEQ ID NO: 19008 - DNA, 25 bp, Homo sapien
ccttgtgtcttggggcggaatggtg

SEQ ID NO: 19009 - DNA, 25 bp, Homo sapien
gggcggaatggtgtctcagatgttg

SEQ ID NO: 19010 - DNA, 25 bp, Homo sapien
ggaggaggcccttttcaagaagagt

SEQ ID NO: 19011 - DNA, 25 bp, Homo sapien
taaagccttctaatgttccactgtt

SEQ ID NO: 19012 - DNA, 25 bp, Homo sapien
ggtgttgctctgaagactctggacc

SEQ ID NO: 19013 - DNA, 25 bp, Homo sapien
gaagactctggaccctaaattagga

SEQ ID NO: 19014 - DNA, 25 bp, Homo sapien
gctgaaggggtatacctcttgggct

SEQ ID NO: 19015 - DNA, 25 bp, Homo sapien
tcttgggctattggactgtctgtga

SEQ ID NO: 19016 - DNA, 25 bp, Homo sapien
gactgtctgtgatggatctggtagg

SEQ ID NO: 19017 - DNA, 25 bp, Homo sapien
tcttaggagagtgcacccagtttcc

SEQ ID NO: 19018 - DNA, 25 bp, Homo sapien
ggaaggctgtacagtaaaacgtaag

SEQ ID NO: 19019 - DNA, 25 bp, Homo sapien
gggtgttgaagtcacagggtttggt

SEQ ID NO: 19020 - DNA, 25 bp, Homo sapien
cacagggtttggtttcgaatctagg

SEQ ID NO: 19021 - DNA, 25 bp, Homo sapien
ttcgaatctaggctccacttgttag

SEQ ID NO: 19022 - DNA, 25 bp, Homo sapien
acttgttagagcctcggtgatcact

SEQ ID NO: 19023 - DNA, 25 bp, Homo sapien
ggtgatcactgaatagtaacttctt

SEQ ID NO: 19024 - DNA, 25 bp, Homo sapien
gtaacttctttcttgaactaagatc

SEQ ID NO: 19025 - DNA, 25 bp, Homo sapien
gaatgattttaacctcaatgagttg

SEQ ID NO: 19026 - DNA, 25 bp, Homo sapien
aatgcttatcacagtactttcaata

SEQ ID NO: 19027 - DNA, 25 bp, Homo sapien
tatcctggcggagttatgcacgctt

SEQ ID NO: 19028 - DNA, 25 bp, Homo sapien
ggcggagttatgcacgcttgtagtc

SEQ ID NO: 19029 - DNA, 25 bp, Homo sapien
gctcctgtgggggctccaagggagg

SEQ ID NO: 19030 - DNA, 25 bp, Homo sapien
caagggaggctgtggttcttgtggc

SEQ ID NO: 19031 - DNA, 25 bp, Homo sapien
tgctcccagtgcagctgctataagc

SEQ ID NO: 19032 - DNA, 25 bp, Homo sapien
gcagctgctataagccctgctgctg

SEQ ID NO: 19033 - DNA, 25 bp, Homo sapien
gttcccagtccagctgttgtaagcc

SEQ ID NO: 19034 - DNA, 25 bp, Homo sapien
tcttcaggctgtgggtcatcctgct

SEQ ID NO: 19035 - DNA, 25 bp, Homo sapien
tgttcccagtccagctgctgtaagc

SEQ ID NO: 19036 - DNA, 25 bp, Homo sapien
ctcttcaggctgtgggtcatcctgc

SEQ ID NO: 19037 - DNA, 25 bp, Homo sapien
ccagctgctgtgtcccaatttgctg

SEQ ID NO: 19038 - DNA, 25 bp, Homo sapien
gtcccaatttgctgccagtgcaaga

SEQ ID NO: 19039 - DNA, 25 bp, Homo sapien
tggctgtgggggatgtggctctagc

SEQ ID NO: 19040 - DNA, 25 bp, Homo sapien
tgccaccacaccaggctggttttct

SEQ ID NO: 19041 - DNA, 25 bp, Homo sapien
caccaggctggttttcttgtatttt

SEQ ID NO: 19042 - DNA, 25 bp, Homo sapien
gacaaagttttgctcttgtcaccca

SEQ ID NO: 19043 - DNA, 25 bp, Homo sapien
tcccaggttcaagagattctcctgc

SEQ ID NO: 19044 - DNA, 25 bp, Homo sapien
tgcccggctaattttttgcattttt

SEQ ID NO: 19045 - DNA, 25 bp, Homo sapien
ttgcatttttagtagacatgaggtt

SEQ ID NO: 19046 - DNA, 25 bp, Homo sapien
catgaggtttcatcatgttggccag

SEQ ID NO: 19047 - DNA, 25 bp, Homo sapien
caccatgcctggccatgattcttaa

SEQ ID NO: 19048 - DNA, 25 bp, Homo sapien
atgcctggccatgattcttaagaga

SEQ ID NO: 19049 - DNA, 25 bp, Homo sapien
tgcctggccatgattcttaagagaa

SEQ ID NO: 19050 - DNA, 25 bp, Homo sapien
cttaagagaattgactgggcctcat

SEQ ID NO: 19051 - DNA, 25 bp, Homo sapien
gactcaggtcctgatgagggcgttg

SEQ ID NO: 19052 - DNA, 25 bp, Homo sapien
gcgttgtgggagctgtacctgacag

SEQ ID NO: 19053 - DNA, 25 bp, Homo sapien
ctgacaggccttctgaggaagccaa

SEQ ID NO: 19054 - DNA, 25 bp, Homo sapien
gaagccaagacgccaggagaggctc

SEQ ID NO: 19055 - DNA, 25 bp, Homo sapien
ggctcaggcctgggagtcagtagtt

SEQ ID NO: 19056 - DNA, 25 bp, Homo sapien
ccactctgggtgcagcatggcaaac

SEQ ID NO: 19057 - DNA, 25 bp, Homo sapien
gcagcatggcaaacgtgggcggtat

SEQ ID NO: 19058 - DNA, 25 bp, Homo sapien
tgggcggtatttcagcagctgggcc

SEQ ID NO: 19059 - DNA, 25 bp, Homo sapien
gtcctaatggctgtactcatctgct

SEQ ID NO: 19060 - DNA, 25 bp, Homo sapien
gtggtgccagaagtgtggcttcccg

SEQ ID NO: 19061 - DNA, 25 bp, Homo sapien
acctggcgcaggccgtatagactca

SEQ ID NO: 19062 - DNA, 25 bp, Homo sapien
tgtgactgatgactttatcctgagt

SEQ ID NO: 19063 - DNA, 25 bp, Homo sapien
tcctgagtcccttaatcttatgggg

SEQ ID NO: 19064 - DNA, 25 bp, Homo sapien
gagtcccttaatcttatggggccgg

SEQ ID NO: 19065 - DNA, 25 bp, Homo sapien
tcccttaatcttatggggccggaag

SEQ ID NO: 19066 - DNA, 25 bp, Homo sapien
tatggggccggaaggaatgtcaggg

SEQ ID NO: 19067 - DNA, 25 bp, Homo sapien
cggaaggaatgtcagggccaggtgc

SEQ ID NO: 19068 - DNA, 25 bp, Homo sapien
aatgtcagggccaggtgcagacctt

SEQ ID NO: 19069 - DNA, 25 bp, Homo sapien
ggtgcagaccttgggggaagacttt

SEQ ID NO: 19070 - DNA, 25 bp, Homo sapien
ccactggggcatcggtctaaagctt

SEQ ID NO: 19071 - DNA, 25 bp, Homo sapien
ggcatcggtctaaagctttggggga

SEQ ID NO: 19072 - DNA, 25 bp, Homo sapien
tcggtctaaagctttgggggagtgg

SEQ ID NO: 19073 - DNA, 25 bp, Homo sapien
gcagtacagtccttcctaataacgg

SEQ ID NO: 19074 - DNA, 25 bp, Homo sapien
cagtccttcctaataacggggatgc

SEQ ID NO: 19075 - DNA, 25 bp, Homo sapien
cctaataacggggatgctctgtcat

SEQ ID NO: 19076 - DNA, 25 bp, Homo sapien
gtggacatgtctgttctgtatataa

SEQ ID NO: 19077 - DNA, 25 bp, Homo sapien
gcaggtgggatttgaagcttttcca

SEQ ID NO: 19078 - DNA, 25 bp, Homo sapien
gatttgaagcttttccacagtcctt

SEQ ID NO: 19079 - DNA, 25 bp, Homo sapien
agctctgctcagctgtcacagctga

SEQ ID NO: 19080 - DNA, 25 bp, Homo sapien
tgtcacagctgaattctttttttgt

SEQ ID NO: 19081 - DNA, 25 bp, Homo sapien
gaattctttttttgtgctgaacact

SEQ ID NO: 19082 - DNA, 25 bp, Homo sapien
ctttttttgtgctgaacactgggca

SEQ ID NO: 19083 - DNA, 25 bp, Homo sapien
ttaatcttgtttgttgcgcaatgga

SEQ ID NO: 19084 - DNA, 25 bp, Homo sapien
aaggcacggaaggctatgtccaaac

SEQ ID NO: 19085 - DNA, 25 bp, Homo sapien
atgtccaaactgggtcttcggcagg

SEQ ID NO: 19086 - DNA, 25 bp, Homo sapien
gtcttcggcaggttacaggagttac

SEQ ID NO: 19087 - DNA, 25 bp, Homo sapien
ggagttactagagtcactatccgga

SEQ ID NO: 19088 - DNA, 25 bp, Homo sapien
agaatatcctctttgtcatcacaaa

SEQ ID NO: 19089 - DNA, 25 bp, Homo sapien
accagatgtctacaagagccctgct

SEQ ID NO: 19090 - DNA, 25 bp, Homo sapien
gagccctgcttcagatacttacata

SEQ ID NO: 19091 - DNA, 25 bp, Homo sapien
cgaagatttatcccagcaagcacaa

SEQ ID NO: 19092 - DNA, 25 bp, Homo sapien
gcaagcacaactagcagctgctgag

SEQ ID NO: 19093 - DNA, 25 bp, Homo sapien
gcagtccgagccctgaagaacaaca

SEQ ID NO: 19094 - DNA, 25 bp, Homo sapien
ggaagcaactttttttggtgtctca

SEQ ID NO: 19095 - DNA, 25 bp, Homo sapien
agaatgcctcaatctttgggagagt

SEQ ID NO: 19096 - DNA, 25 bp, Homo sapien
gggagagtttcagtactggcataga

SEQ ID NO: 19097 - DNA, 25 bp, Homo sapien
tctgaaaccctttctcctagaaact

SEQ ID NO: 19098 - DNA, 25 bp, Homo sapien
aggtgtagaagactctccctaaggg

SEQ ID NO: 19099 - DNA, 25 bp, Homo sapien
agactctccctaagggtagccagga

SEQ ID NO: 19100 - DNA, 25 bp, Homo sapien
gaagtctcctgattcggacaaccat

SEQ ID NO: 19101 - DNA, 25 bp, Homo sapien
gtggtgctagggagaaggcaacctt

SEQ ID NO: 19102 - DNA, 25 bp, Homo sapien
ggcaaccttcactggttttgaactc

SEQ ID NO: 19103 - DNA, 25 bp, Homo sapien
gaactcagtgcctaagaaagtctct

SEQ ID NO: 19104 - DNA, 25 bp, Homo sapien
ggatgtcttaggccctaattcacca

SEQ ID NO: 19105 - DNA, 25 bp, Homo sapien
gatatgctatcattgccttaataat

SEQ ID NO: 19106 - DNA, 25 bp, Homo sapien
aggtctcctatgtcacagcgatgga

SEQ ID NO: 19107 - DNA, 25 bp, Homo sapien
gcgatggatctctttgtatctgttt

SEQ ID NO: 19108 - DNA, 25 bp, Homo sapien
gagtatggcaccttgcattattttg

SEQ ID NO: 19109 - DNA, 25 bp, Homo sapien
taccattgatatccgcccaagatca

SEQ ID NO: 19110 - DNA, 25 bp, Homo sapien
gcccaagatcagcaaccattcaaat

SEQ ID NO: 19111 - DNA, 25 bp, Homo sapien
ataatgctacacaccttcaagagag

SEQ ID NO: 19112 - DNA, 25 bp, Homo sapien
tacggctatgagtgtctggacggca

SEQ ID NO: 19113 - DNA, 25 bp, Homo sapien
ggatacatatccgcattgccaaaat

SEQ ID NO: 19114 - DNA, 25 bp, Homo sapien
aaatggactcctatgctcggatctt

SEQ ID NO: 19115 - DNA, 25 bp, Homo sapien
tctcctacctctacctgtgaggagg

SEQ ID NO: 19116 - DNA, 25 bp, Homo sapien
gagatgtctgttctaagtccactta

SEQ ID NO: 19117 - DNA, 25 bp, Homo sapien
gaagaacaggtcatcagcctcggac

SEQ ID NO: 19118 - DNA, 25 bp, Homo sapien
cagcctcggacctcaggtggctgaa

SEQ ID NO: 19119 - DNA, 25 bp, Homo sapien
ctcggacctcaggtggctgaaggag

SEQ ID NO: 19120 - DNA, 25 bp, Homo sapien
tttgcatccttcaatgacacttttg

SEQ ID NO: 19121 - DNA, 25 bp, Homo sapien
gcatccttcaatgacacttttgtcc

SEQ ID NO: 19122 - DNA, 25 bp, Homo sapien
cacttttgtccatgtcactgatctt

SEQ ID NO: 19123 - DNA, 25 bp, Homo sapien
gtccatgtcactgatctttctggca

SEQ ID NO: 19124 - DNA, 25 bp, Homo sapien
atctgccgtgtgactggtgggatga

SEQ ID NO: 19125 - DNA, 25 bp, Homo sapien
gactggtgggatgaaggtaaaggca

SEQ ID NO: 19126 - DNA, 25 bp, Homo sapien
ggcagaccgagatgaatcctcacca

SEQ ID NO: 19127 - DNA, 25 bp, Homo sapien
cgagatgaatcctcaccatatgctg

SEQ ID NO: 19128 - DNA, 25 bp, Homo sapien
ttacccttcattcacctattacggt

SEQ ID NO: 19129 - DNA, 25 bp, Homo sapien
acttgtcctgcttcacggaatctaa

SEQ ID NO: 19130 - DNA, 25 bp, Homo sapien
ctaacccaccggcagagtatttttg

SEQ ID NO: 19131 - DNA, 25 bp, Homo sapien
gctctttatcccccaaattactaga

SEQ ID NO: 19132 - DNA, 25 bp, Homo sapien
tgctctgttcataactcagccactg

SEQ ID NO: 19133 - DNA, 25 bp, Homo sapien
gaaatctccaaatccatgacagtca

SEQ ID NO: 19134 - DNA, 25 bp, Homo sapien
tgacagtcaaagtctctggtccctg

SEQ ID NO: 19135 - DNA, 25 bp, Homo sapien
tccctgccatggagacctgacagag

SEQ ID NO: 19136 - DNA, 25 bp, Homo sapien
gaaatatttgcttttgctgtctatc

SEQ ID NO: 19137 - DNA, 25 bp, Homo sapien
gctgtctatctgaatgccccagaat

SEQ ID NO: 19138 - DNA, 25 bp, Homo sapien
atgccccagaattgtgaaactactc

SEQ ID NO: 19139 - DNA, 25 bp, Homo sapien
gttgaagattactggatgcacgtac

SEQ ID NO: 19140 - DNA, 25 bp, Homo sapien
gcacgtacagaatacattcagccgt

SEQ ID NO: 19141 - DNA, 25 bp, Homo sapien
cattcagccgtcaggtaataacatg

SEQ ID NO: 19142 - DNA, 25 bp, Homo sapien
agggaccaagtacataatcattatt

SEQ ID NO: 19143 - DNA, 25 bp, Homo sapien
atcattattaatacactggaatttc

SEQ ID NO: 19144 - DNA, 25 bp, Homo sapien
aaatatttcaggctgggcgtggtgg

SEQ ID NO: 19145 - DNA, 25 bp, Homo sapien
ggccgaggtggatagatcacttgag

SEQ ID NO: 19146 - DNA, 25 bp, Homo sapien
aagaccagcctggctaatatggtga

SEQ ID NO: 19147 - DNA, 25 bp, Homo sapien
gctactagggaggctgcggcaggag

SEQ ID NO: 19148 - DNA, 25 bp, Homo sapien
ccgggaggtggaggtcgcggtgagc

SEQ ID NO: 19149 - DNA, 25 bp, Homo sapien
actccagcctggacagcaggagcga

SEQ ID NO: 19150 - DNA, 25 bp, Homo sapien
gaatcctagatagttttcccttcaa

SEQ ID NO: 19151 - DNA, 25 bp, Homo sapien
tagttttcccttcaagtcaagcgtc

SEQ ID NO: 19152 - DNA, 25 bp, Homo sapien
gttttgattgacatccaagtggaga

SEQ ID NO: 19153 - DNA, 25 bp, Homo sapien
tgattctgtggaaaatacccccctt

SEQ ID NO: 19154 - DNA, 25 bp, Homo sapien
tgctccattcagctcttaaatcttt

SEQ ID NO: 19155 - DNA, 25 bp, Homo sapien
ggtaagttaattttgctctcactgt

SEQ ID NO: 19156 - DNA, 25 bp, Homo sapien
aattttgctctcactgttttaacaa

SEQ ID NO: 19157 - DNA, 25 bp, Homo sapien
aaatccttgcataccttgttcaatt

SEQ ID NO: 19158 - DNA, 25 bp, Homo sapien
ttataacttttttgtacgtagctgt

SEQ ID NO: 19159 - DNA, 25 bp, Homo sapien
gtacgtagctgttacatgtagggca

SEQ ID NO: 19160 - DNA, 25 bp, Homo sapien
gtagggcaatctgtctttaagtagg

SEQ ID NO: 19161 - DNA, 25 bp, Homo sapien
tccgcacagcgtggagacggggcag

SEQ ID NO: 19162 - DNA, 25 bp, Homo sapien
gattggtggttttgttttgctttgt

SEQ ID NO: 19163 - DNA, 25 bp, Homo sapien
ggaaaatggcacaactttacctctg

SEQ ID NO: 19164 - DNA, 25 bp, Homo sapien
tttacctctgtgggagatgcaacac

SEQ ID NO: 19165 - DNA, 25 bp, Homo sapien
gatgcaacactgagagccaaggggt

SEQ ID NO: 19166 - DNA, 25 bp, Homo sapien
gaagtttttccactttgaattgcta

SEQ ID NO: 19167 - DNA, 25 bp, Homo sapien
atttttcctatgtgcagtcactcct

SEQ ID NO: 19168 - DNA, 25 bp, Homo sapien
agtcactcctctcatttctaaaata

SEQ ID NO: 19169 - DNA, 25 bp, Homo sapien
tctaaaatagggacgtggccaggca

SEQ ID NO: 19170 - DNA, 25 bp, Homo sapien
gagaaaggcatgaatccaggaggca

SEQ ID NO: 19171 - DNA, 25 bp, Homo sapien
gcaacagtgttaagactctgtctca

SEQ ID NO: 19172 - DNA, 25 bp, Homo sapien
gacttccaggtcggacaagccaagg

SEQ ID NO: 19173 - DNA, 25 bp, Homo sapien
gacaagccaaggtggtcctgaagag

SEQ ID NO: 19174 - DNA, 25 bp, Homo sapien
ggatgaccaggtgaccgttatcggg

SEQ ID NO: 19175 - DNA, 25 bp, Homo sapien
tgaccgttatcggggctggggtgac

SEQ ID NO: 19176 - DNA, 25 bp, Homo sapien
aaagatcaacatccgcgtgctggac

SEQ ID NO: 19177 - DNA, 25 bp, Homo sapien
agaaaactcattctcgacagcgctc

SEQ ID NO: 19178 - DNA, 25 bp, Homo sapien
gaggaccattattatgaaggtggca

SEQ ID NO: 19179 - DNA, 25 bp, Homo sapien
tggtgaggctgtgtccagtgcagta

SEQ ID NO: 19180 - DNA, 25 bp, Homo sapien
cagtgcagtagtgggcgagcctggc

SEQ ID NO: 19181 - DNA, 25 bp, Homo sapien
gctgctgaagatgtttggtatcgac

SEQ ID NO: 19182 - DNA, 25 bp, Homo sapien
attgcacaagctgtgaggggcctca

SEQ ID NO: 19183 - DNA, 25 bp, Homo sapien
cattggaagaaggtggtcatagctc

SEQ ID NO: 19184 - DNA, 25 bp, Homo sapien
cacaaggaggaaaccagtcccaagg

SEQ ID NO: 19185 - DNA, 25 bp, Homo sapien
cacctcgtccgggaaagccagaagg

SEQ ID NO: 19186 - DNA, 25 bp, Homo sapien
ccacaaggaggaaaccagtcccaag

SEQ ID NO: 19187 - DNA, 25 bp, Homo sapien
ccacctcgtccaggaaagccagaag

SEQ ID NO: 19188 - DNA, 25 bp, Homo sapien
gaaggatcaccttcacaaggaggca

SEQ ID NO: 19189 - DNA, 25 bp, Homo sapien
ccacctcatccaggaaagccacaag

SEQ ID NO: 19190 - DNA, 25 bp, Homo sapien
caagaaggcaacaaacctcaacgtc

SEQ ID NO: 19191 - DNA, 25 bp, Homo sapien
ccctcctccaagaaggccacaagga

SEQ ID NO: 19192 - DNA, 25 bp, Homo sapien
tcctcaagggggcagaccacacaga

SEQ ID NO: 19193 - DNA, 25 bp, Homo sapien
gcctccccagtaatcaaggttcaat

SEQ ID NO: 19194 - DNA, 25 bp, Homo sapien
acaggaagcgggggcttgcaaggaa

SEQ ID NO: 19195 - DNA, 25 bp, Homo sapien
taaagaggacccttcctctcattgg

SEQ ID NO: 19196 - DNA, 25 bp, Homo sapien
aacagccactcccatctatgtggaa

SEQ ID NO: 19197 - DNA, 25 bp, Homo sapien
gccactcccatctatgtggaatttc

SEQ ID NO: 19198 - DNA, 25 bp, Homo sapien
gtggaatttctatactctgatgcaa

SEQ ID NO: 19199 - DNA, 25 bp, Homo sapien
actctgatgcaaacatttactgcca

SEQ ID NO: 19200 - DNA, 25 bp, Homo sapien
tgcaaacatttactgccagatcgac

SEQ ID NO: 19201 - DNA, 25 bp, Homo sapien
gttgatggagcgtcctcgaagctcc

SEQ ID NO: 19202 - DNA, 25 bp, Homo sapien
gatggagcgtcctcgaagctccagc

SEQ ID NO: 19203 - DNA, 25 bp, Homo sapien
gggagtccctgctgaatatctggag

SEQ ID NO: 19204 - DNA, 25 bp, Homo sapien
gagtccctgctgaatatctggagac

SEQ ID NO: 19205 - DNA, 25 bp, Homo sapien
taattggagtcacagtattcttgga

SEQ ID NO: 19206 - DNA, 25 bp, Homo sapien
gagaactgatgattgtgcattatgt

SEQ ID NO: 19207 - DNA, 25 bp, Homo sapien
tatgcttaaaggtgcagtatgccat

SEQ ID NO: 19208 - DNA, 25 bp, Homo sapien
atgccataaaaggcaaacccttgca

SEQ ID NO: 19209 - DNA, 25 bp, Homo sapien
gcaaacccttgcaataatgagaaac

SEQ ID NO: 19210 - DNA, 25 bp, Homo sapien
acaggagaaatgattaccacagtat

SEQ ID NO: 19211 - DNA, 25 bp, Homo sapien
aatagagtctgtgaatgattcttga

SEQ ID NO: 19212 - DNA, 25 bp, Homo sapien
gcactttaggaggccgaggctggca

SEQ ID NO: 19213 - DNA, 25 bp, Homo sapien
ggcgtggtggcacacgcctgaagtc

SEQ ID NO: 19214 - DNA, 25 bp, Homo sapien
agtgggccaagatcacgccactaca

SEQ ID NO: 19215 - DNA, 25 bp, Homo sapien
cactacattccagctgggcaacaca

SEQ ID NO: 19216 - DNA, 25 bp, Homo sapien
ataaaggtgatcggcactcagacat

SEQ ID NO: 19217 - DNA, 25 bp, Homo sapien
tctttccagtctacaactcgttgac

SEQ ID NO: 19218 - DNA, 25 bp, Homo sapien
ctacaactcgttgaccacaggtgga

SEQ ID NO: 19219 - DNA, 25 bp, Homo sapien
gaccacaggtggaattcataagctc

SEQ ID NO: 19220 - DNA, 25 bp, Homo sapien
tggaattcataagctctgttccctg

SEQ ID NO: 19221 - DNA, 25 bp, Homo sapien
aatgttgaattatcatcttggtgat

SEQ ID NO: 19222 - DNA, 25 bp, Homo sapien
catcttggtgatggtcaactctgaa

SEQ ID NO: 19223 - DNA, 25 bp, Homo sapien
gatggtcaactctgaaagcctaaat

SEQ ID NO: 19224 - DNA, 25 bp, Homo sapien
aagcctaaattttcatgatcaccaa

SEQ ID NO: 19225 - DNA, 25 bp, Homo sapien
ttttcatgatcaccaaagtgtttgg

SEQ ID NO: 19226 - DNA, 25 bp, Homo sapien
gatttaaaagggtggctcactccgt

SEQ ID NO: 19227 - DNA, 25 bp, Homo sapien
ccttggtttaaggctgggcgcggtg

SEQ ID NO: 19228 - DNA, 25 bp, Homo sapien
gcggccggatcacaaggccaggaga

SEQ ID NO: 19229 - DNA, 25 bp, Homo sapien
atcgagaccatcctgtgaatggcga

SEQ ID NO: 19230 - DNA, 25 bp, Homo sapien
tgtgaatggcgaaaccctgtctcta

SEQ ID NO: 19231 - DNA, 25 bp, Homo sapien
gaggcggagcttgcaatgaactgag

SEQ ID NO: 19232 - DNA, 25 bp, Homo sapien
ctgagaatgtgccactggactccca

SEQ ID NO: 19233 - DNA, 25 bp, Homo sapien
tatagcagtactagctctgtttata

SEQ ID NO: 19234 - DNA, 25 bp, Homo sapien
aaactacctggttatcccatatatt

SEQ ID NO: 19235 - DNA, 25 bp, Homo sapien
aatgttttacgatctagcctttcca

SEQ ID NO: 19236 - DNA, 25 bp, Homo sapien
gcctttccagtataggcacttcctg

SEQ ID NO: 19237 - DNA, 25 bp, Homo sapien
gcacttcctgaaaaacctttgtcct

SEQ ID NO: 19238 - DNA, 25 bp, Homo sapien
aatgccatttttgagaactaaccta

SEQ ID NO: 19239 - DNA, 25 bp, Homo sapien
agtcatgctaaccagaaaatccact

SEQ ID NO: 19240 - DNA, 25 bp, Homo sapien
aatgctgttcagttagtaaccaagt

SEQ ID NO: 19241 - DNA, 25 bp, Homo sapien
gcagctgtgtttctgataagtactg

SEQ ID NO: 19242 - DNA, 25 bp, Homo sapien
atgtgtgtaattttctgtgccagac

SEQ ID NO: 19243 - DNA, 25 bp, Homo sapien
gtgccagacttatgactttgttttc

SEQ ID NO: 19244 - DNA, 25 bp, Homo sapien
actttgttttcaagcactgtaatgt

SEQ ID NO: 19245 - DNA, 25 bp, Homo sapien
gttaattttcccctgtgttgtgata

SEQ ID NO: 19246 - DNA, 25 bp, Homo sapien
ctacgcattcagtccttaaggggtt

SEQ ID NO: 19247 - DNA, 25 bp, Homo sapien
aaaaagaatctgctcagttccatat

SEQ ID NO: 19248 - DNA, 25 bp, Homo sapien
ttcatccgtgaaaaacttgcaatac

SEQ ID NO: 19249 - DNA, 25 bp, Homo sapien
gcacttcctggataagaaggggcag

SEQ ID NO: 19250 - DNA, 25 bp, Homo sapien
tccatcggaaagcggtactgttttg

SEQ ID NO: 19251 - DNA, 25 bp, Homo sapien
atcggaaagcggtactgttttggag

SEQ ID NO: 19252 - DNA, 25 bp, Homo sapien
caccaccatcatgcagaactttcgc

SEQ ID NO: 19253 - DNA, 25 bp, Homo sapien
atgcagaactttcgcttcaagtccc

SEQ ID NO: 19254 - DNA, 25 bp, Homo sapien
tcccctcagtcgcctaaggatatcg

SEQ ID NO: 19255 - DNA, 25 bp, Homo sapien
cgcctaaggatatcgacgtgtcccc

SEQ ID NO: 19256 - DNA, 25 bp, Homo sapien
tgggaggggcggggctaagaatggg

SEQ ID NO: 19257 - DNA, 25 bp, Homo sapien
ggggctaagaatgggggcagtgggg

SEQ ID NO: 19258 - DNA, 25 bp, Homo sapien
ggggagaggtggttagagggaacag

SEQ ID NO: 19259 - DNA, 25 bp, Homo sapien
gggaaaccttacagtatgctacaaa

SEQ ID NO: 19260 - DNA, 25 bp, Homo sapien
acccactgccagtcagggcagtccc

SEQ ID NO: 19261 - DNA, 25 bp, Homo sapien
agtccctcattctgcgttgggagtc

SEQ ID NO: 19262 - DNA, 25 bp, Homo sapien
ccctcattctgcgttgggagtctgg

SEQ ID NO: 19263 - DNA, 25 bp, Homo sapien
gaaaagcaaaagcagatgtgtggcc

SEQ ID NO: 19264 - DNA, 25 bp, Homo sapien
tgtggcccaaaactgctccaaagaa

SEQ ID NO: 19265 - DNA, 25 bp, Homo sapien
ggcccaaaactgctccaaagaaaga

SEQ ID NO: 19266 - DNA, 25 bp, Homo sapien
gccttcatgaaactggacacaccag

SEQ ID NO: 19267 - DNA, 25 bp, Homo sapien
tggacacaccagctacttcagatcc

SEQ ID NO: 19268 - DNA, 25 bp, Homo sapien
tccacaccaagtgacactactggcc

SEQ ID NO: 19269 - DNA, 25 bp, Homo sapien
gtttccacaatgtgagggggaacca

SEQ ID NO: 19270 - DNA, 25 bp, Homo sapien
taaatacagtgtattttccagcttc

SEQ ID NO: 19271 - DNA, 25 bp, Homo sapien
cggatgcttggcttggttttgtgtt

SEQ ID NO: 19272 - DNA, 25 bp, Homo sapien
ggcttggttttgtgttgattctgca

SEQ ID NO: 19273 - DNA, 25 bp, Homo sapien
gattctgcaagagcggttgattttg

SEQ ID NO: 19274 - DNA, 25 bp, Homo sapien
gagcggttgattttggattgagtat

SEQ ID NO: 19275 - DNA, 25 bp, Homo sapien
tggattgagtatcctgtggttcttg

SEQ ID NO: 19276 - DNA, 25 bp, Homo sapien
agtgacagttcatttagattctttg

SEQ ID NO: 19277 - DNA, 25 bp, Homo sapien
tctttgtattcttcttcgtctatat

SEQ ID NO: 19278 - DNA, 25 bp, Homo sapien
tcttcgtctatatttgtcagtttgc

SEQ ID NO: 19279 - DNA, 25 bp, Homo sapien
tgtcagtttgctgtacatgtactcc

SEQ ID NO: 19280 - DNA, 25 bp, Homo sapien
catgtactccaagctgcaggatttc

SEQ ID NO: 19281 - DNA, 25 bp, Homo sapien
gcaggatttcataactggggcaatt

SEQ ID NO: 19282 - DNA, 25 bp, Homo sapien
aaagctttagtacgttctcaatcct

SEQ ID NO: 19283 - DNA, 25 bp, Homo sapien
ggcaaagcctataagtggtcctcaa

SEQ ID NO: 19284 - DNA, 25 bp, Homo sapien
tggtcctcaacccttagttatcata

SEQ ID NO: 19285 - DNA, 25 bp, Homo sapien
ggcaaaggctttgttatgttctcaa

SEQ ID NO: 19286 - DNA, 25 bp, Homo sapien
gttatgttctcaatccttgcaaaac

SEQ ID NO: 19287 - DNA, 25 bp, Homo sapien
gcaaagcctataagtggccctcaac

SEQ ID NO: 19288 - DNA, 25 bp, Homo sapien
ccctcaacccttagatatcacaaga

SEQ ID NO: 19289 - DNA, 25 bp, Homo sapien
ggcaaagcctttagtacgttctcaa

SEQ ID NO: 19290 - DNA, 25 bp, Homo sapien
tacgttctcaatcctcactaaacat

SEQ ID NO: 19291 - DNA, 25 bp, Homo sapien
gtggcaaagccttcagctggttatc

SEQ ID NO: 19292 - DNA, 25 bp, Homo sapien
aattcatactggagttcccaaccct

SEQ ID NO: 19293 - DNA, 25 bp, Homo sapien
tcttcctccctaagggcaccgaagt

SEQ ID NO: 19294 - DNA, 25 bp, Homo sapien
gcaccgaagtgtaccctatgctggg

SEQ ID NO: 19295 - DNA, 25 bp, Homo sapien
tgctgggctctgtgctgagagaccc

SEQ ID NO: 19296 - DNA, 25 bp, Homo sapien
atccccagcacttcctgaatgagaa

SEQ ID NO: 19297 - DNA, 25 bp, Homo sapien
aagagtgatgcttttgtgccctttt

SEQ ID NO: 19298 - DNA, 25 bp, Homo sapien
cagaatggagctctttctcttcttc

SEQ ID NO: 19299 - DNA, 25 bp, Homo sapien
cgaaactacaccatgagcttcctgc

SEQ ID NO: 19300 - DNA, 25 bp, Homo sapien
gaaagggcagggccaagaccgggct

SEQ ID NO: 19301 - DNA, 25 bp, Homo sapien
gagaggggcgcagctaagactgggg

SEQ ID NO: 19302 - DNA, 25 bp, Homo sapien
gactgggggcaggatggcggaaagg

SEQ ID NO: 19303 - DNA, 25 bp, Homo sapien
gaaggggctcagttcaccttgataa

SEQ ID NO: 19304 - DNA, 25 bp, Homo sapien
aaaaagatatgcttatacactgttg

SEQ ID NO: 19305 - DNA, 25 bp, Homo sapien
gacagtgtggggataaagacagaga

SEQ ID NO: 19306 - DNA, 25 bp, Homo sapien
agacagagataccattcaacccagc

SEQ ID NO: 19307 - DNA, 25 bp, Homo sapien
cattcaacccagcaatctcattact

SEQ ID NO: 19308 - DNA, 25 bp, Homo sapien
ttgcagcactgcccatcagtgacag

SEQ ID NO: 19309 - DNA, 25 bp, Homo sapien
gcactgcccatcagtgacagactgg

SEQ ID NO: 19310 - DNA, 25 bp, Homo sapien
ggtacatacacaccagggaatacta

SEQ ID NO: 19311 - DNA, 25 bp, Homo sapien
accagggaatactatacagccataa

SEQ ID NO: 19312 - DNA, 25 bp, Homo sapien
ggaacaagactgactgggcgtggtg

SEQ ID NO: 19313 - DNA, 25 bp, Homo sapien
tgtgatcctagcactttgcgaggcc

SEQ ID NO: 19314 - DNA, 25 bp, Homo sapien
ccgcgctcaggaggtcaagaccagc

SEQ ID NO: 19315 - DNA, 25 bp, Homo sapien
tgcaaggatggcgtcactggcctca

SEQ ID NO: 19316 - DNA, 25 bp, Homo sapien
cagctaccgcatcagcctaaagaag

SEQ ID NO: 19317 - DNA, 25 bp, Homo sapien
gcatcagcctaaagaagttctgcaa

SEQ ID NO: 19318 - DNA, 25 bp, Homo sapien
gaagttctgcaagaaggactatgcg

SEQ ID NO: 19319 - DNA, 25 bp, Homo sapien
aggactatgcggtgcaggtggcggt

SEQ ID NO: 19320 - DNA, 25 bp, Homo sapien
tcgccgtgttccggagcggagagga

SEQ ID NO: 19321 - DNA, 25 bp, Homo sapien
tgttccggagcggagaggagcgcgc

SEQ ID NO: 19322 - DNA, 25 bp, Homo sapien
cgcgcgcggcgcgggagtagcgcgc

SEQ ID NO: 19323 - DNA, 25 bp, Homo sapien
ggcgcgggagtagcgcgctgtgggt

SEQ ID NO: 19324 - DNA, 25 bp, Homo sapien
tgctaccctggagggacgcgtggac

SEQ ID NO: 19325 - DNA, 25 bp, Homo sapien
ccctggagggacgcgtggacgcggc

SEQ ID NO: 19326 - DNA, 25 bp, Homo sapien
tcaaggggttgctcagatgggccgg

SEQ ID NO: 19327 - DNA, 25 bp, Homo sapien
tgctcagatgggccgggcatggtgg

SEQ ID NO: 19328 - DNA, 25 bp, Homo sapien
gtaacctcagcactgtgggaggcca

SEQ ID NO: 19329 - DNA, 25 bp, Homo sapien
ggaggccaagggggcagatcacttc

SEQ ID NO: 19330 - DNA, 25 bp, Homo sapien
agatcacttcaggtcgggagttcca

SEQ ID NO: 19331 - DNA, 25 bp, Homo sapien
cagaccagcctgttcaacatggcga

SEQ ID NO: 19332 - DNA, 25 bp, Homo sapien
caacatggcgaaaccccattctacc

SEQ ID NO: 19333 - DNA, 25 bp, Homo sapien
gactgaggaggggtcacctgaggtc

SEQ ID NO: 19334 - DNA, 25 bp, Homo sapien
ggatgtcaagatcagactggccaac

SEQ ID NO: 19335 - DNA, 25 bp, Homo sapien
gccaacagaatgaaaccctgtctct

SEQ ID NO: 19336 - DNA, 25 bp, Homo sapien
agaaagttagccgggcgtggcacct

SEQ ID NO: 19337 - DNA, 25 bp, Homo sapien
aacccaaaaggatacatgcttgatg

SEQ ID NO: 19338 - DNA, 25 bp, Homo sapien
gttcaaaagagtcccctcaataaat

SEQ ID NO: 19339 - DNA, 25 bp, Homo sapien
caagaataacaatgagccgctccca

SEQ ID NO: 19340 - DNA, 25 bp, Homo sapien
acaatgagccgctcccagagataaa

SEQ ID NO: 19341 - DNA, 25 bp, Homo sapien
aatccataggagaccagatcatttt

SEQ ID NO: 19342 - DNA, 25 bp, Homo sapien
taaagatgccgaccagaaccacatg

SEQ ID NO: 19343 - DNA, 25 bp, Homo sapien
gaaccacatgagtcagaatcatcag

SEQ ID NO: 19344 - DNA, 25 bp, Homo sapien
gtcagaatcatcagaatatcccacc

SEQ ID NO: 19345 - DNA, 25 bp, Homo sapien
gaatatcccaccaacaaatacagag

SEQ ID NO: 19346 - DNA, 25 bp, Homo sapien
gagaagatcaaaatcctgtacaata

SEQ ID NO: 19347 - DNA, 25 bp, Homo sapien
agtttctgatagtagtctttaaaag

SEQ ID NO: 19348 - DNA, 25 bp, Homo sapien
gacacatgggtgctattggggttgg

SEQ ID NO: 19349 - DNA, 25 bp, Homo sapien
tgggggggaggtgaggtaccagcct

SEQ ID NO: 19350 - DNA, 25 bp, Homo sapien
aggtaccagccttggatactccatg

SEQ ID NO: 19351 - DNA, 25 bp, Homo sapien
tggacatgggccccagataccatga

SEQ ID NO: 19352 - DNA, 25 bp, Homo sapien
gataccatgatgctgagcccggaaa

SEQ ID NO: 19353 - DNA, 25 bp, Homo sapien
cggaaactccacatcctgtgggacc

SEQ ID NO: 19354 - DNA, 25 bp, Homo sapien
tgtgggacctgggccatagtcattc

SEQ ID NO: 19355 - DNA, 25 bp, Homo sapien
ctgaaagtcccagatcaagcctgcc

SEQ ID NO: 19356 - DNA, 25 bp, Homo sapien
caagcctgcctcaatcagtattcat

SEQ ID NO: 19357 - DNA, 25 bp, Homo sapien
atttatagccaggtaccttctcacc

SEQ ID NO: 19358 - DNA, 25 bp, Homo sapien
accttctcacctgtgagaccaaatt

SEQ ID NO: 19359 - DNA, 25 bp, Homo sapien
tgcccgcagacctctggattaggtc

SEQ ID NO: 19360 - DNA, 25 bp, Homo sapien
ttaggtctctgttgactggctgtgt

SEQ ID NO: 19361 - DNA, 25 bp, Homo sapien
ctctgggcctcagaggccttatgag

SEQ ID NO: 19362 - DNA, 25 bp, Homo sapien
ggccttatgagggtcctctacttca

SEQ ID NO: 19363 - DNA, 25 bp, Homo sapien
aacacccccatgacattgcatttgg

SEQ ID NO: 19364 - DNA, 25 bp, Homo sapien
gctcccgtggcctgtagaatagcct

SEQ ID NO: 19365 - DNA, 25 bp, Homo sapien
atagcctgtggcctttgcaatttgt

SEQ ID NO: 19366 - DNA, 25 bp, Homo sapien
gatgggcatatgtgtcagtggggct

SEQ ID NO: 19367 - DNA, 25 bp, Homo sapien
atgtgtcagtggggctctctgagtc

SEQ ID NO: 19368 - DNA, 25 bp, Homo sapien
aaatttaagactctcgcatcttccc

SEQ ID NO: 19369 - DNA, 25 bp, Homo sapien
ctcgctcgttacccagggtggagtg

SEQ ID NO: 19370 - DNA, 25 bp, Homo sapien
attctcctggtcggggacagtcaga

SEQ ID NO: 19371 - DNA, 25 bp, Homo sapien
agagatgatgggggagatgaccggt

SEQ ID NO: 19372 - DNA, 25 bp, Homo sapien
gatgaccggtgggtaaaagtccagg

SEQ ID NO: 19373 - DNA, 25 bp, Homo sapien
gggagaggttgggtgctctcctgct

SEQ ID NO: 19374 - DNA, 25 bp, Homo sapien
cttcatcctgtggagtcttgtgagg

SEQ ID NO: 19375 - DNA, 25 bp, Homo sapien
aggagaacaggttggcctcctggtc

SEQ ID NO: 19376 - DNA, 25 bp, Homo sapien
cctgtgatctctgccaactacaaat

SEQ ID NO: 19377 - DNA, 25 bp, Homo sapien
atctctgccaactacaaatgctgcc

SEQ ID NO: 19378 - DNA, 25 bp, Homo sapien
cttctccacaggttttccagcggag

SEQ ID NO: 19379 - DNA, 25 bp, Homo sapien
gggagaacacactctggaattctct

SEQ ID NO: 19380 - DNA, 25 bp, Homo sapien
ctctggaattctctattctcctggt

SEQ ID NO: 19381 - DNA, 25 bp, Homo sapien
aaaatgatcgcctcttggtatgcca

SEQ ID NO: 19382 - DNA, 25 bp, Homo sapien
ggtatgccaggtgtgcatcaaactg

SEQ ID NO: 19383 - DNA, 25 bp, Homo sapien
agaagcaaatcttggtctgcccatc

SEQ ID NO: 19384 - DNA, 25 bp, Homo sapien
tctgcccatcagtccattcatggat

SEQ ID NO: 19385 - DNA, 25 bp, Homo sapien
tccattcatggatcgttcttctcct

SEQ ID NO: 19386 - DNA, 25 bp, Homo sapien
tcttctcctcaactagcaaaactcc

SEQ ID NO: 19387 - DNA, 25 bp, Homo sapien
tccaagaatcttttatcacccacat

SEQ ID NO: 19388 - DNA, 25 bp, Homo sapien
acatagtgggtcccctgtgtaactc

SEQ ID NO: 19389 - DNA, 25 bp, Homo sapien
gtgtaactcctatgatgctgctggt

SEQ ID NO: 19390 - DNA, 25 bp, Homo sapien
gctgctggtttgctaccaggtcagt

SEQ ID NO: 19391 - DNA, 25 bp, Homo sapien
ttcctccttacctcaagcagatgag

SEQ ID NO: 19392 - DNA, 25 bp, Homo sapien
cggagcctccgacggaagggaagca

SEQ ID NO: 19393 - DNA, 25 bp, Homo sapien
ggaagggaagcaggctgtcccagcg

SEQ ID NO: 19394 - DNA, 25 bp, Homo sapien
ggctgtcccagcggagaacgaggcc

SEQ ID NO: 19395 - DNA, 25 bp, Homo sapien
cagacccagggcaaacgcatcaaag

SEQ ID NO: 19396 - DNA, 25 bp, Homo sapien
aaacgcatcaaagtggagcccggcc

SEQ ID NO: 19397 - DNA, 25 bp, Homo sapien
gaaaccaaaggttccgaggacagtg

SEQ ID NO: 19398 - DNA, 25 bp, Homo sapien
gaggacagtggcgacgaggatccct

SEQ ID NO: 19399 - DNA, 25 bp, Homo sapien
tcatccgggcaggggtcctgaagca

SEQ ID NO: 19400 - DNA, 25 bp, Homo sapien
gtcctgaagcaggatccggtgcggc

SEQ ID NO: 19401 - DNA, 25 bp, Homo sapien
ctgccgcggaagggggactgaggac

SEQ ID NO: 19402 - DNA, 25 bp, Homo sapien
tgaggactggcagagctgccggcgc

SEQ ID NO: 19403 - DNA, 25 bp, Homo sapien
ggaaagggtttgcatgttcattata

SEQ ID NO: 19404 - DNA, 25 bp, Homo sapien
gttcattatataaacccataccgat

SEQ ID NO: 19405 - DNA, 25 bp, Homo sapien
attacatacgagtggggtagctcta

SEQ ID NO: 19406 - DNA, 25 bp, Homo sapien
gagtggggtagctctatttcttgct

SEQ ID NO: 19407 - DNA, 25 bp, Homo sapien
atttcttgctaattcctgacagtat

SEQ ID NO: 19408 - DNA, 25 bp, Homo sapien
attttaagcatgtctttaattcaaa

SEQ ID NO: 19409 - DNA, 25 bp, Homo sapien
atatgttataaggaccacgtattta

SEQ ID NO: 19410 - DNA, 25 bp, Homo sapien
ggtgttttacacagtatatcacatt

SEQ ID NO: 19411 - DNA, 25 bp, Homo sapien
acacatgcacatataggtatgacac

SEQ ID NO: 19412 - DNA, 25 bp, Homo sapien
ggtatgacactttatacttgtatag

SEQ ID NO: 19413 - DNA, 25 bp, Homo sapien
agttgggtgcggtgacatgcacctg

SEQ ID NO: 19414 - DNA, 25 bp, Homo sapien
gtttccacgggtcctgggacagagc

SEQ ID NO: 19415 - DNA, 25 bp, Homo sapien
agagctcacctgttttgttttgaat

SEQ ID NO: 19416 - DNA, 25 bp, Homo sapien
ttatatgcaactacaggcctgacgc

SEQ ID NO: 19417 - DNA, 25 bp, Homo sapien
ctacaggcctgacgctagcggtgaa

SEQ ID NO: 19418 - DNA, 25 bp, Homo sapien
gacgctagcggtgaagaaggcagat

SEQ ID NO: 19419 - DNA, 25 bp, Homo sapien
gaaaactaatctcattatcggccac

SEQ ID NO: 19420 - DNA, 25 bp, Homo sapien
atctcattatcggccacaggctgtg

SEQ ID NO: 19421 - DNA, 25 bp, Homo sapien
cacaggctgtggtcagtgttttgaa

SEQ ID NO: 19422 - DNA, 25 bp, Homo sapien
gatgtttggcaactgtggtatttca

SEQ ID NO: 19423 - DNA, 25 bp, Homo sapien
tcaggtttgaccttaaatccttact

SEQ ID NO: 19424 - DNA, 25 bp, Homo sapien
acaaggattggtctaggtgcccggg

SEQ ID NO: 19425 - DNA, 25 bp, Homo sapien
gagacgctcaagaaggtgcaggcgc

SEQ ID NO: 19426 - DNA, 25 bp, Homo sapien
gctcaagaaggtgcaggcgctcaag

SEQ ID NO: 19427 - DNA, 25 bp, Homo sapien
gaaggtgcaggcgctcaagaagagc

SEQ ID NO: 19428 - DNA, 25 bp, Homo sapien
gcaggcgctcaagaagagcaagctg

SEQ ID NO: 19429 - DNA, 25 bp, Homo sapien
atcacctaccgcttcaagcggtgat

SEQ ID NO: 19430 - DNA, 25 bp, Homo sapien
cgcttcaagcggtgatcgcaccacg

SEQ ID NO: 19431 - DNA, 25 bp, Homo sapien
ccctcgagtgggggactgtacagac

SEQ ID NO: 19432 - DNA, 25 bp, Homo sapien
gagtgggggactgtacagaccccgt

SEQ ID NO: 19433 - DNA, 25 bp, Homo sapien
ccccaactccgcgtgagacagagaa

SEQ ID NO: 19434 - DNA, 25 bp, Homo sapien
ccaactccgcgtgagacagagaatt

SEQ ID NO: 19435 - DNA, 25 bp, Homo sapien
tccgcgtgagacagagaattattca

SEQ ID NO: 19436 - DNA, 25 bp, Homo sapien
aagatcctggagtttgtggggcgct

SEQ ID NO: 19437 - DNA, 25 bp, Homo sapien
gagactgtggacctcatggttgagc

SEQ ID NO: 19438 - DNA, 25 bp, Homo sapien
agaagaaccctatgaccaactacac

SEQ ID NO: 19439 - DNA, 25 bp, Homo sapien
gggagttcatggaccacagcatctc

SEQ ID NO: 19440 - DNA, 25 bp, Homo sapien
tgagcgcttcgatgcggactatgcg

SEQ ID NO: 19441 - DNA, 25 bp, Homo sapien
tcagcttccgctctgagctgtgaga

SEQ ID NO: 19442 - DNA, 25 bp, Homo sapien
tgagaggggttcctggagtcactgc

SEQ ID NO: 19443 - DNA, 25 bp, Homo sapien
gggagtgtgcgaatcaagcctgacc

SEQ ID NO: 19444 - DNA, 25 bp, Homo sapien
taccacatggccaaagtgtaccctc

SEQ ID NO: 19445 - DNA, 25 bp, Homo sapien
cctcaccctgggacctgggaaagct

SEQ ID NO: 19446 - DNA, 25 bp, Homo sapien
agaagtgtcctatgggtcctggtac

SEQ ID NO: 19447 - DNA, 25 bp, Homo sapien
tgaggttccaggggcacaggacgac

SEQ ID NO: 19448 - DNA, 25 bp, Homo sapien
tccaggggcacaggacgacgagcag

SEQ ID NO: 19449 - DNA, 25 bp, Homo sapien
aggacgacgagcaggagaggcggcg

SEQ ID NO: 19450 - DNA, 25 bp, Homo sapien
gcgcgtcaaggccaacgatcgcgag

SEQ ID NO: 19451 - DNA, 25 bp, Homo sapien
cgcaaccgcatgcacaacttgaacg

SEQ ID NO: 19452 - DNA, 25 bp, Homo sapien
cgcatgcacaacttgaacgcggccc

SEQ ID NO: 19453 - DNA, 25 bp, Homo sapien
acgacaccaagctcaccaaaatcga

SEQ ID NO: 19454 - DNA, 25 bp, Homo sapien
ccaaaatcgagacgctgcgcttcgc

SEQ ID NO: 19455 - DNA, 25 bp, Homo sapien
gcttcgcctacaactacatctgggc

SEQ ID NO: 19456 - DNA, 25 bp, Homo sapien
gcctacaactacatctgggctctgg

SEQ ID NO: 19457 - DNA, 25 bp, Homo sapien
gacactgcgcctggcggatcaaggg

SEQ ID NO: 19458 - DNA, 25 bp, Homo sapien
ggagagctattccgtgtacgtgtac

SEQ ID NO: 19459 - DNA, 25 bp, Homo sapien
caaggtgctgaagcaggtccacccc

SEQ ID NO: 19460 - DNA, 25 bp, Homo sapien
gcctgaaccagctaagtcagctccc

SEQ ID NO: 19461 - DNA, 25 bp, Homo sapien
catctcgtccaaggctatggggatt

SEQ ID NO: 19462 - DNA, 25 bp, Homo sapien
gattatgaactccttcgtcaacgac

SEQ ID NO: 19463 - DNA, 25 bp, Homo sapien
ttttcgagcgcattgcaggcgaggc

SEQ ID NO: 19464 - DNA, 25 bp, Homo sapien
tcccgcctggcgcattataacaagc

SEQ ID NO: 19465 - DNA, 25 bp, Homo sapien
ttataacaagcgctcgaccatcact

SEQ ID NO: 19466 - DNA, 25 bp, Homo sapien
ccagggagatccaaacggctgtgcg

SEQ ID NO: 19467 - DNA, 25 bp, Homo sapien
aaacacgcggtgtcggagggcacca

SEQ ID NO: 19468 - DNA, 25 bp, Homo sapien
gaagggctccaagaaggcggtgacc

SEQ ID NO: 19469 - DNA, 25 bp, Homo sapien
ccagccttggccaacatggcgaaac

SEQ ID NO: 19470 - DNA, 25 bp, Homo sapien
gagccgagatcattgcattgcactc

SEQ ID NO: 19471 - DNA, 25 bp, Homo sapien
gcattgcactccagcttgagcaaca

SEQ ID NO: 19472 - DNA, 25 bp, Homo sapien
gcaacagagggacacttcgttcccc

SEQ ID NO: 19473 - DNA, 25 bp, Homo sapien
taatgatcagaagcggctgggcgcg

SEQ ID NO: 19474 - DNA, 25 bp, Homo sapien
cccagcactttcggaggccgaggaa

SEQ ID NO: 19475 - DNA, 25 bp, Homo sapien
ggccgaggaaggtagatcacttgag

SEQ ID NO: 19476 - DNA, 25 bp, Homo sapien
catggccaaaaactgtctctactaa

SEQ ID NO: 19477 - DNA, 25 bp, Homo sapien
ctactcaggaggctcaggcacgaga

SEQ ID NO: 19478 - DNA, 25 bp, Homo sapien
ggcacgagaatcgcttgagtctggg

SEQ ID NO: 19479 - DNA, 25 bp, Homo sapien
cgcttgagtctgggaggcggaggtt

SEQ ID NO: 19480 - DNA, 25 bp, Homo sapien
gttttgggtatgtttaatctgttat

SEQ ID NO: 19481 - DNA, 25 bp, Homo sapien
aatctgttatgtactagtgttctgt

SEQ ID NO: 19482 - DNA, 25 bp, Homo sapien
actagtgttctgtttgttattgttt

SEQ ID NO: 19483 - DNA, 25 bp, Homo sapien
gttttgttaattacaccataatgct

SEQ ID NO: 19484 - DNA, 25 bp, Homo sapien
atctcaatgaagccagctcacagtg

SEQ ID NO: 19485 - DNA, 25 bp, Homo sapien
cccggtcatctagcaagctgccgaa

SEQ ID NO: 19486 - DNA, 25 bp, Homo sapien
agcaagctgccgaaccaaaagaatt

SEQ ID NO: 19487 - DNA, 25 bp, Homo sapien
aaccaaaagaatttgcaccccgctg

SEQ ID NO: 19488 - DNA, 25 bp, Homo sapien
tgcgggcccacgtggttggggccct

SEQ ID NO: 19489 - DNA, 25 bp, Homo sapien
gacgcgcaagtctgagggtctgggc

SEQ ID NO: 19490 - DNA, 25 bp, Homo sapien
cgcaagtctgagggtctgggcggcg

SEQ ID NO: 19491 - DNA, 25 bp, Homo sapien
attcccttatccaggctttttgaca

SEQ ID NO: 19492 - DNA, 25 bp, Homo sapien
gctttttgacaacgctatgctccgc

SEQ ID NO: 19493 - DNA, 25 bp, Homo sapien
ctggcctttgacacctaccaggagt

SEQ ID NO: 19494 - DNA, 25 bp, Homo sapien
gggcagatcttcaagcagacctaca

SEQ ID NO: 19495 - DNA, 25 bp, Homo sapien
gcagacctacagcaagttcgacaca

SEQ ID NO: 19496 - DNA, 25 bp, Homo sapien
gacgcactactcaagaactacgggc

SEQ ID NO: 19497 - DNA, 25 bp, Homo sapien
gctgctctactgcttcaggaaggac

SEQ ID NO: 19498 - DNA, 25 bp, Homo sapien
cgaaccactcagggtcctgtggacg

SEQ ID NO: 19499 - DNA, 25 bp, Homo sapien
gacaaggtcgagacattcctgcgca

SEQ ID NO: 19500 - DNA, 25 bp, Homo sapien
gccttggaagttgccactccagtgc

SEQ ID NO: 19501 - DNA, 25 bp, Homo sapien
cgctcacctagctgcaatggctaca

SEQ ID NO: 19502 - DNA, 25 bp, Homo sapien
aagttctgatcagtggtcaaaatgt

SEQ ID NO: 19503 - DNA, 25 bp, Homo sapien
gtggtcaaaatgttccagagggctg

SEQ ID NO: 19504 - DNA, 25 bp, Homo sapien
caaaatgttccagagggctgagtgc

SEQ ID NO: 19505 - DNA, 25 bp, Homo sapien
gggaggccaaattcaggatggcttg

SEQ ID NO: 19506 - DNA, 25 bp, Homo sapien
ggccaaattcaggatggcttgagtc

SEQ ID NO: 19507 - DNA, 25 bp, Homo sapien
tatgatcactctactgcattcaagc

SEQ ID NO: 19508 - DNA, 25 bp, Homo sapien
gatcactctactgcattcaagctgg

SEQ ID NO: 19509 - DNA, 25 bp, Homo sapien
cactctactgcattcaagctggggc

SEQ ID NO: 19510 - DNA, 25 bp, Homo sapien
tactgcattcaagctggggcagcag

SEQ ID NO: 19511 - DNA, 25 bp, Homo sapien
aggttgcagtgttcgcgcaattgca

SEQ ID NO: 19512 - DNA, 25 bp, Homo sapien
tgcagtgttcgcgcaattgcactcc

SEQ ID NO: 19513 - DNA, 25 bp, Homo sapien
gccttgatactcctggcacaaatgg

SEQ ID NO: 19514 - DNA, 25 bp, Homo sapien
aatgggaagaatctctcctttctcc

SEQ ID NO: 19515 - DNA, 25 bp, Homo sapien
gacatgaattcagattcccggagga

SEQ ID NO: 19516 - DNA, 25 bp, Homo sapien
atggccaccagttccagaagactca

SEQ ID NO: 19517 - DNA, 25 bp, Homo sapien
gagatgatccagcagaccttcaatc

SEQ ID NO: 19518 - DNA, 25 bp, Homo sapien
gcacagaggactcatctgctgcttg

SEQ ID NO: 19519 - DNA, 25 bp, Homo sapien
gaatgaggacttcatcctggctgtg

SEQ ID NO: 19520 - DNA, 25 bp, Homo sapien
agaaatacagcccttgtgcctggga

SEQ ID NO: 19521 - DNA, 25 bp, Homo sapien
gagatccttctctttttcaacaaac

SEQ ID NO: 19522 - DNA, 25 bp, Homo sapien
gactaatgcatcatctcacactttc

SEQ ID NO: 19523 - DNA, 25 bp, Homo sapien
acactttcatgagttcttccatttc

SEQ ID NO: 19524 - DNA, 25 bp, Homo sapien
gctttttgacaacgctatgctccgc

SEQ ID NO: 19525 - DNA, 25 bp, Homo sapien
accaggagtttaacctagagctgct

SEQ ID NO: 19526 - DNA, 25 bp, Homo sapien
gctcatccagtcgtggctggagccc

SEQ ID NO: 19527 - DNA, 25 bp, Homo sapien
tgcagttcctcaggagtgtcttcgc

SEQ ID NO: 19528 - DNA, 25 bp, Homo sapien
cttcgccaacagcctggtgtacggc

SEQ ID NO: 19529 - DNA, 25 bp, Homo sapien
tgacagcaacgtctatgacctccta

SEQ ID NO: 19530 - DNA, 25 bp, Homo sapien
gcagacctacagcaagttcgacaca

SEQ ID NO: 19531 - DNA, 25 bp, Homo sapien
gacgcactactcaagaactacgggc

SEQ ID NO: 19532 - DNA, 25 bp, Homo sapien
gctgctctactgcttcaggaaggac

SEQ ID NO: 19533 - DNA, 25 bp, Homo sapien
gacaaggtcgagacattcctgcgca

SEQ ID NO: 19534 - DNA, 25 bp, Homo sapien
gccttggaagttgccactccagtgc

SEQ ID NO: 19535 - DNA, 25 bp, Homo sapien
acgtgtgtacgtgatggaacggctg

SEQ ID NO: 19536 - DNA, 25 bp, Homo sapien
gtgatggaacggctgagcgccgagg

SEQ ID NO: 19537 - DNA, 25 bp, Homo sapien
cgcctacacctttgactgcgatgaa

SEQ ID NO: 19538 - DNA, 25 bp, Homo sapien
gactgcgatgaaggcaaattttact

SEQ ID NO: 19539 - DNA, 25 bp, Homo sapien
aattttactgcaagcctcacttcat

SEQ ID NO: 19540 - DNA, 25 bp, Homo sapien
gcctcacttcattcactgtaaaacc

SEQ ID NO: 19541 - DNA, 25 bp, Homo sapien
gcaaacaacggaagagacgggcaga

SEQ ID NO: 19542 - DNA, 25 bp, Homo sapien
agagacgggcagagttgaagcaaca

SEQ ID NO: 19543 - DNA, 25 bp, Homo sapien
agagaggaggaggcaacatggcaag

SEQ ID NO: 19544 - DNA, 25 bp, Homo sapien
tcccaccgaaagttcttgcgcagtg

SEQ ID NO: 19545 - DNA, 25 bp, Homo sapien
ccgaaagttcttgcgcagtggccgc

SEQ ID NO: 19546 - DNA, 25 bp, Homo sapien
gccccacagtggcctcaggagagaa

SEQ ID NO: 19547 - DNA, 25 bp, Homo sapien
accctgctgtgtcagtcatggtggc

SEQ ID NO: 19548 - DNA, 25 bp, Homo sapien
tggtggcagtttgacactttccttc

SEQ ID NO: 19549 - DNA, 25 bp, Homo sapien
taagtaccaggctgaattccccatg

SEQ ID NO: 19550 - DNA, 25 bp, Homo sapien
tacaggtgctacggctcatacagct

SEQ ID NO: 19551 - DNA, 25 bp, Homo sapien
tcagcctcacacgccaaggattaca

SEQ ID NO: 19552 - DNA, 25 bp, Homo sapien
tggagaatctcatccgcatgggcat

SEQ ID NO: 19553 - DNA, 25 bp, Homo sapien
catggcaggcttggtcctggtgttc

SEQ ID NO: 19554 - DNA, 25 bp, Homo sapien
tgttcctcgggattctgttatttga

SEQ ID NO: 19555 - DNA, 25 bp, Homo sapien
ggtgctatggtgcacacaacctctc

SEQ ID NO: 19556 - DNA, 25 bp, Homo sapien
accccctgaacatcctgatggcagg

SEQ ID NO: 19557 - DNA, 25 bp, Homo sapien
caccaagggggaaccccagcagctg

SEQ ID NO: 19558 - DNA, 25 bp, Homo sapien
ccagcagctggggcttttctagtgc

SEQ ID NO: 19559 - DNA, 25 bp, Homo sapien
tggggcttttctagtgctttttggc

SEQ ID NO: 19560 - DNA, 25 bp, Homo sapien
ttggcccaagaatctcagagtgctt

SEQ ID NO: 19561 - DNA, 25 bp, Homo sapien
gagtgcttctaatcatcacagtagt

SEQ ID NO: 19562 - DNA, 25 bp, Homo sapien
tgtttttttcacaatctcagccagc

SEQ ID NO: 19563 - DNA, 25 bp, Homo sapien
tcagccagcctgtggtgtgacctgg

SEQ ID NO: 19564 - DNA, 25 bp, Homo sapien
atgatgagccagttggccctgaaac

SEQ ID NO: 19565 - DNA, 25 bp, Homo sapien
gagcaaggagagccaggagcattta

SEQ ID NO: 19566 - DNA, 25 bp, Homo sapien
aaaaatcagcatctgggccaggcaa

SEQ ID NO: 19567 - DNA, 25 bp, Homo sapien
ccaggcaagatggctcacacctgtg

SEQ ID NO: 19568 - DNA, 25 bp, Homo sapien
tcccaggttgaggtgcgctcacctc

SEQ ID NO: 19569 - DNA, 25 bp, Homo sapien
gttgaggtgcgctcacctcagagca

SEQ ID NO: 19570 - DNA, 25 bp, Homo sapien
cctcagagcagggccaaagcacagc

SEQ ID NO: 19571 - DNA, 25 bp, Homo sapien
agaactggggttcaagcccaggctt

SEQ ID NO: 19572 - DNA, 25 bp, Homo sapien
tgtgactctgggtggaagtgcccag

SEQ ID NO: 19573 - DNA, 25 bp, Homo sapien
cccacctacccagctgatgggggtt

SEQ ID NO: 19574 - DNA, 25 bp, Homo sapien
ctacccagctgatgggggttggggt

SEQ ID NO: 19575 - DNA, 25 bp, Homo sapien
gccaaggctatgaagggacagctgc

SEQ ID NO: 19576 - DNA, 25 bp, Homo sapien
ggtgctgaggatacagctcttctca

SEQ ID NO: 19577 - DNA, 25 bp, Homo sapien
atatttttgctaggagccccagctt

SEQ ID NO: 19578 - DNA, 25 bp, Homo sapien
gtacacagactgacgaaactttaaa

SEQ ID NO: 19579 - DNA, 25 bp, Homo sapien
tttttcctctgcatttacacacaca

SEQ ID NO: 19580 - DNA, 25 bp, Homo sapien
agtaccagtataagcatctcccatc

SEQ ID NO: 19581 - DNA, 25 bp, Homo sapien
tcactctgtttcctggtcagcatgt

SEQ ID NO: 19582 - DNA, 25 bp, Homo sapien
gaacatgggcatggctgtggacccc

SEQ ID NO: 19583 - DNA, 25 bp, Homo sapien
gagcgtcatttttcttagtgtgcca

SEQ ID NO: 19584 - DNA, 25 bp, Homo sapien
gtgtgccaagagtacgatattagcg

SEQ ID NO: 19585 - DNA, 25 bp, Homo sapien
cgatattagcgtttccattgtattt

SEQ ID NO: 19586 - DNA, 25 bp, Homo sapien
tggtttgtgtatccatgcacctacc

SEQ ID NO: 19587 - DNA, 25 bp, Homo sapien
gtattgtcagttacctctgcatgga

SEQ ID NO: 19588 - DNA, 25 bp, Homo sapien
ctgcatggaacagcattaccctcct

SEQ ID NO: 19589 - DNA, 25 bp, Homo sapien
ctctctccctagatgtgactactga

SEQ ID NO: 19590 - DNA, 25 bp, Homo sapien
gtcccagctactccagatgctgagg

SEQ ID NO: 19591 - DNA, 25 bp, Homo sapien
ttgcagggagtcgagatcgcgccac

SEQ ID NO: 19592 - DNA, 25 bp, Homo sapien
gagttcaagcctttattgacattca

SEQ ID NO: 19593 - DNA, 25 bp, Homo sapien
aagaggatggggccaggtgtggtgg

SEQ ID NO: 19594 - DNA, 25 bp, Homo sapien
cacgtcgggaggccaaggcacatag

SEQ ID NO: 19595 - DNA, 25 bp, Homo sapien
ggcacataggtcacttgaggtcagg

SEQ ID NO: 19596 - DNA, 25 bp, Homo sapien
accagcatggccaacagatgtgagc

SEQ ID NO: 19597 - DNA, 25 bp, Homo sapien
agatgtgagccacttttctcagcct

SEQ ID NO: 19598 - DNA, 25 bp, Homo sapien
ttctcagcctgttttttgtttctta

SEQ ID NO: 19599 - DNA, 25 bp, Homo sapien
gatatgaggccaggcacggaggctc

SEQ ID NO: 19600 - DNA, 25 bp, Homo sapien
gagactttcctggctaacagggtga

SEQ ID NO: 19601 - DNA, 25 bp, Homo sapien
gtgctgtggccagggtgagagctgc

SEQ ID NO: 19602 - DNA, 25 bp, Homo sapien
agagctgctctggaaaatgtgaccc

SEQ ID NO: 19603 - DNA, 25 bp, Homo sapien
aaatgtgacccagatcctcacaacc

SEQ ID NO: 19604 - DNA, 25 bp, Homo sapien
tcctcacaaccacctaatcaggctg

SEQ ID NO: 19605 - DNA, 25 bp, Homo sapien
ctaatcaggctgaggtgtcttaagc

SEQ ID NO: 19606 - DNA, 25 bp, Homo sapien
agccttttgctcacaaaacctggca

SEQ ID NO: 19607 - DNA, 25 bp, Homo sapien
aaacctggcacaatggctaattccc

SEQ ID NO: 19608 - DNA, 25 bp, Homo sapien
attcccagagtgtgaaacttcctaa

SEQ ID NO: 19609 - DNA, 25 bp, Homo sapien
gtataaatggttgtctgtttttgta

SEQ ID NO: 19610 - DNA, 25 bp, Homo sapien
gggatcacaaggtcactagatggcg

SEQ ID NO: 19611 - DNA, 25 bp, Homo sapien
actagatggcgagcatcctggccaa

SEQ ID NO: 19612 - DNA, 25 bp, Homo sapien
gatggggctcgggacatgtggagag

SEQ ID NO: 19613 - DNA, 25 bp, Homo sapien
gacatgagagaagccaattacatcg

SEQ ID NO: 19614 - DNA, 25 bp, Homo sapien
agaagccaattacatcggctcagac

SEQ ID NO: 19615 - DNA, 25 bp, Homo sapien
ggaactatgatgctgccaaaagggg

SEQ ID NO: 19616 - DNA, 25 bp, Homo sapien
gatgctgccaaaaggggacctgggg

SEQ ID NO: 19617 - DNA, 25 bp, Homo sapien
tgctgccaaaaggggacctgggggt

SEQ ID NO: 19618 - DNA, 25 bp, Homo sapien
tttcgttccttggcgaggcttttga

SEQ ID NO: 19619 - DNA, 25 bp, Homo sapien
cgttccttggcgaggcttttgatgg

SEQ ID NO: 19620 - DNA, 25 bp, Homo sapien
ccttggcgaggcttttgatggggct

SEQ ID NO: 19621 - DNA, 25 bp, Homo sapien
ggcgaggcttttgatggggctcggg

SEQ ID NO: 19622 - DNA, 25 bp, Homo sapien
gcttttgatggggctcgggacatgt

SEQ ID NO: 19623 - DNA, 25 bp, Homo sapien
ggccttgacacattacaagcctgga

SEQ ID NO: 19624 - DNA, 25 bp, Homo sapien
tatacatgtgccatgctggtgcgct

SEQ ID NO: 19625 - DNA, 25 bp, Homo sapien
cgctgcacccactaatgtgtcatct

SEQ ID NO: 19626 - DNA, 25 bp, Homo sapien
gcattaggtatatctcccagtgcta

SEQ ID NO: 19627 - DNA, 25 bp, Homo sapien
acagtccccagagtgtgatattccc

SEQ ID NO: 19628 - DNA, 25 bp, Homo sapien
cttcctgtgtccatgtgatctcatt

SEQ ID NO: 19629 - DNA, 25 bp, Homo sapien
tgatctcattgttcaattcccacct

SEQ ID NO: 19630 - DNA, 25 bp, Homo sapien
gtgtttggttttttgttcttgcgat

SEQ ID NO: 19631 - DNA, 25 bp, Homo sapien
tggtttccaatttcatccatgtccc

SEQ ID NO: 19632 - DNA, 25 bp, Homo sapien
tgtgccacattttcttaatccagtc

SEQ ID NO: 19633 - DNA, 25 bp, Homo sapien
ggttggttccaagtctttgctattg

SEQ ID NO: 19634 - DNA, 25 bp, Homo sapien
agctcacctagtggcaatggctcca

SEQ ID NO: 19635 - DNA, 25 bp, Homo sapien
gcagatcctcaagcagacctacagc

SEQ ID NO: 19636 - DNA, 25 bp, Homo sapien
gtttgacacaaactcgcacaaccat

SEQ ID NO: 19637 - DNA, 25 bp, Homo sapien
cacaaccatgacgcactgctcaaga

SEQ ID NO: 19638 - DNA, 25 bp, Homo sapien
tgctcaagaactacgggctgctcta

SEQ ID NO: 19639 - DNA, 25 bp, Homo sapien
gctgctctactgcttcaggaaggac

SEQ ID NO: 19640 - DNA, 25 bp, Homo sapien
gacaaggtcgagacattcctgcgca

SEQ ID NO: 19641 - DNA, 25 bp, Homo sapien
agggcagctgtggcttctaggtgcc

SEQ ID NO: 19642 - DNA, 25 bp, Homo sapien
ttctaggtgcccgagtagcatcctg

SEQ ID NO: 19643 - DNA, 25 bp, Homo sapien
acaagagaccggctctaggatccca

SEQ ID NO: 19644 - DNA, 25 bp, Homo sapien
gaaccactcagggtcctgtggacag

SEQ ID NO: 19645 - DNA, 25 bp, Homo sapien
tgcccggcccacaattaattttaga

SEQ ID NO: 19646 - DNA, 25 bp, Homo sapien
attttagaacattttcatcacccct

SEQ ID NO: 19647 - DNA, 25 bp, Homo sapien
agaacattttcatcacccctaaaag

SEQ ID NO: 19648 - DNA, 25 bp, Homo sapien
tcatcacccctaaaagaaaccctgc

SEQ ID NO: 19649 - DNA, 25 bp, Homo sapien
agaaaccctgcacccattagcagtc

SEQ ID NO: 19650 - DNA, 25 bp, Homo sapien
agccctggcaactgctaatctactt

SEQ ID NO: 19651 - DNA, 25 bp, Homo sapien
ggcaactgctaatctactttctgtg

SEQ ID NO: 19652 - DNA, 25 bp, Homo sapien
aactgctaatctactttctgtgtct

SEQ ID NO: 19653 - DNA, 25 bp, Homo sapien
gctaatctactttctgtgtctatgg

SEQ ID NO: 19654 - DNA, 25 bp, Homo sapien
actttctgtgtctatggatttgcct

SEQ ID NO: 19655 - DNA, 25 bp, Homo sapien
tgtgtctatggatttgccttctcta

SEQ ID NO: 19656 - DNA, 25 bp, Homo sapien
ctcctccaagtccacctaatggtga

SEQ ID NO: 19657 - DNA, 25 bp, Homo sapien
ccacctaatggtgataagagtgtct

SEQ ID NO: 19658 - DNA, 25 bp, Homo sapien
agagtgtcttgagtatctgtcctgt

SEQ ID NO: 19659 - DNA, 25 bp, Homo sapien
atctgtcctgtgataaacccgggca

SEQ ID NO: 19660 - DNA, 25 bp, Homo sapien
tgtcctgtgataaacccgggcacta

SEQ ID NO: 19661 - DNA, 25 bp, Homo sapien
gataaacccgggcactactgatgct

SEQ ID NO: 19662 - DNA, 25 bp, Homo sapien
gctctactcggtaaaagcgttatac

SEQ ID NO: 19663 - DNA, 25 bp, Homo sapien
aaagcgttatacaaagtcataggag

SEQ ID NO: 19664 - DNA, 25 bp, Homo sapien
aatatgggacaattcatgattatac

SEQ ID NO: 19665 - DNA, 25 bp, Homo sapien
gtttataaattgagtcctaagtatt

SEQ ID NO: 19666 - DNA, 25 bp, Homo sapien
tagaaatattctgtattctgggatc

SEQ ID NO: 19667 - DNA, 25 bp, Homo sapien
cccccaactatgaccatgtggtcct

SEQ ID NO: 19668 - DNA, 25 bp, Homo sapien
ggtcctgggcggtggtcaggaagcc

SEQ ID NO: 19669 - DNA, 25 bp, Homo sapien
catggatgtaaccacaacctccacc

SEQ ID NO: 19670 - DNA, 25 bp, Homo sapien
tttgaggccaggttcttccatttgg

SEQ ID NO: 19671 - DNA, 25 bp, Homo sapien
ggaagagtcaagggtcactttggac

SEQ ID NO: 19672 - DNA, 25 bp, Homo sapien
gggtcactttggacctatcaacagt

SEQ ID NO: 19673 - DNA, 25 bp, Homo sapien
ctatcaacagtgttgccttccatcc

SEQ ID NO: 19674 - DNA, 25 bp, Homo sapien
gccttccatcctgatggcaagagct

SEQ ID NO: 19675 - DNA, 25 bp, Homo sapien
ttacgtccgtatccattacttcgac

SEQ ID NO: 19676 - DNA, 25 bp, Homo sapien
attacttcgacccacagtacttcga

SEQ ID NO: 19677 - DNA, 25 bp, Homo sapien
tcgacccacagtacttcgaatttga

SEQ ID NO: 19678 - DNA, 25 bp, Homo sapien
tccgtcgcgctggaccagagggagg

SEQ ID NO: 19679 - DNA, 25 bp, Homo sapien
ccgtcgcgctggaccagagggagga

SEQ ID NO: 19680 - DNA, 25 bp, Homo sapien
gtcgcgctggaccagagggaggagg

SEQ ID NO: 19681 - DNA, 25 bp, Homo sapien
ctggaccagagggaggaggtgcccc

SEQ ID NO: 19682 - DNA, 25 bp, Homo sapien
cagagggaggaggtgcccctcacta

SEQ ID NO: 19683 - DNA, 25 bp, Homo sapien
gaggtgcccctcactagataagggg

SEQ ID NO: 19684 - DNA, 25 bp, Homo sapien
ggtgcccctcactagataaggggcc

SEQ ID NO: 19685 - DNA, 25 bp, Homo sapien
ctcactagataaggggccgggctgg

SEQ ID NO: 19686 - DNA, 25 bp, Homo sapien
cactagataaggggccgggctggtg

SEQ ID NO: 19687 - DNA, 25 bp, Homo sapien
ctagataaggggccgggctggtggc

SEQ ID NO: 19688 - DNA, 25 bp, Homo sapien
agataaggggccgggctggtggctg

SEQ ID NO: 19689 - DNA, 25 bp, Homo sapien
tggactggtgtcgagccaagactcg

SEQ ID NO: 19690 - DNA, 25 bp, Homo sapien
ctacgagcacgtcgacatccagaac

SEQ ID NO: 19691 - DNA, 25 bp, Homo sapien
tctgtgccctggtgcacaacttctt

SEQ ID NO: 19692 - DNA, 25 bp, Homo sapien
tccctgaggccttcgactatgggca

SEQ ID NO: 19693 - DNA, 25 bp, Homo sapien
ggccttcgactatgggcagcttagc

SEQ ID NO: 19694 - DNA, 25 bp, Homo sapien
tatgggcagcttagccctcagaacc

SEQ ID NO: 19695 - DNA, 25 bp, Homo sapien
ctcagaaccgacgccagaacttcga

SEQ ID NO: 19696 - DNA, 25 bp, Homo sapien
acgccagaacttcgaggtggccttc

SEQ ID NO: 19697 - DNA, 25 bp, Homo sapien
accccaagtgtgtcttcacctatgt

SEQ ID NO: 19698 - DNA, 25 bp, Homo sapien
gcggcaagaatgtctagcctgcccg

SEQ ID NO: 19699 - DNA, 25 bp, Homo sapien
cccacatacacacgcagcgttttga

SEQ ID NO: 19700 - DNA, 25 bp, Homo sapien
gaaatccaacttagagctgctccac

SEQ ID NO: 19701 - DNA, 25 bp, Homo sapien
ttcctcaggagtaccttcaccaaca

SEQ ID NO: 19702 - DNA, 25 bp, Homo sapien
gacacctcggacagcgatgactatc

SEQ ID NO: 19703 - DNA, 25 bp, Homo sapien
gatgactatcacctcctaaaggacc

SEQ ID NO: 19704 - DNA, 25 bp, Homo sapien
ctgactgggcagaccctcaagcaga

SEQ ID NO: 19705 - DNA, 25 bp, Homo sapien
agcagacctacagcaagtttgacac

SEQ ID NO: 19706 - DNA, 25 bp, Homo sapien
gtttgacacaaactcgcacaaccat

SEQ ID NO: 19707 - DNA, 25 bp, Homo sapien
caccactcagggtcctgtggacagc

SEQ ID NO: 19708 - DNA, 25 bp, Homo sapien
gacgcactgctcaagaactacgggc

SEQ ID NO: 19709 - DNA, 25 bp, Homo sapien
gacaaggtcgagacattcctgcgca

SEQ ID NO: 19710 - DNA, 25 bp, Homo sapien
ctcacctagcggcaatggctgcaga

SEQ ID NO: 19711 - DNA, 25 bp, Homo sapien
tgggaaacgcagtgagactgtgcct

SEQ ID NO: 19712 - DNA, 25 bp, Homo sapien
gagctgttggtcagccagcagtcac

SEQ ID NO: 19713 - DNA, 25 bp, Homo sapien
tgtggtacacctggaggctggggag

SEQ ID NO: 19714 - DNA, 25 bp, Homo sapien
tccgtgtgctggatgaacgcctggt

SEQ ID NO: 19715 - DNA, 25 bp, Homo sapien
gctggatgaacgcctggttcgactg

SEQ ID NO: 19716 - DNA, 25 bp, Homo sapien
tggttcgactgcgtgatggtacccg

SEQ ID NO: 19717 - DNA, 25 bp, Homo sapien
tgatggtacccggtcttacttcggg

SEQ ID NO: 19718 - DNA, 25 bp, Homo sapien
ttacttcggggctttcatggtgtga

SEQ ID NO: 19719 - DNA, 25 bp, Homo sapien
gagcgtggtgcattggacatgggtc

SEQ ID NO: 19720 - DNA, 25 bp, Homo sapien
atgggtctgacacgtggagaactca

SEQ ID NO: 19721 - DNA, 25 bp, Homo sapien
ggagaactcagagggtgcctcaggg

SEQ ID NO: 19722 - DNA, 25 bp, Homo sapien
ggaatcctgctaaagagtctggcct

SEQ ID NO: 19723 - DNA, 25 bp, Homo sapien
tgctaaagagtctggcctggaccct

SEQ ID NO: 19724 - DNA, 25 bp, Homo sapien
gaataacatcaccactgtatatttc

SEQ ID NO: 19725 - DNA, 25 bp, Homo sapien
cagaaagatcactagggcagccgag

SEQ ID NO: 19726 - DNA, 25 bp, Homo sapien
gggggttagagagaaggcaggttga

SEQ ID NO: 19727 - DNA, 25 bp, Homo sapien
ggcaggttgagactacttaagatat

SEQ ID NO: 19728 - DNA, 25 bp, Homo sapien
gaagagagaaatgacaggagcctgc

SEQ ID NO: 19729 - DNA, 25 bp, Homo sapien
acaggagcctgctctaaggcagtag

SEQ ID NO: 19730 - DNA, 25 bp, Homo sapien
agaatggtggctgggaagatgtgaa

SEQ ID NO: 19731 - DNA, 25 bp, Homo sapien
gaagattttcccagtctgtgaagtc

SEQ ID NO: 19732 - DNA, 25 bp, Homo sapien
gaagtcaagaatcacttgccggccg

SEQ ID NO: 19733 - DNA, 25 bp, Homo sapien
aaagcccaacatcccatggctgttt

SEQ ID NO: 19734 - DNA, 25 bp, Homo sapien
tggctgtttctcacagatcccaaat

SEQ ID NO: 19735 - DNA, 25 bp, Homo sapien
ttgtagtccctaccagtttaggctg

SEQ ID NO: 19736 - DNA, 25 bp, Homo sapien
gtgggaccggtcgttgaaacccatg

SEQ ID NO: 19737 - DNA, 25 bp, Homo sapien
gaaacccatgcagacacgagtggtc

SEQ ID NO: 19738 - DNA, 25 bp, Homo sapien
gtggtcgggagacttcagaagcctt

SEQ ID NO: 19739 - DNA, 25 bp, Homo sapien
tttccattggctgaagctctttgca

SEQ ID NO: 19740 - DNA, 25 bp, Homo sapien
gctctttgcaattcctattctgtta

SEQ ID NO: 19741 - DNA, 25 bp, Homo sapien
tattctgttaatcgctgttttcctt

SEQ ID NO: 19742 - DNA, 25 bp, Homo sapien
gttttccttgtgttgacctaatcat

SEQ ID NO: 19743 - DNA, 25 bp, Homo sapien
gacaatacccagacaggggctttgc

SEQ ID NO: 19744 - DNA, 25 bp, Homo sapien
ggatcaatgggtttaacttgggccg

SEQ ID NO: 19745 - DNA, 25 bp, Homo sapien
acttgggccggtactggacaaagca

SEQ ID NO: 19746 - DNA, 25 bp, Homo sapien
gacaaagcaggggccacaacagacc

SEQ ID NO: 19747 - DNA, 25 bp, Homo sapien
ccaagattcctgctgtttcctaggg

SEQ ID NO: 19748 - DNA, 25 bp, Homo sapien
ggggagccctcaacaaaattacatt

SEQ ID NO: 19749 - DNA, 25 bp, Homo sapien
aactagaagatgtacctctccagcc

SEQ ID NO: 19750 - DNA, 25 bp, Homo sapien
tccagccccaagtccaatttttgga

SEQ ID NO: 19751 - DNA, 25 bp, Homo sapien
gcctatcctcaatagcactagtact

SEQ ID NO: 19752 - DNA, 25 bp, Homo sapien
cactagtactttgcacaggacacat

SEQ ID NO: 19753 - DNA, 25 bp, Homo sapien
acacatatcaattccctttcagctg

SEQ ID NO: 19754 - DNA, 25 bp, Homo sapien
tgatacactgagtgcctctgaacca

SEQ ID NO: 19755 - DNA, 25 bp, Homo sapien
agctgcaatgtgaattctgcccagt

SEQ ID NO: 19756 - DNA, 25 bp, Homo sapien
tgcaatgtgaattctgcccagtgac

SEQ ID NO: 19757 - DNA, 25 bp, Homo sapien
tacttgtcttcagatcagactggct

SEQ ID NO: 19758 - DNA, 25 bp, Homo sapien
tgtcttcagatcagactggctcctc

SEQ ID NO: 19759 - DNA, 25 bp, Homo sapien
tcctcctttggcaagaactccgaga

SEQ ID NO: 19760 - DNA, 25 bp, Homo sapien
cctttggcaagaactccgagaggag

SEQ ID NO: 19761 - DNA, 25 bp, Homo sapien
agagtagtcatagggggaagaaatc

SEQ ID NO: 19762 - DNA, 25 bp, Homo sapien
gaagaaataggcaccgcagctggga

SEQ ID NO: 19763 - DNA, 25 bp, Homo sapien
aagaaataggcaccgcagctgggac

SEQ ID NO: 19764 - DNA, 25 bp, Homo sapien
tctaggtgccgaagtcgtgggagga

SEQ ID NO: 19765 - DNA, 25 bp, Homo sapien
cgaagtcgtgggaggaggaagtcgg

SEQ ID NO: 19766 - DNA, 25 bp, Homo sapien
gagttatgcctgtatttaagaagct

SEQ ID NO: 19767 - DNA, 25 bp, Homo sapien
gaagctgagtgaaacccaaagaagt

SEQ ID NO: 19768 - DNA, 25 bp, Homo sapien
gaaacccaaagaagtccatgatagg

SEQ ID NO: 19769 - DNA, 25 bp, Homo sapien
tccatgataggacagacttctgaaa

SEQ ID NO: 19770 - DNA, 25 bp, Homo sapien
agtaactcagatgacagtggatttc

SEQ ID NO: 19771 - DNA, 25 bp, Homo sapien
gtgagacaagttcttttagtgccag

SEQ ID NO: 19772 - DNA, 25 bp, Homo sapien
gacaagttcttttagtgccagaaga

SEQ ID NO: 19773 - DNA, 25 bp, Homo sapien
tcttttagtgccagaagaactatca

SEQ ID NO: 19774 - DNA, 25 bp, Homo sapien
agaactatcaacttgtggctgggca

SEQ ID NO: 19775 - DNA, 25 bp, Homo sapien
caaaactctgtcaactccaaattcc

SEQ ID NO: 19776 - DNA, 25 bp, Homo sapien
aatgatccttcaggattgatggggt

SEQ ID NO: 19777 - DNA, 25 bp, Homo sapien
cagagtacccattgagctgtttcgc

SEQ ID NO: 19778 - DNA, 25 bp, Homo sapien
tcaagggctttttccagagtgctaa

SEQ ID NO: 19779 - DNA, 25 bp, Homo sapien
gcaagattgagacccggggcaccag

SEQ ID NO: 19780 - DNA, 25 bp, Homo sapien
gcaccaggtaccagtactgtgactt

SEQ ID NO: 19781 - DNA, 25 bp, Homo sapien
tgtggaggtggagtatggcccctgt

SEQ ID NO: 19782 - DNA, 25 bp, Homo sapien
cccctgtgtggtagctagtgactgc

SEQ ID NO: 19783 - DNA, 25 bp, Homo sapien
ctgctgctcgagttcctacagagtt

SEQ ID NO: 19784 - DNA, 25 bp, Homo sapien
gagttttctaggcagccacacacca

SEQ ID NO: 19785 - DNA, 25 bp, Homo sapien
acagacatgatgcggtctacggccc

SEQ ID NO: 19786 - DNA, 25 bp, Homo sapien
cccagcagataccatggtccagtac

SEQ ID NO: 19787 - DNA, 25 bp, Homo sapien
ggtggctgggattcgttagtgatga

SEQ ID NO: 19788 - DNA, 25 bp, Homo sapien
ccttcattctattagatctgttcat

SEQ ID NO: 19789 - DNA, 25 bp, Homo sapien
cattctattagatctgttcatcctt

SEQ ID NO: 19790 - DNA, 25 bp, Homo sapien
tattagatctgttcatccttaccct

SEQ ID NO: 19791 - DNA, 25 bp, Homo sapien
tgcaacagggctttacgaagtcacc

SEQ ID NO: 19792 - DNA, 25 bp, Homo sapien
gcaacagggctttacgaagtcaccc

SEQ ID NO: 19793 - DNA, 25 bp, Homo sapien
gccgagccccaaaaaactagtcatc

SEQ ID NO: 19794 - DNA, 25 bp, Homo sapien
aaaactagtcatccctactatcttc

SEQ ID NO: 19795 - DNA, 25 bp, Homo sapien
aaactagtcatccctactatcttct

SEQ ID NO: 19796 - DNA, 25 bp, Homo sapien
ttgtttacaccgccggtttacactg

SEQ ID NO: 19797 - DNA, 25 bp, Homo sapien
ctcttaactccctcttagagtggat

SEQ ID NO: 19798 - DNA, 25 bp, Homo sapien
tcttaactccctcttagagtggata

SEQ ID NO: 19799 - DNA, 25 bp, Homo sapien
aaaaccatcattcacagcatcaatg

SEQ ID NO: 19800 - DNA, 25 bp, Homo sapien
ggttgtcctactgtgcatctggaag

SEQ ID NO: 19801 - DNA, 25 bp, Homo sapien
cctactgtgcatctggaagctactg

SEQ ID NO: 19802 - DNA, 25 bp, Homo sapien
atctggaagctactggtgtcatttc

SEQ ID NO: 19803 - DNA, 25 bp, Homo sapien
aagctactggtgtcatttcatgatc

SEQ ID NO: 19804 - DNA, 25 bp, Homo sapien
actggtgtcatttcatgatcgtaaa

SEQ ID NO: 19805 - DNA, 25 bp, Homo sapien
gcagaacgatcaaaagccaagtggc

SEQ ID NO: 19806 - DNA, 25 bp, Homo sapien
ggcaaacgggaaccaatccactcta

SEQ ID NO: 19807 - DNA, 25 bp, Homo sapien
caaacgggaaccaatccactctaca

SEQ ID NO: 19808 - DNA, 25 bp, Homo sapien
caatccactctacagaggatccaca

SEQ ID NO: 19809 - DNA, 25 bp, Homo sapien
acagaggatccacaagtacttttaa

SEQ ID NO: 19810 - DNA, 25 bp, Homo sapien
gaaacggggctccagtctgggaggc

SEQ ID NO: 19811 - DNA, 25 bp, Homo sapien
cagctggtggctttatggtggtggc

SEQ ID NO: 19812 - DNA, 25 bp, Homo sapien
tggtgctgtcagggcctgttagcca

SEQ ID NO: 19813 - DNA, 25 bp, Homo sapien
caccagcactactgtggtggctccg

SEQ ID NO: 19814 - DNA, 25 bp, Homo sapien
tgagggcacagagcatggcctccag

SEQ ID NO: 19815 - DNA, 25 bp, Homo sapien
tccggcccaagaagcgcctgattgt

SEQ ID NO: 19816 - DNA, 25 bp, Homo sapien
gcaggtactcagtgcaccaactgcc

SEQ ID NO: 19817 - DNA, 25 bp, Homo sapien
tgccagtggggatcccgtgtgcaat

SEQ ID NO: 19818 - DNA, 25 bp, Homo sapien
agctacaccaggtgaaccggccact

SEQ ID NO: 19819 - DNA, 25 bp, Homo sapien
ccggccactgaccatgcggaaggat

SEQ ID NO: 19820 - DNA, 25 bp, Homo sapien
gactcgaaaccgcaaggcatctgga

SEQ ID NO: 19821 - DNA, 25 bp, Homo sapien
tttgtcctgtactttgtgcagtggc

SEQ ID NO: 19822 - DNA, 25 bp, Homo sapien
cctgtactttgtgcagtggctggtg

SEQ ID NO: 19823 - DNA, 25 bp, Homo sapien
gcccacagcacatcttctttggtgc

SEQ ID NO: 19824 - DNA, 25 bp, Homo sapien
cagcacatcttctttggtgctacca

SEQ ID NO: 19825 - DNA, 25 bp, Homo sapien
tgctgttcaacctcgggggcaagta

SEQ ID NO: 19826 - DNA, 25 bp, Homo sapien
gttcaacctcgggggcaagtatagc

SEQ ID NO: 19827 - DNA, 25 bp, Homo sapien
acctcgggggcaagtatagcgcatt

SEQ ID NO: 19828 - DNA, 25 bp, Homo sapien
aagtatagcgcatttgagcccgagg

SEQ ID NO: 19829 - DNA, 25 bp, Homo sapien
cgcatttgagcccgagggtgtcctg

SEQ ID NO: 19830 - DNA, 25 bp, Homo sapien
cctgctgaggcgtcttcaggactgc

SEQ ID NO: 19831 - DNA, 25 bp, Homo sapien
ctgaggcgtcttcaggactgcaggc

SEQ ID NO: 19832 - DNA, 25 bp, Homo sapien
tcatttgattcacttttttctgcag

SEQ ID NO: 19833 - DNA, 25 bp, Homo sapien
gaaattgcttccaagttcagcgaga

SEQ ID NO: 19834 - DNA, 25 bp, Homo sapien
gttaccagacagacctttttatagg

SEQ ID NO: 19835 - DNA, 25 bp, Homo sapien
aggcatgtcatctatgctccaagca

SEQ ID NO: 19836 - DNA, 25 bp, Homo sapien
gctccaagcagccacaacaagtatg

SEQ ID NO: 19837 - DNA, 25 bp, Homo sapien
gtatgcaggggagtcattcccagga

SEQ ID NO: 19838 - DNA, 25 bp, Homo sapien
acccttccaaggcctggggagatgt

SEQ ID NO: 19839 - DNA, 25 bp, Homo sapien
gacagatttctgttgcagccttcac

SEQ ID NO: 19840 - DNA, 25 bp, Homo sapien
gcagccttcacagtgcaggcagctg

SEQ ID NO: 19841 - DNA, 25 bp, Homo sapien
caggcagctgcagagactttgagtg

SEQ ID NO: 19842 - DNA, 25 bp, Homo sapien
tagagactctgtattgaatttgtgt

SEQ ID NO: 19843 - DNA, 25 bp, Homo sapien
gctctggggcttcagaaggcttgaa

SEQ ID NO: 19844 - DNA, 25 bp, Homo sapien
gttagagtaacacatatcctgcctt

SEQ ID NO: 19845 - DNA, 25 bp, Homo sapien
taacacatatcctgcctttactaaa

SEQ ID NO: 19846 - DNA, 25 bp, Homo sapien
gaatcctaggtatataatcaccttt

SEQ ID NO: 19847 - DNA, 25 bp, Homo sapien
aacatagggataatggcaagccact

SEQ ID NO: 19848 - DNA, 25 bp, Homo sapien
atggcaagccactcataatgttgtc

SEQ ID NO: 19849 - DNA, 25 bp, Homo sapien
caagccactcataatgttgtcattt

SEQ ID NO: 19850 - DNA, 25 bp, Homo sapien
gttgtcatttgaagatcacaccttt

SEQ ID NO: 19851 - DNA, 25 bp, Homo sapien
gatcacaccttttaatgtagctgaa

SEQ ID NO: 19852 - DNA, 25 bp, Homo sapien
aacagatgccagtgcacaaatctta

SEQ ID NO: 19853 - DNA, 25 bp, Homo sapien
ttataaggcctggtgcgatggctca

SEQ ID NO: 19854 - DNA, 25 bp, Homo sapien
aggtccctagatatcccagaacctg

SEQ ID NO: 19855 - DNA, 25 bp, Homo sapien
tccaccttcaccccaagactagggg

SEQ ID NO: 19856 - DNA, 25 bp, Homo sapien
ggctgggtggtagctgggatgtccc

SEQ ID NO: 19857 - DNA, 25 bp, Homo sapien
gtggtagctgggatgtcccacctac

SEQ ID NO: 19858 - DNA, 25 bp, Homo sapien
cacctacgtgcctggggagagaagc

SEQ ID NO: 19859 - DNA, 25 bp, Homo sapien
gagcaggctggagtctctactttgt

SEQ ID NO: 19860 - DNA, 25 bp, Homo sapien
ctactttgtattcttgtgaggcaca

SEQ ID NO: 19861 - DNA, 25 bp, Homo sapien
tataggctagaatccaggccccaca

SEQ ID NO: 19862 - DNA, 25 bp, Homo sapien
tccaggccccacaaatataggctag

SEQ ID NO: 19863 - DNA, 25 bp, Homo sapien
gaatccggaatgttttcttgattta

SEQ ID NO: 19864 - DNA, 25 bp, Homo sapien
taaagacatctttagaccgggcaca

SEQ ID NO: 19865 - DNA, 25 bp, Homo sapien
agcctggatgaatctgacctctata

SEQ ID NO: 19866 - DNA, 25 bp, Homo sapien
atgaatctgacctctatagcctggc

SEQ ID NO: 19867 - DNA, 25 bp, Homo sapien
ggaggtggaggccggaaaggtcgca

SEQ ID NO: 19868 - DNA, 25 bp, Homo sapien
ggccggaaaggtcgcaccaagagag

SEQ ID NO: 19869 - DNA, 25 bp, Homo sapien
agccctggcgggcacgagaggaaac

SEQ ID NO: 19870 - DNA, 25 bp, Homo sapien
gaagaagcgaggggcacggcgctga

SEQ ID NO: 19871 - DNA, 25 bp, Homo sapien
gcacggcgctgagacagagctggag

SEQ ID NO: 19872 - DNA, 25 bp, Homo sapien
gatgaggccagaccatggacactac

SEQ ID NO: 19873 - DNA, 25 bp, Homo sapien
ggacactacacccagcaatagagac

SEQ ID NO: 19874 - DNA, 25 bp, Homo sapien
gacgggactgcggaggaaggaggac

SEQ ID NO: 19875 - DNA, 25 bp, Homo sapien
tcccgctgactgagtctctgagggg

SEQ ID NO: 19876 - DNA, 25 bp, Homo sapien
atcgttagggtgaagcattatggtc

SEQ ID NO: 19877 - DNA, 25 bp, Homo sapien
atgttttaaagtttaatgcctagca

SEQ ID NO: 19878 - DNA, 25 bp, Homo sapien
caggaaagtttctcagcgccgagtg

SEQ ID NO: 19879 - DNA, 25 bp, Homo sapien
aaagtttctcagcgccgagtggact

SEQ ID NO: 19880 - DNA, 25 bp, Homo sapien
tctcagcgccgagtggacttttgca

SEQ ID NO: 19881 - DNA, 25 bp, Homo sapien
gcgccgagtggacttttgcaaagac

SEQ ID NO: 19882 - DNA, 25 bp, Homo sapien
tgcaaagacccaagtgcaattggaa

SEQ ID NO: 19883 - DNA, 25 bp, Homo sapien
gaaagaagcaggttccctgttttgc

SEQ ID NO: 19884 - DNA, 25 bp, Homo sapien
ccctgttttgcctcaatgctaacta

SEQ ID NO: 19885 - DNA, 25 bp, Homo sapien
gcctcaatgctaactaaaaagctgc

SEQ ID NO: 19886 - DNA, 25 bp, Homo sapien
tgtattgaaaatggctttctcagcc

SEQ ID NO: 19887 - DNA, 25 bp, Homo sapien
agacaggagagttattagcactacc

SEQ ID NO: 19888 - DNA, 25 bp, Homo sapien
tgaaagacaagcagttacaccccca

SEQ ID NO: 19889 - DNA, 25 bp, Homo sapien
ggaggcaatcaatgacctggtgaag

SEQ ID NO: 19890 - DNA, 25 bp, Homo sapien
caagctttctcgagcttttgtccgg

SEQ ID NO: 19891 - DNA, 25 bp, Homo sapien
tccggccctctggtacagaagatgt

SEQ ID NO: 19892 - DNA, 25 bp, Homo sapien
gatgtcgtccgagtatatgcagaag

SEQ ID NO: 19893 - DNA, 25 bp, Homo sapien
aaagtgcagatcaccttgcacatga

SEQ ID NO: 19894 - DNA, 25 bp, Homo sapien
gcacatgaagtgagcttggcagtat

SEQ ID NO: 19895 - DNA, 25 bp, Homo sapien
ttggcagtatttcagctggctggag

SEQ ID NO: 19896 - DNA, 25 bp, Homo sapien
gaattggagaaaggccccaaccagg

SEQ ID NO: 19897 - DNA, 25 bp, Homo sapien
ggattgtctctagatctgtttttct

SEQ ID NO: 19898 - DNA, 25 bp, Homo sapien
caaatgctgagcccagtgcgttgtc

SEQ ID NO: 19899 - DNA, 25 bp, Homo sapien
gcaccacagtcaggccttgatggga

SEQ ID NO: 19900 - DNA, 25 bp, Homo sapien
ccacccacggagagacctacagatg

SEQ ID NO: 19901 - DNA, 25 bp, Homo sapien
tggatctccctacgagtggtcagac

SEQ ID NO: 19902 - DNA, 25 bp, Homo sapien
agtggtcagacccgagtgacccact

SEQ ID NO: 19903 - DNA, 25 bp, Homo sapien
gccagacacctgcatgctgtgatta

SEQ ID NO: 19904 - DNA, 25 bp, Homo sapien
ttaggtactcagtggccatcatcct

SEQ ID NO: 19905 - DNA, 25 bp, Homo sapien
atgaaccaagagcctgcgggacaca

SEQ ID NO: 19906 - DNA, 25 bp, Homo sapien
agttggatcactgcattttcacaca

SEQ ID NO: 19907 - DNA, 25 bp, Homo sapien
actggcccttctcagaggagcaaga

SEQ ID NO: 19908 - DNA, 25 bp, Homo sapien
caagagaccctcaacagataccagc

SEQ ID NO: 19909 - DNA, 25 bp, Homo sapien
ggtaggtctgatattgtcttttagt

SEQ ID NO: 19910 - DNA, 25 bp, Homo sapien
agaaccattctctcagcagtttgca

SEQ ID NO: 19911 - DNA, 25 bp, Homo sapien
gcagtgctacctcgtgttatttgta

SEQ ID NO: 19912 - DNA, 25 bp, Homo sapien
gtagatctgcttgtgttatttcatt

SEQ ID NO: 19913 - DNA, 25 bp, Homo sapien
ggagaactgatttagtcctatttcc

SEQ ID NO: 19914 - DNA, 25 bp, Homo sapien
ttagtcctatttccatcattcttat

SEQ ID NO: 19915 - DNA, 25 bp, Homo sapien
gtctagtgagtctttgtatgctttg

SEQ ID NO: 19916 - DNA, 25 bp, Homo sapien
gtaagctttctttagaccagtacat

SEQ ID NO: 19917 - DNA, 25 bp, Homo sapien
gtctgtgatgaggaaccgtttttgt

SEQ ID NO: 19918 - DNA, 25 bp, Homo sapien
ctggagcacagtggctagtcacaga

SEQ ID NO: 19919 - DNA, 25 bp, Homo sapien
gtggctagtcacagatgcagtcatg

SEQ ID NO: 19920 - DNA, 25 bp, Homo sapien
cctgttcgcctttgtcatcaagatg

SEQ ID NO: 19921 - DNA, 25 bp, Homo sapien
gtcatcaagatgcccgttatgtacc

SEQ ID NO: 19922 - DNA, 25 bp, Homo sapien
gcccgttatgtaccggatcggctgc

SEQ ID NO: 19923 - DNA, 25 bp, Homo sapien
ctgcctgcgggacgatgtggttttc

SEQ ID NO: 19924 - DNA, 25 bp, Homo sapien
gcgggacgatgtggttttcttcatc

SEQ ID NO: 19925 - DNA, 25 bp, Homo sapien
ttcatctacctctaccaacggtgga

SEQ ID NO: 19926 - DNA, 25 bp, Homo sapien
taccaacggtggatctaccgcgtcg

SEQ ID NO: 19927 - DNA, 25 bp, Homo sapien
cccacccgagtcaacgagtttggca

SEQ ID NO: 19928 - DNA, 25 bp, Homo sapien
gtttggcatgagtggagaagacccc

SEQ ID NO: 19929 - DNA, 25 bp, Homo sapien
agcccagcaccactgggaatcatgg

SEQ ID NO: 19930 - DNA, 25 bp, Homo sapien
gaagctgatgcagcgttgccgaggg

SEQ ID NO: 19931 - DNA, 25 bp, Homo sapien
agagcagccgcagtgaggtgacgga

SEQ ID NO: 19932 - DNA, 25 bp, Homo sapien
cgcagtgaggtgacggagctccgga

SEQ ID NO: 19933 - DNA, 25 bp, Homo sapien
gtgaggtgacggagctccggagggt

SEQ ID NO: 19934 - DNA, 25 bp, Homo sapien
tgacggagctccggagggtgctcca

SEQ ID NO: 19935 - DNA, 25 bp, Homo sapien
ctggcccagctacgctgtgagatgg

SEQ ID NO: 19936 - DNA, 25 bp, Homo sapien
cccagctacgctgtgagatggagca

SEQ ID NO: 19937 - DNA, 25 bp, Homo sapien
gctacgctgtgagatggagcagcag

SEQ ID NO: 19938 - DNA, 25 bp, Homo sapien
agcagagccaggagtaccagatctt

SEQ ID NO: 19939 - DNA, 25 bp, Homo sapien
gagccaggagtaccagatcttgctg

SEQ ID NO: 19940 - DNA, 25 bp, Homo sapien
tcccagcaagcatctggccaatcct

SEQ ID NO: 19941 - DNA, 25 bp, Homo sapien
agcaagcatctggccaatcctattc

SEQ ID NO: 19942 - DNA, 25 bp, Homo sapien
agaagtttatcacagatgtctctaa

SEQ ID NO: 19943 - DNA, 25 bp, Homo sapien
gatgtctctaatctctatagctgat

SEQ ID NO: 19944 - DNA, 25 bp, Homo sapien
taatctctatagctgatccctacct

SEQ ID NO: 19945 - DNA, 25 bp, Homo sapien
tgcattctgtttcgatctgtctttt

SEQ ID NO: 19946 - DNA, 25 bp, Homo sapien
gatctgtcttttagcagtccataca

SEQ ID NO: 19947 - DNA, 25 bp, Homo sapien
tagcagtccatacaatcatttttct

SEQ ID NO: 19948 - DNA, 25 bp, Homo sapien
aatcatttttctacatgctggccct

SEQ ID NO: 19949 - DNA, 25 bp, Homo sapien
gcgagacataacatgggctctcaac

SEQ ID NO: 19950 - DNA, 25 bp, Homo sapien
ggctctcaactgatggtgaacttct

SEQ ID NO: 19951 - DNA, 25 bp, Homo sapien
gaacttcttctggtgagtgacagag

SEQ ID NO: 19952 - DNA, 25 bp, Homo sapien
tctggtgagtgacagaggctgcagt

SEQ ID NO: 19953 - DNA, 25 bp, Homo sapien
ggtcggatggacacacagccagacc

SEQ ID NO: 19954 - DNA, 25 bp, Homo sapien
tggacacacagccagaccgtaaacc

SEQ ID NO: 19955 - DNA, 25 bp, Homo sapien
cagagctggggacatggcatgccct

SEQ ID NO: 19956 - DNA, 25 bp, Homo sapien
cccgagggctgagccagattcctgg

SEQ ID NO: 19957 - DNA, 25 bp, Homo sapien
gcctcttgagtaccagacctcatgg

SEQ ID NO: 19958 - DNA, 25 bp, Homo sapien
ccccttgggaccacatggcacaatg

SEQ ID NO: 19959 - DNA, 25 bp, Homo sapien
gaccacatggcacaatgggacctct

SEQ ID NO: 19960 - DNA, 25 bp, Homo sapien
acctctgttgtacattccggttggg

SEQ ID NO: 19961 - DNA, 25 bp, Homo sapien
ccggttgggggatgagcgttgctat

SEQ ID NO: 19962 - DNA, 25 bp, Homo sapien
tgccttagaggaggccgggcgagcc

SEQ ID NO: 19963 - DNA, 25 bp, Homo sapien
gcccggtgttctgaagacctgtggc

SEQ ID NO: 19964 - DNA, 25 bp, Homo sapien
gatacttacagtcagccactgcttt

SEQ ID NO: 19965 - DNA, 25 bp, Homo sapien
gagtcccactcggtaagagttgctt

SEQ ID NO: 19966 - DNA, 25 bp, Homo sapien
gacactgttgacatttgggctggat

SEQ ID NO: 19967 - DNA, 25 bp, Homo sapien
aaacccctgtggtggggtctgtgct

SEQ ID NO: 19968 - DNA, 25 bp, Homo sapien
ggtctgtgctgtgcattgcaggatg

SEQ ID NO: 19969 - DNA, 25 bp, Homo sapien
ttgcaggatggtgagcagcgtccct

SEQ ID NO: 19970 - DNA, 25 bp, Homo sapien
tgacacccacagttatgccggatgt

SEQ ID NO: 19971 - DNA, 25 bp, Homo sapien
ttatgccggatgttgccagatgccc

SEQ ID NO: 19972 - DNA, 25 bp, Homo sapien
tgcccctaggggacagagtcaaccc

SEQ ID NO: 19973 - DNA, 25 bp, Homo sapien
ggaccactgtcctacagagtcagga

SEQ ID NO: 19974 - DNA, 25 bp, Homo sapien
gaaacctcaagacagatttattatt

SEQ ID NO: 19975 - DNA, 25 bp, Homo sapien
gcctagtcccagctgcttgggagac

SEQ ID NO: 19976 - DNA, 25 bp, Homo sapien
gtcacctaagcagcagccattggaa

SEQ ID NO: 19977 - DNA, 25 bp, Homo sapien
tggaaccgggagaagccgcactcca

SEQ ID NO: 19978 - DNA, 25 bp, Homo sapien
tttcctcaggtcttgctaagcctgt

SEQ ID NO: 19979 - DNA, 25 bp, Homo sapien
aagcctgtgacctgtcagctatgct

SEQ ID NO: 19980 - DNA, 25 bp, Homo sapien
gtcagctatgcttagatggccctat

SEQ ID NO: 19981 - DNA, 25 bp, Homo sapien
atggccctattgaatttcttcttcc

SEQ ID NO: 19982 - DNA, 25 bp, Homo sapien
ttcttcttccctgatgaaaagccat

SEQ ID NO: 19983 - DNA, 25 bp, Homo sapien
gaaagtaggcgtgttcgccgcaata

SEQ ID NO: 19984 - DNA, 25 bp, Homo sapien
aagtctactcagttgatcctttatc

SEQ ID NO: 19985 - DNA, 25 bp, Homo sapien
tgagggattcgaaaccagcctggcc

SEQ ID NO: 19986 - DNA, 25 bp, Homo sapien
acctatttatggctcctccaacaag

SEQ ID NO: 19987 - DNA, 25 bp, Homo sapien
ggtgggtccaaagtagtcagacttc

SEQ ID NO: 19988 - DNA, 25 bp, Homo sapien
agacttcttatgtggcagctcaggg

SEQ ID NO: 19989 - DNA, 25 bp, Homo sapien
aggggtcccagagagaatgttccaa

SEQ ID NO: 19990 - DNA, 25 bp, Homo sapien
aaggtttcttttgacataggcccag

SEQ ID NO: 19991 - DNA, 25 bp, Homo sapien
gttccagaacgttacttcagctatc

SEQ ID NO: 19992 - DNA, 25 bp, Homo sapien
acttcagctatcttcttttgatgac

SEQ ID NO: 19993 - DNA, 25 bp, Homo sapien
gacataagtcaataaagccaggcca

SEQ ID NO: 19994 - DNA, 25 bp, Homo sapien
tggggaattagaccctacctctcag

SEQ ID NO: 19995 - DNA, 25 bp, Homo sapien
tgtagccacctttaagctaccacaa

SEQ ID NO: 19996 - DNA, 25 bp, Homo sapien
gtttaggccgggagcgatggctgta

SEQ ID NO: 19997 - DNA, 25 bp, Homo sapien
gccgcaccctgagcatggacaaggg

SEQ ID NO: 19998 - DNA, 25 bp, Homo sapien
ggacaagggcttctgaggccagcca

SEQ ID NO: 19999 - DNA, 25 bp, Homo sapien
gcgccagggctcagatggggcctgg

SEQ ID NO: 20000 - DNA, 25 bp, Homo sapien
tgggctgttgtgtctggagcctgca

SEQ ID NO: 20001 - DNA, 25 bp, Homo sapien
gagcctgcaggcaggtgggggctgc

SEQ ID NO: 20002 - DNA, 25 bp, Homo sapien
cctccggctggtgtcttgagaccag

SEQ ID NO: 20003 - DNA, 25 bp, Homo sapien
ggacagagtgccctggggcatccac

SEQ ID NO: 20004 - DNA, 25 bp, Homo sapien
gctgggctcactacatgggccagcc

SEQ ID NO: 20005 - DNA, 25 bp, Homo sapien
tgctggcgcctaggttgtgttgaga

SEQ ID NO: 20006 - DNA, 25 bp, Homo sapien
cacctgtcaccttttctagaaataa

SEQ ID NO: 20007 - DNA, 25 bp, Homo sapien
accctgactgtggggtgcatcggtc

SEQ ID NO: 20008 - DNA, 25 bp, Homo sapien
ccttctgtcactggtctcagacaca

SEQ ID NO: 20009 - DNA, 25 bp, Homo sapien
gataaagatgaggcttgcggctgtg

SEQ ID NO: 20010 - DNA, 25 bp, Homo sapien
gctggtgggctgagccacaaggccc

SEQ ID NO: 20011 - DNA, 25 bp, Homo sapien
ggagcagatgggaggaccccgaggc

SEQ ID NO: 20012 - DNA, 25 bp, Homo sapien
cacagggagccgggaatcggggcct

SEQ ID NO: 20013 - DNA, 25 bp, Homo sapien
gtcagcactgtactccgttgctgtt

SEQ ID NO: 20014 - DNA, 25 bp, Homo sapien
agtagcccagaccacggcagggcat

SEQ ID NO: 20015 - DNA, 25 bp, Homo sapien
agaccacggcagggcatgacctggg

SEQ ID NO: 20016 - DNA, 25 bp, Homo sapien
cagggcatgacctggggagggcagg

SEQ ID NO: 20017 - DNA, 25 bp, Homo sapien
gagggcaggtggaagccgatggctg

SEQ ID NO: 20018 - DNA, 25 bp, Homo sapien
gaagccgatggctggaggatgggca

SEQ ID NO: 20019 - DNA, 25 bp, Homo sapien
tcacctgcccaagagtacctttgtg

SEQ ID NO: 20020 - DNA, 25 bp, Homo sapien
gtggcactgccatatttctgggagc

SEQ ID NO: 20021 - DNA, 25 bp, Homo sapien
gataaggacggctggtccctgtggt

SEQ ID NO: 20022 - DNA, 25 bp, Homo sapien
gtatcgcttccctgaagaactcact

SEQ ID NO: 20023 - DNA, 25 bp, Homo sapien
gaactcactcagaccttcatgagct

SEQ ID NO: 20024 - DNA, 25 bp, Homo sapien
ttcgccagtgtcatcctttttggaa

SEQ ID NO: 20025 - DNA, 25 bp, Homo sapien
atttctggagtctgggtcttccgag

SEQ ID NO: 20026 - DNA, 25 bp, Homo sapien
gcctttccgctgagtccagattggc

SEQ ID NO: 20027 - DNA, 25 bp, Homo sapien
gacgctggttcgagagtacttttcc

SEQ ID NO: 20028 - DNA, 25 bp, Homo sapien
ggccttccagcatgtgggcaaagcc

SEQ ID NO: 20029 - DNA, 25 bp, Homo sapien
tgcacctgcccttcagggagatggg

SEQ ID NO: 20030 - DNA, 25 bp, Homo sapien
tcactgaagcggcgtaccgcaggcc

SEQ ID NO: 20031 - DNA, 25 bp, Homo sapien
cctcccctcagccgaacaaaagagc

SEQ ID NO: 20032 - DNA, 25 bp, Homo sapien
acaaaagagcctcgcagtctgcgct

SEQ ID NO: 20033 - DNA, 25 bp, Homo sapien
ctcgggggtctgtccaagactacaa

SEQ ID NO: 20034 - DNA, 25 bp, Homo sapien
caagactacaaggcccgaagcgccg

SEQ ID NO: 20035 - DNA, 25 bp, Homo sapien
ccgcgcacgcacagtaggcgagggt

SEQ ID NO: 20036 - DNA, 25 bp, Homo sapien
ggcgagggtggtagggacttatagt

SEQ ID NO: 20037 - DNA, 25 bp, Homo sapien
aaactgtaacggtggagagattgca

SEQ ID NO: 20038 - DNA, 25 bp, Homo sapien
gagagattgcagcgtagagcgttgt

SEQ ID NO: 20039 - DNA, 25 bp, Homo sapien
gcagcgtagagcgttgtaacctaga

SEQ ID NO: 20040 - DNA, 25 bp, Homo sapien
gaacatatgggccaggggcggtcgc

SEQ ID NO: 20041 - DNA, 25 bp, Homo sapien
gaagtacggcggcatatccacagcc

SEQ ID NO: 20042 - DNA, 25 bp, Homo sapien
cagcctctgtagacttcgagcagcc

SEQ ID NO: 20043 - DNA, 25 bp, Homo sapien
gatgctgcaggccatgggctggaaa

SEQ ID NO: 20044 - DNA, 25 bp, Homo sapien
gggcattgtaacgcctatcgaggcc

SEQ ID NO: 20045 - DNA, 25 bp, Homo sapien
gaggcccaaacacgggtgcggggct

SEQ ID NO: 20046 - DNA, 25 bp, Homo sapien
tcacctcaaccgagtcctacaagga

SEQ ID NO: 20047 - DNA, 25 bp, Homo sapien
cttcaacgaggcccagtgagcagct

SEQ ID NO: 20048 - DNA, 25 bp, Homo sapien
gcagcttcaagagcaacttctccac

SEQ ID NO: 20049 - DNA, 25 bp, Homo sapien
acttctccacatgttgggtgtccat

SEQ ID NO: 20050 - DNA, 25 bp, Homo sapien
cactccccagccagagagggcttga

SEQ ID NO: 20051 - DNA, 25 bp, Homo sapien
aaattgggctgggatcacgtcctgt

SEQ ID NO: 20052 - DNA, 25 bp, Homo sapien
cagctacttgggaggttgaaacagg

SEQ ID NO: 20053 - DNA, 25 bp, Homo sapien
ttaagccactaagttgtttaataat

SEQ ID NO: 20054 - DNA, 25 bp, Homo sapien
tgtacaggcaaacttggaagatact

SEQ ID NO: 20055 - DNA, 25 bp, Homo sapien
aagatactgtgggttgggttccaga

SEQ ID NO: 20056 - DNA, 25 bp, Homo sapien
ggttccagaccactacaataaagcc

SEQ ID NO: 20057 - DNA, 25 bp, Homo sapien
aaagtgagtcacagggatttttttg

SEQ ID NO: 20058 - DNA, 25 bp, Homo sapien
gggatttttttgttttgcagtgcat

SEQ ID NO: 20059 - DNA, 25 bp, Homo sapien
aaagttatgttgggccggcatggtg

SEQ ID NO: 20060 - DNA, 25 bp, Homo sapien
gttatgttgggccggcatggtggct

SEQ ID NO: 20061 - DNA, 25 bp, Homo sapien
gagaccaaccttggtaacatggtaa

SEQ ID NO: 20062 - DNA, 25 bp, Homo sapien
aacatggtaagaccccatctcttaa

SEQ ID NO: 20063 - DNA, 25 bp, Homo sapien
ctggagaggatgttcctgtccttcc

SEQ ID NO: 20064 - DNA, 25 bp, Homo sapien
cacggctctgcccaggttaagggcc

SEQ ID NO: 20065 - DNA, 25 bp, Homo sapien
acggcaagaaggtggccgacgcgct

SEQ ID NO: 20066 - DNA, 25 bp, Homo sapien
agagaacccaccatggtgctgtctc

SEQ ID NO: 20067 - DNA, 25 bp, Homo sapien
cgcacaagcttcgggtggacccggt

SEQ ID NO: 20068 - DNA, 25 bp, Homo sapien
tcaacttcaagctcctaagccactg

SEQ ID NO: 20069 - DNA, 25 bp, Homo sapien
gacaagttcctggcttctgtgagca

SEQ ID NO: 20070 - DNA, 25 bp, Homo sapien
ctgacctccaaataccgttaagctg

SEQ ID NO: 20071 - DNA, 25 bp, Homo sapien
tcctgccgacaagaccaacgtcaag

SEQ ID NO: 20072 - DNA, 25 bp, Homo sapien
tcaaggccgcctggggtaaggtcgg

SEQ ID NO: 20073 - DNA, 25 bp, Homo sapien
tggcgagtatggtgcggaggccctg

SEQ ID NO: 20074 - DNA, 25 bp, Homo sapien
tcaccctgaatgtcctctatggtcc

SEQ ID NO: 20075 - DNA, 25 bp, Homo sapien
agaatttacccttcattcacctatt

SEQ ID NO: 20076 - DNA, 25 bp, Homo sapien
acttgtcctgctttgcggactctaa

SEQ ID NO: 20077 - DNA, 25 bp, Homo sapien
ctaacccaccggcagagtatttttg

SEQ ID NO: 20078 - DNA, 25 bp, Homo sapien
caggacaaaagctctttatccccca

SEQ ID NO: 20079 - DNA, 25 bp, Homo sapien
ctctatgcttgctctgttcgtaact

SEQ ID NO: 20080 - DNA, 25 bp, Homo sapien
gttcgtaactcagccactggcaagg

SEQ ID NO: 20081 - DNA, 25 bp, Homo sapien
atgatagtcaaagtctctggtccct

SEQ ID NO: 20082 - DNA, 25 bp, Homo sapien
gacagagtctcattaatggctgcca

SEQ ID NO: 20083 - DNA, 25 bp, Homo sapien
atggctgccacaatagagacactga

SEQ ID NO: 20084 - DNA, 25 bp, Homo sapien
gatatggtggcatccgcagtaaccc

SEQ ID NO: 20085 - DNA, 25 bp, Homo sapien
gccaggcagcctggagttagccgac

SEQ ID NO: 20086 - DNA, 25 bp, Homo sapien
ttagccgaccgttgcgagacgttga

SEQ ID NO: 20087 - DNA, 25 bp, Homo sapien
gatgagtccaaagccgagagcctcg

SEQ ID NO: 20088 - DNA, 25 bp, Homo sapien
gacctccggccaaggccacggaggc

SEQ ID NO: 20089 - DNA, 25 bp, Homo sapien
gaaagaggaagtcctcctctcagcc

SEQ ID NO: 20090 - DNA, 25 bp, Homo sapien
ggggctgcgacaaagatggcggccg

SEQ ID NO: 20091 - DNA, 25 bp, Homo sapien
cagtgagcgaggggacccagcacga

SEQ ID NO: 20092 - DNA, 25 bp, Homo sapien
cccgagtcaggaggccgagctggag

SEQ ID NO: 20093 - DNA, 25 bp, Homo sapien
tgactgtgtggatggccagcttttc

SEQ ID NO: 20094 - DNA, 25 bp, Homo sapien
agagcagcgactaagttcaggccca

SEQ ID NO: 20095 - DNA, 25 bp, Homo sapien
gggcgcttgccattctgaagataat

SEQ ID NO: 20096 - DNA, 25 bp, Homo sapien
ggacatcgtgtataagctggtgcct

SEQ ID NO: 20097 - DNA, 25 bp, Homo sapien
catcgtgtataagctggtgcctggc

SEQ ID NO: 20098 - DNA, 25 bp, Homo sapien
gtataagctggtgcctggcttgcaa

SEQ ID NO: 20099 - DNA, 25 bp, Homo sapien
taagctggtgcctggcttgcaagac

SEQ ID NO: 20100 - DNA, 25 bp, Homo sapien
gctggtgcctggcttgcaagacagt

SEQ ID NO: 20101 - DNA, 25 bp, Homo sapien
ggtgcctggcttgcaagacagtgaa

SEQ ID NO: 20102 - DNA, 25 bp, Homo sapien
gcctggcttgcaagacagtgaagag

SEQ ID NO: 20103 - DNA, 25 bp, Homo sapien
ctggagcggctgagttctggcaaag

SEQ ID NO: 20104 - DNA, 25 bp, Homo sapien
tggagcggctgagttctggcaaaga

SEQ ID NO: 20105 - DNA, 25 bp, Homo sapien
ccatcccctttgcttttacaataca

SEQ ID NO: 20106 - DNA, 25 bp, Homo sapien
cccctttgcttttacaatacagtgt

SEQ ID NO: 20107 - DNA, 25 bp, Homo sapien
atttccaagaattctcccaataata

SEQ ID NO: 20108 - DNA, 25 bp, Homo sapien
gagcctgagtaatcaaccgggcact

SEQ ID NO: 20109 - DNA, 25 bp, Homo sapien
accgggcactccaagggatgatggc

SEQ ID NO: 20110 - DNA, 25 bp, Homo sapien
cagagtgagagttactcccctagca

SEQ ID NO: 20111 - DNA, 25 bp, Homo sapien
actcccctagcatgacaatgagcgt

SEQ ID NO: 20112 - DNA, 25 bp, Homo sapien
gagcgtgtgatccattaccaagtct

SEQ ID NO: 20113 - DNA, 25 bp, Homo sapien
aagtctcctcatgaaaaccacagtg

SEQ ID NO: 20114 - DNA, 25 bp, Homo sapien
gtgagtcagcccttcacagaactac

SEQ ID NO: 20115 - DNA, 25 bp, Homo sapien
gggtcagatggtcccatgggtggat

SEQ ID NO: 20116 - DNA, 25 bp, Homo sapien
ggaggaatggagtcacatcacatga

SEQ ID NO: 20117 - DNA, 25 bp, Homo sapien
atcacatgaatggctctttaggctc

SEQ ID NO: 20118 - DNA, 25 bp, Homo sapien
ccccttgtgccacacattgcattat

SEQ ID NO: 20119 - DNA, 25 bp, Homo sapien
cccttgtgccacacattgcattatt

SEQ ID NO: 20120 - DNA, 25 bp, Homo sapien
cttgtgccacacattgcattattaa

SEQ ID NO: 20121 - DNA, 25 bp, Homo sapien
gtgccacacattgcattattaaatg

SEQ ID NO: 20122 - DNA, 25 bp, Homo sapien
gcatccaagcatgatgagccctctc

SEQ ID NO: 20123 - DNA, 25 bp, Homo sapien
catccaagcatgatgagccctctca

SEQ ID NO: 20124 - DNA, 25 bp, Homo sapien
agccctctcacggtgcaatggagtg

SEQ ID NO: 20125 - DNA, 25 bp, Homo sapien
gccctctcacggtgcaatggagtgc

SEQ ID NO: 20126 - DNA, 25 bp, Homo sapien
ccctctcacggtgcaatggagtgca

SEQ ID NO: 20127 - DNA, 25 bp, Homo sapien
gcaatggagtgcacggtctgaatct

SEQ ID NO: 20128 - DNA, 25 bp, Homo sapien
agccaacaggactcttgagctgaag

SEQ ID NO: 20129 - DNA, 25 bp, Homo sapien
cagctgctagacgggccagaagccc

SEQ ID NO: 20130 - DNA, 25 bp, Homo sapien
tagacgggccagaagcccagggcag

SEQ ID NO: 20131 - DNA, 25 bp, Homo sapien
gtagacacgtaccgacagacaacct

SEQ ID NO: 20132 - DNA, 25 bp, Homo sapien
tcctgcgcagctacgagctggctgg

SEQ ID NO: 20133 - DNA, 25 bp, Homo sapien
gctggcggggacctggcaggtctac

SEQ ID NO: 20134 - DNA, 25 bp, Homo sapien
ggacctggcaggtctactggaggcc

SEQ ID NO: 20135 - DNA, 25 bp, Homo sapien
ccctgtctgacatgggcctagagga

SEQ ID NO: 20136 - DNA, 25 bp, Homo sapien
gctgaggggtccagaaacccgagac

SEQ ID NO: 20137 - DNA, 25 bp, Homo sapien
tccagaaacccgagacaagctgccc

SEQ ID NO: 20138 - DNA, 25 bp, Homo sapien
gaagacagtgcgtacgggagccagt

SEQ ID NO: 20139 - DNA, 25 bp, Homo sapien
ctgagccaccaggagggctctgcca

SEQ ID NO: 20140 - DNA, 25 bp, Homo sapien
ggtgatccacccagttacaggggca

SEQ ID NO: 20141 - DNA, 25 bp, Homo sapien
gcccccaggagcctctcagggggac

SEQ ID NO: 20142 - DNA, 25 bp, Homo sapien
cttcaagctgctgctgtttgacctg

SEQ ID NO: 20143 - DNA, 25 bp, Homo sapien
gactgggggacgagaggccaccagc

SEQ ID NO: 20144 - DNA, 25 bp, Homo sapien
tggggggaagggtcttacctcagca

SEQ ID NO: 20145 - DNA, 25 bp, Homo sapien
gcacaggcctggtgctcaagatctc

SEQ ID NO: 20146 - DNA, 25 bp, Homo sapien
attttttcgaggtgacctgcctcct

SEQ ID NO: 20147 - DNA, 25 bp, Homo sapien
ctcctctgcaggctggagctgcctg

SEQ ID NO: 20148 - DNA, 25 bp, Homo sapien
gagctgcctgagggcagggctctac

SEQ ID NO: 20149 - DNA, 25 bp, Homo sapien
actgtgtgaggctgtgtctctgcca

SEQ ID NO: 20150 - DNA, 25 bp, Homo sapien
gtctctgccatccaaaagggggccc

SEQ ID NO: 20151 - DNA, 25 bp, Homo sapien
ctctaccagcatcaccaacgagttt

SEQ ID NO: 20152 - DNA, 25 bp, Homo sapien
gccaatttcatccagccagggaagc

SEQ ID NO: 20153 - DNA, 25 bp, Homo sapien
gacgatcatggtgggccaggacggc

SEQ ID NO: 20154 - DNA, 25 bp, Homo sapien
gccaggtccggatggtggtgggagc

SEQ ID NO: 20155 - DNA, 25 bp, Homo sapien
tcatctacaacctctggttcggcta

SEQ ID NO: 20156 - DNA, 25 bp, Homo sapien
tctgcccaacgtcacgacagtggag

SEQ ID NO: 20157 - DNA, 25 bp, Homo sapien
cacgtccaccttcattgctgtggtg

SEQ ID NO: 20158 - DNA, 25 bp, Homo sapien
acctgctggctactgattgctccag

SEQ ID NO: 20159 - DNA, 25 bp, Homo sapien
attgctccaggcggacaaggctgac

SEQ ID NO: 20160 - DNA, 25 bp, Homo sapien
gaggactttgggggacaggcttctc

SEQ ID NO: 20161 - DNA, 25 bp, Homo sapien
gcttctcctgtgagcagcagagcag

SEQ ID NO: 20162 - DNA, 25 bp, Homo sapien
gcagccccgtgatcaacaactgctg

SEQ ID NO: 20163 - DNA, 25 bp, Homo sapien
cccgtgatcaacaactgctgcaaga

SEQ ID NO: 20164 - DNA, 25 bp, Homo sapien
acaactgctgcaagaggggccgttt

SEQ ID NO: 20165 - DNA, 25 bp, Homo sapien
gctgcaagaggggccgtttgttcga

SEQ ID NO: 20166 - DNA, 25 bp, Homo sapien
tgcaagaggggccgtttgttcgact

SEQ ID NO: 20167 - DNA, 25 bp, Homo sapien
ttctgcggctctatgcggtactaaa

SEQ ID NO: 20168 - DNA, 25 bp, Homo sapien
ctgcggctctatgcggtactaaaga

SEQ ID NO: 20169 - DNA, 25 bp, Homo sapien
ggaggcggaagtttcagcgagccga

SEQ ID NO: 20170 - DNA, 25 bp, Homo sapien
gcggaagtttcagcgagccgagatc

SEQ ID NO: 20171 - DNA, 25 bp, Homo sapien
acagaatgaaagagcccggcgcggt

SEQ ID NO: 20172 - DNA, 25 bp, Homo sapien
agaatgaaagagcccggcgcggtgg

SEQ ID NO: 20173 - DNA, 25 bp, Homo sapien
gctttctgcaaggcctgctggaaac

SEQ ID NO: 20174 - DNA, 25 bp, Homo sapien
ggaggaatccaggtaccagacacgc

SEQ ID NO: 20175 - DNA, 25 bp, Homo sapien
gacacgcggcatagcggcttggttc

SEQ ID NO: 20176 - DNA, 25 bp, Homo sapien
caacctctcggccaagaccgagctg

SEQ ID NO: 20177 - DNA, 25 bp, Homo sapien
caggcccatctcaaggtggacgtgt

SEQ ID NO: 20178 - DNA, 25 bp, Homo sapien
ccctgccccagggaaccatgatgga

SEQ ID NO: 20179 - DNA, 25 bp, Homo sapien
tgtcccggtacaagttctatctggc

SEQ ID NO: 20180 - DNA, 25 bp, Homo sapien
gaagcaactacgagaggttcctgcc

SEQ ID NO: 20181 - DNA, 25 bp, Homo sapien
catccacgtggacgacttccagagc

SEQ ID NO: 20182 - DNA, 25 bp, Homo sapien
gcaggagctggacaaggaccacgcc

SEQ ID NO: 20183 - DNA, 25 bp, Homo sapien
tgagctactttcgctggcgggagac

SEQ ID NO: 20184 - DNA, 25 bp, Homo sapien
taagcatctcttatacaaagttatt

SEQ ID NO: 20185 - DNA, 25 bp, Homo sapien
gttattgggacattcttacgtactg

SEQ ID NO: 20186 - DNA, 25 bp, Homo sapien
gacattcttacgtactgattatagc

SEQ ID NO: 20187 - DNA, 25 bp, Homo sapien
aggtgtactgagtcttgcttttttc

SEQ ID NO: 20188 - DNA, 25 bp, Homo sapien
agactttctattactgttttggtga

SEQ ID NO: 20189 - DNA, 25 bp, Homo sapien
gttttggtgagttactttatcttct

SEQ ID NO: 20190 - DNA, 25 bp, Homo sapien
ttctataagcgattctacagtaacc

SEQ ID NO: 20191 - DNA, 25 bp, Homo sapien
atataccaggacaggcaagccattt

SEQ ID NO: 20192 - DNA, 25 bp, Homo sapien
ttttaaaccttgcataattcctctt

SEQ ID NO: 20193 - DNA, 25 bp, Homo sapien
cataattcctcttcactgaatgaat

SEQ ID NO: 20194 - DNA, 25 bp, Homo sapien
gaataaggcgtgtctttccatttaa

SEQ ID NO: 20195 - DNA, 25 bp, Homo sapien
tcactgcctccttcactaggaaggt

SEQ ID NO: 20196 - DNA, 25 bp, Homo sapien
taggaaggtcattcccttctttggg

SEQ ID NO: 20197 - DNA, 25 bp, Homo sapien
aaggagcagttacctactctcctct

SEQ ID NO: 20198 - DNA, 25 bp, Homo sapien
agtacaggactcattcaacccagta

SEQ ID NO: 20199 - DNA, 25 bp, Homo sapien
actcattcaacccagtaccatgtgg

SEQ ID NO: 20200 - DNA, 25 bp, Homo sapien
cagtaccatgtggcttgatccctgg

SEQ ID NO: 20201 - DNA, 25 bp, Homo sapien
gaatcacctggatgactcgggatag

SEQ ID NO: 20202 - DNA, 25 bp, Homo sapien
gactcgggatagaaatgactgcttt

SEQ ID NO: 20203 - DNA, 25 bp, Homo sapien
gaagatgggatggggtcgggtggta

SEQ ID NO: 20204 - DNA, 25 bp, Homo sapien
gagaggactctcaatctactgatca

SEQ ID NO: 20205 - DNA, 25 bp, Homo sapien
caatctactgatcaagtcctttccc

SEQ ID NO: 20206 - DNA, 25 bp, Homo sapien
aaaaaaggaaatcgctgcagaatga

SEQ ID NO: 20207 - DNA, 25 bp, Homo sapien
ctgaaagcattttggggtgtcaagt

SEQ ID NO: 20208 - DNA, 25 bp, Homo sapien
ttggggtgtcaagtaagggtgggca

SEQ ID NO: 20209 - DNA, 25 bp, Homo sapien
ttgatgctcagtgcattggccttag

SEQ ID NO: 20210 - DNA, 25 bp, Homo sapien
tgctcagtgcattggccttagaata

SEQ ID NO: 20211 - DNA, 25 bp, Homo sapien
cagtgcattggccttagaatatccc

SEQ ID NO: 20212 - DNA, 25 bp, Homo sapien
cattggccttagaatatcccagcct

SEQ ID NO: 20213 - DNA, 25 bp, Homo sapien
agcatggtagaattgtttggagaca

SEQ ID NO: 20214 - DNA, 25 bp, Homo sapien
gagacatatatagtgatccttggtc

SEQ ID NO: 20215 - DNA, 25 bp, Homo sapien
aacattctggaaagtcacatcgatc

SEQ ID NO: 20216 - DNA, 25 bp, Homo sapien
gtcacatcgatcaagaatatttttt

SEQ ID NO: 20217 - DNA, 25 bp, Homo sapien
ccagcctgggttcatgtagttcaaa

SEQ ID NO: 20218 - DNA, 25 bp, Homo sapien
agaccacgatgatcagaaaggctgc

SEQ ID NO: 20219 - DNA, 25 bp, Homo sapien
aaaggctgctcaaatactccttcgt

SEQ ID NO: 20220 - DNA, 25 bp, Homo sapien
ctgggggaggctgaatctccactca

SEQ ID NO: 20221 - DNA, 25 bp, Homo sapien
gcagagcagataggggaatccagca

SEQ ID NO: 20222 - DNA, 25 bp, Homo sapien
gcaaaggtggaaaacagtgccatcc

SEQ ID NO: 20223 - DNA, 25 bp, Homo sapien
aactttttgtgacagtgttacttat

SEQ ID NO: 20224 - DNA, 25 bp, Homo sapien
acatgcagtgggtttgttatggtta

SEQ ID NO: 20225 - DNA, 25 bp, Homo sapien
gaagccagctgagcttctgggttgg

SEQ ID NO: 20226 - DNA, 25 bp, Homo sapien
atgcaccaatcaatgctcagtgtct

SEQ ID NO: 20227 - DNA, 25 bp, Homo sapien
aaaattgaccaatcagcgttctgta

SEQ ID NO: 20228 - DNA, 25 bp, Homo sapien
gcacgccatcaatgccatcgtgcgc

SEQ ID NO: 20229 - DNA, 25 bp, Homo sapien
tcacgggcaacgacagtctgcacga

SEQ ID NO: 20230 - DNA, 25 bp, Homo sapien
gggcaacgacagtctgcacgagtcg

SEQ ID NO: 20231 - DNA, 25 bp, Homo sapien
gcaacgacagtctgcacgagtcggc

SEQ ID NO: 20232 - DNA, 25 bp, Homo sapien
aacgacagtctgcacgagtcggcgc

SEQ ID NO: 20233 - DNA, 25 bp, Homo sapien
gggcagcgacgtggacatggacgtg

SEQ ID NO: 20234 - DNA, 25 bp, Homo sapien
gcgacgtggacatggacgtgctcac

SEQ ID NO: 20235 - DNA, 25 bp, Homo sapien
acgtggacatggacgtgctcaccac

SEQ ID NO: 20236 - DNA, 25 bp, Homo sapien
cacgagaaggactatgacagcctgg

SEQ ID NO: 20237 - DNA, 25 bp, Homo sapien
accccgtccatggtgctaagcgggc

SEQ ID NO: 20238 - DNA, 25 bp, Homo sapien
cccgtccatggtgctaagcgggccc

SEQ ID NO: 20239 - DNA, 25 bp, Homo sapien
agtgagctgagattgcaccacggca

SEQ ID NO: 20240 - DNA, 25 bp, Homo sapien
tggggagcaaaggcagtccgagccc

SEQ ID NO: 20241 - DNA, 25 bp, Homo sapien
gcagtccgagccctgaagaacagta

SEQ ID NO: 20242 - DNA, 25 bp, Homo sapien
atgtaaccatctgaaagcaactttt

SEQ ID NO: 20243 - DNA, 25 bp, Homo sapien
caacttttttggtgtctcagatgag

SEQ ID NO: 20244 - DNA, 25 bp, Homo sapien
gatgagtaactgcagcttggtttga

SEQ ID NO: 20245 - DNA, 25 bp, Homo sapien
aaagttatggcttcttgttggatga

SEQ ID NO: 20246 - DNA, 25 bp, Homo sapien
gtggaagatggctctgatttcaggg

SEQ ID NO: 20247 - DNA, 25 bp, Homo sapien
aaaatttgctgaatgcttgctacga

SEQ ID NO: 20248 - DNA, 25 bp, Homo sapien
gaatgcttgctacgagcggtggctc

SEQ ID NO: 20249 - DNA, 25 bp, Homo sapien
ctcatgcctgaatctcagcactttg

SEQ ID NO: 20250 - DNA, 25 bp, Homo sapien
gaggagcaggcaaggctacgtgggc

SEQ ID NO: 20251 - DNA, 25 bp, Homo sapien
gcaaggctacgtgggcagctgaagg

SEQ ID NO: 20252 - DNA, 25 bp, Homo sapien
gccccagggaccgggggtgattctg

SEQ ID NO: 20253 - DNA, 25 bp, Homo sapien
agggaccgggggtgattctgtgtgt

SEQ ID NO: 20254 - DNA, 25 bp, Homo sapien
tcatgcagctgcttcgtgagatgca

SEQ ID NO: 20255 - DNA, 25 bp, Homo sapien
tttttttaccgggctgacgagaatg

SEQ ID NO: 20256 - DNA, 25 bp, Homo sapien
ccgggctgacgagaatgatgaggtg

SEQ ID NO: 20257 - DNA, 25 bp, Homo sapien
gaagtggggctggataccctgcccc

SEQ ID NO: 20258 - DNA, 25 bp, Homo sapien
ttacccttacagtagcaagcataga

SEQ ID NO: 20259 - DNA, 25 bp, Homo sapien
gcatagacccctgtctaacgggggt

SEQ ID NO: 20260 - DNA, 25 bp, Homo sapien
aacgggggtagacaggtgcagatga

SEQ ID NO: 20261 - DNA, 25 bp, Homo sapien
tccctctaagaactgctttgcctgg

SEQ ID NO: 20262 - DNA, 25 bp, Homo sapien
gaggtgggtggatgccgaggtgagt

SEQ ID NO: 20263 - DNA, 25 bp, Homo sapien
aatcgcttgaatccgggaggcagag

SEQ ID NO: 20264 - DNA, 25 bp, Homo sapien
ccttcgggcagtggctccggaaagg

SEQ ID NO: 20265 - DNA, 25 bp, Homo sapien
tccggaaaggccatcaaggcttccc

SEQ ID NO: 20266 - DNA, 25 bp, Homo sapien
ccttcgggcagtggactgtgtccat

SEQ ID NO: 20267 - DNA, 25 bp, Homo sapien
ggactgtgtccatagctgaaaacca

SEQ ID NO: 20268 - DNA, 25 bp, Homo sapien
ctgaaaaccagacttgacagttctg

SEQ ID NO: 20269 - DNA, 25 bp, Homo sapien
gacagttctggattcaggctgttgt

SEQ ID NO: 20270 - DNA, 25 bp, Homo sapien
ggctgttgtgggagcgggaaggtca

SEQ ID NO: 20271 - DNA, 25 bp, Homo sapien
gatgaatgtgaatttccctctaaga

SEQ ID NO: 20272 - DNA, 25 bp, Homo sapien
gacattcatctgtttccactgagtc

SEQ ID NO: 20273 - DNA, 25 bp, Homo sapien
tcaagttttcactccagctaacaca

SEQ ID NO: 20274 - DNA, 25 bp, Homo sapien
agcacatcatggttggccttatcct

SEQ ID NO: 20275 - DNA, 25 bp, Homo sapien
ttatcctgcctggtattgtcatcct

SEQ ID NO: 20276 - DNA, 25 bp, Homo sapien
tcatcctgtcctgctattgcattat

SEQ ID NO: 20277 - DNA, 25 bp, Homo sapien
tgcattatcatctccaagctgtcac

SEQ ID NO: 20278 - DNA, 25 bp, Homo sapien
gttggctgccttactacattgggat

SEQ ID NO: 20279 - DNA, 25 bp, Homo sapien
acattgggatcagcatcgactcctt

SEQ ID NO: 20280 - DNA, 25 bp, Homo sapien
cctctatgctttccttggagccaaa

SEQ ID NO: 20281 - DNA, 25 bp, Homo sapien
gccaaatttaaaacctctgcccagc

SEQ ID NO: 20282 - DNA, 25 bp, Homo sapien
cacgcactcacctctgtgagcagag

SEQ ID NO: 20283 - DNA, 25 bp, Homo sapien
ttccaattagctgtttcggttgtgc

SEQ ID NO: 20284 - DNA, 25 bp, Homo sapien
attagctgtttcggttgtgcattga

SEQ ID NO: 20285 - DNA, 25 bp, Homo sapien
gctgtttcggttgtgcattgatgtg

SEQ ID NO: 20286 - DNA, 25 bp, Homo sapien
gaatgttgatattaagaaccaatgt

SEQ ID NO: 20287 - DNA, 25 bp, Homo sapien
gaaccaatgtttcaggtacacaagt

SEQ ID NO: 20288 - DNA, 25 bp, Homo sapien
taagctgatcaattcaattaaagtt

SEQ ID NO: 20289 - DNA, 25 bp, Homo sapien
taaagttattcagtcttggctggac

SEQ ID NO: 20290 - DNA, 25 bp, Homo sapien
ctggacacagtgcctcatgtctgaa

SEQ ID NO: 20291 - DNA, 25 bp, Homo sapien
acagtgcctcatgtctgaaatccca

SEQ ID NO: 20292 - DNA, 25 bp, Homo sapien
actccagcctaggtggcagaactag

SEQ ID NO: 20293 - DNA, 25 bp, Homo sapien
gcctaggtggcagaactagaccctg

SEQ ID NO: 20294 - DNA, 25 bp, Homo sapien
taatcctacaactactggtagtgtt

SEQ ID NO: 20295 - DNA, 25 bp, Homo sapien
ctggtagtgttgttgtgcatttgca

SEQ ID NO: 20296 - DNA, 25 bp, Homo sapien
ttttcttattacatcccaagtttat

SEQ ID NO: 20297 - DNA, 25 bp, Homo sapien
aagtttatgatgcattaagcgtttg

SEQ ID NO: 20298 - DNA, 25 bp, Homo sapien
tatatttttgctttggtttaccata

SEQ ID NO: 20299 - DNA, 25 bp, Homo sapien
tttaccatacattttagtggctaca

SEQ ID NO: 20300 - DNA, 25 bp, Homo sapien
gtggctacagaatgtagtctgctta

SEQ ID NO: 20301 - DNA, 25 bp, Homo sapien
gaattcctagaatgtttaaatacca

SEQ ID NO: 20302 - DNA, 25 bp, Homo sapien
aaaaatccaggttgcgtggctggtt

SEQ ID NO: 20303 - DNA, 25 bp, Homo sapien
gttgcgtggctggttagtaaaggac

SEQ ID NO: 20304 - DNA, 25 bp, Homo sapien
atccacttctacttattaaatagta

SEQ ID NO: 20305 - DNA, 25 bp, Homo sapien
cgtcacctaagcagcagccattgga

SEQ ID NO: 20306 - DNA, 25 bp, Homo sapien
tggaaccgggagaagccgcactcca

SEQ ID NO: 20307 - DNA, 25 bp, Homo sapien
acgggcaccagatggccctattgaa

SEQ ID NO: 20308 - DNA, 25 bp, Homo sapien
atggccctattgaatttcttcttcc

SEQ ID NO: 20309 - DNA, 25 bp, Homo sapien
ttcttcttccctgatgaaaagccat

SEQ ID NO: 20310 - DNA, 25 bp, Homo sapien
gaaagtaggcgtgttcgccgcaata

SEQ ID NO: 20311 - DNA, 25 bp, Homo sapien
ggtaagtctactcagttgatccttt

SEQ ID NO: 20312 - DNA, 25 bp, Homo sapien
gttgatcctttatcacttctgaatt

SEQ ID NO: 20313 - DNA, 25 bp, Homo sapien
accttcttggtagggcatggtggct

SEQ ID NO: 20314 - DNA, 25 bp, Homo sapien
tgagggattcgaaaccagcctggcc

SEQ ID NO: 20315 - DNA, 25 bp, Homo sapien
gcctagtcccagctgcttgggagac

SEQ ID NO: 20316 - DNA, 25 bp, Homo sapien
ctggatacagaggacatggtgcggc

SEQ ID NO: 20317 - DNA, 25 bp, Homo sapien
aggacatggtgcggcttcgagagcc

SEQ ID NO: 20318 - DNA, 25 bp, Homo sapien
atggtgcggcttcgagagcctgact

SEQ ID NO: 20319 - DNA, 25 bp, Homo sapien
tgcggcttcgagagcctgactggaa

SEQ ID NO: 20320 - DNA, 25 bp, Homo sapien
gcctgactggaagtgcgtgtacacg

SEQ ID NO: 20321 - DNA, 25 bp, Homo sapien
ggaagtgcgtgtacacgtacatcca

SEQ ID NO: 20322 - DNA, 25 bp, Homo sapien
acatccaggaattctaccgctgtct

SEQ ID NO: 20323 - DNA, 25 bp, Homo sapien
ccaggaattctaccgctgtctggtc

SEQ ID NO: 20324 - DNA, 25 bp, Homo sapien
tctaccgctgtctggtccaaaaggg

SEQ ID NO: 20325 - DNA, 25 bp, Homo sapien
taccgctgtctggtccaaaaggggt

SEQ ID NO: 20326 - DNA, 25 bp, Homo sapien
gctgtctggtccaaaaggggttggt

SEQ ID NO: 20327 - DNA, 25 bp, Homo sapien
taagccaagatcattgtctcctgcc

SEQ ID NO: 20328 - DNA, 25 bp, Homo sapien
cagccctgtctcaaaaccgggttgc

SEQ ID NO: 20329 - DNA, 25 bp, Homo sapien
aggcatcagtcttcatcttagggga

SEQ ID NO: 20330 - DNA, 25 bp, Homo sapien
accacaaatctgaacatgcctctct

SEQ ID NO: 20331 - DNA, 25 bp, Homo sapien
tgcctctctcttgcttacaaatgtc

SEQ ID NO: 20332 - DNA, 25 bp, Homo sapien
tacaaatgtctaaggtccccactgc

SEQ ID NO: 20333 - DNA, 25 bp, Homo sapien
tccccactgcctgctggagagaaga

SEQ ID NO: 20334 - DNA, 25 bp, Homo sapien
agagaagacacactcctttgcttag

SEQ ID NO: 20335 - DNA, 25 bp, Homo sapien
acaattctctatttcacttgacccc

SEQ ID NO: 20336 - DNA, 25 bp, Homo sapien
tgaactggcttacttcctagtctac

SEQ ID NO: 20337 - DNA, 25 bp, Homo sapien
ggatcactgcgttttcacacagaca

SEQ ID NO: 20338 - DNA, 25 bp, Homo sapien
agtcaaatgccaaacactagctctg

SEQ ID NO: 20339 - DNA, 25 bp, Homo sapien
gggagaagacattggtttgttgaca

SEQ ID NO: 20340 - DNA, 25 bp, Homo sapien
gacaataacagtacatcttttcaag

SEQ ID NO: 20341 - DNA, 25 bp, Homo sapien
cttttcaagttctcagctatttctt

SEQ ID NO: 20342 - DNA, 25 bp, Homo sapien
tacctctccctatcttacatttgag

SEQ ID NO: 20343 - DNA, 25 bp, Homo sapien
ggtaacttatgtcatctatgttgaa

SEQ ID NO: 20344 - DNA, 25 bp, Homo sapien
taaagcacaaagcatacatttcctg

SEQ ID NO: 20345 - DNA, 25 bp, Homo sapien
gcatacatttcctgactggtctaga

SEQ ID NO: 20346 - DNA, 25 bp, Homo sapien
tcctgactggtctagagaactgatg

SEQ ID NO: 20347 - DNA, 25 bp, Homo sapien
gaactgatgtttcaatttacccctc

SEQ ID NO: 20348 - DNA, 25 bp, Homo sapien
tcaatttacccctctgctaaataaa

SEQ ID NO: 20349 - DNA, 25 bp, Homo sapien
ggcaggtacgtgtagtccctgctac

SEQ ID NO: 20350 - DNA, 25 bp, Homo sapien
tttataaaaggactgtctcactcac

SEQ ID NO: 20351 - DNA, 25 bp, Homo sapien
ttccctcctgggaaaatgaagtcca

SEQ ID NO: 20352 - DNA, 25 bp, Homo sapien
ccttcattcctggtagattaaccct

SEQ ID NO: 20353 - DNA, 25 bp, Homo sapien
gattaacccttggcattaagcagat

SEQ ID NO: 20354 - DNA, 25 bp, Homo sapien
tattctaccagattcatgaaggcta

SEQ ID NO: 20355 - DNA, 25 bp, Homo sapien
ttgtccttgttacttaggggtcagg

SEQ ID NO: 20356 - DNA, 25 bp, Homo sapien
aggggtcagggataaggatggtaga

SEQ ID NO: 20357 - DNA, 25 bp, Homo sapien
ggatggtagagttgattgaggccct

SEQ ID NO: 20358 - DNA, 25 bp, Homo sapien
gaggccctagatcaggaccattgtc

SEQ ID NO: 20359 - DNA, 25 bp, Homo sapien
gaaaatgaatggcatggccgggcgc

SEQ ID NO: 20360 - DNA, 25 bp, Homo sapien
ttggataaagtacacatcattttgg

SEQ ID NO: 20361 - DNA, 25 bp, Homo sapien
ggatgagatggtgttaaatggctgc

SEQ ID NO: 20362 - DNA, 25 bp, Homo sapien
ggtgttaaatggctgcattgtggaa

SEQ ID NO: 20363 - DNA, 25 bp, Homo sapien
gctgcattgtggaaactaacagggc

SEQ ID NO: 20364 - DNA, 25 bp, Homo sapien
ggcaagaattcttgcccctctacta

SEQ ID NO: 20365 - DNA, 25 bp, Homo sapien
ttgcccctctactaattcttgataa

SEQ ID NO: 20366 - DNA, 25 bp, Homo sapien
ttcgagacaatatggatttatcaga

SEQ ID NO: 20367 - DNA, 25 bp, Homo sapien
atttatcagaaatgcgagtaccgtg

SEQ ID NO: 20368 - DNA, 25 bp, Homo sapien
atgcgagtaccgtggaatacatctc

SEQ ID NO: 20369 - DNA, 25 bp, Homo sapien
agtaccgtggaatacatctcaacat

SEQ ID NO: 20370 - DNA, 25 bp, Homo sapien
catctcaacatgttaacccagaaga

SEQ ID NO: 20371 - DNA, 25 bp, Homo sapien
ccccatcgtgggcattgttgctggc

SEQ ID NO: 20372 - DNA, 25 bp, Homo sapien
ggctgtcctagcagttgtggtcatc

SEQ ID NO: 20373 - DNA, 25 bp, Homo sapien
ctgtggtcgctgctgtgatgtgtag

SEQ ID NO: 20374 - DNA, 25 bp, Homo sapien
gcgacagtgcccagggctctgatgt

SEQ ID NO: 20375 - DNA, 25 bp, Homo sapien
gagacagctgtcttgtgagggactg

SEQ ID NO: 20376 - DNA, 25 bp, Homo sapien
gagatgcaggatttcttcacgcctc

SEQ ID NO: 20377 - DNA, 25 bp, Homo sapien
gtgacttcaagagcctctggcatct

SEQ ID NO: 20378 - DNA, 25 bp, Homo sapien
gcatctctttctgcaaaggcacctg

SEQ ID NO: 20379 - DNA, 25 bp, Homo sapien
aaggcacctgaatgtgtctgcgtcc

SEQ ID NO: 20380 - DNA, 25 bp, Homo sapien
gtctgcgtccctgttagcataatgt

SEQ ID NO: 20381 - DNA, 25 bp, Homo sapien
gacctggcagcgggatggcgaggac

SEQ ID NO: 20382 - DNA, 25 bp, Homo sapien
taggctgggcatggtgactcacgcc

SEQ ID NO: 20383 - DNA, 25 bp, Homo sapien
ggtgggagaatcgcgtgagcccagg

SEQ ID NO: 20384 - DNA, 25 bp, Homo sapien
agcccaggagttccagaccaggctg

SEQ ID NO: 20385 - DNA, 25 bp, Homo sapien
tccagaccaggctgggtcacatgac

SEQ ID NO: 20386 - DNA, 25 bp, Homo sapien
aaggggtcgctgtggagatcatgga

SEQ ID NO: 20387 - DNA, 25 bp, Homo sapien
taatgagccattcaagccttgggaa

SEQ ID NO: 20388 - DNA, 25 bp, Homo sapien
ccaactttcgacttctgaaaagaag

SEQ ID NO: 20389 - DNA, 25 bp, Homo sapien
aagaaggctacgggagagtctccag

SEQ ID NO: 20390 - DNA, 25 bp, Homo sapien
gggagagtctccagtgaggggtctc

SEQ ID NO: 20391 - DNA, 25 bp, Homo sapien
ctccccagcataaccaaatcttact

SEQ ID NO: 20392 - DNA, 25 bp, Homo sapien
ttactaaactcatgctaggctgggc

SEQ ID NO: 20393 - DNA, 25 bp, Homo sapien
gaaaacagaatcatccatcgggatc

SEQ ID NO: 20394 - DNA, 25 bp, Homo sapien
atcatccatcgggatctaaagccag

SEQ ID NO: 20395 - DNA, 25 bp, Homo sapien
aagccagaaaacatcgtcctgcagc

SEQ ID NO: 20396 - DNA, 25 bp, Homo sapien
gacctaggatatgccaaggagctgg

SEQ ID NO: 20397 - DNA, 25 bp, Homo sapien
ggagctggatcagggcagtctttgc

SEQ ID NO: 20398 - DNA, 25 bp, Homo sapien
gcagtctttgcacatcattcgtggg

SEQ ID NO: 20399 - DNA, 25 bp, Homo sapien
catcattcgtggggaccctgcagta

SEQ ID NO: 20400 - DNA, 25 bp, Homo sapien
gccccagagctactggagcagcaga

SEQ ID NO: 20401 - DNA, 25 bp, Homo sapien
gcagaagtacacagtgaccgtcgac

SEQ ID NO: 20402 - DNA, 25 bp, Homo sapien
cagtgaccgtcgactactggagctt

SEQ ID NO: 20403 - DNA, 25 bp, Homo sapien
ggcctttgagtgcatcacgggcttc

SEQ ID NO: 20404 - DNA, 25 bp, Homo sapien
tcgcgtgggcaaggtggggcctatg

SEQ ID NO: 20405 - DNA, 25 bp, Homo sapien
ggggcctatgattgggcagtacgtg

SEQ ID NO: 20406 - DNA, 25 bp, Homo sapien
aatacttccaagaacgtcaactctg

SEQ ID NO: 20407 - DNA, 25 bp, Homo sapien
agaacgtcaactctgtcattgccat

SEQ ID NO: 20408 - DNA, 25 bp, Homo sapien
tctgtcattgccatctgcgtagatg

SEQ ID NO: 20409 - DNA, 25 bp, Homo sapien
tctgcgtagatgggaccttccacaa

SEQ ID NO: 20410 - DNA, 25 bp, Homo sapien
ccacaaatatgtcttcactcctgat

SEQ ID NO: 20411 - DNA, 25 bp, Homo sapien
tcactcctgatggaaactgcaacag

SEQ ID NO: 20412 - DNA, 25 bp, Homo sapien
actgcaacagagaggctttcgacgt

SEQ ID NO: 20413 - DNA, 25 bp, Homo sapien
tcgacgtgtaccttgacatctgtga

SEQ ID NO: 20414 - DNA, 25 bp, Homo sapien
agtggcagaactgcagagctgagcc

SEQ ID NO: 20415 - DNA, 25 bp, Homo sapien
cttgggccacaaaatatcagtttaa

SEQ ID NO: 20416 - DNA, 25 bp, Homo sapien
atcagtttaatcagatggtttatgt

SEQ ID NO: 20417 - DNA, 25 bp, Homo sapien
ggcaaacatagatctctaatctcca

SEQ ID NO: 20418 - DNA, 25 bp, Homo sapien
atagatctctaatctccatttctct

SEQ ID NO: 20419 - DNA, 25 bp, Homo sapien
gagacatagatattattcttcattt

SEQ ID NO: 20420 - DNA, 25 bp, Homo sapien
agaatgttatcttggtatgtttaaa

SEQ ID NO: 20421 - DNA, 25 bp, Homo sapien
acttaagatgtgttgcaattgcagt

SEQ ID NO: 20422 - DNA, 25 bp, Homo sapien
tgcaattgcagtatgagtttcaggt

SEQ ID NO: 20423 - DNA, 25 bp, Homo sapien
gagagacacacacaaacacatttca

SEQ ID NO: 20424 - DNA, 25 bp, Homo sapien
gtaagtacagcagcagcattattaa

SEQ ID NO: 20425 - DNA, 25 bp, Homo sapien
aatactgtatttctatggtgattga

SEQ ID NO: 20426 - DNA, 25 bp, Homo sapien
gaagcctttgtcaagcacatcatgt

SEQ ID NO: 20427 - DNA, 25 bp, Homo sapien
tgaagcagagtcttccaggtgcctg

SEQ ID NO: 20428 - DNA, 25 bp, Homo sapien
ctggcccttggctttagccatacca

SEQ ID NO: 20429 - DNA, 25 bp, Homo sapien
taaagagaggccccggctgggtgag

SEQ ID NO: 20430 - DNA, 25 bp, Homo sapien
gagatggagtcctcgacttatcacc

SEQ ID NO: 20431 - DNA, 25 bp, Homo sapien
taaacagctctaacacggccaggct

SEQ ID NO: 20432 - DNA, 25 bp, Homo sapien
ctaccaatgccgaggtgctgcgtgt

SEQ ID NO: 20433 - DNA, 25 bp, Homo sapien
tggactttgagacgttcttgcccat

SEQ ID NO: 20434 - DNA, 25 bp, Homo sapien
gcagggcacctatgaggacttcgtg

SEQ ID NO: 20435 - DNA, 25 bp, Homo sapien
ggtcatgggtgctgagcttcggcac

SEQ ID NO: 20436 - DNA, 25 bp, Homo sapien
gtccttgccaccctgggagagaaga

SEQ ID NO: 20437 - DNA, 25 bp, Homo sapien
gccctccaagcgcagacatgagtga

SEQ ID NO: 20438 - DNA, 25 bp, Homo sapien
cgcagacatgagtgatggcgcccgg

SEQ ID NO: 20439 - DNA, 25 bp, Homo sapien
caccatttctcaaggtccataaaga

SEQ ID NO: 20440 - DNA, 25 bp, Homo sapien
aaggtccataaagactgagcggatg

SEQ ID NO: 20441 - DNA, 25 bp, Homo sapien
aagactgagcggatgtttcctcgcc

SEQ ID NO: 20442 - DNA, 25 bp, Homo sapien
tgtttcctcgcctctcgaaaaggaa

SEQ ID NO: 20443 - DNA, 25 bp, Homo sapien
ctctcgaaaaggaaaaccaccatct

SEQ ID NO: 20444 - DNA, 25 bp, Homo sapien
ccatctttcttttaaggctgttcct

SEQ ID NO: 20445 - DNA, 25 bp, Homo sapien
tctttcttttaaggctgttcctggg

SEQ ID NO: 20446 - DNA, 25 bp, Homo sapien
tgagaggatggaattgtgtgcacaa

SEQ ID NO: 20447 - DNA, 25 bp, Homo sapien
gatggaattgtgtgcacaagaactg

SEQ ID NO: 20448 - DNA, 25 bp, Homo sapien
ccagtcttcctggcaagggtaaaca

SEQ ID NO: 20449 - DNA, 25 bp, Homo sapien
caagggtaaacagatcccctctcct

SEQ ID NO: 20450 - DNA, 25 bp, Homo sapien
tcatgtgacctcttcagtgaccact

SEQ ID NO: 20451 - DNA, 25 bp, Homo sapien
tacggtgtcgggccttgaactacta

SEQ ID NO: 20452 - DNA, 25 bp, Homo sapien
gggctggataaccttggctgtaccc

SEQ ID NO: 20453 - DNA, 25 bp, Homo sapien
attgtgatctggggtatgtgactga

SEQ ID NO: 20454 - DNA, 25 bp, Homo sapien
gtgactgatgagagccaggagctga

SEQ ID NO: 20455 - DNA, 25 bp, Homo sapien
aggagtgcctgaggagagccctcac

SEQ ID NO: 20456 - DNA, 25 bp, Homo sapien
ggcaccctagtcattggagtcatca

SEQ ID NO: 20457 - DNA, 25 bp, Homo sapien
gaattgctgtttttgtcgtcatctt

SEQ ID NO: 20458 - DNA, 25 bp, Homo sapien
agaggagccatggggcactacgtct

SEQ ID NO: 20459 - DNA, 25 bp, Homo sapien
ctgttgcagagaggggtcctggaga

SEQ ID NO: 20460 - DNA, 25 bp, Homo sapien
gagaaatgggttaccccagttgtct

SEQ ID NO: 20461 - DNA, 25 bp, Homo sapien
ttaccccagttgtcttatttaaatg

SEQ ID NO: 20462 - DNA, 25 bp, Homo sapien
aatggttacccatcagattttaatt

SEQ ID NO: 20463 - DNA, 25 bp, Homo sapien
attttaattttatcttctctttgag

SEQ ID NO: 20464 - DNA, 25 bp, Homo sapien
gaagcacttaaatcactccaaagaa

SEQ ID NO: 20465 - DNA, 25 bp, Homo sapien
agcacagattttttctttctgcttt

SEQ ID NO: 20466 - DNA, 25 bp, Homo sapien
aagagacagggggctgggcgtggtg

SEQ ID NO: 20467 - DNA, 25 bp, Homo sapien
ggtggatcacgaggtaggagttaaa

SEQ ID NO: 20468 - DNA, 25 bp, Homo sapien
agtgaaccgagatcatgccattgta

SEQ ID NO: 20469 - DNA, 25 bp, Homo sapien
ccattgtactctagcctgggtgaca

SEQ ID NO: 20470 - DNA, 25 bp, Homo sapien
aatgtcagacttaatctgcactata

SEQ ID NO: 20471 - DNA, 25 bp, Homo sapien
tttacagaacgtttcatccaacagc

SEQ ID NO: 20472 - DNA, 25 bp, Homo sapien
aacgtttcatccaacagctgcaaaa

SEQ ID NO: 20473 - DNA, 25 bp, Homo sapien
cacattcttctcctagcacatggat

SEQ ID NO: 20474 - DNA, 25 bp, Homo sapien
catggatctttctcaaggacaacca

SEQ ID NO: 20475 - DNA, 25 bp, Homo sapien
tcaaggacaaccatatgttaggtca

SEQ ID NO: 20476 - DNA, 25 bp, Homo sapien
gcatcttctctgaccacagtggaat

SEQ ID NO: 20477 - DNA, 25 bp, Homo sapien
gtatgctcctgaatgacaagtgggt

SEQ ID NO: 20478 - DNA, 25 bp, Homo sapien
gtttatagctataagcacctacatc

SEQ ID NO: 20479 - DNA, 25 bp, Homo sapien
gctataagcacctacatcaaaaaag

SEQ ID NO: 20480 - DNA, 25 bp, Homo sapien
ataaataatctaaccatgaatctta

SEQ ID NO: 20481 - DNA, 25 bp, Homo sapien
aaggtgcaagaggttggcagcttcg

SEQ ID NO: 20482 - DNA, 25 bp, Homo sapien
gcaagaggttggcagcttcgattga

SEQ ID NO: 20483 - DNA, 25 bp, Homo sapien
agaggttggcagcttcgattgaagc

SEQ ID NO: 20484 - DNA, 25 bp, Homo sapien
cgattgaagcacatcgaccggcgac

SEQ ID NO: 20485 - DNA, 25 bp, Homo sapien
gccaggagtcatgagcgacagcggc

SEQ ID NO: 20486 - DNA, 25 bp, Homo sapien
agtcatgagcgacagcggcgagcag

SEQ ID NO: 20487 - DNA, 25 bp, Homo sapien
gagcgacagcggcgagcagaactac

SEQ ID NO: 20488 - DNA, 25 bp, Homo sapien
acagcggcgagcagaactacggcga

SEQ ID NO: 20489 - DNA, 25 bp, Homo sapien
tgcggcggagcctccttaaggaagg

SEQ ID NO: 20490 - DNA, 25 bp, Homo sapien
ggcggagcctccttaaggaaggtgc

SEQ ID NO: 20491 - DNA, 25 bp, Homo sapien
ggagcctccttaaggaaggtgcaag

SEQ ID NO: 20492 - DNA, 25 bp, Homo sapien
gaggaaagacgctctttaggttttg

SEQ ID NO: 20493 - DNA, 25 bp, Homo sapien
ttactctagggaaaacactgacgaa

SEQ ID NO: 20494 - DNA, 25 bp, Homo sapien
gacgaatggtcagagctcctatcct

SEQ ID NO: 20495 - DNA, 25 bp, Homo sapien
aatggtcagagctcctatcctgatc

SEQ ID NO: 20496 - DNA, 25 bp, Homo sapien
atcctgatcttttcatcaaggcgcc

SEQ ID NO: 20497 - DNA, 25 bp, Homo sapien
cttttcatcaaggcgcctttcctaa

SEQ ID NO: 20498 - DNA, 25 bp, Homo sapien
ggcgcctttcctaataatatggttc

SEQ ID NO: 20499 - DNA, 25 bp, Homo sapien
gttacaaataacgcagacttcaaaa

SEQ ID NO: 20500 - DNA, 25 bp, Homo sapien
taaatgatcagaattggcagcacaa

SEQ ID NO: 20501 - DNA, 25 bp, Homo sapien
gcccccagaaaattgtgccaaagag

SEQ ID NO: 20502 - DNA, 25 bp, Homo sapien
ttcaggtaactattttggattgcaa

SEQ ID NO: 20503 - DNA, 25 bp, Homo sapien
ataaatggtaaggagcagctgctgc

SEQ ID NO: 20504 - DNA, 25 bp, Homo sapien
gcagctgctgcgcttggataacaag

SEQ ID NO: 20505 - DNA, 25 bp, Homo sapien
ggataacaagtaattcaacgcacgc

SEQ ID NO: 20506 - DNA, 25 bp, Homo sapien
gtaattcaacgcacgcacttaacag

SEQ ID NO: 20507 - DNA, 25 bp, Homo sapien
caacgcacgcacttaacagaaatgt

SEQ ID NO: 20508 - DNA, 25 bp, Homo sapien
aaactataacaagcaccatttgagg

SEQ ID NO: 20509 - DNA, 25 bp, Homo sapien
caccatttgaggattaacaggaaca

SEQ ID NO: 20510 - DNA, 25 bp, Homo sapien
tgaagatttcaaacgaactcgactt

SEQ ID NO: 20511 - DNA, 25 bp, Homo sapien
aaacgaactcgactttcagtataat

SEQ ID NO: 20512 - DNA, 25 bp, Homo sapien
agtatttataaacagctcatcggag

SEQ ID NO: 20513 - DNA, 25 bp, Homo sapien
gctcatcggagcctctatttgtcat

SEQ ID NO: 20514 - DNA, 25 bp, Homo sapien
gaggtggaatccgaagtcctgggac

SEQ ID NO: 20515 - DNA, 25 bp, Homo sapien
cgaagtcctgggactgcgggatgct

SEQ ID NO: 20516 - DNA, 25 bp, Homo sapien
actgcgggatgctaaacattgaaag

SEQ ID NO: 20517 - DNA, 25 bp, Homo sapien
agctgggtgtaggcactgcagggag

SEQ ID NO: 20518 - DNA, 25 bp, Homo sapien
ggagagtgtggaggtctgacagggt

SEQ ID NO: 20519 - DNA, 25 bp, Homo sapien
gtggaggtctgacagggtaggaata

SEQ ID NO: 20520 - DNA, 25 bp, Homo sapien
aggaatatgtgggagggctgggcta

SEQ ID NO: 20521 - DNA, 25 bp, Homo sapien
gagggctgggctaggaatggccttg

SEQ ID NO: 20522 - DNA, 25 bp, Homo sapien
tgggctaggaatggccttggaggct

SEQ ID NO: 20523 - DNA, 25 bp, Homo sapien
ggaggctggcctgtgtggatatggc

SEQ ID NO: 20524 - DNA, 25 bp, Homo sapien
tggatatggcaccaattctaccctg

SEQ ID NO: 20525 - DNA, 25 bp, Homo sapien
ctcacccatgaggggcaccaatgta

SEQ ID NO: 20526 - DNA, 25 bp, Homo sapien
aaagctgaggcttcatctactgatg

SEQ ID NO: 20527 - DNA, 25 bp, Homo sapien
tactgatgagcttcactggtttccc

SEQ ID NO: 20528 - DNA, 25 bp, Homo sapien
tcccctgaggtttgtgctttggcag

SEQ ID NO: 20529 - DNA, 25 bp, Homo sapien
gggactgggattgtgtggtcagctg

SEQ ID NO: 20530 - DNA, 25 bp, Homo sapien
gctgtggctgccaacagatgcaggt

SEQ ID NO: 20531 - DNA, 25 bp, Homo sapien
aaggggaaatgccgatgcctatcct

SEQ ID NO: 20532 - DNA, 25 bp, Homo sapien
gctactggacttaaatgggcaacaa

SEQ ID NO: 20533 - DNA, 25 bp, Homo sapien
gcaacaaggggctttgcctgttcat

SEQ ID NO: 20534 - DNA, 25 bp, Homo sapien
tttgcctgttcatttgccatggaga

SEQ ID NO: 20535 - DNA, 25 bp, Homo sapien
gggctgggaatccaggtgcggtggc

SEQ ID NO: 20536 - DNA, 25 bp, Homo sapien
tgctgccaccaaatctgtctagaat

SEQ ID NO: 20537 - DNA, 25 bp, Homo sapien
aatctgtctagaatcctgctttaca

SEQ ID NO: 20538 - DNA, 25 bp, Homo sapien
tgtaatgtagttctttgttcctgct

SEQ ID NO: 20539 - DNA, 25 bp, Homo sapien
ttctctttcagtattaaactctcct

SEQ ID NO: 20540 - DNA, 25 bp, Homo sapien
gtattaaactctcctttgatattat

SEQ ID NO: 20541 - DNA, 25 bp, Homo sapien
tgtggcttttatttcagtgccatac

SEQ ID NO: 20542 - DNA, 25 bp, Homo sapien
tacatgttattgttttcaacctaga

SEQ ID NO: 20543 - DNA, 25 bp, Homo sapien
tcaacctagaaacctttatccctgc

SEQ ID NO: 20544 - DNA, 25 bp, Homo sapien
tagaaacctttatccctgcttatct

SEQ ID NO: 20545 - DNA, 25 bp, Homo sapien
ttatccctgcttatctgaaacttcc

SEQ ID NO: 20546 - DNA, 25 bp, Homo sapien
ccaacttccctgatctttaagactt

SEQ ID NO: 20547 - DNA, 25 bp, Homo sapien
accactaccatcaagacgcagagac

SEQ ID NO: 20548 - DNA, 25 bp, Homo sapien
tcaagacgcagagaccggtagtggc

SEQ ID NO: 20549 - DNA, 25 bp, Homo sapien
ctgggcgcgctgatatttattgtat

SEQ ID NO: 20550 - DNA, 25 bp, Homo sapien
ggagggtgagtcgtccaaatgactg

SEQ ID NO: 20551 - DNA, 25 bp, Homo sapien
aggtcaagcaagtcacgtgatcatg

SEQ ID NO: 20552 - DNA, 25 bp, Homo sapien
tgatcatgggacagggggcccttcc

SEQ ID NO: 20553 - DNA, 25 bp, Homo sapien
cttcccttttaggcagccgaagcag

SEQ ID NO: 20554 - DNA, 25 bp, Homo sapien
gagaaggcagcatatgtcagcgttt

SEQ ID NO: 20555 - DNA, 25 bp, Homo sapien
gcatatgtcagcgttttcttctctg

SEQ ID NO: 20556 - DNA, 25 bp, Homo sapien
tcacaaggtcaggaggtggaggcca

SEQ ID NO: 20557 - DNA, 25 bp, Homo sapien
atccgggcgcgtggtggagggcgcc

SEQ ID NO: 20558 - DNA, 25 bp, Homo sapien
tcacaaacttttatactctttctgt

SEQ ID NO: 20559 - DNA, 25 bp, Homo sapien
gaacctggtcctaagcctaaaagtg

SEQ ID NO: 20560 - DNA, 25 bp, Homo sapien
aagtgggcttgattctgcagtaaat

SEQ ID NO: 20561 - DNA, 25 bp, Homo sapien
taaatcttttacaactgcctcgaca

SEQ ID NO: 20562 - DNA, 25 bp, Homo sapien
gcctcgacacacataaaccttttta

SEQ ID NO: 20563 - DNA, 25 bp, Homo sapien
aatagacactccccgaagtcttttg

SEQ ID NO: 20564 - DNA, 25 bp, Homo sapien
aagtcttttgttcgcatggtcacac

SEQ ID NO: 20565 - DNA, 25 bp, Homo sapien
tatggccacagtagtcttgatgacc

SEQ ID NO: 20566 - DNA, 25 bp, Homo sapien
tgaccaaagtcctttttttccatct

SEQ ID NO: 20567 - DNA, 25 bp, Homo sapien
gaacactcttgctttattccagaat

SEQ ID NO: 20568 - DNA, 25 bp, Homo sapien
gtgtatttacgctttgattcatagt

SEQ ID NO: 20569 - DNA, 25 bp, Homo sapien
ctgcccaggagcatgaactgatcca

SEQ ID NO: 20570 - DNA, 25 bp, Homo sapien
tgatccatgaatgccttttccaggt

SEQ ID NO: 20571 - DNA, 25 bp, Homo sapien
gtcactgatgcctataatcgtggaa

SEQ ID NO: 20572 - DNA, 25 bp, Homo sapien
gtcagagggattcccctttttcatc

SEQ ID NO: 20573 - DNA, 25 bp, Homo sapien
tccttatggttaacatctccctaca

SEQ ID NO: 20574 - DNA, 25 bp, Homo sapien
caaactcctactacgtcgtctaaat

SEQ ID NO: 20575 - DNA, 25 bp, Homo sapien
cgtcgtctaaattgctgctctggaa

SEQ ID NO: 20576 - DNA, 25 bp, Homo sapien
tggaataaggtgatttctgccccca

SEQ ID NO: 20577 - DNA, 25 bp, Homo sapien
tcttccctagccggtagatacgtga

SEQ ID NO: 20578 - DNA, 25 bp, Homo sapien
gatacgtgaagatattcccaactgt

SEQ ID NO: 20579 - DNA, 25 bp, Homo sapien
atggcagtgtaggtagcttcaggaa

SEQ ID NO: 20580 - DNA, 25 bp, Homo sapien
gaccaggaagtgggacccatggcag

SEQ ID NO: 20581 - DNA, 25 bp, Homo sapien
acctcccagtcaacagaatcatcga

SEQ ID NO: 20582 - DNA, 25 bp, Homo sapien
ctcccagtcaacagaatcatcgatg

SEQ ID NO: 20583 - DNA, 25 bp, Homo sapien
gtcaacagaatcatcgatgtggatc

SEQ ID NO: 20584 - DNA, 25 bp, Homo sapien
gaatcatcgatgtggatcttgtaac

SEQ ID NO: 20585 - DNA, 25 bp, Homo sapien
gatgtggatcttgtaactggctcgg

SEQ ID NO: 20586 - DNA, 25 bp, Homo sapien
cccgggcgggatggtggcatagcgg

SEQ ID NO: 20587 - DNA, 25 bp, Homo sapien
ccgggcgggatggtggcatagcggg

SEQ ID NO: 20588 - DNA, 25 bp, Homo sapien
ggaggtcgcaggccagtggtgggcc

SEQ ID NO: 20589 - DNA, 25 bp, Homo sapien
ccaactctcctgtggacatgtcggg

SEQ ID NO: 20590 - DNA, 25 bp, Homo sapien
aactctcctgtggacatgtcggggt

SEQ ID NO: 20591 - DNA, 25 bp, Homo sapien
gactcatgctctgattgtggtgggg

SEQ ID NO: 20592 - DNA, 25 bp, Homo sapien
agagtaactctcattatctcctcca

SEQ ID NO: 20593 - DNA, 25 bp, Homo sapien
agaaaacacacagcttccacaactt

SEQ ID NO: 20594 - DNA, 25 bp, Homo sapien
caacttctctgttttctgtcagtcc

SEQ ID NO: 20595 - DNA, 25 bp, Homo sapien
ttacacgtctcctacttcaatggta

SEQ ID NO: 20596 - DNA, 25 bp, Homo sapien
aggccactgggatgagcctgaccta

SEQ ID NO: 20597 - DNA, 25 bp, Homo sapien
gcttgagaacgacctttctttcttt

SEQ ID NO: 20598 - DNA, 25 bp, Homo sapien
ctcagcctgcccttggggagatgag

SEQ ID NO: 20599 - DNA, 25 bp, Homo sapien
agatgagggagccctgtctgcgttt

SEQ ID NO: 20600 - DNA, 25 bp, Homo sapien
attcctggccatactcaggggtcca

SEQ ID NO: 20601 - DNA, 25 bp, Homo sapien
tcagacagcttatcctttttcaacc

SEQ ID NO: 20602 - DNA, 25 bp, Homo sapien
attaaagaacattcttcattcaagt

SEQ ID NO: 20603 - DNA, 25 bp, Homo sapien
atttcttacagggttattgattagc

SEQ ID NO: 20604 - DNA, 25 bp, Homo sapien
gggttattgattagcctgtggcaca

SEQ ID NO: 20605 - DNA, 25 bp, Homo sapien
gcctgtggcacaatgaaaagatttt

SEQ ID NO: 20606 - DNA, 25 bp, Homo sapien
gattttctccaagcttaagtaccaa

SEQ ID NO: 20607 - DNA, 25 bp, Homo sapien
tatacacaagaggtctttcaaaact

SEQ ID NO: 20608 - DNA, 25 bp, Homo sapien
ggtgcagtctcgactcattgcaccc

SEQ ID NO: 20609 - DNA, 25 bp, Homo sapien
aggtaaccacaggaaccaggccatc

SEQ ID NO: 20610 - DNA, 25 bp, Homo sapien
taaccacaggaaccaggccatctgc

SEQ ID NO: 20611 - DNA, 25 bp, Homo sapien
aggccatctgccttagataaataaa

SEQ ID NO: 20612 - DNA, 25 bp, Homo sapien
atgttacatggggcattctttttta

SEQ ID NO: 20613 - DNA, 25 bp, Homo sapien
aaacctgcgagatcggagttcttta

SEQ ID NO: 20614 - DNA, 25 bp, Homo sapien
ggaatgcaacagatttggacaagtc

SEQ ID NO: 20615 - DNA, 25 bp, Homo sapien
ggacaagagctttagagagaccaaa

SEQ ID NO: 20616 - DNA, 25 bp, Homo sapien
gagagaccaaagagtttttcactgt

SEQ ID NO: 20617 - DNA, 25 bp, Homo sapien
tttttcactgttaaagtgtccagta

SEQ ID NO: 20618 - DNA, 25 bp, Homo sapien
gtgtccagtatgtagccgagaacca

SEQ ID NO: 20619 - DNA, 25 bp, Homo sapien
gtagccgagaaccatatggagaaca

SEQ ID NO: 20620 - DNA, 25 bp, Homo sapien
ggagaacatcaaatacagtggaaca

SEQ ID NO: 20621 - DNA, 25 bp, Homo sapien
atgtaactgctattgatgtcacact

SEQ ID NO: 20622 - DNA, 25 bp, Homo sapien
gtcacactttgtgaagtagtctttg

SEQ ID NO: 20623 - DNA, 25 bp, Homo sapien
aaaaagggtgacatctagtggctaa

SEQ ID NO: 20624 - DNA, 25 bp, Homo sapien
gacaattccaaggcagtcctggtgg

SEQ ID NO: 20625 - DNA, 25 bp, Homo sapien
gtcctggtggtgcctatgggactgc

SEQ ID NO: 20626 - DNA, 25 bp, Homo sapien
acacagccagcttatagtcctagtc

SEQ ID NO: 20627 - DNA, 25 bp, Homo sapien
agtcctagtcagcagctcagagctc

SEQ ID NO: 20628 - DNA, 25 bp, Homo sapien
tccctgcagtgcagtacctatctca

SEQ ID NO: 20629 - DNA, 25 bp, Homo sapien
gccacagccctatgctgtgcatggc

SEQ ID NO: 20630 - DNA, 25 bp, Homo sapien
gtgccctgtccttgcaaaagcagat

SEQ ID NO: 20631 - DNA, 25 bp, Homo sapien
gatggaacatgctaaccagcagact

SEQ ID NO: 20632 - DNA, 25 bp, Homo sapien
taaccagcagactggcttctccgac

SEQ ID NO: 20633 - DNA, 25 bp, Homo sapien
tccctgtgcagatgcagccagcagg

SEQ ID NO: 20634 - DNA, 25 bp, Homo sapien
cagattatatcttcaacaccacacc

SEQ ID NO: 20635 - DNA, 25 bp, Homo sapien
gaattgacagagtgagttgagcatc

SEQ ID NO: 20636 - DNA, 25 bp, Homo sapien
tgagttgagcatctctgtctaacct

SEQ ID NO: 20637 - DNA, 25 bp, Homo sapien
attgcagactaaaaccacttctacc

SEQ ID NO: 20638 - DNA, 25 bp, Homo sapien
agactaaaaccacttctaccatctc

SEQ ID NO: 20639 - DNA, 25 bp, Homo sapien
gagatgtcttatgtagggaaggggc

SEQ ID NO: 20640 - DNA, 25 bp, Homo sapien
aaggggcaggtatgaagtgaggtag

SEQ ID NO: 20641 - DNA, 25 bp, Homo sapien
gtgaggtagattatctatacctctc

SEQ ID NO: 20642 - DNA, 25 bp, Homo sapien
tacctctcactcattcaggattctc

SEQ ID NO: 20643 - DNA, 25 bp, Homo sapien
ccttcattctcacactcacaggaat

SEQ ID NO: 20644 - DNA, 25 bp, Homo sapien
atcacttataggattttgtggggtg

SEQ ID NO: 20645 - DNA, 25 bp, Homo sapien
tcttcctcttgggggaaatctgtgt

SEQ ID NO: 20646 - DNA, 25 bp, Homo sapien
agaggactgataacatgcttagggt

SEQ ID NO: 20647 - DNA, 25 bp, Homo sapien
tttcagtacatatttcttccctcac

SEQ ID NO: 20648 - DNA, 25 bp, Homo sapien
cttccctcaccttatttacagtaat

SEQ ID NO: 20649 - DNA, 25 bp, Homo sapien
tgctaggttgtttataggctcagga

SEQ ID NO: 20650 - DNA, 25 bp, Homo sapien
gagacctagtgtcagtatagtacag

SEQ ID NO: 20651 - DNA, 25 bp, Homo sapien
gagtgataacactaatttgctttaa

SEQ ID NO: 20652 - DNA, 25 bp, Homo sapien
atttgctttaaatggctttacacca

SEQ ID NO: 20653 - DNA, 25 bp, Homo sapien
atttataatttgctttgttccagaa

SEQ ID NO: 20654 - DNA, 25 bp, Homo sapien
aagtgatggagggaggccgggcacg

SEQ ID NO: 20655 - DNA, 25 bp, Homo sapien
gcacggtggctcatacctataatcc

SEQ ID NO: 20656 - DNA, 25 bp, Homo sapien
aaaatacaaaacaagccgggcacag

SEQ ID NO: 20657 - DNA, 25 bp, Homo sapien
ctccgacatcgacgtcagggcaaac

SEQ ID NO: 20658 - DNA, 25 bp, Homo sapien
gaaaacctctatgctgccgtgaagc

SEQ ID NO: 20659 - DNA, 25 bp, Homo sapien
cactcggagcccacacgatgaagac

SEQ ID NO: 20660 - DNA, 25 bp, Homo sapien
acccccaggcagtgacgtatgccga

SEQ ID NO: 20661 - DNA, 25 bp, Homo sapien
atgccgaggtgaaacactccagacc

SEQ ID NO: 20662 - DNA, 25 bp, Homo sapien
ggagagaaatggcctctcctccttc

SEQ ID NO: 20663 - DNA, 25 bp, Homo sapien
cccactgtctggggaattcctggac

SEQ ID NO: 20664 - DNA, 25 bp, Homo sapien
gatggacactgaggctgctgcatct

SEQ ID NO: 20665 - DNA, 25 bp, Homo sapien
agacggaaggcaactgagcctcctc

SEQ ID NO: 20666 - DNA, 25 bp, Homo sapien
gtctggaatgcatgggagctgcccc

SEQ ID NO: 20667 - DNA, 25 bp, Homo sapien
agcctggatctaccccaggagactc

SEQ ID NO: 20668 - DNA, 25 bp, Homo sapien
tgtgcctgagctctgacagtgtggg

SEQ ID NO: 20669 - DNA, 25 bp, Homo sapien
tctgacagtgtggggaagtgtccct

SEQ ID NO: 20670 - DNA, 25 bp, Homo sapien
tgatcttggcagtggaacatgcaag

SEQ ID NO: 20671 - DNA, 25 bp, Homo sapien
ggaacatgcaaggcactgactgagc

SEQ ID NO: 20672 - DNA, 25 bp, Homo sapien
ggcactgactgagcatgcaggatca

SEQ ID NO: 20673 - DNA, 25 bp, Homo sapien
ggatcagctccatctcattatgtac

SEQ ID NO: 20674 - DNA, 25 bp, Homo sapien
agctccatctcattatgtacgtaga

SEQ ID NO: 20675 - DNA, 25 bp, Homo sapien
ggaaaaagactaagccagacgtggt

SEQ ID NO: 20676 - DNA, 25 bp, Homo sapien
aaggactaacaggcagtatgctgtc

SEQ ID NO: 20677 - DNA, 25 bp, Homo sapien
gtatgctgtcatgttaatgtggggt

SEQ ID NO: 20678 - DNA, 25 bp, Homo sapien
aattgtctgcattttttctgcattt

SEQ ID NO: 20679 - DNA, 25 bp, Homo sapien
cgaagaggcagtcgaagctctcgcg

SEQ ID NO: 20680 - DNA, 25 bp, Homo sapien
ggcctgaaagtgcacgcggatgctc

SEQ ID NO: 20681 - DNA, 25 bp, Homo sapien
gaaagtgcacgcggatgctcgtggg

SEQ ID NO: 20682 - DNA, 25 bp, Homo sapien
ccatcttcacgctaagggcgaaaaa

SEQ ID NO: 20683 - DNA, 25 bp, Homo sapien
ctaagggcgaaaaagcagttccgct

SEQ ID NO: 20684 - DNA, 25 bp, Homo sapien
ggctgtcgcgcaccaggaaggtgcc

SEQ ID NO: 20685 - DNA, 25 bp, Homo sapien
cccagtagaatccgcaggcgtccag

SEQ ID NO: 20686 - DNA, 25 bp, Homo sapien
tggcgcgcgtgatgcgccggtaatc

SEQ ID NO: 20687 - DNA, 25 bp, Homo sapien
gccggtaatcggcgtgcgaacggaa

SEQ ID NO: 20688 - DNA, 25 bp, Homo sapien
ggcgtgcgaacggaatgtgcggaag

SEQ ID NO: 20689 - DNA, 25 bp, Homo sapien
aacggaatgtgcggaagtgcgtgtc

SEQ ID NO: 20690 - DNA, 25 bp, Homo sapien
ggaggatcactgatgtatgtgtgta

SEQ ID NO: 20691 - DNA, 25 bp, Homo sapien
tgtatttgtagattgggggtcccca

SEQ ID NO: 20692 - DNA, 25 bp, Homo sapien
ccacccttaggtttgacaccttgct

SEQ ID NO: 20693 - DNA, 25 bp, Homo sapien
ttgacaccttgctagaagaactcag

SEQ ID NO: 20694 - DNA, 25 bp, Homo sapien
aactattatgctcatggtcatggtt

SEQ ID NO: 20695 - DNA, 25 bp, Homo sapien
ggtcatggtttattacagcaaaaag

SEQ ID NO: 20696 - DNA, 25 bp, Homo sapien
cagattaggatgggtgcggtggctc

SEQ ID NO: 20697 - DNA, 25 bp, Homo sapien
tgaccaacatgatcaaaccccaact

SEQ ID NO: 20698 - DNA, 25 bp, Homo sapien
tgatcaaaccccaactctactaaaa

SEQ ID NO: 20699 - DNA, 25 bp, Homo sapien
gcacagattgcaatgagcctagatt

SEQ ID NO: 20700 - DNA, 25 bp, Homo sapien
tgagcctagattgtgcctctgtact

SEQ ID NO: 20701 - DNA, 25 bp, Homo sapien
atttatttttgtcagcctcaagtaa

SEQ ID NO: 20702 - DNA, 25 bp, Homo sapien
gtcagcctcaagtaatactgctcta

SEQ ID NO: 20703 - DNA, 25 bp, Homo sapien
aatactgctctatagtagggcaaca

SEQ ID NO: 20704 - DNA, 25 bp, Homo sapien
gtagggcaacattcattgcttaaaa

SEQ ID NO: 20705 - DNA, 25 bp, Homo sapien
caaagttagtcacagaacaccatga

SEQ ID NO: 20706 - DNA, 25 bp, Homo sapien
gaacaccatgacagatgtttgaatt

SEQ ID NO: 20707 - DNA, 25 bp, Homo sapien
aatttttgattgaggatgttcttct

SEQ ID NO: 20708 - DNA, 25 bp, Homo sapien
ggatgttcttctgtaattatttttc

SEQ ID NO: 20709 - DNA, 25 bp, Homo sapien
ttttgtgctcaattcagtgtccttc

SEQ ID NO: 20710 - DNA, 25 bp, Homo sapien
ttcagtgtccttccaacatgtgtca

SEQ ID NO: 20711 - DNA, 25 bp, Homo sapien
catgtgtcagaaacccattgggccg

SEQ ID NO: 20712 - DNA, 25 bp, Homo sapien
ccccaagttggcgggcctgattggg

SEQ ID NO: 20713 - DNA, 25 bp, Homo sapien
caagttggcgggcctgattgggcgg

SEQ ID NO: 20714 - DNA, 25 bp, Homo sapien
catccggtccacggggagcaaacag

SEQ ID NO: 20715 - DNA, 25 bp, Homo sapien
ccggtccacggggagcaaacagcgc

SEQ ID NO: 20716 - DNA, 25 bp, Homo sapien
agaaccaggaagccctgcggatggc

SEQ ID NO: 20717 - DNA, 25 bp, Homo sapien
cagcgaccagaggcaggcctgtaag

SEQ ID NO: 20718 - DNA, 25 bp, Homo sapien
taagaagcacgagctgtatgtcagc

SEQ ID NO: 20719 - DNA, 25 bp, Homo sapien
gcacgagctgtatgtcagcttccga

SEQ ID NO: 20720 - DNA, 25 bp, Homo sapien
agctgtatgtcagcttccgagacct

SEQ ID NO: 20721 - DNA, 25 bp, Homo sapien
cgccgcctactactgtgagggggag

SEQ ID NO: 20722 - DNA, 25 bp, Homo sapien
tgtgagggggagtgtgccttccctc

SEQ ID NO: 20723 - DNA, 25 bp, Homo sapien
ggaacacagcggtgtgagaagtgca

SEQ ID NO: 20724 - DNA, 25 bp, Homo sapien
tgagaagtgcagcaagccctgtgcc

SEQ ID NO: 20725 - DNA, 25 bp, Homo sapien
cctggtcacctacaacacagacacg

SEQ ID NO: 20726 - DNA, 25 bp, Homo sapien
cacagacacgtttgagtccatgccc

SEQ ID NO: 20727 - DNA, 25 bp, Homo sapien
cccaatcccgagggccggtatacat

SEQ ID NO: 20728 - DNA, 25 bp, Homo sapien
aatcccgagggccggtatacattcg

SEQ ID NO: 20729 - DNA, 25 bp, Homo sapien
gagggccggtatacattcggcgcca

SEQ ID NO: 20730 - DNA, 25 bp, Homo sapien
ctacaactacctttctacggacgtg

SEQ ID NO: 20731 - DNA, 25 bp, Homo sapien
tacctttctacggacgtgggatcct

SEQ ID NO: 20732 - DNA, 25 bp, Homo sapien
tttctacggacgtgggatcctgcac

SEQ ID NO: 20733 - DNA, 25 bp, Homo sapien
ggtgacagcagaggatggaacacag

SEQ ID NO: 20734 - DNA, 25 bp, Homo sapien
tagaccatctccatttttagcactt

SEQ ID NO: 20735 - DNA, 25 bp, Homo sapien
atttttagcacttggcagcctcatg

SEQ ID NO: 20736 - DNA, 25 bp, Homo sapien
gcagcctcatgatccttttataaat

SEQ ID NO: 20737 - DNA, 25 bp, Homo sapien
aacagatttgccggcattcactgaa

SEQ ID NO: 20738 - DNA, 25 bp, Homo sapien
gcagatattgggtccttgtaacttc

SEQ ID NO: 20739 - DNA, 25 bp, Homo sapien
gtaacttcaactgactcttccaaat

SEQ ID NO: 20740 - DNA, 25 bp, Homo sapien
aatgcggctaattaacagtcgtatg

SEQ ID NO: 20741 - DNA, 25 bp, Homo sapien
cagtcgtatgatttctagcccatgg

SEQ ID NO: 20742 - DNA, 25 bp, Homo sapien
gccaattacaggccaaagcgttatt

SEQ ID NO: 20743 - DNA, 25 bp, Homo sapien
agcgttatttgccaagttttcttag

SEQ ID NO: 20744 - DNA, 25 bp, Homo sapien
gtggcattattgactgctgatgtga

SEQ ID NO: 20745 - DNA, 25 bp, Homo sapien
gtgctcgcgctttcacagaattatt

SEQ ID NO: 20746 - DNA, 25 bp, Homo sapien
tcagggtggtgacttcacacgccat

SEQ ID NO: 20747 - DNA, 25 bp, Homo sapien
ggcactggtggcaagtccatctatg

SEQ ID NO: 20748 - DNA, 25 bp, Homo sapien
taaagcatacgggtcctggcatctt

SEQ ID NO: 20749 - DNA, 25 bp, Homo sapien
cctggcatcttgtccatggcaaatg

SEQ ID NO: 20750 - DNA, 25 bp, Homo sapien
ggacccaacacaaatggttcccagt

SEQ ID NO: 20751 - DNA, 25 bp, Homo sapien
gtttttcatctgcactgccaagact

SEQ ID NO: 20752 - DNA, 25 bp, Homo sapien
ggagcgctttgggtccaggaatggc

SEQ ID NO: 20753 - DNA, 25 bp, Homo sapien
tcttaaccaccagatcattccttct

SEQ ID NO: 20754 - DNA, 25 bp, Homo sapien
atcctagaatctttgtgctctcgct

SEQ ID NO: 20755 - DNA, 25 bp, Homo sapien
ctcccatgcctagctggattgcaga

SEQ ID NO: 20756 - DNA, 25 bp, Homo sapien
aaggtggcctgggactagacagccc

SEQ ID NO: 20757 - DNA, 25 bp, Homo sapien
cagcccctctgagcacatgtatagt

SEQ ID NO: 20758 - DNA, 25 bp, Homo sapien
atcaggaggttcctggtctactccc

SEQ ID NO: 20759 - DNA, 25 bp, Homo sapien
gcgagtgctttttggcccaagattc

SEQ ID NO: 20760 - DNA, 25 bp, Homo sapien
ggcccaagattctcagagtgcttct

SEQ ID NO: 20761 - DNA, 25 bp, Homo sapien
ttgtgtgttgtgttgtgttgtgttg

SEQ ID NO: 20762 - DNA, 25 bp, Homo sapien
ttgtgttgtgttgtgttgtgttgtg

SEQ ID NO: 20763 - DNA, 25 bp, Homo sapien
ttgtgttgtgttgtgttgtgttttt

SEQ ID NO: 20764 - DNA, 25 bp, Homo sapien
tgtgtttttcacaatctcagccagc

SEQ ID NO: 20765 - DNA, 25 bp, Homo sapien
gacatgatgatccaggttggccctg

SEQ ID NO: 20766 - DNA, 25 bp, Homo sapien
aggcaagatggctcacgcctgtgat

SEQ ID NO: 20767 - DNA, 25 bp, Homo sapien
tccataagaaggtgggttggggcct

SEQ ID NO: 20768 - DNA, 25 bp, Homo sapien
tgctccgcctgcagggttgagaaac

SEQ ID NO: 20769 - DNA, 25 bp, Homo sapien
ccccacacctctgaggaggtctcag

SEQ ID NO: 20770 - DNA, 25 bp, Homo sapien
acctctgaggaggtctcagggcccc

SEQ ID NO: 20771 - DNA, 25 bp, Homo sapien
tccctgccactgtgggcatcagagg

SEQ ID NO: 20772 - DNA, 25 bp, Homo sapien
cactgtgggcatcagaggccctctc

SEQ ID NO: 20773 - DNA, 25 bp, Homo sapien
cctccagggtgcatctcctggtcag

SEQ ID NO: 20774 - DNA, 25 bp, Homo sapien
gggtgcatctcctggtcaggagggg

SEQ ID NO: 20775 - DNA, 25 bp, Homo sapien
cggcctgcacaggtcgtgaggaaaa

SEQ ID NO: 20776 - DNA, 25 bp, Homo sapien
gaggaaaagcacctggtttcggccg

SEQ ID NO: 20777 - DNA, 25 bp, Homo sapien
tccagcctggcgacggaggaatgct

SEQ ID NO: 20778 - DNA, 25 bp, Homo sapien
agttcaagtacagtgactatttcaa

SEQ ID NO: 20779 - DNA, 25 bp, Homo sapien
cctggctcgcatggagttgtttctt

SEQ ID NO: 20780 - DNA, 25 bp, Homo sapien
tttcttttgttgtgtgccattttgc

SEQ ID NO: 20781 - DNA, 25 bp, Homo sapien
tgttgtgtgccattttgcagcattt

SEQ ID NO: 20782 - DNA, 25 bp, Homo sapien
ttaatttgaagcctctcgttgaccc

SEQ ID NO: 20783 - DNA, 25 bp, Homo sapien
gacccaaaggatatcgacctcagcc

SEQ ID NO: 20784 - DNA, 25 bp, Homo sapien
gacctcagccctatacatattgggt

SEQ ID NO: 20785 - DNA, 25 bp, Homo sapien
atcccaccacgttacaaactctgtg

SEQ ID NO: 20786 - DNA, 25 bp, Homo sapien
acgttacaaactctgtgtcattccc

SEQ ID NO: 20787 - DNA, 25 bp, Homo sapien
cattccccgctcatgagtgtgtgga

SEQ ID NO: 20788 - DNA, 25 bp, Homo sapien
tgagtgtgtggaggacaccctgaac

SEQ ID NO: 20789 - DNA, 25 bp, Homo sapien
tgcctcaagcgctacgaccttgagt

SEQ ID NO: 20790 - DNA, 25 bp, Homo sapien
caagcgctacgaccttgagtactgg

SEQ ID NO: 20791 - DNA, 25 bp, Homo sapien
ctcgccttctacgacgtgacgggcg

SEQ ID NO: 20792 - DNA, 25 bp, Homo sapien
tacgacgtgacgggcggcatgagcc

SEQ ID NO: 20793 - DNA, 25 bp, Homo sapien
gtgacagcctccagacttgaatctg

SEQ ID NO: 20794 - DNA, 25 bp, Homo sapien
gacttgaatctgtagacatttcttt

SEQ ID NO: 20795 - DNA, 25 bp, Homo sapien
gacatttctttattgatatggcaaa

SEQ ID NO: 20796 - DNA, 25 bp, Homo sapien
atggcaaattgcttgcagatatttt

SEQ ID NO: 20797 - DNA, 25 bp, Homo sapien
aatgacagcaattttctaatatttg

SEQ ID NO: 20798 - DNA, 25 bp, Homo sapien
ccgccactactgggaggttgacgtg

SEQ ID NO: 20799 - DNA, 25 bp, Homo sapien
tgggaggttgacgtgcaggaggcgg

SEQ ID NO: 20800 - DNA, 25 bp, Homo sapien
cggtcagcaccgtggtgtgaggccc

SEQ ID NO: 20801 - DNA, 25 bp, Homo sapien
tagcccggccaaggacactgatggg

SEQ ID NO: 20802 - DNA, 25 bp, Homo sapien
aggacactgatgggtcctgctgctc

SEQ ID NO: 20803 - DNA, 25 bp, Homo sapien
tgctgctcgggaaggcctgagggaa

SEQ ID NO: 20804 - DNA, 25 bp, Homo sapien
tgaggacggggcagagctgagtcgg

SEQ ID NO: 20805 - DNA, 25 bp, Homo sapien
cctggggtctctgagcagtggggag

SEQ ID NO: 20806 - DNA, 25 bp, Homo sapien
cagtggggagcgggggctaactggc

SEQ ID NO: 20807 - DNA, 25 bp, Homo sapien
gctaactggccccaggcggaggggc

SEQ ID NO: 20808 - DNA, 25 bp, Homo sapien
ccaggcggaggggcttggagcagag

SEQ ID NO: 20809 - DNA, 25 bp, Homo sapien
ggcttggagcagagacggcagcccc

SEQ ID NO: 20810 - DNA, 25 bp, Homo sapien
agccacagtggggcccatggcccca

SEQ ID NO: 20811 - DNA, 25 bp, Homo sapien
ctcagcaccagcgatggctttggca

SEQ ID NO: 20812 - DNA, 25 bp, Homo sapien
gcaccagcgatggctttggcagtag

SEQ ID NO: 20813 - DNA, 25 bp, Homo sapien
gcgatggctttggcagtaggcctaa

SEQ ID NO: 20814 - DNA, 25 bp, Homo sapien
gcagtaggcctaatgccagcttcga

SEQ ID NO: 20815 - DNA, 25 bp, Homo sapien
taggcctaatgccagcttcgacaga

SEQ ID NO: 20816 - DNA, 25 bp, Homo sapien
ctaatgccagcttcgacagaggact

SEQ ID NO: 20817 - DNA, 25 bp, Homo sapien
gccagcttcgacagaggactgagta

SEQ ID NO: 20818 - DNA, 25 bp, Homo sapien
agaggactgagtaccatcattggct

SEQ ID NO: 20819 - DNA, 25 bp, Homo sapien
gagtaccatcattggctttggcagt

SEQ ID NO: 20820 - DNA, 25 bp, Homo sapien
catcattggctttggcagtggttcc

SEQ ID NO: 20821 - DNA, 25 bp, Homo sapien
tggctttggcagtggttccaacacc

SEQ ID NO: 20822 - DNA, 25 bp, Homo sapien
aggacggggtggaaatggacactcg

SEQ ID NO: 20823 - DNA, 25 bp, Homo sapien
cacagctttaccctcagacagaagg

SEQ ID NO: 20824 - DNA, 25 bp, Homo sapien
tttaccctcagacagaaggcaactg

SEQ ID NO: 20825 - DNA, 25 bp, Homo sapien
ccaacactggcgtcagggaaaacac

SEQ ID NO: 20826 - DNA, 25 bp, Homo sapien
ggaaaacacaggacattggcccaga

SEQ ID NO: 20827 - DNA, 25 bp, Homo sapien
attggcccagagacaggctgatttc

SEQ ID NO: 20828 - DNA, 25 bp, Homo sapien
gagacaggctgatttccaacgtcct

SEQ ID NO: 20829 - DNA, 25 bp, Homo sapien
gagcccaaggacgggggcctacaga

SEQ ID NO: 20830 - DNA, 25 bp, Homo sapien
gctgacgtccagggagaaaacttct

SEQ ID NO: 20831 - DNA, 25 bp, Homo sapien
aaacttctgtgctgccgtgaagaac

SEQ ID NO: 20832 - DNA, 25 bp, Homo sapien
tctgtgctgccgtgaagaacacaca

SEQ ID NO: 20833 - DNA, 25 bp, Homo sapien
gaaggcagcaagtgcccatctttcc

SEQ ID NO: 20834 - DNA, 25 bp, Homo sapien
tgcccgctgcaagtacagtcacaag

SEQ ID NO: 20835 - DNA, 25 bp, Homo sapien
gtagctgaggggttgcgccagctgc

SEQ ID NO: 20836 - DNA, 25 bp, Homo sapien
aaataccgccaggacctgactgtgc

SEQ ID NO: 20837 - DNA, 25 bp, Homo sapien
ccaggctactgcacagacttcctgc

SEQ ID NO: 20838 - DNA, 25 bp, Homo sapien
acctgaggcagaagctccaggccct

SEQ ID NO: 20839 - DNA, 25 bp, Homo sapien
gatgtggggttcaggatggcccccc

SEQ ID NO: 20840 - DNA, 25 bp, Homo sapien
gatggcccccccatggggggtggat

SEQ ID NO: 20841 - DNA, 25 bp, Homo sapien
ggatgatttgcactttggttccctg

SEQ ID NO: 20842 - DNA, 25 bp, Homo sapien
tggttccctgtgttttgatttctca

SEQ ID NO: 20843 - DNA, 25 bp, Homo sapien
gtgaatctcagttttgggacgggga

SEQ ID NO: 20844 - DNA, 25 bp, Homo sapien
atgccaatgaccaggagcggcgctg

SEQ ID NO: 20845 - DNA, 25 bp, Homo sapien
acctctgcgagtacgacttcgtcaa

SEQ ID NO: 20846 - DNA, 25 bp, Homo sapien
cgacttcgtcaagctgagctcgggg

SEQ ID NO: 20847 - DNA, 25 bp, Homo sapien
ctccgactactccaacgagaagccg

SEQ ID NO: 20848 - DNA, 25 bp, Homo sapien
gagaagccgttcacggggttcgagg

SEQ ID NO: 20849 - DNA, 25 bp, Homo sapien
gccttctatgcagccgaggacattg

SEQ ID NO: 20850 - DNA, 25 bp, Homo sapien
cattgacgagtgccaggtggccccg

SEQ ID NO: 20851 - DNA, 25 bp, Homo sapien
cctgctcagagcagagcctctagcc

SEQ ID NO: 20852 - DNA, 25 bp, Homo sapien
cggcctgcccagcaggtcagaagcc

SEQ ID NO: 20853 - DNA, 25 bp, Homo sapien
cagaagccagagccagcctgctggc

SEQ ID NO: 20854 - DNA, 25 bp, Homo sapien
tgggctgagatggctgtgccccaac

SEQ ID NO: 20855 - DNA, 25 bp, Homo sapien
gaaggacgtggtgcggttcttcaac

SEQ ID NO: 20856 - DNA, 25 bp, Homo sapien
gcaacttcccggaagccatgctcaa

SEQ ID NO: 20857 - DNA, 25 bp, Homo sapien
ccatgctcaaggagcggcaccacac

SEQ ID NO: 20858 - DNA, 25 bp, Homo sapien
aaaggtgcagtaccagctcaagtcg

SEQ ID NO: 20859 - DNA, 25 bp, Homo sapien
gctcaagtcggagcacatctcgctg

SEQ ID NO: 20860 - DNA, 25 bp, Homo sapien
tcgctggcccaggtgttcagcaaga

SEQ ID NO: 20861 - DNA, 25 bp, Homo sapien
agatggagcaggtgtctggcgtgct

SEQ ID NO: 20862 - DNA, 25 bp, Homo sapien
tcgaggactactcggtcagccagac

SEQ ID NO: 20863 - DNA, 25 bp, Homo sapien
tccgggcacttgtggcagacgagcc

SEQ ID NO: 20864 - DNA, 25 bp, Homo sapien
gctgggccagggactcaacaatggg

SEQ ID NO: 20865 - DNA, 25 bp, Homo sapien
tggggacagaagtcccccagtgcct

SEQ ID NO: 20866 - DNA, 25 bp, Homo sapien
ccatgctcacgtccggagtaacact

SEQ ID NO: 20867 - DNA, 25 bp, Homo sapien
gctcacgtccggagtaacactacat

SEQ ID NO: 20868 - DNA, 25 bp, Homo sapien
gtaacactacatacagttcacctga

SEQ ID NO: 20869 - DNA, 25 bp, Homo sapien
catacagttcacctgaaacgcctcg

SEQ ID NO: 20870 - DNA, 25 bp, Homo sapien
gcctactgcagtccctgagttagtc

SEQ ID NO: 20871 - DNA, 25 bp, Homo sapien
tactgcagtccctgagttagtctct

SEQ ID NO: 20872 - DNA, 25 bp, Homo sapien
gcagtccctgagttagtctctgctt

SEQ ID NO: 20873 - DNA, 25 bp, Homo sapien
ctgtgggtcatggtctgtgagaggt

SEQ ID NO: 20874 - DNA, 25 bp, Homo sapien
gtcatggtctgtgagaggtggcagg

SEQ ID NO: 20875 - DNA, 25 bp, Homo sapien
agggtggaggcttcaggtctccagc

SEQ ID NO: 20876 - DNA, 25 bp, Homo sapien
ccagaatggtacagcgataataaaa

SEQ ID NO: 20877 - DNA, 25 bp, Homo sapien
tttgcaactcactgattctctacat

SEQ ID NO: 20878 - DNA, 25 bp, Homo sapien
gcaactcactgattctctacatgct

SEQ ID NO: 20879 - DNA, 25 bp, Homo sapien
ttctgtgataactctgcaaaggcct

SEQ ID NO: 20880 - DNA, 25 bp, Homo sapien
ggctggcctggcagttgaacagagg

SEQ ID NO: 20881 - DNA, 25 bp, Homo sapien
ggcctggcagttgaacagagggaga

SEQ ID NO: 20882 - DNA, 25 bp, Homo sapien
gagggagagactaaccttgagtcag

SEQ ID NO: 20883 - DNA, 25 bp, Homo sapien
actaaccttgagtcagaaaacagag

SEQ ID NO: 20884 - DNA, 25 bp, Homo sapien
tttgcttcaaattcaaggccttcca

SEQ ID NO: 20885 - DNA, 25 bp, Homo sapien
tcaaattcaaggccttccaacgccc

SEQ ID NO: 20886 - DNA, 25 bp, Homo sapien
gggactctgatcccatattcttaac

SEQ ID NO: 20887 - DNA, 25 bp, Homo sapien
atattcttaacagatctttactctt

SEQ ID NO: 20888 - DNA, 25 bp, Homo sapien
ctcgttctgtcccagactggagcac

SEQ ID NO: 20889 - DNA, 25 bp, Homo sapien
tgtcccagactggagcactattcac

SEQ ID NO: 20890 - DNA, 25 bp, Homo sapien
acctagatgtccaacaacagataaa

SEQ ID NO: 20891 - DNA, 25 bp, Homo sapien
gtttatacacacaaaggaatactat

SEQ ID NO: 20892 - DNA, 25 bp, Homo sapien
ggaatactattcaaagaccagaatg

SEQ ID NO: 20893 - DNA, 25 bp, Homo sapien
agaccagaatgaaatcctatcacct

SEQ ID NO: 20894 - DNA, 25 bp, Homo sapien
gaatgaaatcctatcacctgaggca

SEQ ID NO: 20895 - DNA, 25 bp, Homo sapien
aaatcctatcacctgaggcaacatg

SEQ ID NO: 20896 - DNA, 25 bp, Homo sapien
aataagccaggaacataaacatgca

SEQ ID NO: 20897 - DNA, 25 bp, Homo sapien
taaacatgcacattcccactcatat

SEQ ID NO: 20898 - DNA, 25 bp, Homo sapien
tgcacattcccactcatatgtggaa

SEQ ID NO: 20899 - DNA, 25 bp, Homo sapien
taccacatggccaaagtgtaccctc

SEQ ID NO: 20900 - DNA, 25 bp, Homo sapien
cctcaccctgggacctgggaaagct

SEQ ID NO: 20901 - DNA, 25 bp, Homo sapien
agaagtgtcctatgggtcctggtac

SEQ ID NO: 20902 - DNA, 25 bp, Homo sapien
aagatcctggagtttgtggggcgct

SEQ ID NO: 20903 - DNA, 25 bp, Homo sapien
gagactgtggacctcatggttgagc

SEQ ID NO: 20904 - DNA, 25 bp, Homo sapien
agaagaaccctatgaccaactacac

SEQ ID NO: 20905 - DNA, 25 bp, Homo sapien
gggagttcatggaccacagcatctc

SEQ ID NO: 20906 - DNA, 25 bp, Homo sapien
tgagcgcttcgatgcggactatgcg

SEQ ID NO: 20907 - DNA, 25 bp, Homo sapien
gaagatggcaggctgcagcctcagc

SEQ ID NO: 20908 - DNA, 25 bp, Homo sapien
tcagcttccgctctgagctgtgaga

SEQ ID NO: 20909 - DNA, 25 bp, Homo sapien
gggagtgtgcgaatcaagcctgacc

SEQ ID NO: 20910 - DNA, 25 bp, Homo sapien
gagtgtctgatacataaaacccttt

SEQ ID NO: 20911 - DNA, 25 bp, Homo sapien
atttactctaaatgtctcacctgca

SEQ ID NO: 20912 - DNA, 25 bp, Homo sapien
tcacctgcatgacagtcttttcaaa

SEQ ID NO: 20913 - DNA, 25 bp, Homo sapien
gaaagacatggtaattgcaattttt

SEQ ID NO: 20914 - DNA, 25 bp, Homo sapien
tgctattaagggtactttttccagc

SEQ ID NO: 20915 - DNA, 25 bp, Homo sapien
tttcaaacttactgtcttaaatatg

SEQ ID NO: 20916 - DNA, 25 bp, Homo sapien
gtcagctttaagtaatgtcagactc

SEQ ID NO: 20917 - DNA, 25 bp, Homo sapien
agtaatgtcagactcatatgcattt

SEQ ID NO: 20918 - DNA, 25 bp, Homo sapien
tttcattctcattagctaaagtaaa

SEQ ID NO: 20919 - DNA, 25 bp, Homo sapien
taatatgcttatttgtaatcctaat

SEQ ID NO: 20920 - DNA, 25 bp, Homo sapien
tgagggtgacatttttaagattgta

SEQ ID NO: 20921 - DNA, 25 bp, Homo sapien
tgaaatggacgacttcagctctccc

SEQ ID NO: 20922 - DNA, 25 bp, Homo sapien
ctcccagcatcaccaacgagtttgg

SEQ ID NO: 20923 - DNA, 25 bp, Homo sapien
gacgatcatggtgggccaggacggc

SEQ ID NO: 20924 - DNA, 25 bp, Homo sapien
tcatctacaacctctggttcggcta

SEQ ID NO: 20925 - DNA, 25 bp, Homo sapien
tctgcccaacgtcacgacagtggag

SEQ ID NO: 20926 - DNA, 25 bp, Homo sapien
gaccaggcagtgactgcagccctgg

SEQ ID NO: 20927 - DNA, 25 bp, Homo sapien
tcatcgctgtggtgcaagccatcgt

SEQ ID NO: 20928 - DNA, 25 bp, Homo sapien
agctgcctcggactccaggaaaggc

SEQ ID NO: 20929 - DNA, 25 bp, Homo sapien
cggctactgagtgctccaggaggac

SEQ ID NO: 20930 - DNA, 25 bp, Homo sapien
gggacaagatactcaccaggaccag

SEQ ID NO: 20931 - DNA, 25 bp, Homo sapien
cttcccctgtgagcagcagagcagc

SEQ ID NO: 20932 - DNA, 25 bp, Homo sapien
aattgagaaacatggagactccaaa

SEQ ID NO: 20933 - DNA, 25 bp, Homo sapien
acatggagactccaaatggattatt

SEQ ID NO: 20934 - DNA, 25 bp, Homo sapien
aaatggattatttacaggttcacaa

SEQ ID NO: 20935 - DNA, 25 bp, Homo sapien
tttacaggttcacaaaacagctttg

SEQ ID NO: 20936 - DNA, 25 bp, Homo sapien
aacagctttgtggcactgaaagggc

SEQ ID NO: 20937 - DNA, 25 bp, Homo sapien
tttgtggcactgaaagggcgagagc

SEQ ID NO: 20938 - DNA, 25 bp, Homo sapien
agggcgagagccaagatctcctgat

SEQ ID NO: 20939 - DNA, 25 bp, Homo sapien
agccaagatctcctgatttctgttc

SEQ ID NO: 20940 - DNA, 25 bp, Homo sapien
ttctgttcctgtgttcatagattct

SEQ ID NO: 20941 - DNA, 25 bp, Homo sapien
gttcctgtgttcatagattcttttt

SEQ ID NO: 20942 - DNA, 25 bp, Homo sapien
tgtgttcatagattctttttcctta

SEQ ID NO: 20943 - DNA, 25 bp, Homo sapien
atccctcttgtcagcacggctgaaa

SEQ ID NO: 20944 - DNA, 25 bp, Homo sapien
cagcacggctgaaaggagctgcctg

SEQ ID NO: 20945 - DNA, 25 bp, Homo sapien
tgaggtggctgaggctcatctttga

SEQ ID NO: 20946 - DNA, 25 bp, Homo sapien
tcatctttgaggagcatggaactcg

SEQ ID NO: 20947 - DNA, 25 bp, Homo sapien
gaactcgaggggagaagtcgcgccc

SEQ ID NO: 20948 - DNA, 25 bp, Homo sapien
tggacttgcagaactgcgcacgctc

SEQ ID NO: 20949 - DNA, 25 bp, Homo sapien
cgcacgctccctttctgaaagaaac

SEQ ID NO: 20950 - DNA, 25 bp, Homo sapien
ccgttaccgggtccagactgaatgt

SEQ ID NO: 20951 - DNA, 25 bp, Homo sapien
gggtccagactgaatgtgggcgtaa

SEQ ID NO: 20952 - DNA, 25 bp, Homo sapien
ctcccagtcacttggtcatctgagc

SEQ ID NO: 20953 - DNA, 25 bp, Homo sapien
atctgagccttgagtgtgtccggcc

SEQ ID NO: 20954 - DNA, 25 bp, Homo sapien
ggggtgttctgaatgacttctgtga

SEQ ID NO: 20955 - DNA, 25 bp, Homo sapien
aatgagttcttggtggcccaacctt

SEQ ID NO: 20956 - DNA, 25 bp, Homo sapien
caggcactgtgcattgggttcaaac

SEQ ID NO: 20957 - DNA, 25 bp, Homo sapien
gggttcaaactgttggctggtgcaa

SEQ ID NO: 20958 - DNA, 25 bp, Homo sapien
ggaatgttggtccacttacagcctg

SEQ ID NO: 20959 - DNA, 25 bp, Homo sapien
agtgtgaagtcaccagtacccatgg

SEQ ID NO: 20960 - DNA, 25 bp, Homo sapien
cccatggtgcatctttcctggaata

SEQ ID NO: 20961 - DNA, 25 bp, Homo sapien
agtaagtgccttctgaaactgctgc

SEQ ID NO: 20962 - DNA, 25 bp, Homo sapien
gcagtttctctttgggggtattggt

SEQ ID NO: 20963 - DNA, 25 bp, Homo sapien
attggtagccattcagtattttttt

SEQ ID NO: 20964 - DNA, 25 bp, Homo sapien
tgatatcagcagtccagaagtcttg

SEQ ID NO: 20965 - DNA, 25 bp, Homo sapien
tcccggcgaagacgcctcgccggag

SEQ ID NO: 20966 - DNA, 25 bp, Homo sapien
ccggaggagctgaaccgctactacg

SEQ ID NO: 20967 - DNA, 25 bp, Homo sapien
gtcacccggcagcggtatgggaaaa

SEQ ID NO: 20968 - DNA, 25 bp, Homo sapien
gaaaagagacggcccggacacgctt

SEQ ID NO: 20969 - DNA, 25 bp, Homo sapien
gacacgcttctttccaaaacgttct

SEQ ID NO: 20970 - DNA, 25 bp, Homo sapien
gtcaggtcgcggtaaaagcgcccgt

SEQ ID NO: 20971 - DNA, 25 bp, Homo sapien
cctaccctggcaacatcatttaacg

SEQ ID NO: 20972 - DNA, 25 bp, Homo sapien
gcaacatcatttaacgacgtctccc

SEQ ID NO: 20973 - DNA, 25 bp, Homo sapien
acatcatttaacgacgtctcccagg

SEQ ID NO: 20974 - DNA, 25 bp, Homo sapien
caggtcggagggcccagacctgtgg

SEQ ID NO: 20975 - DNA, 25 bp, Homo sapien
cagccccctgggctggagggctgtg

SEQ ID NO: 20976 - DNA, 25 bp, Homo sapien
ggaaccaagaagcgggtgctcaccc

SEQ ID NO: 20977 - DNA, 25 bp, Homo sapien
aagtccttgctggtgcagacgaagc

SEQ ID NO: 20978 - DNA, 25 bp, Homo sapien
ttaagttcattgacaccacctccaa

SEQ ID NO: 20979 - DNA, 25 bp, Homo sapien
gcctgcgcaaggtggcctgtattgg

SEQ ID NO: 20980 - DNA, 25 bp, Homo sapien
tgtattggggcatggcatcctgctc

SEQ ID NO: 20981 - DNA, 25 bp, Homo sapien
gcacgcgctgggcagaaaggctacc

SEQ ID NO: 20982 - DNA, 25 bp, Homo sapien
taccatcaccgcactgagatcaaca

SEQ ID NO: 20983 - DNA, 25 bp, Homo sapien
gattggccagggctaccttatcaag

SEQ ID NO: 20984 - DNA, 25 bp, Homo sapien
gatcaagaacaatgcctccactgac

SEQ ID NO: 20985 - DNA, 25 bp, Homo sapien
ctccactgactatgacctatctgac

SEQ ID NO: 20986 - DNA, 25 bp, Homo sapien
tcaaccctctgggtggctttgtcca

SEQ ID NO: 20987 - DNA, 25 bp, Homo sapien
acagagcctcttcacatcagaaaca

SEQ ID NO: 20988 - DNA, 25 bp, Homo sapien
agagcctcttcacatcagaaacaat

SEQ ID NO: 20989 - DNA, 25 bp, Homo sapien
cagaaacaatcccagtatcatcctc

SEQ ID NO: 20990 - DNA, 25 bp, Homo sapien
cctctacagactggcaagcagcttt

SEQ ID NO: 20991 - DNA, 25 bp, Homo sapien
gactggcaagcagcttttggctttg

SEQ ID NO: 20992 - DNA, 25 bp, Homo sapien
acttgggttttgatcccttcgatgt

SEQ ID NO: 20993 - DNA, 25 bp, Homo sapien
tgggttttgatcccttcgatgtcac

SEQ ID NO: 20994 - DNA, 25 bp, Homo sapien
tttgatcccttcgatgtcactcgaa

SEQ ID NO: 20995 - DNA, 25 bp, Homo sapien
gatcccttcgatgtcactcgaaaag

SEQ ID NO: 20996 - DNA, 25 bp, Homo sapien
gatgtcactcgaaaagccttagcag

SEQ ID NO: 20997 - DNA, 25 bp, Homo sapien
tcactcgaaaagccttagcagacct

SEQ ID NO: 20998 - DNA, 25 bp, Homo sapien
gtttcataattcagcaagtacagat

SEQ ID NO: 20999 - DNA, 25 bp, Homo sapien
gatgcaagcgcattgcacacttttt

SEQ ID NO: 21000 - DNA, 25 bp, Homo sapien
gacaagtcaaaaagccattcttaga

SEQ ID NO: 21001 - DNA, 25 bp, Homo sapien
ttttatcttctggcccaaagtcaga

SEQ ID NO: 21002 - DNA, 25 bp, Homo sapien
gaaataagctatgtgtccagggtat

SEQ ID NO: 21003 - DNA, 25 bp, Homo sapien
tatgtgtccagggtattgctcccct

SEQ ID NO: 21004 - DNA, 25 bp, Homo sapien
gtattgctcccctgagtgtatatga

SEQ ID NO: 21005 - DNA, 25 bp, Homo sapien
tcccctgagtgtatatgagtgctga

SEQ ID NO: 21006 - DNA, 25 bp, Homo sapien
tttaccaaaatacttccatatcaat

SEQ ID NO: 21007 - DNA, 25 bp, Homo sapien
aagtcttagcatcatcatattgtgc

SEQ ID NO: 21008 - DNA, 25 bp, Homo sapien
catcatcatattgtgctgttttgga

SEQ ID NO: 21009 - DNA, 25 bp, Homo sapien
ctcccagcatcaccaacgagtttgg

SEQ ID NO: 21010 - DNA, 25 bp, Homo sapien
gacgatcatggtgggccaggacggc

SEQ ID NO: 21011 - DNA, 25 bp, Homo sapien
tcatctacaacctctggttcggcta

SEQ ID NO: 21012 - DNA, 25 bp, Homo sapien
tctgcccaacgtcacgacagtggag

SEQ ID NO: 21013 - DNA, 25 bp, Homo sapien
gaccaggcagtgactgcagccctgg

SEQ ID NO: 21014 - DNA, 25 bp, Homo sapien
tcatcgctgtggtgcaagccatcgt

SEQ ID NO: 21015 - DNA, 25 bp, Homo sapien
agctgcctcggactccaggaaaggc

SEQ ID NO: 21016 - DNA, 25 bp, Homo sapien
cggctactgagtgctccaggaggac

SEQ ID NO: 21017 - DNA, 25 bp, Homo sapien
gggacaagatactcaccaggaccag

SEQ ID NO: 21018 - DNA, 25 bp, Homo sapien
cttcccctgtgagcagcagagcagc

SEQ ID NO: 21019 - DNA, 25 bp, Homo sapien
taaatgaggccactgtgccaggctc

SEQ ID NO: 21020 - DNA, 25 bp, Homo sapien
ctcacctgctggagtcttcggtggc

SEQ ID NO: 21021 - DNA, 25 bp, Homo sapien
gtggccaggtatgtcccttacctgg

SEQ ID NO: 21022 - DNA, 25 bp, Homo sapien
ccttacctgggatttcacatgctgg

SEQ ID NO: 21023 - DNA, 25 bp, Homo sapien
tcacatgctggcttccaggagcgtc

SEQ ID NO: 21024 - DNA, 25 bp, Homo sapien
agagaccttccacactgaatctcac

SEQ ID NO: 21025 - DNA, 25 bp, Homo sapien
ggcccacccatgagtgatggttctg

SEQ ID NO: 21026 - DNA, 25 bp, Homo sapien
gatggttctggctgatttgtttgtg

SEQ ID NO: 21027 - DNA, 25 bp, Homo sapien
ttgtttgtgatgttgttagccgcct

SEQ ID NO: 21028 - DNA, 25 bp, Homo sapien
ttagccgcctgtgaggggtgcagag

SEQ ID NO: 21029 - DNA, 25 bp, Homo sapien
gcagagagataatcaccgcaccgtt

SEQ ID NO: 21030 - DNA, 25 bp, Homo sapien
accgcaccgtttccagatgtaatac

SEQ ID NO: 21031 - DNA, 25 bp, Homo sapien
agctaatagatctgtgtgtgacaca

SEQ ID NO: 21032 - DNA, 25 bp, Homo sapien
gtaattgtaccaggttacagcagct

SEQ ID NO: 21033 - DNA, 25 bp, Homo sapien
acagcagctggacatattaggaaca

SEQ ID NO: 21034 - DNA, 25 bp, Homo sapien
caagaatggtaagtccggcatcctt

SEQ ID NO: 21035 - DNA, 25 bp, Homo sapien
tccggcatccttaagaaaactcctg

SEQ ID NO: 21036 - DNA, 25 bp, Homo sapien
gatctttctttacttgatgtgtcct

SEQ ID NO: 21037 - DNA, 25 bp, Homo sapien
tttacttgatgtgtccttctgttcg

SEQ ID NO: 21038 - DNA, 25 bp, Homo sapien
gtgtccttctgttcgcagattgata

SEQ ID NO: 21039 - DNA, 25 bp, Homo sapien
gctagaactgaatgcaagctttcca

SEQ ID NO: 21040 - DNA, 25 bp, Homo sapien
agagctttactcagtgacttaatat

SEQ ID NO: 21041 - DNA, 25 bp, Homo sapien
ggaatcatgctaacttattttcaaa

SEQ ID NO: 21042 - DNA, 25 bp, Homo sapien
gtggtggtgcaggcctgtaatctga

SEQ ID NO: 21043 - DNA, 25 bp, Homo sapien
ggtgcaggcctgtaatctgagctac

SEQ ID NO: 21044 - DNA, 25 bp, Homo sapien
gcaggcctgtaatctgagctacgcg

SEQ ID NO: 21045 - DNA, 25 bp, Homo sapien
gtaatctgagctacgcgggaggctg

SEQ ID NO: 21046 - DNA, 25 bp, Homo sapien
ctgagctacgcgggaggctgaggca

SEQ ID NO: 21047 - DNA, 25 bp, Homo sapien
ggcaggaaaatgcttgaacctggga

SEQ ID NO: 21048 - DNA, 25 bp, Homo sapien
gcagaggtgcaatgatcatgccatt

SEQ ID NO: 21049 - DNA, 25 bp, Homo sapien
gggcaacagagcaaaactgaatctc

SEQ ID NO: 21050 - DNA, 25 bp, Homo sapien
cctgtaatcccggcactttggaggc

SEQ ID NO: 21051 - DNA, 25 bp, Homo sapien
atcccggcactttggaggccgaagt

SEQ ID NO: 21052 - DNA, 25 bp, Homo sapien
ctttggaggccgaagtgggcagatc

SEQ ID NO: 21053 - DNA, 25 bp, Homo sapien
gtaagctgggcagaatggggctcgg

SEQ ID NO: 21054 - DNA, 25 bp, Homo sapien
gaatggggctcggtgagaccaacaa

SEQ ID NO: 21055 - DNA, 25 bp, Homo sapien
gagaccaacaaggtgcagggtgcac

SEQ ID NO: 21056 - DNA, 25 bp, Homo sapien
cagggtgcactgcgtgaggaagcct

SEQ ID NO: 21057 - DNA, 25 bp, Homo sapien
gtgaggaagccttccctcaaaaaga

SEQ ID NO: 21058 - DNA, 25 bp, Homo sapien
ccctcaaaaagatgcctggacctgg

SEQ ID NO: 21059 - DNA, 25 bp, Homo sapien
atgcctggacctggggctagaggag

SEQ ID NO: 21060 - DNA, 25 bp, Homo sapien
ggggctagaggagggtgctgtggta

SEQ ID NO: 21061 - DNA, 25 bp, Homo sapien
agggtgctgtggtacatggcagcca

SEQ ID NO: 21062 - DNA, 25 bp, Homo sapien
atggcagccaggggcttcatttctt

SEQ ID NO: 21063 - DNA, 25 bp, Homo sapien
ggtgcctctattgaagactttgccc

SEQ ID NO: 21064 - DNA, 25 bp, Homo sapien
tggactggagggtggtcctgccatt

SEQ ID NO: 21065 - DNA, 25 bp, Homo sapien
ccaccaggtactgggggcctgtggc

SEQ ID NO: 21066 - DNA, 25 bp, Homo sapien
tgtggcagcaagatagggggagaga

SEQ ID NO: 21067 - DNA, 25 bp, Homo sapien
agagagacccagagatgtgagagag

SEQ ID NO: 21068 - DNA, 25 bp, Homo sapien
cctggttccgacaaggacactgagg

SEQ ID NO: 21069 - DNA, 25 bp, Homo sapien
ggccaaggagaaggctcgagccatg

SEQ ID NO: 21070 - DNA, 25 bp, Homo sapien
ggctcgagccatgcgagtcaacaag

SEQ ID NO: 21071 - DNA, 25 bp, Homo sapien
gccatgcgagtcaacaagcgcgcgc

SEQ ID NO: 21072 - DNA, 25 bp, Homo sapien
tcaacaagcgcgcgccacagatgga

SEQ ID NO: 21073 - DNA, 25 bp, Homo sapien
cgcgcgccacagatggactggaaca

SEQ ID NO: 21074 - DNA, 25 bp, Homo sapien
gaacaggaagcgtgaaatcttcagc

SEQ ID NO: 21075 - DNA, 25 bp, Homo sapien
ggcttagcaagttcagcctggttaa

SEQ ID NO: 21076 - DNA, 25 bp, Homo sapien
gcaagttcagcctggttaagtccaa

SEQ ID NO: 21077 - DNA, 25 bp, Homo sapien
gcagcagcagcagcatcacggaaac

SEQ ID NO: 21078 - DNA, 25 bp, Homo sapien
agcagcagcagcatcacggaaactc

SEQ ID NO: 21079 - DNA, 25 bp, Homo sapien
cagcagcagcatcacggaaactctg

SEQ ID NO: 21080 - DNA, 25 bp, Homo sapien
gcagcagcatcacggaaactctggg

SEQ ID NO: 21081 - DNA, 25 bp, Homo sapien
agttcagcctggttaagtccaagct

SEQ ID NO: 21082 - DNA, 25 bp, Homo sapien
agcagcatcacggaaactctgggcc

SEQ ID NO: 21083 - DNA, 25 bp, Homo sapien
cagcctggttaagtccaagctgcca

SEQ ID NO: 21084 - DNA, 25 bp, Homo sapien
cctggttaagtccaagctgccacca

SEQ ID NO: 21085 - DNA, 25 bp, Homo sapien
tcttagccaacagcaatgcccatcc

SEQ ID NO: 21086 - DNA, 25 bp, Homo sapien
ctttgccagtacccgctgtaggaat

SEQ ID NO: 21087 - DNA, 25 bp, Homo sapien
cagtacccgctgtaggaattggcac

SEQ ID NO: 21088 - DNA, 25 bp, Homo sapien
tacccgctgtaggaattggcacagt

SEQ ID NO: 21089 - DNA, 25 bp, Homo sapien
cagcatgaagatatcctcgccaaga

SEQ ID NO: 21090 - DNA, 25 bp, Homo sapien
tgaagatatcctcgccaagaccttc

SEQ ID NO: 21091 - DNA, 25 bp, Homo sapien
ctcgccaagaccttcgcttgatgat

SEQ ID NO: 21092 - DNA, 25 bp, Homo sapien
agaccttcgcttgatgatgactttt

SEQ ID NO: 21093 - DNA, 25 bp, Homo sapien
accttcgcttgatgatgacttttga

SEQ ID NO: 21094 - DNA, 25 bp, Homo sapien
tgatgacttttgaagaaacactatt

SEQ ID NO: 21095 - DNA, 25 bp, Homo sapien
gaaaatggccattaaggccgggtgg

SEQ ID NO: 21096 - DNA, 25 bp, Homo sapien
atggccattaaggccgggtggggtg

SEQ ID NO: 21097 - DNA, 25 bp, Homo sapien
tcctctagccatcccttggggaagg

SEQ ID NO: 21098 - DNA, 25 bp, Homo sapien
ccccactggacaacactgattcctg

SEQ ID NO: 21099 - DNA, 25 bp, Homo sapien
ggaccccactggctgagaatctggg

SEQ ID NO: 21100 - DNA, 25 bp, Homo sapien
ggaaaatgtttccttgtgcctgctc

SEQ ID NO: 21101 - DNA, 25 bp, Homo sapien
catcacctgaaacactggacctggg

SEQ ID NO: 21102 - DNA, 25 bp, Homo sapien
ttcccacttgcagtcttgtagctag

SEQ ID NO: 21103 - DNA, 25 bp, Homo sapien
gactctctaagcctatacgtttctg

SEQ ID NO: 21104 - DNA, 25 bp, Homo sapien
aatagggtgcaacgcccatagcctt

SEQ ID NO: 21105 - DNA, 25 bp, Homo sapien
catagccttggggttggacatctct

SEQ ID NO: 21106 - DNA, 25 bp, Homo sapien
ggacatctctagtgtagctgccaca

SEQ ID NO: 21107 - DNA, 25 bp, Homo sapien
gaggcaattttaatccctgcactag

SEQ ID NO: 21108 - DNA, 25 bp, Homo sapien
gggtggcagccaagaaaggcacaga

SEQ ID NO: 21109 - DNA, 25 bp, Homo sapien
aaatttgcaatggcggcccagcacc

SEQ ID NO: 21110 - DNA, 25 bp, Homo sapien
cttcaacctgctgtatcctgtgagc

SEQ ID NO: 21111 - DNA, 25 bp, Homo sapien
caacctgctgtatcctgtgagcact

SEQ ID NO: 21112 - DNA, 25 bp, Homo sapien
ctcaatcttcacccactaggatttg

SEQ ID NO: 21113 - DNA, 25 bp, Homo sapien
tcacccactaggatttgggttctgc

SEQ ID NO: 21114 - DNA, 25 bp, Homo sapien
ttgggttctgcctgtggctatttgc

SEQ ID NO: 21115 - DNA, 25 bp, Homo sapien
gttctgcctgtggctatttgctaca

SEQ ID NO: 21116 - DNA, 25 bp, Homo sapien
ctgtggctatttgctacaagaggtt

SEQ ID NO: 21117 - DNA, 25 bp, Homo sapien
tacaagaggttaggaagcccaagaa

SEQ ID NO: 21118 - DNA, 25 bp, Homo sapien
aaactgaagccaactgtgaataaac

SEQ ID NO: 21119 - DNA, 25 bp, Homo sapien
taaacccttttccatccaggaactg

SEQ ID NO: 21120 - DNA, 25 bp, Homo sapien
atccaggaactggaactccgttctc

SEQ ID NO: 21121 - DNA, 25 bp, Homo sapien
caggaactggaactccgttctctgg

SEQ ID NO: 21122 - DNA, 25 bp, Homo sapien
agcagctacagccccgaaggggtgg

SEQ ID NO: 21123 - DNA, 25 bp, Homo sapien
tacagccccgaaggggtggagcccg

SEQ ID NO: 21124 - DNA, 25 bp, Homo sapien
cagtctgacccacgacaaggggctc

SEQ ID NO: 21125 - DNA, 25 bp, Homo sapien
agcacctggaagagctcgacaagag

SEQ ID NO: 21126 - DNA, 25 bp, Homo sapien
agagctcgacaagagccacctggag

SEQ ID NO: 21127 - DNA, 25 bp, Homo sapien
gacaagagccacctggagggggagc

SEQ ID NO: 21128 - DNA, 25 bp, Homo sapien
ccaggccccgtgaagcttggcgggg

SEQ ID NO: 21129 - DNA, 25 bp, Homo sapien
ggccccgtgaagcttggcggggagg

SEQ ID NO: 21130 - DNA, 25 bp, Homo sapien
gattgggccagtctctgggtcaagt

SEQ ID NO: 21131 - DNA, 25 bp, Homo sapien
cttccctcactggccagatatcaaa

SEQ ID NO: 21132 - DNA, 25 bp, Homo sapien
ggatatgctgatggagggcacggag

SEQ ID NO: 21133 - DNA, 25 bp, Homo sapien
gaagccattcatgcaatcttgagat

SEQ ID NO: 21134 - DNA, 25 bp, Homo sapien
gagatcagagttgcctttgtgtaca

SEQ ID NO: 21135 - DNA, 25 bp, Homo sapien
ctttgtgtacacacctgctttcagc

SEQ ID NO: 21136 - DNA, 25 bp, Homo sapien
ctgctttcagccttctacatatgaa

SEQ ID NO: 21137 - DNA, 25 bp, Homo sapien
tcagccttctacatatgaacatatc

SEQ ID NO: 21138 - DNA, 25 bp, Homo sapien
agaatactgtcacatggccaggcat

SEQ ID NO: 21139 - DNA, 25 bp, Homo sapien
tacaaaattcgctgggcgtggtggc

SEQ ID NO: 21140 - DNA, 25 bp, Homo sapien
gggcaacaagagcgagactctcaaa

SEQ ID NO: 21141 - DNA, 25 bp, Homo sapien
aaatatacatactaggcaaatccat

SEQ ID NO: 21142 - DNA, 25 bp, Homo sapien
agtggttgccaggggatagaggagt

SEQ ID NO: 21143 - DNA, 25 bp, Homo sapien
gaggagtaattgttagtgggcatgg

SEQ ID NO: 21144 - DNA, 25 bp, Homo sapien
gtgggcatgggatttgtttttggga

SEQ ID NO: 21145 - DNA, 25 bp, Homo sapien
tttttgacacggagtctcactctgt

SEQ ID NO: 21146 - DNA, 25 bp, Homo sapien
gtagctgggattataggtacatgcc

SEQ ID NO: 21147 - DNA, 25 bp, Homo sapien
taggtacatgccatcacacctggct

SEQ ID NO: 21148 - DNA, 25 bp, Homo sapien
gagatgaggtttcaccattttggcc

SEQ ID NO: 21149 - DNA, 25 bp, Homo sapien
caccattttggccaggctgatcttg

SEQ ID NO: 21150 - DNA, 25 bp, Homo sapien
tacaggtgggagccacaacacccga

SEQ ID NO: 21151 - DNA, 25 bp, Homo sapien
acacccgaccatgaattaactccgt

SEQ ID NO: 21152 - DNA, 25 bp, Homo sapien
aactcccaaatctggttgatgcctt

SEQ ID NO: 21153 - DNA, 25 bp, Homo sapien
ggttgatgcctttgacagtgatgaa

SEQ ID NO: 21154 - DNA, 25 bp, Homo sapien
acgatttcaccacatctgaatccag

SEQ ID NO: 21155 - DNA, 25 bp, Homo sapien
ctgaatccagagaaaccggcttttt

SEQ ID NO: 21156 - DNA, 25 bp, Homo sapien
ccggctttttttcttattgcgagca

SEQ ID NO: 21157 - DNA, 25 bp, Homo sapien
gtggggaattgtatattgcgctgaa

SEQ ID NO: 21158 - DNA, 25 bp, Homo sapien
gcctcttgtaatgctctggtgggtt

SEQ ID NO: 21159 - DNA, 25 bp, Homo sapien
ggtgggttcttgtttgggaatgcga

SEQ ID NO: 21160 - DNA, 25 bp, Homo sapien
gggaatgcgatattttgtggctggt

SEQ ID NO: 21161 - DNA, 25 bp, Homo sapien
aggtatcaaaactgtgcttccatta

SEQ ID NO: 21162 - DNA, 25 bp, Homo sapien
actgtgcttccattattagtgcaag

SEQ ID NO: 21163 - DNA, 25 bp, Homo sapien
cactgagaagcggggccggggcagg

SEQ ID NO: 21164 - DNA, 25 bp, Homo sapien
gtcccgggacagcgctggtagggag

SEQ ID NO: 21165 - DNA, 25 bp, Homo sapien
gtcagaaggagcccagcgaagtgcc

SEQ ID NO: 21166 - DNA, 25 bp, Homo sapien
tgccaacacctaagagacctcgggg

SEQ ID NO: 21167 - DNA, 25 bp, Homo sapien
catctcgcaggagtcctcggaggag

SEQ ID NO: 21168 - DNA, 25 bp, Homo sapien
ggaggaggagcagtgacccatgcgt

SEQ ID NO: 21169 - DNA, 25 bp, Homo sapien
cactggaggagcagcttccttctgg

SEQ ID NO: 21170 - DNA, 25 bp, Homo sapien
ttctgggactggacagctttgctcc

SEQ ID NO: 21171 - DNA, 25 bp, Homo sapien
cttccacctgctccttagagaaggg

SEQ ID NO: 21172 - DNA, 25 bp, Homo sapien
gagtggggagcagttttcccctggc

SEQ ID NO: 21173 - DNA, 25 bp, Homo sapien
agtgagtcgagctcgaagtccagcc

SEQ ID NO: 21174 - DNA, 25 bp, Homo sapien
tcccctgagtggcctaatgggcatc

SEQ ID NO: 21175 - DNA, 25 bp, Homo sapien
agtggcctaatgggcatctcaccac

SEQ ID NO: 21176 - DNA, 25 bp, Homo sapien
accacggcccacagagaactgatct

SEQ ID NO: 21177 - DNA, 25 bp, Homo sapien
agaactgatctactcgattttccct

SEQ ID NO: 21178 - DNA, 25 bp, Homo sapien
tgcagtctacccatgtcagtcaatg

SEQ ID NO: 21179 - DNA, 25 bp, Homo sapien
gtctacccatgtcagtcaatggcaa

SEQ ID NO: 21180 - DNA, 25 bp, Homo sapien
cagtcaatggcaacaccatcctctt

SEQ ID NO: 21181 - DNA, 25 bp, Homo sapien
acgcaggtgaggggatccggaacgc

SEQ ID NO: 21182 - DNA, 25 bp, Homo sapien
tgaggggatccggaacgcgagaccg

SEQ ID NO: 21183 - DNA, 25 bp, Homo sapien
tccggaacgcgagaccggaggcggc

SEQ ID NO: 21184 - DNA, 25 bp, Homo sapien
cagcatcgccgggaggtgtttgggg

SEQ ID NO: 21185 - DNA, 25 bp, Homo sapien
ctccgaggcagtgaccagaacgtgg

SEQ ID NO: 21186 - DNA, 25 bp, Homo sapien
agaacgtggtctcaaggtggtgggg

SEQ ID NO: 21187 - DNA, 25 bp, Homo sapien
caaggtggtgggggctatgggggct

SEQ ID NO: 21188 - DNA, 25 bp, Homo sapien
ggctatgggggctgcagggggtagc

SEQ ID NO: 21189 - DNA, 25 bp, Homo sapien
tgggggctgcagggggtagccctgc

SEQ ID NO: 21190 - DNA, 25 bp, Homo sapien
cactttgtcacgggagcccagggta

SEQ ID NO: 21191 - DNA, 25 bp, Homo sapien
tgcactgcgggctaaacatgtttcc

SEQ ID NO: 21192 - DNA, 25 bp, Homo sapien
ctctcgcctgctctcagcaggaagg

SEQ ID NO: 21193 - DNA, 25 bp, Homo sapien
ggcccggggtggtgaagtagctgga

SEQ ID NO: 21194 - DNA, 25 bp, Homo sapien
gtgaagtagctggagcccgatcaca

SEQ ID NO: 21195 - DNA, 25 bp, Homo sapien
caccttctagatgaccccttaataa

SEQ ID NO: 21196 - DNA, 25 bp, Homo sapien
gagcagcaagctccttagagggtag

SEQ ID NO: 21197 - DNA, 25 bp, Homo sapien
gagggtagggagtgacccaggctct

SEQ ID NO: 21198 - DNA, 25 bp, Homo sapien
gtgacccaggctctttgaagtaggt

SEQ ID NO: 21199 - DNA, 25 bp, Homo sapien
gacctttgaggtctccattcaatta

SEQ ID NO: 21200 - DNA, 25 bp, Homo sapien
aaaggcctctagaacagcactgaca

SEQ ID NO: 21201 - DNA, 25 bp, Homo sapien
gacaggcaaaaagcggacctggtct

SEQ ID NO: 21202 - DNA, 25 bp, Homo sapien
gcggacctggtcttaacatgaaaaa

SEQ ID NO: 21203 - DNA, 25 bp, Homo sapien
acaaacctttaatgcaatcctcagt

SEQ ID NO: 21204 - DNA, 25 bp, Homo sapien
tgcaatcctcagtcagcaatttaga

SEQ ID NO: 21205 - DNA, 25 bp, Homo sapien
aatctactttctaacatggacactt

SEQ ID NO: 21206 - DNA, 25 bp, Homo sapien
atggacactttgtggttcttccttt

SEQ ID NO: 21207 - DNA, 25 bp, Homo sapien
aaagctgtgtgacacctggcattcc

SEQ ID NO: 21208 - DNA, 25 bp, Homo sapien
cattcctctctgttcatggagcttc

SEQ ID NO: 21209 - DNA, 25 bp, Homo sapien
ttactatctagacctctctggctaa

SEQ ID NO: 21210 - DNA, 25 bp, Homo sapien
tctggctaatacctattctccaacc

SEQ ID NO: 21211 - DNA, 25 bp, Homo sapien
accacctcggttactctgacatagg

SEQ ID NO: 21212 - DNA, 25 bp, Homo sapien
gaatttacttcttttccttgagtgg

SEQ ID NO: 21213 - DNA, 25 bp, Homo sapien
acacactgtgctgcaatctactgtt

SEQ ID NO: 21214 - DNA, 25 bp, Homo sapien
gatcgcagagttgtatttcctcaca

SEQ ID NO: 21215 - DNA, 25 bp, Homo sapien
tatttcctcacaaacttctttacga

SEQ ID NO: 21216 - DNA, 25 bp, Homo sapien
ttttgtacctctcagtttcagtcag

SEQ ID NO: 21217 - DNA, 25 bp, Homo sapien
gattgtgcctatgcgtgatgagtga

SEQ ID NO: 21218 - DNA, 25 bp, Homo sapien
ttctttggaactttggctggtctgt

SEQ ID NO: 21219 - DNA, 25 bp, Homo sapien
tggctggtctgtatcattattttga

SEQ ID NO: 21220 - DNA, 25 bp, Homo sapien
ttgaaaatctccttgatgtttacaa

SEQ ID NO: 21221 - DNA, 25 bp, Homo sapien
gatgtttacaagctacctgactact

SEQ ID NO: 21222 - DNA, 25 bp, Homo sapien
aagctacctgactactttatctttt

SEQ ID NO: 21223 - DNA, 25 bp, Homo sapien
gattagggtgacctagttccacatg

SEQ ID NO: 21224 - DNA, 25 bp, Homo sapien
gttccacatggcctgaaggtaacat

SEQ ID NO: 21225 - DNA, 25 bp, Homo sapien
tttatacctcttattgtttcaaatt

SEQ ID NO: 21226 - DNA, 25 bp, Homo sapien
gtttcaaattctctatcctttctaa

SEQ ID NO: 21227 - DNA, 25 bp, Homo sapien
tctgttaaacaggctgcttccttgg

SEQ ID NO: 21228 - DNA, 25 bp, Homo sapien
gagacttctattgtacctcaaatag

SEQ ID NO: 21229 - DNA, 25 bp, Homo sapien
ataaaacccatacattccactttct

SEQ ID NO: 21230 - DNA, 25 bp, Homo sapien
acccatacattccactttctgttgg

SEQ ID NO: 21231 - DNA, 25 bp, Homo sapien
acattccactttctgttgggttcaa

SEQ ID NO: 21232 - DNA, 25 bp, Homo sapien
ctttctgttgggttcaatatacgga

SEQ ID NO: 21233 - DNA, 25 bp, Homo sapien
aatatacggagagtgccctgtgcca

SEQ ID NO: 21234 - DNA, 25 bp, Homo sapien
tatacggagagtgccctgtgccaaa

SEQ ID NO: 21235 - DNA, 25 bp, Homo sapien
ctgtgccaaagccacgagttgatcg

SEQ ID NO: 21236 - DNA, 25 bp, Homo sapien
aaagccacgagttgatcgtccaaga

SEQ ID NO: 21237 - DNA, 25 bp, Homo sapien
gatcgtccaagaaaagttcctgtga

SEQ ID NO: 21238 - DNA, 25 bp, Homo sapien
caagaaaagttcctgtgatacaaga

SEQ ID NO: 21239 - DNA, 25 bp, Homo sapien
acaagaggagagggcaatgcctgcc

SEQ ID NO: 21240 - DNA, 25 bp, Homo sapien
ggagagaccccttcagagcagggat

SEQ ID NO: 21241 - DNA, 25 bp, Homo sapien
gaccccttcagagcagggattgtgc

SEQ ID NO: 21242 - DNA, 25 bp, Homo sapien
agggattgtgccgggagagtgcctc

SEQ ID NO: 21243 - DNA, 25 bp, Homo sapien
tttgggacatttcatccacagaaat

SEQ ID NO: 21244 - DNA, 25 bp, Homo sapien
cagaaatttccaagccaatggtttc

SEQ ID NO: 21245 - DNA, 25 bp, Homo sapien
cagcagatggaccatgcccttgctg

SEQ ID NO: 21246 - DNA, 25 bp, Homo sapien
gaaagaagtgtctctgttgggggac

SEQ ID NO: 21247 - DNA, 25 bp, Homo sapien
ttgggggacagaggaacctggggag

SEQ ID NO: 21248 - DNA, 25 bp, Homo sapien
gcatgtcctacaatctgctcttaga

SEQ ID NO: 21249 - DNA, 25 bp, Homo sapien
ctcttagacacggccttgccaggag

SEQ ID NO: 21250 - DNA, 25 bp, Homo sapien
ttagacacggccttgccaggagagc

SEQ ID NO: 21251 - DNA, 25 bp, Homo sapien
agcaaatatcaggcctgtcgcacac

SEQ ID NO: 21252 - DNA, 25 bp, Homo sapien
tgtcgcacacgggcggcatttaaat

SEQ ID NO: 21253 - DNA, 25 bp, Homo sapien
taagggatggtctatgaggcataca

SEQ ID NO: 21254 - DNA, 25 bp, Homo sapien
agatttgatgtgatccttttctccc

SEQ ID NO: 21255 - DNA, 25 bp, Homo sapien
ccctcccttccataatggatcgtgg

SEQ ID NO: 21256 - DNA, 25 bp, Homo sapien
gatcgtggtctgtgtgactgaaccc

SEQ ID NO: 21257 - DNA, 25 bp, Homo sapien
gactgaacccacacagagtgtcatg

SEQ ID NO: 21258 - DNA, 25 bp, Homo sapien
gtcatgggtgacagtttctggttga

SEQ ID NO: 21259 - DNA, 25 bp, Homo sapien
gtttctggttgaagtagctccacgc

SEQ ID NO: 21260 - DNA, 25 bp, Homo sapien
ggacagcagattcttttccttctca

SEQ ID NO: 21261 - DNA, 25 bp, Homo sapien
tttccttctcacaaggggctcattt

SEQ ID NO: 21262 - DNA, 25 bp, Homo sapien
gagtctgagcacgagttgcagccag

SEQ ID NO: 21263 - DNA, 25 bp, Homo sapien
ggccagtgggagggggtctgggcca

SEQ ID NO: 21264 - DNA, 25 bp, Homo sapien
ttccactgcctcgtgtgacatgagg

SEQ ID NO: 21265 - DNA, 25 bp, Homo sapien
tgtgacatgaggcccattcttcact

SEQ ID NO: 21266 - DNA, 25 bp, Homo sapien
gtgagtttctgttctattggatgac

SEQ ID NO: 21267 - DNA, 25 bp, Homo sapien
gagatttatctttgtttcctgttgg

SEQ ID NO: 21268 - DNA, 25 bp, Homo sapien
tgggaaatccattccattttgtgaa

SEQ ID NO: 21269 - DNA, 25 bp, Homo sapien
gatacttaattcttgccttatacct

SEQ ID NO: 21270 - DNA, 25 bp, Homo sapien
ccttatacctcactctattctgtaa

SEQ ID NO: 21271 - DNA, 25 bp, Homo sapien
tggatacctggatatccttggcttc

SEQ ID NO: 21272 - DNA, 25 bp, Homo sapien
ggatatccttggcttctttgagaat

SEQ ID NO: 21273 - DNA, 25 bp, Homo sapien
ggaagaagtttgagctgctgcccac

SEQ ID NO: 21274 - DNA, 25 bp, Homo sapien
ggcttcgcggagcacagctccgagc

SEQ ID NO: 21275 - DNA, 25 bp, Homo sapien
ccgagctgggtcacggagatgctgc

SEQ ID NO: 21276 - DNA, 25 bp, Homo sapien
agctgggtcacggagatgctgcttg

SEQ ID NO: 21277 - DNA, 25 bp, Homo sapien
gggtcacggagatgctgcttgagaa

SEQ ID NO: 21278 - DNA, 25 bp, Homo sapien
gagatgctgcttgagaacgagctgt

SEQ ID NO: 21279 - DNA, 25 bp, Homo sapien
gcttgagaacgagctgtggggcagc

SEQ ID NO: 21280 - DNA, 25 bp, Homo sapien
agcgcgccgtgagcgagaagctgca

SEQ ID NO: 21281 - DNA, 25 bp, Homo sapien
gcgcgccgtgagcgagaagctgcag

SEQ ID NO: 21282 - DNA, 25 bp, Homo sapien
ccgtgaacaagcgcgagccagcgcc

SEQ ID NO: 21283 - DNA, 25 bp, Homo sapien
tcgggggcgggtattgccgccccag

SEQ ID NO: 21284 - DNA, 25 bp, Homo sapien
ggagtaggccgagggagtgaggagg

SEQ ID NO: 21285 - DNA, 25 bp, Homo sapien
ggaggcaagggtgttccttaaggag

SEQ ID NO: 21286 - DNA, 25 bp, Homo sapien
gaggcagtatggcatgtttgagttg

SEQ ID NO: 21287 - DNA, 25 bp, Homo sapien
gtatggcatgtttgagttgctgata

SEQ ID NO: 21288 - DNA, 25 bp, Homo sapien
gctgatagaatttttgtgcggcaaa

SEQ ID NO: 21289 - DNA, 25 bp, Homo sapien
agcacagaatgccaggtaagggcct

SEQ ID NO: 21290 - DNA, 25 bp, Homo sapien
tgccaggtaagggcctagaaggcta

SEQ ID NO: 21291 - DNA, 25 bp, Homo sapien
gctagtctatggggttaaactctca

SEQ ID NO: 21292 - DNA, 25 bp, Homo sapien
ggaaaggtttcctggagcaagcaat

SEQ ID NO: 21293 - DNA, 25 bp, Homo sapien
tggagcaagcaatggctgagctaag

SEQ ID NO: 21294 - DNA, 25 bp, Homo sapien
atggctgagctaagatctgaagaat

SEQ ID NO: 21295 - DNA, 25 bp, Homo sapien
ggtgactaaatggagtacctggagt

SEQ ID NO: 21296 - DNA, 25 bp, Homo sapien
ggagtacaagataacacacacacac

SEQ ID NO: 21297 - DNA, 25 bp, Homo sapien
agcagccccgagaggatttgatagc

SEQ ID NO: 21298 - DNA, 25 bp, Homo sapien
ggatttgatagcttcaccgcttcac

SEQ ID NO: 21299 - DNA, 25 bp, Homo sapien
aaatgcggagactgaggtttagggc

SEQ ID NO: 21300 - DNA, 25 bp, Homo sapien
gaggtttagggcagttaagcttctt

SEQ ID NO: 21301 - DNA, 25 bp, Homo sapien
gggcagttaagcttcttgcttagca

SEQ ID NO: 21302 - DNA, 25 bp, Homo sapien
tcttgcttagcatcatgtaggtaaa

SEQ ID NO: 21303 - DNA, 25 bp, Homo sapien
ttgaacccgacctgggcaattccac

SEQ ID NO: 21304 - DNA, 25 bp, Homo sapien
gagggctgtcctcagaatgaatctt

SEQ ID NO: 21305 - DNA, 25 bp, Homo sapien
aatcttctgatgggctgggcacggt

SEQ ID NO: 21306 - DNA, 25 bp, Homo sapien
gaggggtgcccggagggaagagcgc

SEQ ID NO: 21307 - DNA, 25 bp, Homo sapien
gagggaagagcgcggtgggggcgcc

SEQ ID NO: 21308 - DNA, 25 bp, Homo sapien
ccctggggctatggccatggtgacc

SEQ ID NO: 21309 - DNA, 25 bp, Homo sapien
cggcgacacgaacggcgtggacaag

SEQ ID NO: 21310 - DNA, 25 bp, Homo sapien
cacgaacggcgtggacaaggcgggc

SEQ ID NO: 21311 - DNA, 25 bp, Homo sapien
gctgcaggtggactgcgtggtgtgc

SEQ ID NO: 21312 - DNA, 25 bp, Homo sapien
gtcgagcggcaagcattacggtgtc

SEQ ID NO: 21313 - DNA, 25 bp, Homo sapien
gcggcaagcattacggtgtcttcac

SEQ ID NO: 21314 - DNA, 25 bp, Homo sapien
aagcattacggtgtcttcacctgcg

SEQ ID NO: 21315 - DNA, 25 bp, Homo sapien
gagctttttcaagcgaagcatccgc

SEQ ID NO: 21316 - DNA, 25 bp, Homo sapien
ttttcaagcgaagcatccgccgcaa

SEQ ID NO: 21317 - DNA, 25 bp, Homo sapien
gtcttccacactggtgctaactggc

SEQ ID NO: 21318 - DNA, 25 bp, Homo sapien
gcagctggaggctacgcatggcctc

SEQ ID NO: 21319 - DNA, 25 bp, Homo sapien
cagctggagagggcttctgtccctg

SEQ ID NO: 21320 - DNA, 25 bp, Homo sapien
ctcgtggaggtgccgtgctttaaag

SEQ ID NO: 21321 - DNA, 25 bp, Homo sapien
taaagaggccttagtgcccgggatg

SEQ ID NO: 21322 - DNA, 25 bp, Homo sapien
tgctctcctggtcactgcagaatga

SEQ ID NO: 21323 - DNA, 25 bp, Homo sapien
gaaggtgaagctccatgcatgtgtg

SEQ ID NO: 21324 - DNA, 25 bp, Homo sapien
gtgtgcgcgggtgtatgtgcgctca

SEQ ID NO: 21325 - DNA, 25 bp, Homo sapien
tgcgctcagggtctctgtttaagta

SEQ ID NO: 21326 - DNA, 25 bp, Homo sapien
gagaccaacaggctacagtgtccct

SEQ ID NO: 21327 - DNA, 25 bp, Homo sapien
ggggagatgcggttcacaatgcctc

SEQ ID NO: 21328 - DNA, 25 bp, Homo sapien
aggccagggattagccactgtggga

SEQ ID NO: 21329 - DNA, 25 bp, Homo sapien
aatggttcagtggcctggctgttgg

SEQ ID NO: 21330 - DNA, 25 bp, Homo sapien
tggcaggaactccaagtgcccaggc

SEQ ID NO: 21331 - DNA, 25 bp, Homo sapien
gcctctgtttcatgatgcatgggtc

SEQ ID NO: 21332 - DNA, 25 bp, Homo sapien
gcatgggtcatttgtcttgggtgtc

SEQ ID NO: 21333 - DNA, 25 bp, Homo sapien
gggtgtcctatcccatatggagaag

SEQ ID NO: 21334 - DNA, 25 bp, Homo sapien
ggtgactttgcagatctgctcaccc

SEQ ID NO: 21335 - DNA, 25 bp, Homo sapien
tgctgggctgggtcgcgtagcccag

SEQ ID NO: 21336 - DNA, 25 bp, Homo sapien
tcatgcccatgcttgattcttgcac

SEQ ID NO: 21337 - DNA, 25 bp, Homo sapien
gaaggcatccgactgcattaagtgt

SEQ ID NO: 21338 - DNA, 25 bp, Homo sapien
aaagacatttacaactaggccaggg

SEQ ID NO: 21339 - DNA, 25 bp, Homo sapien
gcacttagactatgcactttttctg

SEQ ID NO: 21340 - DNA, 25 bp, Homo sapien
aaggttgtggtgtagttggtctgta

SEQ ID NO: 21341 - DNA, 25 bp, Homo sapien
ggtgttttttgtcctggtatatcgt

SEQ ID NO: 21342 - DNA, 25 bp, Homo sapien
tggtatatcgtcattccatctgcag

SEQ ID NO: 21343 - DNA, 25 bp, Homo sapien
gagctggaatcccattgatcttcta

SEQ ID NO: 21344 - DNA, 25 bp, Homo sapien
tgatcttctagctaccattcatttt

SEQ ID NO: 21345 - DNA, 25 bp, Homo sapien
gaatgctgttactaatcctgttacg

SEQ ID NO: 21346 - DNA, 25 bp, Homo sapien
gaagacacatcactctgaaattgga

SEQ ID NO: 21347 - DNA, 25 bp, Homo sapien
cacttaaggctccacagtggcttac

SEQ ID NO: 21348 - DNA, 25 bp, Homo sapien
gggagatggccattctaactactgt

SEQ ID NO: 21349 - DNA, 25 bp, Homo sapien
tgaatgtctctgttttgggaaggta

SEQ ID NO: 21350 - DNA, 25 bp, Homo sapien
taattcttgtaaagtttcttaactg

SEQ ID NO: 21351 - DNA, 25 bp, Homo sapien
gtattaaaccagattattcacagta

SEQ ID NO: 21352 - DNA, 25 bp, Homo sapien
gagctgaggtaatacagatccaagg

SEQ ID NO: 21353 - DNA, 25 bp, Homo sapien
acatcaatactataatcttaaggac

SEQ ID NO: 21354 - DNA, 25 bp, Homo sapien
tcttaaggacttggtggacatcaca

SEQ ID NO: 21355 - DNA, 25 bp, Homo sapien
tggtggacatcacaaaacaacctgt

SEQ ID NO: 21356 - DNA, 25 bp, Homo sapien
aaaacaacctgtggtgtacctgaag

SEQ ID NO: 21357 - DNA, 25 bp, Homo sapien
aaagggatccacaaaaacacatggg

SEQ ID NO: 21358 - DNA, 25 bp, Homo sapien
gaagccagagtacagacactatcaa

SEQ ID NO: 21359 - DNA, 25 bp, Homo sapien
gtgactaagaagactcctagccagc

SEQ ID NO: 21360 - DNA, 25 bp, Homo sapien
ctaagaagactcctagccagcatgc

SEQ ID NO: 21361 - DNA, 25 bp, Homo sapien
ttgccacagcaatttcattctctta

SEQ ID NO: 21362 - DNA, 25 bp, Homo sapien
acagcaatttcattctcttatcgga

SEQ ID NO: 21363 - DNA, 25 bp, Homo sapien
attttacctacagatacttatgaag

SEQ ID NO: 21364 - DNA, 25 bp, Homo sapien
gaagacattctttcgctatcgtgag

SEQ ID NO: 21365 - DNA, 25 bp, Homo sapien
cattctttcgctatcgtgagtaaaa

SEQ ID NO: 21366 - DNA, 25 bp, Homo sapien
agtatataaagctgtttctaactga

SEQ ID NO: 21367 - DNA, 25 bp, Homo sapien
gctgtttctaactgaaaatgcttga

SEQ ID NO: 21368 - DNA, 25 bp, Homo sapien
ttaacttaatatgaaaactctccaa

SEQ ID NO: 21369 - DNA, 25 bp, Homo sapien
aactctccaagtcttgatcatcagc

SEQ ID NO: 21370 - DNA, 25 bp, Homo sapien
caagtcttgatcatcagccaggatt

SEQ ID NO: 21371 - DNA, 25 bp, Homo sapien
agccaggattttgccacagcaattt

SEQ ID NO: 21372 - DNA, 25 bp, Homo sapien
gaaatacttcctaattcttctcaag

SEQ ID NO: 21373 - DNA, 25 bp, Homo sapien
aattcttctcaaggctgttggtaac

SEQ ID NO: 21374 - DNA, 25 bp, Homo sapien
gctgttggtaactttatttcagata

SEQ ID NO: 21375 - DNA, 25 bp, Homo sapien
gagaggaattgatggtttctgagaa

SEQ ID NO: 21376 - DNA, 25 bp, Homo sapien
ggtacattcatcctcacagattgca

SEQ ID NO: 21377 - DNA, 25 bp, Homo sapien
gagtatcttgtaaccattacctata

SEQ ID NO: 21378 - DNA, 25 bp, Homo sapien
atatgctttctctgtgtgtgtacct

SEQ ID NO: 21379 - DNA, 25 bp, Homo sapien
gtgtgtacctgttgtatgtcctaaa

SEQ ID NO: 21380 - DNA, 25 bp, Homo sapien
ggtaaagccatgttttgacttggtg

SEQ ID NO: 21381 - DNA, 25 bp, Homo sapien
ggttgtcaaacagcccattaagctc

SEQ ID NO: 21382 - DNA, 25 bp, Homo sapien
cattaagctccctggtatttcacct

SEQ ID NO: 21383 - DNA, 25 bp, Homo sapien
ctcagcatttagtgaaggtaattcc

SEQ ID NO: 21384 - DNA, 25 bp, Homo sapien
ggtaattccaaaatactggtatcag

SEQ ID NO: 21385 - DNA, 25 bp, Homo sapien
actggtatcagtactcttatttata

SEQ ID NO: 21386 - DNA, 25 bp, Homo sapien
aagtgtacggaatgcataacatgaa

SEQ ID NO: 21387 - DNA, 25 bp, Homo sapien
gaaacattaagcgtcattatcatac

SEQ ID NO: 21388 - DNA, 25 bp, Homo sapien
aagcgtcattatcatacaaattatt

SEQ ID NO: 21389 - DNA, 25 bp, Homo sapien
gtctcgctttgtcacctaagctgga

SEQ ID NO: 21390 - DNA, 25 bp, Homo sapien
ttccgcctcctgggatcaagtgatt

SEQ ID NO: 21391 - DNA, 25 bp, Homo sapien
ggtttacaggtgtgtaccgccacac

SEQ ID NO: 21392 - DNA, 25 bp, Homo sapien
agaatagcatggacctgggaggcgg

SEQ ID NO: 21393 - DNA, 25 bp, Homo sapien
agctgaaatggtgccactgcactcc

SEQ ID NO: 21394 - DNA, 25 bp, Homo sapien
cggctcatcgcaagcgcagggaggc

SEQ ID NO: 21395 - DNA, 25 bp, Homo sapien
gctcatcgcaagcgcagggaggccc

SEQ ID NO: 21396 - DNA, 25 bp, Homo sapien
atggtgggcggcgagcgctcgccgc

SEQ ID NO: 21397 - DNA, 25 bp, Homo sapien
ctcccgaaccagagcgacgtggtgg

SEQ ID NO: 21398 - DNA, 25 bp, Homo sapien
ccagagcgacgtggtggaggccgag

SEQ ID NO: 21399 - DNA, 25 bp, Homo sapien
gatcagtcctaccaatacctgggat

SEQ ID NO: 21400 - DNA, 25 bp, Homo sapien
agtcctaccaatacctgggatccat

SEQ ID NO: 21401 - DNA, 25 bp, Homo sapien
accaatacctgggatccattgcctc

SEQ ID NO: 21402 - DNA, 25 bp, Homo sapien
tggacgtgccagcggcatgacaacc

SEQ ID NO: 21403 - DNA, 25 bp, Homo sapien
cctctctgcagaactttccagtcga

SEQ ID NO: 21404 - DNA, 25 bp, Homo sapien
ctctgcagaactttccagtcgactc

SEQ ID NO: 21405 - DNA, 25 bp, Homo sapien
gccgatcaaagtcccagattctcat

SEQ ID NO: 21406 - DNA, 25 bp, Homo sapien
tcccagattctcatctccaaaaaga

SEQ ID NO: 21407 - DNA, 25 bp, Homo sapien
tactcagacttgctaggaccacagg

SEQ ID NO: 21408 - DNA, 25 bp, Homo sapien
aagatcggggtccatagggcgaggc

SEQ ID NO: 21409 - DNA, 25 bp, Homo sapien
gtctctgatcccctttgaggtttaa

SEQ ID NO: 21410 - DNA, 25 bp, Homo sapien
tttgaggtttaactttctgcttttg

SEQ ID NO: 21411 - DNA, 25 bp, Homo sapien
tctgcttttgatttcctgttagcat

SEQ ID NO: 21412 - DNA, 25 bp, Homo sapien
ctgttagcatttggcctcctacagt

SEQ ID NO: 21413 - DNA, 25 bp, Homo sapien
ttggcctcctacagtggctgactaa

SEQ ID NO: 21414 - DNA, 25 bp, Homo sapien
cccgtcgaggtcaagctccaagatc

SEQ ID NO: 21415 - DNA, 25 bp, Homo sapien
ccaggtctatttccacgacccaaga

SEQ ID NO: 21416 - DNA, 25 bp, Homo sapien
ttgtcacgagtgccgtgccgtgtaa

SEQ ID NO: 21417 - DNA, 25 bp, Homo sapien
gagtgccgtgccgtgtaataaagtc

SEQ ID NO: 21418 - DNA, 25 bp, Homo sapien
gccgtgccgtgtaataaagtcccag

SEQ ID NO: 21419 - DNA, 25 bp, Homo sapien
gtgccgtgtaataaagtcccagtgc

SEQ ID NO: 21420 - DNA, 25 bp, Homo sapien
gtaataaagtcccagtgctcatcca

SEQ ID NO: 21421 - DNA, 25 bp, Homo sapien
gctctccttattggcctgtggagtc

SEQ ID NO: 21422 - DNA, 25 bp, Homo sapien
ccttattggcctgtggagtctccat

SEQ ID NO: 21423 - DNA, 25 bp, Homo sapien
tattggcctgtggagtctccatccc

SEQ ID NO: 21424 - DNA, 25 bp, Homo sapien
tcagcctgggttgcactggagggga

SEQ ID NO: 21425 - DNA, 25 bp, Homo sapien
gaggaagaaagctgttttcagcata

SEQ ID NO: 21426 - DNA, 25 bp, Homo sapien
agctgttttcagcatagtaaagctg

SEQ ID NO: 21427 - DNA, 25 bp, Homo sapien
tttttgcagcaccaggcgaacactt

SEQ ID NO: 21428 - DNA, 25 bp, Homo sapien
ttgcagcaccaggcgaacacttaca

SEQ ID NO: 21429 - DNA, 25 bp, Homo sapien
ccaggcgaacacttacaccagtgct

SEQ ID NO: 21430 - DNA, 25 bp, Homo sapien
cgaacacttacaccagtgctttgta

SEQ ID NO: 21431 - DNA, 25 bp, Homo sapien
taaaggaatcttattgtccaccccg

SEQ ID NO: 21432 - DNA, 25 bp, Homo sapien
caccccgtgtcttggcaaaagaaca

SEQ ID NO: 21433 - DNA, 25 bp, Homo sapien
agtgatcacacagattcctacttgg

SEQ ID NO: 21434 - DNA, 25 bp, Homo sapien
atcacacagattcctacttgggctc

SEQ ID NO: 21435 - DNA, 25 bp, Homo sapien
ctttcctttaatcttcggaggctga

SEQ ID NO: 21436 - DNA, 25 bp, Homo sapien
cttcggaggctgagtttgcccaact

SEQ ID NO: 21437 - DNA, 25 bp, Homo sapien
ttgcccaactcaggtttaaccacca

SEQ ID NO: 21438 - DNA, 25 bp, Homo sapien
attcccttatccaggctttttgaca

SEQ ID NO: 21439 - DNA, 25 bp, Homo sapien
gctttttgacaacgctatgctccgc

SEQ ID NO: 21440 - DNA, 25 bp, Homo sapien
ctggcctttgacacctaccaggagt

SEQ ID NO: 21441 - DNA, 25 bp, Homo sapien
gaagtattcattcctgcagaacccc

SEQ ID NO: 21442 - DNA, 25 bp, Homo sapien
gtttctcagagtctattccgacacc

SEQ ID NO: 21443 - DNA, 25 bp, Homo sapien
gggcagatcttcaagcagacctaca

SEQ ID NO: 21444 - DNA, 25 bp, Homo sapien
gcagacctacagcaagttcgacaca

SEQ ID NO: 21445 - DNA, 25 bp, Homo sapien
gacgcactactcaagaactacgggc

SEQ ID NO: 21446 - DNA, 25 bp, Homo sapien
gctgctctactgcttcaggaaggac

SEQ ID NO: 21447 - DNA, 25 bp, Homo sapien
gacaaggtcgagacattcctgcgca

SEQ ID NO: 21448 - DNA, 25 bp, Homo sapien
ttcaagagggcagtgccttcccaac

SEQ ID NO: 21449 - DNA, 25 bp, Homo sapien
aggtaacacacttccagtgtctgtc

SEQ ID NO: 21450 - DNA, 25 bp, Homo sapien
acacttccagtgtctgtcatttcag

SEQ ID NO: 21451 - DNA, 25 bp, Homo sapien
gatattccaggttcattgcgtgatt

SEQ ID NO: 21452 - DNA, 25 bp, Homo sapien
attgcgtgattcaatgaaccacaaa

SEQ ID NO: 21453 - DNA, 25 bp, Homo sapien
gaaacttgctgatccatgagaatct

SEQ ID NO: 21454 - DNA, 25 bp, Homo sapien
gttttaatccttaacacattcaata

SEQ ID NO: 21455 - DNA, 25 bp, Homo sapien
aacacattcaatagcatatcacaga

SEQ ID NO: 21456 - DNA, 25 bp, Homo sapien
gttttatcacttcattcacattcag

SEQ ID NO: 21457 - DNA, 25 bp, Homo sapien
taatttgaatagcctgttcctttaa

SEQ ID NO: 21458 - DNA, 25 bp, Homo sapien
aaattatgtctatggcactaatata

SEQ ID NO: 21459 - DNA, 25 bp, Homo sapien
tggagtacagcagagcgatctcggc

SEQ ID NO: 21460 - DNA, 25 bp, Homo sapien
tgcgcagccacgatgcggaggaggt

SEQ ID NO: 21461 - DNA, 25 bp, Homo sapien
gcagccacgatgcggaggaggtgct

SEQ ID NO: 21462 - DNA, 25 bp, Homo sapien
cttcccattgagggccgaaaagaag

SEQ ID NO: 21463 - DNA, 25 bp, Homo sapien
tgaagagagacctggctacctccga

SEQ ID NO: 21464 - DNA, 25 bp, Homo sapien
tacctccgacatccagatggtccac

SEQ ID NO: 21465 - DNA, 25 bp, Homo sapien
tgcaccatccacgggaacacagagg

SEQ ID NO: 21466 - DNA, 25 bp, Homo sapien
tccacgggaacacagaggagctgcg

SEQ ID NO: 21467 - DNA, 25 bp, Homo sapien
tcattctggaccagcactgacagcc

SEQ ID NO: 21468 - DNA, 25 bp, Homo sapien
tgtccacaccacgagtggcacatcc

SEQ ID NO: 21469 - DNA, 25 bp, Homo sapien
cctggaacccaggctctaaacaagc

SEQ ID NO: 21470 - DNA, 25 bp, Homo sapien
acccaggctctaaacaagcagggag

SEQ ID NO: 21471 - DNA, 25 bp, Homo sapien
tatacacaggccgatgtggctcacc

SEQ ID NO: 21472 - DNA, 25 bp, Homo sapien
aggtgttcagccaaacgaccatctg

SEQ ID NO: 21473 - DNA, 25 bp, Homo sapien
ttgaggctctgcagcttagcttcaa

SEQ ID NO: 21474 - DNA, 25 bp, Homo sapien
tgcggcccttgctgcagaagtgggt

SEQ ID NO: 21475 - DNA, 25 bp, Homo sapien
gcaaagcagaaaccctcgtgcaggc

SEQ ID NO: 21476 - DNA, 25 bp, Homo sapien
cacatcgcccagcagcttgggctgg

SEQ ID NO: 21477 - DNA, 25 bp, Homo sapien
gatgtggtccgagtgtggttctgta

SEQ ID NO: 21478 - DNA, 25 bp, Homo sapien
caagcagtggctatgcacaacgaga

SEQ ID NO: 21479 - DNA, 25 bp, Homo sapien
gattttgaggctgttgggtctcctt

SEQ ID NO: 21480 - DNA, 25 bp, Homo sapien
tctcagggggaccagtgtcctttcc

SEQ ID NO: 21481 - DNA, 25 bp, Homo sapien
ttggtaccccaggctatgggagccc

SEQ ID NO: 21482 - DNA, 25 bp, Homo sapien
aggtgttcagccaaacgaccatctg

SEQ ID NO: 21483 - DNA, 25 bp, Homo sapien
tttgagggtctgcagcttagcttca

SEQ ID NO: 21484 - DNA, 25 bp, Homo sapien
aagaacatgtgtaagctgcggccct

SEQ ID NO: 21485 - DNA, 25 bp, Homo sapien
tgcggcccttgctgcagaagtgggt

SEQ ID NO: 21486 - DNA, 25 bp, Homo sapien
tggagaatttgttcctgcagtgccc

SEQ ID NO: 21487 - DNA, 25 bp, Homo sapien
atcgcccagcagcttgggctcgaga

SEQ ID NO: 21488 - DNA, 25 bp, Homo sapien
gatgtggtccgagtgtggttctgta

SEQ ID NO: 21489 - DNA, 25 bp, Homo sapien
aaggcaagcaatcaagcagcgacta

SEQ ID NO: 21490 - DNA, 25 bp, Homo sapien
aggattttgaggctgctgggtctcc

SEQ ID NO: 21491 - DNA, 25 bp, Homo sapien
ctcaggggtaccagtatcctttcct

SEQ ID NO: 21492 - DNA, 25 bp, Homo sapien
ttggtaccccaggctatgggagccc

SEQ ID NO: 21493 - DNA, 25 bp, Homo sapien
ttgccgatatttctcaggtctacac

SEQ ID NO: 21494 - DNA, 25 bp, Homo sapien
gaggcctcttggttgttgtatgatt

SEQ ID NO: 21495 - DNA, 25 bp, Homo sapien
gatcctgcaggttactactgtgggt

SEQ ID NO: 21496 - DNA, 25 bp, Homo sapien
aaagccactgcagcgggagttaaac

SEQ ID NO: 21497 - DNA, 25 bp, Homo sapien
acaaactgagtcaaccagcttcctt

SEQ ID NO: 21498 - DNA, 25 bp, Homo sapien
ggaaactgcaattacatgcctgtct

SEQ ID NO: 21499 - DNA, 25 bp, Homo sapien
atgcctgtctactgttctatcaatt

SEQ ID NO: 21500 - DNA, 25 bp, Homo sapien
gctcaccttgttgctctagcagaga

SEQ ID NO: 21501 - DNA, 25 bp, Homo sapien
ttaccagatccgtgatgccacttac

SEQ ID NO: 21502 - DNA, 25 bp, Homo sapien
aaaccaacatcatggaggtccctgg

SEQ ID NO: 21503 - DNA, 25 bp, Homo sapien
ttgaaaaaggagcctctcccactcc

SEQ ID NO: 21504 - DNA, 25 bp, Homo sapien
atgcagctgatctaaaagggaataa

SEQ ID NO: 21505 - DNA, 25 bp, Homo sapien
gggaataaaaggctgcgcataatca

SEQ ID NO: 21506 - DNA, 25 bp, Homo sapien
gaaggggagcgcgagagaaggaaag

SEQ ID NO: 21507 - DNA, 25 bp, Homo sapien
gaaagaaagccgggaggtggaagag

SEQ ID NO: 21508 - DNA, 25 bp, Homo sapien
gaagaggagggggagcgtctcaaag

SEQ ID NO: 21509 - DNA, 25 bp, Homo sapien
ggagcgtctcaaagaagcgatcaga

SEQ ID NO: 21510 - DNA, 25 bp, Homo sapien
cttctggaacgggccgctcttgaaa

SEQ ID NO: 21511 - DNA, 25 bp, Homo sapien
gggccgctcttgaaagggcttttga

SEQ ID NO: 21512 - DNA, 25 bp, Homo sapien
agtggtgttgttttccagtcgtgca

SEQ ID NO: 21513 - DNA, 25 bp, Homo sapien
gtgcatgctccaatcggcggagtat

SEQ ID NO: 21514 - DNA, 25 bp, Homo sapien
ggagtatattagagccgggacgcgg

SEQ ID NO: 21515 - DNA, 25 bp, Homo sapien
cccaccccgtggacgagaggctggg

SEQ ID NO: 21516 - DNA, 25 bp, Homo sapien
tggacgagaggctgggggtccaccc

SEQ ID NO: 21517 - DNA, 25 bp, Homo sapien
ttcgatgttcccatcttcactgaag

SEQ ID NO: 21518 - DNA, 25 bp, Homo sapien
ttcactgaagagttcttggaccaaa

SEQ ID NO: 21519 - DNA, 25 bp, Homo sapien
ggaccaaaacaaagcgcgtgaggcg

SEQ ID NO: 21520 - DNA, 25 bp, Homo sapien
tcggcgcttgcggaagatgaatgtg

SEQ ID NO: 21521 - DNA, 25 bp, Homo sapien
tgtggccttcgaggagcagaacgcg

SEQ ID NO: 21522 - DNA, 25 bp, Homo sapien
agaacgcggtactgcagaggcacac

SEQ ID NO: 21523 - DNA, 25 bp, Homo sapien
ccagcacgagaagctcatcgtccgc

SEQ ID NO: 21524 - DNA, 25 bp, Homo sapien
gctcatcgtccgcatcaaggaaatc

SEQ ID NO: 21525 - DNA, 25 bp, Homo sapien
gccagcgagcacctgtgaggagtgg

SEQ ID NO: 21526 - DNA, 25 bp, Homo sapien
tgcatgtgtccgacaggcagcacca

SEQ ID NO: 21527 - DNA, 25 bp, Homo sapien
cttggagccttacctctatgtggcc

SEQ ID NO: 21528 - DNA, 25 bp, Homo sapien
cctctatgtggccaatggctccggc

SEQ ID NO: 21529 - DNA, 25 bp, Homo sapien
ggtaccatcaatatggccgagctcc

SEQ ID NO: 21530 - DNA, 25 bp, Homo sapien
acagcccttgctggggacagttgct

SEQ ID NO: 21531 - DNA, 25 bp, Homo sapien
cttcgcccagaaggacctgctggtt

SEQ ID NO: 21532 - DNA, 25 bp, Homo sapien
cctggccttctcaatggatgtgggg

SEQ ID NO: 21533 - DNA, 25 bp, Homo sapien
atgtggggccagtgcacacagacag

SEQ ID NO: 21534 - DNA, 25 bp, Homo sapien
gcacacagacagtgcacacggtgca

SEQ ID NO: 21535 - DNA, 25 bp, Homo sapien
cacggtgcactctacaagtgaccat

SEQ ID NO: 21536 - DNA, 25 bp, Homo sapien
gctggagaccacggagttcatcatc

SEQ ID NO: 21537 - DNA, 25 bp, Homo sapien
gagacttggtggtctgagctgtccc

SEQ ID NO: 21538 - DNA, 25 bp, Homo sapien
acttgccagggctctgggggcagat

SEQ ID NO: 21539 - DNA, 25 bp, Homo sapien
ggcagatttgtggggacctcagcct

SEQ ID NO: 21540 - DNA, 25 bp, Homo sapien
ctggcttccctctctgaaatagccg

SEQ ID NO: 21541 - DNA, 25 bp, Homo sapien
aaatagccgaactccaggctgggct

SEQ ID NO: 21542 - DNA, 25 bp, Homo sapien
agccaaagccagagtggccacggcc

SEQ ID NO: 21543 - DNA, 25 bp, Homo sapien
ttgacgggccaggccctggagggca

SEQ ID NO: 21544 - DNA, 25 bp, Homo sapien
gattcccaggccagggctgggtcac

SEQ ID NO: 21545 - DNA, 25 bp, Homo sapien
ttgaggccgaagctgctgtgactgt

SEQ ID NO: 21546 - DNA, 25 bp, Homo sapien
caagccacagcctgtcttgtcaggt

SEQ ID NO: 21547 - DNA, 25 bp, Homo sapien
taaatacatcctttttctgctaacc

SEQ ID NO: 21548 - DNA, 25 bp, Homo sapien
gcttccaccggcagggagttgtgag

SEQ ID NO: 21549 - DNA, 25 bp, Homo sapien
ttccaccggcagggagttgtgagcg

SEQ ID NO: 21550 - DNA, 25 bp, Homo sapien
accccttgatgcccatgctaatggt

SEQ ID NO: 21551 - DNA, 25 bp, Homo sapien
tgcccatgctaatggtagccaccct

SEQ ID NO: 21552 - DNA, 25 bp, Homo sapien
catgctaatggtagccaccctggtt

SEQ ID NO: 21553 - DNA, 25 bp, Homo sapien
tgacttgagggacctggctgtcttc

SEQ ID NO: 21554 - DNA, 25 bp, Homo sapien
tcagtccctacctactgtttgtaac

SEQ ID NO: 21555 - DNA, 25 bp, Homo sapien
tccctacctactgtttgtaaccaca

SEQ ID NO: 21556 - DNA, 25 bp, Homo sapien
tgtaaccacaagtgtctctgtgtgt

SEQ ID NO: 21557 - DNA, 25 bp, Homo sapien
gtgtgcgtgtggtgcaggaaataaa

SEQ ID NO: 21558 - DNA, 25 bp, Homo sapien
gaaataaaggatctataccctcctg

SEQ ID NO: 21559 - DNA, 25 bp, Homo sapien
gcatggatagagattctgcagtaaa

SEQ ID NO: 21560 - DNA, 25 bp, Homo sapien
atgagcagagaatacgtgaacaaca

SEQ ID NO: 21561 - DNA, 25 bp, Homo sapien
gtgaacaacaggaacagctgtcact

SEQ ID NO: 21562 - DNA, 25 bp, Homo sapien
caagctaaaatctcagttacttctt

SEQ ID NO: 21563 - DNA, 25 bp, Homo sapien
ctcagttacttcttgtgaattccac

SEQ ID NO: 21564 - DNA, 25 bp, Homo sapien
tgtgaattccactcaagataacaat

SEQ ID NO: 21565 - DNA, 25 bp, Homo sapien
tagtgatgctacaggacgaagagga

SEQ ID NO: 21566 - DNA, 25 bp, Homo sapien
ggataaaaacattggcgagcaactc

SEQ ID NO: 21567 - DNA, 25 bp, Homo sapien
ggcgagcaactcaataaagcgtatg

SEQ ID NO: 21568 - DNA, 25 bp, Homo sapien
aaagcgtatgaagccttccggcagg

SEQ ID NO: 21569 - DNA, 25 bp, Homo sapien
ccttccggcaggcatgcatggatag

SEQ ID NO: 21570 - DNA, 25 bp, Homo sapien
aatctggtaacctcagacacctgca

SEQ ID NO: 21571 - DNA, 25 bp, Homo sapien
gacacctgcacattctgattgggac

SEQ ID NO: 21572 - DNA, 25 bp, Homo sapien
agtggtcaaaatccctttcaccatc

SEQ ID NO: 21573 - DNA, 25 bp, Homo sapien
ttcatcgctggtgctccaacaaaaa

SEQ ID NO: 21574 - DNA, 25 bp, Homo sapien
aatggaccaagagcctgcagggaac

SEQ ID NO: 21575 - DNA, 25 bp, Homo sapien
ggagctcctatgacatgtaccatct

SEQ ID NO: 21576 - DNA, 25 bp, Homo sapien
tccctgcagtgcgcaaggtcaacag

SEQ ID NO: 21577 - DNA, 25 bp, Homo sapien
gaacattccaggcagatttccctct

SEQ ID NO: 21578 - DNA, 25 bp, Homo sapien
acggagggacctacagatgcttcgg

SEQ ID NO: 21579 - DNA, 25 bp, Homo sapien
gagtggtcagacccgagtgacccac

SEQ ID NO: 21580 - DNA, 25 bp, Homo sapien
gtgacccactgcttgtttctgtcac

SEQ ID NO: 21581 - DNA, 25 bp, Homo sapien
tctttacttatggccgtgctggtgc

SEQ ID NO: 21582 - DNA, 25 bp, Homo sapien
gctggtgctcagctacaaatccatc

SEQ ID NO: 21583 - DNA, 25 bp, Homo sapien
atccatctgttctctaggctgtgat

SEQ ID NO: 21584 - DNA, 25 bp, Homo sapien
aatgggaagaatctctcctttctcc

SEQ ID NO: 21585 - DNA, 25 bp, Homo sapien
gacagacatgactttggacttcccc

SEQ ID NO: 21586 - DNA, 25 bp, Homo sapien
catccctgtcctccatgagatgatc

SEQ ID NO: 21587 - DNA, 25 bp, Homo sapien
gagatgatccagcagaccttcaatc

SEQ ID NO: 21588 - DNA, 25 bp, Homo sapien
gcacagaggactcatctgctgcttg

SEQ ID NO: 21589 - DNA, 25 bp, Homo sapien
tgaatgaggactccatcctggctgt

SEQ ID NO: 21590 - DNA, 25 bp, Homo sapien
agaaatacagcccttgtgcctggga

SEQ ID NO: 21591 - DNA, 25 bp, Homo sapien
tcatgagatccctctctttttcaac

SEQ ID NO: 21592 - DNA, 25 bp, Homo sapien
aactctcgggctagagactgcagga

SEQ ID NO: 21593 - DNA, 25 bp, Homo sapien
gactgcaggaacatgtgaatacgct

SEQ ID NO: 21594 - DNA, 25 bp, Homo sapien
aatacgctagtgcaattccagcctg

SEQ ID NO: 21595 - DNA, 25 bp, Homo sapien
taggaagagtagtctttgggtccct

SEQ ID NO: 21596 - DNA, 25 bp, Homo sapien
ttgggtccctaaagatcacctgata

SEQ ID NO: 21597 - DNA, 25 bp, Homo sapien
gacttttctgagcactcttgtggag

SEQ ID NO: 21598 - DNA, 25 bp, Homo sapien
gaataccatgggcattggcaatgta

SEQ ID NO: 21599 - DNA, 25 bp, Homo sapien
ctaaccaggtgtgacggcttgcgtc

SEQ ID NO: 21600 - DNA, 25 bp, Homo sapien
ggcttgcgtctgtactatcatttac

SEQ ID NO: 21601 - DNA, 25 bp, Homo sapien
gtactatcatttactcggtaggctg

SEQ ID NO: 21602 - DNA, 25 bp, Homo sapien
ggtaggatagcttaaactctcgggc

SEQ ID NO: 21603 - DNA, 25 bp, Homo sapien
cagttccagttcgtgccatcaagga

SEQ ID NO: 21604 - DNA, 25 bp, Homo sapien
tctgtgcacaaatccatcaaccgtt

SEQ ID NO: 21605 - DNA, 25 bp, Homo sapien
cgagcgggaggatatcacccacacc

SEQ ID NO: 21606 - DNA, 25 bp, Homo sapien
atggccatgcggatccgtgtgggcc

SEQ ID NO: 21607 - DNA, 25 bp, Homo sapien
ggcagtgactttgacgtctttgccc

SEQ ID NO: 21608 - DNA, 25 bp, Homo sapien
aacaccgctgaggagtacgtctgcc

SEQ ID NO: 21609 - DNA, 25 bp, Homo sapien
gcaccgtcagctacaatgggatctt

SEQ ID NO: 21610 - DNA, 25 bp, Homo sapien
cttggggcccgagtgtggcaccaag

SEQ ID NO: 21611 - DNA, 25 bp, Homo sapien
tggagcctttctctggtaaagccct

SEQ ID NO: 21612 - DNA, 25 bp, Homo sapien
aaagccctgtgttcctggagcattt

SEQ ID NO: 21613 - DNA, 25 bp, Homo sapien
gagcatttgttgaccgccaactgac

SEQ ID NO: 21614 - DNA, 25 bp, Homo sapien
ctctgccctatttgaaagtctcagg

SEQ ID NO: 21615 - DNA, 25 bp, Homo sapien
gggaacaagatgctgatccaacctg

SEQ ID NO: 21616 - DNA, 25 bp, Homo sapien
gctgatccaacctgagtggagtcag

SEQ ID NO: 21617 - DNA, 25 bp, Homo sapien
gtcaggtgaggcatctttacatcta

SEQ ID NO: 21618 - DNA, 25 bp, Homo sapien
tctagggtacatgtccacaatgcac

SEQ ID NO: 21619 - DNA, 25 bp, Homo sapien
gtccacaatgcacatgtctgtcaca

SEQ ID NO: 21620 - DNA, 25 bp, Homo sapien
atgcacatgtctgtcacacatgcac

SEQ ID NO: 21621 - DNA, 25 bp, Homo sapien
caccaacctgtcatccagcattagg

SEQ ID NO: 21622 - DNA, 25 bp, Homo sapien
cacagcaggccccggtatgtgatgt

SEQ ID NO: 21623 - DNA, 25 bp, Homo sapien
tttggtttttggtccttgcaacagt

SEQ ID NO: 21624 - DNA, 25 bp, Homo sapien
ttttggtccttgcaacagtttgctg

SEQ ID NO: 21625 - DNA, 25 bp, Homo sapien
acccggcctgagtagagtctttaag

SEQ ID NO: 21626 - DNA, 25 bp, Homo sapien
ggcctgagtagagtctttaaggtaa

SEQ ID NO: 21627 - DNA, 25 bp, Homo sapien
gtcttgggaagataggtaacaacct

SEQ ID NO: 21628 - DNA, 25 bp, Homo sapien
tgttcataaaattacatcctttgta

SEQ ID NO: 21629 - DNA, 25 bp, Homo sapien
ttgtaatactcctgcaagtcaaagt

SEQ ID NO: 21630 - DNA, 25 bp, Homo sapien
gcaagtcaaagtaaaggatggcata

SEQ ID NO: 21631 - DNA, 25 bp, Homo sapien
ggatggcatagactattcttggaca

SEQ ID NO: 21632 - DNA, 25 bp, Homo sapien
atagactattcttggacagttttgt

SEQ ID NO: 21633 - DNA, 25 bp, Homo sapien
aaaaagtgtatcttgaccccaccat

SEQ ID NO: 21634 - DNA, 25 bp, Homo sapien
atcagtactccattcttcattttaa

SEQ ID NO: 21635 - DNA, 25 bp, Homo sapien
tcagtactccattcttcattttaaa

SEQ ID NO: 21636 - DNA, 25 bp, Homo sapien
tctatacctcctggcagattccaca

SEQ ID NO: 21637 - DNA, 25 bp, Homo sapien
gaagctgaatgcctgaggggcctgg

SEQ ID NO: 21638 - DNA, 25 bp, Homo sapien
ctgcgagggcccagtgaacttggtg

SEQ ID NO: 21639 - DNA, 25 bp, Homo sapien
tgagccagggcaatggccctgccac

SEQ ID NO: 21640 - DNA, 25 bp, Homo sapien
ttctaagagtcccatctgctatgcc

SEQ ID NO: 21641 - DNA, 25 bp, Homo sapien
tgcccagccacattaactaacttta

SEQ ID NO: 21642 - DNA, 25 bp, Homo sapien
aattagtattttctctgacatctca

SEQ ID NO: 21643 - DNA, 25 bp, Homo sapien
ccttcaactcttcgtacattcaatg

SEQ ID NO: 21644 - DNA, 25 bp, Homo sapien
aatcagtgtgattagctttctcagc

SEQ ID NO: 21645 - DNA, 25 bp, Homo sapien
gctttctcagcagacattgtgccat

SEQ ID NO: 21646 - DNA, 25 bp, Homo sapien
ttgctcagcaccaccttttaatata

SEQ ID NO: 21647 - DNA, 25 bp, Homo sapien
atagctacactcacaaaaatacccc

SEQ ID NO: 21648 - DNA, 25 bp, Homo sapien
cacaaaaataccccctcatgaaata

SEQ ID NO: 21649 - DNA, 25 bp, Homo sapien
aataccccctcatgaaataactgtt

SEQ ID NO: 21650 - DNA, 25 bp, Homo sapien
atgaaataactgttctcttggatgg

SEQ ID NO: 21651 - DNA, 25 bp, Homo sapien
gttctcttggatggttaccttattt

SEQ ID NO: 21652 - DNA, 25 bp, Homo sapien
ttggatggttaccttatttctaaga

SEQ ID NO: 21653 - DNA, 25 bp, Homo sapien
atttctaagaaacgccactgaggaa

SEQ ID NO: 21654 - DNA, 25 bp, Homo sapien
acgccactgaggaacaggatccact

SEQ ID NO: 21655 - DNA, 25 bp, Homo sapien
aggatccactttgaacagtccgcta

SEQ ID NO: 21656 - DNA, 25 bp, Homo sapien
tgaacagtccgctaaagctatcaaa

SEQ ID NO: 21657 - DNA, 25 bp, Homo sapien
ttgagttgagttgtagtactttata

SEQ ID NO: 21658 - DNA, 25 bp, Homo sapien
tctgcaccttcatccttaatatgtc

SEQ ID NO: 21659 - DNA, 25 bp, Homo sapien
catccttaatatgtcacagtttgtg

SEQ ID NO: 21660 - DNA, 25 bp, Homo sapien
acagtttgtgtgatccagcgtcatt

SEQ ID NO: 21661 - DNA, 25 bp, Homo sapien
ttgtgtgatccagcgtcatttccac

SEQ ID NO: 21662 - DNA, 25 bp, Homo sapien
gtcatttccacctgatggggcaact

SEQ ID NO: 21663 - DNA, 25 bp, Homo sapien
ggggcaactgtgagcattaaacctg

SEQ ID NO: 21664 - DNA, 25 bp, Homo sapien
acctgaaccagaagatcgagagcct

SEQ ID NO: 21665 - DNA, 25 bp, Homo sapien
gatcgagagcctaactttgcaacca

SEQ ID NO: 21666 - DNA, 25 bp, Homo sapien
gagcctaactttgcaaccattggtc

SEQ ID NO: 21667 - DNA, 25 bp, Homo sapien
caaccattggtctgcaggacatcac

SEQ ID NO: 21668 - DNA, 25 bp, Homo sapien
tggtctgcaggacatcactttagat

SEQ ID NO: 21669 - DNA, 25 bp, Homo sapien
ggcaaagtcttccctttctttgccg

SEQ ID NO: 21670 - DNA, 25 bp, Homo sapien
gaaaaaaggttcctgccttacgctg

SEQ ID NO: 21671 - DNA, 25 bp, Homo sapien
ggttcctgccttacgctgaaaggct

SEQ ID NO: 21672 - DNA, 25 bp, Homo sapien
tgaaaggctgaagtggggcgcgcga

SEQ ID NO: 21673 - DNA, 25 bp, Homo sapien
gctgaagtggggcgcgcgaagggcg

SEQ ID NO: 21674 - DNA, 25 bp, Homo sapien
ctgtgcccgcgtgaggcgagagaac

SEQ ID NO: 21675 - DNA, 25 bp, Homo sapien
gaggcgagagaacaggggacttgag

SEQ ID NO: 21676 - DNA, 25 bp, Homo sapien
ggggacttgagtctcgaacagcggt

SEQ ID NO: 21677 - DNA, 25 bp, Homo sapien
gtctcgaacagcggttgtttttact

SEQ ID NO: 21678 - DNA, 25 bp, Homo sapien
ttactttatttatcttaggccctca

SEQ ID NO: 21679 - DNA, 25 bp, Homo sapien
tttatttatcttaggccctcagctc

SEQ ID NO: 21680 - DNA, 25 bp, Homo sapien
cgctgctcccacagtaggtattgaa

SEQ ID NO: 21681 - DNA, 25 bp, Homo sapien
tcttttttctcagtcaacacattga

SEQ ID NO: 21682 - DNA, 25 bp, Homo sapien
aacacattgattgaacactctggca

SEQ ID NO: 21683 - DNA, 25 bp, Homo sapien
gaacactctggcaaagatgctgtgg

SEQ ID NO: 21684 - DNA, 25 bp, Homo sapien
ctggcaaagatgctgtggtggatga

SEQ ID NO: 21685 - DNA, 25 bp, Homo sapien
ggtggatgaggttggagttcgaaag

SEQ ID NO: 21686 - DNA, 25 bp, Homo sapien
gatagttctgtcaagcacacttctg

SEQ ID NO: 21687 - DNA, 25 bp, Homo sapien
tcaagcacacttctgttctcttaga

SEQ ID NO: 21688 - DNA, 25 bp, Homo sapien
gcacacttctgttctcttagaactt

SEQ ID NO: 21689 - DNA, 25 bp, Homo sapien
acgtgtggaattcaacatctttggt

SEQ ID NO: 21690 - DNA, 25 bp, Homo sapien
gcaaaagtagtttttgtcttttctg

SEQ ID NO: 21691 - DNA, 25 bp, Homo sapien
tgccagggaggctctggttgtctga

SEQ ID NO: 21692 - DNA, 25 bp, Homo sapien
tggttgtctgagcaccatgggggcc

SEQ ID NO: 21693 - DNA, 25 bp, Homo sapien
cctgtggcctgtgattatgaataaa

SEQ ID NO: 21694 - DNA, 25 bp, Homo sapien
agcgttctcaagagggaagctggga

SEQ ID NO: 21695 - DNA, 25 bp, Homo sapien
tgggaacctgaccaaggctacagcc

SEQ ID NO: 21696 - DNA, 25 bp, Homo sapien
gaccagaaaagtagcggcggcaggg

SEQ ID NO: 21697 - DNA, 25 bp, Homo sapien
gccccagcaagtgtgtgctcagagc

SEQ ID NO: 21698 - DNA, 25 bp, Homo sapien
tgctcagagcatctttgttcttcac

SEQ ID NO: 21699 - DNA, 25 bp, Homo sapien
caggtgccgagaggggcaggtgcca

SEQ ID NO: 21700 - DNA, 25 bp, Homo sapien
cttcatgctcacacaggctatgggg

SEQ ID NO: 21701 - DNA, 25 bp, Homo sapien
ctgcaaggggcttgtctctgtggca

SEQ ID NO: 21702 - DNA, 25 bp, Homo sapien
aatgggaagaatctctcctttctcc

SEQ ID NO: 21703 - DNA, 25 bp, Homo sapien
gacagacatgactttggattccccc

SEQ ID NO: 21704 - DNA, 25 bp, Homo sapien
cagaaggctcaagccatctctgtcc

SEQ ID NO: 21705 - DNA, 25 bp, Homo sapien
gagatgatccagcagaccttcaatc

SEQ ID NO: 21706 - DNA, 25 bp, Homo sapien
tttccactgaacttaaccagcagct

SEQ ID NO: 21707 - DNA, 25 bp, Homo sapien
gaatgacctggaagcctgcgtgata

SEQ ID NO: 21708 - DNA, 25 bp, Homo sapien
gactcccctgatgaatgtggactcc

SEQ ID NO: 21709 - DNA, 25 bp, Homo sapien
tggactccatcctggctgtgaagaa

SEQ ID NO: 21710 - DNA, 25 bp, Homo sapien
agaaatacagcccttgtgcctggga

SEQ ID NO: 21711 - DNA, 25 bp, Homo sapien
gactaatacaccagtccacacttct

SEQ ID NO: 21712 - DNA, 25 bp, Homo sapien
cagtccacacttctatgacttctgc

SEQ ID NO: 21713 - DNA, 25 bp, Homo sapien
cgttttcacaagacctacgaggtgg

SEQ ID NO: 21714 - DNA, 25 bp, Homo sapien
cacaagacctacgaggtggccggca

SEQ ID NO: 21715 - DNA, 25 bp, Homo sapien
ggagctgcaggagagtaagatcacc

SEQ ID NO: 21716 - DNA, 25 bp, Homo sapien
aggagagtaagatcaccgtgctgcc

SEQ ID NO: 21717 - DNA, 25 bp, Homo sapien
gagaacgagctggcccttatgagcc

SEQ ID NO: 21718 - DNA, 25 bp, Homo sapien
aacgagctggcccttatgagccagg

SEQ ID NO: 21719 - DNA, 25 bp, Homo sapien
gcctggaggcgggttccaaggagga

SEQ ID NO: 21720 - DNA, 25 bp, Homo sapien
tggaggcgggttccaaggaggaggc

SEQ ID NO: 21721 - DNA, 25 bp, Homo sapien
ggcatcatccggatgctggagttcg

SEQ ID NO: 21722 - DNA, 25 bp, Homo sapien
tcatccggatgctggagttcggcag

SEQ ID NO: 21723 - DNA, 25 bp, Homo sapien
cggatgctggagttcggcagccacc

SEQ ID NO: 21724 - DNA, 25 bp, Homo sapien
acccttaatccattcaaccctgagg

SEQ ID NO: 21725 - DNA, 25 bp, Homo sapien
gtgtttgtgtccctgggtacttgag

SEQ ID NO: 21726 - DNA, 25 bp, Homo sapien
aatgaaaagtctcccatgtctacct

SEQ ID NO: 21727 - DNA, 25 bp, Homo sapien
ctacctctttctacacagacatggc

SEQ ID NO: 21728 - DNA, 25 bp, Homo sapien
atggcaaccatccgatttctcaatc

SEQ ID NO: 21729 - DNA, 25 bp, Homo sapien
aaccgccattgtcatcatggcccgt

SEQ ID NO: 21730 - DNA, 25 bp, Homo sapien
atggcccgttctcaatgagctgttg

SEQ ID NO: 21731 - DNA, 25 bp, Homo sapien
tacacctcccagacggggtggtggc

SEQ ID NO: 21732 - DNA, 25 bp, Homo sapien
ctcacctcctggacagggtggctgg

SEQ ID NO: 21733 - DNA, 25 bp, Homo sapien
gactcttaacgagcatgctgccttc

SEQ ID NO: 21734 - DNA, 25 bp, Homo sapien
taacaaagcacatcttgcaccaccc

SEQ ID NO: 21735 - DNA, 25 bp, Homo sapien
tacaataaaactcaggtcaccttcg

SEQ ID NO: 21736 - DNA, 25 bp, Homo sapien
ctcaggtcaccttcgaattaattaa

SEQ ID NO: 21737 - DNA, 25 bp, Homo sapien
tgacttaattacccaaggtttggca

SEQ ID NO: 21738 - DNA, 25 bp, Homo sapien
aggtttggcatgtaaagatcttaag

SEQ ID NO: 21739 - DNA, 25 bp, Homo sapien
gagggtgcagaacgaaccactcgaa

SEQ ID NO: 21740 - DNA, 25 bp, Homo sapien
gcagaacgaaccactcgaaaacgag

SEQ ID NO: 21741 - DNA, 25 bp, Homo sapien
gaaccactcgaaaacgagtagcagt

SEQ ID NO: 21742 - DNA, 25 bp, Homo sapien
gtagcagtgtaatgaaggcttcttt

SEQ ID NO: 21743 - DNA, 25 bp, Homo sapien
caataacaaatgcttcatcaatctg

SEQ ID NO: 21744 - DNA, 25 bp, Homo sapien
gcttcatcaatctgagtgtggaagg

SEQ ID NO: 21745 - DNA, 25 bp, Homo sapien
gagtgtggaaggtgatttatcaaaa

SEQ ID NO: 21746 - DNA, 25 bp, Homo sapien
gcctagaattaccctaagaccctgt

SEQ ID NO: 21747 - DNA, 25 bp, Homo sapien
gtcctgtattccatcctagatatct

SEQ ID NO: 21748 - DNA, 25 bp, Homo sapien
aatgttcatggcggccctattcaca

SEQ ID NO: 21749 - DNA, 25 bp, Homo sapien
aacaaccccaagctatatattacca

SEQ ID NO: 21750 - DNA, 25 bp, Homo sapien
gtgatccctactacactgtggatga

SEQ ID NO: 21751 - DNA, 25 bp, Homo sapien
agcggattggtggctttcagcagct

SEQ ID NO: 21752 - DNA, 25 bp, Homo sapien
ggaggtgggactgaggagcgactgc

SEQ ID NO: 21753 - DNA, 25 bp, Homo sapien
taatcagtatggggtttcctcccgg

SEQ ID NO: 21754 - DNA, 25 bp, Homo sapien
gtttcctcccgggatggtgaaaatg

SEQ ID NO: 21755 - DNA, 25 bp, Homo sapien
ttccggacctagatactgacgaagg

SEQ ID NO: 21756 - DNA, 25 bp, Homo sapien
ctgacgaaggtagcacgacactgtg

SEQ ID NO: 21757 - DNA, 25 bp, Homo sapien
gaaatgacaggctacgtggccacta

SEQ ID NO: 21758 - DNA, 25 bp, Homo sapien
acaggctacgtggccactaggtggt

SEQ ID NO: 21759 - DNA, 25 bp, Homo sapien
cactaggtggtacagggctcctgag

SEQ ID NO: 21760 - DNA, 25 bp, Homo sapien
cagggctcctgagatcatgctgaac

SEQ ID NO: 21761 - DNA, 25 bp, Homo sapien
ccgagacctgaagcctagtaaccta

SEQ ID NO: 21762 - DNA, 25 bp, Homo sapien
tgaagcctagtaacctagctgtgaa

SEQ ID NO: 21763 - DNA, 25 bp, Homo sapien
aacctagctgtgaatgaagactgtg

SEQ ID NO: 21764 - DNA, 25 bp, Homo sapien
gaagactgtgagctgaagattctgg

SEQ ID NO: 21765 - DNA, 25 bp, Homo sapien
gattctggattttggactggctcgg

SEQ ID NO: 21766 - DNA, 25 bp, Homo sapien
gactggctcggcacacagatgatga

SEQ ID NO: 21767 - DNA, 25 bp, Homo sapien
ggctcggcacacagatgatgaaatg

SEQ ID NO: 21768 - DNA, 25 bp, Homo sapien
gaagtacattctggccaggcacgat

SEQ ID NO: 21769 - DNA, 25 bp, Homo sapien
aggcacgatggctcatgctgtaatc

SEQ ID NO: 21770 - DNA, 25 bp, Homo sapien
ttgcagtaagccgagttcactccat

SEQ ID NO: 21771 - DNA, 25 bp, Homo sapien
cgagttcactccattgtactctagc

SEQ ID NO: 21772 - DNA, 25 bp, Homo sapien
attgtactctagcctgggtgacaga

SEQ ID NO: 21773 - DNA, 25 bp, Homo sapien
ggatgactcggatgtctggtggggc

SEQ ID NO: 21774 - DNA, 25 bp, Homo sapien
ggggcggagcagacacagactatgc

SEQ ID NO: 21775 - DNA, 25 bp, Homo sapien
gaagccgatgatgacgaggacgatg

SEQ ID NO: 21776 - DNA, 25 bp, Homo sapien
ggaaccctacgaagaagccacagag

SEQ ID NO: 21777 - DNA, 25 bp, Homo sapien
cacagagagaaccaccagcattgcc

SEQ ID NO: 21778 - DNA, 25 bp, Homo sapien
ccaccaccaccacagagtctgtgga

SEQ ID NO: 21779 - DNA, 25 bp, Homo sapien
gggaggccggggaaggatcaggagg

SEQ ID NO: 21780 - DNA, 25 bp, Homo sapien
gtggtgatgcaagatgttgccccca

SEQ ID NO: 21781 - DNA, 25 bp, Homo sapien
tcttgaaagagccctgtttcccagc

SEQ ID NO: 21782 - DNA, 25 bp, Homo sapien
acaatagatgttgcttttcccgtgt

SEQ ID NO: 21783 - DNA, 25 bp, Homo sapien
gcttttcccgtgtcatgtaaatttg

SEQ ID NO: 21784 - DNA, 25 bp, Homo sapien
ggctgagctgttagaggggcttctc

SEQ ID NO: 21785 - DNA, 25 bp, Homo sapien
tgttagaggggcttctccagaggct

SEQ ID NO: 21786 - DNA, 25 bp, Homo sapien
agaggctcgagagcaggccatttcc

SEQ ID NO: 21787 - DNA, 25 bp, Homo sapien
gactgtgtttttattgaaggaattt

SEQ ID NO: 21788 - DNA, 25 bp, Homo sapien
gttgtaaaatagactccatggagac

SEQ ID NO: 21789 - DNA, 25 bp, Homo sapien
tagactccatggagactcttaggaa

SEQ ID NO: 21790 - DNA, 25 bp, Homo sapien
taatttacttggcattttaggacat

SEQ ID NO: 21791 - DNA, 25 bp, Homo sapien
gaaaatgagatccaccaacatcttt

SEQ ID NO: 21792 - DNA, 25 bp, Homo sapien
atgagatccaccaacatcttttatt

SEQ ID NO: 21793 - DNA, 25 bp, Homo sapien
caacatcttttattaagttcagtta

SEQ ID NO: 21794 - DNA, 25 bp, Homo sapien
taagttcagttattagtctgtgaag

SEQ ID NO: 21795 - DNA, 25 bp, Homo sapien
agtgctttactttttgcacaatttt

SEQ ID NO: 21796 - DNA, 25 bp, Homo sapien
gtgaattcatgatcaaggtttcctt

SEQ ID NO: 21797 - DNA, 25 bp, Homo sapien
ttagcattgcatttcagtactgact

SEQ ID NO: 21798 - DNA, 25 bp, Homo sapien
tcagtactgactgtgtaagctaaat

SEQ ID NO: 21799 - DNA, 25 bp, Homo sapien
gtgtaagctaaattgctgatccaaa

SEQ ID NO: 21800 - DNA, 25 bp, Homo sapien
ttaaaatcttaattgttggctgggc

SEQ ID NO: 21801 - DNA, 25 bp, Homo sapien
tttacagactgagtgacagtactca

SEQ ID NO: 21802 - DNA, 25 bp, Homo sapien
gagtgacagtactcagtatatctga

SEQ ID NO: 21803 - DNA, 25 bp, Homo sapien
tatatctgagataaactctataatg

SEQ ID NO: 21804 - DNA, 25 bp, Homo sapien
ttggctcttggtggaattgaattca

SEQ ID NO: 21805 - DNA, 25 bp, Homo sapien
gaattgaattcatcttgtgtcttat

SEQ ID NO: 21806 - DNA, 25 bp, Homo sapien
attcatcttgtgtcttattcaagta

SEQ ID NO: 21807 - DNA, 25 bp, Homo sapien
gtaataaatggagtgcttggaggca

SEQ ID NO: 21808 - DNA, 25 bp, Homo sapien
ggagtgcttggaggcatatgtggct

SEQ ID NO: 21809 - DNA, 25 bp, Homo sapien
gaggcatatgtggcttttgctgctc

SEQ ID NO: 21810 - DNA, 25 bp, Homo sapien
cttttgctgctctcaccaacagcaa

SEQ ID NO: 21811 - DNA, 25 bp, Homo sapien
tccccacagtctacttttacaaacg

SEQ ID NO: 21812 - DNA, 25 bp, Homo sapien
gcgccctgtacataaccagcaagct

SEQ ID NO: 21813 - DNA, 25 bp, Homo sapien
ataaccagcaagctctcagatgcca

SEQ ID NO: 21814 - DNA, 25 bp, Homo sapien
atctgctactactacatggccaagg

SEQ ID NO: 21815 - DNA, 25 bp, Homo sapien
ctcccagtgctaaggcccacaaaag

SEQ ID NO: 21816 - DNA, 25 bp, Homo sapien
gcccacaaaagccaggactctctgt

SEQ ID NO: 21817 - DNA, 25 bp, Homo sapien
gtgaccctcgcctaagaggcgtgct

SEQ ID NO: 21818 - DNA, 25 bp, Homo sapien
ctaagaggcgtgctgtgggcgctgt

SEQ ID NO: 21819 - DNA, 25 bp, Homo sapien
cactgtgtattctcttggagccttg

SEQ ID NO: 21820 - DNA, 25 bp, Homo sapien
caggtacctgctctcttgggaagag

SEQ ID NO: 21821 - DNA, 25 bp, Homo sapien
gggacaagggcaagaggactgaggc

SEQ ID NO: 21822 - DNA, 25 bp, Homo sapien
agggtgcagccttgatgacacctgc

SEQ ID NO: 21823 - DNA, 25 bp, Homo sapien
aagtactccgtgtgggtcggtggct

SEQ ID NO: 21824 - DNA, 25 bp, Homo sapien
ggagtatgatgagtcaggcccctcc

SEQ ID NO: 21825 - DNA, 25 bp, Homo sapien
aggtggactctgacttagttgcgtt

SEQ ID NO: 21826 - DNA, 25 bp, Homo sapien
agaaaacaacatgagattggcgtgg

SEQ ID NO: 21827 - DNA, 25 bp, Homo sapien
tcaggatttgaaaaccggaacggcg

SEQ ID NO: 21828 - DNA, 25 bp, Homo sapien
cggaacggcgaaggtgatagtagtc

SEQ ID NO: 21829 - DNA, 25 bp, Homo sapien
aaggtgatagtagtcggttggagcg

SEQ ID NO: 21830 - DNA, 25 bp, Homo sapien
ccccaaagttctacaatgtggccaa

SEQ ID NO: 21831 - DNA, 25 bp, Homo sapien
aagttctacaatgtggccaaggact

SEQ ID NO: 21832 - DNA, 25 bp, Homo sapien
tcaactccatagtgaagtctgatgt

SEQ ID NO: 21833 - DNA, 25 bp, Homo sapien
ccctggcgcctagcattatgaagat

SEQ ID NO: 21834 - DNA, 25 bp, Homo sapien
cctgcccaggaggactactacagtc

SEQ ID NO: 21835 - DNA, 25 bp, Homo sapien
acaagccactgtagaacctgcgatc

SEQ ID NO: 21836 - DNA, 25 bp, Homo sapien
aagagagcaccatggctcctacatt

SEQ ID NO: 21837 - DNA, 25 bp, Homo sapien
catggctcctacattggaccttgga

SEQ ID NO: 21838 - DNA, 25 bp, Homo sapien
agccaagagggtactgctcagttgc

SEQ ID NO: 21839 - DNA, 25 bp, Homo sapien
gagggacagacagaaggccaaggcc

SEQ ID NO: 21840 - DNA, 25 bp, Homo sapien
caaggcccgatgtggtgtgcagagg

SEQ ID NO: 21841 - DNA, 25 bp, Homo sapien
gtggggaggtggcgaggatggggac

SEQ ID NO: 21842 - DNA, 25 bp, Homo sapien
agaatcttggaccaggtctctcttc

SEQ ID NO: 21843 - DNA, 25 bp, Homo sapien
cctgccccgttggtgtgattatttc

SEQ ID NO: 21844 - DNA, 25 bp, Homo sapien
tgttttgcgtagcatcgtgtgccac

SEQ ID NO: 21845 - DNA, 25 bp, Homo sapien
gagtaactgctctctgagttttgca

SEQ ID NO: 21846 - DNA, 25 bp, Homo sapien
gagttttgcacacgaagttgccctc

SEQ ID NO: 21847 - DNA, 25 bp, Homo sapien
tgccctcatctgctggagatcgata

SEQ ID NO: 21848 - DNA, 25 bp, Homo sapien
aggaaggcacaagacgttctcctct

SEQ ID NO: 21849 - DNA, 25 bp, Homo sapien
ttgagcgtccaaaaaccctgagtgt

SEQ ID NO: 21850 - DNA, 25 bp, Homo sapien
ccgccatgaccctgggcacagggga

SEQ ID NO: 21851 - DNA, 25 bp, Homo sapien
accagcgcccagcgttagggctgga

SEQ ID NO: 21852 - DNA, 25 bp, Homo sapien
gaagacggcagtgttcagaattcca

SEQ ID NO: 21853 - DNA, 25 bp, Homo sapien
tcagaattccagccgctcatctgaa

SEQ ID NO: 21854 - DNA, 25 bp, Homo sapien
gtgaactgacctctaaagcagcgtg

SEQ ID NO: 21855 - DNA, 25 bp, Homo sapien
attacgcttttcagatcctttcaat

SEQ ID NO: 21856 - DNA, 25 bp, Homo sapien
gagtaccctcgtatgcaggtgactg

SEQ ID NO: 21857 - DNA, 25 bp, Homo sapien
tgcaggtgactgtgtttgacctccc

SEQ ID NO: 21858 - DNA, 25 bp, Homo sapien
tgacctcccagacattatcgagctg

SEQ ID NO: 21859 - DNA, 25 bp, Homo sapien
gatccacttcgcagcaggtgacttt

SEQ ID NO: 21860 - DNA, 25 bp, Homo sapien
tcctgcatgactggccagacgacaa

SEQ ID NO: 21861 - DNA, 25 bp, Homo sapien
gttactcagcaaggtcgccgagagc

SEQ ID NO: 21862 - DNA, 25 bp, Homo sapien
gcagtcactgaacatgctggtgcag

SEQ ID NO: 21863 - DNA, 25 bp, Homo sapien
caaggagcggagcctgggcgagtat

SEQ ID NO: 21864 - DNA, 25 bp, Homo sapien
gagtatcagtgcttgctggagctgc

SEQ ID NO: 21865 - DNA, 25 bp, Homo sapien
gttcattatagggatgtcctccccc

SEQ ID NO: 21866 - DNA, 25 bp, Homo sapien
ccggtccccaagtaccataggacag

SEQ ID NO: 21867 - DNA, 25 bp, Homo sapien
agttggatcactgcattttcacaca

SEQ ID NO: 21868 - DNA, 25 bp, Homo sapien
actggcccttctcagaggagcaaga

SEQ ID NO: 21869 - DNA, 25 bp, Homo sapien
tagaacttccaaatgctgagcccag

SEQ ID NO: 21870 - DNA, 25 bp, Homo sapien
gcaccacagtcaggccttgatggga

SEQ ID NO: 21871 - DNA, 25 bp, Homo sapien
tcaaacccagcttggcagctctaat

SEQ ID NO: 21872 - DNA, 25 bp, Homo sapien
ttggcagctctaatgtaccagcagc

SEQ ID NO: 21873 - DNA, 25 bp, Homo sapien
aaggcgtgagtctccatcttagagc

SEQ ID NO: 21874 - DNA, 25 bp, Homo sapien
atcttagagcatcactcttcctcac

SEQ ID NO: 21875 - DNA, 25 bp, Homo sapien
ctgtctcttgcttaccaatgtctaa

SEQ ID NO: 21876 - DNA, 25 bp, Homo sapien
acaattctctatttcacttgacccc

SEQ ID NO: 21877 - DNA, 25 bp, Homo sapien
taactggcttacttcctagtctact

SEQ ID NO: 21878 - DNA, 25 bp, Homo sapien
gaggagcacaacagatgccacgtct

SEQ ID NO: 21879 - DNA, 25 bp, Homo sapien
gcacaacagatgccacgtcttcgtg

SEQ ID NO: 21880 - DNA, 25 bp, Homo sapien
acagatgccacgtcttcgtgcattc

SEQ ID NO: 21881 - DNA, 25 bp, Homo sapien
tcttcgtgcattcgccaacacgtgc

SEQ ID NO: 21882 - DNA, 25 bp, Homo sapien
cttccctgcgcaagacttgcgtccc

SEQ ID NO: 21883 - DNA, 25 bp, Homo sapien
gtggctgggtcctgtggaggccagc

SEQ ID NO: 21884 - DNA, 25 bp, Homo sapien
gagggaggcaaggcaggggagtggg

SEQ ID NO: 21885 - DNA, 25 bp, Homo sapien
ccttcccatttcatcggtggggacg

SEQ ID NO: 21886 - DNA, 25 bp, Homo sapien
ccatttcatcggtggggacgtggag

SEQ ID NO: 21887 - DNA, 25 bp, Homo sapien
cccagtggggttggcgtgcatgtgt

SEQ ID NO: 21888 - DNA, 25 bp, Homo sapien
tggggttggcgtgcatgtgtacata

SEQ ID NO: 21889 - DNA, 25 bp, Homo sapien
gccgggcgggggaatatacaaagtg

SEQ ID NO: 21890 - DNA, 25 bp, Homo sapien
agtgaagccacattgccaaacttgc

SEQ ID NO: 21891 - DNA, 25 bp, Homo sapien
gaagccacattgccaaacttgcagc

SEQ ID NO: 21892 - DNA, 25 bp, Homo sapien
ccaaacttgcagcagcgattgcagc

SEQ ID NO: 21893 - DNA, 25 bp, Homo sapien
tgcagcagcgattgcagcagttgct

SEQ ID NO: 21894 - DNA, 25 bp, Homo sapien
gcgattgcagcagttgctgccgctg

SEQ ID NO: 21895 - DNA, 25 bp, Homo sapien
ctcgcgcgcagtcggaggcggagaa

SEQ ID NO: 21896 - DNA, 25 bp, Homo sapien
cgcgcagtcggaggcggagaaggac

SEQ ID NO: 21897 - DNA, 25 bp, Homo sapien
gaggcggagaaggacgaagactgag

SEQ ID NO: 21898 - DNA, 25 bp, Homo sapien
gaaggacgaagactgagactgacac

SEQ ID NO: 21899 - DNA, 25 bp, Homo sapien
aagactgagactgacacttctgctc

SEQ ID NO: 21900 - DNA, 25 bp, Homo sapien
gaggcatccaaggctttctgtgcca

SEQ ID NO: 21901 - DNA, 25 bp, Homo sapien
tctgtgccaagaatcccaagtgact

SEQ ID NO: 21902 - DNA, 25 bp, Homo sapien
tcccaagtgactggggctggggacc

SEQ ID NO: 21903 - DNA, 25 bp, Homo sapien
ccatcctgcaacagctggactcaag

SEQ ID NO: 21904 - DNA, 25 bp, Homo sapien
ctagaagtttcctgtggaacctgga

SEQ ID NO: 21905 - DNA, 25 bp, Homo sapien
ctccccaagtgtcacacaggcactt

SEQ ID NO: 21906 - DNA, 25 bp, Homo sapien
aggcactttgtacacatcctggttt

SEQ ID NO: 21907 - DNA, 25 bp, Homo sapien
gggaacttgccatcaagattcctgt

SEQ ID NO: 21908 - DNA, 25 bp, Homo sapien
atcaagattcctgtaccaggcccac

SEQ ID NO: 21909 - DNA, 25 bp, Homo sapien
cgcctcttttccgttcttgaggaat

SEQ ID NO: 21910 - DNA, 25 bp, Homo sapien
cttcctttgcagctgttttgaatgt

SEQ ID NO: 21911 - DNA, 25 bp, Homo sapien
ggaattacaaatgtgctgggtgtgg

SEQ ID NO: 21912 - DNA, 25 bp, Homo sapien
gtaatcccaacacctgggtgtggtg

SEQ ID NO: 21913 - DNA, 25 bp, Homo sapien
gcaatatgacaagacctcatctatc

SEQ ID NO: 21914 - DNA, 25 bp, Homo sapien
acccacaaacagctcactcttaaat

SEQ ID NO: 21915 - DNA, 25 bp, Homo sapien
actcttaaatagtcagtgggccgaa

SEQ ID NO: 21916 - DNA, 25 bp, Homo sapien
caagcaatgcttctagggaaattta

SEQ ID NO: 21917 - DNA, 25 bp, Homo sapien
atttatagctgttaatgcctacaat

SEQ ID NO: 21918 - DNA, 25 bp, Homo sapien
agaaagctctcaaatcagtaatcga

SEQ ID NO: 21919 - DNA, 25 bp, Homo sapien
atcagtaatcgattcaccaccataa

SEQ ID NO: 21920 - DNA, 25 bp, Homo sapien
gattcaccaccataagacactggaa

SEQ ID NO: 21921 - DNA, 25 bp, Homo sapien
aacctttagctaaacatatcagggt

SEQ ID NO: 21922 - DNA, 25 bp, Homo sapien
aatctccctccctaatagcaggaaa

SEQ ID NO: 21923 - DNA, 25 bp, Homo sapien
caggaaatccacaaggaccatcccc

SEQ ID NO: 21924 - DNA, 25 bp, Homo sapien
caaggaggcaacaagccccaaggcc

SEQ ID NO: 21925 - DNA, 25 bp, Homo sapien
cacctcctccaggaaagccacaagg

SEQ ID NO: 21926 - DNA, 25 bp, Homo sapien
cccacctccaggaaagccacaagga

SEQ ID NO: 21927 - DNA, 25 bp, Homo sapien
ccacccgcacaaggaggcagcaagt

SEQ ID NO: 21928 - DNA, 25 bp, Homo sapien
gaggcagcaagtcccaaagtgcccg

SEQ ID NO: 21929 - DNA, 25 bp, Homo sapien
ggaccaccccaacaagaaggcaaca

SEQ ID NO: 21930 - DNA, 25 bp, Homo sapien
gaaggcaacaatcctcaaggtcccc

SEQ ID NO: 21931 - DNA, 25 bp, Homo sapien
tcctcaagggggcagaccttccaga

SEQ ID NO: 21932 - DNA, 25 bp, Homo sapien
cctccccagtcatctaggattcaat

SEQ ID NO: 21933 - DNA, 25 bp, Homo sapien
cagcactccggtcagtgccggaaag

SEQ ID NO: 21934 - DNA, 25 bp, Homo sapien
ggtcagtgccggaaagtcttttggt

SEQ ID NO: 21935 - DNA, 25 bp, Homo sapien
gaaagtcttttggtggctgagtggt

SEQ ID NO: 21936 - DNA, 25 bp, Homo sapien
gtgcctctgtcaacctagcaagaga

SEQ ID NO: 21937 - DNA, 25 bp, Homo sapien
ctagcaagagattaagccaagcatg

SEQ ID NO: 21938 - DNA, 25 bp, Homo sapien
tgctagctagttggtggagttagga

SEQ ID NO: 21939 - DNA, 25 bp, Homo sapien
ggagttaggaccttggtggagttat

SEQ ID NO: 21940 - DNA, 25 bp, Homo sapien
ttcatctttctaagcctctgattcc

SEQ ID NO: 21941 - DNA, 25 bp, Homo sapien
tccttgtctgtaaagggggaatcct

SEQ ID NO: 21942 - DNA, 25 bp, Homo sapien
gaatcctaaaacaggcatcccttgg

SEQ ID NO: 21943 - DNA, 25 bp, Homo sapien
attgcaggttcagttgaaggcaaca

SEQ ID NO: 21944 - DNA, 25 bp, Homo sapien
gaagaccatacaggtctctgttcca

SEQ ID NO: 21945 - DNA, 25 bp, Homo sapien
gttccagcattttctggctacctca

SEQ ID NO: 21946 - DNA, 25 bp, Homo sapien
ggctacctcatggcactgcataatc

SEQ ID NO: 21947 - DNA, 25 bp, Homo sapien
catggcactgcataatcacttccac

SEQ ID NO: 21948 - DNA, 25 bp, Homo sapien
tccacccaaatctagccaaatctaa

SEQ ID NO: 21949 - DNA, 25 bp, Homo sapien
ttaagcacttctgtatctattccaa

SEQ ID NO: 21950 - DNA, 25 bp, Homo sapien
ctattccaagacaaactccctttct

SEQ ID NO: 21951 - DNA, 25 bp, Homo sapien
tttcttgtttaatctcagtgactct

SEQ ID NO: 21952 - DNA, 25 bp, Homo sapien
aatctcagtgactcttacttctaga

SEQ ID NO: 21953 - DNA, 25 bp, Homo sapien
tagagagggcactcttccttctata

SEQ ID NO: 21954 - DNA, 25 bp, Homo sapien
acctctaacctttctaaccatcaag

SEQ ID NO: 21955 - DNA, 25 bp, Homo sapien
gtagtggaccatacctggggaccaa

SEQ ID NO: 21956 - DNA, 25 bp, Homo sapien
gtggaccatacctggggaccaaaag

SEQ ID NO: 21957 - DNA, 25 bp, Homo sapien
caccccaggggtggcagtagacaac

SEQ ID NO: 21958 - DNA, 25 bp, Homo sapien
cccaggggtggcagtagacaacaac

SEQ ID NO: 21959 - DNA, 25 bp, Homo sapien
ggtggcagtagacaacaacccagaa

SEQ ID NO: 21960 - DNA, 25 bp, Homo sapien
ggggttaggcatgaaggtggttgtg

SEQ ID NO: 21961 - DNA, 25 bp, Homo sapien
ggtggttgtgattaagaagatggtt

SEQ ID NO: 21962 - DNA, 25 bp, Homo sapien
acatctagaaacattacaccacaca

SEQ ID NO: 21963 - DNA, 25 bp, Homo sapien
tctagaaacattacaccacacacac

SEQ ID NO: 21964 - DNA, 25 bp, Homo sapien
gtattcctggggtttaattgttgtg

SEQ ID NO: 21965 - DNA, 25 bp, Homo sapien
attcctggggtttaattgttgtgca

SEQ ID NO: 21966 - DNA, 25 bp, Homo sapien
gttatgccaaaggtgagtcccagta

SEQ ID NO: 21967 - DNA, 25 bp, Homo sapien
gagtcccagtaacctgggaggtggg

SEQ ID NO: 21968 - DNA, 25 bp, Homo sapien
ctctttactgtgatttccattcgtt

SEQ ID NO: 21969 - DNA, 25 bp, Homo sapien
gatttccattcgttgttgaacattt

SEQ ID NO: 21970 - DNA, 25 bp, Homo sapien
tgaacattttccttagctgagctat

SEQ ID NO: 21971 - DNA, 25 bp, Homo sapien
agctgagctattttttgtccaaaga

SEQ ID NO: 21972 - DNA, 25 bp, Homo sapien
tatctggtatcagttttaggcccct

SEQ ID NO: 21973 - DNA, 25 bp, Homo sapien
ctcaatcttagttttctaatctgct

SEQ ID NO: 21974 - DNA, 25 bp, Homo sapien
tctgcttttttcagcgaatacatta

SEQ ID NO: 21975 - DNA, 25 bp, Homo sapien
gcgaatacattataaacactttccc

SEQ ID NO: 21976 - DNA, 25 bp, Homo sapien
aacactttcccacaaacatgattta

SEQ ID NO: 21977 - DNA, 25 bp, Homo sapien
caggccttttccactttgagggagg

SEQ ID NO: 21978 - DNA, 25 bp, Homo sapien
gccttttccactttgagggaggtgc

SEQ ID NO: 21979 - DNA, 25 bp, Homo sapien
tttccactttgagggaggtgcttcg

SEQ ID NO: 21980 - DNA, 25 bp, Homo sapien
ccactttgagggaggtgcttcgaag

SEQ ID NO: 21981 - DNA, 25 bp, Homo sapien
ggaggtgcttcgaagaatgttgccc

SEQ ID NO: 21982 - DNA, 25 bp, Homo sapien
tgcttcgaagaatgttgcccacacc

SEQ ID NO: 21983 - DNA, 25 bp, Homo sapien
ttcgaagaatgttgcccacacctaa

SEQ ID NO: 21984 - DNA, 25 bp, Homo sapien
tgcccacacctaagtgttagaagcc

SEQ ID NO: 21985 - DNA, 25 bp, Homo sapien
aagtgttagaagcctatgtccgttc

SEQ ID NO: 21986 - DNA, 25 bp, Homo sapien
tgttagaagcctatgtccgttcatc

SEQ ID NO: 21987 - DNA, 25 bp, Homo sapien
tccgttcatccctgagaggtctgaa

SEQ ID NO: 21988 - DNA, 25 bp, Homo sapien
gagaattaaccattgatacctcctg

SEQ ID NO: 21989 - DNA, 25 bp, Homo sapien
attaaccattgatacctcctggctg

SEQ ID NO: 21990 - DNA, 25 bp, Homo sapien
attgatacctcctggctgggtgagg

SEQ ID NO: 21991 - DNA, 25 bp, Homo sapien
tgagattgcgtcactgaactccggc

SEQ ID NO: 21992 - DNA, 25 bp, Homo sapien
catgagagccgaggtgggaggcatg

SEQ ID NO: 21993 - DNA, 25 bp, Homo sapien
gtgggaggcatgggaaacagtgcag

SEQ ID NO: 21994 - DNA, 25 bp, Homo sapien
caccaaccacccatattcaggagaa

SEQ ID NO: 21995 - DNA, 25 bp, Homo sapien
ccaaccacccatattcaggagaaga

SEQ ID NO: 21996 - DNA, 25 bp, Homo sapien
gaagaggacagacacggcacctctg

SEQ ID NO: 21997 - DNA, 25 bp, Homo sapien
agaggacagacacggcacctctgag

SEQ ID NO: 21998 - DNA, 25 bp, Homo sapien
ttccatttgttcagtggagagaatt

SEQ ID NO: 21999 - DNA, 25 bp, Homo sapien
cacagtgacgtactccatctcacat

SEQ ID NO: 22000 - DNA, 25 bp, Homo sapien
tgcctcagtgagggatcagggcagc

SEQ ID NO: 22001 - DNA, 25 bp, Homo sapien
aagggccaagaccatctgagccagc

SEQ ID NO: 22002 - DNA, 25 bp, Homo sapien
cttagccaccagagagctacatttt

SEQ ID NO: 22003 - DNA, 25 bp, Homo sapien
aaggctgtcttggcaaaaatactcc

SEQ ID NO: 22004 - DNA, 25 bp, Homo sapien
tccatttgggaactcactgccttat

SEQ ID NO: 22005 - DNA, 25 bp, Homo sapien
tgatgttttcagaagttggccactg

SEQ ID NO: 22006 - DNA, 25 bp, Homo sapien
gagagtgtaattttcagccttttat

SEQ ID NO: 22007 - DNA, 25 bp, Homo sapien
aattttcagccttttatatcactaa

SEQ ID NO: 22008 - DNA, 25 bp, Homo sapien
tgagaaacagggccgagcacagtgg

SEQ ID NO: 22009 - DNA, 25 bp, Homo sapien
ataccagcaccttagaggtcgaggc

SEQ ID NO: 22010 - DNA, 25 bp, Homo sapien
gctcgacgtatttcaaacatttcaa

SEQ ID NO: 22011 - DNA, 25 bp, Homo sapien
aatccagtgtagctggccacttatc

SEQ ID NO: 22012 - DNA, 25 bp, Homo sapien
ggccacttatccagggctttttcta

SEQ ID NO: 22013 - DNA, 25 bp, Homo sapien
ggctttttctacttcatcacaagga

SEQ ID NO: 22014 - DNA, 25 bp, Homo sapien
gaaagtgtctgctttttttatcctt

SEQ ID NO: 22015 - DNA, 25 bp, Homo sapien
tttatccttaaaattcacctgtcag

SEQ ID NO: 22016 - DNA, 25 bp, Homo sapien
gagctctgtattttttggcattctt

SEQ ID NO: 22017 - DNA, 25 bp, Homo sapien
gatactgggaattttctttttcctg

SEQ ID NO: 22018 - DNA, 25 bp, Homo sapien
tttcctgaaactttgaatcacccta

SEQ ID NO: 22019 - DNA, 25 bp, Homo sapien
gacttatgtgctcttactgattgaa

SEQ ID NO: 22020 - DNA, 25 bp, Homo sapien
atcacattttaataccacagcactt

SEQ ID NO: 22021 - DNA, 25 bp, Homo sapien
aagcgtttaaccagagctcatccct

SEQ ID NO: 22022 - DNA, 25 bp, Homo sapien
agctctgccttcgttagacatcaga

SEQ ID NO: 22023 - DNA, 25 bp, Homo sapien
agagactccacgccggagagtaact

SEQ ID NO: 22024 - DNA, 25 bp, Homo sapien
cacgccggagagtaactaggaacat

SEQ ID NO: 22025 - DNA, 25 bp, Homo sapien
gtggagagagtcccggacatgccga

SEQ ID NO: 22026 - DNA, 25 bp, Homo sapien
gacatgccgactcaggacaggtggg

SEQ ID NO: 22027 - DNA, 25 bp, Homo sapien
aggtgggtgaggatctgagaaatgc

SEQ ID NO: 22028 - DNA, 25 bp, Homo sapien
agcatctgaagacatctaacttaga

SEQ ID NO: 22029 - DNA, 25 bp, Homo sapien
aacttagagtctgcagcccagagcc

SEQ ID NO: 22030 - DNA, 25 bp, Homo sapien
gagccacatgcaaaacaccttcaat

SEQ ID NO: 22031 - DNA, 25 bp, Homo sapien
aaacaccttcaataaacagccacta

SEQ ID NO: 22032 - DNA, 25 bp, Homo sapien
agttcagttccttctggcagagagg

SEQ ID NO: 22033 - DNA, 25 bp, Homo sapien
ccatgccatatggatgtgactcaaa

SEQ ID NO: 22034 - DNA, 25 bp, Homo sapien
caaatgaggggtcccacagcttttc

SEQ ID NO: 22035 - DNA, 25 bp, Homo sapien
aagagggtcggcagtggacgcgtac

SEQ ID NO: 22036 - DNA, 25 bp, Homo sapien
gtggacgcgtacattttgtcacgga

SEQ ID NO: 22037 - DNA, 25 bp, Homo sapien
attttgtcacggagtccacagagct

SEQ ID NO: 22038 - DNA, 25 bp, Homo sapien
gagctgagcttttgagcagactctg

SEQ ID NO: 22039 - DNA, 25 bp, Homo sapien
gcagactctgagaagtatcattgct

SEQ ID NO: 22040 - DNA, 25 bp, Homo sapien
gagaagtatcattgcttgtgttgaa

SEQ ID NO: 22041 - DNA, 25 bp, Homo sapien
tacaacaggatttaagtttctcttt

SEQ ID NO: 22042 - DNA, 25 bp, Homo sapien
tgcactgaagaaaggccgggcgcgg

SEQ ID NO: 22043 - DNA, 25 bp, Homo sapien
cagtcattttattctcaagtgctta

SEQ ID NO: 22044 - DNA, 25 bp, Homo sapien
aagcttagctgactacagaataggt

SEQ ID NO: 22045 - DNA, 25 bp, Homo sapien
ggtgagggtttcttaaaaatgagat

SEQ ID NO: 22046 - DNA, 25 bp, Homo sapien
aatgagatttaagggctgggcacgg

SEQ ID NO: 22047 - DNA, 25 bp, Homo sapien
gttttgtcattactggtgggatctg

SEQ ID NO: 22048 - DNA, 25 bp, Homo sapien
tactggtgggatctggtcacacaag

SEQ ID NO: 22049 - DNA, 25 bp, Homo sapien
gggatctggtcacacaagatagcat

SEQ ID NO: 22050 - DNA, 25 bp, Homo sapien
aagatagcattaaacgtgacatggc

SEQ ID NO: 22051 - DNA, 25 bp, Homo sapien
gtgacatggcacataaaattggtta

SEQ ID NO: 22052 - DNA, 25 bp, Homo sapien
gtaatgtaaaagcccaacaaacact

SEQ ID NO: 22053 - DNA, 25 bp, Homo sapien
agcccaacaaacactttatgcaaga

SEQ ID NO: 22054 - DNA, 25 bp, Homo sapien
gtgagccccagcactaggtgggaag

SEQ ID NO: 22055 - DNA, 25 bp, Homo sapien
cagccccctcagtctgatgaattgc

SEQ ID NO: 22056 - DNA, 25 bp, Homo sapien
gatgaattgcttagcctgttgcctt

SEQ ID NO: 22057 - DNA, 25 bp, Homo sapien
gcctgttgcctttgactaggggcct

SEQ ID NO: 22058 - DNA, 25 bp, Homo sapien
ggcctcattaactctaggggtccct

SEQ ID NO: 22059 - DNA, 25 bp, Homo sapien
tcttcctgtacccacatttggggga

SEQ ID NO: 22060 - DNA, 25 bp, Homo sapien
ggagggaggaacagtcagccacagc

SEQ ID NO: 22061 - DNA, 25 bp, Homo sapien
tctccaccccaagctttgaggaaga

SEQ ID NO: 22062 - DNA, 25 bp, Homo sapien
gggaccctctccacagaggggatgt

SEQ ID NO: 22063 - DNA, 25 bp, Homo sapien
gtggtccctggtcatgacataacct

SEQ ID NO: 22064 - DNA, 25 bp, Homo sapien
ggactggctcaagtgcccaaggttt

SEQ ID NO: 22065 - DNA, 25 bp, Homo sapien
actctgtatctgtttctagcatgtg

SEQ ID NO: 22066 - DNA, 25 bp, Homo sapien
gcatgtgctgcattgactctattaa

SEQ ID NO: 22067 - DNA, 25 bp, Homo sapien
acatttcaaattcaccctacattcc

SEQ ID NO: 22068 - DNA, 25 bp, Homo sapien
cactagcctctctgaaggtgtcctg

SEQ ID NO: 22069 - DNA, 25 bp, Homo sapien
tggccagccctggagaagcactggt

SEQ ID NO: 22070 - DNA, 25 bp, Homo sapien
ggagaagcactggtgtctgcagcac

SEQ ID NO: 22071 - DNA, 25 bp, Homo sapien
acaaggcccaggctggggccagggc

SEQ ID NO: 22072 - DNA, 25 bp, Homo sapien
ctcagcccacaggccactgtgataa

SEQ ID NO: 22073 - DNA, 25 bp, Homo sapien
aatggtctgtttagcacttctgtat

SEQ ID NO: 22074 - DNA, 25 bp, Homo sapien
gaggggaaggccctggattctcact

SEQ ID NO: 22075 - DNA, 25 bp, Homo sapien
tctctttctttgttctgtttgttta

SEQ ID NO: 22076 - DNA, 25 bp, Homo sapien
aacaacagtgtcgcaatcattcctc

SEQ ID NO: 22077 - DNA, 25 bp, Homo sapien
gtcgcaatcattcctcagttatggc

SEQ ID NO: 22078 - DNA, 25 bp, Homo sapien
aatcattcctcagttatggcaagaa

SEQ ID NO: 22079 - DNA, 25 bp, Homo sapien
agcccacaggccaagataacttata

SEQ ID NO: 22080 - DNA, 25 bp, Homo sapien
aaatgtgttcactggaaactggctg

SEQ ID NO: 22081 - DNA, 25 bp, Homo sapien
gtgttcactggaaactggctgttga

SEQ ID NO: 22082 - DNA, 25 bp, Homo sapien
tgggagctgaggagctgtgtctctg

SEQ ID NO: 22083 - DNA, 25 bp, Homo sapien
gcatggggactggccacaagcaaag

SEQ ID NO: 22084 - DNA, 25 bp, Homo sapien
ggccacaagcaaagagtcagcagca

SEQ ID NO: 22085 - DNA, 25 bp, Homo sapien
agctgtagcgtgtgcagcaggcgcc

SEQ ID NO: 22086 - DNA, 25 bp, Homo sapien
ccaacagcatgggaacaacagtgtc

SEQ ID NO: 22087 - DNA, 25 bp, Homo sapien
ctggtccctgtggtactcagagtat

SEQ ID NO: 22088 - DNA, 25 bp, Homo sapien
gtatcgcttccctgaagaactcact

SEQ ID NO: 22089 - DNA, 25 bp, Homo sapien
gaactcactcagaccttcatgagct

SEQ ID NO: 22090 - DNA, 25 bp, Homo sapien
gagctgcaatctcatcactggaatg

SEQ ID NO: 22091 - DNA, 25 bp, Homo sapien
atttctggagtctgggtcttccgag

SEQ ID NO: 22092 - DNA, 25 bp, Homo sapien
gacgctggttcgagagtacttttcc

SEQ ID NO: 22093 - DNA, 25 bp, Homo sapien
ggccttccagcatgtgggcaaagcc

SEQ ID NO: 22094 - DNA, 25 bp, Homo sapien
caagtgaacatctcttgccatcacc

SEQ ID NO: 22095 - DNA, 25 bp, Homo sapien
tgcacctgcccttcagggagatggg

SEQ ID NO: 22096 - DNA, 25 bp, Homo sapien
cacctgcccaagagtacctttgtgt

SEQ ID NO: 22097 - DNA, 25 bp, Homo sapien
acactctctgtggcactgccatatt

SEQ ID NO: 22098 - DNA, 25 bp, Homo sapien
agggcctacctggagagggactgcc

SEQ ID NO: 22099 - DNA, 25 bp, Homo sapien
tgccctgcacagctgcagcagttgc

SEQ ID NO: 22100 - DNA, 25 bp, Homo sapien
gttttggaccaacaagtgcctcctt

SEQ ID NO: 22101 - DNA, 25 bp, Homo sapien
tcatgtgacctcttcagtgaccact

SEQ ID NO: 22102 - DNA, 25 bp, Homo sapien
tacggtgtcgggccttgaactacta

SEQ ID NO: 22103 - DNA, 25 bp, Homo sapien
tacccccagaacatcaccatgaagt

SEQ ID NO: 22104 - DNA, 25 bp, Homo sapien
gggctggataaccttggctgtaccc

SEQ ID NO: 22105 - DNA, 25 bp, Homo sapien
agcccctcattgtgatctgggagcc

SEQ ID NO: 22106 - DNA, 25 bp, Homo sapien
ggcaccctagtcattggagtcatca

SEQ ID NO: 22107 - DNA, 25 bp, Homo sapien
gaattgctgtttttgtcgtcatctt

SEQ ID NO: 22108 - DNA, 25 bp, Homo sapien
agaggagccatggggcactacgtct

SEQ ID NO: 22109 - DNA, 25 bp, Homo sapien
gaccttgcccacgtggtagagatct

SEQ ID NO: 22110 - DNA, 25 bp, Homo sapien
gatctatgactttgaaccagcgctc

SEQ ID NO: 22111 - DNA, 25 bp, Homo sapien
ccagcgctcaagacggaggacctgc

SEQ ID NO: 22112 - DNA, 25 bp, Homo sapien
gctggcaacgttttctgagttccaa

SEQ ID NO: 22113 - DNA, 25 bp, Homo sapien
ggggttcaggattcagtgggtggat

SEQ ID NO: 22114 - DNA, 25 bp, Homo sapien
gtgggtggatgatactcacgcactc

SEQ ID NO: 22115 - DNA, 25 bp, Homo sapien
gcagtcaaagctcaaagccttgcag

SEQ ID NO: 22116 - DNA, 25 bp, Homo sapien
tgcagaggccaaaactcctgcgtct

SEQ ID NO: 22117 - DNA, 25 bp, Homo sapien
aaagaaagagcggcctgctgtccgg

SEQ ID NO: 22118 - DNA, 25 bp, Homo sapien
caacaccataagccttcacagacgc

SEQ ID NO: 22119 - DNA, 25 bp, Homo sapien
caccctcgagcttcaccatggggtg

SEQ ID NO: 22120 - DNA, 25 bp, Homo sapien
catggcatgatgttgtgtttttctt

SEQ ID NO: 22121 - DNA, 25 bp, Homo sapien
atcaggaggcacaagatattgatca

SEQ ID NO: 22122 - DNA, 25 bp, Homo sapien
caagatattgatcagttctattact

SEQ ID NO: 22123 - DNA, 25 bp, Homo sapien
gttctattactggttatgttaactt

SEQ ID NO: 22124 - DNA, 25 bp, Homo sapien
acttcaagctttggttaagatggtg

SEQ ID NO: 22125 - DNA, 25 bp, Homo sapien
taagatggtgtctgccaggtgtctc

SEQ ID NO: 22126 - DNA, 25 bp, Homo sapien
gccaggtgtctccattgtaaagtta

SEQ ID NO: 22127 - DNA, 25 bp, Homo sapien
gaatacatttaaagaaccatctact

SEQ ID NO: 22128 - DNA, 25 bp, Homo sapien
aaccatctactaatttctaaccata

SEQ ID NO: 22129 - DNA, 25 bp, Homo sapien
catctactaatttctaaccatatat

SEQ ID NO: 22130 - DNA, 25 bp, Homo sapien
tctttttctatagacaccaaatctg

SEQ ID NO: 22131 - DNA, 25 bp, Homo sapien
aagggagctcaaggtcacaagaaga

SEQ ID NO: 22132 - DNA, 25 bp, Homo sapien
gaaaggaacaatcagcagccctgtt

SEQ ID NO: 22133 - DNA, 25 bp, Homo sapien
gcagccctgttcagaaggtggtttg

SEQ ID NO: 22134 - DNA, 25 bp, Homo sapien
gaagacttcattgctgtagtttgga

SEQ ID NO: 22135 - DNA, 25 bp, Homo sapien
gctgtagtttggattaactcccctc

SEQ ID NO: 22136 - DNA, 25 bp, Homo sapien
ccccatcccaaactgcatttataat

SEQ ID NO: 22137 - DNA, 25 bp, Homo sapien
gtgactgaggatcatttgtttgtta

SEQ ID NO: 22138 - DNA, 25 bp, Homo sapien
ttgtttgttaatgtactgtgccttt

SEQ ID NO: 22139 - DNA, 25 bp, Homo sapien
gtactgtgcctttaactttagacaa

SEQ ID NO: 22140 - DNA, 25 bp, Homo sapien
ttttattttgatgtcctgttggctc

SEQ ID NO: 22141 - DNA, 25 bp, Homo sapien
gtcctgttggctcagtaatgctcaa

SEQ ID NO: 22142 - DNA, 25 bp, Homo sapien
gtttatcactactagaagcaagaga

SEQ ID NO: 22143 - DNA, 25 bp, Homo sapien
aagcagacggtgatgtggttaatga

SEQ ID NO: 22144 - DNA, 25 bp, Homo sapien
gaactccaaatgaaaccacatcagt

SEQ ID NO: 22145 - DNA, 25 bp, Homo sapien
agtaacctttgcctgaaggttctgt

SEQ ID NO: 22146 - DNA, 25 bp, Homo sapien
aggttctgtgaactccttaagcgtt

SEQ ID NO: 22147 - DNA, 25 bp, Homo sapien
tccccaccccgaataagcgtattct

SEQ ID NO: 22148 - DNA, 25 bp, Homo sapien
aagcgtattcttctgggaaaaggca

SEQ ID NO: 22149 - DNA, 25 bp, Homo sapien
aatgaactttcttctcagaccttga

SEQ ID NO: 22150 - DNA, 25 bp, Homo sapien
tgatagactgagctttatgcacaca

SEQ ID NO: 22151 - DNA, 25 bp, Homo sapien
ggcatcgaatccggcaaaaacagga

SEQ ID NO: 22152 - DNA, 25 bp, Homo sapien
gaacagcagctattacatgataaac

SEQ ID NO: 22153 - DNA, 25 bp, Homo sapien
cgcgcggccgagggagcaaagggct

SEQ ID NO: 22154 - DNA, 25 bp, Homo sapien
gcgcggccgagggagcaaagggctc

SEQ ID NO: 22155 - DNA, 25 bp, Homo sapien
gagggagcaaagggctcggcactcg

SEQ ID NO: 22156 - DNA, 25 bp, Homo sapien
tagggcgaggcggggagggcctcga

SEQ ID NO: 22157 - DNA, 25 bp, Homo sapien
cgcttagacctgggctcgccaggtc

SEQ ID NO: 22158 - DNA, 25 bp, Homo sapien
cttagacctgggctcgccaggtcct

SEQ ID NO: 22159 - DNA, 25 bp, Homo sapien
tagacctgggctcgccaggtcctaa

SEQ ID NO: 22160 - DNA, 25 bp, Homo sapien
cctgggctcgccaggtcctaaagaa

SEQ ID NO: 22161 - DNA, 25 bp, Homo sapien
tgggctcgccaggtcctaaagaaga

SEQ ID NO: 22162 - DNA, 25 bp, Homo sapien
ggtcctaaagaagagcctgcgcctc

SEQ ID NO: 22163 - DNA, 25 bp, Homo sapien
gaagccgaagcagagctcggcgccg

SEQ ID NO: 22164 - DNA, 25 bp, Homo sapien
aatttccacagatacttcccttaga

SEQ ID NO: 22165 - DNA, 25 bp, Homo sapien
tgagcgaggccttgtcaattttaag

SEQ ID NO: 22166 - DNA, 25 bp, Homo sapien
taggaaggaccacaacatgacccgt

SEQ ID NO: 22167 - DNA, 25 bp, Homo sapien
tacacactttatttacttcgttttg

SEQ ID NO: 22168 - DNA, 25 bp, Homo sapien
gttggcttctgtttctagttgagga

SEQ ID NO: 22169 - DNA, 25 bp, Homo sapien
tcctctttttccatcataattctaa

SEQ ID NO: 22170 - DNA, 25 bp, Homo sapien
gatttgcccatttacacttttgaga

SEQ ID NO: 22171 - DNA, 25 bp, Homo sapien
gtaaataaccccattctttgcttga

SEQ ID NO: 22172 - DNA, 25 bp, Homo sapien
gtattttcccaatagcactttcatt

SEQ ID NO: 22173 - DNA, 25 bp, Homo sapien
attgccagtgtctttctttggtgcc

SEQ ID NO: 22174 - DNA, 25 bp, Homo sapien
ttcagcattcttagcctgtggcaat

SEQ ID NO: 22175 - DNA, 25 bp, Homo sapien
gaggcagtggcttcaagtcgtcctc

SEQ ID NO: 22176 - DNA, 25 bp, Homo sapien
ctgcgtcgtccaccaagaaggacaa

SEQ ID NO: 22177 - DNA, 25 bp, Homo sapien
gctgcagcagctgcgtctcaagatc

SEQ ID NO: 22178 - DNA, 25 bp, Homo sapien
agcagctgcgtctcaagatcaacag

SEQ ID NO: 22179 - DNA, 25 bp, Homo sapien
cagctgcgtctcaagatcaacagcc

SEQ ID NO: 22180 - DNA, 25 bp, Homo sapien
acgacctcaacatcgccatggatgg

SEQ ID NO: 22181 - DNA, 25 bp, Homo sapien
acctcaacatcgccatggatggcct

SEQ ID NO: 22182 - DNA, 25 bp, Homo sapien
tgctcaccaactcgctggaggagat

SEQ ID NO: 22183 - DNA, 25 bp, Homo sapien
ggaggagatgaagcgactggtgagc

SEQ ID NO: 22184 - DNA, 25 bp, Homo sapien
gaagcgactggtgagcgagatctac

SEQ ID NO: 22185 - DNA, 25 bp, Homo sapien
tggtgagcgagatctacgggggcca

SEQ ID NO: 22186 - DNA, 25 bp, Homo sapien
aattccaagtgaagcagcacagtgc

SEQ ID NO: 22187 - DNA, 25 bp, Homo sapien
atcctatcttccttttaggcttgaa

SEQ ID NO: 22188 - DNA, 25 bp, Homo sapien
taggcttgaatatgatgctgaacag

SEQ ID NO: 22189 - DNA, 25 bp, Homo sapien
aacaatcctgctttctcaagtacta

SEQ ID NO: 22190 - DNA, 25 bp, Homo sapien
gtactattctaacattgcgctttat

SEQ ID NO: 22191 - DNA, 25 bp, Homo sapien
agggatgatatttctaccacctcac

SEQ ID NO: 22192 - DNA, 25 bp, Homo sapien
gattttcctggtatgtctgttattt

SEQ ID NO: 22193 - DNA, 25 bp, Homo sapien
tgggtgctgccaaaattccaggcca

SEQ ID NO: 22194 - DNA, 25 bp, Homo sapien
tccaggccattttgcagggactctg

SEQ ID NO: 22195 - DNA, 25 bp, Homo sapien
gggactctgaagtgacctttagtag

SEQ ID NO: 22196 - DNA, 25 bp, Homo sapien
gtagtaatagtcttatgtgcagtaa

SEQ ID NO: 22197 - DNA, 25 bp, Homo sapien
agcctgggggacaagagtgaatctg

SEQ ID NO: 22198 - DNA, 25 bp, Homo sapien
gagtgaatctgtgtctcaccaaaaa

SEQ ID NO: 22199 - DNA, 25 bp, Homo sapien
aaagatgcttaacaaaggttaccat

SEQ ID NO: 22200 - DNA, 25 bp, Homo sapien
aggttaccataagccacaaattcat

SEQ ID NO: 22201 - DNA, 25 bp, Homo sapien
accacttatccttccagtttcaagt

SEQ ID NO: 22202 - DNA, 25 bp, Homo sapien
tatccttccagtttcaagtagaata

SEQ ID NO: 22203 - DNA, 25 bp, Homo sapien
gtagaatatattcataacctcaata

SEQ ID NO: 22204 - DNA, 25 bp, Homo sapien
taacctcaataaagttctccctgct

SEQ ID NO: 22205 - DNA, 25 bp, Homo sapien
gcagtgagccaagacagtgccagtg

SEQ ID NO: 22206 - DNA, 25 bp, Homo sapien
agcctcggtgacagcgcaaggctcc

SEQ ID NO: 22207 - DNA, 25 bp, Homo sapien
tcagccttggcaacacggtgaaacc

SEQ ID NO: 22208 - DNA, 25 bp, Homo sapien
agtactcggtgtggatcggtggctc

SEQ ID NO: 22209 - DNA, 25 bp, Homo sapien
ctgtccaccttccagcagatgtgga

SEQ ID NO: 22210 - DNA, 25 bp, Homo sapien
gcaggagtacgacgagtcgggcccc

SEQ ID NO: 22211 - DNA, 25 bp, Homo sapien
gatgcgtagcatttgctgcatgggt

SEQ ID NO: 22212 - DNA, 25 bp, Homo sapien
gaacttgttgctgattttgaccttg

SEQ ID NO: 22213 - DNA, 25 bp, Homo sapien
gcttggtcacttcgtggctaaggta

SEQ ID NO: 22214 - DNA, 25 bp, Homo sapien
ttggtgagtctgtgtggccagcagc

SEQ ID NO: 22215 - DNA, 25 bp, Homo sapien
cagcctctgatctgtgcagggtatt

SEQ ID NO: 22216 - DNA, 25 bp, Homo sapien
gtgttctgggatttctctagaggct

SEQ ID NO: 22217 - DNA, 25 bp, Homo sapien
gaaccagttgttttgtcttgcgggt

SEQ ID NO: 22218 - DNA, 25 bp, Homo sapien
tcttgcgggtctgtcagggttggaa

SEQ ID NO: 22219 - DNA, 25 bp, Homo sapien
tggcgagtatggtgcggaggccctg

SEQ ID NO: 22220 - DNA, 25 bp, Homo sapien
ctggagaggatgttcctgtccttcc

SEQ ID NO: 22221 - DNA, 25 bp, Homo sapien
cacggctctgcccaggttaagggcc

SEQ ID NO: 22222 - DNA, 25 bp, Homo sapien
agagaacccaccatggtgctgtctc

SEQ ID NO: 22223 - DNA, 25 bp, Homo sapien
cgcacaagcttcgggtggacccggt

SEQ ID NO: 22224 - DNA, 25 bp, Homo sapien
tcaacttcaagctcctaagccactg

SEQ ID NO: 22225 - DNA, 25 bp, Homo sapien
gacaagttcctggcttctgtgagca

SEQ ID NO: 22226 - DNA, 25 bp, Homo sapien
tgctgtctcctgacgacaagaccaa

SEQ ID NO: 22227 - DNA, 25 bp, Homo sapien
ctgacctccaaataccgttaagctg

SEQ ID NO: 22228 - DNA, 25 bp, Homo sapien
acgacaagaccaacgtcaaggccgc

SEQ ID NO: 22229 - DNA, 25 bp, Homo sapien
tcaaggccgcctggggtaaggtcgg

SEQ ID NO: 22230 - DNA, 25 bp, Homo sapien
ctgctggacagagacgcgctcaagc

SEQ ID NO: 22231 - DNA, 25 bp, Homo sapien
gctcaagcagagcctcgtggtggcc

SEQ ID NO: 22232 - DNA, 25 bp, Homo sapien
gtcacgcctgctgcaggcttcggga

SEQ ID NO: 22233 - DNA, 25 bp, Homo sapien
tgcagacctattcccacgaggtctc

SEQ ID NO: 22234 - DNA, 25 bp, Homo sapien
cctcactgcggactcgcggaagagc

SEQ ID NO: 22235 - DNA, 25 bp, Homo sapien
cgcggaagagccacctgattttccc

SEQ ID NO: 22236 - DNA, 25 bp, Homo sapien
aactatgcggacacgctcatcagcc

SEQ ID NO: 22237 - DNA, 25 bp, Homo sapien
gacacgctcatcagccaggagagct

SEQ ID NO: 22238 - DNA, 25 bp, Homo sapien
aagcgagcctcttctgataactcag

SEQ ID NO: 22239 - DNA, 25 bp, Homo sapien
gaaaggagattccaacctacttcag

SEQ ID NO: 22240 - DNA, 25 bp, Homo sapien
acctacttcaggtgagtttatttat

SEQ ID NO: 22241 - DNA, 25 bp, Homo sapien
agtactcggtgtggatcggtggctc

SEQ ID NO: 22242 - DNA, 25 bp, Homo sapien
gcaggagtacgacgagtcgggcccc

SEQ ID NO: 22243 - DNA, 25 bp, Homo sapien
tcgtccaccgcaaatgcttctaaac

SEQ ID NO: 22244 - DNA, 25 bp, Homo sapien
ctcatgctagcctcacgaaactgga

SEQ ID NO: 22245 - DNA, 25 bp, Homo sapien
gaacttgttgctgattttgaccttg

SEQ ID NO: 22246 - DNA, 25 bp, Homo sapien
tgaagttaactgttccccttggtat

SEQ ID NO: 22247 - DNA, 25 bp, Homo sapien
ataccctgtacatatctttgagttc

SEQ ID NO: 22248 - DNA, 25 bp, Homo sapien
tagtacgtgtggcttggtcacttcg

SEQ ID NO: 22249 - DNA, 25 bp, Homo sapien
ttggtgagtctgtgtggccagcagc

SEQ ID NO: 22250 - DNA, 25 bp, Homo sapien
cagcctctgatctgtgcagggtatt

SEQ ID NO: 22251 - DNA, 25 bp, Homo sapien
gtgttctgggatttctctagaggct

SEQ ID NO: 22252 - DNA, 25 bp, Homo sapien
tccttttctctactttgtaatttat

SEQ ID NO: 22253 - DNA, 25 bp, Homo sapien
gtaatttattgatcagtttctgttg

SEQ ID NO: 22254 - DNA, 25 bp, Homo sapien
gtttctgttgggagacgggtgtcct

SEQ ID NO: 22255 - DNA, 25 bp, Homo sapien
gcatgcggggagaggctgctccctc

SEQ ID NO: 22256 - DNA, 25 bp, Homo sapien
gtcttccttcttcgtccgaaaggag

SEQ ID NO: 22257 - DNA, 25 bp, Homo sapien
tagggggcgcagaatggcgcttccc

SEQ ID NO: 22258 - DNA, 25 bp, Homo sapien
tctggctccggggtttgcatgggag

SEQ ID NO: 22259 - DNA, 25 bp, Homo sapien
tgcatgggagaatcctctttccacg

SEQ ID NO: 22260 - DNA, 25 bp, Homo sapien
ccacgatgccgctgggcgacgtggc

SEQ ID NO: 22261 - DNA, 25 bp, Homo sapien
cccaggcgtcactcagtgatcacgg

SEQ ID NO: 22262 - DNA, 25 bp, Homo sapien
gtgatcacgggtaaagagaactgtt

SEQ ID NO: 22263 - DNA, 25 bp, Homo sapien
ccaccccagaggttgatggcgctga

SEQ ID NO: 22264 - DNA, 25 bp, Homo sapien
tgatggcgctgagagaacccgctgc

SEQ ID NO: 22265 - DNA, 25 bp, Homo sapien
cctcgtggctcctgtgtgaggtgtc

SEQ ID NO: 22266 - DNA, 25 bp, Homo sapien
cccaacatcctcctgatgtggctgg

SEQ ID NO: 22267 - DNA, 25 bp, Homo sapien
gaggtgaacacttctgggtttgccc

SEQ ID NO: 22268 - DNA, 25 bp, Homo sapien
ccagccacctacacgtgtgtggtca

SEQ ID NO: 22269 - DNA, 25 bp, Homo sapien
gtgtgtggtcagccacgaggactcc

SEQ ID NO: 22270 - DNA, 25 bp, Homo sapien
ggagcctagaagtcagctatgtaac

SEQ ID NO: 22271 - DNA, 25 bp, Homo sapien
agctatgtaacagaccatggcccca

SEQ ID NO: 22272 - DNA, 25 bp, Homo sapien
gaaatgatcccggaccagatccgtc

SEQ ID NO: 22273 - DNA, 25 bp, Homo sapien
cgagctcacagtacaaccacaataa

SEQ ID NO: 22274 - DNA, 25 bp, Homo sapien
tgtagtgtatcttagtggcctgcct

SEQ ID NO: 22275 - DNA, 25 bp, Homo sapien
tgtatcttagtggcctgcctagctg

SEQ ID NO: 22276 - DNA, 25 bp, Homo sapien
gtaactattatatacgccatggcct

SEQ ID NO: 22277 - DNA, 25 bp, Homo sapien
tatatacgccatggcctggggggca

SEQ ID NO: 22278 - DNA, 25 bp, Homo sapien
ggggcattgaaggaagtaagctctc

SEQ ID NO: 22279 - DNA, 25 bp, Homo sapien
gtaagctctcagagatcctaacact

SEQ ID NO: 22280 - DNA, 25 bp, Homo sapien
gctctcagagatcctaacactggct

SEQ ID NO: 22281 - DNA, 25 bp, Homo sapien
gatcctaacactggctgggaacctc

SEQ ID NO: 22282 - DNA, 25 bp, Homo sapien
ggctgggaacctctgactcagagca

SEQ ID NO: 22283 - DNA, 25 bp, Homo sapien
agcatgtctttaaagagtccacatc

SEQ ID NO: 22284 - DNA, 25 bp, Homo sapien
ttaaagagtccacatctggccaggc

SEQ ID NO: 22285 - DNA, 25 bp, Homo sapien
aactatggtggtggtgggaactata

SEQ ID NO: 22286 - DNA, 25 bp, Homo sapien
gggcagttttggtggaagaagctcg

SEQ ID NO: 22287 - DNA, 25 bp, Homo sapien
ggtggatatggtagcagaaggttct

SEQ ID NO: 22288 - DNA, 25 bp, Homo sapien
ggagttgtcaggaaagctgcaggtt

SEQ ID NO: 22289 - DNA, 25 bp, Homo sapien
aaagttactgcagcttaaacaggaa

SEQ ID NO: 22290 - DNA, 25 bp, Homo sapien
taaacaggaaacccttcttgttcag

SEQ ID NO: 22291 - DNA, 25 bp, Homo sapien
gttcaggactgtcatagccacagtt

SEQ ID NO: 22292 - DNA, 25 bp, Homo sapien
gtgtcaattagatgtacattcctga

SEQ ID NO: 22293 - DNA, 25 bp, Homo sapien
atctgttgtagctttgtctttttct

SEQ ID NO: 22294 - DNA, 25 bp, Homo sapien
ttttcttttcattacatcaggtata

SEQ ID NO: 22295 - DNA, 25 bp, Homo sapien
ttacatcaggtatattgccctgtaa

SEQ ID NO: 22296 - DNA, 25 bp, Homo sapien
gaaggcagcttgtgcggagaaactg

SEQ ID NO: 22297 - DNA, 25 bp, Homo sapien
gaaacgattggatgagaagcttggc

SEQ ID NO: 22298 - DNA, 25 bp, Homo sapien
gagaagcttggcatcctggaaaaac

SEQ ID NO: 22299 - DNA, 25 bp, Homo sapien
cacctccaaagttgcttgcacagca

SEQ ID NO: 22300 - DNA, 25 bp, Homo sapien
gaaaaacaaccatctccagaggaaa

SEQ ID NO: 22301 - DNA, 25 bp, Homo sapien
gaacgggagcgtgagaaagaacttg

SEQ ID NO: 22302 - DNA, 25 bp, Homo sapien
aagttgcttgcacagcagcatccac

SEQ ID NO: 22303 - DNA, 25 bp, Homo sapien
gaacaggagcgagagaaggagaggg

SEQ ID NO: 22304 - DNA, 25 bp, Homo sapien
tccacctccagatcgacaggcagta

SEQ ID NO: 22305 - DNA, 25 bp, Homo sapien
cctccagatcgacaggcagtacctg

SEQ ID NO: 22306 - DNA, 25 bp, Homo sapien
gcagtacctggaagaccaggcccct

SEQ ID NO: 22307 - DNA, 25 bp, Homo sapien
taaaaatgaccatatcctttgcccc

SEQ ID NO: 22308 - DNA, 25 bp, Homo sapien
tatcctttgccccataaattctact

SEQ ID NO: 22309 - DNA, 25 bp, Homo sapien
aagacatttatgtctgcattcttta

SEQ ID NO: 22310 - DNA, 25 bp, Homo sapien
gtctgcattctttataataacaaaa

SEQ ID NO: 22311 - DNA, 25 bp, Homo sapien
aaaaaaactccatgtcaagaaagtg

SEQ ID NO: 22312 - DNA, 25 bp, Homo sapien
gaaacgtggacatgtttgatatggt

SEQ ID NO: 22313 - DNA, 25 bp, Homo sapien
atgcatactatgattgtgactttgt

SEQ ID NO: 22314 - DNA, 25 bp, Homo sapien
gtaaaatctttatgcatgtggaagg

SEQ ID NO: 22315 - DNA, 25 bp, Homo sapien
gcatgtggaaggtaatctgcaaaac

SEQ ID NO: 22316 - DNA, 25 bp, Homo sapien
attcattgtgttagtgtagcgggat

SEQ ID NO: 22317 - DNA, 25 bp, Homo sapien
gtgttagtgtagcgggatatggaat

SEQ ID NO: 22318 - DNA, 25 bp, Homo sapien
gatcaggaggagacagccggcgttg

SEQ ID NO: 22319 - DNA, 25 bp, Homo sapien
cccccctcattaggaacggtgactg

SEQ ID NO: 22320 - DNA, 25 bp, Homo sapien
ggaccttccagatcctggtgatgct

SEQ ID NO: 22321 - DNA, 25 bp, Homo sapien
cagcgtggagatgtctacacctgcc

SEQ ID NO: 22322 - DNA, 25 bp, Homo sapien
gccccatcaccgtggagtggcgggc

SEQ ID NO: 22323 - DNA, 25 bp, Homo sapien
tggcgggctcagtctgaatctgccc

SEQ ID NO: 22324 - DNA, 25 bp, Homo sapien
tgctgagtggcgttggaggcttcgt

SEQ ID NO: 22325 - DNA, 25 bp, Homo sapien
aggagtcggaaagggcttctgcact

SEQ ID NO: 22326 - DNA, 25 bp, Homo sapien
tctgcactgactcctgagactgttt

SEQ ID NO: 22327 - DNA, 25 bp, Homo sapien
tatcactcttctgtgatgcctgctt

SEQ ID NO: 22328 - DNA, 25 bp, Homo sapien
aaagtcctacagtggctgtcacgca

SEQ ID NO: 22329 - DNA, 25 bp, Homo sapien
ggagtgggtctcagctattagtggt

SEQ ID NO: 22330 - DNA, 25 bp, Homo sapien
tacgcagactccgtgaagggccggt

SEQ ID NO: 22331 - DNA, 25 bp, Homo sapien
ggttcaccatctccagagacaattc

SEQ ID NO: 22332 - DNA, 25 bp, Homo sapien
tggagtctgggggaggcttggtaca

SEQ ID NO: 22333 - DNA, 25 bp, Homo sapien
tgagagccgaggacacggccgtcta

SEQ ID NO: 22334 - DNA, 25 bp, Homo sapien
ggccgtctattactgtgcggccgcc

SEQ ID NO: 22335 - DNA, 25 bp, Homo sapien
gccgccccaagacatgcggggagtc

SEQ ID NO: 22336 - DNA, 25 bp, Homo sapien
tcccccctatgactactggggccag

SEQ ID NO: 22337 - DNA, 25 bp, Homo sapien
tggggccagggaaccctggtcaccg

SEQ ID NO: 22338 - DNA, 25 bp, Homo sapien
attcacctttagcacctatggcatg

SEQ ID NO: 22339 - DNA, 25 bp, Homo sapien
tagcacctatggcatgagctgggtc

SEQ ID NO: 22340 - DNA, 25 bp, Homo sapien
catcctgaaccgctgcagcgagagc

SEQ ID NO: 22341 - DNA, 25 bp, Homo sapien
agagcaccaagcggaagctggcgtc

SEQ ID NO: 22342 - DNA, 25 bp, Homo sapien
tctgccgtctgaggctggagcgcag

SEQ ID NO: 22343 - DNA, 25 bp, Homo sapien
acgtgttctatagagcctggcgtct

SEQ ID NO: 22344 - DNA, 25 bp, Homo sapien
gcctggcgtctggacgccgagggca

SEQ ID NO: 22345 - DNA, 25 bp, Homo sapien
cccgccaccctcaataaatgttgct

SEQ ID NO: 22346 - DNA, 25 bp, Homo sapien
gttgcttggagtggaccgaggctct

SEQ ID NO: 22347 - DNA, 25 bp, Homo sapien
tggaccgaggctctgcaggaatgca

SEQ ID NO: 22348 - DNA, 25 bp, Homo sapien
aggaatgcagggagggccgggctcc

SEQ ID NO: 22349 - DNA, 25 bp, Homo sapien
gaaagacgacgtcacaggctacttc

SEQ ID NO: 22350 - DNA, 25 bp, Homo sapien
agtcagggcaagacgtgtcccaggc

SEQ ID NO: 22351 - DNA, 25 bp, Homo sapien
cagaactactgataagggtccatgt

SEQ ID NO: 22352 - DNA, 25 bp, Homo sapien
gttcagcggtgcacgtattatcttg

SEQ ID NO: 22353 - DNA, 25 bp, Homo sapien
aacgtctgaccacaaattcaccagg

SEQ ID NO: 22354 - DNA, 25 bp, Homo sapien
ttccccaccgtagtaagcctgaggg

SEQ ID NO: 22355 - DNA, 25 bp, Homo sapien
gggtactgcaggagatcagggcgta

SEQ ID NO: 22356 - DNA, 25 bp, Homo sapien
atcagggcgtatctcagtccttatc

SEQ ID NO: 22357 - DNA, 25 bp, Homo sapien
tcaaccacgtaagacagacattccc

SEQ ID NO: 22358 - DNA, 25 bp, Homo sapien
acagacattcccagagcagctgttt

SEQ ID NO: 22359 - DNA, 25 bp, Homo sapien
gagcagctgtttatagacctctccc

SEQ ID NO: 22360 - DNA, 25 bp, Homo sapien
tccctacttgcatgtccttttatag

SEQ ID NO: 22361 - DNA, 25 bp, Homo sapien
caattatcacggtggtcctgaggtg

SEQ ID NO: 22362 - DNA, 25 bp, Homo sapien
cagtatgtttctctgctcatcagag

SEQ ID NO: 22363 - DNA, 25 bp, Homo sapien
gtttctctgctcatcagagactccc

SEQ ID NO: 22364 - DNA, 25 bp, Homo sapien
tctctgctcatcagagactcccagc

SEQ ID NO: 22365 - DNA, 25 bp, Homo sapien
cctacctctgtgccgtgagagacta

SEQ ID NO: 22366 - DNA, 25 bp, Homo sapien
ctacctctgtgccgtgagagactac

SEQ ID NO: 22367 - DNA, 25 bp, Homo sapien
acctctgtgccgtgagagactacaa

SEQ ID NO: 22368 - DNA, 25 bp, Homo sapien
tctgtgccgtgagagactacaagct

SEQ ID NO: 22369 - DNA, 25 bp, Homo sapien
ctgtgccgtgagagactacaagctc

SEQ ID NO: 22370 - DNA, 25 bp, Homo sapien
tgccgtgagagactacaagctcagc

SEQ ID NO: 22371 - DNA, 25 bp, Homo sapien
gagactacaagctcagctttggagc

SEQ ID NO: 22372 - DNA, 25 bp, Homo sapien
ctacaagctcagctttggagccgga

SEQ ID NO: 22373 - DNA, 25 bp, Homo sapien
cacccgctgaccagtgtcaggcagg

SEQ ID NO: 22374 - DNA, 25 bp, Homo sapien
acccgctgaccagtgtcaggcaggg

SEQ ID NO: 22375 - DNA, 25 bp, Homo sapien
caaccggtcctcttggctgaggagg

SEQ ID NO: 22376 - DNA, 25 bp, Homo sapien
aaccggtcctcttggctgaggagga

SEQ ID NO: 22377 - DNA, 25 bp, Homo sapien
gtcaccctggctgcacagttagaga

SEQ ID NO: 22378 - DNA, 25 bp, Homo sapien
caccctggctgcacagttagagagg

SEQ ID NO: 22379 - DNA, 25 bp, Homo sapien
ggctgcacagttagagaggggagaa

SEQ ID NO: 22380 - DNA, 25 bp, Homo sapien
gaaggaacccatgatgggactcctg

SEQ ID NO: 22381 - DNA, 25 bp, Homo sapien
aaggaacccatgatgggactcctgg

SEQ ID NO: 22382 - DNA, 25 bp, Homo sapien
ccaacccttcctcaagagctgaagg

SEQ ID NO: 22383 - DNA, 25 bp, Homo sapien
tcctcaagagctgaagggatcccag

SEQ ID NO: 22384 - DNA, 25 bp, Homo sapien
cctgtcccttggctatgagcaggct

SEQ ID NO: 22385 - DNA, 25 bp, Homo sapien
cttggctatgagcaggctttggggg

SEQ ID NO: 22386 - DNA, 25 bp, Homo sapien
gggggcttagaggctgggatggctc

SEQ ID NO: 22387 - DNA, 25 bp, Homo sapien
gggcttagaggctgggatggctcct

SEQ ID NO: 22388 - DNA, 25 bp, Homo sapien
cctctttggacccagatctgttcat

SEQ ID NO: 22389 - DNA, 25 bp, Homo sapien
gacccagatctgttcatgcttttgt

SEQ ID NO: 22390 - DNA, 25 bp, Homo sapien
agatctgttcatgcttttgtcttcg

SEQ ID NO: 22391 - DNA, 25 bp, Homo sapien
tgtatggggtggaaaaatcaccggg

SEQ ID NO: 22392 - DNA, 25 bp, Homo sapien
gaaaaagttccatgactcgaatatc

SEQ ID NO: 22393 - DNA, 25 bp, Homo sapien
gttccatgactcgaatatctgaaat

SEQ ID NO: 22394 - DNA, 25 bp, Homo sapien
tacctgtcccttggctatgagcagg

SEQ ID NO: 22395 - DNA, 25 bp, Homo sapien
ttcacacccgcatggggacagctgt

SEQ ID NO: 22396 - DNA, 25 bp, Homo sapien
tggggacagctgtctgtgggctgca

SEQ ID NO: 22397 - DNA, 25 bp, Homo sapien
caagatgcctgatgcgctatgtcct

SEQ ID NO: 22398 - DNA, 25 bp, Homo sapien
ctgttccttctagattcttctgatg

SEQ ID NO: 22399 - DNA, 25 bp, Homo sapien
gcgactggaaagattcttcgactca

SEQ ID NO: 22400 - DNA, 25 bp, Homo sapien
gaagactttgaaatcctgtcccttt

SEQ ID NO: 22401 - DNA, 25 bp, Homo sapien
tcctgtccctttgaaaatcctgggg

SEQ ID NO: 22402 - DNA, 25 bp, Homo sapien
acctgtgagagcctggggctcctgg

SEQ ID NO: 22403 - DNA, 25 bp, Homo sapien
ttactgcttggtgtcagactgccca

SEQ ID NO: 22404 - DNA, 25 bp, Homo sapien
agccgtctgttaggagcttccagag

SEQ ID NO: 22405 - DNA, 25 bp, Homo sapien
gccggttctgtggttggtttggaat

SEQ ID NO: 22406 - DNA, 25 bp, Homo sapien
acggaagcaattaaaccctctcaga

SEQ ID NO: 22407 - DNA, 25 bp, Homo sapien
tgatatctttgctgacttaactgta

SEQ ID NO: 22408 - DNA, 25 bp, Homo sapien
gatatggatgacatcttctcctctg

SEQ ID NO: 22409 - DNA, 25 bp, Homo sapien
tcttctcctctggtatccaggctaa

SEQ ID NO: 22410 - DNA, 25 bp, Homo sapien
caaaaagccgatctgcacaggccgc

SEQ ID NO: 22411 - DNA, 25 bp, Homo sapien
gccgcacctgaaccaagatttgaac

SEQ ID NO: 22412 - DNA, 25 bp, Homo sapien
gtccaacatctttgatgatcccctg

SEQ ID NO: 22413 - DNA, 25 bp, Homo sapien
gatcccctgaatgcctttggaggcc

SEQ ID NO: 22414 - DNA, 25 bp, Homo sapien
ggccagtagagcacacagggtatcc

SEQ ID NO: 22415 - DNA, 25 bp, Homo sapien
ctcatcgttcacccaatgtacttgg

SEQ ID NO: 22416 - DNA, 25 bp, Homo sapien
gtacttggtatttttctgcactggt

SEQ ID NO: 22417 - DNA, 25 bp, Homo sapien
cacctctaccagcatctgctgagct

SEQ ID NO: 22418 - DNA, 25 bp, Homo sapien
aacaagcaattcctagacgatccca

SEQ ID NO: 22419 - DNA, 25 bp, Homo sapien
gcagtgatgaggatctgccctccaa

SEQ ID NO: 22420 - DNA, 25 bp, Homo sapien
tctgccctccaaactggaaggcttc

SEQ ID NO: 22421 - DNA, 25 bp, Homo sapien
ttggagtccccaagactcacctaga

SEQ ID NO: 22422 - DNA, 25 bp, Homo sapien
agtggctccggggagacgttcagct

SEQ ID NO: 22423 - DNA, 25 bp, Homo sapien
ttcagctaccctgactttctcagga

SEQ ID NO: 22424 - DNA, 25 bp, Homo sapien
gctgggcaagagatctgccatccta

SEQ ID NO: 22425 - DNA, 25 bp, Homo sapien
ccccccagccaagaaagctatctct

SEQ ID NO: 22426 - DNA, 25 bp, Homo sapien
aagctatctctgagttgccctgatt

SEQ ID NO: 22427 - DNA, 25 bp, Homo sapien
ggggcttctaatgacccagatatgg

SEQ ID NO: 22428 - DNA, 25 bp, Homo sapien
cggtccaggtcatctcacaaagatt

SEQ ID NO: 22429 - DNA, 25 bp, Homo sapien
atcaccatctggttcaaggacacct

SEQ ID NO: 22430 - DNA, 25 bp, Homo sapien
aaaaggtctaggcgatcacggtcta

SEQ ID NO: 22431 - DNA, 25 bp, Homo sapien
agatctccacacaggtctcataaaa

SEQ ID NO: 22432 - DNA, 25 bp, Homo sapien
gatgctgtcacttattggaaatgcg

SEQ ID NO: 22433 - DNA, 25 bp, Homo sapien
gaaatgcgatttgttttgtgcctga

SEQ ID NO: 22434 - DNA, 25 bp, Homo sapien
ttgtgcctgaacggtctgtttttta

SEQ ID NO: 22435 - DNA, 25 bp, Homo sapien
aactcatgagcaactgcatctgtag

SEQ ID NO: 22436 - DNA, 25 bp, Homo sapien
gcatctgtagatctgtcattgtttt

SEQ ID NO: 22437 - DNA, 25 bp, Homo sapien
ttactttcattgtggctatttctca

SEQ ID NO: 22438 - DNA, 25 bp, Homo sapien
gtgtataatggatctgctgacagta

SEQ ID NO: 22439 - DNA, 25 bp, Homo sapien
gccatcagaagcagagatctcccac

SEQ ID NO: 22440 - DNA, 25 bp, Homo sapien
cctcaatgactccagatactgcctg

SEQ ID NO: 22441 - DNA, 25 bp, Homo sapien
caatgactccagatactgcctgagc

SEQ ID NO: 22442 - DNA, 25 bp, Homo sapien
tccgctgtcaagtccagttctacgg

SEQ ID NO: 22443 - DNA, 25 bp, Homo sapien
ctgtcaagtccagttctacgggctc

SEQ ID NO: 22444 - DNA, 25 bp, Homo sapien
cagttctacgggctctcggagaatg

SEQ ID NO: 22445 - DNA, 25 bp, Homo sapien
tcggagaatgacgagtggacccagg

SEQ ID NO: 22446 - DNA, 25 bp, Homo sapien
aatgacgagtggacccaggataggg

SEQ ID NO: 22447 - DNA, 25 bp, Homo sapien
ccgaggcctggggtagagcagactg

SEQ ID NO: 22448 - DNA, 25 bp, Homo sapien
cctggggtagagcagactgtggctt

SEQ ID NO: 22449 - DNA, 25 bp, Homo sapien
tgatggccatggtcaagagaaagga

SEQ ID NO: 22450 - DNA, 25 bp, Homo sapien
cttgatttggtgaatacagttatat

SEQ ID NO: 22451 - DNA, 25 bp, Homo sapien
aaccttaaggtgacaagcattttct

SEQ ID NO: 22452 - DNA, 25 bp, Homo sapien
aagcattttctatgcctaaatcttc

SEQ ID NO: 22453 - DNA, 25 bp, Homo sapien
ttttctatgcctaaatcttcattgg

SEQ ID NO: 22454 - DNA, 25 bp, Homo sapien
ggtttgcctggaaagagtctctgtt

SEQ ID NO: 22455 - DNA, 25 bp, Homo sapien
gagtctctgttaaaagattttccat

SEQ ID NO: 22456 - DNA, 25 bp, Homo sapien
cttgctttctaattgtcttttggac

SEQ ID NO: 22457 - DNA, 25 bp, Homo sapien
tcttttggacacatgcctattttct

SEQ ID NO: 22458 - DNA, 25 bp, Homo sapien
gaggtataaacctttagatgtgaaa

SEQ ID NO: 22459 - DNA, 25 bp, Homo sapien
ttcattctgctattgtgtgtgcttg

SEQ ID NO: 22460 - DNA, 25 bp, Homo sapien
aatcctgctttgttggtaataaatc

SEQ ID NO: 22461 - DNA, 25 bp, Homo sapien
ggtcgctgctgtgatacataggagg

SEQ ID NO: 22462 - DNA, 25 bp, Homo sapien
cagtgcccagggctctgatgagtct

SEQ ID NO: 22463 - DNA, 25 bp, Homo sapien
tgagtctctcatcgcttgtaaagcc

SEQ ID NO: 22464 - DNA, 25 bp, Homo sapien
gaggcggagcagctgagagcctacc

SEQ ID NO: 22465 - DNA, 25 bp, Homo sapien
gagcctacctggagggcgagtgcgt

SEQ ID NO: 22466 - DNA, 25 bp, Homo sapien
gaacgggaaggagacgctgcagcgc

SEQ ID NO: 22467 - DNA, 25 bp, Homo sapien
gacaccgagcttgtggagaccaggc

SEQ ID NO: 22468 - DNA, 25 bp, Homo sapien
gcacgaggggctgcaggagccctgc

SEQ ID NO: 22469 - DNA, 25 bp, Homo sapien
cctgcaccctgagatggaagccgtc

SEQ ID NO: 22470 - DNA, 25 bp, Homo sapien
caccatccccaacttgggcatcgtt

SEQ ID NO: 22471 - DNA, 25 bp, Homo sapien
agctgtcctaggagctgtggtcgct

SEQ ID NO: 22472 - DNA, 25 bp, Homo sapien
tgcgctcaccatcaataaaagtaat

SEQ ID NO: 22473 - DNA, 25 bp, Homo sapien
gattgcagaaggtacagagcctccg

SEQ ID NO: 22474 - DNA, 25 bp, Homo sapien
cagaaggtacagagcctccgaaggg

SEQ ID NO: 22475 - DNA, 25 bp, Homo sapien
ccgaggaagatcccgggagacctgg

SEQ ID NO: 22476 - DNA, 25 bp, Homo sapien
gacctggggctgccgaagaagctct

SEQ ID NO: 22477 - DNA, 25 bp, Homo sapien
gaagaagctctgctccaaatggaga

SEQ ID NO: 22478 - DNA, 25 bp, Homo sapien
gaagctctgctccaaatggagagtg

SEQ ID NO: 22479 - DNA, 25 bp, Homo sapien
aaatggagagtgtagcctgagggct

SEQ ID NO: 22480 - DNA, 25 bp, Homo sapien
gcactcacgccctaataaggagcga

SEQ ID NO: 22481 - DNA, 25 bp, Homo sapien
ataaggagcgaatcctacatccacc

SEQ ID NO: 22482 - DNA, 25 bp, Homo sapien
tctgaaagaggtgcagtcactcaca

SEQ ID NO: 22483 - DNA, 25 bp, Homo sapien
gccaggagacccttgtggttgacta

SEQ ID NO: 22484 - DNA, 25 bp, Homo sapien
gtggttgactagggctgggagcaga

SEQ ID NO: 22485 - DNA, 25 bp, Homo sapien
gggttttgttcttggaggactatga

SEQ ID NO: 22486 - DNA, 25 bp, Homo sapien
aaagcccagcttgatgtgaatggac

SEQ ID NO: 22487 - DNA, 25 bp, Homo sapien
tgtgaatggacatcttgaccctccc

SEQ ID NO: 22488 - DNA, 25 bp, Homo sapien
tccctggaatgacgccagctctggg

SEQ ID NO: 22489 - DNA, 25 bp, Homo sapien
cctagtctccccatcttaagatagc

SEQ ID NO: 22490 - DNA, 25 bp, Homo sapien
atctttcacagagtcacctcctctg

SEQ ID NO: 22491 - DNA, 25 bp, Homo sapien
agagctgtcctcaaagcatccagtg

SEQ ID NO: 22492 - DNA, 25 bp, Homo sapien
cagaatatctgcactgtcttctgat

SEQ ID NO: 22493 - DNA, 25 bp, Homo sapien
tgtcttctgatcctgttagtcactg

SEQ ID NO: 22494 - DNA, 25 bp, Homo sapien
tcttgcgggtctgtcagggttggaa

SEQ ID NO: 22495 - DNA, 25 bp, Homo sapien
gaaagtccaagccgtaggacccagt

SEQ ID NO: 22496 - DNA, 25 bp, Homo sapien
agtttcctttcttagctgatgtctt

SEQ ID NO: 22497 - DNA, 25 bp, Homo sapien
gaacttgttgctgattttgaccttg

SEQ ID NO: 22498 - DNA, 25 bp, Homo sapien
ctgatgtctttggccagaacaccgt

SEQ ID NO: 22499 - DNA, 25 bp, Homo sapien
agaacaccgtgggctgttacttgct

SEQ ID NO: 22500 - DNA, 25 bp, Homo sapien
gaagcggtttgcatttacgcctgta

SEQ ID NO: 22501 - DNA, 25 bp, Homo sapien
ttttgtacgcaattctcgattcttt

SEQ ID NO: 22502 - DNA, 25 bp, Homo sapien
tgagaacattaggccccagcaacac

SEQ ID NO: 22503 - DNA, 25 bp, Homo sapien
tgtattcaagttaactgttcccctt

SEQ ID NO: 22504 - DNA, 25 bp, Homo sapien
gttccccttggtattaacatgtcag

SEQ ID NO: 22505 - DNA, 25 bp, Homo sapien
ggctccgaggcgcagagaagggggc

SEQ ID NO: 22506 - DNA, 25 bp, Homo sapien
gggtggaggaaggcaccatccatca

SEQ ID NO: 22507 - DNA, 25 bp, Homo sapien
gcacctggggctggatgtgagaggc

SEQ ID NO: 22508 - DNA, 25 bp, Homo sapien
ggatgtgagaggcctggaccagggc

SEQ ID NO: 22509 - DNA, 25 bp, Homo sapien
tgcagtgtctgtgttgggggctggc

SEQ ID NO: 22510 - DNA, 25 bp, Homo sapien
gggctggctccagggtgtggagagc

SEQ ID NO: 22511 - DNA, 25 bp, Homo sapien
tggagagcctgggagtggtctccgt

SEQ ID NO: 22512 - DNA, 25 bp, Homo sapien
gttcccgcaaggagcgactggggca

SEQ ID NO: 22513 - DNA, 25 bp, Homo sapien
agatggctaagggggccgcagacct

SEQ ID NO: 22514 - DNA, 25 bp, Homo sapien
tcccccagctcctgtgtggagaaag

SEQ ID NO: 22515 - DNA, 25 bp, Homo sapien
agaaagggcaacagctgtcccggat

SEQ ID NO: 22516 - DNA, 25 bp, Homo sapien
gactgctgtggatgtttttcgaagg

SEQ ID NO: 22517 - DNA, 25 bp, Homo sapien
gctgtggatgtttttcgaaggataa

SEQ ID NO: 22518 - DNA, 25 bp, Homo sapien
gatgtttttcgaaggataattttgg

SEQ ID NO: 22519 - DNA, 25 bp, Homo sapien
agtcttcatgctcggtgatgtgatt

SEQ ID NO: 22520 - DNA, 25 bp, Homo sapien
cttcatgctcggtgatgtgattctg

SEQ ID NO: 22521 - DNA, 25 bp, Homo sapien
aggacactgggaatatattctacct

SEQ ID NO: 22522 - DNA, 25 bp, Homo sapien
gataaactatgcttcttttttcttc

SEQ ID NO: 22523 - DNA, 25 bp, Homo sapien
ataaactatgcttcttttttcttct

SEQ ID NO: 22524 - DNA, 25 bp, Homo sapien
gattatgttaactctgagtctgtcc

SEQ ID NO: 22525 - DNA, 25 bp, Homo sapien
atgcatattgttacactactattaa

SEQ ID NO: 22526 - DNA, 25 bp, Homo sapien
tattgttacactactattaactagg

SEQ ID NO: 22527 - DNA, 25 bp, Homo sapien
agaaatctgaaatggctcactgaca

SEQ ID NO: 22528 - DNA, 25 bp, Homo sapien
gaaatctgaaatggctcactgacaa

SEQ ID NO: 22529 - DNA, 25 bp, Homo sapien
aaatctgaaatggctcactgacaag

SEQ ID NO: 22530 - DNA, 25 bp, Homo sapien
atctgaaatggctcactgacaaggg

SEQ ID NO: 22531 - DNA, 25 bp, Homo sapien
tctgaaatggctcactgacaagggg

SEQ ID NO: 22532 - DNA, 25 bp, Homo sapien
gacaagtttattttcttacagtcct

SEQ ID NO: 22533 - DNA, 25 bp, Homo sapien
caagtttattttcttacagtcctgg

SEQ ID NO: 22534 - DNA, 25 bp, Homo sapien
gtttattttcttacagtcctggaag

SEQ ID NO: 22535 - DNA, 25 bp, Homo sapien
tattttcttacagtcctggaagtca

SEQ ID NO: 22536 - DNA, 25 bp, Homo sapien
ttttcttacagtcctggaagtcaga

SEQ ID NO: 22537 - DNA, 25 bp, Homo sapien
tacagtcctggaagtcagaaatctg

SEQ ID NO: 22538 - DNA, 25 bp, Homo sapien
ttttccagcaatgggggcgtcgtca

SEQ ID NO: 22539 - DNA, 25 bp, Homo sapien
gcaatgggggcgtcgtcaaaggatt

SEQ ID NO: 22540 - DNA, 25 bp, Homo sapien
ggggcgtcgtcaaaggattcaagtt

SEQ ID NO: 22541 - DNA, 25 bp, Homo sapien
cttccagaaggaccgcaagatggca

SEQ ID NO: 22542 - DNA, 25 bp, Homo sapien
ggaccgcaagatggcactgatccag

SEQ ID NO: 22543 - DNA, 25 bp, Homo sapien
gatggcactgatccagatgggctcc

SEQ ID NO: 22544 - DNA, 25 bp, Homo sapien
cactgatccagatgggctccgtgga

SEQ ID NO: 22545 - DNA, 25 bp, Homo sapien
tgggctccgtggaggaggcggtcca

SEQ ID NO: 22546 - DNA, 25 bp, Homo sapien
cgacaacttccatcattccagagaa

SEQ ID NO: 22547 - DNA, 25 bp, Homo sapien
attaaatctagttcaccttgctcac

SEQ ID NO: 22548 - DNA, 25 bp, Homo sapien
tggtgactgtggcagcgggagttcc

SEQ ID NO: 22549 - DNA, 25 bp, Homo sapien
gaacttgaggcaagtcaccagcccc

SEQ ID NO: 22550 - DNA, 25 bp, Homo sapien
gatccctgacctaatgttatcgcgg

SEQ ID NO: 22551 - DNA, 25 bp, Homo sapien
gagcaggaactccactatgcatctc

SEQ ID NO: 22552 - DNA, 25 bp, Homo sapien
gcatctctgcagaggctgccagtgc

SEQ ID NO: 22553 - DNA, 25 bp, Homo sapien
gccagtgcccagcagtgagggacct

SEQ ID NO: 22554 - DNA, 25 bp, Homo sapien
caagagctgactatgcctgcattgc

SEQ ID NO: 22555 - DNA, 25 bp, Homo sapien
gcattgctgagaacaaacccacctg

SEQ ID NO: 22556 - DNA, 25 bp, Homo sapien
cttcctcaacccaggcgggtggaca

SEQ ID NO: 22557 - DNA, 25 bp, Homo sapien
atgtggctttttgacctttgaatag

SEQ ID NO: 22558 - DNA, 25 bp, Homo sapien
cgggcaccatgataccctatgttct

SEQ ID NO: 22559 - DNA, 25 bp, Homo sapien
gataccctatgttctggggattagc

SEQ ID NO: 22560 - DNA, 25 bp, Homo sapien
tggagggattgtcctttcaagcacc

SEQ ID NO: 22561 - DNA, 25 bp, Homo sapien
tcctttcaagcaccacagcttcaga

SEQ ID NO: 22562 - DNA, 25 bp, Homo sapien
gtactttcaaatattgtccacttta

SEQ ID NO: 22563 - DNA, 25 bp, Homo sapien
atattggagactcaactgcccttgg

SEQ ID NO: 22564 - DNA, 25 bp, Homo sapien
aatggcctagtactgtggaatttta

SEQ ID NO: 22565 - DNA, 25 bp, Homo sapien
aaagaactcacatcccatctgaaac

SEQ ID NO: 22566 - DNA, 25 bp, Homo sapien
catcccatctgaaacttcccagggg

SEQ ID NO: 22567 - DNA, 25 bp, Homo sapien
tcccatttttggtatcttgttcagc

SEQ ID NO: 22568 - DNA, 25 bp, Homo sapien
atttcttgtctgcagaacatcctat

SEQ ID NO: 22569 - DNA, 25 bp, Homo sapien
aagaccaccacatagaatacccctt

SEQ ID NO: 22570 - DNA, 25 bp, Homo sapien
cagctcgctctgatttagccttaat

SEQ ID NO: 22571 - DNA, 25 bp, Homo sapien
cagccttcctcagggccaaggagga

SEQ ID NO: 22572 - DNA, 25 bp, Homo sapien
ggagcagcaggatgacacagtctac

SEQ ID NO: 22573 - DNA, 25 bp, Homo sapien
gcaaagtgaccttctcatgtgcggc

SEQ ID NO: 22574 - DNA, 25 bp, Homo sapien
gcggctggttttggacagcgacacc

SEQ ID NO: 22575 - DNA, 25 bp, Homo sapien
tggtgctgacccaggagcagctgca

SEQ ID NO: 22576 - DNA, 25 bp, Homo sapien
agaaacgtgggttaagctcttcctg

SEQ ID NO: 22577 - DNA, 25 bp, Homo sapien
tggcctctgccataatttgttgttc

SEQ ID NO: 22578 - DNA, 25 bp, Homo sapien
ccctccttcctgaggggcctcaggg

SEQ ID NO: 22579 - DNA, 25 bp, Homo sapien
tggggggtaggctgagaccccacca

SEQ ID NO: 22580 - DNA, 25 bp, Homo sapien
ggttaagtgaggtccccttgattga

SEQ ID NO: 22581 - DNA, 25 bp, Homo sapien
attgaggacttcaccccttgattaa

SEQ ID NO: 22582 - DNA, 25 bp, Homo sapien
tagccaggctcgtagtgaggcctcc

SEQ ID NO: 22583 - DNA, 25 bp, Homo sapien
aagtgcccaaataagtctgagtgct

SEQ ID NO: 22584 - DNA, 25 bp, Homo sapien
accctcaatcccttagcactgattg

SEQ ID NO: 22585 - DNA, 25 bp, Homo sapien
gattgattagagaggtcccccaaag

SEQ ID NO: 22586 - DNA, 25 bp, Homo sapien
gaaaccactggttttgacccatgaa

SEQ ID NO: 22587 - DNA, 25 bp, Homo sapien
tgcattgttcattcaggagccacta

SEQ ID NO: 22588 - DNA, 25 bp, Homo sapien
ttcattcaggagccactagtcacat

SEQ ID NO: 22589 - DNA, 25 bp, Homo sapien
gacagcactgcattagaatattttc

SEQ ID NO: 22590 - DNA, 25 bp, Homo sapien
gaatattttcatactgctcttcctc

SEQ ID NO: 22591 - DNA, 25 bp, Homo sapien
tactgctcttcctcaattaattttt

SEQ ID NO: 22592 - DNA, 25 bp, Homo sapien
gttgatgtcttcattggatgggtca

SEQ ID NO: 22593 - DNA, 25 bp, Homo sapien
ctgctggacagagacgcgctcaagc

SEQ ID NO: 22594 - DNA, 25 bp, Homo sapien
gctcaagcagagtctcgtggtggcc

SEQ ID NO: 22595 - DNA, 25 bp, Homo sapien
ccgacaggatctccgacatcctggc

SEQ ID NO: 22596 - DNA, 25 bp, Homo sapien
acaagtcacgtctgctacaggcttc

SEQ ID NO: 22597 - DNA, 25 bp, Homo sapien
cggttcgcactttgtgggcgtggac

SEQ ID NO: 22598 - DNA, 25 bp, Homo sapien
tgcagacctattcccacgaggtctc

SEQ ID NO: 22599 - DNA, 25 bp, Homo sapien
cctcactgcggactcgcggaagagc

SEQ ID NO: 22600 - DNA, 25 bp, Homo sapien
cgcggaagagccacctgattttccc

SEQ ID NO: 22601 - DNA, 25 bp, Homo sapien
caactatgcggacacactcatcagc

SEQ ID NO: 22602 - DNA, 25 bp, Homo sapien
aaagggttttctatcagcaccccag

SEQ ID NO: 22603 - DNA, 25 bp, Homo sapien
agcaccccagtctttacttgaagac

SEQ ID NO: 22604 - DNA, 25 bp, Homo sapien
aggctagaagtagcttttctgtctt

SEQ ID NO: 22605 - DNA, 25 bp, Homo sapien
cagtgccgagtggaatgcctggttt

SEQ ID NO: 22606 - DNA, 25 bp, Homo sapien
ggaggagggactgggttcagctgtg

SEQ ID NO: 22607 - DNA, 25 bp, Homo sapien
ggttcagctgtggtgctttgttgta

SEQ ID NO: 22608 - DNA, 25 bp, Homo sapien
tgtaaaaggcagcctggcctttgct

SEQ ID NO: 22609 - DNA, 25 bp, Homo sapien
aagatggagcctgggtctcaagccc

SEQ ID NO: 22610 - DNA, 25 bp, Homo sapien
tcgctgtacctttgccacatggtac

SEQ ID NO: 22611 - DNA, 25 bp, Homo sapien
ggtactgtatgcttgccagctagaa

SEQ ID NO: 22612 - DNA, 25 bp, Homo sapien
gtgtgagtgaggcggtatccacatt

SEQ ID NO: 22613 - DNA, 25 bp, Homo sapien
gtatccacattctcaacttcaagtc

SEQ ID NO: 22614 - DNA, 25 bp, Homo sapien
gaagttctgtctactgatgcagcac

SEQ ID NO: 22615 - DNA, 25 bp, Homo sapien
cgcgttcgcaccaaaaccgtgaaga

SEQ ID NO: 22616 - DNA, 25 bp, Homo sapien
tagaaaagtactacacgcgcctggg

SEQ ID NO: 22617 - DNA, 25 bp, Homo sapien
tgcgaggagatcgccattatcccca

SEQ ID NO: 22618 - DNA, 25 bp, Homo sapien
tatccccagcaaaaagctccgcaac

SEQ ID NO: 22619 - DNA, 25 bp, Homo sapien
gatagcaggttatgtcacgcatctg

SEQ ID NO: 22620 - DNA, 25 bp, Homo sapien
gtaagaggtatctccatcaagctgc

SEQ ID NO: 22621 - DNA, 25 bp, Homo sapien
tcctgaggtctcagccttggatcag

SEQ ID NO: 22622 - DNA, 25 bp, Homo sapien
gcttttggacttcggcagtctgtcc

SEQ ID NO: 22623 - DNA, 25 bp, Homo sapien
gtcactcagcctacagttgggatga

SEQ ID NO: 22624 - DNA, 25 bp, Homo sapien
gatgaatttcaaaacgcctcgggga

SEQ ID NO: 22625 - DNA, 25 bp, Homo sapien
gccaaggcaggcgatcacatgaggt

SEQ ID NO: 22626 - DNA, 25 bp, Homo sapien
cggccgcctactactactatacggc

SEQ ID NO: 22627 - DNA, 25 bp, Homo sapien
ccgcctactactactatacggctgc

SEQ ID NO: 22628 - DNA, 25 bp, Homo sapien
ctactactactatacggctgcgaga

SEQ ID NO: 22629 - DNA, 25 bp, Homo sapien
actactatacggctgcgagaagacg

SEQ ID NO: 22630 - DNA, 25 bp, Homo sapien
atacggctgcgagaagacgacagaa

SEQ ID NO: 22631 - DNA, 25 bp, Homo sapien
gacgacagaagggtcggagtctgta

SEQ ID NO: 22632 - DNA, 25 bp, Homo sapien
gggtcggagtctgtaaaaccagcat

SEQ ID NO: 22633 - DNA, 25 bp, Homo sapien
aaaccagcatacagtttggcttttt

SEQ ID NO: 22634 - DNA, 25 bp, Homo sapien
gcatacagtttggcttttttcacat

SEQ ID NO: 22635 - DNA, 25 bp, Homo sapien
cagtttggcttttttcacattgatc

SEQ ID NO: 22636 - DNA, 25 bp, Homo sapien
ggcttttttcacattgatcattttt

SEQ ID NO: 22637 - DNA, 25 bp, Homo sapien
gccatcatttgccaatcactgagaa

SEQ ID NO: 22638 - DNA, 25 bp, Homo sapien
agtgcacccagccgagaattagtat

SEQ ID NO: 22639 - DNA, 25 bp, Homo sapien
tatggttaaaccttggcgtctagcc

SEQ ID NO: 22640 - DNA, 25 bp, Homo sapien
ggcgtctagccatattttatgtcat

SEQ ID NO: 22641 - DNA, 25 bp, Homo sapien
gtgaagagcagattccatgagtaac

SEQ ID NO: 22642 - DNA, 25 bp, Homo sapien
agattccatgagtaactctgacagg

SEQ ID NO: 22643 - DNA, 25 bp, Homo sapien
gacaggtattttagatcatgatctc

SEQ ID NO: 22644 - DNA, 25 bp, Homo sapien
attcttccaaaatggcatacatctt

SEQ ID NO: 22645 - DNA, 25 bp, Homo sapien
aatggcatacatcttttgtacaaag

SEQ ID NO: 22646 - DNA, 25 bp, Homo sapien
taaatactgtgtttgtgctgtaaga

SEQ ID NO: 22647 - DNA, 25 bp, Homo sapien
tgtgctgtaagagttgtgtatttca

SEQ ID NO: 22648 - DNA, 25 bp, Homo sapien
ccactgtgcttgtgtcgcttgtgga

SEQ ID NO: 22649 - DNA, 25 bp, Homo sapien
cttgtgtcgcttgtggagggcagcc

SEQ ID NO: 22650 - DNA, 25 bp, Homo sapien
ttcagtgggcgtggcgcccgaggtg

SEQ ID NO: 22651 - DNA, 25 bp, Homo sapien
ctgctgtacactgcactgaggtgct

SEQ ID NO: 22652 - DNA, 25 bp, Homo sapien
tacactgcactgaggtgctcggcgg

SEQ ID NO: 22653 - DNA, 25 bp, Homo sapien
ggcgcatgtgggccggtgaagccca

SEQ ID NO: 22654 - DNA, 25 bp, Homo sapien
catgtgggccggtgaagcccacgct

SEQ ID NO: 22655 - DNA, 25 bp, Homo sapien
ccatgcccaatggtagatgtggacg

SEQ ID NO: 22656 - DNA, 25 bp, Homo sapien
gatgtggacggggaagatcagtcta

SEQ ID NO: 22657 - DNA, 25 bp, Homo sapien
gatcagtctattggaggggaccact

SEQ ID NO: 22658 - DNA, 25 bp, Homo sapien
tattggaggggaccactctaggaag

SEQ ID NO: 22659 - DNA, 25 bp, Homo sapien
tgcctatgcttttctctgtgggcac

SEQ ID NO: 22660 - DNA, 25 bp, Homo sapien
tgtgggcacatcaggatgcccctcg

SEQ ID NO: 22661 - DNA, 25 bp, Homo sapien
ggacgtctagggtttggtgtgcctg

SEQ ID NO: 22662 - DNA, 25 bp, Homo sapien
agggtcagtcaatgtatcttctacg

SEQ ID NO: 22663 - DNA, 25 bp, Homo sapien
ccccggctccagagctcaggggtag

SEQ ID NO: 22664 - DNA, 25 bp, Homo sapien
ggggttctcctgagggtgcagggga

SEQ ID NO: 22665 - DNA, 25 bp, Homo sapien
gtcccttaggggaggtgaccaggag

SEQ ID NO: 22666 - DNA, 25 bp, Homo sapien
ctttggtgcagggagctcttggtgg

SEQ ID NO: 22667 - DNA, 25 bp, Homo sapien
ccctgccaggtctgtggacatggtt

SEQ ID NO: 22668 - DNA, 25 bp, Homo sapien
ggacatggttatatgcccgggagag

SEQ ID NO: 22669 - DNA, 25 bp, Homo sapien
taacctttagcattcctattgtaac

SEQ ID NO: 22670 - DNA, 25 bp, Homo sapien
gaagaaccctgactttgtttctgca

SEQ ID NO: 22671 - DNA, 25 bp, Homo sapien
aaggcacctgcatgtgtctgtgttc

SEQ ID NO: 22672 - DNA, 25 bp, Homo sapien
caatcatctttcctgttccagagag

SEQ ID NO: 22673 - DNA, 25 bp, Homo sapien
catctctgtctcaacttcatggtgc

SEQ ID NO: 22674 - DNA, 25 bp, Homo sapien
tggtgcactgagctgtaacttcttc

SEQ ID NO: 22675 - DNA, 25 bp, Homo sapien
gacagacctcaggagggctattggt

SEQ ID NO: 22676 - DNA, 25 bp, Homo sapien
ggctattggtccaggacccacacct

SEQ ID NO: 22677 - DNA, 25 bp, Homo sapien
ggtctgcagtcacacatttctggaa

SEQ ID NO: 22678 - DNA, 25 bp, Homo sapien
ggaaacttctctggggtccaagact

SEQ ID NO: 22679 - DNA, 25 bp, Homo sapien
agacagctgccttgtgtgggactga

SEQ ID NO: 22680 - DNA, 25 bp, Homo sapien
tgcccttccctttgtgacttgaaga

SEQ ID NO: 22681 - DNA, 25 bp, Homo sapien
aggtacaatctctcaggggtttcat

SEQ ID NO: 22682 - DNA, 25 bp, Homo sapien
gagctgtaaatggaactgcttggct

SEQ ID NO: 22683 - DNA, 25 bp, Homo sapien
actgcttggctttgaccatacacat

SEQ ID NO: 22684 - DNA, 25 bp, Homo sapien
cccagcccttacagaatctgcacaa

SEQ ID NO: 22685 - DNA, 25 bp, Homo sapien
tccctttgctccagttaattgttct

SEQ ID NO: 22686 - DNA, 25 bp, Homo sapien
gttcttgtatgtaagttgctttcta

SEQ ID NO: 22687 - DNA, 25 bp, Homo sapien
gttgctttctattccagtatatcca

SEQ ID NO: 22688 - DNA, 25 bp, Homo sapien
taacaaggccagccacgtagccaaa

SEQ ID NO: 22689 - DNA, 25 bp, Homo sapien
gtagccaaaggtcgctccaagcgta

SEQ ID NO: 22690 - DNA, 25 bp, Homo sapien
aagcgtacaggagatgggccatacc

SEQ ID NO: 22691 - DNA, 25 bp, Homo sapien
gagatgggccatacctgaggagaga

SEQ ID NO: 22692 - DNA, 25 bp, Homo sapien
gccccgtgtgatttgtttcattgtt

SEQ ID NO: 22693 - DNA, 25 bp, Homo sapien
ccggctgctccgagatgctggagct

SEQ ID NO: 22694 - DNA, 25 bp, Homo sapien
agctgaccttgacaaaccggagccc

SEQ ID NO: 22695 - DNA, 25 bp, Homo sapien
gcccccttcatttggcagtggaggc

SEQ ID NO: 22696 - DNA, 25 bp, Homo sapien
atttggcagtggaggcccaggcagc

SEQ ID NO: 22697 - DNA, 25 bp, Homo sapien
ggcagccgatgtgctggagcttctc

SEQ ID NO: 22698 - DNA, 25 bp, Homo sapien
cccctgagcccgagggcgaggacga

SEQ ID NO: 22699 - DNA, 25 bp, Homo sapien
gcagcagcagtagcgacagcgacag

SEQ ID NO: 22700 - DNA, 25 bp, Homo sapien
cagcgacagcggagacgagggcgat

SEQ ID NO: 22701 - DNA, 25 bp, Homo sapien
agacgagggcgatgaatacgacgac

SEQ ID NO: 22702 - DNA, 25 bp, Homo sapien
gacgacattgtggttcacagcagcc

SEQ ID NO: 22703 - DNA, 25 bp, Homo sapien
taacactgatgatagctgatgagct

SEQ ID NO: 22704 - DNA, 25 bp, Homo sapien
agttcatgtaattgtcttaagtttt

SEQ ID NO: 22705 - DNA, 25 bp, Homo sapien
tttatgcctttatatacttagctat

SEQ ID NO: 22706 - DNA, 25 bp, Homo sapien
ttagctatattttttcttttgacat

SEQ ID NO: 22707 - DNA, 25 bp, Homo sapien
tcttttgacataaccatctttttga

SEQ ID NO: 22708 - DNA, 25 bp, Homo sapien
tactgacagaggttcactgagtgat

SEQ ID NO: 22709 - DNA, 25 bp, Homo sapien
agatcaaggatgtccaatcttttgg

SEQ ID NO: 22710 - DNA, 25 bp, Homo sapien
agatcagggatgtccaatcttttgg

SEQ ID NO: 22711 - DNA, 25 bp, Homo sapien
tcttgggccgcacataaaatatgct

SEQ ID NO: 22712 - DNA, 25 bp, Homo sapien
atatgctaacactgacgatagctga

SEQ ID NO: 22713 - DNA, 25 bp, Homo sapien
tgtcttgggccgcacataaaatatg

SEQ ID NO: 22714 - DNA, 25 bp, Homo sapien
gttgcatagatatgtgttcttaagt

SEQ ID NO: 22715 - DNA, 25 bp, Homo sapien
aattcttaatgcatcctgtgttcag

SEQ ID NO: 22716 - DNA, 25 bp, Homo sapien
ttaatatatactgtaccatgggtgt

SEQ ID NO: 22717 - DNA, 25 bp, Homo sapien
ggaacttcatattattgcaatgcat

SEQ ID NO: 22718 - DNA, 25 bp, Homo sapien
gagtacttgttgaaagcataccatt

SEQ ID NO: 22719 - DNA, 25 bp, Homo sapien
tgttgaaagcataccattcacctaa

SEQ ID NO: 22720 - DNA, 25 bp, Homo sapien
gaagaatcatttctgggcttgtgat

SEQ ID NO: 22721 - DNA, 25 bp, Homo sapien
gcttgtgatgttaatattgcccccc

SEQ ID NO: 22722 - DNA, 25 bp, Homo sapien
ggatggttggttggatatgtcactt

SEQ ID NO: 22723 - DNA, 25 bp, Homo sapien
ggatatgtcacttttcttatggtaa

SEQ ID NO: 22724 - DNA, 25 bp, Homo sapien
aacaattaaatccatattctctctg

SEQ ID NO: 22725 - DNA, 25 bp, Homo sapien
cagatgcacgcggctcgtgtatgta

SEQ ID NO: 22726 - DNA, 25 bp, Homo sapien
acgcggctcgtgtatgtacatagac

SEQ ID NO: 22727 - DNA, 25 bp, Homo sapien
gtacatagacgttacggcagccgag

SEQ ID NO: 22728 - DNA, 25 bp, Homo sapien
acggcagccgaggtttttaatgaga

SEQ ID NO: 22729 - DNA, 25 bp, Homo sapien
tattcacttggttatgatttgtatt

SEQ ID NO: 22730 - DNA, 25 bp, Homo sapien
taatttataacagtcccactcacct

SEQ ID NO: 22731 - DNA, 25 bp, Homo sapien
ccactcacctctatttattcatttt

SEQ ID NO: 22732 - DNA, 25 bp, Homo sapien
gggttctcatggtgctcaaacccgc

SEQ ID NO: 22733 - DNA, 25 bp, Homo sapien
acctgagggtgagcaactcctgtac

SEQ ID NO: 22734 - DNA, 25 bp, Homo sapien
agggtgagcaactcctgtactgtag

SEQ ID NO: 22735 - DNA, 25 bp, Homo sapien
ctgtaggggaagaagtgggaactga

SEQ ID NO: 22736 - DNA, 25 bp, Homo sapien
ggaagctgaaagtccccgaatgggt

SEQ ID NO: 22737 - DNA, 25 bp, Homo sapien
atgggtggataccgtcaagctggcc

SEQ ID NO: 22738 - DNA, 25 bp, Homo sapien
accgtcaagctggccaagcacaaag

SEQ ID NO: 22739 - DNA, 25 bp, Homo sapien
gagcttgctccctacgatgagaact

SEQ ID NO: 22740 - DNA, 25 bp, Homo sapien
tgagaactggttctacacgcgagct

SEQ ID NO: 22741 - DNA, 25 bp, Homo sapien
ctggggttggctccatgaccaagat

SEQ ID NO: 22742 - DNA, 25 bp, Homo sapien
ggctccatgaccaagatctatgggg

SEQ ID NO: 22743 - DNA, 25 bp, Homo sapien
agaatcgccggacaggtggcagctg

SEQ ID NO: 22744 - DNA, 25 bp, Homo sapien
ccgcacgatgcctggagttactgta

SEQ ID NO: 22745 - DNA, 25 bp, Homo sapien
gacgtgaaccagcaggagttcgtca

SEQ ID NO: 22746 - DNA, 25 bp, Homo sapien
gcaggagttcgtcagagctctggca

SEQ ID NO: 22747 - DNA, 25 bp, Homo sapien
ttgaggcaaggtctcactctgcttc

SEQ ID NO: 22748 - DNA, 25 bp, Homo sapien
gtggggcaatattggctcactgcaa

SEQ ID NO: 22749 - DNA, 25 bp, Homo sapien
gcacctcctggactcaagagatcct

SEQ ID NO: 22750 - DNA, 25 bp, Homo sapien
ctgggactacaggcgtgtcccacca

SEQ ID NO: 22751 - DNA, 25 bp, Homo sapien
tgttgtccaggctcgtctggaactc

SEQ ID NO: 22752 - DNA, 25 bp, Homo sapien
agcctcccaaactgctgagattaca

SEQ ID NO: 22753 - DNA, 25 bp, Homo sapien
cagcccactgacacgttttactgat

SEQ ID NO: 22754 - DNA, 25 bp, Homo sapien
taatacaattcaccattctcttttc

SEQ ID NO: 22755 - DNA, 25 bp, Homo sapien
cattctcttttctcacttcaagtaa

SEQ ID NO: 22756 - DNA, 25 bp, Homo sapien
gaagtagacctaagtattcatcttg

SEQ ID NO: 22757 - DNA, 25 bp, Homo sapien
aaaaatcatgccacctgaattgagc

SEQ ID NO: 22758 - DNA, 25 bp, Homo sapien
taccctgtaaagccgttttagaatg

SEQ ID NO: 22759 - DNA, 25 bp, Homo sapien
gtattgtctcttcttaaactatctt

SEQ ID NO: 22760 - DNA, 25 bp, Homo sapien
aaactatcttattgacttattattt

SEQ ID NO: 22761 - DNA, 25 bp, Homo sapien
taagtatgaaacaacctatggtctg

SEQ ID NO: 22762 - DNA, 25 bp, Homo sapien
tatggtctggaaatttgtatcgcaa

SEQ ID NO: 22763 - DNA, 25 bp, Homo sapien
gtatcgcaaagctatatgtgcatat

SEQ ID NO: 22764 - DNA, 25 bp, Homo sapien
atttaattcatctaacgctacacaa

SEQ ID NO: 22765 - DNA, 25 bp, Homo sapien
ctaaatcatttatgtccatttctca

SEQ ID NO: 22766 - DNA, 25 bp, Homo sapien
gatctatgctttgagtttgctttct

SEQ ID NO: 22767 - DNA, 25 bp, Homo sapien
aatgctttttagtactttttcatat

SEQ ID NO: 22768 - DNA, 25 bp, Homo sapien
atttattttccgaatgtatcattga

SEQ ID NO: 22769 - DNA, 25 bp, Homo sapien
atcattgccagtagtgccttcatca

SEQ ID NO: 22770 - DNA, 25 bp, Homo sapien
tgtcccagcacagatcattctcaaa

SEQ ID NO: 22771 - DNA, 25 bp, Homo sapien
gtgggcatgctgaaggccagcgtgg

SEQ ID NO: 22772 - DNA, 25 bp, Homo sapien
aggtgaggcaggtgctcctcacacc

SEQ ID NO: 22773 - DNA, 25 bp, Homo sapien
gttagtcagtgattctttacttgca

SEQ ID NO: 22774 - DNA, 25 bp, Homo sapien
ggaaccaaatggaccttctgggaca

SEQ ID NO: 22775 - DNA, 25 bp, Homo sapien
acgctgtgttggcatgcgcagtagg

SEQ ID NO: 22776 - DNA, 25 bp, Homo sapien
gagggttagccatagtattctttgc

SEQ ID NO: 22777 - DNA, 25 bp, Homo sapien
atatcttctcttgcttggtgtaact

SEQ ID NO: 22778 - DNA, 25 bp, Homo sapien
aactccttagcaaaccaggtctaca

SEQ ID NO: 22779 - DNA, 25 bp, Homo sapien
aaccaggtctacatcctgttttgtt

SEQ ID NO: 22780 - DNA, 25 bp, Homo sapien
ttctcgccttggttcacgtaggctt

SEQ ID NO: 22781 - DNA, 25 bp, Homo sapien
tctcgccttggttcacgtaggcttg

SEQ ID NO: 22782 - DNA, 25 bp, Homo sapien
tcgccttggttcacgtaggcttggc

SEQ ID NO: 22783 - DNA, 25 bp, Homo sapien
ccttggttcacgtaggcttggcagg

SEQ ID NO: 22784 - DNA, 25 bp, Homo sapien
tggttcacgtaggcttggcagggca

SEQ ID NO: 22785 - DNA, 25 bp, Homo sapien
gtggagtcagagtagggtctgcgct

SEQ ID NO: 22786 - DNA, 25 bp, Homo sapien
tggagtcagagtagggtctgcgctt

SEQ ID NO: 22787 - DNA, 25 bp, Homo sapien
gcccaggtgaggagggaccgatggg

SEQ ID NO: 22788 - DNA, 25 bp, Homo sapien
cgccggagcggtacggggcacggcg

SEQ ID NO: 22789 - DNA, 25 bp, Homo sapien
ggcttcgggggagacgggctgagcc

SEQ ID NO: 22790 - DNA, 25 bp, Homo sapien
ttcgggggagacgggctgagccgta

SEQ ID NO: 22791 - DNA, 25 bp, Homo sapien
tgtgctccctctgccaggaggagaa

SEQ ID NO: 22792 - DNA, 25 bp, Homo sapien
agaccacgcttagcggtggcttctt

SEQ ID NO: 22793 - DNA, 25 bp, Homo sapien
ggcttcttcgttgctgtaattgaac

SEQ ID NO: 22794 - DNA, 25 bp, Homo sapien
tgaacgggtcgagatgccgacctca

SEQ ID NO: 22795 - DNA, 25 bp, Homo sapien
acaggccaaagcatcagcaccagaa

SEQ ID NO: 22796 - DNA, 25 bp, Homo sapien
cagcccagccccaaagagaaagaag

SEQ ID NO: 22797 - DNA, 25 bp, Homo sapien
aaaaagctgcagccggtgcttgcac

SEQ ID NO: 22798 - DNA, 25 bp, Homo sapien
ttgcacatagcagaggctccgggct

SEQ ID NO: 22799 - DNA, 25 bp, Homo sapien
ctcactccttcctggtgggaaagga

SEQ ID NO: 22800 - DNA, 25 bp, Homo sapien
ggaaaggaagatgcctgtcctctcc

SEQ ID NO: 22801 - DNA, 25 bp, Homo sapien
ggctgtgttcttgctggtgagcaaa

SEQ ID NO: 22802 - DNA, 25 bp, Homo sapien
gtgatagcattttacttgggttact

SEQ ID NO: 22803 - DNA, 25 bp, Homo sapien
gcttctagtagaccttaatctagca

SEQ ID NO: 22804 - DNA, 25 bp, Homo sapien
atagttgaacctctgaatatgggaa

SEQ ID NO: 22805 - DNA, 25 bp, Homo sapien
aggttgtattcccagattctttcct

SEQ ID NO: 22806 - DNA, 25 bp, Homo sapien
ctccagggtgagtttattgactacc

SEQ ID NO: 22807 - DNA, 25 bp, Homo sapien
tgactacccaaactgtattttacca

SEQ ID NO: 22808 - DNA, 25 bp, Homo sapien
taacccatcttgcaggacgacattg

SEQ ID NO: 22809 - DNA, 25 bp, Homo sapien
gtgtccaactgtatatagctgccaa

SEQ ID NO: 22810 - DNA, 25 bp, Homo sapien
agctgccaattagttttctttgttt

SEQ ID NO: 22811 - DNA, 25 bp, Homo sapien
gtttttactttgtcctttgctatct

SEQ ID NO: 22812 - DNA, 25 bp, Homo sapien
tcctttgctatctgtgttatgactc

SEQ ID NO: 22813 - DNA, 25 bp, Homo sapien
gctggatgtcaattgacccttttat

SEQ ID NO: 22814 - DNA, 25 bp, Homo sapien
attgttaatcctgccagtctttctc

SEQ ID NO: 22815 - DNA, 25 bp, Homo sapien
ttcaagccagggtgcatcctcagaa

SEQ ID NO: 22816 - DNA, 25 bp, Homo sapien
tgcatcctcagaaacctactcaaca

SEQ ID NO: 22817 - DNA, 25 bp, Homo sapien
tactcaacacagcactctaggcagc

SEQ ID NO: 22818 - DNA, 25 bp, Homo sapien
gaagttgacactctgcattaaatct

SEQ ID NO: 22819 - DNA, 25 bp, Homo sapien
aggtatctgccttggtttcagtggg

SEQ ID NO: 22820 - DNA, 25 bp, Homo sapien
gtttcagtggggacatctggggctt

SEQ ID NO: 22821 - DNA, 25 bp, Homo sapien
atctggggcttatggggctgggatg

SEQ ID NO: 22822 - DNA, 25 bp, Homo sapien
gagagtgtgccaagacactgctttt

SEQ ID NO: 22823 - DNA, 25 bp, Homo sapien
acactgcttttggcattttattcct

SEQ ID NO: 22824 - DNA, 25 bp, Homo sapien
cattccacggaacaccagtgcatgc

SEQ ID NO: 22825 - DNA, 25 bp, Homo sapien
tggccagatgtgttggttcacgcct

SEQ ID NO: 22826 - DNA, 25 bp, Homo sapien
ggcaacatagcaagatcccatctct

SEQ ID NO: 22827 - DNA, 25 bp, Homo sapien
gttagctgaacaaggcggcatgcac

SEQ ID NO: 22828 - DNA, 25 bp, Homo sapien
gcggcatgcacatgctactccagac

SEQ ID NO: 22829 - DNA, 25 bp, Homo sapien
atgctactccagacgctgaagtggg

SEQ ID NO: 22830 - DNA, 25 bp, Homo sapien
tccgagagatcgaggcttcagtgag

SEQ ID NO: 22831 - DNA, 25 bp, Homo sapien
gagatatggctgagacactgctctc

SEQ ID NO: 22832 - DNA, 25 bp, Homo sapien
catgaggagcttgttttctgaccac

SEQ ID NO: 22833 - DNA, 25 bp, Homo sapien
gttgaatctttccggaggtttctca

SEQ ID NO: 22834 - DNA, 25 bp, Homo sapien
tccggaggtttctcaaccattccac

SEQ ID NO: 22835 - DNA, 25 bp, Homo sapien
ccatgtgcaagtctgtggtggcccc

SEQ ID NO: 22836 - DNA, 25 bp, Homo sapien
gccacggatggtggcctcaacctga

SEQ ID NO: 22837 - DNA, 25 bp, Homo sapien
aaaaccagtgtgagacccgaaccat

SEQ ID NO: 22838 - DNA, 25 bp, Homo sapien
gcacctactccgtgtcagtggtgga

SEQ ID NO: 22839 - DNA, 25 bp, Homo sapien
tggtggagaccgactacgaccagta

SEQ ID NO: 22840 - DNA, 25 bp, Homo sapien
cgcgctgctgtacagccagggcagc

SEQ ID NO: 22841 - DNA, 25 bp, Homo sapien
ccagacccccagggctgagttaaag

SEQ ID NO: 22842 - DNA, 25 bp, Homo sapien
aaaggagaaattcaccgccttctgc

SEQ ID NO: 22843 - DNA, 25 bp, Homo sapien
ccttctgcaaggcccagggcttcac

SEQ ID NO: 22844 - DNA, 25 bp, Homo sapien
cagaggataccattgtcttcctgcc

SEQ ID NO: 22845 - DNA, 25 bp, Homo sapien
aataggactccccagggctgaagct

SEQ ID NO: 22846 - DNA, 25 bp, Homo sapien
gattctgtgaaaataccccctttct

SEQ ID NO: 22847 - DNA, 25 bp, Homo sapien
ccctttctccattagtggcatgctc

SEQ ID NO: 22848 - DNA, 25 bp, Homo sapien
tagtggcatgctcattcagctctta

SEQ ID NO: 22849 - DNA, 25 bp, Homo sapien
tcagctcttatctttatattccagt

SEQ ID NO: 22850 - DNA, 25 bp, Homo sapien
attccagtaagttattttgctctca

SEQ ID NO: 22851 - DNA, 25 bp, Homo sapien
ttattttgctctcactgttttaaca

SEQ ID NO: 22852 - DNA, 25 bp, Homo sapien
aaatccttgcataccttgttcaatt

SEQ ID NO: 22853 - DNA, 25 bp, Homo sapien
gtacgtagctgttacatgtagggca

SEQ ID NO: 22854 - DNA, 25 bp, Homo sapien
gtagggcaatctgtctttaagtagg

SEQ ID NO: 22855 - DNA, 25 bp, Homo sapien
gaatcctagatagttttcccttcaa

SEQ ID NO: 22856 - DNA, 25 bp, Homo sapien
tagttttcccttcaagtcaagcgtc

SEQ ID NO: 22857 - DNA, 25 bp, Homo sapien
ttcagaatatcacatcctctccaat

SEQ ID NO: 22858 - DNA, 25 bp, Homo sapien
attctctcttactcaaattgctggg

SEQ ID NO: 22859 - DNA, 25 bp, Homo sapien
caaattgctgggaaactctcatgtt

SEQ ID NO: 22860 - DNA, 25 bp, Homo sapien
ggaaactctcatgttactaactttg

SEQ ID NO: 22861 - DNA, 25 bp, Homo sapien
taactttgttgctctaactctgcca

SEQ ID NO: 22862 - DNA, 25 bp, Homo sapien
cctcatggtacgtgtgctcctaata

SEQ ID NO: 22863 - DNA, 25 bp, Homo sapien
gtgtgctcctaatattagcgttggt

SEQ ID NO: 22864 - DNA, 25 bp, Homo sapien
gcgttggttgagattttcagtggtc

SEQ ID NO: 22865 - DNA, 25 bp, Homo sapien
ttcagtggtccaatattcctcttcc

SEQ ID NO: 22866 - DNA, 25 bp, Homo sapien
ggttgcctttcctgagataatccac

SEQ ID NO: 22867 - DNA, 25 bp, Homo sapien
tttcttttctcagggaatctaaggg

SEQ ID NO: 22868 - DNA, 25 bp, Homo sapien
gaaatatgtaatcccctggctgact

SEQ ID NO: 22869 - DNA, 25 bp, Homo sapien
taatcccctggctgactaggactgt

SEQ ID NO: 22870 - DNA, 25 bp, Homo sapien
tggactggatgatgccttcgacaaa

SEQ ID NO: 22871 - DNA, 25 bp, Homo sapien
gatgatgccttcgacaaaccagaga

SEQ ID NO: 22872 - DNA, 25 bp, Homo sapien
gccaagttggggggagctggtgcct

SEQ ID NO: 22873 - DNA, 25 bp, Homo sapien
ggaccctagaggagactctcattcg

SEQ ID NO: 22874 - DNA, 25 bp, Homo sapien
gaggagactctcattcgattttaaa

SEQ ID NO: 22875 - DNA, 25 bp, Homo sapien
gaagcacaacgggtcattttccttt

SEQ ID NO: 22876 - DNA, 25 bp, Homo sapien
ttcctagcgcagaactgtttctaaa

SEQ ID NO: 22877 - DNA, 25 bp, Homo sapien
tgtctcatctgttgcactgtatttc

SEQ ID NO: 22878 - DNA, 25 bp, Homo sapien
gcactgtatttcaatcatctgtaat

SEQ ID NO: 22879 - DNA, 25 bp, Homo sapien
ctaagcgcctgatctatgctgcatc

SEQ ID NO: 22880 - DNA, 25 bp, Homo sapien
gatctatgctgcatccagtttgcaa

SEQ ID NO: 22881 - DNA, 25 bp, Homo sapien
cagtttgcaaagtggggtcccatca

SEQ ID NO: 22882 - DNA, 25 bp, Homo sapien
ggttcagcggcagtggatctgggac

SEQ ID NO: 22883 - DNA, 25 bp, Homo sapien
gacagaattcactctcacaatcagc

SEQ ID NO: 22884 - DNA, 25 bp, Homo sapien
gcagcctgcagcctgaagattttgc

SEQ ID NO: 22885 - DNA, 25 bp, Homo sapien
tttgcaacttattactgtctacagc

SEQ ID NO: 22886 - DNA, 25 bp, Homo sapien
gtctacagcataatagttacccttg

SEQ ID NO: 22887 - DNA, 25 bp, Homo sapien
tcctccctgtctgcatctgtaggag

SEQ ID NO: 22888 - DNA, 25 bp, Homo sapien
aggagacagagtcaccatcacttgc

SEQ ID NO: 22889 - DNA, 25 bp, Homo sapien
acttgccgggcaagtcagggcatta

SEQ ID NO: 22890 - DNA, 25 bp, Homo sapien
gccgagaacttgacactgttcaccc

SEQ ID NO: 22891 - DNA, 25 bp, Homo sapien
gaagaaagcagcgccaggattcctc

SEQ ID NO: 22892 - DNA, 25 bp, Homo sapien
aaaaagtaattgagcacctcctcta

SEQ ID NO: 22893 - DNA, 25 bp, Homo sapien
cgctggggagtccacactgaacaaa

SEQ ID NO: 22894 - DNA, 25 bp, Homo sapien
gaaacagaaaaccctgtcttccagc

SEQ ID NO: 22895 - DNA, 25 bp, Homo sapien
cttccagcagttgagttctagggca

SEQ ID NO: 22896 - DNA, 25 bp, Homo sapien
gtcgtgctccgtcaaggggtgagca

SEQ ID NO: 22897 - DNA, 25 bp, Homo sapien
aggggtggctgagtaagggcttgca

SEQ ID NO: 22898 - DNA, 25 bp, Homo sapien
gcagctggaggcaacagcacatgca

SEQ ID NO: 22899 - DNA, 25 bp, Homo sapien
gctgcaataagggccactgaggggg

SEQ ID NO: 22900 - DNA, 25 bp, Homo sapien
ggggacagtgtaggttgggggtgag

SEQ ID NO: 22901 - DNA, 25 bp, Homo sapien
tttcgagggggcaaggagggacaga

SEQ ID NO: 22902 - DNA, 25 bp, Homo sapien
aagctaccttttgtaagtgccatgt

SEQ ID NO: 22903 - DNA, 25 bp, Homo sapien
ttttgtaagtgccatgtttattatc

SEQ ID NO: 22904 - DNA, 25 bp, Homo sapien
tcctttctttcaaggacagtgtttt

SEQ ID NO: 22905 - DNA, 25 bp, Homo sapien
gttaagctgctaaaaccccatgttg

SEQ ID NO: 22906 - DNA, 25 bp, Homo sapien
tgctaaaaccccatgttggctgctg

SEQ ID NO: 22907 - DNA, 25 bp, Homo sapien
tggctgctgctgttgagatactgtg

SEQ ID NO: 22908 - DNA, 25 bp, Homo sapien
ctgctgttgagatactgtgctttgg

SEQ ID NO: 22909 - DNA, 25 bp, Homo sapien
agggaacatactgattggtcttaaa

SEQ ID NO: 22910 - DNA, 25 bp, Homo sapien
ggtggctggaacatctatttttcta

SEQ ID NO: 22911 - DNA, 25 bp, Homo sapien
gaacctggttctagaagaatgtaca

SEQ ID NO: 22912 - DNA, 25 bp, Homo sapien
tggcgagtatggtgcggaggccctg

SEQ ID NO: 22913 - DNA, 25 bp, Homo sapien
ctggagaggatgttcctgtccttcc

SEQ ID NO: 22914 - DNA, 25 bp, Homo sapien
cacggctctgcccaggttaagggcc

SEQ ID NO: 22915 - DNA, 25 bp, Homo sapien
acggcaagaaggtggccgacgcgct

SEQ ID NO: 22916 - DNA, 25 bp, Homo sapien
cgcacaagcttcgggtggacccggt

SEQ ID NO: 22917 - DNA, 25 bp, Homo sapien
tcaacttcaagctcctaagccactg

SEQ ID NO: 22918 - DNA, 25 bp, Homo sapien
gacaagttcctggcttctgtgagca

SEQ ID NO: 22919 - DNA, 25 bp, Homo sapien
ctgacctccaaataccgttaagctg

SEQ ID NO: 22920 - DNA, 25 bp, Homo sapien
accgttaagctggagcctcggtggc

SEQ ID NO: 22921 - DNA, 25 bp, Homo sapien
tcctgccgacaagaccaacgtcaag

SEQ ID NO: 22922 - DNA, 25 bp, Homo sapien
tcaaggccgcctggggtaaggtcgg

SEQ ID NO: 22923 - DNA, 25 bp, Homo sapien
ctgcagcagccggaatagagcctcg

SEQ ID NO: 22924 - DNA, 25 bp, Homo sapien
aatagagcctcgtctggcaagtcgg

SEQ ID NO: 22925 - DNA, 25 bp, Homo sapien
tccctgggcctcaacaaggatcagg

SEQ ID NO: 22926 - DNA, 25 bp, Homo sapien
ggatcaggctgctggaaacacagtc

SEQ ID NO: 22927 - DNA, 25 bp, Homo sapien
caaggtggcatccgaaggtgtctct

SEQ ID NO: 22928 - DNA, 25 bp, Homo sapien
tctggtcttccagcgaggtgggaga

SEQ ID NO: 22929 - DNA, 25 bp, Homo sapien
ggtccctgcagaagccagaaggtgc

SEQ ID NO: 22930 - DNA, 25 bp, Homo sapien
ggagcatcggagggagtcccagagc

SEQ ID NO: 22931 - DNA, 25 bp, Homo sapien
ttgggcctagaccgcgtgataaaac

SEQ ID NO: 22932 - DNA, 25 bp, Homo sapien
tcccagccgtggtcaacggagggag

SEQ ID NO: 22933 - DNA, 25 bp, Homo sapien
acggagggagtggcacttctgcctt

SEQ ID NO: 22934 - DNA, 25 bp, Homo sapien
gaagaaggcggcgttgtccatgtgc

SEQ ID NO: 22935 - DNA, 25 bp, Homo sapien
ccatgtgcaagtctgtggtggcccc

SEQ ID NO: 22936 - DNA, 25 bp, Homo sapien
aaaaccagtgtgagacccgaaccat

SEQ ID NO: 22937 - DNA, 25 bp, Homo sapien
gcacctactccgtgtcagtggtgga

SEQ ID NO: 22938 - DNA, 25 bp, Homo sapien
cgcgctgctgtacagccagggcagc

SEQ ID NO: 22939 - DNA, 25 bp, Homo sapien
aaaggagaaattcaccgccttctgc

SEQ ID NO: 22940 - DNA, 25 bp, Homo sapien
ccttctgcaaggcccagggcttcac

SEQ ID NO: 22941 - DNA, 25 bp, Homo sapien
cagaggataccattgtcttcctgcc

SEQ ID NO: 22942 - DNA, 25 bp, Homo sapien
ttcctgccccaaaccgataagtgca

SEQ ID NO: 22943 - DNA, 25 bp, Homo sapien
aataggactccccagggctgaagct

SEQ ID NO: 22944 - DNA, 25 bp, Homo sapien
gggcttcatcctgcacaataaactc

SEQ ID NO: 22945 - DNA, 25 bp, Homo sapien
aggcgagatcagcacaacacgctct

SEQ ID NO: 22946 - DNA, 25 bp, Homo sapien
ctctggatgagaccgaagcaccgcg

SEQ ID NO: 22947 - DNA, 25 bp, Homo sapien
caccgccttctggtgctggtgaagg

SEQ ID NO: 22948 - DNA, 25 bp, Homo sapien
gccacagccacagtgctggtgtcgc

SEQ ID NO: 22949 - DNA, 25 bp, Homo sapien
ggaaagtggccaggcgccgaaggcc

SEQ ID NO: 22950 - DNA, 25 bp, Homo sapien
tgccctggtggatgtcaacgtgtac

SEQ ID NO: 22951 - DNA, 25 bp, Homo sapien
tgatcatcgccatctgtgcggtgtc

SEQ ID NO: 22952 - DNA, 25 bp, Homo sapien
ggccgtgtgcacacggggcaagccc

SEQ ID NO: 22953 - DNA, 25 bp, Homo sapien
agctggtcgtactcgcagcagagga

SEQ ID NO: 22954 - DNA, 25 bp, Homo sapien
aaaacagacctcatggccttcagtc

SEQ ID NO: 22955 - DNA, 25 bp, Homo sapien
ttctaatattaacatccatctttcc

SEQ ID NO: 22956 - DNA, 25 bp, Homo sapien
aatcaagcacatccttgctaatttc

SEQ ID NO: 22957 - DNA, 25 bp, Homo sapien
gaatccagatggcatggttgctcta

SEQ ID NO: 22958 - DNA, 25 bp, Homo sapien
ggttgctctattggactaccgtgag

SEQ ID NO: 22959 - DNA, 25 bp, Homo sapien
ctaccgtgaggatggtgtgacccca

SEQ ID NO: 22960 - DNA, 25 bp, Homo sapien
gtgaccccatatatgattttcttta

SEQ ID NO: 22961 - DNA, 25 bp, Homo sapien
ggatctatcacctgtcatcataact

SEQ ID NO: 22962 - DNA, 25 bp, Homo sapien
tcataactggcttctgcttgtcatc

SEQ ID NO: 22963 - DNA, 25 bp, Homo sapien
tcatccacacaacaccaggacttaa

SEQ ID NO: 22964 - DNA, 25 bp, Homo sapien
gactgatgtcatcttgagctcttca

SEQ ID NO: 22965 - DNA, 25 bp, Homo sapien
gagctcttcatttattttgactgtg

SEQ ID NO: 22966 - DNA, 25 bp, Homo sapien
aaaccttttatgacaggggctgcag

SEQ ID NO: 22967 - DNA, 25 bp, Homo sapien
tgggacctcagtggtcatcatcctc

SEQ ID NO: 22968 - DNA, 25 bp, Homo sapien
cttcatctctggtgctccaacaaaa

SEQ ID NO: 22969 - DNA, 25 bp, Homo sapien
gttggatcactgcgttttcacacag

SEQ ID NO: 22970 - DNA, 25 bp, Homo sapien
taccatcttgtacacggaacttcca

SEQ ID NO: 22971 - DNA, 25 bp, Homo sapien
ggaacttccaaatgctaagcccaga

SEQ ID NO: 22972 - DNA, 25 bp, Homo sapien
agcccagatccaaagttgtctcctg

SEQ ID NO: 22973 - DNA, 25 bp, Homo sapien
acagtcaggccttgagggcgtcttc

SEQ ID NO: 22974 - DNA, 25 bp, Homo sapien
aacagccctgtctcaaaaccgagtt

SEQ ID NO: 22975 - DNA, 25 bp, Homo sapien
gtgagtcttcatcttagggcatcgc

SEQ ID NO: 22976 - DNA, 25 bp, Homo sapien
tgcctctctcttgcttacaaatgtc

SEQ ID NO: 22977 - DNA, 25 bp, Homo sapien
aagaaaacacactcctttgcttagc

SEQ ID NO: 22978 - DNA, 25 bp, Homo sapien
tcatggaaagagctgagccgcttca

SEQ ID NO: 22979 - DNA, 25 bp, Homo sapien
ggaaagagctgagccgcttcagact

SEQ ID NO: 22980 - DNA, 25 bp, Homo sapien
aaagagctgagccgcttcagactgc

SEQ ID NO: 22981 - DNA, 25 bp, Homo sapien
agagctgagccgcttcagactgcgg

SEQ ID NO: 22982 - DNA, 25 bp, Homo sapien
gccccatcccgagtcgctaaggggc

SEQ ID NO: 22983 - DNA, 25 bp, Homo sapien
ccccatcccgagtcgctaaggggct

SEQ ID NO: 22984 - DNA, 25 bp, Homo sapien
atcccgagtcgctaaggggctgcgg

SEQ ID NO: 22985 - DNA, 25 bp, Homo sapien
tcccgagtcgctaaggggctgcggg

SEQ ID NO: 22986 - DNA, 25 bp, Homo sapien
ttctggaagacttggccttccgctc

SEQ ID NO: 22987 - DNA, 25 bp, Homo sapien
tctgacgcagggccgaggtgggcag

SEQ ID NO: 22988 - DNA, 25 bp, Homo sapien
tgacgcagggccgaggtgggcagtc

SEQ ID NO: 22989 - DNA, 25 bp, Homo sapien
agatccacatcaaaccgggggctaa

SEQ ID NO: 22990 - DNA, 25 bp, Homo sapien
ctcccatgtctctgacatcgttggt

SEQ ID NO: 22991 - DNA, 25 bp, Homo sapien
tggtccggatggtctagtctatgca

SEQ ID NO: 22992 - DNA, 25 bp, Homo sapien
cgtgacctcattaacttggccaaga

SEQ ID NO: 22993 - DNA, 25 bp, Homo sapien
ggaccaacatcattcctgtgatcga

SEQ ID NO: 22994 - DNA, 25 bp, Homo sapien
gtgatcgaggatgctcgacacccac

SEQ ID NO: 22995 - DNA, 25 bp, Homo sapien
atgtgatctttgctgatgtggccca

SEQ ID NO: 22996 - DNA, 25 bp, Homo sapien
tgatttccattaaggccaactgcat

SEQ ID NO: 22997 - DNA, 25 bp, Homo sapien
cgcaggagcagttgacccttgagcc

SEQ ID NO: 22998 - DNA, 25 bp, Homo sapien
gtcgtgggagtgtacaggccacccc

SEQ ID NO: 22999 - DNA, 25 bp, Homo sapien
gttcagcgctgtcaggattgcgaga

SEQ ID NO: 23000 - DNA, 25 bp, Homo sapien
agcccagggagggaacggacctgcg

SEQ ID NO: 23001 - DNA, 25 bp, Homo sapien
gacctgcgagtcacacaactggtga

SEQ ID NO: 23002 - DNA, 25 bp, Homo sapien
gtcacacaactggtgacccacacca

SEQ ID NO: 23003 - DNA, 25 bp, Homo sapien
cacaactggtgacccacaccagcgg

SEQ ID NO: 23004 - DNA, 25 bp, Homo sapien
gcaggaccctcttggggagaagagc

SEQ ID NO: 23005 - DNA, 25 bp, Homo sapien
ctcatcaaagtcctcggtgtttttt

SEQ ID NO: 23006 - DNA, 25 bp, Homo sapien
tcctcggtgttttttaaattatcag

SEQ ID NO: 23007 - DNA, 25 bp, Homo sapien
tttaaattatcagaactgcccagga

SEQ ID NO: 23008 - DNA, 25 bp, Homo sapien
ttggctctcggagccgcagggagtg

SEQ ID NO: 23009 - DNA, 25 bp, Homo sapien
gagctattttggggtctcgtttgcc

SEQ ID NO: 23010 - DNA, 25 bp, Homo sapien
gtctcgtttgcccagggagggcttg

SEQ ID NO: 23011 - DNA, 25 bp, Homo sapien
gaaaaagaagactcagagagcaaga

SEQ ID NO: 23012 - DNA, 25 bp, Homo sapien
aaagaagactcagagagcaagagga

SEQ ID NO: 23013 - DNA, 25 bp, Homo sapien
agaagactcagagagcaagaggaat

SEQ ID NO: 23014 - DNA, 25 bp, Homo sapien
gaagactcagagagcaagaggaatt

SEQ ID NO: 23015 - DNA, 25 bp, Homo sapien
aagactcagagagcaagaggaattt

SEQ ID NO: 23016 - DNA, 25 bp, Homo sapien
gactcagagagcaagaggaattttg

SEQ ID NO: 23017 - DNA, 25 bp, Homo sapien
cagagagcaagaggaattttgggga

SEQ ID NO: 23018 - DNA, 25 bp, Homo sapien
agagagcaagaggaattttggggaa

SEQ ID NO: 23019 - DNA, 25 bp, Homo sapien
gagagcaagaggaattttggggaaa

SEQ ID NO: 23020 - DNA, 25 bp, Homo sapien
agagcaagaggaattttggggaaat

SEQ ID NO: 23021 - DNA, 25 bp, Homo sapien
gagcaagaggaattttggggaaatt

SEQ ID NO: 23022 - DNA, 25 bp, Homo sapien
cccctggagacccggggctgatggg

SEQ ID NO: 23023 - DNA, 25 bp, Homo sapien
ccggggctgatgggtgaaaggggag

SEQ ID NO: 23024 - DNA, 25 bp, Homo sapien
ccccgctggaaatggcaccgagggc

SEQ ID NO: 23025 - DNA, 25 bp, Homo sapien
ctggaaatggcaccgagggcttccc

SEQ ID NO: 23026 - DNA, 25 bp, Homo sapien
ctcaagggggacgagggagaagccg

SEQ ID NO: 23027 - DNA, 25 bp, Homo sapien
accccggagacgataacaacgacat

SEQ ID NO: 23028 - DNA, 25 bp, Homo sapien
cgataacaacgacattgcaccccga

SEQ ID NO: 23029 - DNA, 25 bp, Homo sapien
acattgcaccccgaggagtcaaagg

SEQ ID NO: 23030 - DNA, 25 bp, Homo sapien
gcaccccgaggagtcaaaggagcaa

SEQ ID NO: 23031 - DNA, 25 bp, Homo sapien
cctgggccggacgaatgcgagattt

SEQ ID NO: 23032 - DNA, 25 bp, Homo sapien
tgggccggacgaatgcgagattttg

SEQ ID NO: 23033 - DNA, 25 bp, Homo sapien
cactctgtatctatctgctctggtg

SEQ ID NO: 23034 - DNA, 25 bp, Homo sapien
gggccttggagaacctttgtgtgga

SEQ ID NO: 23035 - DNA, 25 bp, Homo sapien
gatactctgtatctaatctgatggg

SEQ ID NO: 23036 - DNA, 25 bp, Homo sapien
agaacctttgtatccagctcaggga

SEQ ID NO: 23037 - DNA, 25 bp, Homo sapien
tcagcgccctgtcaaaacagaccac

SEQ ID NO: 23038 - DNA, 25 bp, Homo sapien
agaccactgggctgtaccaatcagc

SEQ ID NO: 23039 - DNA, 25 bp, Homo sapien
accaatcagccggacgtgggtgggg

SEQ ID NO: 23040 - DNA, 25 bp, Homo sapien
gaaaccagggcttgggacctgcagc

SEQ ID NO: 23041 - DNA, 25 bp, Homo sapien
tttggtggcacttgaggagcgcttc

SEQ ID NO: 23042 - DNA, 25 bp, Homo sapien
cctttctgggctggccaaggccaga

SEQ ID NO: 23043 - DNA, 25 bp, Homo sapien
caataaatcttgctactgctcaaaa

SEQ ID NO: 23044 - DNA, 25 bp, Homo sapien
ggagagaaggcgcaccatgatggaa

SEQ ID NO: 23045 - DNA, 25 bp, Homo sapien
gatggaagatttccggaagtaccgg

SEQ ID NO: 23046 - DNA, 25 bp, Homo sapien
ggagcagaaaaacgagcgcctggag

SEQ ID NO: 23047 - DNA, 25 bp, Homo sapien
agcgcctggagttgcgaggaggggt

SEQ ID NO: 23048 - DNA, 25 bp, Homo sapien
gttgcgaggaggggtggacactgac

SEQ ID NO: 23049 - DNA, 25 bp, Homo sapien
ggtggacactgacgagctggacagc

SEQ ID NO: 23050 - DNA, 25 bp, Homo sapien
cgagctggacagcaacgtggacgac

SEQ ID NO: 23051 - DNA, 25 bp, Homo sapien
acgtggacgactgggaagaggagac

SEQ ID NO: 23052 - DNA, 25 bp, Homo sapien
ggagaccattgagttcttcgtcact

SEQ ID NO: 23053 - DNA, 25 bp, Homo sapien
accattgagttcttcgtcactgaag

SEQ ID NO: 23054 - DNA, 25 bp, Homo sapien
gttttctccgcaggttgaacatgga

SEQ ID NO: 23055 - DNA, 25 bp, Homo sapien
tcccgacgggcagaggagcctgggt

SEQ ID NO: 23056 - DNA, 25 bp, Homo sapien
gagcctgggtcccgaggggacaagg

SEQ ID NO: 23057 - DNA, 25 bp, Homo sapien
gcctgggtcccgaggggacaaggag

SEQ ID NO: 23058 - DNA, 25 bp, Homo sapien
gtcccgaggggacaaggagcctggg

SEQ ID NO: 23059 - DNA, 25 bp, Homo sapien
tcccgaggggacaaggagcctgggt

SEQ ID NO: 23060 - DNA, 25 bp, Homo sapien
ccgaggggacaaggagcctgggttg

SEQ ID NO: 23061 - DNA, 25 bp, Homo sapien
gaggggacaaggagcctgggttgcc

SEQ ID NO: 23062 - DNA, 25 bp, Homo sapien
tacccccggggcttgtatatagatt

SEQ ID NO: 23063 - DNA, 25 bp, Homo sapien
cccccggggcttgtatatagattat

SEQ ID NO: 23064 - DNA, 25 bp, Homo sapien
ccccggggcttgtatatagattata

SEQ ID NO: 23065 - DNA, 25 bp, Homo sapien
ccggggcttgtatatagattataaa

SEQ ID NO: 23066 - DNA, 25 bp, Homo sapien
gagggaaaagcttcactctgaccat

SEQ ID NO: 23067 - DNA, 25 bp, Homo sapien
tctgaccatcactgtcttcacaaac

SEQ ID NO: 23068 - DNA, 25 bp, Homo sapien
cacctaccacagagccatcaaaatc

SEQ ID NO: 23069 - DNA, 25 bp, Homo sapien
tcacagtggatgggccccgagaacc

SEQ ID NO: 23070 - DNA, 25 bp, Homo sapien
agaccaagcccgggagcttgtcctt

SEQ ID NO: 23071 - DNA, 25 bp, Homo sapien
tccttttccgagcggctcagtgaac

SEQ ID NO: 23072 - DNA, 25 bp, Homo sapien
ctcagtgaactggagcagctgcggc

SEQ ID NO: 23073 - DNA, 25 bp, Homo sapien
cggcgcacagccatgagggtcagcc

SEQ ID NO: 23074 - DNA, 25 bp, Homo sapien
tttaaccctcagcctcagagtcaga

SEQ ID NO: 23075 - DNA, 25 bp, Homo sapien
gatcaccgtgacatccgaggtgcct

SEQ ID NO: 23076 - DNA, 25 bp, Homo sapien
gactggttgcgcgtagttgctaaca

SEQ ID NO: 23077 - DNA, 25 bp, Homo sapien
gagaactgcttgaacctaggaggcg

SEQ ID NO: 23078 - DNA, 25 bp, Homo sapien
cgagatcgcaccatttgacacagca

SEQ ID NO: 23079 - DNA, 25 bp, Homo sapien
ccatttgacacagcaagtctccgtc

SEQ ID NO: 23080 - DNA, 25 bp, Homo sapien
gtctccgtctcaaaactacaacaac

SEQ ID NO: 23081 - DNA, 25 bp, Homo sapien
caacaaccaaattttgcacccctgc

SEQ ID NO: 23082 - DNA, 25 bp, Homo sapien
gacgtctccagtgccttggataagc

SEQ ID NO: 23083 - DNA, 25 bp, Homo sapien
caaggctcgggaactcatcagccgc

SEQ ID NO: 23084 - DNA, 25 bp, Homo sapien
gtgaactttctgccaagatgcggga

SEQ ID NO: 23085 - DNA, 25 bp, Homo sapien
gaagggtgacatcccaggaggggcc

SEQ ID NO: 23086 - DNA, 25 bp, Homo sapien
caggaggggcctctgaaatttccca

SEQ ID NO: 23087 - DNA, 25 bp, Homo sapien
tggccccaggtgccaccaataaaaa

SEQ ID NO: 23088 - DNA, 25 bp, Homo sapien
gtaccttcttcacttattaattgcc

SEQ ID NO: 23089 - DNA, 25 bp, Homo sapien
cgacacatgggcctctcaaaggaga

SEQ ID NO: 23090 - DNA, 25 bp, Homo sapien
gagtaagtcccacggtagggccagt

SEQ ID NO: 23091 - DNA, 25 bp, Homo sapien
ggttgctccctgggttttggaatca

SEQ ID NO: 23092 - DNA, 25 bp, Homo sapien
catttctgcggagctttcaaggcca

SEQ ID NO: 23093 - DNA, 25 bp, Homo sapien
tcaaggccagaccctgggcttaggg

SEQ ID NO: 23094 - DNA, 25 bp, Homo sapien
gggcttagggtcgagacttcatagc

SEQ ID NO: 23095 - DNA, 25 bp, Homo sapien
tcatagcagtgacagccagacccag

SEQ ID NO: 23096 - DNA, 25 bp, Homo sapien
caagatggctgcgaccgtgaaaccc

SEQ ID NO: 23097 - DNA, 25 bp, Homo sapien
ttgccgagctacttcattctggaat

SEQ ID NO: 23098 - DNA, 25 bp, Homo sapien
cgccgaattcggcacgaggcttttt

SEQ ID NO: 23099 - DNA, 25 bp, Homo sapien
gggactggcaggaaataacccacaa

SEQ ID NO: 23100 - DNA, 25 bp, Homo sapien
caagggggaagggatgcagggggag

SEQ ID NO: 23101 - DNA, 25 bp, Homo sapien
caggacacgctcctataggaccaag

SEQ ID NO: 23102 - DNA, 25 bp, Homo sapien
caagatggatgcgacccaagaccca

SEQ ID NO: 23103 - DNA, 25 bp, Homo sapien
ccagctgctcagtgcaactgacaag

SEQ ID NO: 23104 - DNA, 25 bp, Homo sapien
aaaggtctatgatcttgagggcaga

SEQ ID NO: 23105 - DNA, 25 bp, Homo sapien
gggcagacagcagaattcctcttat

SEQ ID NO: 23106 - DNA, 25 bp, Homo sapien
gggagagaagaccttgggccaagat

SEQ ID NO: 23107 - DNA, 25 bp, Homo sapien
gcaggacagaggatttgctctggac

SEQ ID NO: 23108 - DNA, 25 bp, Homo sapien
gcacccagaatctcattaaagctta

SEQ ID NO: 23109 - DNA, 25 bp, Homo sapien
tgcagccagcaagctgggactggca

SEQ ID NO: 23110 - DNA, 25 bp, Homo sapien
tcgagaccctgcccagaggtaaagg

SEQ ID NO: 23111 - DNA, 25 bp, Homo sapien
gttgcgggaacgctggcatttctgc

SEQ ID NO: 23112 - DNA, 25 bp, Homo sapien
cacagctacccttcgaggaactgga

SEQ ID NO: 23113 - DNA, 25 bp, Homo sapien
aactggagtcccagagaggcctgcc

SEQ ID NO: 23114 - DNA, 25 bp, Homo sapien
gccccagctcaagagctacctgagg

SEQ ID NO: 23115 - DNA, 25 bp, Homo sapien
acctgaggcagaagctccaggccct

SEQ ID NO: 23116 - DNA, 25 bp, Homo sapien
gatgtggggttcaggatggcccccc

SEQ ID NO: 23117 - DNA, 25 bp, Homo sapien
gatggcccccccatggggggtggat

SEQ ID NO: 23118 - DNA, 25 bp, Homo sapien
ggatgatttgcactttggttccctg

SEQ ID NO: 23119 - DNA, 25 bp, Homo sapien
tggttccctgtgttttgatttctca

SEQ ID NO: 23120 - DNA, 25 bp, Homo sapien
tgatttctcattaaagttcctttcc

SEQ ID NO: 23121 - DNA, 25 bp, Homo sapien
gattgcatagtctgtaatcctctca

SEQ ID NO: 23122 - DNA, 25 bp, Homo sapien
aaaacctctctgaatgatgaccctt

SEQ ID NO: 23123 - DNA, 25 bp, Homo sapien
aatgatgacccttccttaatactgg

SEQ ID NO: 23124 - DNA, 25 bp, Homo sapien
gggtgatgtgtgaatatttgtttgt

SEQ ID NO: 23125 - DNA, 25 bp, Homo sapien
ggcagacagggtctcactttgtcac

SEQ ID NO: 23126 - DNA, 25 bp, Homo sapien
actttgtcacccaggctaggagtgc

SEQ ID NO: 23127 - DNA, 25 bp, Homo sapien
gagtgcagtggtgcaatctcagctc

SEQ ID NO: 23128 - DNA, 25 bp, Homo sapien
cctctgcctcctgagttcaagtgat

SEQ ID NO: 23129 - DNA, 25 bp, Homo sapien
ctacaggtatgcaccaccatgcctg

SEQ ID NO: 23130 - DNA, 25 bp, Homo sapien
acaggcataagccactgcgcctggc

SEQ ID NO: 23131 - DNA, 25 bp, Homo sapien
cgcctggccttgatgtgtgaatatt

SEQ ID NO: 23132 - DNA, 25 bp, Homo sapien
aggcccagaagttcctgatgaccgc

SEQ ID NO: 23133 - DNA, 25 bp, Homo sapien
gtcaatgccatcttcgagtggtcca

SEQ ID NO: 23134 - DNA, 25 bp, Homo sapien
caaagtgccaaaggatcttccccct

SEQ ID NO: 23135 - DNA, 25 bp, Homo sapien
ctgacacaactctgctagacctgca

SEQ ID NO: 23136 - DNA, 25 bp, Homo sapien
tgaagaaccttcacgttgtctacct

SEQ ID NO: 23137 - DNA, 25 bp, Homo sapien
gttggatcaagtgacttctgcccac

SEQ ID NO: 23138 - DNA, 25 bp, Homo sapien
ttgcacaagtttcctgggctggacc

SEQ ID NO: 23139 - DNA, 25 bp, Homo sapien
aaggcttcttattcgggtgtgagtc

SEQ ID NO: 23140 - DNA, 25 bp, Homo sapien
agcaacccggtccagtactgggaga

SEQ ID NO: 23141 - DNA, 25 bp, Homo sapien
cagccatccaccttcagatgtgtct

SEQ ID NO: 23142 - DNA, 25 bp, Homo sapien
gctctgccattcaactcggaaacta

SEQ ID NO: 23143 - DNA, 25 bp, Homo sapien
gaaaatgtaaatcaaccctatccat

SEQ ID NO: 23144 - DNA, 25 bp, Homo sapien
aaccctatccataatagattctcta

SEQ ID NO: 23145 - DNA, 25 bp, Homo sapien
aactttatcttacagtcactttcaa

SEQ ID NO: 23146 - DNA, 25 bp, Homo sapien
gtaactgctatattaacgtcttaaa

SEQ ID NO: 23147 - DNA, 25 bp, Homo sapien
gaaatgccaattccagtccaaagct

SEQ ID NO: 23148 - DNA, 25 bp, Homo sapien
aaagctgtatttgccaagttttctt

SEQ ID NO: 23149 - DNA, 25 bp, Homo sapien
ttttcttagaatgacttttaccgat

SEQ ID NO: 23150 - DNA, 25 bp, Homo sapien
taccgatttatgaattcttatacac

SEQ ID NO: 23151 - DNA, 25 bp, Homo sapien
tactgatttttgtctaaagtggcat

SEQ ID NO: 23152 - DNA, 25 bp, Homo sapien
aagtggcattattgactgctgctgt

SEQ ID NO: 23153 - DNA, 25 bp, Homo sapien
tattgactgctgctgtgatgctact

SEQ ID NO: 23154 - DNA, 25 bp, Homo sapien
gaatccagatggcatggttgctcta

SEQ ID NO: 23155 - DNA, 25 bp, Homo sapien
ggttgctctattggactaccgtgag

SEQ ID NO: 23156 - DNA, 25 bp, Homo sapien
ggtgtgaccccatatatgattttct

SEQ ID NO: 23157 - DNA, 25 bp, Homo sapien
tattttggatctatcacctgtcatc

SEQ ID NO: 23158 - DNA, 25 bp, Homo sapien
atcacctgtcatcataactggcttc

SEQ ID NO: 23159 - DNA, 25 bp, Homo sapien
tcataactggcttctgcttgtcatc

SEQ ID NO: 23160 - DNA, 25 bp, Homo sapien
tcatccacacaacaccaggacttaa

SEQ ID NO: 23161 - DNA, 25 bp, Homo sapien
gactgatgtcatcttgagctcttca

SEQ ID NO: 23162 - DNA, 25 bp, Homo sapien
gagctcttcatttattttgactgtg

SEQ ID NO: 23163 - DNA, 25 bp, Homo sapien
ggagtggaggcattgtttttaagaa

SEQ ID NO: 23164 - DNA, 25 bp, Homo sapien
aaacatgtcatgtaggttgtctaaa

SEQ ID NO: 23165 - DNA, 25 bp, Homo sapien
ttccccagcccagggtggacttaga

SEQ ID NO: 23166 - DNA, 25 bp, Homo sapien
ggtggacttagaaagcaggggctac

SEQ ID NO: 23167 - DNA, 25 bp, Homo sapien
gggctacaagagggaatccccgaag

SEQ ID NO: 23168 - DNA, 25 bp, Homo sapien
gaatccccgaaggtgctggaggtgg

SEQ ID NO: 23169 - DNA, 25 bp, Homo sapien
gagaaagccaggcaggtagccaggg

SEQ ID NO: 23170 - DNA, 25 bp, Homo sapien
gagaggcagagagcggtctcaggct

SEQ ID NO: 23171 - DNA, 25 bp, Homo sapien
caggctggtgggaggggcgcccacc

SEQ ID NO: 23172 - DNA, 25 bp, Homo sapien
ccctgctgcaggggctctggagaga

SEQ ID NO: 23173 - DNA, 25 bp, Homo sapien
ggcaggtagccagggggactagccc

SEQ ID NO: 23174 - DNA, 25 bp, Homo sapien
ggactagcccctgtggagactgggg

SEQ ID NO: 23175 - DNA, 25 bp, Homo sapien
tggggggcttgaaattgtccccgtg

SEQ ID NO: 23176 - DNA, 25 bp, Homo sapien
ctcccagatgcctgaggagggggca

SEQ ID NO: 23177 - DNA, 25 bp, Homo sapien
ttggggagagacacaggcaggcgag

SEQ ID NO: 23178 - DNA, 25 bp, Homo sapien
ggtccccagtctgttggggtggtgc

SEQ ID NO: 23179 - DNA, 25 bp, Homo sapien
ggtggtgctcagggtaaagggctat

SEQ ID NO: 23180 - DNA, 25 bp, Homo sapien
gggaccagaccagggatgagtgggg

SEQ ID NO: 23181 - DNA, 25 bp, Homo sapien
gaccagaccagggatgagtggggag

SEQ ID NO: 23182 - DNA, 25 bp, Homo sapien
gagtggggagggcacaaggaccatt

SEQ ID NO: 23183 - DNA, 25 bp, Homo sapien
gcacaaggaccatttgccagaatcc

SEQ ID NO: 23184 - DNA, 25 bp, Homo sapien
aaggaccatttgccagaatccaccg

SEQ ID NO: 23185 - DNA, 25 bp, Homo sapien
atgtgtcggggagagagcccgcagg

SEQ ID NO: 23186 - DNA, 25 bp, Homo sapien
gagagcccgcagggaagggtaaagc

SEQ ID NO: 23187 - DNA, 25 bp, Homo sapien
ggattggtctggtgtcagctgtgtt

SEQ ID NO: 23188 - DNA, 25 bp, Homo sapien
attgcacacctaaatcctgattata

SEQ ID NO: 23189 - DNA, 25 bp, Homo sapien
ttataggcttttcatttctccgcaa

SEQ ID NO: 23190 - DNA, 25 bp, Homo sapien
ttctccgcaaagcctttattttggc

SEQ ID NO: 23191 - DNA, 25 bp, Homo sapien
gtctgaccccaaacgttattgtcca

SEQ ID NO: 23192 - DNA, 25 bp, Homo sapien
gactggacagcagcttttgtttctt

SEQ ID NO: 23193 - DNA, 25 bp, Homo sapien
gcttttgtttcttgaccctgtaata

SEQ ID NO: 23194 - DNA, 25 bp, Homo sapien
gggttatagtcgtgattttcgctaa

SEQ ID NO: 23195 - DNA, 25 bp, Homo sapien
atgacttgtttctgttgtacttgag

SEQ ID NO: 23196 - DNA, 25 bp, Homo sapien
gaacagactacgtgctcagcttaga

SEQ ID NO: 23197 - DNA, 25 bp, Homo sapien
gaatctctagctgaccagtttgact

SEQ ID NO: 23198 - DNA, 25 bp, Homo sapien
agggagggagcagggagccctcact

SEQ ID NO: 23199 - DNA, 25 bp, Homo sapien
gccccttgcttgcatctgtatatag

SEQ ID NO: 23200 - DNA, 25 bp, Homo sapien
cccttgcttgcatctgtatatagtg

SEQ ID NO: 23201 - DNA, 25 bp, Homo sapien
tgcttgcatctgtatatagtgtgag

SEQ ID NO: 23202 - DNA, 25 bp, Homo sapien
atagtgtgagcagcaagtaaccctt

SEQ ID NO: 23203 - DNA, 25 bp, Homo sapien
ccctcctcaatgtagtggccttgga

SEQ ID NO: 23204 - DNA, 25 bp, Homo sapien
aatgtagtggccttggatatcctgt

SEQ ID NO: 23205 - DNA, 25 bp, Homo sapien
gtagtggccttggatatcctgtttg

SEQ ID NO: 23206 - DNA, 25 bp, Homo sapien
gtggccttggatatcctgtttgtta

SEQ ID NO: 23207 - DNA, 25 bp, Homo sapien
ggccttggatatcctgtttgttaat

SEQ ID NO: 23208 - DNA, 25 bp, Homo sapien
ggatatcctgtttgttaataaagac

SEQ ID NO: 23209 - DNA, 25 bp, Homo sapien
ggttactactggagctggatccgcc

SEQ ID NO: 23210 - DNA, 25 bp, Homo sapien
gccagcccccagggaagggactgga

SEQ ID NO: 23211 - DNA, 25 bp, Homo sapien
tgcagctacagcagtggggcgcagg

SEQ ID NO: 23212 - DNA, 25 bp, Homo sapien
aagagtcgagtcaccatttcagtag

SEQ ID NO: 23213 - DNA, 25 bp, Homo sapien
agacacgtccaagaaccagttctcc

SEQ ID NO: 23214 - DNA, 25 bp, Homo sapien
ccctgaagctgagctctgtgaccgc

SEQ ID NO: 23215 - DNA, 25 bp, Homo sapien
gacacggctgtgtattactgtgcga

SEQ ID NO: 23216 - DNA, 25 bp, Homo sapien
gaggcaggtattatcatggttcggg

SEQ ID NO: 23217 - DNA, 25 bp, Homo sapien
gttcggggagacaaccactttgact

SEQ ID NO: 23218 - DNA, 25 bp, Homo sapien
gcgcaggactgttgaagccttcgga

SEQ ID NO: 23219 - DNA, 25 bp, Homo sapien
tggtgggtccttcagtggttactac

SEQ ID NO: 23220 - DNA, 25 bp, Homo sapien
acgacccgaatctatttgatcttcc

SEQ ID NO: 23221 - DNA, 25 bp, Homo sapien
tttgatcttccaggtcaccttgggc

SEQ ID NO: 23222 - DNA, 25 bp, Homo sapien
tgggctctgtttgtcagatcctgtt

SEQ ID NO: 23223 - DNA, 25 bp, Homo sapien
agatcctgttatccatagcctttag

SEQ ID NO: 23224 - DNA, 25 bp, Homo sapien
gttgtcagtggtcagaaaccgtgtg

SEQ ID NO: 23225 - DNA, 25 bp, Homo sapien
agaaaccgtgtgtttgagcgggtgt

SEQ ID NO: 23226 - DNA, 25 bp, Homo sapien
ggctggtgtgtcgggaggatttaac

SEQ ID NO: 23227 - DNA, 25 bp, Homo sapien
gggattggcctagaaacaacctgtt

SEQ ID NO: 23228 - DNA, 25 bp, Homo sapien
acctgttgagatagtcttgccccat

SEQ ID NO: 23229 - DNA, 25 bp, Homo sapien
ataacctgtctcacaccgtagtgta

SEQ ID NO: 23230 - DNA, 25 bp, Homo sapien
gtctcacaccgtagtgtacggcccc

SEQ ID NO: 23231 - DNA, 25 bp, Homo sapien
agaaaatggacactgtgcccagccc

SEQ ID NO: 23232 - DNA, 25 bp, Homo sapien
cccaggccggggtggagcatgggcc

SEQ ID NO: 23233 - DNA, 25 bp, Homo sapien
ttcaggcaggccaaggccttctcct

SEQ ID NO: 23234 - DNA, 25 bp, Homo sapien
gtcccagtctctggcagttctggaa

SEQ ID NO: 23235 - DNA, 25 bp, Homo sapien
ggaatggaagggttctggctgcccc

SEQ ID NO: 23236 - DNA, 25 bp, Homo sapien
gctgccccaacctgctgaagggcag

SEQ ID NO: 23237 - DNA, 25 bp, Homo sapien
gggcgctgagtagggactcagggcc

SEQ ID NO: 23238 - DNA, 25 bp, Homo sapien
ggaacattccttagtctcaagggct

SEQ ID NO: 23239 - DNA, 25 bp, Homo sapien
gtctcaagggctagcatccctgagg

SEQ ID NO: 23240 - DNA, 25 bp, Homo sapien
ctcgctgcttctgtgtgtggtgagc

SEQ ID NO: 23241 - DNA, 25 bp, Homo sapien
ggagctggggggcgtggagagcccg

SEQ ID NO: 23242 - DNA, 25 bp, Homo sapien
actcattatgatccaccacgaaagc

SEQ ID NO: 23243 - DNA, 25 bp, Homo sapien
gatccaccacgaaagcttatggcca

SEQ ID NO: 23244 - DNA, 25 bp, Homo sapien
caccacgaaagcttatggccatgca

SEQ ID NO: 23245 - DNA, 25 bp, Homo sapien
ggtccttatgacagacctggggctg

SEQ ID NO: 23246 - DNA, 25 bp, Homo sapien
cagacctggggctggtagagggtat

SEQ ID NO: 23247 - DNA, 25 bp, Homo sapien
gtagagggtataacagcattggcag

SEQ ID NO: 23248 - DNA, 25 bp, Homo sapien
actttccagagcacaacaggacact

SEQ ID NO: 23249 - DNA, 25 bp, Homo sapien
acaggacactgtgtacacatgcggg

SEQ ID NO: 23250 - DNA, 25 bp, Homo sapien
gtacacatgcggggattaccttaca

SEQ ID NO: 23251 - DNA, 25 bp, Homo sapien
ggggattaccttacagagctactga

SEQ ID NO: 23252 - DNA, 25 bp, Homo sapien
acagagctactgagaatgacattta

SEQ ID NO: 23253 - DNA, 25 bp, Homo sapien
tgggctgcaacgagtgtacgcaccc

SEQ ID NO: 23254 - DNA, 25 bp, Homo sapien
cagcactcgctgagcatgctgggca

SEQ ID NO: 23255 - DNA, 25 bp, Homo sapien
gcatcggccagtgcgtggaatgtga

SEQ ID NO: 23256 - DNA, 25 bp, Homo sapien
cacctcgggccccaagtggaaggtg

SEQ ID NO: 23257 - DNA, 25 bp, Homo sapien
ggtggcctgcaacaagtgcaacgtg

SEQ ID NO: 23258 - DNA, 25 bp, Homo sapien
tggtagcgcactgcttcgagaacgc

SEQ ID NO: 23259 - DNA, 25 bp, Homo sapien
gacttcaacaaggccaagtccccac

SEQ ID NO: 23260 - DNA, 25 bp, Homo sapien
tcccgggcgatgagacgcagcacat

SEQ ID NO: 23261 - DNA, 25 bp, Homo sapien
gcacatgggctgcgtcttttgtgac

SEQ ID NO: 23262 - DNA, 25 bp, Homo sapien
catgcaccgcggtggaccagggaga

SEQ ID NO: 23263 - DNA, 25 bp, Homo sapien
ggccgcctactttgtatgatgaccc

SEQ ID NO: 23264 - DNA, 25 bp, Homo sapien
taaatcatcttcccaaatacctgcc

SEQ ID NO: 23265 - DNA, 25 bp, Homo sapien
tacctgcccaaccatcagtagcaaa

SEQ ID NO: 23266 - DNA, 25 bp, Homo sapien
cagtagcaaaagttccctatgggaa

SEQ ID NO: 23267 - DNA, 25 bp, Homo sapien
ggaacgtggaacatcttcacatctg

SEQ ID NO: 23268 - DNA, 25 bp, Homo sapien
aagttgcttgcacagcagcatccac

SEQ ID NO: 23269 - DNA, 25 bp, Homo sapien
tccacctccagatcgacaggcagta

SEQ ID NO: 23270 - DNA, 25 bp, Homo sapien
gcagtacctggaagaccaggcccct

SEQ ID NO: 23271 - DNA, 25 bp, Homo sapien
ctttccctccaagcagcaagtagct

SEQ ID NO: 23272 - DNA, 25 bp, Homo sapien
ttctgcagcagtagaacgtgctcgt

SEQ ID NO: 23273 - DNA, 25 bp, Homo sapien
gaacgtgctcgtaaacggcgtgaag

SEQ ID NO: 23274 - DNA, 25 bp, Homo sapien
gagaagcttggcatcctggaaaaac

SEQ ID NO: 23275 - DNA, 25 bp, Homo sapien
gagagagtatgctctgtgtcgtccc

SEQ ID NO: 23276 - DNA, 25 bp, Homo sapien
tcgtcccagacatttctgcattccg

SEQ ID NO: 23277 - DNA, 25 bp, Homo sapien
accagtccaggttccagtaactttg

SEQ ID NO: 23278 - DNA, 25 bp, Homo sapien
cctttacctacacaccagaaccagg

SEQ ID NO: 23279 - DNA, 25 bp, Homo sapien
aatccttcgagccaattcaagccag

SEQ ID NO: 23280 - DNA, 25 bp, Homo sapien
gtgccccctaacgaatcaaacacaa

SEQ ID NO: 23281 - DNA, 25 bp, Homo sapien
gagggaagttacacaaacgccagca

SEQ ID NO: 23282 - DNA, 25 bp, Homo sapien
aaacgccagcacaaattcaaccagt

SEQ ID NO: 23283 - DNA, 25 bp, Homo sapien
aaccagtgtcacatcatctacagcc

SEQ ID NO: 23284 - DNA, 25 bp, Homo sapien
tatcctaactaccgtctttttgcta

SEQ ID NO: 23285 - DNA, 25 bp, Homo sapien
ttgtctccctgcaagtgctgatttg

SEQ ID NO: 23286 - DNA, 25 bp, Homo sapien
atggcaacagctttgccactcgact

SEQ ID NO: 23287 - DNA, 25 bp, Homo sapien
ccactcgactttccaacatttttgt

SEQ ID NO: 23288 - DNA, 25 bp, Homo sapien
ggcaacaaaccatggatttctcttc

SEQ ID NO: 23289 - DNA, 25 bp, Homo sapien
gtgtatggtgactggaggtgctaac

SEQ ID NO: 23290 - DNA, 25 bp, Homo sapien
cgaggaaagggtatccgcctcacca

SEQ ID NO: 23291 - DNA, 25 bp, Homo sapien
ccgcctcaccattgctgaagagaga

SEQ ID NO: 23292 - DNA, 25 bp, Homo sapien
gactggcggccaaacagagcagtgg

SEQ ID NO: 23293 - DNA, 25 bp, Homo sapien
gaaatgggtccctgggtgacatgtc

SEQ ID NO: 23294 - DNA, 25 bp, Homo sapien
gtgacatgtcagatctttgtacgta

SEQ ID NO: 23295 - DNA, 25 bp, Homo sapien
gatcaccaacagagagaggcaccct

SEQ ID NO: 23296 - DNA, 25 bp, Homo sapien
gcaccctggatcttttgacgtggtt

SEQ ID NO: 23297 - DNA, 25 bp, Homo sapien
gtagatcttgtgatttctgaaaacg

SEQ ID NO: 23298 - DNA, 25 bp, Homo sapien
aaacgaatttcttctaaacatcaag

SEQ ID NO: 23299 - DNA, 25 bp, Homo sapien
aaacatcaagctatttttcttcact

SEQ ID NO: 23300 - DNA, 25 bp, Homo sapien
ttttcttcactatctatacctgcta

SEQ ID NO: 23301 - DNA, 25 bp, Homo sapien
tcactatctatacctgctatgcaga

SEQ ID NO: 23302 - DNA, 25 bp, Homo sapien
gcagagattgagaaccaaaccaaat

SEQ ID NO: 23303 - DNA, 25 bp, Homo sapien
aaaccaaatggatatctgcttttaa

SEQ ID NO: 23304 - DNA, 25 bp, Homo sapien
gaatttgttcttcatccttaaagca

SEQ ID NO: 23305 - DNA, 25 bp, Homo sapien
catccttaaagcagaactcattgag

SEQ ID NO: 23306 - DNA, 25 bp, Homo sapien
aatcacgaagtgtactggaatgcta

SEQ ID NO: 23307 - DNA, 25 bp, Homo sapien
aactgtatagtttctgttatgtaat

SEQ ID NO: 23308 - DNA, 25 bp, Homo sapien
gcacgttacagttagcagacgagca

SEQ ID NO: 23309 - DNA, 25 bp, Homo sapien
gagcaattccatttgttcttctcca

SEQ ID NO: 23310 - DNA, 25 bp, Homo sapien
ctctaaggcccacttgaatgcaaag

SEQ ID NO: 23311 - DNA, 25 bp, Homo sapien
gtcacagcagcaagacacgcacagt

SEQ ID NO: 23312 - DNA, 25 bp, Homo sapien
gcacagtcaaccattttccgagaaa

SEQ ID NO: 23313 - DNA, 25 bp, Homo sapien
ggaggaacactggattcttactttc

SEQ ID NO: 23314 - DNA, 25 bp, Homo sapien
ggattcttactttctggatcttgac

SEQ ID NO: 23315 - DNA, 25 bp, Homo sapien
ggatcttgacactgggctgcaaaac

SEQ ID NO: 23316 - DNA, 25 bp, Homo sapien
tgacactgggctgcaaaacctacct

SEQ ID NO: 23317 - DNA, 25 bp, Homo sapien
cctcaactctcaatgtcttgctgtc

SEQ ID NO: 23318 - DNA, 25 bp, Homo sapien
gaacagaaaacgaagccacaggaag

SEQ ID NO: 23319 - DNA, 25 bp, Homo sapien
gggggacagagtctcactgtgtcac

SEQ ID NO: 23320 - DNA, 25 bp, Homo sapien
tctcactgtgtcactcagactggag

SEQ ID NO: 23321 - DNA, 25 bp, Homo sapien
gtacagtgatgcgatctcggctcac

SEQ ID NO: 23322 - DNA, 25 bp, Homo sapien
gcctcctaaagtgccgggattacag

SEQ ID NO: 23323 - DNA, 25 bp, Homo sapien
ggattacaggcgtgaaccaccgcac

SEQ ID NO: 23324 - DNA, 25 bp, Homo sapien
ggccagtactacatccattttattg

SEQ ID NO: 23325 - DNA, 25 bp, Homo sapien
aagctttcttttcacatgtactttt

SEQ ID NO: 23326 - DNA, 25 bp, Homo sapien
tgaagtgacaggttttgcatgtgat

SEQ ID NO: 23327 - DNA, 25 bp, Homo sapien
gcatgtgatgagtgttttctgttaa

SEQ ID NO: 23328 - DNA, 25 bp, Homo sapien
ggtaacctatgttttacagtggagt

SEQ ID NO: 23329 - DNA, 25 bp, Homo sapien
gctaggtctttctttcattttattg

SEQ ID NO: 23330 - DNA, 25 bp, Homo sapien
cggcttgttgggaccaccaaccaag

SEQ ID NO: 23331 - DNA, 25 bp, Homo sapien
tgttagtcacagaggccgcaaggcc

SEQ ID NO: 23332 - DNA, 25 bp, Homo sapien
ggccaagacgtgagtgggctgcccc

SEQ ID NO: 23333 - DNA, 25 bp, Homo sapien
gactctgttaaccactacttgaagt

SEQ ID NO: 23334 - DNA, 25 bp, Homo sapien
agtcttgagggggaaagcctccagg

SEQ ID NO: 23335 - DNA, 25 bp, Homo sapien
gggagacataggggccttctccctt

SEQ ID NO: 23336 - DNA, 25 bp, Homo sapien
gtagggggtaggcaactggttgtca

SEQ ID NO: 23337 - DNA, 25 bp, Homo sapien
aatggggatcatcacagtccccttc

SEQ ID NO: 23338 - DNA, 25 bp, Homo sapien
ggctgggcagtgttaagggtggcaa

SEQ ID NO: 23339 - DNA, 25 bp, Homo sapien
gtggcaagatagtctctgtccccac

SEQ ID NO: 23340 - DNA, 25 bp, Homo sapien
gggaggggcttctctacaatgaggt

SEQ ID NO: 23341 - DNA, 25 bp, Homo sapien
aagggttcctgctttcacagaatta

SEQ ID NO: 23342 - DNA, 25 bp, Homo sapien
tcagggtggtgacttcacacgccat

SEQ ID NO: 23343 - DNA, 25 bp, Homo sapien
ggcactggtggcaagtccatctatg

SEQ ID NO: 23344 - DNA, 25 bp, Homo sapien
taaagcatacgggtcctggcatctt

SEQ ID NO: 23345 - DNA, 25 bp, Homo sapien
cctggcatcttgtccatggcaaatg

SEQ ID NO: 23346 - DNA, 25 bp, Homo sapien
ggacccaacacaaatggttcccagt

SEQ ID NO: 23347 - DNA, 25 bp, Homo sapien
gtttttcatctgcactgccaagact

SEQ ID NO: 23348 - DNA, 25 bp, Homo sapien
ggagcgctttgggtccaggaatggc

SEQ ID NO: 23349 - DNA, 25 bp, Homo sapien
agatcaccattgctgactgtggaca

SEQ ID NO: 23350 - DNA, 25 bp, Homo sapien
tcttaaccaccagatcattccttct

SEQ ID NO: 23351 - DNA, 25 bp, Homo sapien
atcctagaatctttgtgctctcgct

SEQ ID NO: 23352 - DNA, 25 bp, Homo sapien
gctcacccagcagatgttcgatgcc

SEQ ID NO: 23353 - DNA, 25 bp, Homo sapien
caagaacatgatggccgcctgcgac

SEQ ID NO: 23354 - DNA, 25 bp, Homo sapien
gtggacgagcagatgctggccatcc

SEQ ID NO: 23355 - DNA, 25 bp, Homo sapien
gcagctacttcgtggagtggatccc

SEQ ID NO: 23356 - DNA, 25 bp, Homo sapien
gtggatccccaacaacgtgaaggtg

SEQ ID NO: 23357 - DNA, 25 bp, Homo sapien
gtgaaggtggccgtgtgtgacatcc

SEQ ID NO: 23358 - DNA, 25 bp, Homo sapien
acagcacggccatccaggagctgtt

SEQ ID NO: 23359 - DNA, 25 bp, Homo sapien
caggagctgttcaagcgcatctccg

SEQ ID NO: 23360 - DNA, 25 bp, Homo sapien
tgcactggtacacgggcgagggcat

SEQ ID NO: 23361 - DNA, 25 bp, Homo sapien
acgagatggagttcaccgaggccga

SEQ ID NO: 23362 - DNA, 25 bp, Homo sapien
atgaacgacctggtgtccgagtacc

SEQ ID NO: 23363 - DNA, 25 bp, Homo sapien
ttacttttctgctaccactattttt

SEQ ID NO: 23364 - DNA, 25 bp, Homo sapien
gccccagtgacccagagcatggaaa

SEQ ID NO: 23365 - DNA, 25 bp, Homo sapien
atggaaagggggtcagctctggtct

SEQ ID NO: 23366 - DNA, 25 bp, Homo sapien
ggccagtgactaagaagcccaatca

SEQ ID NO: 23367 - DNA, 25 bp, Homo sapien
atcacattccagtttctatagcact

SEQ ID NO: 23368 - DNA, 25 bp, Homo sapien
gcactgggtaggcacaacccacagt

SEQ ID NO: 23369 - DNA, 25 bp, Homo sapien
ataagtagccaggcctttccatagc

SEQ ID NO: 23370 - DNA, 25 bp, Homo sapien
ccatggtgacacaaaggccctcaag

SEQ ID NO: 23371 - DNA, 25 bp, Homo sapien
aaaggccctcaagattagcctcctg

SEQ ID NO: 23372 - DNA, 25 bp, Homo sapien
atcatgggttggcctgtgatctgtc

SEQ ID NO: 23373 - DNA, 25 bp, Homo sapien
ttcccatgtgcttttctgcagaagg

SEQ ID NO: 23374 - DNA, 25 bp, Homo sapien
gagcccatccttggctctaggattc

SEQ ID NO: 23375 - DNA, 25 bp, Homo sapien
ccaaggcctgatgtgagccagcggg

SEQ ID NO: 23376 - DNA, 25 bp, Homo sapien
catcctgactgcagcatggggttcc

SEQ ID NO: 23377 - DNA, 25 bp, Homo sapien
tgtccaggtgttcagacctcttggc

SEQ ID NO: 23378 - DNA, 25 bp, Homo sapien
tttcagaggcgtgaggccctggggc

SEQ ID NO: 23379 - DNA, 25 bp, Homo sapien
ctcccaacaaactccagaacagcag

SEQ ID NO: 23380 - DNA, 25 bp, Homo sapien
gtagaggagcactcagctcacgggg

SEQ ID NO: 23381 - DNA, 25 bp, Homo sapien
gctcacggggagggagctcttggct

SEQ ID NO: 23382 - DNA, 25 bp, Homo sapien
ctcttggctgagcttctacagggct

SEQ ID NO: 23383 - DNA, 25 bp, Homo sapien
ctacagggctgagagctgcgctttg

SEQ ID NO: 23384 - DNA, 25 bp, Homo sapien
ccagtctgggctgagtggggggtcc

SEQ ID NO: 23385 - DNA, 25 bp, Homo sapien
atttcctcatctttttgttgttgtc

SEQ ID NO: 23386 - DNA, 25 bp, Homo sapien
gacaatgctgtgagtttccaacctt

SEQ ID NO: 23387 - DNA, 25 bp, Homo sapien
aaccttagcccatctgcgggcagag

SEQ ID NO: 23388 - DNA, 25 bp, Homo sapien
gaaggtctagtttgtccatcagcat

SEQ ID NO: 23389 - DNA, 25 bp, Homo sapien
ggtctaggagatctgtcccttttag

SEQ ID NO: 23390 - DNA, 25 bp, Homo sapien
tcctgtattccgatgatcatcctgt

SEQ ID NO: 23391 - DNA, 25 bp, Homo sapien
atcatttattaatcatccctgcctg

SEQ ID NO: 23392 - DNA, 25 bp, Homo sapien
tccctgcctgtgtctattattatat

SEQ ID NO: 23393 - DNA, 25 bp, Homo sapien
ctctacgctggaaactttctgcctc

SEQ ID NO: 23394 - DNA, 25 bp, Homo sapien
ttctgcctcaatgtttactgtgcct

SEQ ID NO: 23395 - DNA, 25 bp, Homo sapien
ctgtgcctttgtttttgctagtgtg

SEQ ID NO: 23396 - DNA, 25 bp, Homo sapien
atttctggcaatttctacagaaaca

SEQ ID NO: 23397 - DNA, 25 bp, Homo sapien
ttctacagaaacaagttgaagtacc

SEQ ID NO: 23398 - DNA, 25 bp, Homo sapien
tggctttcctccgcaagcggatgaa

SEQ ID NO: 23399 - DNA, 25 bp, Homo sapien
ggctttcctccgcaagcggatgaac

SEQ ID NO: 23400 - DNA, 25 bp, Homo sapien
gctttcctccgcaagcggatgaaca

SEQ ID NO: 23401 - DNA, 25 bp, Homo sapien
tttcctccgcaagcggatgaacacc

SEQ ID NO: 23402 - DNA, 25 bp, Homo sapien
ctccgcaagcggatgaacaccaacc

SEQ ID NO: 23403 - DNA, 25 bp, Homo sapien
tccgcaagcggatgaacaccaaccc

SEQ ID NO: 23404 - DNA, 25 bp, Homo sapien
tcgtgcgtctgaagcctacaagaaa

SEQ ID NO: 23405 - DNA, 25 bp, Homo sapien
gtgcgtctgaagcctacaagaaagt

SEQ ID NO: 23406 - DNA, 25 bp, Homo sapien
gcgtctgaagcctacaagaaagttt

SEQ ID NO: 23407 - DNA, 25 bp, Homo sapien
ggaaaacgggcagtctgctctgctg

SEQ ID NO: 23408 - DNA, 25 bp, Homo sapien
ctgctctgaccttccagagcccaag

SEQ ID NO: 23409 - DNA, 25 bp, Homo sapien
gcaaccaactgccccagggggatat

SEQ ID NO: 23410 - DNA, 25 bp, Homo sapien
gctgctcccctggaggacagaggga

SEQ ID NO: 23411 - DNA, 25 bp, Homo sapien
agagggagacagggctgctccccaa

SEQ ID NO: 23412 - DNA, 25 bp, Homo sapien
gagctatgacgtcgcatgcacgcgt

SEQ ID NO: 23413 - DNA, 25 bp, Homo sapien
gggcagtgactcgacaaaggccaca

SEQ ID NO: 23414 - DNA, 25 bp, Homo sapien
aaaggccacaggcagtccaggcctc

SEQ ID NO: 23415 - DNA, 25 bp, Homo sapien
tgcagggagacatctgcacccctga

SEQ ID NO: 23416 - DNA, 25 bp, Homo sapien
gagttgggcagccaggagtgccccc

SEQ ID NO: 23417 - DNA, 25 bp, Homo sapien
gcacgcgtacgtaagcttggatcct

SEQ ID NO: 23418 - DNA, 25 bp, Homo sapien
gagcatgtgtgcaggggaattcccc

SEQ ID NO: 23419 - DNA, 25 bp, Homo sapien
gcagcatgagaaagactcacctccg

SEQ ID NO: 23420 - DNA, 25 bp, Homo sapien
gagaaagactcacctccgtgattca

SEQ ID NO: 23421 - DNA, 25 bp, Homo sapien
aagactcacctccgtgattcagtta

SEQ ID NO: 23422 - DNA, 25 bp, Homo sapien
atacattcacactagcattttagtt

SEQ ID NO: 23423 - DNA, 25 bp, Homo sapien
ttcacactagcattttagttttaga

SEQ ID NO: 23424 - DNA, 25 bp, Homo sapien
gaactagttctatgttactatctga

SEQ ID NO: 23425 - DNA, 25 bp, Homo sapien
tgttactatctgaattaatttttcc

SEQ ID NO: 23426 - DNA, 25 bp, Homo sapien
gtaaggaaaaataatgcgttctttg

SEQ ID NO: 23427 - DNA, 25 bp, Homo sapien
taatgcgttctttgaatttcatgtg

SEQ ID NO: 23428 - DNA, 25 bp, Homo sapien
gcgttctttgaatttcatgtgtaaa

SEQ ID NO: 23429 - DNA, 25 bp, Homo sapien
acagcagtaatagttaacggagcca

SEQ ID NO: 23430 - DNA, 25 bp, Homo sapien
aacggagccagaatgcttgagtcat

SEQ ID NO: 23431 - DNA, 25 bp, Homo sapien
gaatgcttgagtcatataattgcaa

SEQ ID NO: 23432 - DNA, 25 bp, Homo sapien
gagtagttgctgtagttcctctttg

SEQ ID NO: 23433 - DNA, 25 bp, Homo sapien
gtagttcctctttgggtcgtaggag

SEQ ID NO: 23434 - DNA, 25 bp, Homo sapien
tttgggtcgtaggagcagttgtcat

SEQ ID NO: 23435 - DNA, 25 bp, Homo sapien
gaagagttcttagtgaggcctgggt

SEQ ID NO: 23436 - DNA, 25 bp, Homo sapien
gcctgggtgaacagctcttcttagt

SEQ ID NO: 23437 - DNA, 25 bp, Homo sapien
gaacagctcttcttagtattctgtg

SEQ ID NO: 23438 - DNA, 25 bp, Homo sapien
gcttgagagagctataactgtaata

SEQ ID NO: 23439 - DNA, 25 bp, Homo sapien
aatagacttatatttctgaacattt

SEQ ID NO: 23440 - DNA, 25 bp, Homo sapien
aagtattcattcctgcatgactccc

SEQ ID NO: 23441 - DNA, 25 bp, Homo sapien
ttctgcttctcagactctattccga

SEQ ID NO: 23442 - DNA, 25 bp, Homo sapien
aaatccaatctagagctgctccgca

SEQ ID NO: 23443 - DNA, 25 bp, Homo sapien
gttcctcaggagtatgttcgccaac

SEQ ID NO: 23444 - DNA, 25 bp, Homo sapien
gacacctcggacagcgatgactatc

SEQ ID NO: 23445 - DNA, 25 bp, Homo sapien
gcagatcctcaagcagacctacagc

SEQ ID NO: 23446 - DNA, 25 bp, Homo sapien
gacgcactgctcaagaactacgggc

SEQ ID NO: 23447 - DNA, 25 bp, Homo sapien
gctgctctactgcttcaggaaggac

SEQ ID NO: 23448 - DNA, 25 bp, Homo sapien
gacaaggtcgagacattcctgcgca

SEQ ID NO: 23449 - DNA, 25 bp, Homo sapien
agggcagctgtggcttctaggtgcc

SEQ ID NO: 23450 - DNA, 25 bp, Homo sapien
ttctaggtgcccgagtagcatcctg

SEQ ID NO: 23451 - DNA, 25 bp, Homo sapien
tcatggcgaacacagagtcctatct

SEQ ID NO: 23452 - DNA, 25 bp, Homo sapien
aaatgtcgccttgaagcacatgccc

SEQ ID NO: 23453 - DNA, 25 bp, Homo sapien
cacatgccccctaacttacagaagg

SEQ ID NO: 23454 - DNA, 25 bp, Homo sapien
ctctttcgggcagttcccaaaccag

SEQ ID NO: 23455 - DNA, 25 bp, Homo sapien
gatctagattcttacgtgtttctga

SEQ ID NO: 23456 - DNA, 25 bp, Homo sapien
gggactacgtgattgacctggagaa

SEQ ID NO: 23457 - DNA, 25 bp, Homo sapien
gacctggagaagggctcacagcact

SEQ ID NO: 23458 - DNA, 25 bp, Homo sapien
gctcacagcacttgatccgatacaa

SEQ ID NO: 23459 - DNA, 25 bp, Homo sapien
aaccattgcacctctggttgcatct

SEQ ID NO: 23460 - DNA, 25 bp, Homo sapien
ttgcatctggagctgtccagctaat

SEQ ID NO: 23461 - DNA, 25 bp, Homo sapien
actaggcataaacagccaggcatgg

SEQ ID NO: 23462 - DNA, 25 bp, Homo sapien
aagggttcctgctttcacagaatta

SEQ ID NO: 23463 - DNA, 25 bp, Homo sapien
tcagggtggtgacttcacacgccat

SEQ ID NO: 23464 - DNA, 25 bp, Homo sapien
ggcactggtggcaagtccatctatg

SEQ ID NO: 23465 - DNA, 25 bp, Homo sapien
taaagcatacgggtcctggcatctt

SEQ ID NO: 23466 - DNA, 25 bp, Homo sapien
cctggcatcttgtccatggcaaatg

SEQ ID NO: 23467 - DNA, 25 bp, Homo sapien
ggacccaacacaaatggttcccagt

SEQ ID NO: 23468 - DNA, 25 bp, Homo sapien
gtttttcatctgcactgccaagact

SEQ ID NO: 23469 - DNA, 25 bp, Homo sapien
ggagcgctttgggtccaggaatggc

SEQ ID NO: 23470 - DNA, 25 bp, Homo sapien
tcttaaccaccagatcattccttct

SEQ ID NO: 23471 - DNA, 25 bp, Homo sapien
atcctagaatctttgtgctctcgct

SEQ ID NO: 23472 - DNA, 25 bp, Homo sapien
ctcccatgcctagctggattgcagg

SEQ ID NO: 23473 - DNA, 25 bp, Homo sapien
catggagagccaggcctacagcggg

SEQ ID NO: 23474 - DNA, 25 bp, Homo sapien
tacagcgggtcccagtagccaagat

SEQ ID NO: 23475 - DNA, 25 bp, Homo sapien
tagccaagatgctgtgtgggccctc

SEQ ID NO: 23476 - DNA, 25 bp, Homo sapien
aaatgtggccttgctgaacgtcatc

SEQ ID NO: 23477 - DNA, 25 bp, Homo sapien
gaacgtcatctccaaccaggagtgt

SEQ ID NO: 23478 - DNA, 25 bp, Homo sapien
tgcactgagggactgttggcccctg

SEQ ID NO: 23479 - DNA, 25 bp, Homo sapien
gctttacccacaactgctgggtcct

SEQ ID NO: 23480 - DNA, 25 bp, Homo sapien
gaattagaatccccaaccgagtatg

SEQ ID NO: 23481 - DNA, 25 bp, Homo sapien
tcacgcgtgtctctgtgtttgtgga

SEQ ID NO: 23482 - DNA, 25 bp, Homo sapien
gagactgggttaggcccagccttga

SEQ ID NO: 23483 - DNA, 25 bp, Homo sapien
gccttgacgccatatgctttgggga

SEQ ID NO: 23484 - DNA, 25 bp, Homo sapien
gaggagcacctgaagaaatcaaggg

SEQ ID NO: 23485 - DNA, 25 bp, Homo sapien
gggaaaagtatgtcctggagctgca

SEQ ID NO: 23486 - DNA, 25 bp, Homo sapien
aagtatgtcctggagctgcagagcc

SEQ ID NO: 23487 - DNA, 25 bp, Homo sapien
cccacgtgctcaacgtgcagtcgta

SEQ ID NO: 23488 - DNA, 25 bp, Homo sapien
cacgtgctcaacgtgcagtcgtagc

SEQ ID NO: 23489 - DNA, 25 bp, Homo sapien
gtctgtgctgccttgggcatggaat

SEQ ID NO: 23490 - DNA, 25 bp, Homo sapien
gccttgggcatggaataaacattct

SEQ ID NO: 23491 - DNA, 25 bp, Homo sapien
ctcacaggcaccgagttcatgcaag

SEQ ID NO: 23492 - DNA, 25 bp, Homo sapien
ggcaccgagttcatgcaagacccgg

SEQ ID NO: 23493 - DNA, 25 bp, Homo sapien
gcaagacccggatgaggagcacctg

SEQ ID NO: 23494 - DNA, 25 bp, Homo sapien
gacccggatgaggagcacctgaaga

SEQ ID NO: 23495 - DNA, 25 bp, Homo sapien
atagagtaacaagtggcagggccag

SEQ ID NO: 23496 - DNA, 25 bp, Homo sapien
cagaaccagggtccccaaagtcctg

SEQ ID NO: 23497 - DNA, 25 bp, Homo sapien
aaagtcctggtgttggcacatttgt

SEQ ID NO: 23498 - DNA, 25 bp, Homo sapien
gtgttggcacatttgtacttcttgt

SEQ ID NO: 23499 - DNA, 25 bp, Homo sapien
gtacttcttgtaagaccatctttaa

SEQ ID NO: 23500 - DNA, 25 bp, Homo sapien
tgggaacacacctgccttttgtgta

SEQ ID NO: 23501 - DNA, 25 bp, Homo sapien
ggggaagactaatgcatggtgacac

SEQ ID NO: 23502 - DNA, 25 bp, Homo sapien
tgcatggtgacacctagttttcctc

SEQ ID NO: 23503 - DNA, 25 bp, Homo sapien
ttcctcaacaggacacttgatccca

SEQ ID NO: 23504 - DNA, 25 bp, Homo sapien
taagaccttaggtttcctcagcgga

SEQ ID NO: 23505 - DNA, 25 bp, Homo sapien
taagacatattggggctgggcgcag

SEQ ID NO: 23506 - DNA, 25 bp, Homo sapien
ctcacactacagccctggtggggga

SEQ ID NO: 23507 - DNA, 25 bp, Homo sapien
aagcggtggattctggcaaatggtc

SEQ ID NO: 23508 - DNA, 25 bp, Homo sapien
tctggcaaatggtccttgtgccctc

SEQ ID NO: 23509 - DNA, 25 bp, Homo sapien
agcaccaccccaacagactggggac

SEQ ID NO: 23510 - DNA, 25 bp, Homo sapien
caccccaacagactggggaccagcc

SEQ ID NO: 23511 - DNA, 25 bp, Homo sapien
gggagggaagaggaggagaggggag

SEQ ID NO: 23512 - DNA, 25 bp, Homo sapien
gaggaggagaggggaggggacctgc

SEQ ID NO: 23513 - DNA, 25 bp, Homo sapien
cctcctcaggcatctgggagggccc

SEQ ID NO: 23514 - DNA, 25 bp, Homo sapien
ctagctcccttggccaggagcgagc

SEQ ID NO: 23515 - DNA, 25 bp, Homo sapien
caggagcgagcgaagctgtggcctt

SEQ ID NO: 23516 - DNA, 25 bp, Homo sapien
aagctgtggccttggtgaagctgcc

SEQ ID NO: 23517 - DNA, 25 bp, Homo sapien
ggcacgaggccaagatggtggcgct

SEQ ID NO: 23518 - DNA, 25 bp, Homo sapien
aggccaagatggtggcgctgggctc

SEQ ID NO: 23519 - DNA, 25 bp, Homo sapien
gctggcgacgaacgccgggatttcg

SEQ ID NO: 23520 - DNA, 25 bp, Homo sapien
gcgacgaacgccgggatttcggcgg

SEQ ID NO: 23521 - DNA, 25 bp, Homo sapien
ctgggctcggggtgactacaggaga

SEQ ID NO: 23522 - DNA, 25 bp, Homo sapien
gcctcgttttccggataaggaagcg

SEQ ID NO: 23523 - DNA, 25 bp, Homo sapien
cggataaggaagcgcgggtcccgca

SEQ ID NO: 23524 - DNA, 25 bp, Homo sapien
taaggaagcgcgggtcccgcatgag

SEQ ID NO: 23525 - DNA, 25 bp, Homo sapien
ggctcggggtgactacaggagacga

SEQ ID NO: 23526 - DNA, 25 bp, Homo sapien
gggtgactacaggagacgacggggc

SEQ ID NO: 23527 - DNA, 25 bp, Homo sapien
gactacaggagacgacggggccttt

SEQ ID NO: 23528 - DNA, 25 bp, Homo sapien
ttgcatgttgaagcctgtataaaac

SEQ ID NO: 23529 - DNA, 25 bp, Homo sapien
acagtgagtgaatatacccccatcc

SEQ ID NO: 23530 - DNA, 25 bp, Homo sapien
cccatccccaagaacactttataca

SEQ ID NO: 23531 - DNA, 25 bp, Homo sapien
tatgtaatgtacacctgccctaagg

SEQ ID NO: 23532 - DNA, 25 bp, Homo sapien
gtacacctgccctaaggagaaaata

SEQ ID NO: 23533 - DNA, 25 bp, Homo sapien
tactttcccaagcatgtcttagaat

SEQ ID NO: 23534 - DNA, 25 bp, Homo sapien
gtggctttatcactttaaatcttta

SEQ ID NO: 23535 - DNA, 25 bp, Homo sapien
gcacatcagaaaaccttgtctggac

SEQ ID NO: 23536 - DNA, 25 bp, Homo sapien
gacaaaactagttcactcactgctt

SEQ ID NO: 23537 - DNA, 25 bp, Homo sapien
acttgtcagttactgatgtctgtgg

SEQ ID NO: 23538 - DNA, 25 bp, Homo sapien
ataaaacttcacactttgtaccatt

SEQ ID NO: 23539 - DNA, 25 bp, Homo sapien
agcccacctgctggatgaggaactt

SEQ ID NO: 23540 - DNA, 25 bp, Homo sapien
gaacttgaggcaagtcaccagcccc

SEQ ID NO: 23541 - DNA, 25 bp, Homo sapien
caaggactagagttcctgacctcca

SEQ ID NO: 23542 - DNA, 25 bp, Homo sapien
gatccctgacctaatgttatcgcgg

SEQ ID NO: 23543 - DNA, 25 bp, Homo sapien
tgcatcgaagagcaccttctgtcct

SEQ ID NO: 23544 - DNA, 25 bp, Homo sapien
gagcaggaactccactatgcatctc

SEQ ID NO: 23545 - DNA, 25 bp, Homo sapien
gcatctctgcagaggctgccagtgc

SEQ ID NO: 23546 - DNA, 25 bp, Homo sapien
gccagtgcccagcagtgagggacct

SEQ ID NO: 23547 - DNA, 25 bp, Homo sapien
caagagctgactatgcctgcattgc

SEQ ID NO: 23548 - DNA, 25 bp, Homo sapien
gcattgctgagaacaaacccacctg

SEQ ID NO: 23549 - DNA, 25 bp, Homo sapien
cttcctcaacccaggcgggtggaca

SEQ ID NO: 23550 - DNA, 25 bp, Homo sapien
gagtacagacctgctgaatgcactg

SEQ ID NO: 23551 - DNA, 25 bp, Homo sapien
tgatcaaccagtaaagcccctgcat

SEQ ID NO: 23552 - DNA, 25 bp, Homo sapien
cccctgcatcgagcagtcttctgga

SEQ ID NO: 23553 - DNA, 25 bp, Homo sapien
aaggagccaaacaccttcgagttgc

SEQ ID NO: 23554 - DNA, 25 bp, Homo sapien
ggttccagtaccactctttggatgt

SEQ ID NO: 23555 - DNA, 25 bp, Homo sapien
ggatgtgattgggtttctgctggcc

SEQ ID NO: 23556 - DNA, 25 bp, Homo sapien
ctgctggcctgtgtggcaactgtga

SEQ ID NO: 23557 - DNA, 25 bp, Homo sapien
ttgtctgttttgtttctggaagttt

SEQ ID NO: 23558 - DNA, 25 bp, Homo sapien
gggttgacatcagtttattccagca

SEQ ID NO: 23559 - DNA, 25 bp, Homo sapien
agatttctttcttcctgtgacaaaa

SEQ ID NO: 23560 - DNA, 25 bp, Homo sapien
tttttcagagatttaccacccaggt

SEQ ID NO: 23561 - DNA, 25 bp, Homo sapien
tgaaccccggggggtggagcctgca

SEQ ID NO: 23562 - DNA, 25 bp, Homo sapien
aaaaagacattctgtgccttacaca

SEQ ID NO: 23563 - DNA, 25 bp, Homo sapien
gtgccttacacattaggtaccttaa

SEQ ID NO: 23564 - DNA, 25 bp, Homo sapien
aggtaccttaaattcgatgtgcttt

SEQ ID NO: 23565 - DNA, 25 bp, Homo sapien
taaattcgatgtgctttacttattt

SEQ ID NO: 23566 - DNA, 25 bp, Homo sapien
gatgtgctttacttattttttattt

SEQ ID NO: 23567 - DNA, 25 bp, Homo sapien
aattttcattcaacatatttttctt

SEQ ID NO: 23568 - DNA, 25 bp, Homo sapien
aacatatttttcttgaatacctaat

SEQ ID NO: 23569 - DNA, 25 bp, Homo sapien
aatacctaatacattcatatggtta

SEQ ID NO: 23570 - DNA, 25 bp, Homo sapien
ggagttcaagaacagcctagccaac

SEQ ID NO: 23571 - DNA, 25 bp, Homo sapien
aagaacagcctagccaacatggtga

SEQ ID NO: 23572 - DNA, 25 bp, Homo sapien
ataggccagtgatgtctcaaagagt

SEQ ID NO: 23573 - DNA, 25 bp, Homo sapien
aggccagtgatgtctcaaagagtag

SEQ ID NO: 23574 - DNA, 25 bp, Homo sapien
gccagtgatgtctcaaagagtagag

SEQ ID NO: 23575 - DNA, 25 bp, Homo sapien
gatgtctcaaagagtagaggagcgt

SEQ ID NO: 23576 - DNA, 25 bp, Homo sapien
tagaggagcgtctactggtctttca

SEQ ID NO: 23577 - DNA, 25 bp, Homo sapien
aattaacccatttattataggccag

SEQ ID NO: 23578 - DNA, 25 bp, Homo sapien
ttaacccatttattataggccagtg

SEQ ID NO: 23579 - DNA, 25 bp, Homo sapien
aacccatttattataggccagtgat

SEQ ID NO: 23580 - DNA, 25 bp, Homo sapien
atttattataggccagtgatgtctc

SEQ ID NO: 23581 - DNA, 25 bp, Homo sapien
tattataggccagtgatgtctcaaa

SEQ ID NO: 23582 - DNA, 25 bp, Homo sapien
ttataggccagtgatgtctcaaaga

SEQ ID NO: 23583 - DNA, 25 bp, Homo sapien
agcgtgtgttactaggtgatcctcc

SEQ ID NO: 23584 - DNA, 25 bp, Homo sapien
gaattgtccatgaatatcaccacat

SEQ ID NO: 23585 - DNA, 25 bp, Homo sapien
tgtgattggagcatctacttctatc

SEQ ID NO: 23586 - DNA, 25 bp, Homo sapien
tacttctatcatagtcttctcttgc

SEQ ID NO: 23587 - DNA, 25 bp, Homo sapien
gtcttctcttgcctcaggatggcag

SEQ ID NO: 23588 - DNA, 25 bp, Homo sapien
atggcagccccatcattgattatct

SEQ ID NO: 23589 - DNA, 25 bp, Homo sapien
ttatctttaaggctacttcctcttc

SEQ ID NO: 23590 - DNA, 25 bp, Homo sapien
ttcccattctcaaatacttccttga

SEQ ID NO: 23591 - DNA, 25 bp, Homo sapien
tgaaagtaagccgttgggttggagg

SEQ ID NO: 23592 - DNA, 25 bp, Homo sapien
aaaggggacagctttgatgacgcgg

SEQ ID NO: 23593 - DNA, 25 bp, Homo sapien
tactgaaatagcctctgtccacata

SEQ ID NO: 23594 - DNA, 25 bp, Homo sapien
tcgcctgtaccagctggcatatgac

SEQ ID NO: 23595 - DNA, 25 bp, Homo sapien
tgtaccagctggcatatgacaccta

SEQ ID NO: 23596 - DNA, 25 bp, Homo sapien
gctggcatatgacacctatcaggag

SEQ ID NO: 23597 - DNA, 25 bp, Homo sapien
tattccaacaccttccaacagggtg

SEQ ID NO: 23598 - DNA, 25 bp, Homo sapien
tccaacagggtgaaaacgcagcaga

SEQ ID NO: 23599 - DNA, 25 bp, Homo sapien
acgcagcagaaatctaacctagagc

SEQ ID NO: 23600 - DNA, 25 bp, Homo sapien
tgcagctcctcaggagcgtcttcgc

SEQ ID NO: 23601 - DNA, 25 bp, Homo sapien
tgggcagatcttcaatcagtcctac

SEQ ID NO: 23602 - DNA, 25 bp, Homo sapien
agatcttcaatcagtcctacagcaa

SEQ ID NO: 23603 - DNA, 25 bp, Homo sapien
ttcaatcagtcctacagcaagtttg

SEQ ID NO: 23604 - DNA, 25 bp, Homo sapien
cacaaaatcgcacaacgatgacgca

SEQ ID NO: 23605 - DNA, 25 bp, Homo sapien
actgtgagttccactgaatacattt

SEQ ID NO: 23606 - DNA, 25 bp, Homo sapien
gctctaaaaccaaagctgatttcag

SEQ ID NO: 23607 - DNA, 25 bp, Homo sapien
gaaaatgtaaatcagccctatccat

SEQ ID NO: 23608 - DNA, 25 bp, Homo sapien
gccctatccataatatagtttctct

SEQ ID NO: 23609 - DNA, 25 bp, Homo sapien
gtaactgctatcttaatgttctgaa

SEQ ID NO: 23610 - DNA, 25 bp, Homo sapien
aatgccaattccagtccaaagtttt

SEQ ID NO: 23611 - DNA, 25 bp, Homo sapien
tatttgccaagttttcttagaatga

SEQ ID NO: 23612 - DNA, 25 bp, Homo sapien
gaaagatttttccctagagtggcct

SEQ ID NO: 23613 - DNA, 25 bp, Homo sapien
tccctagagtggccttattgactgc

SEQ ID NO: 23614 - DNA, 25 bp, Homo sapien
gtggccttattgactgctggtgtga

SEQ ID NO: 23615 - DNA, 25 bp, Homo sapien
gactgctggtgtgatgccactgtaa

SEQ ID NO: 23616 - DNA, 25 bp, Homo sapien
cactgcagaatgaaggaacatccct

SEQ ID NO: 23617 - DNA, 25 bp, Homo sapien
aaggaacatcccttgaggtgaccca

SEQ ID NO: 23618 - DNA, 25 bp, Homo sapien
cccagccaacctgtggccagaagga

SEQ ID NO: 23619 - DNA, 25 bp, Homo sapien
gtaccttgaaaagacactgaaagca

SEQ ID NO: 23620 - DNA, 25 bp, Homo sapien
gtaagggtgggcagaggaggtagaa

SEQ ID NO: 23621 - DNA, 25 bp, Homo sapien
atcaattcaattgtcgcatcattca

SEQ ID NO: 23622 - DNA, 25 bp, Homo sapien
aattgtcgcatcattcatggttctt

SEQ ID NO: 23623 - DNA, 25 bp, Homo sapien
gtcgcatcattcatggttctttaat

SEQ ID NO: 23624 - DNA, 25 bp, Homo sapien
ggttctttaatattgatgctcagtg

SEQ ID NO: 23625 - DNA, 25 bp, Homo sapien
ccttggtcactggtgtttcaaacat

SEQ ID NO: 23626 - DNA, 25 bp, Homo sapien
ttaagaaagcataaccagcaataaa

SEQ ID NO: 23627 - DNA, 25 bp, Homo sapien
gaaccaacctaaatatccaacaaca

SEQ ID NO: 23628 - DNA, 25 bp, Homo sapien
accaacctaaatatccaacaacaat

SEQ ID NO: 23629 - DNA, 25 bp, Homo sapien
aaatatccaacaacaataggctaga

SEQ ID NO: 23630 - DNA, 25 bp, Homo sapien
atatccaacaacaataggctagatt

SEQ ID NO: 23631 - DNA, 25 bp, Homo sapien
atccaacaacaataggctagattaa

SEQ ID NO: 23632 - DNA, 25 bp, Homo sapien
aaggatgagttcatatacttgtagg

SEQ ID NO: 23633 - DNA, 25 bp, Homo sapien
ttggacacagggtggggaacattac

SEQ ID NO: 23634 - DNA, 25 bp, Homo sapien
ggacacagggtggggaacattacac

SEQ ID NO: 23635 - DNA, 25 bp, Homo sapien
cacagggtggggaacattacacact

SEQ ID NO: 23636 - DNA, 25 bp, Homo sapien
cagggtggggaacattacacactgg

SEQ ID NO: 23637 - DNA, 25 bp, Homo sapien
gggtggggaacattacacactgggg

SEQ ID NO: 23638 - DNA, 25 bp, Homo sapien
gtgcgtgatggtggacagccgccac

SEQ ID NO: 23639 - DNA, 25 bp, Homo sapien
gcacttggtctttgctgacagcttg

SEQ ID NO: 23640 - DNA, 25 bp, Homo sapien
gctgagctgcagttttacctagtgg

SEQ ID NO: 23641 - DNA, 25 bp, Homo sapien
tagtggtggccttggccttgatctc

SEQ ID NO: 23642 - DNA, 25 bp, Homo sapien
tgtcaagtctggacctgtggttccc

SEQ ID NO: 23643 - DNA, 25 bp, Homo sapien
tcaggggactttgccttattcctac

SEQ ID NO: 23644 - DNA, 25 bp, Homo sapien
gtgattcatctggggccttatttcc

SEQ ID NO: 23645 - DNA, 25 bp, Homo sapien
tgtaattccagcgagtcgacttccc

SEQ ID NO: 23646 - DNA, 25 bp, Homo sapien
tcccatcctgagttggtgagtttca

SEQ ID NO: 23647 - DNA, 25 bp, Homo sapien
gtgagtttcatttatgtctattctt

SEQ ID NO: 23648 - DNA, 25 bp, Homo sapien
tcattacccacccaattttctgtat

SEQ ID NO: 23649 - DNA, 25 bp, Homo sapien
caggattggccaagtccatcggggt

SEQ ID NO: 23650 - DNA, 25 bp, Homo sapien
caacttcaaccacaggctgctggag

SEQ ID NO: 23651 - DNA, 25 bp, Homo sapien
gatgatcctcaacaagccagggctc

SEQ ID NO: 23652 - DNA, 25 bp, Homo sapien
tcaagtacaagcctgtctgcaacca

SEQ ID NO: 23653 - DNA, 25 bp, Homo sapien
gtggaatgtcatccttacttcaacc

SEQ ID NO: 23654 - DNA, 25 bp, Homo sapien
tctggttgcctatagtgctctggga

SEQ ID NO: 23655 - DNA, 25 bp, Homo sapien
ctaccagctgcagcgtggggttgtg

SEQ ID NO: 23656 - DNA, 25 bp, Homo sapien
tgtggtcctggccaagagctacaat

SEQ ID NO: 23657 - DNA, 25 bp, Homo sapien
tgacccttgatatttttgctggccc

SEQ ID NO: 23658 - DNA, 25 bp, Homo sapien
cccccctaattatccattttctgat

SEQ ID NO: 23659 - DNA, 25 bp, Homo sapien
gagggtgttgcacgacatctagcag

SEQ ID NO: 23660 - DNA, 25 bp, Homo sapien
tcctctagacccccagagtgtagaa

SEQ ID NO: 23661 - DNA, 25 bp, Homo sapien
tgtgatacacttttgtccttttctc

SEQ ID NO: 23662 - DNA, 25 bp, Homo sapien
ccttttctctgaggatgtgctgcct

SEQ ID NO: 23663 - DNA, 25 bp, Homo sapien
gtgctgcctagtgtcgtggaatctg

SEQ ID NO: 23664 - DNA, 25 bp, Homo sapien
gcatccaattttgtgaccagttctt

SEQ ID NO: 23665 - DNA, 25 bp, Homo sapien
cccacctcttctaacaagatctgaa

SEQ ID NO: 23666 - DNA, 25 bp, Homo sapien
aagcagccagtgcctaacttgtagc

SEQ ID NO: 23667 - DNA, 25 bp, Homo sapien
cagtgcctaacttgtagctccactt

SEQ ID NO: 23668 - DNA, 25 bp, Homo sapien
actgtatatatacctctcgtgagca

SEQ ID NO: 23669 - DNA, 25 bp, Homo sapien
gtcattgctaacagggccacatatg

SEQ ID NO: 23670 - DNA, 25 bp, Homo sapien
gccacatatggactcttactctttc

SEQ ID NO: 23671 - DNA, 25 bp, Homo sapien
ttctctgtccagcagtcatgaaccc

SEQ ID NO: 23672 - DNA, 25 bp, Homo sapien
caattcccagggtgtccctaatttg

SEQ ID NO: 23673 - DNA, 25 bp, Homo sapien
tgatcatttagtttggtgggggtgg

SEQ ID NO: 23674 - DNA, 25 bp, Homo sapien
gcccctcccacatacacaggaggag

SEQ ID NO: 23675 - DNA, 25 bp, Homo sapien
gtgtccctaatttgagaagtaacct

SEQ ID NO: 23676 - DNA, 25 bp, Homo sapien
ggagtatttcatttctccttaatga

SEQ ID NO: 23677 - DNA, 25 bp, Homo sapien
ttaatgaaggctctggccctaaccc

SEQ ID NO: 23678 - DNA, 25 bp, Homo sapien
cctcagcactgtctccagataggaa

SEQ ID NO: 23679 - DNA, 25 bp, Homo sapien
aagcagttaattaggcagcctggag

SEQ ID NO: 23680 - DNA, 25 bp, Homo sapien
gagaaaaccagagatccagtacaga

SEQ ID NO: 23681 - DNA, 25 bp, Homo sapien
atgatatttcattctctgtccagca

SEQ ID NO: 23682 - DNA, 25 bp, Homo sapien
caaggggtttctgtttctattctct

SEQ ID NO: 23683 - DNA, 25 bp, Homo sapien
ggaccttccagatcctggtgatgct

SEQ ID NO: 23684 - DNA, 25 bp, Homo sapien
tgactccccagcgtggagacgtcta

SEQ ID NO: 23685 - DNA, 25 bp, Homo sapien
agaaccccatcatcgtggagtggcg

SEQ ID NO: 23686 - DNA, 25 bp, Homo sapien
tggcgggctcagtctgaatctgccc

SEQ ID NO: 23687 - DNA, 25 bp, Homo sapien
gagtggcattggaggcttcgtgctg

SEQ ID NO: 23688 - DNA, 25 bp, Homo sapien
ctgggccttattatccatcacagga

SEQ ID NO: 23689 - DNA, 25 bp, Homo sapien
tcagaaagggctcctgcactgactc

SEQ ID NO: 23690 - DNA, 25 bp, Homo sapien
gttatcacttttctgtaacgcctgc

SEQ ID NO: 23691 - DNA, 25 bp, Homo sapien
cagagtcctacagtggctgtcacgc

SEQ ID NO: 23692 - DNA, 25 bp, Homo sapien
ccacctcgaggctgatggctgtgac

SEQ ID NO: 23693 - DNA, 25 bp, Homo sapien
agatgcacaagcgttttacaccagt

SEQ ID NO: 23694 - DNA, 25 bp, Homo sapien
gattaactcaactaaaacccactgt

SEQ ID NO: 23695 - DNA, 25 bp, Homo sapien
gttagcttccccagacagctaatgc

SEQ ID NO: 23696 - DNA, 25 bp, Homo sapien
gctaatgccgagatcttctaccagc

SEQ ID NO: 23697 - DNA, 25 bp, Homo sapien
gagttgacagaagcaggccagcgag

SEQ ID NO: 23698 - DNA, 25 bp, Homo sapien
gtgtgggacataatagcctgagtgc

SEQ ID NO: 23699 - DNA, 25 bp, Homo sapien
gcctgagtgcttgggttaccatgga

SEQ ID NO: 23700 - DNA, 25 bp, Homo sapien
gccacagcctgtgctaaagagccat

SEQ ID NO: 23701 - DNA, 25 bp, Homo sapien
gagcaagggttgcctttgtcctatc

SEQ ID NO: 23702 - DNA, 25 bp, Homo sapien
tcctatccctgagcttgctcaacaa

SEQ ID NO: 23703 - DNA, 25 bp, Homo sapien
aaacgatcctatgcattgtctttct

SEQ ID NO: 23704 - DNA, 25 bp, Homo sapien
cacagcctccaagtcaggtggggtg

SEQ ID NO: 23705 - DNA, 25 bp, Homo sapien
gtcccagagctgcacagggtttggc

SEQ ID NO: 23706 - DNA, 25 bp, Homo sapien
tggagtgagacccaggagccggaca

SEQ ID NO: 23707 - DNA, 25 bp, Homo sapien
gagccggacacttctcaggaaatgg

SEQ ID NO: 23708 - DNA, 25 bp, Homo sapien
ttcttcctgttctgtgactgtgtat

SEQ ID NO: 23709 - DNA, 25 bp, Homo sapien
ccaccacagcttatggcatctcatt

SEQ ID NO: 23710 - DNA, 25 bp, Homo sapien
gtctccacgggtgaggctggggaac

SEQ ID NO: 23711 - DNA, 25 bp, Homo sapien
tccccaaccacttagtagcaacgct

SEQ ID NO: 23712 - DNA, 25 bp, Homo sapien
agcaacgctaccccaggggctaatg

SEQ ID NO: 23713 - DNA, 25 bp, Homo sapien
taatgactgcacactgggcttcttt

SEQ ID NO: 23714 - DNA, 25 bp, Homo sapien
ccctaacgagacacatttgcccaaa

SEQ ID NO: 23715 - DNA, 25 bp, Homo sapien
gattggtggataatatggtagttct

SEQ ID NO: 23716 - DNA, 25 bp, Homo sapien
atgttttgaggaccctccatactgt

SEQ ID NO: 23717 - DNA, 25 bp, Homo sapien
ttttccgtaatggctataataattt

SEQ ID NO: 23718 - DNA, 25 bp, Homo sapien
gctataataatttacattgccacca

SEQ ID NO: 23719 - DNA, 25 bp, Homo sapien
cttcccttttgtcttcttgataata

SEQ ID NO: 23720 - DNA, 25 bp, Homo sapien
cccttttgtcttcttgataatagtc

SEQ ID NO: 23721 - DNA, 25 bp, Homo sapien
gataatagtcattctaacgggtatg

SEQ ID NO: 23722 - DNA, 25 bp, Homo sapien
cattctaacgggtatgattacagta

SEQ ID NO: 23723 - DNA, 25 bp, Homo sapien
cattgggtattttgaatgtttttct

SEQ ID NO: 23724 - DNA, 25 bp, Homo sapien
ttctcaccttatcctagaacttgag

SEQ ID NO: 23725 - DNA, 25 bp, Homo sapien
ttatcctagaacttgaggctgggcg

SEQ ID NO: 23726 - DNA, 25 bp, Homo sapien
cacctcctccaggaaagccacaagg

SEQ ID NO: 23727 - DNA, 25 bp, Homo sapien
ccgatctcctccaggaaaaccacaa

SEQ ID NO: 23728 - DNA, 25 bp, Homo sapien
cacccccacaaggaggaaagccaca

SEQ ID NO: 23729 - DNA, 25 bp, Homo sapien
cccacctccaggaaagccacaagga

SEQ ID NO: 23730 - DNA, 25 bp, Homo sapien
ccacccgcacaaggaggcagcaagt

SEQ ID NO: 23731 - DNA, 25 bp, Homo sapien
gaggcagcaagtcccaaagtgcccg

SEQ ID NO: 23732 - DNA, 25 bp, Homo sapien
ggaccaccccaacaagaaggcaaca

SEQ ID NO: 23733 - DNA, 25 bp, Homo sapien
gaaggcaacaatcctcaaggtcccc

SEQ ID NO: 23734 - DNA, 25 bp, Homo sapien
ccccacctccagcaggaggcaatcc

SEQ ID NO: 23735 - DNA, 25 bp, Homo sapien
tcctcaagggggcagaccttccaga

SEQ ID NO: 23736 - DNA, 25 bp, Homo sapien
cctccccagtcatctaggattcaat

SEQ ID NO: 23737 - DNA, 25 bp, Homo sapien
tggagtgtgttcctgaagagcagcc

SEQ ID NO: 23738 - DNA, 25 bp, Homo sapien
gaggcaggcataggcagggaaccga

SEQ ID NO: 23739 - DNA, 25 bp, Homo sapien
gggaaccgagcagcaggtcagagca

SEQ ID NO: 23740 - DNA, 25 bp, Homo sapien
aggcgagctgacattctgcagcctg

SEQ ID NO: 23741 - DNA, 25 bp, Homo sapien
gcctggacggccatggcaggaagct

SEQ ID NO: 23742 - DNA, 25 bp, Homo sapien
aagcctcctagggttctgagcagaa

SEQ ID NO: 23743 - DNA, 25 bp, Homo sapien
ggggcatgagctgattcacattctg

SEQ ID NO: 23744 - DNA, 25 bp, Homo sapien
acattctgaaggacctctctagctg

SEQ ID NO: 23745 - DNA, 25 bp, Homo sapien
aaagcagagagaccagtgcagggct

SEQ ID NO: 23746 - DNA, 25 bp, Homo sapien
gttgcaggcgagagactggggtgct

SEQ ID NO: 23747 - DNA, 25 bp, Homo sapien
tctcccaagagacaaaggccattgc

SEQ ID NO: 23748 - DNA, 25 bp, Homo sapien
tgattgtcatcgttacagccggcga

SEQ ID NO: 23749 - DNA, 25 bp, Homo sapien
gcaggtcacggtctagatcacattc

SEQ ID NO: 23750 - DNA, 25 bp, Homo sapien
agaggaaggcgatactctcgctcac

SEQ ID NO: 23751 - DNA, 25 bp, Homo sapien
ctctcgctcacgcagcaggagcagg

SEQ ID NO: 23752 - DNA, 25 bp, Homo sapien
agcatctcctcgacgatcaagatct

SEQ ID NO: 23753 - DNA, 25 bp, Homo sapien
gatcaagatctatctctcttcgtag

SEQ ID NO: 23754 - DNA, 25 bp, Homo sapien
ggatcgaggtatttccaatccccgt

SEQ ID NO: 23755 - DNA, 25 bp, Homo sapien
caatccccgtcgaggtcaagatcaa

SEQ ID NO: 23756 - DNA, 25 bp, Homo sapien
cgaccaagaagcagtcgttccccat

SEQ ID NO: 23757 - DNA, 25 bp, Homo sapien
tccccatcaggaagtcctcgcagaa

SEQ ID NO: 23758 - DNA, 25 bp, Homo sapien
ggactgaagctctcaagttcaccct

SEQ ID NO: 23759 - DNA, 25 bp, Homo sapien
aagacagcaggctttcacagaatta

SEQ ID NO: 23760 - DNA, 25 bp, Homo sapien
tcagggtggtgacttcacacgccat

SEQ ID NO: 23761 - DNA, 25 bp, Homo sapien
ggcactggtggcaagtccatctatg

SEQ ID NO: 23762 - DNA, 25 bp, Homo sapien
taaagcatacgggtcctggcatctt

SEQ ID NO: 23763 - DNA, 25 bp, Homo sapien
cctggcatcttgtccatggcaaatg

SEQ ID NO: 23764 - DNA, 25 bp, Homo sapien
ggacccaacacaaatggttcccagt

SEQ ID NO: 23765 - DNA, 25 bp, Homo sapien
gtttttcatctgcactgccaagact

SEQ ID NO: 23766 - DNA, 25 bp, Homo sapien
ggagcgctttgggtccaggaatggc

SEQ ID NO: 23767 - DNA, 25 bp, Homo sapien
agatcaccattgctgactgtggaca

SEQ ID NO: 23768 - DNA, 25 bp, Homo sapien
tcttaaccaccagatcattccttct

SEQ ID NO: 23769 - DNA, 25 bp, Homo sapien
atcctagaatctttgtgctctcgct

SEQ ID NO: 23770 - DNA, 25 bp, Homo sapien
cgacggtaacttcacagccggactc

SEQ ID NO: 23771 - DNA, 25 bp, Homo sapien
gaaaacagaaacccgagaaagagag

SEQ ID NO: 23772 - DNA, 25 bp, Homo sapien
gaaacccgagaaagagagagacaga

SEQ ID NO: 23773 - DNA, 25 bp, Homo sapien
gagagagaaaaaaaatcacccacca

SEQ ID NO: 23774 - DNA, 25 bp, Homo sapien
aaagaaaatctatctatatacagat

SEQ ID NO: 23775 - DNA, 25 bp, Homo sapien
agatatatatatatgacgcgtcaca

SEQ ID NO: 23776 - DNA, 25 bp, Homo sapien
tttttgtaggacacaaggaatccga

SEQ ID NO: 23777 - DNA, 25 bp, Homo sapien
cttaaatgatttctgtctgctctga

SEQ ID NO: 23778 - DNA, 25 bp, Homo sapien
taaatgatttctgtctgctctgaac

SEQ ID NO: 23779 - DNA, 25 bp, Homo sapien
aaatgatttctgtctgctctgaacg

SEQ ID NO: 23780 - DNA, 25 bp, Homo sapien
tgatttctgtctgctctgaacggaa

SEQ ID NO: 23781 - DNA, 25 bp, Homo sapien
gaccacactcagcagtggcttcttc

SEQ ID NO: 23782 - DNA, 25 bp, Homo sapien
ggcttcttcgttgctgtaattgaac

SEQ ID NO: 23783 - DNA, 25 bp, Homo sapien
tgaacgggtcgaggtgccaagctca

SEQ ID NO: 23784 - DNA, 25 bp, Homo sapien
cagcctcacaggccaaagcatcagc

SEQ ID NO: 23785 - DNA, 25 bp, Homo sapien
caaagcatcagcaccagaacgcaca

SEQ ID NO: 23786 - DNA, 25 bp, Homo sapien
cagcccagccccaaagagaaagaag

SEQ ID NO: 23787 - DNA, 25 bp, Homo sapien
aagagacagcaaagagccgcagccg

SEQ ID NO: 23788 - DNA, 25 bp, Homo sapien
ttgcacatagcagaggctccgggct

SEQ ID NO: 23789 - DNA, 25 bp, Homo sapien
ggaaaggaagatgcctgtcctctcc

SEQ ID NO: 23790 - DNA, 25 bp, Homo sapien
gtgctccctctgccaggaggagaat

SEQ ID NO: 23791 - DNA, 25 bp, Homo sapien
gacgtggtgcgagatgcgctgcagc

SEQ ID NO: 23792 - DNA, 25 bp, Homo sapien
gatctatttatacaaacacttcaca

SEQ ID NO: 23793 - DNA, 25 bp, Homo sapien
aacacttcacatttacagataagtt

SEQ ID NO: 23794 - DNA, 25 bp, Homo sapien
gtttcagcagaaatgtatcttgaca

SEQ ID NO: 23795 - DNA, 25 bp, Homo sapien
taatttgaggcttcaatttcatttt

SEQ ID NO: 23796 - DNA, 25 bp, Homo sapien
gagccagtgactgaaacaccctggt

SEQ ID NO: 23797 - DNA, 25 bp, Homo sapien
acaccctggtggaaacctgttgaca

SEQ ID NO: 23798 - DNA, 25 bp, Homo sapien
aaacctgttgacagaccttccactt

SEQ ID NO: 23799 - DNA, 25 bp, Homo sapien
ttccactttctcttcagaataagta

SEQ ID NO: 23800 - DNA, 25 bp, Homo sapien
gtagctgtggtggatattattattt

SEQ ID NO: 23801 - DNA, 25 bp, Homo sapien
aacagtcaactcacacaaagaatgg

SEQ ID NO: 23802 - DNA, 25 bp, Homo sapien
gaatttttcttctgccgtcaataaa

SEQ ID NO: 23803 - DNA, 25 bp, Homo sapien
agctgatcagatgtttattttactt

SEQ ID NO: 23804 - DNA, 25 bp, Homo sapien
tctaggatcaacatcttttgctttg

SEQ ID NO: 23805 - DNA, 25 bp, Homo sapien
tgaaaaatcaacatctcttggcttt

SEQ ID NO: 23806 - DNA, 25 bp, Homo sapien
tcagccaacccagcaaacagagatt

SEQ ID NO: 23807 - DNA, 25 bp, Homo sapien
gagattatcagactctgttgatttt

SEQ ID NO: 23808 - DNA, 25 bp, Homo sapien
ttttactttcatttggcattggcct

SEQ ID NO: 23809 - DNA, 25 bp, Homo sapien
gcattggcctttttcttactgaaat

SEQ ID NO: 23810 - DNA, 25 bp, Homo sapien
tttctgtctctgacctttgcaggtc

SEQ ID NO: 23811 - DNA, 25 bp, Homo sapien
acctttgcaggtctattttcttaat

SEQ ID NO: 23812 - DNA, 25 bp, Homo sapien
gatactatatatctgaaactttttt

SEQ ID NO: 23813 - DNA, 25 bp, Homo sapien
atgtgtcaactttttaatggataga

SEQ ID NO: 23814 - DNA, 25 bp, Homo sapien
tagacaaggtctccaggctggtcaa

SEQ ID NO: 23815 - DNA, 25 bp, Homo sapien
ctgtccccagctttctaatctggtc

SEQ ID NO: 23816 - DNA, 25 bp, Homo sapien
tttctaatctggtctttctcttgcc

SEQ ID NO: 23817 - DNA, 25 bp, Homo sapien
tctcttgccccagaacctcaagaag

SEQ ID NO: 23818 - DNA, 25 bp, Homo sapien
caagaaggcatgaagccagcccctg

SEQ ID NO: 23819 - DNA, 25 bp, Homo sapien
aggccccaacagccttcaaagatgg

SEQ ID NO: 23820 - DNA, 25 bp, Homo sapien
atgggtaaaggagcttgccctccct

SEQ ID NO: 23821 - DNA, 25 bp, Homo sapien
cacccctcctagtggggactagtga

SEQ ID NO: 23822 - DNA, 25 bp, Homo sapien
agtgaatgacttgacctgtgacctc

SEQ ID NO: 23823 - DNA, 25 bp, Homo sapien
gacttgacctgtgacctcaatacaa

SEQ ID NO: 23824 - DNA, 25 bp, Homo sapien
atacaataaatgtgatcccccaccc

SEQ ID NO: 23825 - DNA, 25 bp, Homo sapien
gttactactggagctggatccggca

SEQ ID NO: 23826 - DNA, 25 bp, Homo sapien
gcagcccccagggaagggactggag

SEQ ID NO: 23827 - DNA, 25 bp, Homo sapien
agtgggagcaccaactataacccct

SEQ ID NO: 23828 - DNA, 25 bp, Homo sapien
aagagtcgagtcaccatatcagtag

SEQ ID NO: 23829 - DNA, 25 bp, Homo sapien
agacacgtccaagaaccagttctcc

SEQ ID NO: 23830 - DNA, 25 bp, Homo sapien
ccctgaagctgagctctgtgaccgc

SEQ ID NO: 23831 - DNA, 25 bp, Homo sapien
gacacggccgtgtattactgtgcga

SEQ ID NO: 23832 - DNA, 25 bp, Homo sapien
gtgcgagaacgatttcggggggtcg

SEQ ID NO: 23833 - DNA, 25 bp, Homo sapien
ggactggtgaagccttcggagaccc

SEQ ID NO: 23834 - DNA, 25 bp, Homo sapien
ctcacctgcagtgtctctggtggct

SEQ ID NO: 23835 - DNA, 25 bp, Homo sapien
tggtggctccatcagtagttactac

SEQ ID NO: 23836 - DNA, 25 bp, Homo sapien
caccacccacctatgatactgtgct

SEQ ID NO: 23837 - DNA, 25 bp, Homo sapien
aacactcagattattcccagttgct

SEQ ID NO: 23838 - DNA, 25 bp, Homo sapien
aagctatgttcttcatcatgaccca

SEQ ID NO: 23839 - DNA, 25 bp, Homo sapien
ggacagagcctgagaagttcctccc

SEQ ID NO: 23840 - DNA, 25 bp, Homo sapien
atccttacatatacacaccctttgg

SEQ ID NO: 23841 - DNA, 25 bp, Homo sapien
ggcatgaggtttgctctcgtgaaca

SEQ ID NO: 23842 - DNA, 25 bp, Homo sapien
agtcagagtccttcagaacttctcc

SEQ ID NO: 23843 - DNA, 25 bp, Homo sapien
acagatccccctgaaattacgcttt

SEQ ID NO: 23844 - DNA, 25 bp, Homo sapien
tacgctttggaggacttcttctaac

SEQ ID NO: 23845 - DNA, 25 bp, Homo sapien
gtagatatggagcccattcacatgg

SEQ ID NO: 23846 - DNA, 25 bp, Homo sapien
tgggaactactttgtcctaccatca

SEQ ID NO: 23847 - DNA, 25 bp, Homo sapien
agacactgtgtgggtagggcactga

SEQ ID NO: 23848 - DNA, 25 bp, Homo sapien
gctgctgcagtttcacagggaaggc

SEQ ID NO: 23849 - DNA, 25 bp, Homo sapien
gcagtttcacagggaaggctgcacc

SEQ ID NO: 23850 - DNA, 25 bp, Homo sapien
aaggctgcacctatcaatcaatcaa

SEQ ID NO: 23851 - DNA, 25 bp, Homo sapien
ccaagacacagttccctgagggaag

SEQ ID NO: 23852 - DNA, 25 bp, Homo sapien
gaggagggacctggaaaggcctaag

SEQ ID NO: 23853 - DNA, 25 bp, Homo sapien
aaaggcctaagggtgtactctctgt

SEQ ID NO: 23854 - DNA, 25 bp, Homo sapien
aagggtgtactctctgtatagcccc

SEQ ID NO: 23855 - DNA, 25 bp, Homo sapien
tctctgtatagccccgctatgggaa

SEQ ID NO: 23856 - DNA, 25 bp, Homo sapien
tatagccccgctatgggaaaataaa

SEQ ID NO: 23857 - DNA, 25 bp, Homo sapien
taaagtggagtagggggcatagaaa

SEQ ID NO: 23858 - DNA, 25 bp, Homo sapien
gcactgcaactttcttcatgtgttc

SEQ ID NO: 23859 - DNA, 25 bp, Homo sapien
catctacttgtctccagatcggact

SEQ ID NO: 23860 - DNA, 25 bp, Homo sapien
ctggctcctcctttgggaagaactc

SEQ ID NO: 23861 - DNA, 25 bp, Homo sapien
caccacgacgactactacagcaggc

SEQ ID NO: 23862 - DNA, 25 bp, Homo sapien
gaaggagaaaccctagtccagacca

SEQ ID NO: 23863 - DNA, 25 bp, Homo sapien
gtccagaccactcctacaaaagaaa

SEQ ID NO: 23864 - DNA, 25 bp, Homo sapien
gaaatagggaccgcagcagggaccg

SEQ ID NO: 23865 - DNA, 25 bp, Homo sapien
ctctaggtcccgaagtcgtggcagg

SEQ ID NO: 23866 - DNA, 25 bp, Homo sapien
gaactgttcagagtcccaaatccaa

SEQ ID NO: 23867 - DNA, 25 bp, Homo sapien
tgcagtgtgaattctgccccgtgac

SEQ ID NO: 23868 - DNA, 25 bp, Homo sapien
tgccccgtgacccggtggaaaatgg

SEQ ID NO: 23869 - DNA, 25 bp, Homo sapien
gtaccccagtcgacctaaagtcagt

SEQ ID NO: 23870 - DNA, 25 bp, Homo sapien
accccagtcgacctaaagtcagtga

SEQ ID NO: 23871 - DNA, 25 bp, Homo sapien
gtcgacctaaagtcagtgattcaac

SEQ ID NO: 23872 - DNA, 25 bp, Homo sapien
gtgattcaactggaaggaaacctca

SEQ ID NO: 23873 - DNA, 25 bp, Homo sapien
ggaaggaaacctcaatgctgcctcc

SEQ ID NO: 23874 - DNA, 25 bp, Homo sapien
tggaaatactcagatcctggccgcc

SEQ ID NO: 23875 - DNA, 25 bp, Homo sapien
ctttgtaaccttctctaaacgtcag

SEQ ID NO: 23876 - DNA, 25 bp, Homo sapien
taaccttctctaaacgtcaggcctg

SEQ ID NO: 23877 - DNA, 25 bp, Homo sapien
aacgtcaggcctggacttaaaagat

SEQ ID NO: 23878 - DNA, 25 bp, Homo sapien
aacctccataagtagtccaggggcg

SEQ ID NO: 23879 - DNA, 25 bp, Homo sapien
ctccataagtagtccaggggcggtg

SEQ ID NO: 23880 - DNA, 25 bp, Homo sapien
gtccccaatcaggaatcgcggttcg

SEQ ID NO: 23881 - DNA, 25 bp, Homo sapien
cgcgttcgcaccaaaaccgtgaaga

SEQ ID NO: 23882 - DNA, 25 bp, Homo sapien
cggcccgggtcatcatagaaaagta

SEQ ID NO: 23883 - DNA, 25 bp, Homo sapien
tatccccagcaaaaagctccgcaac

SEQ ID NO: 23884 - DNA, 25 bp, Homo sapien
gatagcaggttatgtcacgcatctg

SEQ ID NO: 23885 - DNA, 25 bp, Homo sapien
gaagcgaattcagagaggcccagta

SEQ ID NO: 23886 - DNA, 25 bp, Homo sapien
gtaagaggtatctccatcaagctgc

SEQ ID NO: 23887 - DNA, 25 bp, Homo sapien
tcctgaggtctcagccttggatcag

SEQ ID NO: 23888 - DNA, 25 bp, Homo sapien
gcttttggacttcggcagtctgtcc

SEQ ID NO: 23889 - DNA, 25 bp, Homo sapien
gtcactcagcctacagttgggatga

SEQ ID NO: 23890 - DNA, 25 bp, Homo sapien
gatgaatttcaaaacgcctcgggga

SEQ ID NO: 23891 - DNA, 25 bp, Homo sapien
agaagcaaggctagctctgccttcc

SEQ ID NO: 23892 - DNA, 25 bp, Homo sapien
ttccacatgcttctcaggatgccaa

SEQ ID NO: 23893 - DNA, 25 bp, Homo sapien
atgccaagaggcctaggaacccaga

SEQ ID NO: 23894 - DNA, 25 bp, Homo sapien
ccttggaggagctgtgtatgcgggg

SEQ ID NO: 23895 - DNA, 25 bp, Homo sapien
tgtgtatgcgggggtgccaggaagg

SEQ ID NO: 23896 - DNA, 25 bp, Homo sapien
aacacatgcaggctaggccttgccc

SEQ ID NO: 23897 - DNA, 25 bp, Homo sapien
agcagccaccaaagtctggcagact

SEQ ID NO: 23898 - DNA, 25 bp, Homo sapien
aaacatgacaaagggccccgcagcc

SEQ ID NO: 23899 - DNA, 25 bp, Homo sapien
agcacgtgtggccattgtgtgcctg

SEQ ID NO: 23900 - DNA, 25 bp, Homo sapien
gagtgtgtatgatttttgcctcaga

SEQ ID NO: 23901 - DNA, 25 bp, Homo sapien
ttttgcctcagaaactatactcttc

SEQ ID NO: 23902 - DNA, 25 bp, Homo sapien
ttcctgaggaacatgcgcttgccaa

SEQ ID NO: 23903 - DNA, 25 bp, Homo sapien
tcaaggccctcgtaaagcccaagga

SEQ ID NO: 23904 - DNA, 25 bp, Homo sapien
gaggttaagcccaagatcccaaagg

SEQ ID NO: 23905 - DNA, 25 bp, Homo sapien
agatcccaaagggtgtcagccgcaa

SEQ ID NO: 23906 - DNA, 25 bp, Homo sapien
agccgcaagctcgatcgacttgcct

SEQ ID NO: 23907 - DNA, 25 bp, Homo sapien
caagcttgggaagcgtgctcgtgcc

SEQ ID NO: 23908 - DNA, 25 bp, Homo sapien
tcgtgcccgtattgccaaggggctc

SEQ ID NO: 23909 - DNA, 25 bp, Homo sapien
ccaggcccctacaaaggcttcagag

SEQ ID NO: 23910 - DNA, 25 bp, Homo sapien
aggacagaaggactggtgcgacccc

SEQ ID NO: 23911 - DNA, 25 bp, Homo sapien
gtcctcctgtgctatttgtacaaat

SEQ ID NO: 23912 - DNA, 25 bp, Homo sapien
ggcacagaaatggtggaccccaagt

SEQ ID NO: 23913 - DNA, 25 bp, Homo sapien
agatccccaagcaccaacaggaaat

SEQ ID NO: 23914 - DNA, 25 bp, Homo sapien
ggcagacgacaataagctcttcagg

SEQ ID NO: 23915 - DNA, 25 bp, Homo sapien
gggaggaattcaacgctctccctgc

SEQ ID NO: 23916 - DNA, 25 bp, Homo sapien
tataactctgggacccacctattta

SEQ ID NO: 23917 - DNA, 25 bp, Homo sapien
ttcagactctgacaatgggaccaca

SEQ ID NO: 23918 - DNA, 25 bp, Homo sapien
aatgggaccacaagaacagcaagca

SEQ ID NO: 23919 - DNA, 25 bp, Homo sapien
agcaagcaccaattctataggcatt

SEQ ID NO: 23920 - DNA, 25 bp, Homo sapien
ctataggcattacaatttcaccaaa

SEQ ID NO: 23921 - DNA, 25 bp, Homo sapien
agataaccagttcacggatgccaga

SEQ ID NO: 23922 - DNA, 25 bp, Homo sapien
attattgcggtgatggtggccctgt

SEQ ID NO: 23923 - DNA, 25 bp, Homo sapien
tcctctctgctagtgatcgtgttta

SEQ ID NO: 23924 - DNA, 25 bp, Homo sapien
tgttgttttgtatttagccagagga

SEQ ID NO: 23925 - DNA, 25 bp, Homo sapien
ggatgccaaaattagtcttctcaaa

SEQ ID NO: 23926 - DNA, 25 bp, Homo sapien
cttgtatgccacttgtcctaacatg

SEQ ID NO: 23927 - DNA, 25 bp, Homo sapien
ccacttgtcctaacatgtccttaag

SEQ ID NO: 23928 - DNA, 25 bp, Homo sapien
taaggtgtttaacctgcctctgacc

SEQ ID NO: 23929 - DNA, 25 bp, Homo sapien
tgcctctgacctggcttgcaatgca

SEQ ID NO: 23930 - DNA, 25 bp, Homo sapien
gagcttgtcatatgcaagtcctgtc

SEQ ID NO: 23931 - DNA, 25 bp, Homo sapien
caggtctgtagtctttgggtctttg

SEQ ID NO: 23932 - DNA, 25 bp, Homo sapien
agcctagacaacatactacgaccct

SEQ ID NO: 23933 - DNA, 25 bp, Homo sapien
aacatactacgaccctgtctataca

SEQ ID NO: 23934 - DNA, 25 bp, Homo sapien
gaggttgtggctgtagtgagtgatg

SEQ ID NO: 23935 - DNA, 25 bp, Homo sapien
ttaaacttcagctagacaaccaata

SEQ ID NO: 23936 - DNA, 25 bp, Homo sapien
gacaaccaatatgctgtgcttgaaa

SEQ ID NO: 23937 - DNA, 25 bp, Homo sapien
aagcagccactcacaatacaattaa

SEQ ID NO: 23938 - DNA, 25 bp, Homo sapien
gaatgggctttgctaacccttctga

SEQ ID NO: 23939 - DNA, 25 bp, Homo sapien
gctaacccttctgaggtaactagac

SEQ ID NO: 23940 - DNA, 25 bp, Homo sapien
aggtaactagactgcagctaaccac

SEQ ID NO: 23941 - DNA, 25 bp, Homo sapien
agccattcatcatctgatctctgct

SEQ ID NO: 23942 - DNA, 25 bp, Homo sapien
ggatctacagacaccgatgcagacc

SEQ ID NO: 23943 - DNA, 25 bp, Homo sapien
tgcagaccactcgatttcatgaccg

SEQ ID NO: 23944 - DNA, 25 bp, Homo sapien
cggccctattgcactatggaagtta

SEQ ID NO: 23945 - DNA, 25 bp, Homo sapien
aagtgtcacgactgctctatgcata

SEQ ID NO: 23946 - DNA, 25 bp, Homo sapien
ccctaatcagccactgctggtcaca

SEQ ID NO: 23947 - DNA, 25 bp, Homo sapien
gccccacagccatgggtatttctgt

SEQ ID NO: 23948 - DNA, 25 bp, Homo sapien
tggtctcctcgcttcattgaagcaa

SEQ ID NO: 23949 - DNA, 25 bp, Homo sapien
agcaaagcatgagccttcctagaca

SEQ ID NO: 23950 - DNA, 25 bp, Homo sapien
gagccttcctagacaagggcagctg

SEQ ID NO: 23951 - DNA, 25 bp, Homo sapien
cagtccatccatctgcactgagagg

SEQ ID NO: 23952 - DNA, 25 bp, Homo sapien
ccatctgcactgagaggctggatcc

SEQ ID NO: 23953 - DNA, 25 bp, Homo sapien
cactctggaagctctgcgcttcatc

SEQ ID NO: 23954 - DNA, 25 bp, Homo sapien
gaagctctgcgcttcatcaggaggc

SEQ ID NO: 23955 - DNA, 25 bp, Homo sapien
ctgtggcgggaggggtccttgaaga

SEQ ID NO: 23956 - DNA, 25 bp, Homo sapien
gagccagaggtttgactcactttgc

SEQ ID NO: 23957 - DNA, 25 bp, Homo sapien
agaatggcggcagcagagcatcgtc

SEQ ID NO: 23958 - DNA, 25 bp, Homo sapien
catcgtcattcttcaggattgccct

SEQ ID NO: 23959 - DNA, 25 bp, Homo sapien
tcctccaactcaacaacattctata

SEQ ID NO: 23960 - DNA, 25 bp, Homo sapien
ataactgataactccctgagcctca

SEQ ID NO: 23961 - DNA, 25 bp, Homo sapien
gtgcagactgtgttggtggcggtaa

SEQ ID NO: 23962 - DNA, 25 bp, Homo sapien
ccttccaccctcagcggatgataat

SEQ ID NO: 23963 - DNA, 25 bp, Homo sapien
aagacacctccgagtgtctgctcac

SEQ ID NO: 23964 - DNA, 25 bp, Homo sapien
gctccaccctcagcggatgataatc

SEQ ID NO: 23965 - DNA, 25 bp, Homo sapien
tgataatctcaagacacctcccaag

SEQ ID NO: 23966 - DNA, 25 bp, Homo sapien
ccccttccaccctcagtggatgata

SEQ ID NO: 23967 - DNA, 25 bp, Homo sapien
atgtgtgaaaacattccctcctttg

SEQ ID NO: 23968 - DNA, 25 bp, Homo sapien
tttaactttgaattcttgccgggcg

SEQ ID NO: 23969 - DNA, 25 bp, Homo sapien
aattctttgcttgttagtgaccttg

SEQ ID NO: 23970 - DNA, 25 bp, Homo sapien
gtgaccttgatcatggttctctttg

SEQ ID NO: 23971 - DNA, 25 bp, Homo sapien
atggttctctttgtacgatagttgg

SEQ ID NO: 23972 - DNA, 25 bp, Homo sapien
gttgggcatctgtatttccacttgt

SEQ ID NO: 23973 - DNA, 25 bp, Homo sapien
tccacttgtgtgaatttgcctttaa

SEQ ID NO: 23974 - DNA, 25 bp, Homo sapien
aatcaaacatatttatcttttcctg

SEQ ID NO: 23975 - DNA, 25 bp, Homo sapien
tcttttcctgtgtgataggtttttt

SEQ ID NO: 23976 - DNA, 25 bp, Homo sapien
ttctgtatcttttcctgttaaacac

SEQ ID NO: 23977 - DNA, 25 bp, Homo sapien
tcctgttaaacacacagacccctcc

SEQ ID NO: 23978 - DNA, 25 bp, Homo sapien
ccctccccaatctggacattgaata

SEQ ID NO: 23979 - DNA, 25 bp, Homo sapien
ggcctgcctggaatggattgggggt

SEQ ID NO: 23980 - DNA, 25 bp, Homo sapien
gaatggattgggggtgggtctttgg

SEQ ID NO: 23981 - DNA, 25 bp, Homo sapien
ggagtggtggctacagaagcttggg

SEQ ID NO: 23982 - DNA, 25 bp, Homo sapien
tacagaagcttggggccaaccctgg

SEQ ID NO: 23983 - DNA, 25 bp, Homo sapien
ccagctgaggtgtggccctcaggcc

SEQ ID NO: 23984 - DNA, 25 bp, Homo sapien
ggaggagggtgaagactgaggctag

SEQ ID NO: 23985 - DNA, 25 bp, Homo sapien
gtgaagactgaggctaggtgccaga

SEQ ID NO: 23986 - DNA, 25 bp, Homo sapien
actgaggctaggtgccagaatggac

SEQ ID NO: 23987 - DNA, 25 bp, Homo sapien
ctggctgttgtgctggaaagctggg

SEQ ID NO: 23988 - DNA, 25 bp, Homo sapien
ggaggaatctagaggcctcctagat

SEQ ID NO: 23989 - DNA, 25 bp, Homo sapien
cctcctagattaaggcctgcctgga

SEQ ID NO: 23990 - DNA, 25 bp, Homo sapien
ctctctgcttacgtatgccatgcat

SEQ ID NO: 23991 - DNA, 25 bp, Homo sapien
tacgtatgccatgcatacctcctgc

SEQ ID NO: 23992 - DNA, 25 bp, Homo sapien
ccggccagcaatagctcggacgcaa

SEQ ID NO: 23993 - DNA, 25 bp, Homo sapien
gctcggacgcaatctgtgaggacag

SEQ ID NO: 23994 - DNA, 25 bp, Homo sapien
cccacaagccccctgggggaggcag

SEQ ID NO: 23995 - DNA, 25 bp, Homo sapien
cccccatccaagaggagcaggccga

SEQ ID NO: 23996 - DNA, 25 bp, Homo sapien
tgacctgggcccaccaaggtggacg

SEQ ID NO: 23997 - DNA, 25 bp, Homo sapien
gcccaccaaggtggacgctgggccc

SEQ ID NO: 23998 - DNA, 25 bp, Homo sapien
gtctgctgggcgagcagggcaggtg

SEQ ID NO: 23999 - DNA, 25 bp, Homo sapien
gccaactctgcaccgttctaggtgc

SEQ ID NO: 24000 - DNA, 25 bp, Homo sapien
caccgttctaggtgccgatggctgc

SEQ ID NO: 24001 - DNA, 25 bp, Homo sapien
aacactcagcttttcgcaacataat

SEQ ID NO: 24002 - DNA, 25 bp, Homo sapien
cactcagcttttcgcaacataatcc

SEQ ID NO: 24003 - DNA, 25 bp, Homo sapien
cagcttttcgcaacataatcccagc

SEQ ID NO: 24004 - DNA, 25 bp, Homo sapien
gcttttcgcaacataatcccagcac

SEQ ID NO: 24005 - DNA, 25 bp, Homo sapien
cttttcgcaacataatcccagcact

SEQ ID NO: 24006 - DNA, 25 bp, Homo sapien
gcactttggaacgctgggtggattg

SEQ ID NO: 24007 - DNA, 25 bp, Homo sapien
tttggaacgctgggtggattgcttg

SEQ ID NO: 24008 - DNA, 25 bp, Homo sapien
tgcaatgggccatgatcacgatcct

SEQ ID NO: 24009 - DNA, 25 bp, Homo sapien
caatgggccatgatcacgatcctgc

SEQ ID NO: 24010 - DNA, 25 bp, Homo sapien
aatgggccatgatcacgatcctgca

SEQ ID NO: 24011 - DNA, 25 bp, Homo sapien
aacagagagagacagtccctggccc

SEQ ID NO: 24012 - DNA, 25 bp, Homo sapien
ggaagaactgactacatatcaaggc

SEQ ID NO: 24013 - DNA, 25 bp, Homo sapien
gcaacggatgcaatttccaggctgt

SEQ ID NO: 24014 - DNA, 25 bp, Homo sapien
gctgtggacttcttccagcaggttt

SEQ ID NO: 24015 - DNA, 25 bp, Homo sapien
ctgtgagatcagtggcattttttaa

SEQ ID NO: 24016 - DNA, 25 bp, Homo sapien
gcttgccaaatcttcacagatcata

SEQ ID NO: 24017 - DNA, 25 bp, Homo sapien
aagagaacagccagcagcagcttgc

SEQ ID NO: 24018 - DNA, 25 bp, Homo sapien
aaaccgttctaatcaggtgcgatgt

SEQ ID NO: 24019 - DNA, 25 bp, Homo sapien
ggaacagataacttacatacgacaa

SEQ ID NO: 24020 - DNA, 25 bp, Homo sapien
tgatgccagcatccctaagacaaga

SEQ ID NO: 24021 - DNA, 25 bp, Homo sapien
ccatttcctccctaaaatcacaggt

SEQ ID NO: 24022 - DNA, 25 bp, Homo sapien
gcaaaagagagcttccatccttcag

SEQ ID NO: 24023 - DNA, 25 bp, Homo sapien
caggatggtggccttgtttgtccta

SEQ ID NO: 24024 - DNA, 25 bp, Homo sapien
ggtggccttgtttgtcctaaacaca

SEQ ID NO: 24025 - DNA, 25 bp, Homo sapien
tgtttgtcctaaacacacccagcac

SEQ ID NO: 24026 - DNA, 25 bp, Homo sapien
ggcttcctgacatgctgtggaggca

SEQ ID NO: 24027 - DNA, 25 bp, Homo sapien
ggccacatgtgcttgagggttttca

SEQ ID NO: 24028 - DNA, 25 bp, Homo sapien
tgtgcttgagggttttcaccctggc

SEQ ID NO: 24029 - DNA, 25 bp, Homo sapien
cgtgtcgggctttgatcacagcata

SEQ ID NO: 24030 - DNA, 25 bp, Homo sapien
gatcacagcatagccacgtcagtgg

SEQ ID NO: 24031 - DNA, 25 bp, Homo sapien
catagccacgtcagtggcgtgcgcc

SEQ ID NO: 24032 - DNA, 25 bp, Homo sapien
ttctgggtctggtggtgccaggtgc

SEQ ID NO: 24033 - DNA, 25 bp, Homo sapien
cccctcccgccatcagaggaaaggc

SEQ ID NO: 24034 - DNA, 25 bp, Homo sapien
cagagatagcaaatgccacctgacc

SEQ ID NO: 24035 - DNA, 25 bp, Homo sapien
gagatagcaaatgccacctgaccag

SEQ ID NO: 24036 - DNA, 25 bp, Homo sapien
tacttcatgagtcttagcaatatgg

SEQ ID NO: 24037 - DNA, 25 bp, Homo sapien
gagtcttagcaatatgggagcaggt

SEQ ID NO: 24038 - DNA, 25 bp, Homo sapien
agcaatatgggagcaggttttcact

SEQ ID NO: 24039 - DNA, 25 bp, Homo sapien
tgggagcaggttttcactgaattct

SEQ ID NO: 24040 - DNA, 25 bp, Homo sapien
cactgaattctgagggtgcctctgc

SEQ ID NO: 24041 - DNA, 25 bp, Homo sapien
aattctgagggtgcctctgcatgtc

SEQ ID NO: 24042 - DNA, 25 bp, Homo sapien
tgtcctccaaggcaaagtttggcaa

SEQ ID NO: 24043 - DNA, 25 bp, Homo sapien
aaggcaaagtttggcaaactgtggc

SEQ ID NO: 24044 - DNA, 25 bp, Homo sapien
ccccccactgtcatattttgttaat

SEQ ID NO: 24045 - DNA, 25 bp, Homo sapien
tggagcccgacgggacttacgagcc

SEQ ID NO: 24046 - DNA, 25 bp, Homo sapien
caacatgctgtaccccaaggaagac

SEQ ID NO: 24047 - DNA, 25 bp, Homo sapien
gctgtaccccaaggaagacaaggag

SEQ ID NO: 24048 - DNA, 25 bp, Homo sapien
caaggagaaccgcattctgctctac

SEQ ID NO: 24049 - DNA, 25 bp, Homo sapien
tgtgattaccagcaggaggccgaca

SEQ ID NO: 24050 - DNA, 25 bp, Homo sapien
ttaccagcaggaggccgacaacagc

SEQ ID NO: 24051 - DNA, 25 bp, Homo sapien
ggccgacaacagctgcatctatgtc

SEQ ID NO: 24052 - DNA, 25 bp, Homo sapien
acaacagctgcatctatgtcaacaa

SEQ ID NO: 24053 - DNA, 25 bp, Homo sapien
ggccacaaggaggctgtgttcttcc

SEQ ID NO: 24054 - DNA, 25 bp, Homo sapien
aggctgtgttcttccagtcacacag

SEQ ID NO: 24055 - DNA, 25 bp, Homo sapien
tgtgttcttccagtcacacagtgcg

SEQ ID NO: 24056 - DNA, 25 bp, Homo sapien
gagatttaatagtcacatgttatca

SEQ ID NO: 24057 - DNA, 25 bp, Homo sapien
gtcacatgttatcattaggagttgg

SEQ ID NO: 24058 - DNA, 25 bp, Homo sapien
ggagttggttactgtgtcacattca

SEQ ID NO: 24059 - DNA, 25 bp, Homo sapien
tactgtgtcacattcatgcttttag

SEQ ID NO: 24060 - DNA, 25 bp, Homo sapien
ttcatgcttttagctaaacacttta

SEQ ID NO: 24061 - DNA, 25 bp, Homo sapien
aaacactttaagattcaatattact

SEQ ID NO: 24062 - DNA, 25 bp, Homo sapien
gaagatgtcccactaaggtaagttt

SEQ ID NO: 24063 - DNA, 25 bp, Homo sapien
ggtaagtttgacatggtgtaaggga

SEQ ID NO: 24064 - DNA, 25 bp, Homo sapien
ggggtaaacgcggataaagagcaga

SEQ ID NO: 24065 - DNA, 25 bp, Homo sapien
agagcagattacttgaccctacatt

SEQ ID NO: 24066 - DNA, 25 bp, Homo sapien
ttgaccctacattttaagagaagac

SEQ ID NO: 24067 - DNA, 25 bp, Homo sapien
tggggctgagggtcacagcaggagt

SEQ ID NO: 24068 - DNA, 25 bp, Homo sapien
gagggtcacagcaggagtacacagc

SEQ ID NO: 24069 - DNA, 25 bp, Homo sapien
gtcacagcaggagtacacagcccat

SEQ ID NO: 24070 - DNA, 25 bp, Homo sapien
cagcaggagtacacagcccatgcat

SEQ ID NO: 24071 - DNA, 25 bp, Homo sapien
ctgtcaggagaggcttctacagcca

SEQ ID NO: 24072 - DNA, 25 bp, Homo sapien
gtcaggagaggcttctacagccagg

SEQ ID NO: 24073 - DNA, 25 bp, Homo sapien
cggccacggagactgggggacgaga

SEQ ID NO: 24074 - DNA, 25 bp, Homo sapien
cggagactgggggacgagaggccac

SEQ ID NO: 24075 - DNA, 25 bp, Homo sapien
actgggggacgagaggccaccagct

SEQ ID NO: 24076 - DNA, 25 bp, Homo sapien
tccttcctccagtcttggagcattt

SEQ ID NO: 24077 - DNA, 25 bp, Homo sapien
ttcctccagtcttggagcatttttt

SEQ ID NO: 24078 - DNA, 25 bp, Homo sapien
cttgtggccaactctgagtcgtgag

SEQ ID NO: 24079 - DNA, 25 bp, Homo sapien
ggaggagagcacggtgttcagccag

SEQ ID NO: 24080 - DNA, 25 bp, Homo sapien
atccactatgccaaccgcatgagct

SEQ ID NO: 24081 - DNA, 25 bp, Homo sapien
gcatggctggcagtgtggccgagag

SEQ ID NO: 24082 - DNA, 25 bp, Homo sapien
gagagcggcttcgaggatgcagaga

SEQ ID NO: 24083 - DNA, 25 bp, Homo sapien
gcttcatcaaccgctttgtggacaa

SEQ ID NO: 24084 - DNA, 25 bp, Homo sapien
ctgcacggagagtggggtcaccagc

SEQ ID NO: 24085 - DNA, 25 bp, Homo sapien
cacctcaaggggctgcatgtcatgg

SEQ ID NO: 24086 - DNA, 25 bp, Homo sapien
gccagacattgtccagatgcacatc

SEQ ID NO: 24087 - DNA, 25 bp, Homo sapien
cagatgcacatcgagaccctggagg

SEQ ID NO: 24088 - DNA, 25 bp, Homo sapien
cgtgcagcgggagagccggaggctg

SEQ ID NO: 24089 - DNA, 25 bp, Homo sapien
ttcccctaatattttccttgtgcaa

SEQ ID NO: 24090 - DNA, 25 bp, Homo sapien
ttccttgtgcaattcagacttaagc

SEQ ID NO: 24091 - DNA, 25 bp, Homo sapien
gcaattcagacttaagcatcgagtt

SEQ ID NO: 24092 - DNA, 25 bp, Homo sapien
agcatcgagtttttaccatcttcca

SEQ ID NO: 24093 - DNA, 25 bp, Homo sapien
ccatcttccactttaagctaagtta

SEQ ID NO: 24094 - DNA, 25 bp, Homo sapien
taagctaagttatgatacctattcc

SEQ ID NO: 24095 - DNA, 25 bp, Homo sapien
taaggtttgcaaatttcagccaatt

SEQ ID NO: 24096 - DNA, 25 bp, Homo sapien
aatttcagccaattttgtagctaag

SEQ ID NO: 24097 - DNA, 25 bp, Homo sapien
tgtagctaagattgttctgatcagc

SEQ ID NO: 24098 - DNA, 25 bp, Homo sapien
ggcttagtgttttcattgcaaatta

SEQ ID NO: 24099 - DNA, 25 bp, Homo sapien
ttataattgctgtagagccacacac

SEQ ID NO: 24100 - DNA, 25 bp, Homo sapien
tggctgcccaactcaggggtgcaga

SEQ ID NO: 24101 - DNA, 25 bp, Homo sapien
ggggtgcagatgtctccctgcacca

SEQ ID NO: 24102 - DNA, 25 bp, Homo sapien
agagagaggcctggactgcctgtgg

SEQ ID NO: 24103 - DNA, 25 bp, Homo sapien
ctctgtcctccaggggagcagctgg

SEQ ID NO: 24104 - DNA, 25 bp, Homo sapien
gctgggcctgaggaggaagcacccc

SEQ ID NO: 24105 - DNA, 25 bp, Homo sapien
cccatatccccctggggcagttggt

SEQ ID NO: 24106 - DNA, 25 bp, Homo sapien
agcagcagagcagactgcccgtttt

SEQ ID NO: 24107 - DNA, 25 bp, Homo sapien
cccatctcagggcctggctgaggca

SEQ ID NO: 24108 - DNA, 25 bp, Homo sapien
gtagtagtaggcggccgctctagag

SEQ ID NO: 24109 - DNA, 25 bp, Homo sapien
gatccaagcttacgtacgcgtgcat

SEQ ID NO: 24110 - DNA, 25 bp, Homo sapien
tagtatctttattatccattcccgg

SEQ ID NO: 24111 - DNA, 25 bp, Homo sapien
tcacaccgtagcccacatggatagc

SEQ ID NO: 24112 - DNA, 25 bp, Homo sapien
acaccgtagcccacatggatagcac

SEQ ID NO: 24113 - DNA, 25 bp, Homo sapien
cttcagattccgagttgcctaccgg

SEQ ID NO: 24114 - DNA, 25 bp, Homo sapien
cagattccgagttgcctaccggttg

SEQ ID NO: 24115 - DNA, 25 bp, Homo sapien
gaagacagcaataaccacagtacat

SEQ ID NO: 24116 - DNA, 25 bp, Homo sapien
agcaataaccacagtacatattact

SEQ ID NO: 24117 - DNA, 25 bp, Homo sapien
agtacatattactgtagttctctat

SEQ ID NO: 24118 - DNA, 25 bp, Homo sapien
gtagttctctatagttttacataca

SEQ ID NO: 24119 - DNA, 25 bp, Homo sapien
tctctatagttttacatacattcat

SEQ ID NO: 24120 - DNA, 25 bp, Homo sapien
attcataccataactctgttctctc

SEQ ID NO: 24121 - DNA, 25 bp, Homo sapien
ttcataccataactctgttctctcc

SEQ ID NO: 24122 - DNA, 25 bp, Homo sapien
atatttatctgagtgagtccaaggt

SEQ ID NO: 24123 - DNA, 25 bp, Homo sapien
agtccaaggtgcaactcctaaatga

SEQ ID NO: 24124 - DNA, 25 bp, Homo sapien
aattgtgttgcagagaactcccagt

SEQ ID NO: 24125 - DNA, 25 bp, Homo sapien
gaactcccagtataattcactgacc

SEQ ID NO: 24126 - DNA, 25 bp, Homo sapien
acattttataaccatccaggccttg

SEQ ID NO: 24127 - DNA, 25 bp, Homo sapien
ccaggccttggtttgcaagcaacag

SEQ ID NO: 24128 - DNA, 25 bp, Homo sapien
aattggctcgatcagtagtcatagg

SEQ ID NO: 24129 - DNA, 25 bp, Homo sapien
gaagagactcatttagagctcagag

SEQ ID NO: 24130 - DNA, 25 bp, Homo sapien
gtgctgttgcgaaattatgtgtctt

SEQ ID NO: 24131 - DNA, 25 bp, Homo sapien
ttatgtgtcttattcttaaagccat

SEQ ID NO: 24132 - DNA, 25 bp, Homo sapien
taggttttgaactctgagattgcac

SEQ ID NO: 24133 - DNA, 25 bp, Homo sapien
gcaggaccaccttgaattctgccct

SEQ ID NO: 24134 - DNA, 25 bp, Homo sapien
ctgccctgacacactggattggaga

SEQ ID NO: 24135 - DNA, 25 bp, Homo sapien
agggcctacctggagagggactgcc

SEQ ID NO: 24136 - DNA, 25 bp, Homo sapien
tgccctgcacagctgcagcagttgc

SEQ ID NO: 24137 - DNA, 25 bp, Homo sapien
tacggtgtcgggccttgaactacta

SEQ ID NO: 24138 - DNA, 25 bp, Homo sapien
tacccccagaacatcaccatgaagt

SEQ ID NO: 24139 - DNA, 25 bp, Homo sapien
gggctggataaccttggctgtaccc

SEQ ID NO: 24140 - DNA, 25 bp, Homo sapien
agcccctcattgtgatctgggagcc

SEQ ID NO: 24141 - DNA, 25 bp, Homo sapien
ggcaccctagtcattggagtcatca

SEQ ID NO: 24142 - DNA, 25 bp, Homo sapien
gaattgctgtttttgtcgtcatctt

SEQ ID NO: 24143 - DNA, 25 bp, Homo sapien
agaggagccatggggcactacgtct

SEQ ID NO: 24144 - DNA, 25 bp, Homo sapien
tctccatctgatctctaacaccagt

SEQ ID NO: 24145 - DNA, 25 bp, Homo sapien
ccatctgatctctaacaccagttaa

SEQ ID NO: 24146 - DNA, 25 bp, Homo sapien
tgatctctaacaccagttaaaacca

SEQ ID NO: 24147 - DNA, 25 bp, Homo sapien
ccagttaaaaccaagcttccatact

SEQ ID NO: 24148 - DNA, 25 bp, Homo sapien
taaaaccaagcttccatactttttg

SEQ ID NO: 24149 - DNA, 25 bp, Homo sapien
aagcttccatactttttggtctgta

SEQ ID NO: 24150 - DNA, 25 bp, Homo sapien
tttttggtctgtaaagccgcaccct

SEQ ID NO: 24151 - DNA, 25 bp, Homo sapien
gcaccctgtctcgagcttaaggata

SEQ ID NO: 24152 - DNA, 25 bp, Homo sapien
gtctcgagcttaaggatatgtgtgt

SEQ ID NO: 24153 - DNA, 25 bp, Homo sapien
gtgtatgtgcgtgtacagacacaca

SEQ ID NO: 24154 - DNA, 25 bp, Homo sapien
ataaagtggtagtttgctgcaaata

SEQ ID NO: 24155 - DNA, 25 bp, Homo sapien
gcgctactacagactctgcaacgac

SEQ ID NO: 24156 - DNA, 25 bp, Homo sapien
cccctggcactgtgaagctctaggc

SEQ ID NO: 24157 - DNA, 25 bp, Homo sapien
caccacagatgtctcccagatgggc

SEQ ID NO: 24158 - DNA, 25 bp, Homo sapien
ccagcagagctggcttctgggtcca

SEQ ID NO: 24159 - DNA, 25 bp, Homo sapien
ctcccagggcgttggagcaggcgga

SEQ ID NO: 24160 - DNA, 25 bp, Homo sapien
gcacgtggctcatggggcagaattg

SEQ ID NO: 24161 - DNA, 25 bp, Homo sapien
tgccaaggacagctcacgacagtgc

SEQ ID NO: 24162 - DNA, 25 bp, Homo sapien
ttctcaccattccagccaaggagag

SEQ ID NO: 24163 - DNA, 25 bp, Homo sapien
gatgtgacgttggaactgctctggc

SEQ ID NO: 24164 - DNA, 25 bp, Homo sapien
aattgccttgagatctctgctcttt

SEQ ID NO: 24165 - DNA, 25 bp, Homo sapien
gactcacgtttttgttgttttctca

SEQ ID NO: 24166 - DNA, 25 bp, Homo sapien
gacagctccaggatcgagatcactg

SEQ ID NO: 24167 - DNA, 25 bp, Homo sapien
gatcgagatcactgtgagtggttgt

SEQ ID NO: 24168 - DNA, 25 bp, Homo sapien
gagtggttgtggagttaagacccct

SEQ ID NO: 24169 - DNA, 25 bp, Homo sapien
gagttaagacccctatggactcctt

SEQ ID NO: 24170 - DNA, 25 bp, Homo sapien
gagaataacgttgcagttcccacag

SEQ ID NO: 24171 - DNA, 25 bp, Homo sapien
gttcccacagggcatgtgactttga

SEQ ID NO: 24172 - DNA, 25 bp, Homo sapien
ggccacactcagttaataatggggc

SEQ ID NO: 24173 - DNA, 25 bp, Homo sapien
aataatggggcacagatgtgttccc

SEQ ID NO: 24174 - DNA, 25 bp, Homo sapien
ctagagattctctgtaatattggta

SEQ ID NO: 24175 - DNA, 25 bp, Homo sapien
tcccctctactgggcaagtgcttgt

SEQ ID NO: 24176 - DNA, 25 bp, Homo sapien
tactgggcaagtgcttgtcaagttc

SEQ ID NO: 24177 - DNA, 25 bp, Homo sapien
caattctcgtggtaataccagagta

SEQ ID NO: 24178 - DNA, 25 bp, Homo sapien
aggagagggtgactttaccgaactg

SEQ ID NO: 24179 - DNA, 25 bp, Homo sapien
gggtgactttaccgaactgacagcc

SEQ ID NO: 24180 - DNA, 25 bp, Homo sapien
tgactttaccgaactgacagccatt

SEQ ID NO: 24181 - DNA, 25 bp, Homo sapien
taccgaactgacagccattggggag

SEQ ID NO: 24182 - DNA, 25 bp, Homo sapien
aactgacagccattggggaggcaga

SEQ ID NO: 24183 - DNA, 25 bp, Homo sapien
gaggcagatgcgggtgtggaggtgt

SEQ ID NO: 24184 - DNA, 25 bp, Homo sapien
gcttttctcaatgattcagggatac

SEQ ID NO: 24185 - DNA, 25 bp, Homo sapien
tcagggatacaaatgggcttctctc

SEQ ID NO: 24186 - DNA, 25 bp, Homo sapien
gatacaaatgggcttctctcattca

SEQ ID NO: 24187 - DNA, 25 bp, Homo sapien
acaaatgggcttctctcattcatta

SEQ ID NO: 24188 - DNA, 25 bp, Homo sapien
atcgttagggtgaagcattatggtc

SEQ ID NO: 24189 - DNA, 25 bp, Homo sapien
aatgcctagcagagaactgccttaa

SEQ ID NO: 24190 - DNA, 25 bp, Homo sapien
gttggccatggtgaaagggtttgat

SEQ ID NO: 24191 - DNA, 25 bp, Homo sapien
aactgcagggttacaccaaaatcta

SEQ ID NO: 24192 - DNA, 25 bp, Homo sapien
aatctagctgatttaacttgtattt

SEQ ID NO: 24193 - DNA, 25 bp, Homo sapien
gatttaacttgtattttgtcacttt

SEQ ID NO: 24194 - DNA, 25 bp, Homo sapien
gcctgaccaacatggcagaagcccc

SEQ ID NO: 24195 - DNA, 25 bp, Homo sapien
aatttagctaggcatggcggcgcat

SEQ ID NO: 24196 - DNA, 25 bp, Homo sapien
aggcatggcggcgcatgcctgcaat

SEQ ID NO: 24197 - DNA, 25 bp, Homo sapien
tggaggctgcggtgagccgagcatt

SEQ ID NO: 24198 - DNA, 25 bp, Homo sapien
tgtctttctcttccttttatataaa

SEQ ID NO: 24199 - DNA, 25 bp, Homo sapien
ctggctggaagcctggcagtgacac

SEQ ID NO: 24200 - DNA, 25 bp, Homo sapien
ggctggaagcctggcagtgacacga

SEQ ID NO: 24201 - DNA, 25 bp, Homo sapien
ctggaagcctggcagtgacacgatt

SEQ ID NO: 24202 - DNA, 25 bp, Homo sapien
ccctccaaactccacaagtatggga

SEQ ID NO: 24203 - DNA, 25 bp, Homo sapien
aaactccacaagtatgggaccctgg

SEQ ID NO: 24204 - DNA, 25 bp, Homo sapien
tgggaccctggaggggtagggcaag

SEQ ID NO: 24205 - DNA, 25 bp, Homo sapien
gtagggcaagggccttctcaatgcc

SEQ ID NO: 24206 - DNA, 25 bp, Homo sapien
tagggcaagggccttctcaatgcct

SEQ ID NO: 24207 - DNA, 25 bp, Homo sapien
gcctccacctagaagttgaattgtg

SEQ ID NO: 24208 - DNA, 25 bp, Homo sapien
caacccaggcggacaaaaggcctag

SEQ ID NO: 24209 - DNA, 25 bp, Homo sapien
gcggacaaaaggcctagaggtaaca

SEQ ID NO: 24210 - DNA, 25 bp, Homo sapien
gcattagatgggatatctcaagttt

SEQ ID NO: 24211 - DNA, 25 bp, Homo sapien
ggcaaaacatacgatgctccatcag

SEQ ID NO: 24212 - DNA, 25 bp, Homo sapien
aacatacgatgctccatcagcctta

SEQ ID NO: 24213 - DNA, 25 bp, Homo sapien
atctacgttgataaggaaattggag

SEQ ID NO: 24214 - DNA, 25 bp, Homo sapien
tcatgatccttgatgaggagggaga

SEQ ID NO: 24215 - DNA, 25 bp, Homo sapien
gaatgcaatctgtttgcagtctcct

SEQ ID NO: 24216 - DNA, 25 bp, Homo sapien
gcacccgtgtggctgccaaggatgt

SEQ ID NO: 24217 - DNA, 25 bp, Homo sapien
ctgccaaggatgtgctgaagctgga

SEQ ID NO: 24218 - DNA, 25 bp, Homo sapien
gtgctgaagctggagtctagacctt

SEQ ID NO: 24219 - DNA, 25 bp, Homo sapien
gaagctggagtctagaccttcaatc

SEQ ID NO: 24220 - DNA, 25 bp, Homo sapien
gctggagtctagaccttcaatcaaa

SEQ ID NO: 24221 - DNA, 25 bp, Homo sapien
ggcaagtgaggggtccccctattct

SEQ ID NO: 24222 - DNA, 25 bp, Homo sapien
caagtgaggggtccccctattctgg

SEQ ID NO: 24223 - DNA, 25 bp, Homo sapien
ctctacgtcaacctagctctagggc

SEQ ID NO: 24224 - DNA, 25 bp, Homo sapien
tacgtcaacctagctctagggccca

SEQ ID NO: 24225 - DNA, 25 bp, Homo sapien
caacctagctctagggcccaggggt

SEQ ID NO: 24226 - DNA, 25 bp, Homo sapien
tccccagaaacaacgggcaccctgg

SEQ ID NO: 24227 - DNA, 25 bp, Homo sapien
gccagcctacggaagggggggcgag

SEQ ID NO: 24228 - DNA, 25 bp, Homo sapien
cagcctacggaagggggggcgagct

SEQ ID NO: 24229 - DNA, 25 bp, Homo sapien
tccaccgagggtccttgtacagaaa

SEQ ID NO: 24230 - DNA, 25 bp, Homo sapien
gggtccttgtacagaaatggagggc

SEQ ID NO: 24231 - DNA, 25 bp, Homo sapien
gagggcaaagaggggagggggctgg

SEQ ID NO: 24232 - DNA, 25 bp, Homo sapien
agaaaggtggacgctgggcagctct

SEQ ID NO: 24233 - DNA, 25 bp, Homo sapien
gcagctctggggctgctggtggagg

SEQ ID NO: 24234 - DNA, 25 bp, Homo sapien
gctgctggtggagggagctgaagcc

SEQ ID NO: 24235 - DNA, 25 bp, Homo sapien
agctgaagccacatctctgtagagc

SEQ ID NO: 24236 - DNA, 25 bp, Homo sapien
gaagccacatctctgtagagcgtcc

SEQ ID NO: 24237 - DNA, 25 bp, Homo sapien
gcttgagattcaaattccatggaca

SEQ ID NO: 24238 - DNA, 25 bp, Homo sapien
aaatgtcccagtttgagtaaaatgt

SEQ ID NO: 24239 - DNA, 25 bp, Homo sapien
aaaactgggttgcttctatcagaaa

SEQ ID NO: 24240 - DNA, 25 bp, Homo sapien
aggcaggcggatcgcctgaggtcag

SEQ ID NO: 24241 - DNA, 25 bp, Homo sapien
tcgacaccagcctgaccaatatggt

SEQ ID NO: 24242 - DNA, 25 bp, Homo sapien
aaaccccgtctctattcagaataca

SEQ ID NO: 24243 - DNA, 25 bp, Homo sapien
tggtgttttccattggatacctgca

SEQ ID NO: 24244 - DNA, 25 bp, Homo sapien
gttttccattggatacctgcatgcc

SEQ ID NO: 24245 - DNA, 25 bp, Homo sapien
ggatacctgcatgccaagtgttgtg

SEQ ID NO: 24246 - DNA, 25 bp, Homo sapien
cctgcatgccaagtgttgtgctaca

SEQ ID NO: 24247 - DNA, 25 bp, Homo sapien
aagtgttgtgctacagtattactga

SEQ ID NO: 24248 - DNA, 25 bp, Homo sapien
tacttacataggtctttagcctttt

SEQ ID NO: 24249 - DNA, 25 bp, Homo sapien
aaaggatttctgtttgacagctttt

SEQ ID NO: 24250 - DNA, 25 bp, Homo sapien
tctgtttgacagcttttataattga

SEQ ID NO: 24251 - DNA, 25 bp, Homo sapien
ttatgaagtatggggccaggtgcag

SEQ ID NO: 24252 - DNA, 25 bp, Homo sapien
gttatttttcttagtcctatgttct

SEQ ID NO: 24253 - DNA, 25 bp, Homo sapien
tttttcttagtcctatgttctttat

SEQ ID NO: 24254 - DNA, 25 bp, Homo sapien
tagccaggcatagttgctcacacct

SEQ ID NO: 24255 - DNA, 25 bp, Homo sapien
aggcatagttgctcacacctgtagt

SEQ ID NO: 24256 - DNA, 25 bp, Homo sapien
ggactcacactggagaaagacccta

SEQ ID NO: 24257 - DNA, 25 bp, Homo sapien
aagaccctatgaatgtaaacactgt

SEQ ID NO: 24258 - DNA, 25 bp, Homo sapien
agtcgttccagtttctgtcgagaac

SEQ ID NO: 24259 - DNA, 25 bp, Homo sapien
tgtgggaaagccttcagttctctca

SEQ ID NO: 24260 - DNA, 25 bp, Homo sapien
ttcagttctctcagttcctttaata

SEQ ID NO: 24261 - DNA, 25 bp, Homo sapien
gcattcattggttttatcacattca

SEQ ID NO: 24262 - DNA, 25 bp, Homo sapien
aaatcctgtgaatgtaaacgtggta

SEQ ID NO: 24263 - DNA, 25 bp, Homo sapien
aagaagtttccaggctgggcgcagc

SEQ ID NO: 24264 - DNA, 25 bp, Homo sapien
gccgaggagggcagatcacgaggcc

SEQ ID NO: 24265 - DNA, 25 bp, Homo sapien
cacgtcggccgtcgggaaagcacgg

SEQ ID NO: 24266 - DNA, 25 bp, Homo sapien
ccacacggcacccacagactgggtg

SEQ ID NO: 24267 - DNA, 25 bp, Homo sapien
ggcacccacagactgggtgccccgg

SEQ ID NO: 24268 - DNA, 25 bp, Homo sapien
tgggaaggcgtgggccacatggtcc

SEQ ID NO: 24269 - DNA, 25 bp, Homo sapien
ctcaccctctaaacgttcagcggtg

SEQ ID NO: 24270 - DNA, 25 bp, Homo sapien
aacggacgtttgagctcacgtggcg

SEQ ID NO: 24271 - DNA, 25 bp, Homo sapien
atgcatggtttgtggcggaagacgg

SEQ ID NO: 24272 - DNA, 25 bp, Homo sapien
tcccccagcgctgaagcacggggtt

SEQ ID NO: 24273 - DNA, 25 bp, Homo sapien
gctgaagcacggggttcagcggctc

SEQ ID NO: 24274 - DNA, 25 bp, Homo sapien
ggggctcgggaccatgaggatgacc

SEQ ID NO: 24275 - DNA, 25 bp, Homo sapien
gggaccatgaggatgaccagcaaaa

SEQ ID NO: 24276 - DNA, 25 bp, Homo sapien
gtaaccaaactaaatcgcttggaag

SEQ ID NO: 24277 - DNA, 25 bp, Homo sapien
caacagccgcgagttccagctgtgc

SEQ ID NO: 24278 - DNA, 25 bp, Homo sapien
ctgtgcgaccccaaagaggtggctc

SEQ ID NO: 24279 - DNA, 25 bp, Homo sapien
ccccaaagaggtggctcggctgtgg

SEQ ID NO: 24280 - DNA, 25 bp, Homo sapien
cgagcgcaagagaaagccgggcatg

SEQ ID NO: 24281 - DNA, 25 bp, Homo sapien
gccgggcatgaattacgagaagctg

SEQ ID NO: 24282 - DNA, 25 bp, Homo sapien
gccgcgacatcgtgcgcaagagcgg

SEQ ID NO: 24283 - DNA, 25 bp, Homo sapien
gcaagagcggggggcgaaagtacac

SEQ ID NO: 24284 - DNA, 25 bp, Homo sapien
ggcgaaagtacacgtaccgcttcgg

SEQ ID NO: 24285 - DNA, 25 bp, Homo sapien
tagcctatccggactgtgcgggagg

SEQ ID NO: 24286 - DNA, 25 bp, Homo sapien
tccggactgtgcgggaggcggacgg

SEQ ID NO: 24287 - DNA, 25 bp, Homo sapien
gggaatcttattttattcatgtatt

SEQ ID NO: 24288 - DNA, 25 bp, Homo sapien
gtattaacatgctgtggttcagggg

SEQ ID NO: 24289 - DNA, 25 bp, Homo sapien
ggttcaggggaaattctaggtcaga

SEQ ID NO: 24290 - DNA, 25 bp, Homo sapien
ttctaggtcagattataactttcat

SEQ ID NO: 24291 - DNA, 25 bp, Homo sapien
gtcagattataactttcataccata

SEQ ID NO: 24292 - DNA, 25 bp, Homo sapien
tgatggcttttaaagggagggcttt

SEQ ID NO: 24293 - DNA, 25 bp, Homo sapien
attgggaacatgttgctaccttctt

SEQ ID NO: 24294 - DNA, 25 bp, Homo sapien
catgttgctaccttcttttagtcag

SEQ ID NO: 24295 - DNA, 25 bp, Homo sapien
gctaccttcttttagtcagatacca

SEQ ID NO: 24296 - DNA, 25 bp, Homo sapien
ctctttgggtggctgaggcggacgg

SEQ ID NO: 24297 - DNA, 25 bp, Homo sapien
tttgggtggctgaggcggacggatc

SEQ ID NO: 24298 - DNA, 25 bp, Homo sapien
gttttatttgaaagcactacctata

SEQ ID NO: 24299 - DNA, 25 bp, Homo sapien
aatgatatcaacccacttactgtcc

SEQ ID NO: 24300 - DNA, 25 bp, Homo sapien
ttactgtccctttctagcaggcaga

SEQ ID NO: 24301 - DNA, 25 bp, Homo sapien
ctatctcaggaactgattcctccat

SEQ ID NO: 24302 - DNA, 25 bp, Homo sapien
ctccatcctgaaacaccttaacaac

SEQ ID NO: 24303 - DNA, 25 bp, Homo sapien
aaaggaggctgcacagtggctcaca

SEQ ID NO: 24304 - DNA, 25 bp, Homo sapien
tcacacctgtaaacccagtgctctg

SEQ ID NO: 24305 - DNA, 25 bp, Homo sapien
aggtggaaggactgcttgagcccag

SEQ ID NO: 24306 - DNA, 25 bp, Homo sapien
agaccagcctgggtaacacagcaag

SEQ ID NO: 24307 - DNA, 25 bp, Homo sapien
atgtgcctatagtcctggctactca

SEQ ID NO: 24308 - DNA, 25 bp, Homo sapien
gccactgtactttagcctggacgac

SEQ ID NO: 24309 - DNA, 25 bp, Homo sapien
gtgcaagctatatgtatccttctgc

SEQ ID NO: 24310 - DNA, 25 bp, Homo sapien
atgtatccttctgcaggaattcaac

SEQ ID NO: 24311 - DNA, 25 bp, Homo sapien
ttcaacttatgaacagtttgaccta

SEQ ID NO: 24312 - DNA, 25 bp, Homo sapien
ttgacctaaattgctgtgttagtaa

SEQ ID NO: 24313 - DNA, 25 bp, Homo sapien
ctgtgttagtaatgtaggtttgtgt

SEQ ID NO: 24314 - DNA, 25 bp, Homo sapien
gtaggtttgtgtgaggaagaggtga

SEQ ID NO: 24315 - DNA, 25 bp, Homo sapien
gaagaggtgactgtgtgtattcatg

SEQ ID NO: 24316 - DNA, 25 bp, Homo sapien
gactgtgtgtattcatgttttttat

SEQ ID NO: 24317 - DNA, 25 bp, Homo sapien
atgttttttatgtgactagggggag

SEQ ID NO: 24318 - DNA, 25 bp, Homo sapien
gactagggggagtgcattactgtgg

SEQ ID NO: 24319 - DNA, 25 bp, Homo sapien
actgtggaattaagaggttctctgg

SEQ ID NO: 24320 - DNA, 25 bp, Homo sapien
atcttaggctcaaagttggcactca

SEQ ID NO: 24321 - DNA, 25 bp, Homo sapien
gtgaattacagcaggttggattatt

SEQ ID NO: 24322 - DNA, 25 bp, Homo sapien
ggtaatatggttcgcagtgtgggac

SEQ ID NO: 24323 - DNA, 25 bp, Homo sapien
ttcgcagtgtgggactcctgaactc

SEQ ID NO: 24324 - DNA, 25 bp, Homo sapien
actcctgaactccaagatgtctttg

SEQ ID NO: 24325 - DNA, 25 bp, Homo sapien
gtcagactacggattacttaataac

SEQ ID NO: 24326 - DNA, 25 bp, Homo sapien
cagggactatagttcattcatggat

SEQ ID NO: 24327 - DNA, 25 bp, Homo sapien
gttcattcatggatatatccccaga

SEQ ID NO: 24328 - DNA, 25 bp, Homo sapien
atatccccagaatcaggaacagttt

SEQ ID NO: 24329 - DNA, 25 bp, Homo sapien
cagtttctagaatacgcttgagtgc

SEQ ID NO: 24330 - DNA, 25 bp, Homo sapien
gcttgagtgctcaatagacatagct

SEQ ID NO: 24331 - DNA, 25 bp, Homo sapien
gagaatgtccaaagaacactactgt

SEQ ID NO: 24332 - DNA, 25 bp, Homo sapien
actgtggaaagttcttacgatggaa

SEQ ID NO: 24333 - DNA, 25 bp, Homo sapien
acgatggaaattgacatcttttgta

SEQ ID NO: 24334 - DNA, 25 bp, Homo sapien
tatctcattctccagccgtgaaata

SEQ ID NO: 24335 - DNA, 25 bp, Homo sapien
ctcattctccagccgtgaaataaag

SEQ ID NO: 24336 - DNA, 25 bp, Homo sapien
aataaaggcagaggttccctgcaaa

SEQ ID NO: 24337 - DNA, 25 bp, Homo sapien
ttattagtttatcacaagacccatg

SEQ ID NO: 24338 - DNA, 25 bp, Homo sapien
acaagacccatgtgacaactcagaa

SEQ ID NO: 24339 - DNA, 25 bp, Homo sapien
gacccatgtgacaactcagaaaata

SEQ ID NO: 24340 - DNA, 25 bp, Homo sapien
ttgagattacaagcccaaccttcca

SEQ ID NO: 24341 - DNA, 25 bp, Homo sapien
gcccaaccttccataactgaaaact

SEQ ID NO: 24342 - DNA, 25 bp, Homo sapien
tgtgaccacggaaggccgcagggga

SEQ ID NO: 24343 - DNA, 25 bp, Homo sapien
gaaggaggtgtctgtggccatgtgt

SEQ ID NO: 24344 - DNA, 25 bp, Homo sapien
gccatgtgtctttaagggagagccc

SEQ ID NO: 24345 - DNA, 25 bp, Homo sapien
gagagcccacagaaaaatgagccta

SEQ ID NO: 24346 - DNA, 25 bp, Homo sapien
gcgagaagtctgcttcaatcacaga

SEQ ID NO: 24347 - DNA, 25 bp, Homo sapien
gattgacaattatgtgagtgactca

SEQ ID NO: 24348 - DNA, 25 bp, Homo sapien
gatggaaagactgaactgcatgaga

SEQ ID NO: 24349 - DNA, 25 bp, Homo sapien
gggcaataaagctctgtctacacag

SEQ ID NO: 24350 - DNA, 25 bp, Homo sapien
taaaaatagggccaccactcacgcc

SEQ ID NO: 24351 - DNA, 25 bp, Homo sapien
cgagaccagcctgatcaacacggtg

SEQ ID NO: 24352 - DNA, 25 bp, Homo sapien
gtaatcctagctattcaggtggctg

SEQ ID NO: 24353 - DNA, 25 bp, Homo sapien
aaccaactacaacttccctatagct

SEQ ID NO: 24354 - DNA, 25 bp, Homo sapien
caacttccctatagcttctaagcag

SEQ ID NO: 24355 - DNA, 25 bp, Homo sapien
ttctaagcagtttcatcagcattac

SEQ ID NO: 24356 - DNA, 25 bp, Homo sapien
tcagcattacttgggaaaacgtgtt

SEQ ID NO: 24357 - DNA, 25 bp, Homo sapien
acgtgttgcaagtcaaccagtcact

SEQ ID NO: 24358 - DNA, 25 bp, Homo sapien
accagtcactaggatatttctaccc

SEQ ID NO: 24359 - DNA, 25 bp, Homo sapien
taagccacagcaatggttttgtaga

SEQ ID NO: 24360 - DNA, 25 bp, Homo sapien
aaaactcctgtgcttttgagcaagg

SEQ ID NO: 24361 - DNA, 25 bp, Homo sapien
ttgagcaaggacttttgccctctag

SEQ ID NO: 24362 - DNA, 25 bp, Homo sapien
ggacttttgccctctagaaagcaac

SEQ ID NO: 24363 - DNA, 25 bp, Homo sapien
tctagaaagcaactgaggccaggtg

SEQ ID NO: 24364 - DNA, 25 bp, Homo sapien
aaaacagtaagatgtgccttgacac

SEQ ID NO: 24365 - DNA, 25 bp, Homo sapien
gaaccatgtgccaatcaaagtagac

SEQ ID NO: 24366 - DNA, 25 bp, Homo sapien
gtagacaactgtaaagtccttgaga

SEQ ID NO: 24367 - DNA, 25 bp, Homo sapien
atttgtggcaaattcagtgggttca

SEQ ID NO: 24368 - DNA, 25 bp, Homo sapien
aaattgagtttgtcctttctgcttc

SEQ ID NO: 24369 - DNA, 25 bp, Homo sapien
tttctgcttcattagtttaagctgt

SEQ ID NO: 24370 - DNA, 25 bp, Homo sapien
tttaagctgtataattcctttccct

SEQ ID NO: 24371 - DNA, 25 bp, Homo sapien
tgttttcattttttcggaggaagag

SEQ ID NO: 24372 - DNA, 25 bp, Homo sapien
gaggagttgctagtactggcattgg

SEQ ID NO: 24373 - DNA, 25 bp, Homo sapien
agtactggcattggttttcctttct

SEQ ID NO: 24374 - DNA, 25 bp, Homo sapien
tcctgagatggagctttgctgttgt

SEQ ID NO: 24375 - DNA, 25 bp, Homo sapien
gaaatgcatcattcttgttaattat

SEQ ID NO: 24376 - DNA, 25 bp, Homo sapien
ataccatggtgaattaatcactttt

SEQ ID NO: 24377 - DNA, 25 bp, Homo sapien
atcacttttgaagcaatatcagtta

SEQ ID NO: 24378 - DNA, 25 bp, Homo sapien
tttctaaagccttaagtcttaatat

SEQ ID NO: 24379 - DNA, 25 bp, Homo sapien
aaatatatgattagccaggcacggt

SEQ ID NO: 24380 - DNA, 25 bp, Homo sapien
gggattacccgaggtcaggaattcg

SEQ ID NO: 24381 - DNA, 25 bp, Homo sapien
tagccggtcatggtggtgcatgtct

SEQ ID NO: 24382 - DNA, 25 bp, Homo sapien
tggtgcatgtctgcaaacccagcta

SEQ ID NO: 24383 - DNA, 25 bp, Homo sapien
gtgagccaacatcacaccattgcac

SEQ ID NO: 24384 - DNA, 25 bp, Homo sapien
caataacctgctagacacattttta

SEQ ID NO: 24385 - DNA, 25 bp, Homo sapien
gcaacatgtgtacttaatttcttta

SEQ ID NO: 24386 - DNA, 25 bp, Homo sapien
gagtgctgagttaaacgcaaatttc

SEQ ID NO: 24387 - DNA, 25 bp, Homo sapien
ttctagcattaatatgccccacgca

SEQ ID NO: 24388 - DNA, 25 bp, Homo sapien
atatgccccacgcaatatttggaac

SEQ ID NO: 24389 - DNA, 25 bp, Homo sapien
gccccacgcaatatttggaacactt

SEQ ID NO: 24390 - DNA, 25 bp, Homo sapien
tcctgtaactgtccccgaggggatt

SEQ ID NO: 24391 - DNA, 25 bp, Homo sapien
tccccgaggggattgagcagaagct

SEQ ID NO: 24392 - DNA, 25 bp, Homo sapien
gaagctcgggtatgagccctgaggt

SEQ ID NO: 24393 - DNA, 25 bp, Homo sapien
actctagacactaacttagttccag

SEQ ID NO: 24394 - DNA, 25 bp, Homo sapien
cactaacttagttccaggttcggtg

SEQ ID NO: 24395 - DNA, 25 bp, Homo sapien
caatagcttaggtcccatggtgggg

SEQ ID NO: 24396 - DNA, 25 bp, Homo sapien
gcttaggtcccatggtgggggagga

SEQ ID NO: 24397 - DNA, 25 bp, Homo sapien
gggcaagtcagagcattagcagcta

SEQ ID NO: 24398 - DNA, 25 bp, Homo sapien
tggggtcccatcaaggttcagtggc

SEQ ID NO: 24399 - DNA, 25 bp, Homo sapien
ctactctggctccgaggtgccagat

SEQ ID NO: 24400 - DNA, 25 bp, Homo sapien
ggttcagtggcagtggatctgggac

SEQ ID NO: 24401 - DNA, 25 bp, Homo sapien
ctgggacagatttcactctcaccat

SEQ ID NO: 24402 - DNA, 25 bp, Homo sapien
gcagtctgcaacctgaagattttgc

SEQ ID NO: 24403 - DNA, 25 bp, Homo sapien
gattttgcaacttactactgtcaac

SEQ ID NO: 24404 - DNA, 25 bp, Homo sapien
gtcaacagagttacagtacccctca

SEQ ID NO: 24405 - DNA, 25 bp, Homo sapien
tgtgacatccagatgacccagtctc

SEQ ID NO: 24406 - DNA, 25 bp, Homo sapien
tcctccctgtctgcatctgtaggag

SEQ ID NO: 24407 - DNA, 25 bp, Homo sapien
aggagacagagtcaccatcacttgc

SEQ ID NO: 24408 - DNA, 25 bp, Homo sapien
gaagctcagtggttgagacctaggg

SEQ ID NO: 24409 - DNA, 25 bp, Homo sapien
gtgttttttctggtcagtgttttgc

SEQ ID NO: 24410 - DNA, 25 bp, Homo sapien
tgcagaaaactcttgttggcttcat

SEQ ID NO: 24411 - DNA, 25 bp, Homo sapien
tgggattcttgttctattagcttag

SEQ ID NO: 24412 - DNA, 25 bp, Homo sapien
attagcttagagcacagcattgaag

SEQ ID NO: 24413 - DNA, 25 bp, Homo sapien
gcacagcattgaagcaagtgcttta

SEQ ID NO: 24414 - DNA, 25 bp, Homo sapien
aagtgctttagttaactgctctggc

SEQ ID NO: 24415 - DNA, 25 bp, Homo sapien
tgctctggcacttcttaggagacat

SEQ ID NO: 24416 - DNA, 25 bp, Homo sapien
cttaggagacatgcacttttttctt

SEQ ID NO: 24417 - DNA, 25 bp, Homo sapien
tccctgtgagaggtgtaggcctgga

SEQ ID NO: 24418 - DNA, 25 bp, Homo sapien
gtaatgattcctaaagcaatctgaa

SEQ ID NO: 24419 - DNA, 25 bp, Homo sapien
aattctaaccaaagtattgtcagta

SEQ ID NO: 24420 - DNA, 25 bp, Homo sapien
ataatacactaaatgttaagccata

SEQ ID NO: 24421 - DNA, 25 bp, Homo sapien
aagccataagcaaggaataattcat

SEQ ID NO: 24422 - DNA, 25 bp, Homo sapien
cagttctaaactcatatgcacctaa

SEQ ID NO: 24423 - DNA, 25 bp, Homo sapien
tgcacctaacagcatagccttaaga

SEQ ID NO: 24424 - DNA, 25 bp, Homo sapien
atgtaaatacgctgttggggtgaga

SEQ ID NO: 24425 - DNA, 25 bp, Homo sapien
acgctgttggggtgagagattttaa

SEQ ID NO: 24426 - DNA, 25 bp, Homo sapien
ttaagaaaactgtctctgctattga

SEQ ID NO: 24427 - DNA, 25 bp, Homo sapien
gtctctgctattgacagatcctgga

SEQ ID NO: 24428 - DNA, 25 bp, Homo sapien
cagatcctggacataaaatcagtaa

SEQ ID NO: 24429 - DNA, 25 bp, Homo sapien
aaatcagtaaaccggccaggcacgg

SEQ ID NO: 24430 - DNA, 25 bp, Homo sapien
cctcactcaatctactgggagttct

SEQ ID NO: 24431 - DNA, 25 bp, Homo sapien
tctactgggagttcttgaaggcaag

SEQ ID NO: 24432 - DNA, 25 bp, Homo sapien
ccatttccatatccccagtttgtgg

SEQ ID NO: 24433 - DNA, 25 bp, Homo sapien
agagcatatgattcatccatttaac

SEQ ID NO: 24434 - DNA, 25 bp, Homo sapien
gaaacttttactctatgccagacac

SEQ ID NO: 24435 - DNA, 25 bp, Homo sapien
acttttactctatgccagacactat

SEQ ID NO: 24436 - DNA, 25 bp, Homo sapien
aacagacgaaaatctctgccttcgt

SEQ ID NO: 24437 - DNA, 25 bp, Homo sapien
aaaatctctgccttcgtggggcata

SEQ ID NO: 24438 - DNA, 25 bp, Homo sapien
ccttcgtggggcatacagtctagtt

SEQ ID NO: 24439 - DNA, 25 bp, Homo sapien
gggcatacagtctagttgagtgtgt

SEQ ID NO: 24440 - DNA, 25 bp, Homo sapien
aagggagactcaaagctataaatgc

SEQ ID NO: 24441 - DNA, 25 bp, Homo sapien
gggtgggggcagggcatgagttccc

SEQ ID NO: 24442 - DNA, 25 bp, Homo sapien
tgggggcagggcatgagttccccag

SEQ ID NO: 24443 - DNA, 25 bp, Homo sapien
ttccccagtccccaaggaaaggcag

SEQ ID NO: 24444 - DNA, 25 bp, Homo sapien
actcgattcctgcggtaactctgag

SEQ ID NO: 24445 - DNA, 25 bp, Homo sapien
tcgattcctgcggtaactctgagcc

SEQ ID NO: 24446 - DNA, 25 bp, Homo sapien
cggtaactctgagccctgaaatcct

SEQ ID NO: 24447 - DNA, 25 bp, Homo sapien
ctgagccctgaaatcctcagtctcc

SEQ ID NO: 24448 - DNA, 25 bp, Homo sapien
ctcagtctccttggcggggaagatt

SEQ ID NO: 24449 - DNA, 25 bp, Homo sapien
gcggggaagattggctttggggaca

SEQ ID NO: 24450 - DNA, 25 bp, Homo sapien
ggctttggggacaggaagtcggcac

SEQ ID NO: 24451 - DNA, 25 bp, Homo sapien
acaggaagtcggcacatctccaggt

SEQ ID NO: 24452 - DNA, 25 bp, Homo sapien
caagatcctgatcttcgggctgttt

SEQ ID NO: 24453 - DNA, 25 bp, Homo sapien
atcctgatcttcgggctgtttgagg

SEQ ID NO: 24454 - DNA, 25 bp, Homo sapien
gatcttcgggctgtttgaggagacg

SEQ ID NO: 24455 - DNA, 25 bp, Homo sapien
cgggctgtttgaggagacggccctg

SEQ ID NO: 24456 - DNA, 25 bp, Homo sapien
gtctacgacgaaatccgcaaactca

SEQ ID NO: 24457 - DNA, 25 bp, Homo sapien
gacgaaatccgcaaactcatcctgc

SEQ ID NO: 24458 - DNA, 25 bp, Homo sapien
tccgcaaactcatcctgcgcaggaa

SEQ ID NO: 24459 - DNA, 25 bp, Homo sapien
caaactcatcctgcgcaggaaccca

SEQ ID NO: 24460 - DNA, 25 bp, Homo sapien
atcctgcgcaggaacccagggggtt

SEQ ID NO: 24461 - DNA, 25 bp, Homo sapien
aaggaaacctactactgacctcagc

SEQ ID NO: 24462 - DNA, 25 bp, Homo sapien
tgtattctggggggaggagccctct

SEQ ID NO: 24463 - DNA, 25 bp, Homo sapien
gtgtctatgatagttagggaaacct

SEQ ID NO: 24464 - DNA, 25 bp, Homo sapien
gggaaacctgttttagaagagctag

SEQ ID NO: 24465 - DNA, 25 bp, Homo sapien
gaagagctagatatctgtctaacat

SEQ ID NO: 24466 - DNA, 25 bp, Homo sapien
atctgtctaacatttacagcagtta

SEQ ID NO: 24467 - DNA, 25 bp, Homo sapien
tgttgtttaggctggccttgagttc

SEQ ID NO: 24468 - DNA, 25 bp, Homo sapien
ggccttgagttcctggatttaagcg

SEQ ID NO: 24469 - DNA, 25 bp, Homo sapien
gttcctggatttaagcgatcctcct

SEQ ID NO: 24470 - DNA, 25 bp, Homo sapien
ctcctacttcaaccttctgagtagc

SEQ ID NO: 24471 - DNA, 25 bp, Homo sapien
gtagctgagactacgggcgcatgcc

SEQ ID NO: 24472 - DNA, 25 bp, Homo sapien
tgccactgccctgggtatgaagcag

SEQ ID NO: 24473 - DNA, 25 bp, Homo sapien
gcttgaacctgcaaggttgagacta

SEQ ID NO: 24474 - DNA, 25 bp, Homo sapien
tcaatgcagccaagatcatccgcca

SEQ ID NO: 24475 - DNA, 25 bp, Homo sapien
acatcatgctgatcaagctctccac

SEQ ID NO: 24476 - DNA, 25 bp, Homo sapien
ctgctggcaccgagtgccttatctc

SEQ ID NO: 24477 - DNA, 25 bp, Homo sapien
ttatctccggctggggcaataccct

SEQ ID NO: 24478 - DNA, 25 bp, Homo sapien
taccctgagctcaggggccgactac

SEQ ID NO: 24479 - DNA, 25 bp, Homo sapien
gactacccagatgagctgcagtgcc

SEQ ID NO: 24480 - DNA, 25 bp, Homo sapien
ctcctgtgctgacccaggctaagtg

SEQ ID NO: 24481 - DNA, 25 bp, Homo sapien
tcctgccagggtgactctggtggcc

SEQ ID NO: 24482 - DNA, 25 bp, Homo sapien
ggccctgtggtctgcaatggacagc

SEQ ID NO: 24483 - DNA, 25 bp, Homo sapien
ctcctggggctatggctgtgcccag

SEQ ID NO: 24484 - DNA, 25 bp, Homo sapien
aggcctggagtctacaccaaggtct

SEQ ID NO: 24485 - DNA, 25 bp, Homo sapien
catgtctcttccagcttaataactg

SEQ ID NO: 24486 - DNA, 25 bp, Homo sapien
gtcaacaacaatacactctagtgga

SEQ ID NO: 24487 - DNA, 25 bp, Homo sapien
agttttctagacgatgcctgttgtg

SEQ ID NO: 24488 - DNA, 25 bp, Homo sapien
tgcctgttgtgggtatattgtttcc

SEQ ID NO: 24489 - DNA, 25 bp, Homo sapien
gctggaatcgctgcactttacacac

SEQ ID NO: 24490 - DNA, 25 bp, Homo sapien
gctgcactttacacactcaaaatta

SEQ ID NO: 24491 - DNA, 25 bp, Homo sapien
gctcagtttttggagtgaacctcaa

SEQ ID NO: 24492 - DNA, 25 bp, Homo sapien
aagcaatccttggctaacagaagat

SEQ ID NO: 24493 - DNA, 25 bp, Homo sapien
gattcttccagattctagcaatgtt

SEQ ID NO: 24494 - DNA, 25 bp, Homo sapien
gtttgttcaaagtggggcatagctg

SEQ ID NO: 24495 - DNA, 25 bp, Homo sapien
ggggcatagctggccaggtgtagtg

SEQ ID NO: 24496 - DNA, 25 bp, Homo sapien
gatcggggggatgaccagctggagt

SEQ ID NO: 24497 - DNA, 25 bp, Homo sapien
ggatgacagagacagcgccaatggc

SEQ ID NO: 24498 - DNA, 25 bp, Homo sapien
atcttatcccattatttctttacct

SEQ ID NO: 24499 - DNA, 25 bp, Homo sapien
ttctttacctaggcgcttgtctaag

SEQ ID NO: 24500 - DNA, 25 bp, Homo sapien
tcaaatttttcaccagatcctctcc

SEQ ID NO: 24501 - DNA, 25 bp, Homo sapien
tcttcagcacatgctcactgttctc

SEQ ID NO: 24502 - DNA, 25 bp, Homo sapien
ttgtccttcccatgttcattaattc

SEQ ID NO: 24503 - DNA, 25 bp, Homo sapien
tgttcattaattcatattgccccgc

SEQ ID NO: 24504 - DNA, 25 bp, Homo sapien
tcctttgacgctcctagtagttttg

SEQ ID NO: 24505 - DNA, 25 bp, Homo sapien
acaccctcacattagtgtgctgcgt

SEQ ID NO: 24506 - DNA, 25 bp, Homo sapien
gagggggacctactggatgatgatg

SEQ ID NO: 24507 - DNA, 25 bp, Homo sapien
cctgcctccatcggtgtataatcag

SEQ ID NO: 24508 - DNA, 25 bp, Homo sapien
ctccatcggtgtataatcaggcagg

SEQ ID NO: 24509 - DNA, 25 bp, Homo sapien
ggtgtataatcaggcaggtggtgtt

SEQ ID NO: 24510 - DNA, 25 bp, Homo sapien
caggtggtgtttgctcttaggtgat

SEQ ID NO: 24511 - DNA, 25 bp, Homo sapien
ggtgtttgctcttaggtgattagaa

SEQ ID NO: 24512 - DNA, 25 bp, Homo sapien
tgggcgctgagctaaggaaatatgc

SEQ ID NO: 24513 - DNA, 25 bp, Homo sapien
gagctaaggaaatatgcagggggtt

SEQ ID NO: 24514 - DNA, 25 bp, Homo sapien
tcctcagctcttctgggtaagctga

SEQ ID NO: 24515 - DNA, 25 bp, Homo sapien
gtggcccagagggcagatctcttga

SEQ ID NO: 24516 - DNA, 25 bp, Homo sapien
gggaagatcatctgagctggggagg

SEQ ID NO: 24517 - DNA, 25 bp, Homo sapien
gagctggggaggtcgaggcagcagt

SEQ ID NO: 24518 - DNA, 25 bp, Homo sapien
ggccctgaacatccataattgctat

SEQ ID NO: 24519 - DNA, 25 bp, Homo sapien
ataattgctataagccacttttttt

SEQ ID NO: 24520 - DNA, 25 bp, Homo sapien
aatgtgctgagtaccttctgtggaa

SEQ ID NO: 24521 - DNA, 25 bp, Homo sapien
aaaggctagaggggcgagtgctccc

SEQ ID NO: 24522 - DNA, 25 bp, Homo sapien
aagtgcttgttgcaccttagctgga

SEQ ID NO: 24523 - DNA, 25 bp, Homo sapien
gctggagacgttgcaagctcatggt

SEQ ID NO: 24524 - DNA, 25 bp, Homo sapien
agctcatggtgaaagggctgcccaa

SEQ ID NO: 24525 - DNA, 25 bp, Homo sapien
ggctgcccaaaggaagttaattgtc

SEQ ID NO: 24526 - DNA, 25 bp, Homo sapien
aattgtcatgacgaggctcattctt

SEQ ID NO: 24527 - DNA, 25 bp, Homo sapien
gacgaggctcattcttagaagttca

SEQ ID NO: 24528 - DNA, 25 bp, Homo sapien
tagtttcatatgtgacttcagtgtt

SEQ ID NO: 24529 - DNA, 25 bp, Homo sapien
atgctatagttatccatgaagtcta

SEQ ID NO: 24530 - DNA, 25 bp, Homo sapien
gccagagatggaagactttgggctg

SEQ ID NO: 24531 - DNA, 25 bp, Homo sapien
ggctggtgaccagatattagaggtt

SEQ ID NO: 24532 - DNA, 25 bp, Homo sapien
agagatgaagcacactaccgggatg

SEQ ID NO: 24533 - DNA, 25 bp, Homo sapien
gaagcacactaccgggatgaggaga

SEQ ID NO: 24534 - DNA, 25 bp, Homo sapien
accgggatgaggagaacttggagat

SEQ ID NO: 24535 - DNA, 25 bp, Homo sapien
gaaaggcggagccgcagacctggat

SEQ ID NO: 24536 - DNA, 25 bp, Homo sapien
gagccgcagacctggatgggagatt

SEQ ID NO: 24537 - DNA, 25 bp, Homo sapien
gcagacctggatgggagattgattc

SEQ ID NO: 24538 - DNA, 25 bp, Homo sapien
gatgggagattgattcagggagatc

SEQ ID NO: 24539 - DNA, 25 bp, Homo sapien
gggagatcagatcttatctgtgaat

SEQ ID NO: 24540 - DNA, 25 bp, Homo sapien
ggctggtgattttggtactgtttat

SEQ ID NO: 24541 - DNA, 25 bp, Homo sapien
acatttgctaaattttctcgtggta

SEQ ID NO: 24542 - DNA, 25 bp, Homo sapien
tttctcgtggtatagttcacttata

SEQ ID NO: 24543 - DNA, 25 bp, Homo sapien
gttcacttataatgacatcactact

SEQ ID NO: 24544 - DNA, 25 bp, Homo sapien
gtgtctttaatattttgctggttgc

SEQ ID NO: 24545 - DNA, 25 bp, Homo sapien
gagtagagatgtacctcatttaaca

SEQ ID NO: 24546 - DNA, 25 bp, Homo sapien
aaaattctacactttgttgttgaca

SEQ ID NO: 24547 - DNA, 25 bp, Homo sapien
aattcattagctagtgtctcctact

SEQ ID NO: 24548 - DNA, 25 bp, Homo sapien
gtctcctactttcctaatactttag

SEQ ID NO: 24549 - DNA, 25 bp, Homo sapien
taaacccttatggtcgatatttcct

SEQ ID NO: 24550 - DNA, 25 bp, Homo sapien
acacctttggttatatggccagttc

SEQ ID NO: 24551 - DNA, 25 bp, Homo sapien
ttctcggagaagttcttagcctgat

SEQ ID NO: 24552 - DNA, 25 bp, Homo sapien
ggtgtcattgtgttgtgctaaacgc

SEQ ID NO: 24553 - DNA, 25 bp, Homo sapien
gttgtgctaaacgctgggagggtac

SEQ ID NO: 24554 - DNA, 25 bp, Homo sapien
gggagggtacaagttggtcattcct

SEQ ID NO: 24555 - DNA, 25 bp, Homo sapien
caagttggtcattcctaaatctgtg

SEQ ID NO: 24556 - DNA, 25 bp, Homo sapien
ggcaggtctagtttgggcattgtga

SEQ ID NO: 24557 - DNA, 25 bp, Homo sapien
gtttgggcattgtgattgcattgca

SEQ ID NO: 24558 - DNA, 25 bp, Homo sapien
ttgcattgcagattactaggagaag

SEQ ID NO: 24559 - DNA, 25 bp, Homo sapien
ggaatggtgggtacaccggtagtgc

SEQ ID NO: 24560 - DNA, 25 bp, Homo sapien
gtacaccggtagtgctcttttgttc

SEQ ID NO: 24561 - DNA, 25 bp, Homo sapien
gaactttacttcgttagatttcata

SEQ ID NO: 24562 - DNA, 25 bp, Homo sapien
ttcttagggagctatgagggggaaa

SEQ ID NO: 24563 - DNA, 25 bp, Homo sapien
aatggactatgattcctgtggggaa

SEQ ID NO: 24564 - DNA, 25 bp, Homo sapien
atttcattctctccatcgtgaaaat

SEQ ID NO: 24565 - DNA, 25 bp, Homo sapien
gaagcaaaattacacctttatgaga

SEQ ID NO: 24566 - DNA, 25 bp, Homo sapien
atttttcaggccagacatagcttcc

SEQ ID NO: 24567 - DNA, 25 bp, Homo sapien
tcaggccagacatagcttcctaatg

SEQ ID NO: 24568 - DNA, 25 bp, Homo sapien
ggaaatgtaattcgacgactcctca

SEQ ID NO: 24569 - DNA, 25 bp, Homo sapien
tcgacgactcctcaaaggggacttt

SEQ ID NO: 24570 - DNA, 25 bp, Homo sapien
aggggactttagaggacttcataca

SEQ ID NO: 24571 - DNA, 25 bp, Homo sapien
gaggacttcatacaaagctgggcat

SEQ ID NO: 24572 - DNA, 25 bp, Homo sapien
aaaaccacaatgcatggccgggcgt

SEQ ID NO: 24573 - DNA, 25 bp, Homo sapien
taaggggtgcgtgataggctcagct

SEQ ID NO: 24574 - DNA, 25 bp, Homo sapien
gtgataggctcagcttgtgtcacat

SEQ ID NO: 24575 - DNA, 25 bp, Homo sapien
tgtgtcacatgcccagggaggtcac

SEQ ID NO: 24576 - DNA, 25 bp, Homo sapien
gggaggtcacacagatgataccctg

SEQ ID NO: 24577 - DNA, 25 bp, Homo sapien
ataccctgagggaactgctgtaaac

SEQ ID NO: 24578 - DNA, 25 bp, Homo sapien
gatacagcagttttcatgcattttt

SEQ ID NO: 24579 - DNA, 25 bp, Homo sapien
gtccatatggaactcagctcaaaca

SEQ ID NO: 24580 - DNA, 25 bp, Homo sapien
gttaagattctttccttgattcatt

SEQ ID NO: 24581 - DNA, 25 bp, Homo sapien
gaggatcgaatattcgcagtggcct

SEQ ID NO: 24582 - DNA, 25 bp, Homo sapien
gcagtggcctgtgaatagacacttc

SEQ ID NO: 24583 - DNA, 25 bp, Homo sapien
gaggcagaattactttgagcccggg

SEQ ID NO: 24584 - DNA, 25 bp, Homo sapien
gcctggagaggaacgtgtgcccaca

SEQ ID NO: 24585 - DNA, 25 bp, Homo sapien
gaagtatgtatatctctcccaagta

SEQ ID NO: 24586 - DNA, 25 bp, Homo sapien
gtgtgcctgtgtgcaaaaggatcca

SEQ ID NO: 24587 - DNA, 25 bp, Homo sapien
caaaaggatccatgcatgcctgccc

SEQ ID NO: 24588 - DNA, 25 bp, Homo sapien
ctgtgtgtgctgtgggaagaggggg

SEQ ID NO: 24589 - DNA, 25 bp, Homo sapien
gggggtgattatggctggtgctgta

SEQ ID NO: 24590 - DNA, 25 bp, Homo sapien
agatatcagccttgatccgtgttct

SEQ ID NO: 24591 - DNA, 25 bp, Homo sapien
ttgatccgtgttctccagagaggga

SEQ ID NO: 24592 - DNA, 25 bp, Homo sapien
acatgaaaatgcttacctgggtggc

SEQ ID NO: 24593 - DNA, 25 bp, Homo sapien
agaagtgtgatagaggccgggcgca

SEQ ID NO: 24594 - DNA, 25 bp, Homo sapien
acacacctgttaattgcagctactt

SEQ ID NO: 24595 - DNA, 25 bp, Homo sapien
gtgatcaagtgttcatcaatggatg

SEQ ID NO: 24596 - DNA, 25 bp, Homo sapien
taaacagtgatacgtacatacaatg

SEQ ID NO: 24597 - DNA, 25 bp, Homo sapien
gatacgtacatacaatgggtcattt

SEQ ID NO: 24598 - DNA, 25 bp, Homo sapien
ttctgacacatgctattaacacgga

SEQ ID NO: 24599 - DNA, 25 bp, Homo sapien
gctattaacacggatgaaccatgag

SEQ ID NO: 24600 - DNA, 25 bp, Homo sapien
gaaccatgaggacattatgctgagt

SEQ ID NO: 24601 - DNA, 25 bp, Homo sapien
gattccattcacatgaggtactttt

SEQ ID NO: 24602 - DNA, 25 bp, Homo sapien
gaggtacttttatgaggcagaacag

SEQ ID NO: 24603 - DNA, 25 bp, Homo sapien
gaatggtgattgccaatgctgcaga

SEQ ID NO: 24604 - DNA, 25 bp, Homo sapien
ctgtttacgggtacagaatttcagt

SEQ ID NO: 24605 - DNA, 25 bp, Homo sapien
tctggagatagatgacggtgatggc

SEQ ID NO: 24606 - DNA, 25 bp, Homo sapien
gaacccaggaagcggaagttgcagt

SEQ ID NO: 24607 - DNA, 25 bp, Homo sapien
gacagagggagactccgtctccaaa

SEQ ID NO: 24608 - DNA, 25 bp, Homo sapien
aaagttcaggccgggcacggtagct

SEQ ID NO: 24609 - DNA, 25 bp, Homo sapien
ggctgatgcaggtggatcaccggag

SEQ ID NO: 24610 - DNA, 25 bp, Homo sapien
caccggaggtcaggaactagaaatc

SEQ ID NO: 24611 - DNA, 25 bp, Homo sapien
ggaactagaaatcagcctggccaac

SEQ ID NO: 24612 - DNA, 25 bp, Homo sapien
ttagacaggtgtggtggtgcgtgcc

SEQ ID NO: 24613 - DNA, 25 bp, Homo sapien
gaagcagaaaaatcacttgaaccca

SEQ ID NO: 24614 - DNA, 25 bp, Homo sapien
tgagatcgtgccattgcattccagc

SEQ ID NO: 24615 - DNA, 25 bp, Homo sapien
cgacaagactgaaactctatccccc

SEQ ID NO: 24616 - DNA, 25 bp, Homo sapien
taagaaactatattaccagagcaag

SEQ ID NO: 24617 - DNA, 25 bp, Homo sapien
ggtccctagcaaggtatagatagcc

SEQ ID NO: 24618 - DNA, 25 bp, Homo sapien
ggtatagatagcctctgtgtcttag

SEQ ID NO: 24619 - DNA, 25 bp, Homo sapien
tagcctctgtgtcttaggatacccc

SEQ ID NO: 24620 - DNA, 25 bp, Homo sapien
cctctgtgtcttaggataccccggg

SEQ ID NO: 24621 - DNA, 25 bp, Homo sapien
tcttaggataccccgggtgctgttc

SEQ ID NO: 24622 - DNA, 25 bp, Homo sapien
tggagccctgcgggtgggggcaggg

SEQ ID NO: 24623 - DNA, 25 bp, Homo sapien
gggtgggggcagggcatgagttccc

SEQ ID NO: 24624 - DNA, 25 bp, Homo sapien
tgggggcagggcatgagttccccag

SEQ ID NO: 24625 - DNA, 25 bp, Homo sapien
ttccccagtccccaaggaaaggcag

SEQ ID NO: 24626 - DNA, 25 bp, Homo sapien
ccttggcggggaagattggctttgg

SEQ ID NO: 24627 - DNA, 25 bp, Homo sapien
acaggaagtcggcacatctccaggt

SEQ ID NO: 24628 - DNA, 25 bp, Homo sapien
aagagacccagttacagagctatgt

SEQ ID NO: 24629 - DNA, 25 bp, Homo sapien
gaatgtcaattctaggtaacgatcc

SEQ ID NO: 24630 - DNA, 25 bp, Homo sapien
aggtaacgatcctcaatgtcacagg

SEQ ID NO: 24631 - DNA, 25 bp, Homo sapien
tcaatgtcacaggtacttcacgtat

SEQ ID NO: 24632 - DNA, 25 bp, Homo sapien
cacgtattaatacctctttgccatt

SEQ ID NO: 24633 - DNA, 25 bp, Homo sapien
gccattatacatatgtccttctcca

SEQ ID NO: 24634 - DNA, 25 bp, Homo sapien
gtccttctccaaatgatggctcttt

SEQ ID NO: 24635 - DNA, 25 bp, Homo sapien
ttgtcttctaagctggttgtgtgga

SEQ ID NO: 24636 - DNA, 25 bp, Homo sapien
ctaccttccacattgtcttatagga

SEQ ID NO: 24637 - DNA, 25 bp, Homo sapien
atgactctaattacagcactctggg

SEQ ID NO: 24638 - DNA, 25 bp, Homo sapien
tagctggacctagtggtgggcgtct

SEQ ID NO: 24639 - DNA, 25 bp, Homo sapien
taaggtaactgagatctaggctgag

SEQ ID NO: 24640 - DNA, 25 bp, Homo sapien
gagatctaggctgagtaacttgcct

SEQ ID NO: 24641 - DNA, 25 bp, Homo sapien
acttgcctaaggctacccaggtagc

SEQ ID NO: 24642 - DNA, 25 bp, Homo sapien
cccaggtagcaagcagcagagctgg

SEQ ID NO: 24643 - DNA, 25 bp, Homo sapien
cctgggccttctgaatccaggctct

SEQ ID NO: 24644 - DNA, 25 bp, Homo sapien
ttctgaatccaggctctcaactagt

SEQ ID NO: 24645 - DNA, 25 bp, Homo sapien
ctctcaactagtaagccacatggct

SEQ ID NO: 24646 - DNA, 25 bp, Homo sapien
cacatggcttctttcattagctact

SEQ ID NO: 24647 - DNA, 25 bp, Homo sapien
ggcttctttcattagctacttgctc

SEQ ID NO: 24648 - DNA, 25 bp, Homo sapien
gctacttgctcaatacatatctatc

SEQ ID NO: 24649 - DNA, 25 bp, Homo sapien
taggggagcaggaatgggttagttt

SEQ ID NO: 24650 - DNA, 25 bp, Homo sapien
tttgcgtggcactctgcttttaatc

SEQ ID NO: 24651 - DNA, 25 bp, Homo sapien
tttaatcccttgttgaataagtgtt

SEQ ID NO: 24652 - DNA, 25 bp, Homo sapien
gtgttagaaaccttgatcttggccc

SEQ ID NO: 24653 - DNA, 25 bp, Homo sapien
tagaaaccttgatcttggccctata

SEQ ID NO: 24654 - DNA, 25 bp, Homo sapien
cttgatcttggccctatacctgatc

SEQ ID NO: 24655 - DNA, 25 bp, Homo sapien
ccctatacctgatcacctctaaaaa

SEQ ID NO: 24656 - DNA, 25 bp, Homo sapien
atacctgatcacctctaaaaacatg

SEQ ID NO: 24657 - DNA, 25 bp, Homo sapien
acaaaagtcactttatgttcttagt

SEQ ID NO: 24658 - DNA, 25 bp, Homo sapien
gtcactttatgttcttagtaaatat

SEQ ID NO: 24659 - DNA, 25 bp, Homo sapien
taaatatttctaatggggttatagg

SEQ ID NO: 24660 - DNA, 25 bp, Homo sapien
ggggttataggagatctaagtacaa

SEQ ID NO: 24661 - DNA, 25 bp, Homo sapien
ttgtagctttctggttatttaattt

SEQ ID NO: 24662 - DNA, 25 bp, Homo sapien
tcagttactggtttatagttacttt

SEQ ID NO: 24663 - DNA, 25 bp, Homo sapien
gttatttagttgttcattttcagtt

SEQ ID NO: 24664 - DNA, 25 bp, Homo sapien
gttatttatatgtagttgttttgtt

SEQ ID NO: 24665 - DNA, 25 bp, Homo sapien
ggagttacagatgttcaaattaatt

SEQ ID NO: 24666 - DNA, 25 bp, Homo sapien
tatttatttttcgagacggagtctc

SEQ ID NO: 24667 - DNA, 25 bp, Homo sapien
ttatctttacaattattatctgagt

SEQ ID NO: 24668 - DNA, 25 bp, Homo sapien
ttatctgagttatttaccttcatag

SEQ ID NO: 24669 - DNA, 25 bp, Homo sapien
tatttaccttcatagttatttcact

SEQ ID NO: 24670 - DNA, 25 bp, Homo sapien
gttatttcactttatcttattggag

SEQ ID NO: 24671 - DNA, 25 bp, Homo sapien
tatcttattggagtttttgagttat

SEQ ID NO: 24672 - DNA, 25 bp, Homo sapien
tcttttttttgctctgtgtagcaga

SEQ ID NO: 24673 - DNA, 25 bp, Homo sapien
tccatagttcccacccaggattaga

SEQ ID NO: 24674 - DNA, 25 bp, Homo sapien
gcagacatgtctgtacttgaaatca

SEQ ID NO: 24675 - DNA, 25 bp, Homo sapien
aacagagtgaacagccatataccag

SEQ ID NO: 24676 - DNA, 25 bp, Homo sapien
ttggaaatgcagtctctctcatact

SEQ ID NO: 24677 - DNA, 25 bp, Homo sapien
gtctctctcatactgggtttaactc

SEQ ID NO: 24678 - DNA, 25 bp, Homo sapien
catactgggtttaactccatttgtt

SEQ ID NO: 24679 - DNA, 25 bp, Homo sapien
tttgttttccgactttctcaagcta

SEQ ID NO: 24680 - DNA, 25 bp, Homo sapien
tccgactttctcaagctacagactt

SEQ ID NO: 24681 - DNA, 25 bp, Homo sapien
gacttggaacaactcacagcacatt

SEQ ID NO: 24682 - DNA, 25 bp, Homo sapien
agcacattctgcttcagaactttat

SEQ ID NO: 24683 - DNA, 25 bp, Homo sapien
cgccctcatgtgtctacagatggta

SEQ ID NO: 24684 - DNA, 25 bp, Homo sapien
ccctcatgtgtctacagatggtaaa

SEQ ID NO: 24685 - DNA, 25 bp, Homo sapien
tttatttctcaacagacattccagt

SEQ ID NO: 24686 - DNA, 25 bp, Homo sapien
cagacattccagtgatagcatccaa

SEQ ID NO: 24687 - DNA, 25 bp, Homo sapien
tccagtgatagcatccaatgaccta

SEQ ID NO: 24688 - DNA, 25 bp, Homo sapien
gtgatagcatccaatgacctatgta

SEQ ID NO: 24689 - DNA, 25 bp, Homo sapien
agcatccaatgacctatgtaacggc

SEQ ID NO: 24690 - DNA, 25 bp, Homo sapien
caatgacctatgtaacggcaccctt

SEQ ID NO: 24691 - DNA, 25 bp, Homo sapien
tatgtaacggcacccttttttgctg

SEQ ID NO: 24692 - DNA, 25 bp, Homo sapien
ttttttgctgtacgcgttttttgag

SEQ ID NO: 24693 - DNA, 25 bp, Homo sapien
tgctgtacgcgttttttgagatgga

SEQ ID NO: 24694 - DNA, 25 bp, Homo sapien
ctcccctcacccagagaaatacatg

SEQ ID NO: 24695 - DNA, 25 bp, Homo sapien
atcatgtccctgaaacgaatgctgg

SEQ ID NO: 24696 - DNA, 25 bp, Homo sapien
ttggagtccccaagactcacctaga

SEQ ID NO: 24697 - DNA, 25 bp, Homo sapien
ttggagaggtgtccagtggctccgg

SEQ ID NO: 24698 - DNA, 25 bp, Homo sapien
agtggctccggggagacgttcagct

SEQ ID NO: 24699 - DNA, 25 bp, Homo sapien
ttcagctaccctgactttctcagga

SEQ ID NO: 24700 - DNA, 25 bp, Homo sapien
gctgggcaagagatctgccatccta

SEQ ID NO: 24701 - DNA, 25 bp, Homo sapien
ccccccagccaagaaagctatctct

SEQ ID NO: 24702 - DNA, 25 bp, Homo sapien
aagctatctctgagttgccctgatt

SEQ ID NO: 24703 - DNA, 25 bp, Homo sapien
ggggcttctaatgacccagatatgg

SEQ ID NO: 24704 - DNA, 25 bp, Homo sapien
tgctgaaaaccctccagtcagcgct

SEQ ID NO: 24705 - DNA, 25 bp, Homo sapien
ggtaacgtgcttatcatgggagtgt

SEQ ID NO: 24706 - DNA, 25 bp, Homo sapien
acgtgcttatcatgggagtgttttg

SEQ ID NO: 24707 - DNA, 25 bp, Homo sapien
gaaacttagccaaagcttcagcaga

SEQ ID NO: 24708 - DNA, 25 bp, Homo sapien
aagaccagagagttcttcaccacaa

SEQ ID NO: 24709 - DNA, 25 bp, Homo sapien
tctcatcaaacaaggccattttgca

SEQ ID NO: 24710 - DNA, 25 bp, Homo sapien
gttttgatgggaaatcactaggcat

SEQ ID NO: 24711 - DNA, 25 bp, Homo sapien
ttcagggcagtacatttttctcaag

SEQ ID NO: 24712 - DNA, 25 bp, Homo sapien
gataaattcccagaactctcagttc

SEQ ID NO: 24713 - DNA, 25 bp, Homo sapien
aagtgtcttgaatgctatagagcta

SEQ ID NO: 24714 - DNA, 25 bp, Homo sapien
ctcatgttgacttaatgctgactta

SEQ ID NO: 24715 - DNA, 25 bp, Homo sapien
gatacaaattttgtttatagccctt

SEQ ID NO: 24716 - DNA, 25 bp, Homo sapien
tgtttacttctttggcctttttgat

SEQ ID NO: 24717 - DNA, 25 bp, Homo sapien
tacttctttggcctttttgatgaca

SEQ ID NO: 24718 - DNA, 25 bp, Homo sapien
tctttggcctttttgatgacaattc

SEQ ID NO: 24719 - DNA, 25 bp, Homo sapien
gcctttttgatgacaattcagccct

SEQ ID NO: 24720 - DNA, 25 bp, Homo sapien
ctttttgatgacaattcagcccttc

SEQ ID NO: 24721 - DNA, 25 bp, Homo sapien
cccacaggaagaggtcaagagctat

SEQ ID NO: 24722 - DNA, 25 bp, Homo sapien
gaggtcaagagctattggcctccac

SEQ ID NO: 24723 - DNA, 25 bp, Homo sapien
tgcttggtcctgcctagcaaggaat

SEQ ID NO: 24724 - DNA, 25 bp, Homo sapien
ttggtcctgcctagcaaggaatccc

SEQ ID NO: 24725 - DNA, 25 bp, Homo sapien
cctgcctagcaaggaatcccagcac

SEQ ID NO: 24726 - DNA, 25 bp, Homo sapien
tcgagccattgcacttcagactggg

SEQ ID NO: 24727 - DNA, 25 bp, Homo sapien
accctgagttgcacatatgacacca

SEQ ID NO: 24728 - DNA, 25 bp, Homo sapien
gcagatgattctcgttattcgccaa

SEQ ID NO: 24729 - DNA, 25 bp, Homo sapien
gaatcgtttctctgtgaacttccag

SEQ ID NO: 24730 - DNA, 25 bp, Homo sapien
agaaagcagccaaatccttcagtct

SEQ ID NO: 24731 - DNA, 25 bp, Homo sapien
ggagccaatagtaagctgacatttg

SEQ ID NO: 24732 - DNA, 25 bp, Homo sapien
tgagtgttagaccagatatccagaa

SEQ ID NO: 24733 - DNA, 25 bp, Homo sapien
ccgtgtaccagctgagagactctaa

SEQ ID NO: 24734 - DNA, 25 bp, Homo sapien
tgacaagtctgtctgcctattcacc

SEQ ID NO: 24735 - DNA, 25 bp, Homo sapien
gcctattcaccgattttgattctca

SEQ ID NO: 24736 - DNA, 25 bp, Homo sapien
ggggcttgagccaacaaattgactt

SEQ ID NO: 24737 - DNA, 25 bp, Homo sapien
acagtcactcagtctcaaccagaga

SEQ ID NO: 24738 - DNA, 25 bp, Homo sapien
aagttgagccaaactctttgtgtat

SEQ ID NO: 24739 - DNA, 25 bp, Homo sapien
tatcacctttgatgtaagtacctat

SEQ ID NO: 24740 - DNA, 25 bp, Homo sapien
gtacctatgtattgtatggtcacca

SEQ ID NO: 24741 - DNA, 25 bp, Homo sapien
gtatatttttgtggattgccgccaa

SEQ ID NO: 24742 - DNA, 25 bp, Homo sapien
gattgccgccaatctggggggaaaa

SEQ ID NO: 24743 - DNA, 25 bp, Homo sapien
gcgaggtcctttattaagtattcac

SEQ ID NO: 24744 - DNA, 25 bp, Homo sapien
taattattagcccagttttttcaga

SEQ ID NO: 24745 - DNA, 25 bp, Homo sapien
agcccagttttttcagaggattgta

SEQ ID NO: 24746 - DNA, 25 bp, Homo sapien
ttctcccctcactggtggtgaatgt

SEQ ID NO: 24747 - DNA, 25 bp, Homo sapien
attgtaatctttgtgctgtatgggt

SEQ ID NO: 24748 - DNA, 25 bp, Homo sapien
gctgtatgggttgagcatcattata

SEQ ID NO: 24749 - DNA, 25 bp, Homo sapien
aagacgacagaaggggacagaggca

SEQ ID NO: 24750 - DNA, 25 bp, Homo sapien
gacgacagaaggggacagaggcaag

SEQ ID NO: 24751 - DNA, 25 bp, Homo sapien
gacagaaggggacagaggcaagaaa

SEQ ID NO: 24752 - DNA, 25 bp, Homo sapien
gaaggggacagaggcaagaaaagat

SEQ ID NO: 24753 - DNA, 25 bp, Homo sapien
gaggcaagaaaagatgttgatcaag

SEQ ID NO: 24754 - DNA, 25 bp, Homo sapien
aagaaagatgagaaccaggggtgag

SEQ ID NO: 24755 - DNA, 25 bp, Homo sapien
gatgagaaccaggggtgagggctga

SEQ ID NO: 24756 - DNA, 25 bp, Homo sapien
gagaaccaggggtgagggctgaagg

SEQ ID NO: 24757 - DNA, 25 bp, Homo sapien
gaaccaggggtgagggctgaaggag

SEQ ID NO: 24758 - DNA, 25 bp, Homo sapien
ggggtgagggctgaaggagaatcaa

SEQ ID NO: 24759 - DNA, 25 bp, Homo sapien
gagggctgaaggagaatcaaagata

SEQ ID NO: 24760 - DNA, 25 bp, Homo sapien
tccttttctctactttgtaatttat

SEQ ID NO: 24761 - DNA, 25 bp, Homo sapien
tctggctccggggtttgcatgggag

SEQ ID NO: 24762 - DNA, 25 bp, Homo sapien
ctggctccggggtttgcatgggaga

SEQ ID NO: 24763 - DNA, 25 bp, Homo sapien
ggctccggggtttgcatgggagaat

SEQ ID NO: 24764 - DNA, 25 bp, Homo sapien
ccggggtttgcatgggagaatcctc

SEQ ID NO: 24765 - DNA, 25 bp, Homo sapien
ggggtttgcatgggagaatcctctt

SEQ ID NO: 24766 - DNA, 25 bp, Homo sapien
gtttgcatgggagaatcctctttcc

SEQ ID NO: 24767 - DNA, 25 bp, Homo sapien
ttgcatgggagaatcctctttccac

SEQ ID NO: 24768 - DNA, 25 bp, Homo sapien
tgcatgggagaatcctctttccacg

SEQ ID NO: 24769 - DNA, 25 bp, Homo sapien
tccacgatgccgctgggcgacgtgg

SEQ ID NO: 24770 - DNA, 25 bp, Homo sapien
ccacgatgccgctgggcgacgtggc

SEQ ID NO: 24771 - DNA, 25 bp, Homo sapien
gcaagatggtgttgcagacccaggt

SEQ ID NO: 24772 - DNA, 25 bp, Homo sapien
gtgcctacggggacatcgtgatgac

SEQ ID NO: 24773 - DNA, 25 bp, Homo sapien
tacggggacatcgtgatgacccagt

SEQ ID NO: 24774 - DNA, 25 bp, Homo sapien
gccagagtgttttatacagctccaa

SEQ ID NO: 24775 - DNA, 25 bp, Homo sapien
acagctccaacaataagaactactt

SEQ ID NO: 24776 - DNA, 25 bp, Homo sapien
ataagaactacttagcttggtacca

SEQ ID NO: 24777 - DNA, 25 bp, Homo sapien
agaaaccaggacagcctcctaagct

SEQ ID NO: 24778 - DNA, 25 bp, Homo sapien
ctcatttactgggcatctacccggg

SEQ ID NO: 24779 - DNA, 25 bp, Homo sapien
tgggcatctacccgggaatccgggg

SEQ ID NO: 24780 - DNA, 25 bp, Homo sapien
tccctgaccgattcagtggcagcgg

SEQ ID NO: 24781 - DNA, 25 bp, Homo sapien
gtggcagcgggtctgggacagattt

SEQ ID NO: 24782 - DNA, 25 bp, Homo sapien
ttgactgcttccatgttggcatctg

SEQ ID NO: 24783 - DNA, 25 bp, Homo sapien
atgttgggtgaacggctgtttcctc

SEQ ID NO: 24784 - DNA, 25 bp, Homo sapien
gtttcctcttattcaagccatgcac

SEQ ID NO: 24785 - DNA, 25 bp, Homo sapien
gcaccctactcttgctggtaaaatc

SEQ ID NO: 24786 - DNA, 25 bp, Homo sapien
gaacttcttcatatgctcgagtctc

SEQ ID NO: 24787 - DNA, 25 bp, Homo sapien
tatgctcgagtctccagagtcactc

SEQ ID NO: 24788 - DNA, 25 bp, Homo sapien
gagtcactccgttctaaggttgatg

SEQ ID NO: 24789 - DNA, 25 bp, Homo sapien
gctgtagctgtactacaagcccacc

SEQ ID NO: 24790 - DNA, 25 bp, Homo sapien
aagcagttaacagtgccaccggtgt

SEQ ID NO: 24791 - DNA, 25 bp, Homo sapien
agcttttccctctgattgatcaggg

SEQ ID NO: 24792 - DNA, 25 bp, Homo sapien
gtaccgagcaaatgccaggtctagc

SEQ ID NO: 24793 - DNA, 25 bp, Homo sapien
ttggcagttactggtcattggcaac

SEQ ID NO: 24794 - DNA, 25 bp, Homo sapien
ggcaaccagaacctcctgatttgtt

SEQ ID NO: 24795 - DNA, 25 bp, Homo sapien
gaacctcctgatttgtttacctgtt

SEQ ID NO: 24796 - DNA, 25 bp, Homo sapien
acctgtttcctcttagacatttcat

SEQ ID NO: 24797 - DNA, 25 bp, Homo sapien
catcaatatctgtcttctttgctct

SEQ ID NO: 24798 - DNA, 25 bp, Homo sapien
gctcttgacagcacccggtaagaat

SEQ ID NO: 24799 - DNA, 25 bp, Homo sapien
aatccagcaggcctcaaaggtcaaa

SEQ ID NO: 24800 - DNA, 25 bp, Homo sapien
ggcagagaaccatgagtccaggtct

SEQ ID NO: 24801 - DNA, 25 bp, Homo sapien
tttgccatgcatgaatcagccaatg

SEQ ID NO: 24802 - DNA, 25 bp, Homo sapien
gttgcctttcttgtctcaaagattc

SEQ ID NO: 24803 - DNA, 25 bp, Homo sapien
aagattctgtaccaactgggcgtgg

SEQ ID NO: 24804 - DNA, 25 bp, Homo sapien
atgaggccaggggcagtggctctct

SEQ ID NO: 24805 - DNA, 25 bp, Homo sapien
ccaacacttcaggaaagccgggagg

SEQ ID NO: 24806 - DNA, 25 bp, Homo sapien
gaaagccgggaggaaggatcgctta

SEQ ID NO: 24807 - DNA, 25 bp, Homo sapien
gaaggatcgcttaaggacaggagtt

SEQ ID NO: 24808 - DNA, 25 bp, Homo sapien
agcctaagcaacagatccagaccct

SEQ ID NO: 24809 - DNA, 25 bp, Homo sapien
ggtgtggtggcgtacacctttggtc

SEQ ID NO: 24810 - DNA, 25 bp, Homo sapien
gaaggaggaggattgctggagccca

SEQ ID NO: 24811 - DNA, 25 bp, Homo sapien
gagccatgactgtgacactgcactc

SEQ ID NO: 24812 - DNA, 25 bp, Homo sapien
gaaaacatgaccaggcatggtggct

SEQ ID NO: 24813 - DNA, 25 bp, Homo sapien
cccaggaggtggagtttgcagtagg

SEQ ID NO: 24814 - DNA, 25 bp, Homo sapien
tttgcagtaggccaagatcgcacca

SEQ ID NO: 24815 - DNA, 25 bp, Homo sapien
ggttaaatctttctggttaccatat

SEQ ID NO: 24816 - DNA, 25 bp, Homo sapien
gagaatcttgacttgttctgcctgc

SEQ ID NO: 24817 - DNA, 25 bp, Homo sapien
tgcttgcacctgcttttcttagagt

SEQ ID NO: 24818 - DNA, 25 bp, Homo sapien
cacctgcttttcttagagtcctaac

SEQ ID NO: 24819 - DNA, 25 bp, Homo sapien
ttagagtcctaacctctcaactcag

SEQ ID NO: 24820 - DNA, 25 bp, Homo sapien
ctctcaactcaggtgcaaggaagca

SEQ ID NO: 24821 - DNA, 25 bp, Homo sapien
gagtttgactacttttgtgggtact

SEQ ID NO: 24822 - DNA, 25 bp, Homo sapien
gtgggtactgaagacctagcttatt

SEQ ID NO: 24823 - DNA, 25 bp, Homo sapien
aagacctagcttattgtaacaacaa

SEQ ID NO: 24824 - DNA, 25 bp, Homo sapien
aaatcagtgtccaatatgcgctcta

SEQ ID NO: 24825 - DNA, 25 bp, Homo sapien
atgcgctctaaatataatctggtta

SEQ ID NO: 24826 - DNA, 25 bp, Homo sapien
ggtctaatctcttttgtgtttttgt

SEQ ID NO: 24827 - DNA, 25 bp, Homo sapien
gcccggctgcgtagcagttgagtga

SEQ ID NO: 24828 - DNA, 25 bp, Homo sapien
aaggtggcctgttgcagtgcagagt

SEQ ID NO: 24829 - DNA, 25 bp, Homo sapien
gtgcagagtgctgagctgcttcctg

SEQ ID NO: 24830 - DNA, 25 bp, Homo sapien
ttcttctgattgctcctggggaaaa

SEQ ID NO: 24831 - DNA, 25 bp, Homo sapien
ggaaaacacgccttgtcctgaagaa

SEQ ID NO: 24832 - DNA, 25 bp, Homo sapien
taaaatgcctgtcaactgcacttcc

SEQ ID NO: 24833 - DNA, 25 bp, Homo sapien
gcagtgagcacatctagctgacgat

SEQ ID NO: 24834 - DNA, 25 bp, Homo sapien
agctgacgataatcacaccttttcc

SEQ ID NO: 24835 - DNA, 25 bp, Homo sapien
tacgctaaccattgtttctgtagtt

SEQ ID NO: 24836 - DNA, 25 bp, Homo sapien
tgttttcttggtgttatcttttctc

SEQ ID NO: 24837 - DNA, 25 bp, Homo sapien
tccccagcccttagcacagagaggg

SEQ ID NO: 24838 - DNA, 25 bp, Homo sapien
acagagagggacacatgcccctccc

SEQ ID NO: 24839 - DNA, 25 bp, Homo sapien
ccccagctgcgtttttttatagtag

SEQ ID NO: 24840 - DNA, 25 bp, Homo sapien
tttctgtggatacagtgcccaccgc

SEQ ID NO: 24841 - DNA, 25 bp, Homo sapien
ccacttggaaacggtatcctccctg

SEQ ID NO: 24842 - DNA, 25 bp, Homo sapien
agagggaggggacagaggccctgcc

SEQ ID NO: 24843 - DNA, 25 bp, Homo sapien
gcctcctgctctctggaggtactga

SEQ ID NO: 24844 - DNA, 25 bp, Homo sapien
ggaggtactgagacagggtgctgat

SEQ ID NO: 24845 - DNA, 25 bp, Homo sapien
gacagggtgctgatgggaaggaggg

SEQ ID NO: 24846 - DNA, 25 bp, Homo sapien
ctgctcccctttgggggtgtgtgtg

SEQ ID NO: 24847 - DNA, 25 bp, Homo sapien
agaaataccagaggtcaccccatca

SEQ ID NO: 24848 - DNA, 25 bp, Homo sapien
gccaaggcaagcagatcacctgaag

SEQ ID NO: 24849 - DNA, 25 bp, Homo sapien
acctgaagtcaggagagaccagcct

SEQ ID NO: 24850 - DNA, 25 bp, Homo sapien
tggccagcatagtgaaaccccatct

SEQ ID NO: 24851 - DNA, 25 bp, Homo sapien
aaaatacaaacttagctgggcttag

SEQ ID NO: 24852 - DNA, 25 bp, Homo sapien
gctgggcttagtggtgcatgcctgt

SEQ ID NO: 24853 - DNA, 25 bp, Homo sapien
gcttgaatccaagaggcagaggttc

SEQ ID NO: 24854 - DNA, 25 bp, Homo sapien
ggagatcattccattacactccagc

SEQ ID NO: 24855 - DNA, 25 bp, Homo sapien
ctgggcaccaggaacgaaactcgtt

SEQ ID NO: 24856 - DNA, 25 bp, Homo sapien
aaaacgttggctgggcatggtggct

SEQ ID NO: 24857 - DNA, 25 bp, Homo sapien
gaggcaggtggattacttaaggtca

SEQ ID NO: 24858 - DNA, 25 bp, Homo sapien
gaacccaggtggtggaggctgcagt

SEQ ID NO: 24859 - DNA, 25 bp, Homo sapien
aatcagaccttgctaaacatcagag

SEQ ID NO: 24860 - DNA, 25 bp, Homo sapien
gcaggaaaaccttctctcaaaagtc

SEQ ID NO: 24861 - DNA, 25 bp, Homo sapien
gaaatttccagccacaagtcagcct

SEQ ID NO: 24862 - DNA, 25 bp, Homo sapien
cagcctccataatgcctcagagtct

SEQ ID NO: 24863 - DNA, 25 bp, Homo sapien
gcctcagagtcttcacactgtggag

SEQ ID NO: 24864 - DNA, 25 bp, Homo sapien
gaagggcctgttgacatcctgaatg

SEQ ID NO: 24865 - DNA, 25 bp, Homo sapien
tcaataactatccacaaactcgcct

SEQ ID NO: 24866 - DNA, 25 bp, Homo sapien
aaactcgccttatgttactccaaag

SEQ ID NO: 24867 - DNA, 25 bp, Homo sapien
ggggataaacccatagactacaaca

SEQ ID NO: 24868 - DNA, 25 bp, Homo sapien
gactacaacaactataggatggctt

SEQ ID NO: 24869 - DNA, 25 bp, Homo sapien
ggattatgttagcgtttacactgag

SEQ ID NO: 24870 - DNA, 25 bp, Homo sapien
tcccctgcgtcacactgtgtgaggc

SEQ ID NO: 24871 - DNA, 25 bp, Homo sapien
actgtgtgaggctgtgtctctgcca

SEQ ID NO: 24872 - DNA, 25 bp, Homo sapien
gtctctgccatccaaaagggggccc

SEQ ID NO: 24873 - DNA, 25 bp, Homo sapien
cttcaagctgctgctgtttgacctg

SEQ ID NO: 24874 - DNA, 25 bp, Homo sapien
gactgggggacgagaggccaccagc

SEQ ID NO: 24875 - DNA, 25 bp, Homo sapien
tggggggaagggtcttacctcagca

SEQ ID NO: 24876 - DNA, 25 bp, Homo sapien
acaggcctggtgctcaagatctgcc

SEQ ID NO: 24877 - DNA, 25 bp, Homo sapien
tccttcctccagtcttggagcattt

SEQ ID NO: 24878 - DNA, 25 bp, Homo sapien
ttttttgcaggtgacctgcctcctc

SEQ ID NO: 24879 - DNA, 25 bp, Homo sapien
ctcctctgcaggctggagctgcctg

SEQ ID NO: 24880 - DNA, 25 bp, Homo sapien
gagctgcctgagggcagggctctac

SEQ ID NO: 24881 - DNA, 25 bp, Homo sapien
ggaggagagacagggcagcccagct

SEQ ID NO: 24882 - DNA, 25 bp, Homo sapien
cagcccagctggggggtcaggatag

SEQ ID NO: 24883 - DNA, 25 bp, Homo sapien
gatagacgacattgtgggtcacagg

SEQ ID NO: 24884 - DNA, 25 bp, Homo sapien
gccccgtgtgatttgtttcattgtt

SEQ ID NO: 24885 - DNA, 25 bp, Homo sapien
tccacgtggccgttatccacaaaga

SEQ ID NO: 24886 - DNA, 25 bp, Homo sapien
aaagatgtggagatggtccggctgc

SEQ ID NO: 24887 - DNA, 25 bp, Homo sapien
tccggctgctccgagatgctggagc

SEQ ID NO: 24888 - DNA, 25 bp, Homo sapien
agctgaccttgacaaaccggagccc

SEQ ID NO: 24889 - DNA, 25 bp, Homo sapien
gcccccttcatttggcagtggaggc

SEQ ID NO: 24890 - DNA, 25 bp, Homo sapien
ggcagccgatgtgctggagcttctc

SEQ ID NO: 24891 - DNA, 25 bp, Homo sapien
gcccctgcagcagcagtagcgacag

SEQ ID NO: 24892 - DNA, 25 bp, Homo sapien
gcaccccttaggaatgcacacgtgg

SEQ ID NO: 24893 - DNA, 25 bp, Homo sapien
taggaatgcacacgtggggtcctca

SEQ ID NO: 24894 - DNA, 25 bp, Homo sapien
cacacgtggggtcctcaagaggtta

SEQ ID NO: 24895 - DNA, 25 bp, Homo sapien
ggtcctcaagaggttacatgcaaac

SEQ ID NO: 24896 - DNA, 25 bp, Homo sapien
tacatgcaaactaaccccagcagca

SEQ ID NO: 24897 - DNA, 25 bp, Homo sapien
gcagcacacagagaaggcgcataag

SEQ ID NO: 24898 - DNA, 25 bp, Homo sapien
agagaaggcgcataagccgcgacca

SEQ ID NO: 24899 - DNA, 25 bp, Homo sapien
cccgagtccgtggcaggaaccagag

SEQ ID NO: 24900 - DNA, 25 bp, Homo sapien
cgtggcaggaaccagaggccacatg

SEQ ID NO: 24901 - DNA, 25 bp, Homo sapien
cacatgtggctgctcgtatttaagt

SEQ ID NO: 24902 - DNA, 25 bp, Homo sapien
gtggctgctcgtatttaagttaatt

SEQ ID NO: 24903 - DNA, 25 bp, Homo sapien
ctgagcttacagactaagaaggcag

SEQ ID NO: 24904 - DNA, 25 bp, Homo sapien
ggcagaaaagctttacaactacaga

SEQ ID NO: 24905 - DNA, 25 bp, Homo sapien
gtatacacacaaccaacctaaacac

SEQ ID NO: 24906 - DNA, 25 bp, Homo sapien
acaaccaacctaaacacatcagaga

SEQ ID NO: 24907 - DNA, 25 bp, Homo sapien
atacatacttaaatcaattcacttc

SEQ ID NO: 24908 - DNA, 25 bp, Homo sapien
aattcacttcatatacacatctcat

SEQ ID NO: 24909 - DNA, 25 bp, Homo sapien
cacttcatatacacatctcattaga

SEQ ID NO: 24910 - DNA, 25 bp, Homo sapien
gaagaccaagctaaacttcacttag

SEQ ID NO: 24911 - DNA, 25 bp, Homo sapien
aaattatgagtgtctaagtatctta

SEQ ID NO: 24912 - DNA, 25 bp, Homo sapien
ctaagtatcttagttatgcttcata

SEQ ID NO: 24913 - DNA, 25 bp, Homo sapien
cataagatctgactggggtaagaga

SEQ ID NO: 24914 - DNA, 25 bp, Homo sapien
gaagcaggagaatcacttcagcccg

SEQ ID NO: 24915 - DNA, 25 bp, Homo sapien
gcactcgcgtctgggcgacagagtg

SEQ ID NO: 24916 - DNA, 25 bp, Homo sapien
tagtccagaaaaacatctcacagct

SEQ ID NO: 24917 - DNA, 25 bp, Homo sapien
cacagctgaagtggtctcatgggaa

SEQ ID NO: 24918 - DNA, 25 bp, Homo sapien
gggaagggagaacagcactgcccaa

SEQ ID NO: 24919 - DNA, 25 bp, Homo sapien
agcactgcccaataggaatgctata

SEQ ID NO: 24920 - DNA, 25 bp, Homo sapien
ttagattttccaggagccacattaa

SEQ ID NO: 24921 - DNA, 25 bp, Homo sapien
gaatgtattttatgccaggtgtggt

SEQ ID NO: 24922 - DNA, 25 bp, Homo sapien
aagcaggagaaacgcttcagcgatt

SEQ ID NO: 24923 - DNA, 25 bp, Homo sapien
ggaggcagaggttgtggtgagttga

SEQ ID NO: 24924 - DNA, 25 bp, Homo sapien
ggtgagttgagatcatgccactgta

SEQ ID NO: 24925 - DNA, 25 bp, Homo sapien
agaaactgttgccatgaccttactt

SEQ ID NO: 24926 - DNA, 25 bp, Homo sapien
gaccttactttgacttgtccacatt

SEQ ID NO: 24927 - DNA, 25 bp, Homo sapien
tgacttgtccacatttgccttgact

SEQ ID NO: 24928 - DNA, 25 bp, Homo sapien
tttgccttgactaggccacttctac

SEQ ID NO: 24929 - DNA, 25 bp, Homo sapien
ctacctcttggtagccattgctttg

SEQ ID NO: 24930 - DNA, 25 bp, Homo sapien
attgctttgattgtggtttgtcttc

SEQ ID NO: 24931 - DNA, 25 bp, Homo sapien
ggtactggtaaagtcctgttccatc

SEQ ID NO: 24932 - DNA, 25 bp, Homo sapien
ctgttccatctcctgttataattca

SEQ ID NO: 24933 - DNA, 25 bp, Homo sapien
tcagggtcttgatgccacttgttta

SEQ ID NO: 24934 - DNA, 25 bp, Homo sapien
tgggcacaacggttttggcacccat

SEQ ID NO: 24935 - DNA, 25 bp, Homo sapien
cgagtggaaagcttgctcaacttca

SEQ ID NO: 24936 - DNA, 25 bp, Homo sapien
ccaactcaggggtgcagatgtctcc

SEQ ID NO: 24937 - DNA, 25 bp, Homo sapien
ggggtgcagatgtctccctgcacca

SEQ ID NO: 24938 - DNA, 25 bp, Homo sapien
tccctgcaccatgccaggtgtggtg

SEQ ID NO: 24939 - DNA, 25 bp, Homo sapien
accatgccaggtgtggtgcagaatg

SEQ ID NO: 24940 - DNA, 25 bp, Homo sapien
ggtgtggtgcagaatgggaggcagg

SEQ ID NO: 24941 - DNA, 25 bp, Homo sapien
gggaggcagggggatggagcagaga

SEQ ID NO: 24942 - DNA, 25 bp, Homo sapien
ggagcagagagaggcctggactgcc

SEQ ID NO: 24943 - DNA, 25 bp, Homo sapien
agagagaggcctggactgcctgtgg

SEQ ID NO: 24944 - DNA, 25 bp, Homo sapien
ttttgagttctctagtgtctttatt

SEQ ID NO: 24945 - DNA, 25 bp, Homo sapien
ctagtgtctttattatccattcccg

SEQ ID NO: 24946 - DNA, 25 bp, Homo sapien
tggctgcccaactcaggggtgcaga

SEQ ID NO: 24947 - DNA, 25 bp, Homo sapien
aaaatgaatgtgaatctgcagatac

SEQ ID NO: 24948 - DNA, 25 bp, Homo sapien
ccaccagagccaagtgtttgagagt

SEQ ID NO: 24949 - DNA, 25 bp, Homo sapien
gagttttgtgtctcaatacctaggc

SEQ ID NO: 24950 - DNA, 25 bp, Homo sapien
tgtgtctcaatacctaggctcacat

SEQ ID NO: 24951 - DNA, 25 bp, Homo sapien
gcagctgggagaggtaggaaattag

SEQ ID NO: 24952 - DNA, 25 bp, Homo sapien
ggaggaatgtttgacgttacgtcat

SEQ ID NO: 24953 - DNA, 25 bp, Homo sapien
gacgttacgtcattaatctcagaca

SEQ ID NO: 24954 - DNA, 25 bp, Homo sapien
atctcagacatcttgtagattagga

SEQ ID NO: 24955 - DNA, 25 bp, Homo sapien
gtgacttggtcgaggtcatacacct

SEQ ID NO: 24956 - DNA, 25 bp, Homo sapien
gaggtcatacacctatatagtgaca

SEQ ID NO: 24957 - DNA, 25 bp, Homo sapien
gaagctagaggagtgccgagcgcag

SEQ ID NO: 24958 - DNA, 25 bp, Homo sapien
tgggtttatacctttctgattactt

SEQ ID NO: 24959 - DNA, 25 bp, Homo sapien
tatacctttctgattactttgctgt

SEQ ID NO: 24960 - DNA, 25 bp, Homo sapien
actttgctgtacactttaggatttc

SEQ ID NO: 24961 - DNA, 25 bp, Homo sapien
gaaggtattcaagtggtcatttatc

SEQ ID NO: 24962 - DNA, 25 bp, Homo sapien
agtggtcatttatctgaaacttctg

SEQ ID NO: 24963 - DNA, 25 bp, Homo sapien
gaaacttctgactaattttcaaaca

SEQ ID NO: 24964 - DNA, 25 bp, Homo sapien
aatttttccttggtaatagcaacat

SEQ ID NO: 24965 - DNA, 25 bp, Homo sapien
acatgagcttagagtgccacattga

SEQ ID NO: 24966 - DNA, 25 bp, Homo sapien
gtgccacattgaagggactatctat

SEQ ID NO: 24967 - DNA, 25 bp, Homo sapien
gaaagatgccataaattttgaccaa

SEQ ID NO: 24968 - DNA, 25 bp, Homo sapien
ttgataattatctggctgggcatga

SEQ ID NO: 24969 - DNA, 25 bp, Homo sapien
aagatatctgtactagtctaggaga

SEQ ID NO: 24970 - DNA, 25 bp, Homo sapien
atacacagtatttgaggagcaggca

SEQ ID NO: 24971 - DNA, 25 bp, Homo sapien
gaagaaggctataaaaggtcaagaa

SEQ ID NO: 24972 - DNA, 25 bp, Homo sapien
aacagccagagctttgtgaccctga

SEQ ID NO: 24973 - DNA, 25 bp, Homo sapien
gagctttgtgaccctgaagtagata

SEQ ID NO: 24974 - DNA, 25 bp, Homo sapien
agctgtagaagccaatagaaaattt

SEQ ID NO: 24975 - DNA, 25 bp, Homo sapien
agtaagagatccttggccaggcgtg

SEQ ID NO: 24976 - DNA, 25 bp, Homo sapien
tgagaggctcaggtgggccgatcac

SEQ ID NO: 24977 - DNA, 25 bp, Homo sapien
tcaggtgggccgatcacttgagccc

SEQ ID NO: 24978 - DNA, 25 bp, Homo sapien
ccctgtctctacaaacaatgcaaaa

SEQ ID NO: 24979 - DNA, 25 bp, Homo sapien
gagccaagatggtgccactgcattc

SEQ ID NO: 24980 - DNA, 25 bp, Homo sapien
ggaagacctggagtttggcacagca

SEQ ID NO: 24981 - DNA, 25 bp, Homo sapien
gaggagcgtggggctgacacagctc

SEQ ID NO: 24982 - DNA, 25 bp, Homo sapien
gaaggggaaagccctgcggcagggc

SEQ ID NO: 24983 - DNA, 25 bp, Homo sapien
aggagcttgttgaagaagagccctc

SEQ ID NO: 24984 - DNA, 25 bp, Homo sapien
caaccctgttggaagaggagactga

SEQ ID NO: 24985 - DNA, 25 bp, Homo sapien
tgggagtgacaaggtgcagccccca

SEQ ID NO: 24986 - DNA, 25 bp, Homo sapien
cagagacacctgcagaagaagagat

SEQ ID NO: 24987 - DNA, 25 bp, Homo sapien
ggaaaaggagcaggatgacacagct

SEQ ID NO: 24988 - DNA, 25 bp, Homo sapien
tccccctgatgatgagaagccacca

SEQ ID NO: 24989 - DNA, 25 bp, Homo sapien
ctgatgatgagaagccaccacctcc

SEQ ID NO: 24990 - DNA, 25 bp, Homo sapien
tgtttccaataaagttatgtcctta

SEQ ID NO: 24991 - DNA, 25 bp, Homo sapien
atcgcccagcagcttgggctcgaga

SEQ ID NO: 24992 - DNA, 25 bp, Homo sapien
gatgtggtccgagtgtggttctgta

SEQ ID NO: 24993 - DNA, 25 bp, Homo sapien
gggcaagcgatcaagcagcgactat

SEQ ID NO: 24994 - DNA, 25 bp, Homo sapien
aggattttgaggctgctgggtctcc

SEQ ID NO: 24995 - DNA, 25 bp, Homo sapien
tctcagggggaccagtgtcctttcc

SEQ ID NO: 24996 - DNA, 25 bp, Homo sapien
ttggtaccccaggctatgggagccc

SEQ ID NO: 24997 - DNA, 25 bp, Homo sapien
tcagtccctttccctgagggggaag

SEQ ID NO: 24998 - DNA, 25 bp, Homo sapien
gcattcaaactgaggtgcctgccct

SEQ ID NO: 24999 - DNA, 25 bp, Homo sapien
gtgcctgcccttctaggaatgggga

SEQ ID NO: 25000 - DNA, 25 bp, Homo sapien
ggagtttgtggcagggttttgggat

SEQ ID NO: 25001 - DNA, 25 bp, Homo sapien
tggagaatttgttcctgcagtgccc

SEQ ID NO: 25002 - DNA, 25 bp, Homo sapien
cccaaagtcttagttgcagggcact

SEQ ID NO: 25003 - DNA, 25 bp, Homo sapien
gtaggagagcaatacctttgaaaag

SEQ ID NO: 25004 - DNA, 25 bp, Homo sapien
gttgtcaaaactaatactcgtgtat

SEQ ID NO: 25005 - DNA, 25 bp, Homo sapien
atttttgtcatttcacttttgtgga

SEQ ID NO: 25006 - DNA, 25 bp, Homo sapien
tgatgtgatcaggctgggtgcgttg

SEQ ID NO: 25007 - DNA, 25 bp, Homo sapien
atggtgaagccctgtttctactagg

SEQ ID NO: 25008 - DNA, 25 bp, Homo sapien
aagccctgtttctactaggaataca

SEQ ID NO: 25009 - DNA, 25 bp, Homo sapien
ggctgaagcaggagagtcgcttgaa

SEQ ID NO: 25010 - DNA, 25 bp, Homo sapien
gagtcgcttgaacttgggaggtgga

SEQ ID NO: 25011 - DNA, 25 bp, Homo sapien
cagtgagacgagattgcgccattgc

SEQ ID NO: 25012 - DNA, 25 bp, Homo sapien
ctccaggctgggcgacagagtgaga

SEQ ID NO: 25013 - DNA, 25 bp, Homo sapien
aaacttcttggtgataacacataga

SEQ ID NO: 25014 - DNA, 25 bp, Homo sapien
ataactgagcttgcaagagtgaggg

SEQ ID NO: 25015 - DNA, 25 bp, Homo sapien
ggaaatcccccaagggccaataatg

SEQ ID NO: 25016 - DNA, 25 bp, Homo sapien
gtatggcctgtggtataactgctct

SEQ ID NO: 25017 - DNA, 25 bp, Homo sapien
tgtggtataactgctctggggtgat

SEQ ID NO: 25018 - DNA, 25 bp, Homo sapien
gctctggggtgatgggaaagtttac

SEQ ID NO: 25019 - DNA, 25 bp, Homo sapien
tacagatttctgtaaccttggttta

SEQ ID NO: 25020 - DNA, 25 bp, Homo sapien
ggtttaagaaacagcctataggagg

SEQ ID NO: 25021 - DNA, 25 bp, Homo sapien
ggctgggagttagaactgaaaccct

SEQ ID NO: 25022 - DNA, 25 bp, Homo sapien
gcaaagtcaagactgcaacccggcc

SEQ ID NO: 25023 - DNA, 25 bp, Homo sapien
tggccaagacgatgaaatgccatct

SEQ ID NO: 25024 - DNA, 25 bp, Homo sapien
ttgtactgagctgagaccttgccac

SEQ ID NO: 25025 - DNA, 25 bp, Homo sapien
ttgtatttgtgcttacctgtgccag

SEQ ID NO: 25026 - DNA, 25 bp, Homo sapien
actgttctaggtaagcactaagtgg

SEQ ID NO: 25027 - DNA, 25 bp, Homo sapien
gtgggctttaatacagcatattcca

SEQ ID NO: 25028 - DNA, 25 bp, Homo sapien
gcatattccaatggggaatcccagg

SEQ ID NO: 25029 - DNA, 25 bp, Homo sapien
gaatcccaggaaccaaaagactaat

SEQ ID NO: 25030 - DNA, 25 bp, Homo sapien
aagactaattgtccaagtccacaac

SEQ ID NO: 25031 - DNA, 25 bp, Homo sapien
aattgtccaagtccacaactagaag

SEQ ID NO: 25032 - DNA, 25 bp, Homo sapien
gcagaaacaagcatcaaattccctg

SEQ ID NO: 25033 - DNA, 25 bp, Homo sapien
caagcatcaaattccctgctcagga

SEQ ID NO: 25034 - DNA, 25 bp, Homo sapien
aaattccctgctcaggaagaagcca

SEQ ID NO: 25035 - DNA, 25 bp, Homo sapien
aggttgcagtgtggtgagatcatgc

SEQ ID NO: 25036 - DNA, 25 bp, Homo sapien
tggtgagatcatgccactacactcc

SEQ ID NO: 25037 - DNA, 25 bp, Homo sapien
tctattacagtatgtcatgtttgct

SEQ ID NO: 25038 - DNA, 25 bp, Homo sapien
tcatgtttgctgtagtgctcatatt

SEQ ID NO: 25039 - DNA, 25 bp, Homo sapien
gtttgctgtagtgctcatatttatt

SEQ ID NO: 25040 - DNA, 25 bp, Homo sapien
tgtagtgctcatatttattgttgtt

SEQ ID NO: 25041 - DNA, 25 bp, Homo sapien
tgttgtttttgttttagtactcact

SEQ ID NO: 25042 - DNA, 25 bp, Homo sapien
ttgttttagtactcacttgtttcat

SEQ ID NO: 25043 - DNA, 25 bp, Homo sapien
tagtactcacttgtttcataatatc

SEQ ID NO: 25044 - DNA, 25 bp, Homo sapien
ggacttctaatctttttttcataat

SEQ ID NO: 25045 - DNA, 25 bp, Homo sapien
atatctttgacacatattacagaag

SEQ ID NO: 25046 - DNA, 25 bp, Homo sapien
tactgacgacgactgagacactgac

SEQ ID NO: 25047 - DNA, 25 bp, Homo sapien
ctgactccacttgcaatgatttcct

SEQ ID NO: 25048 - DNA, 25 bp, Homo sapien
cctgttcagaacctactccagacgg

SEQ ID NO: 25049 - DNA, 25 bp, Homo sapien
acctactccagacggagctcgggtt

SEQ ID NO: 25050 - DNA, 25 bp, Homo sapien
ctcgggtttttctgagctgtgtggc

SEQ ID NO: 25051 - DNA, 25 bp, Homo sapien
gctgtgtggctattgcatggtgttc

SEQ ID NO: 25052 - DNA, 25 bp, Homo sapien
tgcatggtgttcgggggaggtttat

SEQ ID NO: 25053 - DNA, 25 bp, Homo sapien
tgtttatcctgatagccactgaccc

SEQ ID NO: 25054 - DNA, 25 bp, Homo sapien
gaaagtcaattgcaggcttatctac

SEQ ID NO: 25055 - DNA, 25 bp, Homo sapien
ggcttatctacaatattagcaccat

SEQ ID NO: 25056 - DNA, 25 bp, Homo sapien
tgagttttcgtttaccttggagctt

SEQ ID NO: 25057 - DNA, 25 bp, Homo sapien
tgcctcaggtggtgtgcacctaccg

SEQ ID NO: 25058 - DNA, 25 bp, Homo sapien
cctcaggtggtgtgcacctaccgtg

SEQ ID NO: 25059 - DNA, 25 bp, Homo sapien
tcaggtggtgtgcacctaccgtgat

SEQ ID NO: 25060 - DNA, 25 bp, Homo sapien
tggtgtgcacctaccgtgatgtgcg

SEQ ID NO: 25061 - DNA, 25 bp, Homo sapien
tgtgcacctaccgtgatgtgcgctt

SEQ ID NO: 25062 - DNA, 25 bp, Homo sapien
acctctgactgtgggggtcccaaag

SEQ ID NO: 25063 - DNA, 25 bp, Homo sapien
ctctgactgtgggggtcccaaagac

SEQ ID NO: 25064 - DNA, 25 bp, Homo sapien
tgactgtgggggtcccaaagaccac

SEQ ID NO: 25065 - DNA, 25 bp, Homo sapien
ctgttgctgctgctgagcatgggcg

SEQ ID NO: 25066 - DNA, 25 bp, Homo sapien
tgctgagcatgggcggggcatgggc

SEQ ID NO: 25067 - DNA, 25 bp, Homo sapien
tgagcatgggcggggcatgggcatc

SEQ ID NO: 25068 - DNA, 25 bp, Homo sapien
tctaagaaggatagtcccccctaca

SEQ ID NO: 25069 - DNA, 25 bp, Homo sapien
catactgtcatactgctgggttttc

SEQ ID NO: 25070 - DNA, 25 bp, Homo sapien
tactgctgggttttcatgggtagga

SEQ ID NO: 25071 - DNA, 25 bp, Homo sapien
tgggtaggaaagcttgtcctgaccc

SEQ ID NO: 25072 - DNA, 25 bp, Homo sapien
gaggtggcaggtcgctaatgaatat

SEQ ID NO: 25073 - DNA, 25 bp, Homo sapien
ataatgtccttcttcattgctgaga

SEQ ID NO: 25074 - DNA, 25 bp, Homo sapien
gagagggcagccttagagctgtgga

SEQ ID NO: 25075 - DNA, 25 bp, Homo sapien
tagagctgtggatttctgcatcccc

SEQ ID NO: 25076 - DNA, 25 bp, Homo sapien
ccatggacacctgtttcattcactt

SEQ ID NO: 25077 - DNA, 25 bp, Homo sapien
gtttcattcactttagcatcacagt

SEQ ID NO: 25078 - DNA, 25 bp, Homo sapien
ctgtgtcaggcagtatgcttgtcct

SEQ ID NO: 25079 - DNA, 25 bp, Homo sapien
tagttcagtttaaaaggctcctctt

SEQ ID NO: 25080 - DNA, 25 bp, Homo sapien
ctcctcttaaaccttcctggataga

SEQ ID NO: 25081 - DNA, 25 bp, Homo sapien
taaaccttcctggatagaacatagg

SEQ ID NO: 25082 - DNA, 25 bp, Homo sapien
acataattggaatattgttcttttg

SEQ ID NO: 25083 - DNA, 25 bp, Homo sapien
tttgtattatagttactctgctaga

SEQ ID NO: 25084 - DNA, 25 bp, Homo sapien
agttactctgctagaatcgttttct

SEQ ID NO: 25085 - DNA, 25 bp, Homo sapien
agaatcgttttctttacatgcctct

SEQ ID NO: 25086 - DNA, 25 bp, Homo sapien
tttctttacatgcctctgtggtaaa

SEQ ID NO: 25087 - DNA, 25 bp, Homo sapien
gcctctgtggtaaatgttagctcta

SEQ ID NO: 25088 - DNA, 25 bp, Homo sapien
agctctatctggtgactcaaagttt

SEQ ID NO: 25089 - DNA, 25 bp, Homo sapien
agtttatggatcttttggccgggcg

SEQ ID NO: 25090 - DNA, 25 bp, Homo sapien
gaaattctacagagccccaatacct

SEQ ID NO: 25091 - DNA, 25 bp, Homo sapien
gagccccaataccttacagaatgat

SEQ ID NO: 25092 - DNA, 25 bp, Homo sapien
aagcgaataacttaatggcgtgagt

SEQ ID NO: 25093 - DNA, 25 bp, Homo sapien
atagctaggaattcccaagcaggta

SEQ ID NO: 25094 - DNA, 25 bp, Homo sapien
gaagggggacattccaggcaaagga

SEQ ID NO: 25095 - DNA, 25 bp, Homo sapien
gcaaaggtagggagtcatgaatcaa

SEQ ID NO: 25096 - DNA, 25 bp, Homo sapien
atgaatcaatatgttcggttttttt

SEQ ID NO: 25097 - DNA, 25 bp, Homo sapien
aaagagctataataggctgggcaca

SEQ ID NO: 25098 - DNA, 25 bp, Homo sapien
attatccctgttcagtggtgtgcgc

SEQ ID NO: 25099 - DNA, 25 bp, Homo sapien
gaggcgagaggagtgctcaaggtgg

SEQ ID NO: 25100 - DNA, 25 bp, Homo sapien
ggagtgctcaaggtgggaggtggag

SEQ ID NO: 25101 - DNA, 25 bp, Homo sapien
aggcccgtgtttgccaggtgaagac

SEQ ID NO: 25102 - DNA, 25 bp, Homo sapien
aggtgaagacatattgtgtacacac

SEQ ID NO: 25103 - DNA, 25 bp, Homo sapien
gtgtacacacagcttgttattttca

SEQ ID NO: 25104 - DNA, 25 bp, Homo sapien
attgcattttggattgaagctgtct

SEQ ID NO: 25105 - DNA, 25 bp, Homo sapien
gaagctgtctgatcaggtttgtgtt

SEQ ID NO: 25106 - DNA, 25 bp, Homo sapien
acaaatccttctatcagcagtgggg

SEQ ID NO: 25107 - DNA, 25 bp, Homo sapien
aagaccagtcagatggccgttgcag

SEQ ID NO: 25108 - DNA, 25 bp, Homo sapien
gatggccgttgcagcagttcaggca

SEQ ID NO: 25109 - DNA, 25 bp, Homo sapien
gcagcagttcaggcaaggacaatga

SEQ ID NO: 25110 - DNA, 25 bp, Homo sapien
atgaggcctaaattaagactgcgag

SEQ ID NO: 25111 - DNA, 25 bp, Homo sapien
agaatactaactggccggatgtggt

SEQ ID NO: 25112 - DNA, 25 bp, Homo sapien
tattcatgaattcttgcacattatg

SEQ ID NO: 25113 - DNA, 25 bp, Homo sapien
gagtccatgtggtcagtgtcttacc

SEQ ID NO: 25114 - DNA, 25 bp, Homo sapien
gtcagtgtcttacccggtgtagggt

SEQ ID NO: 25115 - DNA, 25 bp, Homo sapien
gtgtagggtaaatgcacctgatagc

SEQ ID NO: 25116 - DNA, 25 bp, Homo sapien
gcaataacttaagcacacctttata

SEQ ID NO: 25117 - DNA, 25 bp, Homo sapien
aagcacacctttataatgaccctat

SEQ ID NO: 25118 - DNA, 25 bp, Homo sapien
agatgctcctgaatgtgtgtttcga

SEQ ID NO: 25119 - DNA, 25 bp, Homo sapien
tcgagctagaaaatccgggagtggc

SEQ ID NO: 25120 - DNA, 25 bp, Homo sapien
tataatagacatctgagcccctggc

SEQ ID NO: 25121 - DNA, 25 bp, Homo sapien
aaacccaggctgtagagaggattga

SEQ ID NO: 25122 - DNA, 25 bp, Homo sapien
tgtaagacaattctatccagcccgc

SEQ ID NO: 25123 - DNA, 25 bp, Homo sapien
gtcatgaatgtggccatggccccgg

SEQ ID NO: 25124 - DNA, 25 bp, Homo sapien
cctgtccctgggcaggagtgctggt

SEQ ID NO: 25125 - DNA, 25 bp, Homo sapien
aggcctggagcctgtagggctggac

SEQ ID NO: 25126 - DNA, 25 bp, Homo sapien
ggctggactgaggttcaggtctccc

SEQ ID NO: 25127 - DNA, 25 bp, Homo sapien
ctttgtccccactctagagcaggga

SEQ ID NO: 25128 - DNA, 25 bp, Homo sapien
gtgggggaggagttgtgtctcgtct

SEQ ID NO: 25129 - DNA, 25 bp, Homo sapien
tcttctgtctccatgtggtttttgg

SEQ ID NO: 25130 - DNA, 25 bp, Homo sapien
gtttttcttgttgtgtcctggattc

SEQ ID NO: 25131 - DNA, 25 bp, Homo sapien
gcagtaccccagctcatgggggact

SEQ ID NO: 25132 - DNA, 25 bp, Homo sapien
ggactcagcaagcaagcgtggcacc

SEQ ID NO: 25133 - DNA, 25 bp, Homo sapien
ccatcttggatctgagccggtcgag

SEQ ID NO: 25134 - DNA, 25 bp, Homo sapien
gatccctgacctaatgttatcgcgg

SEQ ID NO: 25135 - DNA, 25 bp, Homo sapien
ctgcctgtgttggctgcatcgaaga

SEQ ID NO: 25136 - DNA, 25 bp, Homo sapien
gaagaggaggcccagggctcctcag

SEQ ID NO: 25137 - DNA, 25 bp, Homo sapien
gagcaggaactccactatgcatctc

SEQ ID NO: 25138 - DNA, 25 bp, Homo sapien
gcatctctgcagaggctgccagtgc

SEQ ID NO: 25139 - DNA, 25 bp, Homo sapien
gccagtgcccagcagtgagggacct

SEQ ID NO: 25140 - DNA, 25 bp, Homo sapien
caagagctgactatgcctgcattgc

SEQ ID NO: 25141 - DNA, 25 bp, Homo sapien
cttcctcaacccaggcgggtggaca

SEQ ID NO: 25142 - DNA, 25 bp, Homo sapien
catctcgagcctccgttcaaattga

SEQ ID NO: 25143 - DNA, 25 bp, Homo sapien
atgtggctttttgacctttgaatag

SEQ ID NO: 25144 - DNA, 25 bp, Homo sapien
caaggactagagttcctgacctcca

SEQ ID NO: 25145 - DNA, 25 bp, Homo sapien
ttagattcagattcctggtgcctcc

SEQ ID NO: 25146 - DNA, 25 bp, Homo sapien
cctgggaacagactcctgtagaccc

SEQ ID NO: 25147 - DNA, 25 bp, Homo sapien
ctagtctcctgagcctatagagccc

SEQ ID NO: 25148 - DNA, 25 bp, Homo sapien
tagagcccccaggagactgggaccc

SEQ ID NO: 25149 - DNA, 25 bp, Homo sapien
gggacccaaagaacttcacagcaca

SEQ ID NO: 25150 - DNA, 25 bp, Homo sapien
tcacagcacacttaccgaatgcaga

SEQ ID NO: 25151 - DNA, 25 bp, Homo sapien
tgcagagagcagctttcctggcttt

SEQ ID NO: 25152 - DNA, 25 bp, Homo sapien
gcagaggctctgaagcactttcctt

SEQ ID NO: 25153 - DNA, 25 bp, Homo sapien
tagcaacagcagctctgtacctcat

SEQ ID NO: 25154 - DNA, 25 bp, Homo sapien
tctgttgatcccacctttgaagagg

SEQ ID NO: 25155 - DNA, 25 bp, Homo sapien
gacacagtgctcaccttaattgcgc

SEQ ID NO: 25156 - DNA, 25 bp, Homo sapien
gccggacccgggaagaactggtgag

SEQ ID NO: 25157 - DNA, 25 bp, Homo sapien
agaactggtgagccaagggatcatg

SEQ ID NO: 25158 - DNA, 25 bp, Homo sapien
aggacagaggactatctcaaacgga

SEQ ID NO: 25159 - DNA, 25 bp, Homo sapien
aagccatcattggtgaggaggaccc

SEQ ID NO: 25160 - DNA, 25 bp, Homo sapien
ggggagggagtgccaggctgaagca

SEQ ID NO: 25161 - DNA, 25 bp, Homo sapien
gaattgggctgaggctcttgacttc

SEQ ID NO: 25162 - DNA, 25 bp, Homo sapien
tgaggctcttgacttcttaatcttt

SEQ ID NO: 25163 - DNA, 25 bp, Homo sapien
tcttaatctttgacttcctgcttag

SEQ ID NO: 25164 - DNA, 25 bp, Homo sapien
ggcacagagtttgagagcctcatgc

SEQ ID NO: 25165 - DNA, 25 bp, Homo sapien
gcctcatgcacaggttgtatgaact

SEQ ID NO: 25166 - DNA, 25 bp, Homo sapien
gaacttgggatagtgcctgttgctt

SEQ ID NO: 25167 - DNA, 25 bp, Homo sapien
gaatgagcttgaagtgctcccctct

SEQ ID NO: 25168 - DNA, 25 bp, Homo sapien
cctctgacagttttgctctttggtt

SEQ ID NO: 25169 - DNA, 25 bp, Homo sapien
tgacagttttgctctttggttcaca

SEQ ID NO: 25170 - DNA, 25 bp, Homo sapien
tctttggttcacaaggcttcctaaa

SEQ ID NO: 25171 - DNA, 25 bp, Homo sapien
tggttcacaaggcttcctaaactca

SEQ ID NO: 25172 - DNA, 25 bp, Homo sapien
gttcacaaggcttcctaaactcagg

SEQ ID NO: 25173 - DNA, 25 bp, Homo sapien
aaggcttcctaaactcaggattgct

SEQ ID NO: 25174 - DNA, 25 bp, Homo sapien
aaactcaggattgctttgtgggtct

SEQ ID NO: 25175 - DNA, 25 bp, Homo sapien
caggattgctttgtgggtctgttct

SEQ ID NO: 25176 - DNA, 25 bp, Homo sapien
aggccagggcaggtgcaagctatgc

SEQ ID NO: 25177 - DNA, 25 bp, Homo sapien
ggccagggcaggtgcaagctatgcc

SEQ ID NO: 25178 - DNA, 25 bp, Homo sapien
ggatgggaacacttaaggaatagag

SEQ ID NO: 25179 - DNA, 25 bp, Homo sapien
gagattaaatcttacacttacccca

SEQ ID NO: 25180 - DNA, 25 bp, Homo sapien
accccacagctggttactgacaaca

SEQ ID NO: 25181 - DNA, 25 bp, Homo sapien
gacaacacaagctctagaattcatg

SEQ ID NO: 25182 - DNA, 25 bp, Homo sapien
gctctagaattcatgtttgtttgtt

SEQ ID NO: 25183 - DNA, 25 bp, Homo sapien
ggcattcttactaatagtctttcta

SEQ ID NO: 25184 - DNA, 25 bp, Homo sapien
gtctttctattatactattggatct

SEQ ID NO: 25185 - DNA, 25 bp, Homo sapien
gatctttattcatccacctatacaa

SEQ ID NO: 25186 - DNA, 25 bp, Homo sapien
catcttgtaaaaactgggagcaggc

SEQ ID NO: 25187 - DNA, 25 bp, Homo sapien
ggtggttcgtctgaggtcagtcagg

SEQ ID NO: 25188 - DNA, 25 bp, Homo sapien
gagaatcgtttaaacacaggaggtg

SEQ ID NO: 25189 - DNA, 25 bp, Homo sapien
agcctccaaaatgatgctgagtccg

SEQ ID NO: 25190 - DNA, 25 bp, Homo sapien
aaaatgatgctgagtccggaccaag

SEQ ID NO: 25191 - DNA, 25 bp, Homo sapien
tgagtccggaccaagcagcagattc

SEQ ID NO: 25192 - DNA, 25 bp, Homo sapien
gaccaagcagcagattcggaccatc

SEQ ID NO: 25193 - DNA, 25 bp, Homo sapien
gcacggacaccaaggtgctcggcag

SEQ ID NO: 25194 - DNA, 25 bp, Homo sapien
gcagctgagccgcgaggagaagcgc

SEQ ID NO: 25195 - DNA, 25 bp, Homo sapien
agctgagccgcgaggagaagcgccg

SEQ ID NO: 25196 - DNA, 25 bp, Homo sapien
gctctccaagatcgagatcctgcgc

SEQ ID NO: 25197 - DNA, 25 bp, Homo sapien
ctatctcaaccacgtcctggacgtg

SEQ ID NO: 25198 - DNA, 25 bp, Homo sapien
cacgtcctggacgtgtagggcgggg

SEQ ID NO: 25199 - DNA, 25 bp, Homo sapien
tggacgtgtagggcggggtgcgccg

SEQ ID NO: 25200 - DNA, 25 bp, Homo sapien
gacataaaacaactgatttctgaga

SEQ ID NO: 25201 - DNA, 25 bp, Homo sapien
ctgagaaaaaccctgtgaacgtaca

SEQ ID NO: 25202 - DNA, 25 bp, Homo sapien
gtacagaatgtaggaatgctttcat

SEQ ID NO: 25203 - DNA, 25 bp, Homo sapien
gaatgctttcatttatctgatacct

SEQ ID NO: 25204 - DNA, 25 bp, Homo sapien
gctttcatttatctgatacctgttc

SEQ ID NO: 25205 - DNA, 25 bp, Homo sapien
gatacctgttcagagacacatgata

SEQ ID NO: 25206 - DNA, 25 bp, Homo sapien
gagacacatgataacacacgctgta

SEQ ID NO: 25207 - DNA, 25 bp, Homo sapien
aacacacgctgtagatggaccttac

SEQ ID NO: 25208 - DNA, 25 bp, Homo sapien
cacgctgtagatggaccttacaaat

SEQ ID NO: 25209 - DNA, 25 bp, Homo sapien
gaaagcatgctggattgaaacctca

SEQ ID NO: 25210 - DNA, 25 bp, Homo sapien
ttcagaagttaaggggctgggcaca

SEQ ID NO: 25211 - DNA, 25 bp, Homo sapien
agcagccgtcagagtccatgagagg

SEQ ID NO: 25212 - DNA, 25 bp, Homo sapien
gagtccatgagaggtgaaaccacac

SEQ ID NO: 25213 - DNA, 25 bp, Homo sapien
aaaccacacagcagggatgtccaat

SEQ ID NO: 25214 - DNA, 25 bp, Homo sapien
gcagggatgtccaatatcagaacta

SEQ ID NO: 25215 - DNA, 25 bp, Homo sapien
agtataaccttcccaggtctatgcc

SEQ ID NO: 25216 - DNA, 25 bp, Homo sapien
gagaattgaaaacatccatccacac

SEQ ID NO: 25217 - DNA, 25 bp, Homo sapien
aaacatccatccacacaatacctgt

SEQ ID NO: 25218 - DNA, 25 bp, Homo sapien
tccatccacacaatacctgtgctcc

SEQ ID NO: 25219 - DNA, 25 bp, Homo sapien
gagagaagaggcatgacagctaaca

SEQ ID NO: 25220 - DNA, 25 bp, Homo sapien
ggcatgacagctaacagggacgggc

SEQ ID NO: 25221 - DNA, 25 bp, Homo sapien
agggacgggctttctttggaagatg

SEQ ID NO: 25222 - DNA, 25 bp, Homo sapien
cgagcctgctgcgcgagcaggtggc

SEQ ID NO: 25223 - DNA, 25 bp, Homo sapien
tccaagtgccgcaagcgcaagctgg

SEQ ID NO: 25224 - DNA, 25 bp, Homo sapien
cgcagctcaagcagaaagtcctcag

SEQ ID NO: 25225 - DNA, 25 bp, Homo sapien
tcagccacgtcaacagcggctgcca

SEQ ID NO: 25226 - DNA, 25 bp, Homo sapien
aagcgcaagctggagcgcatctcgc

SEQ ID NO: 25227 - DNA, 25 bp, Homo sapien
gccccggacttggagagggtgcggc

SEQ ID NO: 25228 - DNA, 25 bp, Homo sapien
cccgagtgtgcccaggaactcagag

SEQ ID NO: 25229 - DNA, 25 bp, Homo sapien
ccaggaactcagagagggcgcggcc

SEQ ID NO: 25230 - DNA, 25 bp, Homo sapien
agcgcatctcgcgcctggaagagaa

SEQ ID NO: 25231 - DNA, 25 bp, Homo sapien
gcccaggactcgacaagctggaccc

SEQ ID NO: 25232 - DNA, 25 bp, Homo sapien
gaagaccctcaagagtcagaacacg

SEQ ID NO: 25233 - DNA, 25 bp, Homo sapien
gattacaggcacccgtcaagggatt

SEQ ID NO: 25234 - DNA, 25 bp, Homo sapien
caggcacccgtcaagggattttcct

SEQ ID NO: 25235 - DNA, 25 bp, Homo sapien
gtagctggtattataggggcctgcc

SEQ ID NO: 25236 - DNA, 25 bp, Homo sapien
gctggtattataggggcctgccacc

SEQ ID NO: 25237 - DNA, 25 bp, Homo sapien
accacgcccagttgaggacactgaa

SEQ ID NO: 25238 - DNA, 25 bp, Homo sapien
gaggacactgaatttggcctggact

SEQ ID NO: 25239 - DNA, 25 bp, Homo sapien
gacactgaatttggcctggactgaa

SEQ ID NO: 25240 - DNA, 25 bp, Homo sapien
tgaatttggcctggactgaacccca

SEQ ID NO: 25241 - DNA, 25 bp, Homo sapien
ctgtccttgcagtcacagtgacagg

SEQ ID NO: 25242 - DNA, 25 bp, Homo sapien
gtccttgcagtcacagtgacaggga

SEQ ID NO: 25243 - DNA, 25 bp, Homo sapien
cagtgacagggagaaagcacaggtc

SEQ ID NO: 25244 - DNA, 25 bp, Homo sapien
gcagatcttcgtggtcatcaaagac

SEQ ID NO: 25245 - DNA, 25 bp, Homo sapien
aaagacaaacctctgagctccatca

SEQ ID NO: 25246 - DNA, 25 bp, Homo sapien
caaggctgacatcgtgcacgccttc

SEQ ID NO: 25247 - DNA, 25 bp, Homo sapien
gagcttccgggccgagtacaaggcc

SEQ ID NO: 25248 - DNA, 25 bp, Homo sapien
tccgggccgagtacaaggccacggg

SEQ ID NO: 25249 - DNA, 25 bp, Homo sapien
agccgtgttccagaagccggtcaag

SEQ ID NO: 25250 - DNA, 25 bp, Homo sapien
tgttccagaagccggtcaagttcca

SEQ ID NO: 25251 - DNA, 25 bp, Homo sapien
cctacacggagggtggggaggcgca

SEQ ID NO: 25252 - DNA, 25 bp, Homo sapien
gaaggagaacggcatctactccgtc

SEQ ID NO: 25253 - DNA, 25 bp, Homo sapien
ccgtcgcttcaagagggtggtggag

SEQ ID NO: 25254 - DNA, 25 bp, Homo sapien
cagacaccactaactgtatggaaat

SEQ ID NO: 25255 - DNA, 25 bp, Homo sapien
gccctgactgactgtattctctggc

SEQ ID NO: 25256 - DNA, 25 bp, Homo sapien
cacattcaagtcccccattggtggg

SEQ ID NO: 25257 - DNA, 25 bp, Homo sapien
ccaggccatccttggctacagagct

SEQ ID NO: 25258 - DNA, 25 bp, Homo sapien
acagagagcctgggctcagccttct

SEQ ID NO: 25259 - DNA, 25 bp, Homo sapien
agccttctgcatcaggacatggcct

SEQ ID NO: 25260 - DNA, 25 bp, Homo sapien
aggaccaagggctggcggtgtggcc

SEQ ID NO: 25261 - DNA, 25 bp, Homo sapien
cctgctccttgcagtgaagccacca

SEQ ID NO: 25262 - DNA, 25 bp, Homo sapien
tgaagccaccatgggtgaccgtcca

SEQ ID NO: 25263 - DNA, 25 bp, Homo sapien
ccggtggcctgcacagtgagggaag

SEQ ID NO: 25264 - DNA, 25 bp, Homo sapien
tctgctcccagggcaggggacaggc

SEQ ID NO: 25265 - DNA, 25 bp, Homo sapien
gacaggccaccaaggacctttggca

SEQ ID NO: 25266 - DNA, 25 bp, Homo sapien
ggatgggaagtgttgcattgagcat

SEQ ID NO: 25267 - DNA, 25 bp, Homo sapien
gtaaaatctccaacaccgtaactga

SEQ ID NO: 25268 - DNA, 25 bp, Homo sapien
ccaacaccgtaactgagtggcctgg

SEQ ID NO: 25269 - DNA, 25 bp, Homo sapien
taactgagtggcctggggacctgat

SEQ ID NO: 25270 - DNA, 25 bp, Homo sapien
ggggacctgatagaaagccttgctc

SEQ ID NO: 25271 - DNA, 25 bp, Homo sapien
atagaaagccttgctcaggactaag

SEQ ID NO: 25272 - DNA, 25 bp, Homo sapien
aggactaaggcagagttcccagtta

SEQ ID NO: 25273 - DNA, 25 bp, Homo sapien
gagttcccagttatatcgcagatac

SEQ ID NO: 25274 - DNA, 25 bp, Homo sapien
gcagatacaaagagaccaggaacac

SEQ ID NO: 25275 - DNA, 25 bp, Homo sapien
agaccaggaacacgcttgtaatcac

SEQ ID NO: 25276 - DNA, 25 bp, Homo sapien
cactgcaccacacctgggattgtga

SEQ ID NO: 25277 - DNA, 25 bp, Homo sapien
accaatgttggtttataccacattt

SEQ ID NO: 25278 - DNA, 25 bp, Homo sapien
accacattttgtttatccattcatc

SEQ ID NO: 25279 - DNA, 25 bp, Homo sapien
ccattcatccgtcagtggtcacttg

SEQ ID NO: 25280 - DNA, 25 bp, Homo sapien
ggtcacttgggttgtgttcagcttt

SEQ ID NO: 25281 - DNA, 25 bp, Homo sapien
gaatagtgcttctatgaacattggt

SEQ ID NO: 25282 - DNA, 25 bp, Homo sapien
gtatatgtttgggcagggcacagtg

SEQ ID NO: 25283 - DNA, 25 bp, Homo sapien
gagcccaggaattcgagaccagtct

SEQ ID NO: 25284 - DNA, 25 bp, Homo sapien
gaccctgtctctactactaataaag

SEQ ID NO: 25285 - DNA, 25 bp, Homo sapien
cacccctgtaatcccagaactttgg

SEQ ID NO: 25286 - DNA, 25 bp, Homo sapien
gaaacccgtctctgctgaaaatgca

SEQ ID NO: 25287 - DNA, 25 bp, Homo sapien
gaattgcttgaatctgggcggtgga

SEQ ID NO: 25288 - DNA, 25 bp, Homo sapien
tttgtggcgggtagactggagagtc

SEQ ID NO: 25289 - DNA, 25 bp, Homo sapien
tgggtctgaccccttgtgggatgaa

SEQ ID NO: 25290 - DNA, 25 bp, Homo sapien
atgaaagccaaacctttcccatcgt

SEQ ID NO: 25291 - DNA, 25 bp, Homo sapien
ttcccccaaagccatgagtttcttg

SEQ ID NO: 25292 - DNA, 25 bp, Homo sapien
tgagtttcttgggcaggttgaggag

SEQ ID NO: 25293 - DNA, 25 bp, Homo sapien
gttgctttcactgcaccatcagtgc

SEQ ID NO: 25294 - DNA, 25 bp, Homo sapien
caccatcagtgcactgtctttctgt

SEQ ID NO: 25295 - DNA, 25 bp, Homo sapien
tgtctttctgtgatgccttattctt

SEQ ID NO: 25296 - DNA, 25 bp, Homo sapien
tattcttcacaaagcatccctcaac

SEQ ID NO: 25297 - DNA, 25 bp, Homo sapien
ctgcggcgggggctcattaaaaata

SEQ ID NO: 25298 - DNA, 25 bp, Homo sapien
cattaaaaatagtcagggccgccgg

SEQ ID NO: 25299 - DNA, 25 bp, Homo sapien
aaagctttactttacaatgcccaat

SEQ ID NO: 25300 - DNA, 25 bp, Homo sapien
acaatgcccaattggaggccttaca

SEQ ID NO: 25301 - DNA, 25 bp, Homo sapien
aggccttacatggaatgctgctctc

SEQ ID NO: 25302 - DNA, 25 bp, Homo sapien
atgtccgagatccttccagatgaat

SEQ ID NO: 25303 - DNA, 25 bp, Homo sapien
aatggaacctcttctgatttgagct

SEQ ID NO: 25304 - DNA, 25 bp, Homo sapien
tttgagctcacaatgtctctctgca

SEQ ID NO: 25305 - DNA, 25 bp, Homo sapien
tgcaccaagctccatgactcaggat

SEQ ID NO: 25306 - DNA, 25 bp, Homo sapien
aaagaccagttgttttcacagcctc

SEQ ID NO: 25307 - DNA, 25 bp, Homo sapien
cacagcctccagtgttaaggacagc

SEQ ID NO: 25308 - DNA, 25 bp, Homo sapien
gaggacgaatccatgaaccaaccag

SEQ ID NO: 25309 - DNA, 25 bp, Homo sapien
atgactgcacttggtcacacaagac

SEQ ID NO: 25310 - DNA, 25 bp, Homo sapien
agagggagggaggaagcggcttgcc

SEQ ID NO: 25311 - DNA, 25 bp, Homo sapien
agggaggaagcggcttgccggagag

SEQ ID NO: 25312 - DNA, 25 bp, Homo sapien
gggaggaagcggcttgccggagagc

SEQ ID NO: 25313 - DNA, 25 bp, Homo sapien
ggaggaagcggcttgccggagagcc

SEQ ID NO: 25314 - DNA, 25 bp, Homo sapien
aggaagcggcttgccggagagccag

SEQ ID NO: 25315 - DNA, 25 bp, Homo sapien
ctgttcgtggccagcctgctggcca

SEQ ID NO: 25316 - DNA, 25 bp, Homo sapien
tgttcgtggccagcctgctggccac

SEQ ID NO: 25317 - DNA, 25 bp, Homo sapien
gttcgtggccagcctgctggccacc

SEQ ID NO: 25318 - DNA, 25 bp, Homo sapien
ttcgtggccagcctgctggccaccg

SEQ ID NO: 25319 - DNA, 25 bp, Homo sapien
tcgtggccagcctgctggccaccga

SEQ ID NO: 25320 - DNA, 25 bp, Homo sapien
cgtggccagcctgctggccaccgac

SEQ ID NO: 25321 - DNA, 25 bp, Homo sapien
taaacttctctctagaggtcctttt

SEQ ID NO: 25322 - DNA, 25 bp, Homo sapien
ctctctagaggtccttttaccttct

SEQ ID NO: 25323 - DNA, 25 bp, Homo sapien
tcttcatcataaggatacctatctg

SEQ ID NO: 25324 - DNA, 25 bp, Homo sapien
ggatacctatctgaatggtaaaccc

SEQ ID NO: 25325 - DNA, 25 bp, Homo sapien
tctgaatggtaaacccaaatatccc

SEQ ID NO: 25326 - DNA, 25 bp, Homo sapien
agaggtggatttagccctttgagct

SEQ ID NO: 25327 - DNA, 25 bp, Homo sapien
tttagccctttgagctagctggcca

SEQ ID NO: 25328 - DNA, 25 bp, Homo sapien
cccagattccactctatccttgtgg

SEQ ID NO: 25329 - DNA, 25 bp, Homo sapien
gaccccaaataggcacagcatggtt

SEQ ID NO: 25330 - DNA, 25 bp, Homo sapien
ggcacagcatggttctaggtttaag

SEQ ID NO: 25331 - DNA, 25 bp, Homo sapien
gcatggttctaggtttaagggtacg

SEQ ID NO: 25332 - DNA, 25 bp, Homo sapien
gatagtccataatctttttgggtct

SEQ ID NO: 25333 - DNA, 25 bp, Homo sapien
ataatctttttgggtctcacttctg

SEQ ID NO: 25334 - DNA, 25 bp, Homo sapien
ttgggtctcacttctgcaaattgga

SEQ ID NO: 25335 - DNA, 25 bp, Homo sapien
gtctcacttctgcaaattggagttc

SEQ ID NO: 25336 - DNA, 25 bp, Homo sapien
attggagttcatacttgcgctatct

SEQ ID NO: 25337 - DNA, 25 bp, Homo sapien
catacttgcgctatcttttgttgaa

SEQ ID NO: 25338 - DNA, 25 bp, Homo sapien
gcgctatcttttgttgaagaaccct

SEQ ID NO: 25339 - DNA, 25 bp, Homo sapien
gaagaaccctcaagatagttgcaaa

SEQ ID NO: 25340 - DNA, 25 bp, Homo sapien
tctagactaatttggttgtagttca

SEQ ID NO: 25341 - DNA, 25 bp, Homo sapien
acagtagctgcttcgtaagtgattt

SEQ ID NO: 25342 - DNA, 25 bp, Homo sapien
tcgtaagtgatttttgggctgggcg

SEQ ID NO: 25343 - DNA, 25 bp, Homo sapien
cgccaataagaacatcgccaacccc

SEQ ID NO: 25344 - DNA, 25 bp, Homo sapien
cagctgcatgatgctggaccacctc

SEQ ID NO: 25345 - DNA, 25 bp, Homo sapien
taaggctgtcctggcatccatggac

SEQ ID NO: 25346 - DNA, 25 bp, Homo sapien
tgagaatgtgaggttcccctcgcac

SEQ ID NO: 25347 - DNA, 25 bp, Homo sapien
cagcccccaggggaggatggtactg

SEQ ID NO: 25348 - DNA, 25 bp, Homo sapien
gggaggatggtactggatctggccc

SEQ ID NO: 25349 - DNA, 25 bp, Homo sapien
tcccagtcctgcacgtcacaggaga

SEQ ID NO: 25350 - DNA, 25 bp, Homo sapien
gcacgtcacaggagacagcgggggg

SEQ ID NO: 25351 - DNA, 25 bp, Homo sapien
gcctgtgtcctacagatgcacactc

SEQ ID NO: 25352 - DNA, 25 bp, Homo sapien
gggccagggcacaacatctgaagcc

SEQ ID NO: 25353 - DNA, 25 bp, Homo sapien
atctgaagccatccaggacgtcatc

SEQ ID NO: 25354 - DNA, 25 bp, Homo sapien
catcttccgcttcatgtgcagagaa

SEQ ID NO: 25355 - DNA, 25 bp, Homo sapien
gtgaggaaagcatcagctggcctga

SEQ ID NO: 25356 - DNA, 25 bp, Homo sapien
gcctgagccactgcttgtttatgat

SEQ ID NO: 25357 - DNA, 25 bp, Homo sapien
ttttccttttggacaacctggctct

SEQ ID NO: 25358 - DNA, 25 bp, Homo sapien
aacctggctctgtgggagcacgtgg

SEQ ID NO: 25359 - DNA, 25 bp, Homo sapien
ggaaaacacgatgccgcgagcttcc

SEQ ID NO: 25360 - DNA, 25 bp, Homo sapien
ggaagccatggagactcgggaagtc

SEQ ID NO: 25361 - DNA, 25 bp, Homo sapien
agtctgctcagtgacatcccaaagt

SEQ ID NO: 25362 - DNA, 25 bp, Homo sapien
agtgcagggctgatctgagcgcaac

SEQ ID NO: 25363 - DNA, 25 bp, Homo sapien
tgatctgagcgcaacctaacgtttc

SEQ ID NO: 25364 - DNA, 25 bp, Homo sapien
agctgccaagggtgactgcttttct

SEQ ID NO: 25365 - DNA, 25 bp, Homo sapien
gtatagaaacctgttctgggaacct

SEQ ID NO: 25366 - DNA, 25 bp, Homo sapien
gaaacctgttctgggaacctgaatg

SEQ ID NO: 25367 - DNA, 25 bp, Homo sapien
gggaacctgaatgcttttggaatgc

SEQ ID NO: 25368 - DNA, 25 bp, Homo sapien
gcttttggaatgcacggggagagtc

SEQ ID NO: 25369 - DNA, 25 bp, Homo sapien
tgcacggggagagtctgccagctaa

SEQ ID NO: 25370 - DNA, 25 bp, Homo sapien
tctgccagctaaaggactcctggca

SEQ ID NO: 25371 - DNA, 25 bp, Homo sapien
aaaggactcctggcaacattctgtg

SEQ ID NO: 25372 - DNA, 25 bp, Homo sapien
gactcctggcaacattctgtgaaat

SEQ ID NO: 25373 - DNA, 25 bp, Homo sapien
aactggatttgtcgaaaactaattg

SEQ ID NO: 25374 - DNA, 25 bp, Homo sapien
aaactaattgtgcccattttctcac

SEQ ID NO: 25375 - DNA, 25 bp, Homo sapien
ttgtgcccattttctcacatttttg

SEQ ID NO: 25376 - DNA, 25 bp, Homo sapien
taagtgtgaagaatgcgagaagagc

SEQ ID NO: 25377 - DNA, 25 bp, Homo sapien
gagcttcaaacagcgctctgacctc

SEQ ID NO: 25378 - DNA, 25 bp, Homo sapien
gccctatggatgttccgtctgtggg

SEQ ID NO: 25379 - DNA, 25 bp, Homo sapien
ggatgttccgtctgtgggaaacgct

SEQ ID NO: 25380 - DNA, 25 bp, Homo sapien
gtgggaaacgcttcaatcagagtgc

SEQ ID NO: 25381 - DNA, 25 bp, Homo sapien
aacgcttcaatcagagtgcaaccct

SEQ ID NO: 25382 - DNA, 25 bp, Homo sapien
gcttcaatcagagtgcaaccctcat

SEQ ID NO: 25383 - DNA, 25 bp, Homo sapien
cagagtgcaaccctcattaaacacc

SEQ ID NO: 25384 - DNA, 25 bp, Homo sapien
cacaccttatccgacaccaaagaat

SEQ ID NO: 25385 - DNA, 25 bp, Homo sapien
accttatccgacaccaaagaattca

SEQ ID NO: 25386 - DNA, 25 bp, Homo sapien
aaataaagtgctgtcggctgggcgt

SEQ ID NO: 25387 - DNA, 25 bp, Homo sapien
ctctccaccatcactctgaaagtgt

SEQ ID NO: 25388 - DNA, 25 bp, Homo sapien
gtgtcttggagccaatagttggtga

SEQ ID NO: 25389 - DNA, 25 bp, Homo sapien
atagttggtgaacgtgtcacacttg

SEQ ID NO: 25390 - DNA, 25 bp, Homo sapien
gtcacacttgtgtggtaggaccttg

SEQ ID NO: 25391 - DNA, 25 bp, Homo sapien
ggaccttgaagtctaagttgctttc

SEQ ID NO: 25392 - DNA, 25 bp, Homo sapien
tctaagttgctttcctgagtattct

SEQ ID NO: 25393 - DNA, 25 bp, Homo sapien
gtattcttttcctgcttgtgatagt

SEQ ID NO: 25394 - DNA, 25 bp, Homo sapien
cttttcctgcttgtgatagtcaaca

SEQ ID NO: 25395 - DNA, 25 bp, Homo sapien
gatagtcaacaactgaaacccctca

SEQ ID NO: 25396 - DNA, 25 bp, Homo sapien
agccatgccctgaaataaaggtccc

SEQ ID NO: 25397 - DNA, 25 bp, Homo sapien
atgccctgaaataaaggtcccggat

SEQ ID NO: 25398 - DNA, 25 bp, Homo sapien
tgcctacgtctaagctgggccaggc

SEQ ID NO: 25399 - DNA, 25 bp, Homo sapien
taagctgggccaggcagaggggcga

SEQ ID NO: 25400 - DNA, 25 bp, Homo sapien
gctgggccaggcagaggggcgagat

SEQ ID NO: 25401 - DNA, 25 bp, Homo sapien
cagaggggcgagatgcaggctcagc

SEQ ID NO: 25402 - DNA, 25 bp, Homo sapien
tgaacaccctgtgtggcgaggtgcc

SEQ ID NO: 25403 - DNA, 25 bp, Homo sapien
cctccggtgagcaggtgtgatccca

SEQ ID NO: 25404 - DNA, 25 bp, Homo sapien
ccggtgagcaggtgtgatcccaggg

SEQ ID NO: 25405 - DNA, 25 bp, Homo sapien
cccctgatcagcagcggaggagcgc

SEQ ID NO: 25406 - DNA, 25 bp, Homo sapien
tcatccaggcaactcgggggagggg

SEQ ID NO: 25407 - DNA, 25 bp, Homo sapien
ggcaactcgggggaggggaagctca

SEQ ID NO: 25408 - DNA, 25 bp, Homo sapien
cgggggaggggaagctcacagaccg

SEQ ID NO: 25409 - DNA, 25 bp, Homo sapien
gacttttcagcccaaccagcagggc

SEQ ID NO: 25410 - DNA, 25 bp, Homo sapien
gcagggcccgtttctaacgagagag

SEQ ID NO: 25411 - DNA, 25 bp, Homo sapien
cagggcccgtttctaacgagagagg

SEQ ID NO: 25412 - DNA, 25 bp, Homo sapien
tggggaaatcgatacacattcggct

SEQ ID NO: 25413 - DNA, 25 bp, Homo sapien
gaaatcgatacacattcggctttgt

SEQ ID NO: 25414 - DNA, 25 bp, Homo sapien
ggctggagtagcaatcacatgaccc

SEQ ID NO: 25415 - DNA, 25 bp, Homo sapien
ctggagtagcaatcacatgacccca

SEQ ID NO: 25416 - DNA, 25 bp, Homo sapien
tcacatgaccccatttcaaatgact

SEQ ID NO: 25417 - DNA, 25 bp, Homo sapien
atgaccccatttcaaatgacttcat

SEQ ID NO: 25418 - DNA, 25 bp, Homo sapien
gaccccatttcaaatgacttcattt

SEQ ID NO: 25419 - DNA, 25 bp, Homo sapien
aaaatactcagctgggcgcgatggc

SEQ ID NO: 25420 - DNA, 25 bp, Homo sapien
aggcacaaatacccaggaatctctg

SEQ ID NO: 25421 - DNA, 25 bp, Homo sapien
ggaatctctgatgggtgtgaagtgc

SEQ ID NO: 25422 - DNA, 25 bp, Homo sapien
tgatgggtgtgaagtgcggtcgtgg

SEQ ID NO: 25423 - DNA, 25 bp, Homo sapien
gaagtgcggtcgtgggccacagaaa

SEQ ID NO: 25424 - DNA, 25 bp, Homo sapien
gtgggccacagaaaatgaccgtcat

SEQ ID NO: 25425 - DNA, 25 bp, Homo sapien
tgaccgtcatggagaccctgctaaa

SEQ ID NO: 25426 - DNA, 25 bp, Homo sapien
gagaccctgctaaaggtcggaccct

SEQ ID NO: 25427 - DNA, 25 bp, Homo sapien
tgctaaaggtcggaccctgagccca

SEQ ID NO: 25428 - DNA, 25 bp, Homo sapien
gaccctgagcccaaaggggtattca

SEQ ID NO: 25429 - DNA, 25 bp, Homo sapien
aggggtattcagaagtggagatgat

SEQ ID NO: 25430 - DNA, 25 bp, Homo sapien
agcatataaaatagggtgatcaccc

SEQ ID NO: 25431 - DNA, 25 bp, Homo sapien
tattctggaatttggaccatacact

SEQ ID NO: 25432 - DNA, 25 bp, Homo sapien
tttggaccatacactatgttacaaa

SEQ ID NO: 25433 - DNA, 25 bp, Homo sapien
cacacgggatgaaacctgggtcagc

SEQ ID NO: 25434 - DNA, 25 bp, Homo sapien
ggtcagcatccctaggttgagaagg

SEQ ID NO: 25435 - DNA, 25 bp, Homo sapien
ctaggttgagaagggatgcattttt

SEQ ID NO: 25436 - DNA, 25 bp, Homo sapien
gatgcatttttctgctactactaca

SEQ ID NO: 25437 - DNA, 25 bp, Homo sapien
tacagtttcacagaatacctgagaa

SEQ ID NO: 25438 - DNA, 25 bp, Homo sapien
gtcagctctaattgttcaccacaga

SEQ ID NO: 25439 - DNA, 25 bp, Homo sapien
gctctaattgttcaccacagaactc

SEQ ID NO: 25440 - DNA, 25 bp, Homo sapien
gatttttaactggattcaatgtgtg

SEQ ID NO: 25441 - DNA, 25 bp, Homo sapien
ggattcaatgtgtggatggtttaag

SEQ ID NO: 25442 - DNA, 25 bp, Homo sapien
gagtctgagcatgagctgcagccag

SEQ ID NO: 25443 - DNA, 25 bp, Homo sapien
tttcccctgccttaatgtgacatga

SEQ ID NO: 25444 - DNA, 25 bp, Homo sapien
atgtgacatgaggcccattcttctc

SEQ ID NO: 25445 - DNA, 25 bp, Homo sapien
gagcagtcaacattcttagtagtgg

SEQ ID NO: 25446 - DNA, 25 bp, Homo sapien
gtgggtttctgttctattggatgac

SEQ ID NO: 25447 - DNA, 25 bp, Homo sapien
gagatttgtctttgtttccttttgg

SEQ ID NO: 25448 - DNA, 25 bp, Homo sapien
tgggaaatccattccattttgtgaa

SEQ ID NO: 25449 - DNA, 25 bp, Homo sapien
attgggacatagttacagcagtgga

SEQ ID NO: 25450 - DNA, 25 bp, Homo sapien
ttatactcagtctattcggtaaaat

SEQ ID NO: 25451 - DNA, 25 bp, Homo sapien
aatgtgcatacctggatttccttgg

SEQ ID NO: 25452 - DNA, 25 bp, Homo sapien
ggatttccttggcttctttgagaat

SEQ ID NO: 25453 - DNA, 25 bp, Homo sapien
ggcttggatcctgaatcgtgtaggg

SEQ ID NO: 25454 - DNA, 25 bp, Homo sapien
gatcctgaatcgtgtaggggactac

SEQ ID NO: 25455 - DNA, 25 bp, Homo sapien
gtaggggactacggatatcctgctg

SEQ ID NO: 25456 - DNA, 25 bp, Homo sapien
aggggactacggatatcctgctgat

SEQ ID NO: 25457 - DNA, 25 bp, Homo sapien
tatcctgctgatgtgttgttctctt

SEQ ID NO: 25458 - DNA, 25 bp, Homo sapien
ttctcttctcgacttacacatttta

SEQ ID NO: 25459 - DNA, 25 bp, Homo sapien
ctcttctcgacttacacattttata

SEQ ID NO: 25460 - DNA, 25 bp, Homo sapien
ttctcgacttacacattttatatgg

SEQ ID NO: 25461 - DNA, 25 bp, Homo sapien
ggaagatctgtggccaatcattagc

SEQ ID NO: 25462 - DNA, 25 bp, Homo sapien
gatctgtggccaatcattagcaaac

SEQ ID NO: 25463 - DNA, 25 bp, Homo sapien
tgtggccaatcattagcaaacaaat

SEQ ID NO: 25464 - DNA, 25 bp, Homo sapien
ggagcaggggcattgctgattttgt

SEQ ID NO: 25465 - DNA, 25 bp, Homo sapien
gcccaatccatcctgctcaggaaac

SEQ ID NO: 25466 - DNA, 25 bp, Homo sapien
ccatcctgctcaggaaaccacaacc

SEQ ID NO: 25467 - DNA, 25 bp, Homo sapien
gtatgtaagtttttctacccatgat

SEQ ID NO: 25468 - DNA, 25 bp, Homo sapien
tccccctgggcataggcccataggg

SEQ ID NO: 25469 - DNA, 25 bp, Homo sapien
ggcccataggggatagaagttaaag

SEQ ID NO: 25470 - DNA, 25 bp, Homo sapien
gaagttaaagttcttgagcttattc

SEQ ID NO: 25471 - DNA, 25 bp, Homo sapien
gcaatctgaatgctactcataacat

SEQ ID NO: 25472 - DNA, 25 bp, Homo sapien
gtatgttaaacagctcttaaatctt

SEQ ID NO: 25473 - DNA, 25 bp, Homo sapien
agctcttaaatcttactggcttacc

SEQ ID NO: 25474 - DNA, 25 bp, Homo sapien
taaatcttactggcttaccacatta

SEQ ID NO: 25475 - DNA, 25 bp, Homo sapien
atccctggaggcaattgggagcctg

SEQ ID NO: 25476 - DNA, 25 bp, Homo sapien
attgggagcctgacgggtttggcgg

SEQ ID NO: 25477 - DNA, 25 bp, Homo sapien
ggtgggttgtggggcaggaatcaga

SEQ ID NO: 25478 - DNA, 25 bp, Homo sapien
ggggcaggaatcagattcactcatt

SEQ ID NO: 25479 - DNA, 25 bp, Homo sapien
gattcactcattagtaagccgcact

SEQ ID NO: 25480 - DNA, 25 bp, Homo sapien
cactcattagtaagccgcactcgct

SEQ ID NO: 25481 - DNA, 25 bp, Homo sapien
ttagtaagccgcactcgctgaaggg

SEQ ID NO: 25482 - DNA, 25 bp, Homo sapien
gccgcactcgctgaaggggagagca

SEQ ID NO: 25483 - DNA, 25 bp, Homo sapien
agacgtgagccaggccttggttatt

SEQ ID NO: 25484 - DNA, 25 bp, Homo sapien
gtgagccaggccttggttattagga

SEQ ID NO: 25485 - DNA, 25 bp, Homo sapien
ttaggagctaattatgggccaagta

SEQ ID NO: 25486 - DNA, 25 bp, Homo sapien
cgagtgaccggatggctgtgtccgt

SEQ ID NO: 25487 - DNA, 25 bp, Homo sapien
gaccggatggctgtgtccgtaggtg

SEQ ID NO: 25488 - DNA, 25 bp, Homo sapien
ccggatggctgtgtccgtaggtgag

SEQ ID NO: 25489 - DNA, 25 bp, Homo sapien
ctgccactgctggatttgtgtcctg

SEQ ID NO: 25490 - DNA, 25 bp, Homo sapien
cactgctggatttgtgtcctgactg

SEQ ID NO: 25491 - DNA, 25 bp, Homo sapien
gatgcattttggtttctgcacagtc

SEQ ID NO: 25492 - DNA, 25 bp, Homo sapien
attttggtttctgcacagtcactcg

SEQ ID NO: 25493 - DNA, 25 bp, Homo sapien
tttctgcacagtcactcgggtataa

SEQ ID NO: 25494 - DNA, 25 bp, Homo sapien
cagtcactcgggtataaagggcatc

SEQ ID NO: 25495 - DNA, 25 bp, Homo sapien
ataaagggcatctttgcttttgagc

SEQ ID NO: 25496 - DNA, 25 bp, Homo sapien
caataaagatgaaggccgggcacag

SEQ ID NO: 25497 - DNA, 25 bp, Homo sapien
tgggcacggggagaggaaggcactc

SEQ ID NO: 25498 - DNA, 25 bp, Homo sapien
gaaggcactcctctttaaggaccga

SEQ ID NO: 25499 - DNA, 25 bp, Homo sapien
cattgcttcactggccagagcttag

SEQ ID NO: 25500 - DNA, 25 bp, Homo sapien
tggccagagcttagtcacgcagcct

SEQ ID NO: 25501 - DNA, 25 bp, Homo sapien
cagcctcacccagaggcaagggagg

SEQ ID NO: 25502 - DNA, 25 bp, Homo sapien
gtgtctaacacaaattctattacca

SEQ ID NO: 25503 - DNA, 25 bp, Homo sapien
ttaccatgcagtcaggattctccac

SEQ ID NO: 25504 - DNA, 25 bp, Homo sapien
tccactcttgctctttcattagatt

SEQ ID NO: 25505 - DNA, 25 bp, Homo sapien
acccagatgtgtacaagggcttcat

SEQ ID NO: 25506 - DNA, 25 bp, Homo sapien
agggcttcatatacaatcaggagat

SEQ ID NO: 25507 - DNA, 25 bp, Homo sapien
taatcatgctaggggccgggtgcag

SEQ ID NO: 25508 - DNA, 25 bp, Homo sapien
ctatctgccatcccacaaagtgatt

SEQ ID NO: 25509 - DNA, 25 bp, Homo sapien
gccatcccacaaagtgattatatgc

SEQ ID NO: 25510 - DNA, 25 bp, Homo sapien
atgccaaagggatactagtcatacc

SEQ ID NO: 25511 - DNA, 25 bp, Homo sapien
agtcatacctagtgtttctctttct

SEQ ID NO: 25512 - DNA, 25 bp, Homo sapien
atacctagtgtttctctttctgaaa

SEQ ID NO: 25513 - DNA, 25 bp, Homo sapien
gaacttatcctaaaattagccctgg

SEQ ID NO: 25514 - DNA, 25 bp, Homo sapien
ggataaaactcagataccaaggata

SEQ ID NO: 25515 - DNA, 25 bp, Homo sapien
tagggataaaagtgggctgggcgca

SEQ ID NO: 25516 - DNA, 25 bp, Homo sapien
gtagactagagcttgggaactccta

SEQ ID NO: 25517 - DNA, 25 bp, Homo sapien
gagcttgggaactcctaacctagaa

SEQ ID NO: 25518 - DNA, 25 bp, Homo sapien
taacctagaactatctgccatccca

SEQ ID NO: 25519 - DNA, 25 bp, Homo sapien
tcctgtgtcttgacccagaaaattg

SEQ ID NO: 25520 - DNA, 25 bp, Homo sapien
ttgacccagaaaattgtgacatgta

SEQ ID NO: 25521 - DNA, 25 bp, Homo sapien
taaattcctggtttaagccagtaag

SEQ ID NO: 25522 - DNA, 25 bp, Homo sapien
ggtacattgttacatctcagataat

SEQ ID NO: 25523 - DNA, 25 bp, Homo sapien
catgagagatcacaagtagaacctt

SEQ ID NO: 25524 - DNA, 25 bp, Homo sapien
gaaccttgatctgaaacatggcatg

SEQ ID NO: 25525 - DNA, 25 bp, Homo sapien
acatggcatgtggcgatttatattg

SEQ ID NO: 25526 - DNA, 25 bp, Homo sapien
gcatgtggcgatttatattgagtat

SEQ ID NO: 25527 - DNA, 25 bp, Homo sapien
cagttaattaggttgtcactttttg

SEQ ID NO: 25528 - DNA, 25 bp, Homo sapien
ttagaactgatgcacacatccgttt

SEQ ID NO: 25529 - DNA, 25 bp, Homo sapien
aacataagctagaatcattgacata

SEQ ID NO: 25530 - DNA, 25 bp, Homo sapien
gttgtaacaatatctatgaccactg

SEQ ID NO: 25531 - DNA, 25 bp, Homo sapien
atgaccactgttagcccattatatt

SEQ ID NO: 25532 - DNA, 25 bp, Homo sapien
gtaagttttcatatcatgtgctgta

SEQ ID NO: 25533 - DNA, 25 bp, Homo sapien
tcatgtgctgtaaagttttcctaaa

SEQ ID NO: 25534 - DNA, 25 bp, Homo sapien
gaggctttaacgtaaacactggtga

SEQ ID NO: 25535 - DNA, 25 bp, Homo sapien
ggtgacataaaccattcattgctac

SEQ ID NO: 25536 - DNA, 25 bp, Homo sapien
accattcattgctacgttgcttatt

SEQ ID NO: 25537 - DNA, 25 bp, Homo sapien
gttgcttattgtgtttttatgctgt

SEQ ID NO: 25538 - DNA, 25 bp, Homo sapien
tatgctgttttatacttttttatga

SEQ ID NO: 25539 - DNA, 25 bp, Homo sapien
aaaaatgcttttatcttgctataga

SEQ ID NO: 25540 - DNA, 25 bp, Homo sapien
gtggactgtattttgatgcaacaac

SEQ ID NO: 25541 - DNA, 25 bp, Homo sapien
attcttcccacaatgtctttcttaa

SEQ ID NO: 25542 - DNA, 25 bp, Homo sapien
tcccacaatgtctttcttaagcaac

SEQ ID NO: 25543 - DNA, 25 bp, Homo sapien
gaacagacaggacttaagttaccac

SEQ ID NO: 25544 - DNA, 25 bp, Homo sapien
ggacttaagttaccactgatttgaa

SEQ ID NO: 25545 - DNA, 25 bp, Homo sapien
gaaaaaaagccaacatccttagaag

SEQ ID NO: 25546 - DNA, 25 bp, Homo sapien
aacttaactgtcacattcatactgt

SEQ ID NO: 25547 - DNA, 25 bp, Homo sapien
attcatactgtttctttcaagttca

SEQ ID NO: 25548 - DNA, 25 bp, Homo sapien
gagctctcaaacattgctggtatcc

SEQ ID NO: 25549 - DNA, 25 bp, Homo sapien
tctcaaacattgctggtatcctggt

SEQ ID NO: 25550 - DNA, 25 bp, Homo sapien
ggtatcctggtaaaatctctttgaa

SEQ ID NO: 25551 - DNA, 25 bp, Homo sapien
caaaaatgttgctactctgggccac

SEQ ID NO: 25552 - DNA, 25 bp, Homo sapien
ttctgtctttttagtattcagggat

SEQ ID NO: 25553 - DNA, 25 bp, Homo sapien
tttttcctgcactgaatctctgtgc

SEQ ID NO: 25554 - DNA, 25 bp, Homo sapien
actgaatctctgtgcttgagcctac

SEQ ID NO: 25555 - DNA, 25 bp, Homo sapien
atctctgtgcttgagcctactgaaa

SEQ ID NO: 25556 - DNA, 25 bp, Homo sapien
cttgagcctactgaaatgatccccc

SEQ ID NO: 25557 - DNA, 25 bp, Homo sapien
gtttttttacactgacttatctcct

SEQ ID NO: 25558 - DNA, 25 bp, Homo sapien
tacactgacttatctccttcgtgtg

SEQ ID NO: 25559 - DNA, 25 bp, Homo sapien
ccccagaggaagacaacagaacagt

SEQ ID NO: 25560 - DNA, 25 bp, Homo sapien
ttaattctgtaatccttgaccaggc

SEQ ID NO: 25561 - DNA, 25 bp, Homo sapien
tctgtaatccttgaccaggcatggt

SEQ ID NO: 25562 - DNA, 25 bp, Homo sapien
ggttgcagttagctgagaccacacc

SEQ ID NO: 25563 - DNA, 25 bp, Homo sapien
gtgcggtagctggggttagcgtccg

SEQ ID NO: 25564 - DNA, 25 bp, Homo sapien
ctgcttccagggtccgcaagcaggt

SEQ ID NO: 25565 - DNA, 25 bp, Homo sapien
caagcaggtggtgaacatcccgtcc

SEQ ID NO: 25566 - DNA, 25 bp, Homo sapien
tccgcctggattcccagaagcacat

SEQ ID NO: 25567 - DNA, 25 bp, Homo sapien
cagaagcacatcgacttctctctgc

SEQ ID NO: 25568 - DNA, 25 bp, Homo sapien
cgcccgggccgcgtgaagaggaaga

SEQ ID NO: 25569 - DNA, 25 bp, Homo sapien
ccagggtggggctggggctggagac

SEQ ID NO: 25570 - DNA, 25 bp, Homo sapien
gaggaggattaagtccacctgtccc

SEQ ID NO: 25571 - DNA, 25 bp, Homo sapien
ggcgcacgtaggatcaggtgcaccc

SEQ ID NO: 25572 - DNA, 25 bp, Homo sapien
ttgtctcgttttcctgccaaataaa

SEQ ID NO: 25573 - DNA, 25 bp, Homo sapien
ctgcagcgccttggtgtctgcagcc

SEQ ID NO: 25574 - DNA, 25 bp, Homo sapien
cttgtctgtgggacagttgcctccc

SEQ ID NO: 25575 - DNA, 25 bp, Homo sapien
ctaattcagaggtctcatgcctgcc

SEQ ID NO: 25576 - DNA, 25 bp, Homo sapien
cccagggtcgtgcactctctgggat

SEQ ID NO: 25577 - DNA, 25 bp, Homo sapien
tctgggataccagttcagtctccac

SEQ ID NO: 25578 - DNA, 25 bp, Homo sapien
tcagtctccacatttctggttttct

SEQ ID NO: 25579 - DNA, 25 bp, Homo sapien
gtccccatagtacagttcttcagtg

SEQ ID NO: 25580 - DNA, 25 bp, Homo sapien
accatctcaccagacacaaggggaa

SEQ ID NO: 25581 - DNA, 25 bp, Homo sapien
agacatcaggtgctgcactcacttc

SEQ ID NO: 25582 - DNA, 25 bp, Homo sapien
gaaaggaacgaaccctggctggagg

SEQ ID NO: 25583 - DNA, 25 bp, Homo sapien
ttcctggtggcattagccactccct

SEQ ID NO: 25584 - DNA, 25 bp, Homo sapien
gacctgttcccacaactggggaggt

SEQ ID NO: 25585 - DNA, 25 bp, Homo sapien
aactggttccagagaaagactaagc

SEQ ID NO: 25586 - DNA, 25 bp, Homo sapien
gtcagctttctcatattgagagctc

SEQ ID NO: 25587 - DNA, 25 bp, Homo sapien
gctttctcatattgagagctctgct

SEQ ID NO: 25588 - DNA, 25 bp, Homo sapien
ttttcattttccccttaggcatatt

SEQ ID NO: 25589 - DNA, 25 bp, Homo sapien
cattttccccttaggcatatttagt

SEQ ID NO: 25590 - DNA, 25 bp, Homo sapien
ggcatatttagtatttttcccccag

SEQ ID NO: 25591 - DNA, 25 bp, Homo sapien
tttcccccaggcagatcattctgag

SEQ ID NO: 25592 - DNA, 25 bp, Homo sapien
gatcattctgagtgtgcgagtgtgt

SEQ ID NO: 25593 - DNA, 25 bp, Homo sapien
gtgcgagtgtgtgtgcacatgttac

SEQ ID NO: 25594 - DNA, 25 bp, Homo sapien
gtgtgtgtgcacatgttacaaaggc

SEQ ID NO: 25595 - DNA, 25 bp, Homo sapien
gttacaaaggcaactaccatgttaa

SEQ ID NO: 25596 - DNA, 25 bp, Homo sapien
gcaggactgttggtaaattcccact

SEQ ID NO: 25597 - DNA, 25 bp, Homo sapien
atactgtgtgtgcatggttgtgtct

SEQ ID NO: 25598 - DNA, 25 bp, Homo sapien
ttgtgtctgcgtagccttcatattt

SEQ ID NO: 25599 - DNA, 25 bp, Homo sapien
agccttcatatttacacggttgtgt

SEQ ID NO: 25600 - DNA, 25 bp, Homo sapien
acggttgtgtgtgcttgtggaaagt

SEQ ID NO: 25601 - DNA, 25 bp, Homo sapien
tacaccatgctgttactagtagctg

SEQ ID NO: 25602 - DNA, 25 bp, Homo sapien
tactagtagctgactctgtggagtt

SEQ ID NO: 25603 - DNA, 25 bp, Homo sapien
gttggtaggagggtcactggagagg

SEQ ID NO: 25604 - DNA, 25 bp, Homo sapien
tgcaacatatatacacttcagtggt

SEQ ID NO: 25605 - DNA, 25 bp, Homo sapien
cttcagtggtgtcttttttgggcag

SEQ ID NO: 25606 - DNA, 25 bp, Homo sapien
tgggcagacggggcaacaagtaata

SEQ ID NO: 25607 - DNA, 25 bp, Homo sapien
tggcaacaccccatttctacaaaaa

SEQ ID NO: 25608 - DNA, 25 bp, Homo sapien
tggcctcagaatcaggctgggtgca

SEQ ID NO: 25609 - DNA, 25 bp, Homo sapien
gaatcaggctgggtgcagtggctca

SEQ ID NO: 25610 - DNA, 25 bp, Homo sapien
ctccagcctggtccacagagagaca

SEQ ID NO: 25611 - DNA, 25 bp, Homo sapien
gtccacagagagacactgtcacccc

SEQ ID NO: 25612 - DNA, 25 bp, Homo sapien
tttcccccacaagactggcagaggc

SEQ ID NO: 25613 - DNA, 25 bp, Homo sapien
ggcagaggctgggcagcctggggct

SEQ ID NO: 25614 - DNA, 25 bp, Homo sapien
cagcctggggctgatgaagcagaga

SEQ ID NO: 25615 - DNA, 25 bp, Homo sapien
gaagcagagatgttcgctggatccc

SEQ ID NO: 25616 - DNA, 25 bp, Homo sapien
ccctggcacccctcaggaaatacaa

SEQ ID NO: 25617 - DNA, 25 bp, Homo sapien
gagtgagaggatcacttgagctcag

SEQ ID NO: 25618 - DNA, 25 bp, Homo sapien
gaggatgtgatagaaaaggctgagt

SEQ ID NO: 25619 - DNA, 25 bp, Homo sapien
cagaagggaactgtaccactcccaa

SEQ ID NO: 25620 - DNA, 25 bp, Homo sapien
ctggtcctatcctcaccagaggacc

SEQ ID NO: 25621 - DNA, 25 bp, Homo sapien
tcctatcctcaccagaggacctcac

SEQ ID NO: 25622 - DNA, 25 bp, Homo sapien
tatcctcaccagaggacctcacaca

SEQ ID NO: 25623 - DNA, 25 bp, Homo sapien
accagaggacctcacacaggacttt

SEQ ID NO: 25624 - DNA, 25 bp, Homo sapien
agaggacctcacacaggactttgag

SEQ ID NO: 25625 - DNA, 25 bp, Homo sapien
tcacacaggactttgaggagatgaa

SEQ ID NO: 25626 - DNA, 25 bp, Homo sapien
tgaggagatgaagcgtgaggagagg

SEQ ID NO: 25627 - DNA, 25 bp, Homo sapien
gaggtccctgaggaacaaggcagca

SEQ ID NO: 25628 - DNA, 25 bp, Homo sapien
gaggaacaaggcagcaaggacagag

SEQ ID NO: 25629 - DNA, 25 bp, Homo sapien
ctgcttctccatcaggcagcaaaac

SEQ ID NO: 25630 - DNA, 25 bp, Homo sapien
ctggaaggacgtgagggctgcctgg

SEQ ID NO: 25631 - DNA, 25 bp, Homo sapien
tggggcaagggaggacctttgttca

SEQ ID NO: 25632 - DNA, 25 bp, Homo sapien
ggaggacctttgttcaagagcttcc

SEQ ID NO: 25633 - DNA, 25 bp, Homo sapien
gttcaagagcttccatgtttgtatg

SEQ ID NO: 25634 - DNA, 25 bp, Homo sapien
cagtgtccaaatgtatgtctgtaca

SEQ ID NO: 25635 - DNA, 25 bp, Homo sapien
gtatgtctgtacacttagtatggta

SEQ ID NO: 25636 - DNA, 25 bp, Homo sapien
tagtatggtattccccagtctgaac

SEQ ID NO: 25637 - DNA, 25 bp, Homo sapien
cagtctgaacatgtgttcccttcct

SEQ ID NO: 25638 - DNA, 25 bp, Homo sapien
tgctcccagccttgcaaagctaagt

SEQ ID NO: 25639 - DNA, 25 bp, Homo sapien
gaaactaagcaggcaggccgggcgt

SEQ ID NO: 25640 - DNA, 25 bp, Homo sapien
ctcctggaaggcgctcgggagcgag

SEQ ID NO: 25641 - DNA, 25 bp, Homo sapien
ggcgctcgggagcgagaggcaggca

SEQ ID NO: 25642 - DNA, 25 bp, Homo sapien
ggcaggcagagcctcgcatggaggc

SEQ ID NO: 25643 - DNA, 25 bp, Homo sapien
gcagagcctcgcatggaggcgcgag

SEQ ID NO: 25644 - DNA, 25 bp, Homo sapien
ctcgcatggaggcgcgagagcccca

SEQ ID NO: 25645 - DNA, 25 bp, Homo sapien
agggaccatgatgtcagcgcttccc

SEQ ID NO: 25646 - DNA, 25 bp, Homo sapien
cagcgcttccctcagaaaatggggt

SEQ ID NO: 25647 - DNA, 25 bp, Homo sapien
gaaaatggggttttcattgctaacg

SEQ ID NO: 25648 - DNA, 25 bp, Homo sapien
acagccagaagggggaactcaccca

SEQ ID NO: 25649 - DNA, 25 bp, Homo sapien
ccagaagggggaactcacccagcac

SEQ ID NO: 25650 - DNA, 25 bp, Homo sapien
aactcacccagcacgaaggaaatgg

SEQ ID NO: 25651 - DNA, 25 bp, Homo sapien
aaacctgaaaagaccaactatgagt

SEQ ID NO: 25652 - DNA, 25 bp, Homo sapien
aaatcagtaatatagagtctcccat

SEQ ID NO: 25653 - DNA, 25 bp, Homo sapien
aaaagtccaggccctgatggcttca

SEQ ID NO: 25654 - DNA, 25 bp, Homo sapien
ctcataccagttctcaaactcatcc

SEQ ID NO: 25655 - DNA, 25 bp, Homo sapien
tcctgtgagggcagcattaccctga

SEQ ID NO: 25656 - DNA, 25 bp, Homo sapien
gcattaccctgataccaaaactaga

SEQ ID NO: 25657 - DNA, 25 bp, Homo sapien
atctataggccagtatccctgatga

SEQ ID NO: 25658 - DNA, 25 bp, Homo sapien
gatgcaagaatcctcaacaagacca

SEQ ID NO: 25659 - DNA, 25 bp, Homo sapien
aagaccaggtgtggtggttcatgcc

SEQ ID NO: 25660 - DNA, 25 bp, Homo sapien
aaggtggcgtgtgcctgtaatccta

SEQ ID NO: 25661 - DNA, 25 bp, Homo sapien
aagttgcagcgagctcagatcgtcc

SEQ ID NO: 25662 - DNA, 25 bp, Homo sapien
ccccaaggaggaggaccatcgagct

SEQ ID NO: 25663 - DNA, 25 bp, Homo sapien
ggaccatcgagctaaaggtttgggc

SEQ ID NO: 25664 - DNA, 25 bp, Homo sapien
ggcatggagaacattggtggcattt

SEQ ID NO: 25665 - DNA, 25 bp, Homo sapien
ggtggcatttttatcgtgctcatct

SEQ ID NO: 25666 - DNA, 25 bp, Homo sapien
tgtcttcgtggcggtcatggaattc

SEQ ID NO: 25667 - DNA, 25 bp, Homo sapien
ggcggtcatggaattcatatggtcc

SEQ ID NO: 25668 - DNA, 25 bp, Homo sapien
atatggtccacacggaggtcagctg

SEQ ID NO: 25669 - DNA, 25 bp, Homo sapien
ggaggtcagctgagtccgaggaggt

SEQ ID NO: 25670 - DNA, 25 bp, Homo sapien
gagtccgaggaggtgtcggtgtgcc

SEQ ID NO: 25671 - DNA, 25 bp, Homo sapien
gtgtcggtgtgccaggagatgctgc

SEQ ID NO: 25672 - DNA, 25 bp, Homo sapien
gccgtttcttgccgcaagacgtcgc

SEQ ID NO: 25673 - DNA, 25 bp, Homo sapien
accaggatcatctacgaccgaaagt

SEQ ID NO: 25674 - DNA, 25 bp, Homo sapien
gaccgaaagttcctgctggagtgca

SEQ ID NO: 25675 - DNA, 25 bp, Homo sapien
ggagtgcaagaactcacccattgcc

SEQ ID NO: 25676 - DNA, 25 bp, Homo sapien
gagatacccgatgacgcacaatttg

SEQ ID NO: 25677 - DNA, 25 bp, Homo sapien
gtgcagatgacctggcatgtggagt

SEQ ID NO: 25678 - DNA, 25 bp, Homo sapien
gttacagagggatccctcatgccac

SEQ ID NO: 25679 - DNA, 25 bp, Homo sapien
ggcctcatctaatctggaagggagt

SEQ ID NO: 25680 - DNA, 25 bp, Homo sapien
gagtgacttgttagttccaggcctc

SEQ ID NO: 25681 - DNA, 25 bp, Homo sapien
ccaggcctcctttagttctgaggca

SEQ ID NO: 25682 - DNA, 25 bp, Homo sapien
gaggcagctagaccagggataggag

SEQ ID NO: 25683 - DNA, 25 bp, Homo sapien
gtaagtcaccttctgactgcttagt

SEQ ID NO: 25684 - DNA, 25 bp, Homo sapien
tttcagggaggtatctaatttggtc

SEQ ID NO: 25685 - DNA, 25 bp, Homo sapien
agaggaaaagtattttctctcatgt

SEQ ID NO: 25686 - DNA, 25 bp, Homo sapien
agcagtgctgaagctgagaggctca

SEQ ID NO: 25687 - DNA, 25 bp, Homo sapien
gagaggctcatgacagcagttggac

SEQ ID NO: 25688 - DNA, 25 bp, Homo sapien
gacagcagttggacagatactggag

SEQ ID NO: 25689 - DNA, 25 bp, Homo sapien
ggaggagaacatgtcactttgccat

SEQ ID NO: 25690 - DNA, 25 bp, Homo sapien
cagacacccgttctactcagaacac

SEQ ID NO: 25691 - DNA, 25 bp, Homo sapien
tctactcagaacacagcagaatgct

SEQ ID NO: 25692 - DNA, 25 bp, Homo sapien
cagcagaatgctgagctatgcagcc

SEQ ID NO: 25693 - DNA, 25 bp, Homo sapien
gccactctcaagaaccagagtcgtc

SEQ ID NO: 25694 - DNA, 25 bp, Homo sapien
aaatcagagatcagtagcccttgaa

SEQ ID NO: 25695 - DNA, 25 bp, Homo sapien
ggaaaacttcgaagcagctgttggc

SEQ ID NO: 25696 - DNA, 25 bp, Homo sapien
ctccccttattgctgatgtttatta

SEQ ID NO: 25697 - DNA, 25 bp, Homo sapien
gagggggtggtcatcacgaggaaca

SEQ ID NO: 25698 - DNA, 25 bp, Homo sapien
agagatggcccagcagacatttggc

SEQ ID NO: 25699 - DNA, 25 bp, Homo sapien
gatcctttgaatggagcgtggttcc

SEQ ID NO: 25700 - DNA, 25 bp, Homo sapien
gagcgtggttccgagttgagacaaa

SEQ ID NO: 25701 - DNA, 25 bp, Homo sapien
gttgagacaaattacgaccactgga

SEQ ID NO: 25702 - DNA, 25 bp, Homo sapien
ttacgaccactggaagccagcaccc

SEQ ID NO: 25703 - DNA, 25 bp, Homo sapien
gccagcacccaaggaagatgaccgg

SEQ ID NO: 25704 - DNA, 25 bp, Homo sapien
tgccatcaaggcccttaatgctaca

SEQ ID NO: 25705 - DNA, 25 bp, Homo sapien
tgctacaggacaagcaaacctcagc

SEQ ID NO: 25706 - DNA, 25 bp, Homo sapien
tgaactgtgctgactccagaaaatg

SEQ ID NO: 25707 - DNA, 25 bp, Homo sapien
gactccagaaaatgattatgtactc

SEQ ID NO: 25708 - DNA, 25 bp, Homo sapien
agattgtcttcttctgagagatatg

SEQ ID NO: 25709 - DNA, 25 bp, Homo sapien
gagagatatgttactgcctccttgg

SEQ ID NO: 25710 - DNA, 25 bp, Homo sapien
tatgttactgcctccttggaatctg

SEQ ID NO: 25711 - DNA, 25 bp, Homo sapien
caagtaatactccagtggggcagtc

SEQ ID NO: 25712 - DNA, 25 bp, Homo sapien
gggcagtcagtaggagagcattttc

SEQ ID NO: 25713 - DNA, 25 bp, Homo sapien
agtcagtaggagagcattttcagag

SEQ ID NO: 25714 - DNA, 25 bp, Homo sapien
tttcagagggaagagctgtctcaac

SEQ ID NO: 25715 - DNA, 25 bp, Homo sapien
gtctcaacagaattacaccttactg

SEQ ID NO: 25716 - DNA, 25 bp, Homo sapien
tacaccttactgtattttcaggatg

SEQ ID NO: 25717 - DNA, 25 bp, Homo sapien
ttctgcaccacacctggcatggtgc

SEQ ID NO: 25718 - DNA, 25 bp, Homo sapien
accacacctggcatggtgcagggag

SEQ ID NO: 25719 - DNA, 25 bp, Homo sapien
cggccgcctactactactatacggc

SEQ ID NO: 25720 - DNA, 25 bp, Homo sapien
tgcagggagacatctgcacccctga

SEQ ID NO: 25721 - DNA, 25 bp, Homo sapien
cacccctgagttgggcagccaggag

SEQ ID NO: 25722 - DNA, 25 bp, Homo sapien
gagttgggcagccaggagtgccccc

SEQ ID NO: 25723 - DNA, 25 bp, Homo sapien
aggagtgcccccgggaatggataat

SEQ ID NO: 25724 - DNA, 25 bp, Homo sapien
actatacggctgcgagaagacgaca

SEQ ID NO: 25725 - DNA, 25 bp, Homo sapien
gacgacagaagggcagtgactcgac

SEQ ID NO: 25726 - DNA, 25 bp, Homo sapien
gggcagtgactcgacaaaggccaca

SEQ ID NO: 25727 - DNA, 25 bp, Homo sapien
aaaggccacaggcagtccaggcctc

SEQ ID NO: 25728 - DNA, 25 bp, Homo sapien
ctcttttcagtttttgcttatacac

SEQ ID NO: 25729 - DNA, 25 bp, Homo sapien
acacaattcattctttgcagctaat

SEQ ID NO: 25730 - DNA, 25 bp, Homo sapien
ttaagccgaagaagcctgggaatca

SEQ ID NO: 25731 - DNA, 25 bp, Homo sapien
gttctttgcctagtatacagtttta

SEQ ID NO: 25732 - DNA, 25 bp, Homo sapien
tttatttcattgacaccgatctgta

SEQ ID NO: 25733 - DNA, 25 bp, Homo sapien
cattgacaccgatctgtacacagta

SEQ ID NO: 25734 - DNA, 25 bp, Homo sapien
aatatggctgataacctttggaatt

SEQ ID NO: 25735 - DNA, 25 bp, Homo sapien
gcaaactgaattgagtcaacttctg

SEQ ID NO: 25736 - DNA, 25 bp, Homo sapien
agaagttactgggagctgctatttt

SEQ ID NO: 25737 - DNA, 25 bp, Homo sapien
agatctctaatatttttaagcccaa

SEQ ID NO: 25738 - DNA, 25 bp, Homo sapien
cttggacactgcagctcttttcagt

SEQ ID NO: 25739 - DNA, 25 bp, Homo sapien
agaaggaagtcagtcaccaggccag

SEQ ID NO: 25740 - DNA, 25 bp, Homo sapien
gccagctgggtcatctgctgtaatc

SEQ ID NO: 25741 - DNA, 25 bp, Homo sapien
ggtcatctgctgtaatcacttgtga

SEQ ID NO: 25742 - DNA, 25 bp, Homo sapien
atcacttgtgatcttactgtaataa

SEQ ID NO: 25743 - DNA, 25 bp, Homo sapien
taataaataccttctacatccactg

SEQ ID NO: 25744 - DNA, 25 bp, Homo sapien
aagaccccagagaggaaggcatgcg

SEQ ID NO: 25745 - DNA, 25 bp, Homo sapien
ccacagcatcttccatactatgacc

SEQ ID NO: 25746 - DNA, 25 bp, Homo sapien
cccctactactccagggttgtgttg

SEQ ID NO: 25747 - DNA, 25 bp, Homo sapien
gagaggaaggcatgcggtgggcccc

SEQ ID NO: 25748 - DNA, 25 bp, Homo sapien
tgcctcttgccagtcagaaatcttc

SEQ ID NO: 25749 - DNA, 25 bp, Homo sapien
gaaatcttccaacttgcaagggaga

SEQ ID NO: 25750 - DNA, 25 bp, Homo sapien
aggacaaaaagcttcatgatactgg

SEQ ID NO: 25751 - DNA, 25 bp, Homo sapien
aagcttcatgatactggatttgaca

SEQ ID NO: 25752 - DNA, 25 bp, Homo sapien
ttgacagtgattactatttcttgga

SEQ ID NO: 25753 - DNA, 25 bp, Homo sapien
tgacaccaaaagcatacgcaagaaa

SEQ ID NO: 25754 - DNA, 25 bp, Homo sapien
aaaacttttgtgcaggacgttgtca

SEQ ID NO: 25755 - DNA, 25 bp, Homo sapien
gtgcaggacgttgtcaacacagtga

SEQ ID NO: 25756 - DNA, 25 bp, Homo sapien
atagacaaaggactcgctgggcgtg

SEQ ID NO: 25757 - DNA, 25 bp, Homo sapien
aaaggactcgctgggcgtggtggtt

SEQ ID NO: 25758 - DNA, 25 bp, Homo sapien
gggaggctgagacacaagaattgct

SEQ ID NO: 25759 - DNA, 25 bp, Homo sapien
tggaaggcagaggttgtggtgagtc

SEQ ID NO: 25760 - DNA, 25 bp, Homo sapien
ggttgtggtgagtcgagatcgtgcc

SEQ ID NO: 25761 - DNA, 25 bp, Homo sapien
caagtacccaagtacttcacccagg

SEQ ID NO: 25762 - DNA, 25 bp, Homo sapien
agggacctgggtatagacctgccct

SEQ ID NO: 25763 - DNA, 25 bp, Homo sapien
cacttctggcatgtgcttgcaccag

SEQ ID NO: 25764 - DNA, 25 bp, Homo sapien
tggcatgtgcttgcaccagcagggg

SEQ ID NO: 25765 - DNA, 25 bp, Homo sapien
caccagcagggggcctaacaacagg

SEQ ID NO: 25766 - DNA, 25 bp, Homo sapien
ggggcctaacaacaggccagaccac

SEQ ID NO: 25767 - DNA, 25 bp, Homo sapien
atcaggtcccatgccatcgtgggac

SEQ ID NO: 25768 - DNA, 25 bp, Homo sapien
atcgtgggacctagggatcaccctg

SEQ ID NO: 25769 - DNA, 25 bp, Homo sapien
gttcatcccacctggcatatgtatg

SEQ ID NO: 25770 - DNA, 25 bp, Homo sapien
gagatgtgtttgcctgctgggcatg

SEQ ID NO: 25771 - DNA, 25 bp, Homo sapien
tcagcctgggggataatccgattga

SEQ ID NO: 25772 - DNA, 25 bp, Homo sapien
gaaactcccaggaaacaggcagcct

SEQ ID NO: 25773 - DNA, 25 bp, Homo sapien
cagcctagtttccggaggtggtaga

SEQ ID NO: 25774 - DNA, 25 bp, Homo sapien
ccggaggtggtagaagcttgtgctt

SEQ ID NO: 25775 - DNA, 25 bp, Homo sapien
gcttgtagaaagctaaccatgttaa

SEQ ID NO: 25776 - DNA, 25 bp, Homo sapien
accatgttaaccaccaagggcaaag

SEQ ID NO: 25777 - DNA, 25 bp, Homo sapien
ccaccaagggcaaagcagcccaggt

SEQ ID NO: 25778 - DNA, 25 bp, Homo sapien
cagcccaggtggtgattaggaacag

SEQ ID NO: 25779 - DNA, 25 bp, Homo sapien
acagagcggggatcaaaattttcac

SEQ ID NO: 25780 - DNA, 25 bp, Homo sapien
cagaagacgggtcacgctgaggggc

SEQ ID NO: 25781 - DNA, 25 bp, Homo sapien
cctgcacacacggggttgttgagga

SEQ ID NO: 25782 - DNA, 25 bp, Homo sapien
tgaggacccacagattgggcgccga

SEQ ID NO: 25783 - DNA, 25 bp, Homo sapien
gctgtgttgagagagctgcgttgcg

SEQ ID NO: 25784 - DNA, 25 bp, Homo sapien
gagagagctgcgttgcgtttgttta

SEQ ID NO: 25785 - DNA, 25 bp, Homo sapien
tgcgttgcgtttgtttacagaccac

SEQ ID NO: 25786 - DNA, 25 bp, Homo sapien
gttgcgtttgtttacagaccacgca

SEQ ID NO: 25787 - DNA, 25 bp, Homo sapien
atcagtaatctgcaagtgttcgcca

SEQ ID NO: 25788 - DNA, 25 bp, Homo sapien
taatctgcaagtgttcgccataggc

SEQ ID NO: 25789 - DNA, 25 bp, Homo sapien
gattaagagaaatgagcacgcatgg

SEQ ID NO: 25790 - DNA, 25 bp, Homo sapien
gcacgcatggaaaagtttcccagtc

SEQ ID NO: 25791 - DNA, 25 bp, Homo sapien
gaagttttctggaggtctctgaacc

SEQ ID NO: 25792 - DNA, 25 bp, Homo sapien
gaagagtgtgaggaaaacctatgtt

SEQ ID NO: 25793 - DNA, 25 bp, Homo sapien
ccaggaatcactggctgttaatctt

SEQ ID NO: 25794 - DNA, 25 bp, Homo sapien
acagcaactggatgatgctcgcaac

SEQ ID NO: 25795 - DNA, 25 bp, Homo sapien
gatgctcgcaacaaagctgacaatc

SEQ ID NO: 25796 - DNA, 25 bp, Homo sapien
aagcaatacttaatattcaagccag

SEQ ID NO: 25797 - DNA, 25 bp, Homo sapien
tattcaagccagatgtgatgctaga

SEQ ID NO: 25798 - DNA, 25 bp, Homo sapien
gatgctagagtacaaaaccttcaag

SEQ ID NO: 25799 - DNA, 25 bp, Homo sapien
agtacaaaaccttcaagctgagtgc

SEQ ID NO: 25800 - DNA, 25 bp, Homo sapien
gtgcagaaagcaccgtcttttacta

SEQ ID NO: 25801 - DNA, 25 bp, Homo sapien
gttggtcaatgaactgactcattcg

SEQ ID NO: 25802 - DNA, 25 bp, Homo sapien
gctgtgagacagcttcaacaaaaac

SEQ ID NO: 25803 - DNA, 25 bp, Homo sapien
gcaacaaaagctctgctggatgctt

SEQ ID NO: 25804 - DNA, 25 bp, Homo sapien
aagtatgtatgcaactttgcacacc

SEQ ID NO: 25805 - DNA, 25 bp, Homo sapien
tgatggagctgaacctcttacacca

SEQ ID NO: 25806 - DNA, 25 bp, Homo sapien
aaaacttctcacacaaggtttcaca

SEQ ID NO: 25807 - DNA, 25 bp, Homo sapien
acacaaggtttcacaaactggacta

SEQ ID NO: 25808 - DNA, 25 bp, Homo sapien
tggactaaacgagattttaaccagt

SEQ ID NO: 25809 - DNA, 25 bp, Homo sapien
tggagtattcagctgtattttggga

SEQ ID NO: 25810 - DNA, 25 bp, Homo sapien
ggaacgttgcaatgaattacaggac

SEQ ID NO: 25811 - DNA, 25 bp, Homo sapien
cagtatcaagaaagccctggatgcc

SEQ ID NO: 25812 - DNA, 25 bp, Homo sapien
tttcatcagttgcgcattcagtatg

SEQ ID NO: 25813 - DNA, 25 bp, Homo sapien
atcagttgcgcattcagtatggaac

SEQ ID NO: 25814 - DNA, 25 bp, Homo sapien
gaattccagagacgctgtaacactc

SEQ ID NO: 25815 - DNA, 25 bp, Homo sapien
ccagagacgctgtaacactctgatt

SEQ ID NO: 25816 - DNA, 25 bp, Homo sapien
tggctggggcggccttagcaaacaa

SEQ ID NO: 25817 - DNA, 25 bp, Homo sapien
aacaaggcagggccttctggctgtg

SEQ ID NO: 25818 - DNA, 25 bp, Homo sapien
ggctgtggtcagaggcttttctggt

SEQ ID NO: 25819 - DNA, 25 bp, Homo sapien
tttctggtctttggctgagccgtgc

SEQ ID NO: 25820 - DNA, 25 bp, Homo sapien
ctgagccgtgcagctctgggaattc

SEQ ID NO: 25821 - DNA, 25 bp, Homo sapien
caggggctctttctgaattgtccag

SEQ ID NO: 25822 - DNA, 25 bp, Homo sapien
gaattgtccagggctctctaggagt

SEQ ID NO: 25823 - DNA, 25 bp, Homo sapien
ctctctaggagtctgcacctgcaga

SEQ ID NO: 25824 - DNA, 25 bp, Homo sapien
gagtgcgttggtggggagtgtgcgg

SEQ ID NO: 25825 - DNA, 25 bp, Homo sapien
ggagggggtagagttggcaggtttg

SEQ ID NO: 25826 - DNA, 25 bp, Homo sapien
aaattagaagcttaggccgggtgca

SEQ ID NO: 25827 - DNA, 25 bp, Homo sapien
gaccgtgagctggaggagtaccgca

SEQ ID NO: 25828 - DNA, 25 bp, Homo sapien
aagaaaagagtcctccagaccagcc

SEQ ID NO: 25829 - DNA, 25 bp, Homo sapien
tcccagcactcccatcaagctggag

SEQ ID NO: 25830 - DNA, 25 bp, Homo sapien
gctggaggaagaccttgtgccggag

SEQ ID NO: 25831 - DNA, 25 bp, Homo sapien
tgccggagccgactactggagatga

SEQ ID NO: 25832 - DNA, 25 bp, Homo sapien
gacagtgatgctgccacctttaagc

SEQ ID NO: 25833 - DNA, 25 bp, Homo sapien
tctgtcccctgatgaaccttcagaa

SEQ ID NO: 25834 - DNA, 25 bp, Homo sapien
cactcggcttcccaatgttagagaa

SEQ ID NO: 25835 - DNA, 25 bp, Homo sapien
ggaccctggcagcgatgggtctcca

SEQ ID NO: 25836 - DNA, 25 bp, Homo sapien
taccccgtcctttctgaagaagagc

SEQ ID NO: 25837 - DNA, 25 bp, Homo sapien
agaagagtgactcctgaaagccctg

SEQ ID NO: 25838 - DNA, 25 bp, Homo sapien
ggaggccgaggcatgagaatcactt

SEQ ID NO: 25839 - DNA, 25 bp, Homo sapien
cgtgcagcagatcccaggagttgga

SEQ ID NO: 25840 - DNA, 25 bp, Homo sapien
ttctcctccagaagtttccaagcat

SEQ ID NO: 25841 - DNA, 25 bp, Homo sapien
gtttccaagcatccagcaactgagt

SEQ ID NO: 25842 - DNA, 25 bp, Homo sapien
gcaactgagtaatgcttccattggg

SEQ ID NO: 25843 - DNA, 25 bp, Homo sapien
atgcttccattggggaactggagca

SEQ ID NO: 25844 - DNA, 25 bp, Homo sapien
aactggagcaggtggtcggacaagc

SEQ ID NO: 25845 - DNA, 25 bp, Homo sapien
gcaggtggtcggacaagcagtggca

SEQ ID NO: 25846 - DNA, 25 bp, Homo sapien
ccgagaccacaaacaccaggatctt

SEQ ID NO: 25847 - DNA, 25 bp, Homo sapien
accaagagaatgggccgggtgcact

SEQ ID NO: 25848 - DNA, 25 bp, Homo sapien
ggaggccgaagacagcggatcatct

SEQ ID NO: 25849 - DNA, 25 bp, Homo sapien
gaggtgcagctgttggagtctgggg

SEQ ID NO: 25850 - DNA, 25 bp, Homo sapien
gagtctgggggaggcttggtacagc

SEQ ID NO: 25851 - DNA, 25 bp, Homo sapien
ggttcaccatctccagagacaattc

SEQ ID NO: 25852 - DNA, 25 bp, Homo sapien
agagacaattccaagaacacgctgt

SEQ ID NO: 25853 - DNA, 25 bp, Homo sapien
gcaaatgaacagcctgagagccgag

SEQ ID NO: 25854 - DNA, 25 bp, Homo sapien
ccaacctatgttgactactggggcc

SEQ ID NO: 25855 - DNA, 25 bp, Homo sapien
tactggggccaggaaccctggtcac

SEQ ID NO: 25856 - DNA, 25 bp, Homo sapien
tcaccgtctcctcagggagtgcatc

SEQ ID NO: 25857 - DNA, 25 bp, Homo sapien
tgtgagaattccccgtcggatacga

SEQ ID NO: 25858 - DNA, 25 bp, Homo sapien
ttccccgtcggatacgaagcagcgt

SEQ ID NO: 25859 - DNA, 25 bp, Homo sapien
gaagcagcgtggccgttggctgctc

SEQ ID NO: 25860 - DNA, 25 bp, Homo sapien
gggagatctgcagaagcatcagacc

SEQ ID NO: 25861 - DNA, 25 bp, Homo sapien
agaagcatcagaccaggcagggcct

SEQ ID NO: 25862 - DNA, 25 bp, Homo sapien
gcagtcctgaggagttttactttta

SEQ ID NO: 25863 - DNA, 25 bp, Homo sapien
ttggggagagactggattccagcct

SEQ ID NO: 25864 - DNA, 25 bp, Homo sapien
ctggattccagcctgcaaaagctgt

SEQ ID NO: 25865 - DNA, 25 bp, Homo sapien
aaaaccagtgaggagaggtggaggt

SEQ ID NO: 25866 - DNA, 25 bp, Homo sapien
attcttggaaagattctgaaggctg

SEQ ID NO: 25867 - DNA, 25 bp, Homo sapien
gaaggctgtgttgaaaagacaccta

SEQ ID NO: 25868 - DNA, 25 bp, Homo sapien
aagacacctatagctgtggggacat

SEQ ID NO: 25869 - DNA, 25 bp, Homo sapien
gggcaacagaacaatactccattcc

SEQ ID NO: 25870 - DNA, 25 bp, Homo sapien
caacagaacaatactccattccctc

SEQ ID NO: 25871 - DNA, 25 bp, Homo sapien
tcctcgtctgggatggtgcccaaat

SEQ ID NO: 25872 - DNA, 25 bp, Homo sapien
gatggtgcccaaattgccagctggc

SEQ ID NO: 25873 - DNA, 25 bp, Homo sapien
tgaataaccgtgatctcaaacccca

SEQ ID NO: 25874 - DNA, 25 bp, Homo sapien
ctgatatagtcttgcttccgttgcc

SEQ ID NO: 25875 - DNA, 25 bp, Homo sapien
cccactgcctatgagctagacagca

SEQ ID NO: 25876 - DNA, 25 bp, Homo sapien
tgaagagcccactaattacttcccc

SEQ ID NO: 25877 - DNA, 25 bp, Homo sapien
atgttccgtaatgtgcccacagcaa

SEQ ID NO: 25878 - DNA, 25 bp, Homo sapien
gcacatgcgcccaagtgggaatcca

SEQ ID NO: 25879 - DNA, 25 bp, Homo sapien
gaatccaaggactttagacctaaca

SEQ ID NO: 25880 - DNA, 25 bp, Homo sapien
gacctaacaaagtctccgaaactag

SEQ ID NO: 25881 - DNA, 25 bp, Homo sapien
aggactactaccacatctttatccc

SEQ ID NO: 25882 - DNA, 25 bp, Homo sapien
ggctgcaagcagtgacagtgcccag

SEQ ID NO: 25883 - DNA, 25 bp, Homo sapien
agacagctgccttgtgtgggactga

SEQ ID NO: 25884 - DNA, 25 bp, Homo sapien
gaagaaccctgactttgtttctgca

SEQ ID NO: 25885 - DNA, 25 bp, Homo sapien
tgcatgtgtctgtgttcgtgtaggc

SEQ ID NO: 25886 - DNA, 25 bp, Homo sapien
caatcatctttcctgttccagagag

SEQ ID NO: 25887 - DNA, 25 bp, Homo sapien
catctctgtctcaacttcatggtgc

SEQ ID NO: 25888 - DNA, 25 bp, Homo sapien
tggtgcactgagctgtaacttcttc

SEQ ID NO: 25889 - DNA, 25 bp, Homo sapien
tgagatgggagctgtcttcccagcc

SEQ ID NO: 25890 - DNA, 25 bp, Homo sapien
catcgtgggcatcattgctggcctg

SEQ ID NO: 25891 - DNA, 25 bp, Homo sapien
tgatcactggagctgtggtcgctgc

SEQ ID NO: 25892 - DNA, 25 bp, Homo sapien
gtcgctgccgtgatgtggaggagga

SEQ ID NO: 25893 - DNA, 25 bp, Homo sapien
cagtctttcccagggaactccgatg

SEQ ID NO: 25894 - DNA, 25 bp, Homo sapien
ctttcccagggaactccgatgaagt

SEQ ID NO: 25895 - DNA, 25 bp, Homo sapien
gaactccgatgaagtgttccaacaa

SEQ ID NO: 25896 - DNA, 25 bp, Homo sapien
gtgttccaacaaaatgagcgagtga

SEQ ID NO: 25897 - DNA, 25 bp, Homo sapien
gacattagatccaggagatacaaca

SEQ ID NO: 25898 - DNA, 25 bp, Homo sapien
ggagataatctccaggatgcctgtg

SEQ ID NO: 25899 - DNA, 25 bp, Homo sapien
atgcctgtgaagaaagatccctgga

SEQ ID NO: 25900 - DNA, 25 bp, Homo sapien
ggatcccaggatgattataggacaa

SEQ ID NO: 25901 - DNA, 25 bp, Homo sapien
aagttgttcataatccagcaggcca

SEQ ID NO: 25902 - DNA, 25 bp, Homo sapien
cagcaggccagaagacttccaggga

SEQ ID NO: 25903 - DNA, 25 bp, Homo sapien
cagaagacttccagggaaactcatt

SEQ ID NO: 25904 - DNA, 25 bp, Homo sapien
agctgtgatggtgccttctggagaa

SEQ ID NO: 25905 - DNA, 25 bp, Homo sapien
ccctcaccctgagatgggagccgtc

SEQ ID NO: 25906 - DNA, 25 bp, Homo sapien
cagtgcccagggctctgatgagtct

SEQ ID NO: 25907 - DNA, 25 bp, Homo sapien
tgagtctctcatcgcttgtaaagcc

SEQ ID NO: 25908 - DNA, 25 bp, Homo sapien
agctgcctgtgtgggactgagatgc

SEQ ID NO: 25909 - DNA, 25 bp, Homo sapien
agatgcaggatttcttcacacctct

SEQ ID NO: 25910 - DNA, 25 bp, Homo sapien
gtgacttcaagagcctctggcatct

SEQ ID NO: 25911 - DNA, 25 bp, Homo sapien
ggcatctctttctgcaaaggcatct

SEQ ID NO: 25912 - DNA, 25 bp, Homo sapien
ggcatctgaatgtgtctgcgttcct

SEQ ID NO: 25913 - DNA, 25 bp, Homo sapien
ctgtccccaacacatgacctgtgtt

SEQ ID NO: 25914 - DNA, 25 bp, Homo sapien
cgatcatctttcctgttccagagaa

SEQ ID NO: 25915 - DNA, 25 bp, Homo sapien
accatgcatccccaaaaccaaggag

SEQ ID NO: 25916 - DNA, 25 bp, Homo sapien
catgcatccccaaaaccaaggagcc

SEQ ID NO: 25917 - DNA, 25 bp, Homo sapien
ccagcccagcagaagaccaagcaga

SEQ ID NO: 25918 - DNA, 25 bp, Homo sapien
caagcagaagtaatgtggtccacag

SEQ ID NO: 25919 - DNA, 25 bp, Homo sapien
agtaatgtggtccacagccatgccc

SEQ ID NO: 25920 - DNA, 25 bp, Homo sapien
ccacagccatgcccttgaggagctg

SEQ ID NO: 25921 - DNA, 25 bp, Homo sapien
agccatgcccttgaggagctggcca

SEQ ID NO: 25922 - DNA, 25 bp, Homo sapien
ccttgaggagctggccactggatac

SEQ ID NO: 25923 - DNA, 25 bp, Homo sapien
tgaggagctggccactggatactga

SEQ ID NO: 25924 - DNA, 25 bp, Homo sapien
gcagcaggtgaaacaaccttgccag

SEQ ID NO: 25925 - DNA, 25 bp, Homo sapien
caggtgaaacaaccttgccagcctc

SEQ ID NO: 25926 - DNA, 25 bp, Homo sapien
aggtcctgaagatcgccaagttttt

SEQ ID NO: 25927 - DNA, 25 bp, Homo sapien
ggggcaagaccaagtacaacgggtg

SEQ ID NO: 25928 - DNA, 25 bp, Homo sapien
ccccctggtctgccagaaggacgga

SEQ ID NO: 25929 - DNA, 25 bp, Homo sapien
ccagaaggacggagcctggaccctg

SEQ ID NO: 25930 - DNA, 25 bp, Homo sapien
tggaccctggtgggcattgtgtcct

SEQ ID NO: 25931 - DNA, 25 bp, Homo sapien
tcaccaagctcataccctgggtgca

SEQ ID NO: 25932 - DNA, 25 bp, Homo sapien
ccctgggtgcagaagatcctggccg

SEQ ID NO: 25933 - DNA, 25 bp, Homo sapien
cctgccttaagatttcccattaaat

SEQ ID NO: 25934 - DNA, 25 bp, Homo sapien
gaaccccaagttcagcattctgacc

SEQ ID NO: 25935 - DNA, 25 bp, Homo sapien
tcagcattctgaccgtgaacaatga

SEQ ID NO: 25936 - DNA, 25 bp, Homo sapien
tgaacaatgacatcaccctgctgaa

SEQ ID NO: 25937 - DNA, 25 bp, Homo sapien
gctcactaggggacatgcacatgga

SEQ ID NO: 25938 - DNA, 25 bp, Homo sapien
tgcacatggaagctcacctctaaga

SEQ ID NO: 25939 - DNA, 25 bp, Homo sapien
gaagctcacctctaagaaagggctg

SEQ ID NO: 25940 - DNA, 25 bp, Homo sapien
agggctgggcagatggatttatttt

SEQ ID NO: 25941 - DNA, 25 bp, Homo sapien
acaaaaccattatctttgagggagt

SEQ ID NO: 25942 - DNA, 25 bp, Homo sapien
gaacagagatttgtgtgctcatctt

SEQ ID NO: 25943 - DNA, 25 bp, Homo sapien
gtgctcatcttaagagccagagcca

SEQ ID NO: 25944 - DNA, 25 bp, Homo sapien
aagcaagtttgaaccagctgctggt

SEQ ID NO: 25945 - DNA, 25 bp, Homo sapien
accagctgctggtgtaatgtacagt

SEQ ID NO: 25946 - DNA, 25 bp, Homo sapien
taaatggagctgtttatggcaattt

SEQ ID NO: 25947 - DNA, 25 bp, Homo sapien
ggcaatttaataccattctctttgt

SEQ ID NO: 25948 - DNA, 25 bp, Homo sapien
gtggctacttacaggcatgatcatg

SEQ ID NO: 25949 - DNA, 25 bp, Homo sapien
actcctggactagagcagttctcct

SEQ ID NO: 25950 - DNA, 25 bp, Homo sapien
tcctggactagagcagttctcctgc

SEQ ID NO: 25951 - DNA, 25 bp, Homo sapien
cagagcccagcctgagtcattttga

SEQ ID NO: 25952 - DNA, 25 bp, Homo sapien
agcccagcctgagtcattttgattc

SEQ ID NO: 25953 - DNA, 25 bp, Homo sapien
atgcaggccatcgatggaaatgtca

SEQ ID NO: 25954 - DNA, 25 bp, Homo sapien
catcgatggaaatgtcagacagtgc

SEQ ID NO: 25955 - DNA, 25 bp, Homo sapien
tgggactgacactggcagatccatc

SEQ ID NO: 25956 - DNA, 25 bp, Homo sapien
ggactgacactggcagatccatcga

SEQ ID NO: 25957 - DNA, 25 bp, Homo sapien
agcgttgttttcctatgtataattg

SEQ ID NO: 25958 - DNA, 25 bp, Homo sapien
tcctatgtataattgtctcctccca

SEQ ID NO: 25959 - DNA, 25 bp, Homo sapien
cctgctgttttattcatttcctaat

SEQ ID NO: 25960 - DNA, 25 bp, Homo sapien
ttattcatttcctaattttaagatt

SEQ ID NO: 25961 - DNA, 25 bp, Homo sapien
aagcatgatcttgtgtatttgtata

SEQ ID NO: 25962 - DNA, 25 bp, Homo sapien
gaagaccaggagatcctgcatagcc

SEQ ID NO: 25963 - DNA, 25 bp, Homo sapien
agatcctgcatagccttcacagaga

SEQ ID NO: 25964 - DNA, 25 bp, Homo sapien
agccttcacagagagtccagttgcc

SEQ ID NO: 25965 - DNA, 25 bp, Homo sapien
ttcacagagagtccagttgccaagg

SEQ ID NO: 25966 - DNA, 25 bp, Homo sapien
tcatgcttatttgagtattcagaaa

SEQ ID NO: 25967 - DNA, 25 bp, Homo sapien
gagttttgatatttgctctgtattt

SEQ ID NO: 25968 - DNA, 25 bp, Homo sapien
tatttgctctgtatttatttattta

SEQ ID NO: 25969 - DNA, 25 bp, Homo sapien
tgagacggagtttcgctcttgttgc

SEQ ID NO: 25970 - DNA, 25 bp, Homo sapien
actccgtcctgggtgacaaagtgag

SEQ ID NO: 25971 - DNA, 25 bp, Homo sapien
gtgacaaagtgagactccctctcaa

SEQ ID NO: 25972 - DNA, 25 bp, Homo sapien
ctaacatctgtagtactaatctttt

SEQ ID NO: 25973 - DNA, 25 bp, Homo sapien
gtactaatcttttttccagtggctt

SEQ ID NO: 25974 - DNA, 25 bp, Homo sapien
tttccagtggctttaaactgcaaat

SEQ ID NO: 25975 - DNA, 25 bp, Homo sapien
gaatgttgtttctgtaggtaaaatt

SEQ ID NO: 25976 - DNA, 25 bp, Homo sapien
cttttgttagttttttcaggcatat

SEQ ID NO: 25977 - DNA, 25 bp, Homo sapien
gtaaatgaggtatccatcaccttta

SEQ ID NO: 25978 - DNA, 25 bp, Homo sapien
gtatccatcacctttagaatttatt

SEQ ID NO: 25979 - DNA, 25 bp, Homo sapien
gaacagttcaattgtacagttttag

SEQ ID NO: 25980 - DNA, 25 bp, Homo sapien
atacgattgttattgactacagggt

SEQ ID NO: 25981 - DNA, 25 bp, Homo sapien
tcaacttcaagctcctaagccactg

SEQ ID NO: 25982 - DNA, 25 bp, Homo sapien
tgctgacctccaaataccgttaagc

SEQ ID NO: 25983 - DNA, 25 bp, Homo sapien
ctgacctccaaataccgttaagctg

SEQ ID NO: 25984 - DNA, 25 bp, Homo sapien
gacctccaaataccgttaagctgga

SEQ ID NO: 25985 - DNA, 25 bp, Homo sapien
caaataccgttaagctggagcctcg

SEQ ID NO: 25986 - DNA, 25 bp, Homo sapien
aataccgttaagctggagcctcggt

SEQ ID NO: 25987 - DNA, 25 bp, Homo sapien
accgttaagctggagcctcggtagc

SEQ ID NO: 25988 - DNA, 25 bp, Homo sapien
ccgttaagctggagcctcggtagcc

SEQ ID NO: 25989 - DNA, 25 bp, Homo sapien
gcccttcctggtctttgaataaagt

SEQ ID NO: 25990 - DNA, 25 bp, Homo sapien
cttcctggtctttgaataaagtctg

SEQ ID NO: 25991 - DNA, 25 bp, Homo sapien
ctggtctttgaataaagtctgagtg

SEQ ID NO: 25992 - DNA, 25 bp, Homo sapien
gaaaactcagtgcaggttgccctta

SEQ ID NO: 25993 - DNA, 25 bp, Homo sapien
cagtgcaggttgcccttaattttcc

SEQ ID NO: 25994 - DNA, 25 bp, Homo sapien
caagtctagttgccctttagcacct

SEQ ID NO: 25995 - DNA, 25 bp, Homo sapien
ttagcacctaaagatctgcacccca

SEQ ID NO: 25996 - DNA, 25 bp, Homo sapien
ccccaaaccaatgtcaccataaaga

SEQ ID NO: 25997 - DNA, 25 bp, Homo sapien
gagtgggtgtgatcccaacggggtt

SEQ ID NO: 25998 - DNA, 25 bp, Homo sapien
tgatcccaacggggttttgtaactg

SEQ ID NO: 25999 - DNA, 25 bp, Homo sapien
gtgagcttctcatcttttcatatac

SEQ ID NO: 26000 - DNA, 25 bp, Homo sapien
tctaacccccggtactcattgaatc

SEQ ID NO: 26001 - DNA, 25 bp, Homo sapien
gatttgcaaggactttgataccatt

SEQ ID NO: 26002 - DNA, 25 bp, Homo sapien
gccaagatggcaaaaaccccgactc

SEQ ID NO: 26003 - DNA, 25 bp, Homo sapien
attgtgatgactcagtctccactct

SEQ ID NO: 26004 - DNA, 25 bp, Homo sapien
tccatctcctgcaggtctagtcaga

SEQ ID NO: 26005 - DNA, 25 bp, Homo sapien
atttggattggtacctgcagaagcc

SEQ ID NO: 26006 - DNA, 25 bp, Homo sapien
tgcagaagccagggcagtctccaca

SEQ ID NO: 26007 - DNA, 25 bp, Homo sapien
tctccacagctcctgatctatttgg

SEQ ID NO: 26008 - DNA, 25 bp, Homo sapien
tctatttgggttctaatcgggcctc

SEQ ID NO: 26009 - DNA, 25 bp, Homo sapien
gacaggttcagtggcagtggatcag

SEQ ID NO: 26010 - DNA, 25 bp, Homo sapien
gatgttggggtttattactgcatgc

SEQ ID NO: 26011 - DNA, 25 bp, Homo sapien
tactgcatgcaagctctacaaactc

SEQ ID NO: 26012 - DNA, 25 bp, Homo sapien
caaacgaactgtggctgcaccatct

SEQ ID NO: 26013 - DNA, 25 bp, Homo sapien
aatgctctgggtctctggatccagt

SEQ ID NO: 26014 - DNA, 25 bp, Homo sapien
gggccagtgctgggaggattttgtg

SEQ ID NO: 26015 - DNA, 25 bp, Homo sapien
tgggaggattttgtgggccaggagc

SEQ ID NO: 26016 - DNA, 25 bp, Homo sapien
ggccaggagctgtaccggttcctgg

SEQ ID NO: 26017 - DNA, 25 bp, Homo sapien
gctgtaccggttcctggtgatggac

SEQ ID NO: 26018 - DNA, 25 bp, Homo sapien
tgtaccggttcctggtgatggactt

SEQ ID NO: 26019 - DNA, 25 bp, Homo sapien
gtgatggacttcgtcctcatgttgc

SEQ ID NO: 26020 - DNA, 25 bp, Homo sapien
gacttcgtcctcatgttgctggaca

SEQ ID NO: 26021 - DNA, 25 bp, Homo sapien
tcgtcctcatgttgctggacacgct

SEQ ID NO: 26022 - DNA, 25 bp, Homo sapien
tcatgttgctggacacgctttttgg

SEQ ID NO: 26023 - DNA, 25 bp, Homo sapien
gttgctggacacgctttttggggaa

SEQ ID NO: 26024 - DNA, 25 bp, Homo sapien
tggacacgctttttggggaactggt

SEQ ID NO: 26025 - DNA, 25 bp, Homo sapien
tttctgattttccctaattttatat

SEQ ID NO: 26026 - DNA, 25 bp, Homo sapien
tatgtctgatgagcaatttgtgttt

SEQ ID NO: 26027 - DNA, 25 bp, Homo sapien
agaagtcactgatggtggcttgtaa

SEQ ID NO: 26028 - DNA, 25 bp, Homo sapien
acagactaagtaatttggatcatga

SEQ ID NO: 26029 - DNA, 25 bp, Homo sapien
taatctctttgtaggctttggagaa

SEQ ID NO: 26030 - DNA, 25 bp, Homo sapien
agaagataaacatctcaggccggga

SEQ ID NO: 26031 - DNA, 25 bp, Homo sapien
gaggtgggcagatgcttgagctcag

SEQ ID NO: 26032 - DNA, 25 bp, Homo sapien
agaagttcaagatcaccctggctaa

SEQ ID NO: 26033 - DNA, 25 bp, Homo sapien
gtgcctgtaattccatctacttgag

SEQ ID NO: 26034 - DNA, 25 bp, Homo sapien
gaggcttaggtaggagaagtgcttg

SEQ ID NO: 26035 - DNA, 25 bp, Homo sapien
gaagtgcttgaactggggaggcaga

SEQ ID NO: 26036 - DNA, 25 bp, Homo sapien
acaactctagttcttatgtggaggg

SEQ ID NO: 26037 - DNA, 25 bp, Homo sapien
gtgcattggagtgcactatccctcc

SEQ ID NO: 26038 - DNA, 25 bp, Homo sapien
cactatccctccacagaagtgcttc

SEQ ID NO: 26039 - DNA, 25 bp, Homo sapien
cccaggtatttctgagtctgacgat

SEQ ID NO: 26040 - DNA, 25 bp, Homo sapien
gtctgacgatcatggagtgaaggcc

SEQ ID NO: 26041 - DNA, 25 bp, Homo sapien
ggagaatcaaataatgccccccaag

SEQ ID NO: 26042 - DNA, 25 bp, Homo sapien
gccccccaagttactaagtgtcttg

SEQ ID NO: 26043 - DNA, 25 bp, Homo sapien
aagtgtcttgctgaacttttgcttt

SEQ ID NO: 26044 - DNA, 25 bp, Homo sapien
gagataactcgagacagtgcaggaa

SEQ ID NO: 26045 - DNA, 25 bp, Homo sapien
catttaaaacctaaccttgaggctg

SEQ ID NO: 26046 - DNA, 25 bp, Homo sapien
cacctgaatccggtggggcggaggt

SEQ ID NO: 26047 - DNA, 25 bp, Homo sapien
atctcaaattgcacctcctcagaga

SEQ ID NO: 26048 - DNA, 25 bp, Homo sapien
ctcagagaggtcttccataaccgcc

SEQ ID NO: 26049 - DNA, 25 bp, Homo sapien
tcttccataaccgcccttataaagc

SEQ ID NO: 26050 - DNA, 25 bp, Homo sapien
aagcaggattctttcaccaataccc

SEQ ID NO: 26051 - DNA, 25 bp, Homo sapien
tctcacagcactcctctaaaagtct

SEQ ID NO: 26052 - DNA, 25 bp, Homo sapien
agtctgtttacttccttgacaatct

SEQ ID NO: 26053 - DNA, 25 bp, Homo sapien
gactctctctgtctagttgactgtt

SEQ ID NO: 26054 - DNA, 25 bp, Homo sapien
ggcttagaccaaggccctgacatgc

SEQ ID NO: 26055 - DNA, 25 bp, Homo sapien
ggccctgacatgcagtaggtgctta

SEQ ID NO: 26056 - DNA, 25 bp, Homo sapien
attataggcatggagccgccacacc

SEQ ID NO: 26057 - DNA, 25 bp, Homo sapien
cacacccagccaatgtgccgaagaa

SEQ ID NO: 26058 - DNA, 25 bp, Homo sapien
gagtgtggaacagaggtgtcaacat

SEQ ID NO: 26059 - DNA, 25 bp, Homo sapien
gtgtcaacatcacctccgggtgaag

SEQ ID NO: 26060 - DNA, 25 bp, Homo sapien
acatcacctccgggtgaagggattt

SEQ ID NO: 26061 - DNA, 25 bp, Homo sapien
gaagggatttcaggagcacgttctt

SEQ ID NO: 26062 - DNA, 25 bp, Homo sapien
ggatttcaggagcacgttcttttct

SEQ ID NO: 26063 - DNA, 25 bp, Homo sapien
tcaggagcacgttcttttctgtaca

SEQ ID NO: 26064 - DNA, 25 bp, Homo sapien
ccccgagccagtcaagctgaaggga

SEQ ID NO: 26065 - DNA, 25 bp, Homo sapien
ctgaagggagagcgggtgcgggggc

SEQ ID NO: 26066 - DNA, 25 bp, Homo sapien
cctattttactactattgaccctga

SEQ ID NO: 26067 - DNA, 25 bp, Homo sapien
actattgaccctgaaggccatcgag

SEQ ID NO: 26068 - DNA, 25 bp, Homo sapien
tattgaccctgaaggccatcgagga

SEQ ID NO: 26069 - DNA, 25 bp, Homo sapien
ccttaacttctcgacagttccgtga

SEQ ID NO: 26070 - DNA, 25 bp, Homo sapien
gacagttccgtgaggatgacttccg

SEQ ID NO: 26071 - DNA, 25 bp, Homo sapien
atgacttccggagagttgtggactt

SEQ ID NO: 26072 - DNA, 25 bp, Homo sapien
gatgaaggggtcaacattggcttag

SEQ ID NO: 26073 - DNA, 25 bp, Homo sapien
gggtcaacattggcttagaggtgaa

SEQ ID NO: 26074 - DNA, 25 bp, Homo sapien
tgaagagcaagactgccaagctcca

SEQ ID NO: 26075 - DNA, 25 bp, Homo sapien
aagctccaggatttcaaatccttcc

SEQ ID NO: 26076 - DNA, 25 bp, Homo sapien
ccttcctgcttaaggactcagaaac

SEQ ID NO: 26077 - DNA, 25 bp, Homo sapien
agaaacaagtcagcgtctggccaac

SEQ ID NO: 26078 - DNA, 25 bp, Homo sapien
gccaacctcaggcaacgggtggagc

SEQ ID NO: 26079 - DNA, 25 bp, Homo sapien
aacgggtggagcagtttgccagggc

SEQ ID NO: 26080 - DNA, 25 bp, Homo sapien
gtatgcaagactgattctgtttgga

SEQ ID NO: 26081 - DNA, 25 bp, Homo sapien
aacagtttcctatttggctgcattc

SEQ ID NO: 26082 - DNA, 25 bp, Homo sapien
gctgcattctaggaggcctcctgac

SEQ ID NO: 26083 - DNA, 25 bp, Homo sapien
aggcctcctgacttattcatagtat

SEQ ID NO: 26084 - DNA, 25 bp, Homo sapien
ttcatagtattgtcgcctggtggca

SEQ ID NO: 26085 - DNA, 25 bp, Homo sapien
ttgtcgcctggtggcattggtgtgg

SEQ ID NO: 26086 - DNA, 25 bp, Homo sapien
gcttgtcctgctacttgctaaagtt

SEQ ID NO: 26087 - DNA, 25 bp, Homo sapien
gctacttgctaaagttctctttctt

SEQ ID NO: 26088 - DNA, 25 bp, Homo sapien
aatgaccatctcacaaaaacgagtt

SEQ ID NO: 26089 - DNA, 25 bp, Homo sapien
gagtttagttgaatgctcaattcct

SEQ ID NO: 26090 - DNA, 25 bp, Homo sapien
gctcaattccttacaaaatcttcat

SEQ ID NO: 26091 - DNA, 25 bp, Homo sapien
gagggaaagctgtttgttcttaata

SEQ ID NO: 26092 - DNA, 25 bp, Homo sapien
gtagaatgaaactcacatgtgtcac

SEQ ID NO: 26093 - DNA, 25 bp, Homo sapien
acatgtgtcactaaccaaggggcct

SEQ ID NO: 26094 - DNA, 25 bp, Homo sapien
ctatgcagctttccctttattactg

SEQ ID NO: 26095 - DNA, 25 bp, Homo sapien
gcagctttccctttattactggagg

SEQ ID NO: 26096 - DNA, 25 bp, Homo sapien
gtgtgaagataactttttccctcaa

SEQ ID NO: 26097 - DNA, 25 bp, Homo sapien
tttccctcaaacgattgtaaagagc

SEQ ID NO: 26098 - DNA, 25 bp, Homo sapien
attaagatgagagacgggccaggcg

SEQ ID NO: 26099 - DNA, 25 bp, Homo sapien
atgagagacgggccaggcgcagtgg

SEQ ID NO: 26100 - DNA, 25 bp, Homo sapien
ggcgcagtggttcatgtctgtaatc

SEQ ID NO: 26101 - DNA, 25 bp, Homo sapien
tggccaacatggcgaaacctcttct

SEQ ID NO: 26102 - DNA, 25 bp, Homo sapien
tgaataaatctcccatctgttccaa

SEQ ID NO: 26103 - DNA, 25 bp, Homo sapien
aattgcgcatcaaatatggtactta

SEQ ID NO: 26104 - DNA, 25 bp, Homo sapien
aactgcctagcaggatagtttgtgt

SEQ ID NO: 26105 - DNA, 25 bp, Homo sapien
aggatagtttgtgttactctgcctg

SEQ ID NO: 26106 - DNA, 25 bp, Homo sapien
tctgcctgtatccatgaccgtgata

SEQ ID NO: 26107 - DNA, 25 bp, Homo sapien
gcctgtatccatgaccgtgataaga

SEQ ID NO: 26108 - DNA, 25 bp, Homo sapien
ataaaaatgagccagatgcggtggt

SEQ ID NO: 26109 - DNA, 25 bp, Homo sapien
gaggttgagtcttattttcatttgt

SEQ ID NO: 26110 - DNA, 25 bp, Homo sapien
tatttctctcactgcctagcatagt

SEQ ID NO: 26111 - DNA, 25 bp, Homo sapien
cctagcatagtgcctttcactcagt

SEQ ID NO: 26112 - DNA, 25 bp, Homo sapien
agtgcctttcactcagttggaatat

SEQ ID NO: 26113 - DNA, 25 bp, Homo sapien
gagtttcctatgtttcactgtgcaa

SEQ ID NO: 26114 - DNA, 25 bp, Homo sapien
aaactatctcattcccaagggcaca

SEQ ID NO: 26115 - DNA, 25 bp, Homo sapien
ggcacaaccatattaatttccctga

SEQ ID NO: 26116 - DNA, 25 bp, Homo sapien
ccctgacttctgtgctacatgacaa

SEQ ID NO: 26117 - DNA, 25 bp, Homo sapien
agatgtttgaccctcatcactttct

SEQ ID NO: 26118 - DNA, 25 bp, Homo sapien
gtaaatacttcatgcctttctcagc

SEQ ID NO: 26119 - DNA, 25 bp, Homo sapien
cagggacctccattttacagaactt

SEQ ID NO: 26120 - DNA, 25 bp, Homo sapien
ttgtcaatggatttgcctctgtgcc

SEQ ID NO: 26121 - DNA, 25 bp, Homo sapien
gctgtgcttcattcctgtctgaaga

SEQ ID NO: 26122 - DNA, 25 bp, Homo sapien
tcctctggggcattatccatctttc

SEQ ID NO: 26123 - DNA, 25 bp, Homo sapien
cactatctgtaatgccttttctcac

SEQ ID NO: 26124 - DNA, 25 bp, Homo sapien
tgctgcgtggcattaaggttctggc

SEQ ID NO: 26125 - DNA, 25 bp, Homo sapien
tggcattaaggttctggcacagaga

SEQ ID NO: 26126 - DNA, 25 bp, Homo sapien
aaaaagcggggctcatccaggattg

SEQ ID NO: 26127 - DNA, 25 bp, Homo sapien
ccaggattggtggtgtgctcgttgc

SEQ ID NO: 26128 - DNA, 25 bp, Homo sapien
gtgctcgttgcatatacagtgtcca

SEQ ID NO: 26129 - DNA, 25 bp, Homo sapien
atatacagtgtccagggtctcacct

SEQ ID NO: 26130 - DNA, 25 bp, Homo sapien
cagggtctcacctccagagatgaag

SEQ ID NO: 26131 - DNA, 25 bp, Homo sapien
atgaagtcagtgaagggtcctgaga

SEQ ID NO: 26132 - DNA, 25 bp, Homo sapien
gatgatttcagtgcaggtgattcag

SEQ ID NO: 26133 - DNA, 25 bp, Homo sapien
cagagacctcacttgaaaatatatt

SEQ ID NO: 26134 - DNA, 25 bp, Homo sapien
actgttcttttctgctacagagatc

SEQ ID NO: 26135 - DNA, 25 bp, Homo sapien
ccaggcccttctggttggtagtgag

SEQ ID NO: 26136 - DNA, 25 bp, Homo sapien
gcccttctggttggtagtgagtgtg

SEQ ID NO: 26137 - DNA, 25 bp, Homo sapien
tagtgagtgtggacagcttcccagc

SEQ ID NO: 26138 - DNA, 25 bp, Homo sapien
cagctcttcgggtacaaccctgagc

SEQ ID NO: 26139 - DNA, 25 bp, Homo sapien
ggtacaaccctgagcaggtcggggg

SEQ ID NO: 26140 - DNA, 25 bp, Homo sapien
ctgagcaggtcgggggacacagggc

SEQ ID NO: 26141 - DNA, 25 bp, Homo sapien
cctgcttccgggcagggacgaggcc

SEQ ID NO: 26142 - DNA, 25 bp, Homo sapien
ctgctgtcacctgaggggaatctgc

SEQ ID NO: 26143 - DNA, 25 bp, Homo sapien
ggaatctgcttcttaggagtgggtt

SEQ ID NO: 26144 - DNA, 25 bp, Homo sapien
ggagtgggttgagctgatagagaaa

SEQ ID NO: 26145 - DNA, 25 bp, Homo sapien
gagaaaaaacggccttcagcccagg

SEQ ID NO: 26146 - DNA, 25 bp, Homo sapien
acttttcttcatttagagtggaggg

SEQ ID NO: 26147 - DNA, 25 bp, Homo sapien
gagggtctctgaaggcagacaccat

SEQ ID NO: 26148 - DNA, 25 bp, Homo sapien
tgaacagattctctgcagactccca

SEQ ID NO: 26149 - DNA, 25 bp, Homo sapien
gtggcggccacaggtaaagcgaggg

SEQ ID NO: 26150 - DNA, 25 bp, Homo sapien
aagcgaggggagcccaggatgcaaa

SEQ ID NO: 26151 - DNA, 25 bp, Homo sapien
acacgtcaaatctctcggcaaggtc

SEQ ID NO: 26152 - DNA, 25 bp, Homo sapien
ggcaaggtcttgccgattctgtgtg

SEQ ID NO: 26153 - DNA, 25 bp, Homo sapien
ggaggaagttgttggctgtgtcggc

SEQ ID NO: 26154 - DNA, 25 bp, Homo sapien
ctgtgtcggcatccaaggtcatatc

SEQ ID NO: 26155 - DNA, 25 bp, Homo sapien
ggcatccaaggtcatatccactgtg

SEQ ID NO: 26156 - DNA, 25 bp, Homo sapien
tctacttcaaaggcccaaatatctc

SEQ ID NO: 26157 - DNA, 25 bp, Homo sapien
atgatgtgttaagttaacccgattt

SEQ ID NO: 26158 - DNA, 25 bp, Homo sapien
gttaacccgatttatggaagacagt

SEQ ID NO: 26159 - DNA, 25 bp, Homo sapien
gtaaagaacagccctctgtagtcag

SEQ ID NO: 26160 - DNA, 25 bp, Homo sapien
ctgtagtcagtaaagtttcaccttc

SEQ ID NO: 26161 - DNA, 25 bp, Homo sapien
aagtttcaccttctaaagaatatat

SEQ ID NO: 26162 - DNA, 25 bp, Homo sapien
gaattagttttatgaactctgttaa

SEQ ID NO: 26163 - DNA, 25 bp, Homo sapien
aattctgacccattacttgccaatt

SEQ ID NO: 26164 - DNA, 25 bp, Homo sapien
gacccattacttgccaatttataaa

SEQ ID NO: 26165 - DNA, 25 bp, Homo sapien
tattacaaggcattgtctctggaaa

SEQ ID NO: 26166 - DNA, 25 bp, Homo sapien
tcaaattttctgtatgatcatgtaa

SEQ ID NO: 26167 - DNA, 25 bp, Homo sapien
tttcatctgaatggagactttattt

SEQ ID NO: 26168 - DNA, 25 bp, Homo sapien
tgtgggtgggtgggtactgaggttt

SEQ ID NO: 26169 - DNA, 25 bp, Homo sapien
aacagaaattagagtagtccagtta

SEQ ID NO: 26170 - DNA, 25 bp, Homo sapien
tcacttaacattgcctctttacttc

SEQ ID NO: 26171 - DNA, 25 bp, Homo sapien
ctcttctttgtgattgtctgtagta

SEQ ID NO: 26172 - DNA, 25 bp, Homo sapien
gtgattgtctgtagtatgctttgaa

SEQ ID NO: 26173 - DNA, 25 bp, Homo sapien
gctttgacacattacagatctgggt

SEQ ID NO: 26174 - DNA, 25 bp, Homo sapien
tgggtatttggattttgcctatgga

SEQ ID NO: 26175 - DNA, 25 bp, Homo sapien
tatttggattttgcctatggagtgc

SEQ ID NO: 26176 - DNA, 25 bp, Homo sapien
tgtctgtagtatgctttgaaggtgc

SEQ ID NO: 26177 - DNA, 25 bp, Homo sapien
tggattttgcctatggagtgcatat

SEQ ID NO: 26178 - DNA, 25 bp, Homo sapien
gcctatggagtgcatatatgatttc

SEQ ID NO: 26179 - DNA, 25 bp, Homo sapien
acagggaggctgcagtttcctgcgt

SEQ ID NO: 26180 - DNA, 25 bp, Homo sapien
tgggcaatgcagtgcagcatgggaa

SEQ ID NO: 26181 - DNA, 25 bp, Homo sapien
gcatgggaaaggaataagggggcaa

SEQ ID NO: 26182 - DNA, 25 bp, Homo sapien
gaataagggggcaacaaggtgcaca

SEQ ID NO: 26183 - DNA, 25 bp, Homo sapien
atggcttccttgtttatggggctct

SEQ ID NO: 26184 - DNA, 25 bp, Homo sapien
ttccttgtttatggggctctcacag

SEQ ID NO: 26185 - DNA, 25 bp, Homo sapien
cttgtttatggggctctcacagata

SEQ ID NO: 26186 - DNA, 25 bp, Homo sapien
gtttatggggctctcacagataccc

SEQ ID NO: 26187 - DNA, 25 bp, Homo sapien
tatggggctctcacagatacccatc

SEQ ID NO: 26188 - DNA, 25 bp, Homo sapien
tccaactcctctagtcagcactaga

SEQ ID NO: 26189 - DNA, 25 bp, Homo sapien
caactcctctagtcagcactagatc

SEQ ID NO: 26190 - DNA, 25 bp, Homo sapien
caccaagtggtcgggagctctggct

SEQ ID NO: 26191 - DNA, 25 bp, Homo sapien
agctctggcttgcacccagaataaa

SEQ ID NO: 26192 - DNA, 25 bp, Homo sapien
gagtcatttctcacttatggcactg

SEQ ID NO: 26193 - DNA, 25 bp, Homo sapien
aacttctcactaatttgcatgtctt

SEQ ID NO: 26194 - DNA, 25 bp, Homo sapien
catgtcttaggctcctctttattag

SEQ ID NO: 26195 - DNA, 25 bp, Homo sapien
tttaggccaggtacggtggctcatg

SEQ ID NO: 26196 - DNA, 25 bp, Homo sapien
ttagggaggccgaggtgtgcagatc

SEQ ID NO: 26197 - DNA, 25 bp, Homo sapien
gaaactccatctctactcaaaatac

SEQ ID NO: 26198 - DNA, 25 bp, Homo sapien
tgtggaggcacacgcctgtaatccc

SEQ ID NO: 26199 - DNA, 25 bp, Homo sapien
agccgggaggatctcttgaacctgg

SEQ ID NO: 26200 - DNA, 25 bp, Homo sapien
gagcttagatggtgccactgtactc

SEQ ID NO: 26201 - DNA, 25 bp, Homo sapien
gatgcttcagtaagcccagatcaca

SEQ ID NO: 26202 - DNA, 25 bp, Homo sapien
atgcttcagtaagcccagatcacac

SEQ ID NO: 26203 - DNA, 25 bp, Homo sapien
aaaaagacatagagccaggcgcctg

SEQ ID NO: 26204 - DNA, 25 bp, Homo sapien
gccaaggcgtgaggactgtttgagg

SEQ ID NO: 26205 - DNA, 25 bp, Homo sapien
aggcgtgaggactgtttgaggtcag

SEQ ID NO: 26206 - DNA, 25 bp, Homo sapien
gcgtgaggactgtttgaggtcagga

SEQ ID NO: 26207 - DNA, 25 bp, Homo sapien
agccactggcaaggctgaggcacga

SEQ ID NO: 26208 - DNA, 25 bp, Homo sapien
ggaggctgcggtgaggtgagatcac

SEQ ID NO: 26209 - DNA, 25 bp, Homo sapien
agagtgagattatgtcttaagaaaa

SEQ ID NO: 26210 - DNA, 25 bp, Homo sapien
aaagagtctgggcgtgatgtctcat

SEQ ID NO: 26211 - DNA, 25 bp, Homo sapien
gagtctgggcgtgatgtctcatgcc

SEQ ID NO: 26212 - DNA, 25 bp, Homo sapien
ccaggtggcctccaaggtaggacaa

SEQ ID NO: 26213 - DNA, 25 bp, Homo sapien
cacaaaacccaggagacctttccag

SEQ ID NO: 26214 - DNA, 25 bp, Homo sapien
aaagcaaaaagatcaccacacccaa

SEQ ID NO: 26215 - DNA, 25 bp, Homo sapien
tcaccacacccaagacacttgcttt

SEQ ID NO: 26216 - DNA, 25 bp, Homo sapien
ccctctgtcacccacgtagaaaaat

SEQ ID NO: 26217 - DNA, 25 bp, Homo sapien
gaaaagagtttcttagccaagtttg

SEQ ID NO: 26218 - DNA, 25 bp, Homo sapien
gaaaccagcctaatttacatggact

SEQ ID NO: 26219 - DNA, 25 bp, Homo sapien
gactgatgttcattttatcttgggc

SEQ ID NO: 26220 - DNA, 25 bp, Homo sapien
ttttatcttgggcaatacttctaag

SEQ ID NO: 26221 - DNA, 25 bp, Homo sapien
tcacttgagccgaggcggacgtttt

SEQ ID NO: 26222 - DNA, 25 bp, Homo sapien
ggcggacgtttttgagatcagcctg

SEQ ID NO: 26223 - DNA, 25 bp, Homo sapien
gagtgagtctcagcacatgttgcag

SEQ ID NO: 26224 - DNA, 25 bp, Homo sapien
gagtctcagcacatgttgcagccag

SEQ ID NO: 26225 - DNA, 25 bp, Homo sapien
tctcagcacatgttgcagccagggc

SEQ ID NO: 26226 - DNA, 25 bp, Homo sapien
gtgtgatatgaggcccattcctgcc

SEQ ID NO: 26227 - DNA, 25 bp, Homo sapien
tgatatgaggcccattcctgcctct

SEQ ID NO: 26228 - DNA, 25 bp, Homo sapien
aaatggttggatgaacttcagcatc

SEQ ID NO: 26229 - DNA, 25 bp, Homo sapien
tatagtttaggggtaagagtcctgt

SEQ ID NO: 26230 - DNA, 25 bp, Homo sapien
gtgagttgtcacataataacagcag

SEQ ID NO: 26231 - DNA, 25 bp, Homo sapien
acagcagtggaatatgtatttgcct

SEQ ID NO: 26232 - DNA, 25 bp, Homo sapien
atgtatttgcctatattgtgaacga

SEQ ID NO: 26233 - DNA, 25 bp, Homo sapien
gcctatattgtgaacgaattagcag

SEQ ID NO: 26234 - DNA, 25 bp, Homo sapien
ctgaggacaagcccagactttcgtc

SEQ ID NO: 26235 - DNA, 25 bp, Homo sapien
aagcccagactttcgtcacagggac

SEQ ID NO: 26236 - DNA, 25 bp, Homo sapien
gactttcgtcacagggacagaccaa

SEQ ID NO: 26237 - DNA, 25 bp, Homo sapien
gtcacagggacagaccaacgtgtta

SEQ ID NO: 26238 - DNA, 25 bp, Homo sapien
gggacagaccaacgtgttaacacaa

SEQ ID NO: 26239 - DNA, 25 bp, Homo sapien
agggagaacacgggagcatcctgca

SEQ ID NO: 26240 - DNA, 25 bp, Homo sapien
accgtgcatttcagccacagatcac

SEQ ID NO: 26241 - DNA, 25 bp, Homo sapien
ccttcccaactgcggacatgctggg

SEQ ID NO: 26242 - DNA, 25 bp, Homo sapien
caactgcggacatgctgggtggatc

SEQ ID NO: 26243 - DNA, 25 bp, Homo sapien
catgctgggtggatccggatcgcat

SEQ ID NO: 26244 - DNA, 25 bp, Homo sapien
cggatcgcatggaagacgcagcctg

SEQ ID NO: 26245 - DNA, 25 bp, Homo sapien
attgtttctggtggcgttctcagtg

SEQ ID NO: 26246 - DNA, 25 bp, Homo sapien
tggagaggtatctgctttgatttgc

SEQ ID NO: 26247 - DNA, 25 bp, Homo sapien
gtatctgctttgatttgctaagtta

SEQ ID NO: 26248 - DNA, 25 bp, Homo sapien
atatatgtattaggtgtctcagcta

SEQ ID NO: 26249 - DNA, 25 bp, Homo sapien
gagagcattaaaggggattccgcag

SEQ ID NO: 26250 - DNA, 25 bp, Homo sapien
gcaggtttttccccatggatgaaaa

SEQ ID NO: 26251 - DNA, 25 bp, Homo sapien
aaaagaagctttactggacctcatt

SEQ ID NO: 26252 - DNA, 25 bp, Homo sapien
gaagctttactggacctcattcaga

SEQ ID NO: 26253 - DNA, 25 bp, Homo sapien
ggacctcattcagatcttacaatgg

SEQ ID NO: 26254 - DNA, 25 bp, Homo sapien
ttcagatcttacaatggccgcatcc

SEQ ID NO: 26255 - DNA, 25 bp, Homo sapien
ttgggaggctagagtgggtgagtca

SEQ ID NO: 26256 - DNA, 25 bp, Homo sapien
gagcctgggaggttgaggctgcagt

SEQ ID NO: 26257 - DNA, 25 bp, Homo sapien
gctgcagtgagtcaagattgcacca

SEQ ID NO: 26258 - DNA, 25 bp, Homo sapien
ttgagggcagggtggtggcacacgc

SEQ ID NO: 26259 - DNA, 25 bp, Homo sapien
gagctcaggaggttgaagctgcagt

SEQ ID NO: 26260 - DNA, 25 bp, Homo sapien
aagctgcagtgagatgtgtttgcgc

SEQ ID NO: 26261 - DNA, 25 bp, Homo sapien
agtgagatgtgtttgcgccactgca

SEQ ID NO: 26262 - DNA, 25 bp, Homo sapien
tgcactccagcttgggtgacggagc

SEQ ID NO: 26263 - DNA, 25 bp, Homo sapien
ttgggtgacggagcgagaccctgtc

SEQ ID NO: 26264 - DNA, 25 bp, Homo sapien
gaattgcagtaaaaccgtgtgcttc

SEQ ID NO: 26265 - DNA, 25 bp, Homo sapien
aaaccgtgtgcttctatgaggggat

SEQ ID NO: 26266 - DNA, 25 bp, Homo sapien
atttacttgtggctgggcacggtgg

SEQ ID NO: 26267 - DNA, 25 bp, Homo sapien
tctgacttccatctgggggctgaga

SEQ ID NO: 26268 - DNA, 25 bp, Homo sapien
ccccttctttctgccttaagaatgt

SEQ ID NO: 26269 - DNA, 25 bp, Homo sapien
ctttctgccttaagaatgtcctttt

SEQ ID NO: 26270 - DNA, 25 bp, Homo sapien
gaatgtccttttaggctgggcatgg

SEQ ID NO: 26271 - DNA, 25 bp, Homo sapien
ctttgggaggcggagacgggcagat

SEQ ID NO: 26272 - DNA, 25 bp, Homo sapien
gggaggcggagacgggcagataacc

SEQ ID NO: 26273 - DNA, 25 bp, Homo sapien
gagacgggcagataacctgaggtca

SEQ ID NO: 26274 - DNA, 25 bp, Homo sapien
gaggtcaggatttcgagaccaacct

SEQ ID NO: 26275 - DNA, 25 bp, Homo sapien
aggatttcgagaccaacctgaccta

SEQ ID NO: 26276 - DNA, 25 bp, Homo sapien
gagaccaacctgacctacatggaga

SEQ ID NO: 26277 - DNA, 25 bp, Homo sapien
acctacatggagaaactccgcctct

SEQ ID NO: 26278 - DNA, 25 bp, Homo sapien
acacacccagagagtacagcttgac

SEQ ID NO: 26279 - DNA, 25 bp, Homo sapien
cttgactacacacctgggctgtgtg

SEQ ID NO: 26280 - DNA, 25 bp, Homo sapien
ggctgtgtggttagcctgttgctct

SEQ ID NO: 26281 - DNA, 25 bp, Homo sapien
agcatattaccatactgtttactgt

SEQ ID NO: 26282 - DNA, 25 bp, Homo sapien
aaatatgatataggccagacacggt

SEQ ID NO: 26283 - DNA, 25 bp, Homo sapien
aattagctggacgtgatggcgcgcg

SEQ ID NO: 26284 - DNA, 25 bp, Homo sapien
gtatccttagctgtactcactagta

SEQ ID NO: 26285 - DNA, 25 bp, Homo sapien
tactcactagtacagtcatgtgtta

SEQ ID NO: 26286 - DNA, 25 bp, Homo sapien
gggataccttcttagaattgcgtca

SEQ ID NO: 26287 - DNA, 25 bp, Homo sapien
ttagaattgcgtcattaggcgattt

SEQ ID NO: 26288 - DNA, 25 bp, Homo sapien
gcaaacatagagggtacttcacaca

SEQ ID NO: 26289 - DNA, 25 bp, Homo sapien
ccctctggttgtgtggccagcatgt

SEQ ID NO: 26290 - DNA, 25 bp, Homo sapien
gccagcatgtttttctagccaaagg

SEQ ID NO: 26291 - DNA, 25 bp, Homo sapien
aaaggacttgggatgagatttttca

SEQ ID NO: 26292 - DNA, 25 bp, Homo sapien
agtgtactgtcacaatcttggctca

SEQ ID NO: 26293 - DNA, 25 bp, Homo sapien
gtagccgggattacaggcgcgtgcc

SEQ ID NO: 26294 - DNA, 25 bp, Homo sapien
agatggggttttgtcatgttggcca

SEQ ID NO: 26295 - DNA, 25 bp, Homo sapien
agtgctgggattacatgcttgagct

SEQ ID NO: 26296 - DNA, 25 bp, Homo sapien
tgcttgagctaccatacctggctaa

SEQ ID NO: 26297 - DNA, 25 bp, Homo sapien
ggttttgccatgttggctgggctgg

SEQ ID NO: 26298 - DNA, 25 bp, Homo sapien
tgatttcaggtgatccacttgcctc

SEQ ID NO: 26299 - DNA, 25 bp, Homo sapien
ctcgacctcccaaagtgctagaatt

SEQ ID NO: 26300 - DNA, 25 bp, Homo sapien
tttgatatctcatttccatgtaaca

SEQ ID NO: 26301 - DNA, 25 bp, Homo sapien
aaagatgttctattctagttggaga

SEQ ID NO: 26302 - DNA, 25 bp, Homo sapien
gtgactaataactgtaagactctct

SEQ ID NO: 26303 - DNA, 25 bp, Homo sapien
tgtgttgactcaaattcatttctga

SEQ ID NO: 26304 - DNA, 25 bp, Homo sapien
aagcaccaagtttcaggccaggagt

SEQ ID NO: 26305 - DNA, 25 bp, Homo sapien
tgaggcaggcggattacctgaggtc

SEQ ID NO: 26306 - DNA, 25 bp, Homo sapien
ggacaatatgatgagaccccgtctc

SEQ ID NO: 26307 - DNA, 25 bp, Homo sapien
aaattagctggctggtggtgcgcgc

SEQ ID NO: 26308 - DNA, 25 bp, Homo sapien
ttgtcccggctacttgggaggttga

SEQ ID NO: 26309 - DNA, 25 bp, Homo sapien
gaggttgaggcacaagaatcgcttg

SEQ ID NO: 26310 - DNA, 25 bp, Homo sapien
ggaggttgcagcgagccaagatctc

SEQ ID NO: 26311 - DNA, 25 bp, Homo sapien
atttcccattttcaaacctgacaag

SEQ ID NO: 26312 - DNA, 25 bp, Homo sapien
aagttggtcttgatgctgttattca

SEQ ID NO: 26313 - DNA, 25 bp, Homo sapien
aggaatttcagatcacagactcagt

SEQ ID NO: 26314 - DNA, 25 bp, Homo sapien
cacagactcagtaagcctggccagc

SEQ ID NO: 26315 - DNA, 25 bp, Homo sapien
ccccaaggctgtgtcttccttaaag

SEQ ID NO: 26316 - DNA, 25 bp, Homo sapien
aaagttgggatctctgtattatctc

SEQ ID NO: 26317 - DNA, 25 bp, Homo sapien
tgtaggattgctttgtcttctcaca

SEQ ID NO: 26318 - DNA, 25 bp, Homo sapien
tcttctcacactcacttttcagaaa

SEQ ID NO: 26319 - DNA, 25 bp, Homo sapien
aaatgtaagtattgccaggcgcggt

SEQ ID NO: 26320 - DNA, 25 bp, Homo sapien
gcctggccaacatggagaaatccca

SEQ ID NO: 26321 - DNA, 25 bp, Homo sapien
attagccgggtgtagtggcgcatgc

SEQ ID NO: 26322 - DNA, 25 bp, Homo sapien
ggtgtttccctgttgttaagtgaag

SEQ ID NO: 26323 - DNA, 25 bp, Homo sapien
ttgttaagtgaaggaggccgcccct

SEQ ID NO: 26324 - DNA, 25 bp, Homo sapien
gagaaggcagagcagtgtctgtgct

SEQ ID NO: 26325 - DNA, 25 bp, Homo sapien
gcagagcagtgtctgtgctgccagg

SEQ ID NO: 26326 - DNA, 25 bp, Homo sapien
caggtcctggtgaagcccaaggttg

SEQ ID NO: 26327 - DNA, 25 bp, Homo sapien
caaggttgaagggggcggcttcctg

SEQ ID NO: 26328 - DNA, 25 bp, Homo sapien
ctcttcggtgacattcttctaccta

SEQ ID NO: 26329 - DNA, 25 bp, Homo sapien
ggtgacattcttctacctagtagga

SEQ ID NO: 26330 - DNA, 25 bp, Homo sapien
tacctagtaggagtcatgcccctgt

SEQ ID NO: 26331 - DNA, 25 bp, Homo sapien
tagtaggagtcatgcccctgtagtg

SEQ ID NO: 26332 - DNA, 25 bp, Homo sapien
aagtccttaacgatggtctattcaa

SEQ ID NO: 26333 - DNA, 25 bp, Homo sapien
gaaggcttaatctctttcagctctg

SEQ ID NO: 26334 - DNA, 25 bp, Homo sapien
ctctgagctcactgtgtgcactgag

SEQ ID NO: 26335 - DNA, 25 bp, Homo sapien
tgcactgagcgatgtcaccatttct

SEQ ID NO: 26336 - DNA, 25 bp, Homo sapien
ctgccacgcgtcggtgaaggttggg

SEQ ID NO: 26337 - DNA, 25 bp, Homo sapien
gttgggactcgactggtgtttgatc

SEQ ID NO: 26338 - DNA, 25 bp, Homo sapien
gaagcagttattttctacgctacct

SEQ ID NO: 26339 - DNA, 25 bp, Homo sapien
ctacgctacctgtgcgccataagga

SEQ ID NO: 26340 - DNA, 25 bp, Homo sapien
attaagaagacgtgcctgcttcccc

SEQ ID NO: 26341 - DNA, 25 bp, Homo sapien
tctgccgtgattgtcagtttcctga

SEQ ID NO: 26342 - DNA, 25 bp, Homo sapien
gctctgggccagtggtactgagtct

SEQ ID NO: 26343 - DNA, 25 bp, Homo sapien
aacagtctggatgctggtgccacta

SEQ ID NO: 26344 - DNA, 25 bp, Homo sapien
aattatggtctaagagcgctcaggc

SEQ ID NO: 26345 - DNA, 25 bp, Homo sapien
gtctaagagcgctcaggctgggtgc

SEQ ID NO: 26346 - DNA, 25 bp, Homo sapien
aagttagccaggcatggtcacgcat

SEQ ID NO: 26347 - DNA, 25 bp, Homo sapien
catggtcacgcatgcctataatccc

SEQ ID NO: 26348 - DNA, 25 bp, Homo sapien
ctcaggaggctgacgcataagactt

SEQ ID NO: 26349 - DNA, 25 bp, Homo sapien
cgcataagacttgcttgaacccggg

SEQ ID NO: 26350 - DNA, 25 bp, Homo sapien
ccattgtactccagcttgggagata

SEQ ID NO: 26351 - DNA, 25 bp, Homo sapien
ttgggagatactcccgctgtctcaa

SEQ ID NO: 26352 - DNA, 25 bp, Homo sapien
agcaccttgggagggtgaggcgggt

SEQ ID NO: 26353 - DNA, 25 bp, Homo sapien
aggctgtggcaggagaatcgtttga

SEQ ID NO: 26354 - DNA, 25 bp, Homo sapien
gaatcgtttgaacacgggaggcgga

SEQ ID NO: 26355 - DNA, 25 bp, Homo sapien
ctgagttattcagcacactcctaga

SEQ ID NO: 26356 - DNA, 25 bp, Homo sapien
agcacactcctagatgtggggtctg

SEQ ID NO: 26357 - DNA, 25 bp, Homo sapien
gtggggtctgattgttggtcaaact

SEQ ID NO: 26358 - DNA, 25 bp, Homo sapien
gttggtcaaactgaaggactcgaga

SEQ ID NO: 26359 - DNA, 25 bp, Homo sapien
gagacatgtgagtgggtgttgggcc

SEQ ID NO: 26360 - DNA, 25 bp, Homo sapien
aaaggagcaggcccaggctctttgg

SEQ ID NO: 26361 - DNA, 25 bp, Homo sapien
acattcgtcctcatggatgtcttct

SEQ ID NO: 26362 - DNA, 25 bp, Homo sapien
tcctcatggatgtcttctttataat

SEQ ID NO: 26363 - DNA, 25 bp, Homo sapien
taataacctgtggaggacggcccag

SEQ ID NO: 26364 - DNA, 25 bp, Homo sapien
agaagtaatgtcccttggctgggcg

SEQ ID NO: 26365 - DNA, 25 bp, Homo sapien
aggagttggaagttgcagggagctg

SEQ ID NO: 26366 - DNA, 25 bp, Homo sapien
taggatcttgtgagtgagggacgtc

SEQ ID NO: 26367 - DNA, 25 bp, Homo sapien
gagggacgtcagccaaaattggcaa

SEQ ID NO: 26368 - DNA, 25 bp, Homo sapien
tggcaactttttcaagcaactggct

SEQ ID NO: 26369 - DNA, 25 bp, Homo sapien
ggaatttctctaataatgagccatc

SEQ ID NO: 26370 - DNA, 25 bp, Homo sapien
gagccatcgttttttgaattcaaca

SEQ ID NO: 26371 - DNA, 25 bp, Homo sapien
agttaggatatgattccagtttccc

SEQ ID NO: 26372 - DNA, 25 bp, Homo sapien
cagtttcccctcagtgcaaattgat

SEQ ID NO: 26373 - DNA, 25 bp, Homo sapien
aattgatatttttttctgttgacac

SEQ ID NO: 26374 - DNA, 25 bp, Homo sapien
ggcggattgcctgagctcaggagtt

SEQ ID NO: 26375 - DNA, 25 bp, Homo sapien
ggaggcagacattgcagtgggctga

SEQ ID NO: 26376 - DNA, 25 bp, Homo sapien
cagtgggctgagatcacgccagtgc

SEQ ID NO: 26377 - DNA, 25 bp, Homo sapien
gctggacatcagaaatgcagtggta

SEQ ID NO: 26378 - DNA, 25 bp, Homo sapien
tcactgactcagcaaatacttatat

SEQ ID NO: 26379 - DNA, 25 bp, Homo sapien
atacttatatagtacctgctatgtg

SEQ ID NO: 26380 - DNA, 25 bp, Homo sapien
gctatgtgccagggacagttccagg

SEQ ID NO: 26381 - DNA, 25 bp, Homo sapien
gccagggacagttccaggcactgga

SEQ ID NO: 26382 - DNA, 25 bp, Homo sapien
gccctcatgcagctgatttctagtg

SEQ ID NO: 26383 - DNA, 25 bp, Homo sapien
catgcagctgatttctagtggggag

SEQ ID NO: 26384 - DNA, 25 bp, Homo sapien
gtggggagagtagacaagcagacaa

SEQ ID NO: 26385 - DNA, 25 bp, Homo sapien
atgtcatctgttaggaagccattct

SEQ ID NO: 26386 - DNA, 25 bp, Homo sapien
cctaggcaacacgagcaaaacttcc

SEQ ID NO: 26387 - DNA, 25 bp, Homo sapien
aacacgagcaaaacttcctctcaaa

SEQ ID NO: 26388 - DNA, 25 bp, Homo sapien
gacatattgcctctttacagtgtat

SEQ ID NO: 26389 - DNA, 25 bp, Homo sapien
tacagtgtatgataagtgcttgcca

SEQ ID NO: 26390 - DNA, 25 bp, Homo sapien
gaactgactatccagctaagtttct

SEQ ID NO: 26391 - DNA, 25 bp, Homo sapien
aactgtctttaagcagggaccttgc

SEQ ID NO: 26392 - DNA, 25 bp, Homo sapien
tctctccagtcaccactacagagca

SEQ ID NO: 26393 - DNA, 25 bp, Homo sapien
gtcaccactacagagcacaatgcat

SEQ ID NO: 26394 - DNA, 25 bp, Homo sapien
gcacaatgcatggtgccttcttcac

SEQ ID NO: 26395 - DNA, 25 bp, Homo sapien
tcttcacaagcaaataccttctccc

SEQ ID NO: 26396 - DNA, 25 bp, Homo sapien
ccttcttcaaatcctgactacagat

SEQ ID NO: 26397 - DNA, 25 bp, Homo sapien
cagggtagcaccatataccacacct

SEQ ID NO: 26398 - DNA, 25 bp, Homo sapien
gttataggcagggcgtggcggctta

SEQ ID NO: 26399 - DNA, 25 bp, Homo sapien
gtctccaggggaaagagccaccctc

SEQ ID NO: 26400 - DNA, 25 bp, Homo sapien
tctcctgcagggccagtcagagtgt

SEQ ID NO: 26401 - DNA, 25 bp, Homo sapien
ggtaccagcagaaacctggccaggc

SEQ ID NO: 26402 - DNA, 25 bp, Homo sapien
ggttcagtggcagtgggtctgggac

SEQ ID NO: 26403 - DNA, 25 bp, Homo sapien
atcttcccgccatctgatgagcagt

SEQ ID NO: 26404 - DNA, 25 bp, Homo sapien
gtgcctgctgaataacttctatccc

SEQ ID NO: 26405 - DNA, 25 bp, Homo sapien
aacttctatcccagagaggccaaag

SEQ ID NO: 26406 - DNA, 25 bp, Homo sapien
gtggaaggtggataacgccctccaa

SEQ ID NO: 26407 - DNA, 25 bp, Homo sapien
cctccaatcgggtaactcccaggag

SEQ ID NO: 26408 - DNA, 25 bp, Homo sapien
cacccctgaacgctgagcaaaggca

SEQ ID NO: 26409 - DNA, 25 bp, Homo sapien
caaaggcagacttacgagaaaccac

SEQ ID NO: 26410 - DNA, 25 bp, Homo sapien
attcttctaaataactcatgagtcc

SEQ ID NO: 26411 - DNA, 25 bp, Homo sapien
gaagagttccttctcagtttctagc

SEQ ID NO: 26412 - DNA, 25 bp, Homo sapien
gttccttctcagtttctagcatatg

SEQ ID NO: 26413 - DNA, 25 bp, Homo sapien
ttctcagtttctagcatatgatgat

SEQ ID NO: 26414 - DNA, 25 bp, Homo sapien
aatagtgaaaatgtcctagctttct

SEQ ID NO: 26415 - DNA, 25 bp, Homo sapien
aatgtcctagctttctttaaataat

SEQ ID NO: 26416 - DNA, 25 bp, Homo sapien
gaggggctgggcataatggctcaca

SEQ ID NO: 26417 - DNA, 25 bp, Homo sapien
cccaacactttaagaggctgagatg

SEQ ID NO: 26418 - DNA, 25 bp, Homo sapien
gagatggaaggattccttcagccca

SEQ ID NO: 26419 - DNA, 25 bp, Homo sapien
gattccttcagcccaggagtttgaa

SEQ ID NO: 26420 - DNA, 25 bp, Homo sapien
tcagcccaggagtttgaaaccagcc

SEQ ID NO: 26421 - DNA, 25 bp, Homo sapien
acttaggagtggtgctttttctcag

SEQ ID NO: 26422 - DNA, 25 bp, Homo sapien
gaaaacaggccacggtgtttcatac

SEQ ID NO: 26423 - DNA, 25 bp, Homo sapien
caggccacggtgtttcatacagaat

SEQ ID NO: 26424 - DNA, 25 bp, Homo sapien
atcatctgaaatggtatggctgaag

SEQ ID NO: 26425 - DNA, 25 bp, Homo sapien
tgaaatggtatggctgaagttcatt

SEQ ID NO: 26426 - DNA, 25 bp, Homo sapien
tcatttgtttacagggtcgggaatg

SEQ ID NO: 26427 - DNA, 25 bp, Homo sapien
tacagggtcgggaatgtcttcagtt

SEQ ID NO: 26428 - DNA, 25 bp, Homo sapien
tggttgtaagccaagggacatttta

SEQ ID NO: 26429 - DNA, 25 bp, Homo sapien
gggacattttaagctagtgaagagt

SEQ ID NO: 26430 - DNA, 25 bp, Homo sapien
gaagagttttttctggaattgattt

SEQ ID NO: 26431 - DNA, 25 bp, Homo sapien
cttggttatcaagtcttttggggag

SEQ ID NO: 26432 - DNA, 25 bp, Homo sapien
ttgtctggtggtttcttgtggttga

SEQ ID NO: 26433 - DNA, 25 bp, Homo sapien
ggtggtttcttgtggttgaagtcct

SEQ ID NO: 26434 - DNA, 25 bp, Homo sapien
gtttcttgtggttgaagtcctacag

SEQ ID NO: 26435 - DNA, 25 bp, Homo sapien
ggttgaagtcctacagttttggcag

SEQ ID NO: 26436 - DNA, 25 bp, Homo sapien
gaagtcctacagttttggcaggaat

SEQ ID NO: 26437 - DNA, 25 bp, Homo sapien
ctttcctcctgtgactgatcagtgc

SEQ ID NO: 26438 - DNA, 25 bp, Homo sapien
tcctcctgtgactgatcagtgcctt

SEQ ID NO: 26439 - DNA, 25 bp, Homo sapien
tcctgtgactgatcagtgccttcga

SEQ ID NO: 26440 - DNA, 25 bp, Homo sapien
gactgatcagtgccttcgagagata

SEQ ID NO: 26441 - DNA, 25 bp, Homo sapien
gatcagtgccttcgagagatacttt

SEQ ID NO: 26442 - DNA, 25 bp, Homo sapien
agtgccttcgagagatactttaaat

SEQ ID NO: 26443 - DNA, 25 bp, Homo sapien
ctgtccaccatgtaagttctcctgg

SEQ ID NO: 26444 - DNA, 25 bp, Homo sapien
tacctctagccaggctcatctatct

SEQ ID NO: 26445 - DNA, 25 bp, Homo sapien
cctctagccaggctcatctatctgt

SEQ ID NO: 26446 - DNA, 25 bp, Homo sapien
cttaaaaactcgtcaggctttctgt

SEQ ID NO: 26447 - DNA, 25 bp, Homo sapien
gcaggcatcgtctaggtgttgaggc

SEQ ID NO: 26448 - DNA, 25 bp, Homo sapien
taggtgttgaggctgcacacacccg

SEQ ID NO: 26449 - DNA, 25 bp, Homo sapien
tagtgaattgccacagaaagcatgt

SEQ ID NO: 26450 - DNA, 25 bp, Homo sapien
cagaaagcatgtccacagtgatttg

SEQ ID NO: 26451 - DNA, 25 bp, Homo sapien
atgtccacagtgatttgaaaaccca

SEQ ID NO: 26452 - DNA, 25 bp, Homo sapien
aaattcaaaagttagccagttatgg

SEQ ID NO: 26453 - DNA, 25 bp, Homo sapien
ctgaggcaggacagttgctggaacc

SEQ ID NO: 26454 - DNA, 25 bp, Homo sapien
ctctacctcttaggaaagtttcact

SEQ ID NO: 26455 - DNA, 25 bp, Homo sapien
cactgtgtttacttgggacttctgg

SEQ ID NO: 26456 - DNA, 25 bp, Homo sapien
tacttgggacttctggactagctgc

SEQ ID NO: 26457 - DNA, 25 bp, Homo sapien
actagctgccgtttgcaacagtgga

SEQ ID NO: 26458 - DNA, 25 bp, Homo sapien
caacagtggacttaccagtttgcca

SEQ ID NO: 26459 - DNA, 25 bp, Homo sapien
acctttctactggtgcacacacctt

SEQ ID NO: 26460 - DNA, 25 bp, Homo sapien
tggtgcacacaccttagtaaggcag

SEQ ID NO: 26461 - DNA, 25 bp, Homo sapien
gattactaaatgcagctgtctccag

SEQ ID NO: 26462 - DNA, 25 bp, Homo sapien
ggaatgatgctataggccacttact

SEQ ID NO: 26463 - DNA, 25 bp, Homo sapien
gcagtgagtggctctctaaaaccat

SEQ ID NO: 26464 - DNA, 25 bp, Homo sapien
ggatttaattctgaccagttctgaa

SEQ ID NO: 26465 - DNA, 25 bp, Homo sapien
ctcatcatcttcctgggtgacggga

SEQ ID NO: 26466 - DNA, 25 bp, Homo sapien
tacggtgacagctgccaggatccta

SEQ ID NO: 26467 - DNA, 25 bp, Homo sapien
aggacaaactggggcctgagacctt

SEQ ID NO: 26468 - DNA, 25 bp, Homo sapien
cgtacgtggctctgtccaagacata

SEQ ID NO: 26469 - DNA, 25 bp, Homo sapien
agcatgtgccagacagtggagccac

SEQ ID NO: 26470 - DNA, 25 bp, Homo sapien
cctacctgtgcggggtcaagggcaa

SEQ ID NO: 26471 - DNA, 25 bp, Homo sapien
caagggcaacttccagaccattggc

SEQ ID NO: 26472 - DNA, 25 bp, Homo sapien
gaccattggcttgagtgcagccgcc

SEQ ID NO: 26473 - DNA, 25 bp, Homo sapien
ttaaccagtgcaacacgacacgcgg

SEQ ID NO: 26474 - DNA, 25 bp, Homo sapien
cgaggtgacgtggggcctcgtgtgg

SEQ ID NO: 26475 - DNA, 25 bp, Homo sapien
tctccctgggcatcatcccagttga

SEQ ID NO: 26476 - DNA, 25 bp, Homo sapien
tttcctttctcagcttaacttgaac

SEQ ID NO: 26477 - DNA, 25 bp, Homo sapien
ttctcagcttaacttgaacccttgc

SEQ ID NO: 26478 - DNA, 25 bp, Homo sapien
ccctcatccagttcttgtgacagtc

SEQ ID NO: 26479 - DNA, 25 bp, Homo sapien
gttcttgtgacagtcggacttcttc

SEQ ID NO: 26480 - DNA, 25 bp, Homo sapien
ctggccacccattatacagagccca

SEQ ID NO: 26481 - DNA, 25 bp, Homo sapien
tcagccttccatgtcatggcacaca

SEQ ID NO: 26482 - DNA, 25 bp, Homo sapien
ggcacacataggaaacagtggcatc

SEQ ID NO: 26483 - DNA, 25 bp, Homo sapien
cagtggcatccacagggtgcaatgg

SEQ ID NO: 26484 - DNA, 25 bp, Homo sapien
aatgggtaatttggaggcgagacta

SEQ ID NO: 26485 - DNA, 25 bp, Homo sapien
ggaggcgagactaggggaaagtgca

SEQ ID NO: 26486 - DNA, 25 bp, Homo sapien
gcatgtgctgtttctaccatagaaa

SEQ ID NO: 26487 - DNA, 25 bp, Homo sapien
tagccccaaactagaaacaatccca

SEQ ID NO: 26488 - DNA, 25 bp, Homo sapien
agaaacaatcccaatgtccttcaat

SEQ ID NO: 26489 - DNA, 25 bp, Homo sapien
ataaaaagacctactgatacaagca

SEQ ID NO: 26490 - DNA, 25 bp, Homo sapien
acaagtacttactgaatgattccat

SEQ ID NO: 26491 - DNA, 25 bp, Homo sapien
ggcaaaaagtgatctgtggtggtag

SEQ ID NO: 26492 - DNA, 25 bp, Homo sapien
gaaaacactgtttgcctcaggtggt

SEQ ID NO: 26493 - DNA, 25 bp, Homo sapien
gtttgcctcaggtggtcaggtgaga

SEQ ID NO: 26494 - DNA, 25 bp, Homo sapien
ggtggtcaggtgagacattcattaa

SEQ ID NO: 26495 - DNA, 25 bp, Homo sapien
aagaagatacgttttgatggccagg

SEQ ID NO: 26496 - DNA, 25 bp, Homo sapien
aattggctggacatggtggcacaca

SEQ ID NO: 26497 - DNA, 25 bp, Homo sapien
tgcagtgagcctatatcacgccact

SEQ ID NO: 26498 - DNA, 25 bp, Homo sapien
ccttgaataccacagggattaggaa

SEQ ID NO: 26499 - DNA, 25 bp, Homo sapien
cagggattaggaatgctgccccgcc

SEQ ID NO: 26500 - DNA, 25 bp, Homo sapien
tgccccgccatgcagtagaaaatct

SEQ ID NO: 26501 - DNA, 25 bp, Homo sapien
cccaaaagcttaaccactaatagct

SEQ ID NO: 26502 - DNA, 25 bp, Homo sapien
accactaatagcttattgttgatgg

SEQ ID NO: 26503 - DNA, 25 bp, Homo sapien
tagcttattgttgatgggaagcctt

SEQ ID NO: 26504 - DNA, 25 bp, Homo sapien
gggaagccttacagataacatcaac

SEQ ID NO: 26505 - DNA, 25 bp, Homo sapien
gccttacagataacatcaacagtcc

SEQ ID NO: 26506 - DNA, 25 bp, Homo sapien
gataacatcaacagtccatgaacat

SEQ ID NO: 26507 - DNA, 25 bp, Homo sapien
aacagtccatgaacatatattttgt

SEQ ID NO: 26508 - DNA, 25 bp, Homo sapien
aaattggccgggcaaggcggtgcac

SEQ ID NO: 26509 - DNA, 25 bp, Homo sapien
gagccactgcatgtggcctattttc

SEQ ID NO: 26510 - DNA, 25 bp, Homo sapien
ccactgcatgtggcctattttcttc

SEQ ID NO: 26511 - DNA, 25 bp, Homo sapien
tcttccactgttgttcggcgtggag

SEQ ID NO: 26512 - DNA, 25 bp, Homo sapien
actgttgttcggcgtggagaatatt

SEQ ID NO: 26513 - DNA, 25 bp, Homo sapien
tcggcgtggagaatattatatacat

SEQ ID NO: 26514 - DNA, 25 bp, Homo sapien
tacataattacgtaaatgatatcat

SEQ ID NO: 26515 - DNA, 25 bp, Homo sapien
gatatcatactgtatataccttttt

SEQ ID NO: 26516 - DNA, 25 bp, Homo sapien
ttcctactccttccttaagttatat

SEQ ID NO: 26517 - DNA, 25 bp, Homo sapien
gagactaccaattattagacttttt

SEQ ID NO: 26518 - DNA, 25 bp, Homo sapien
gggttccaccatgctagcaggatgg

SEQ ID NO: 26519 - DNA, 25 bp, Homo sapien
ttccaccatgctagcaggatggtct

SEQ ID NO: 26520 - DNA, 25 bp, Homo sapien
tggagtgggcaagaccaggccacct

SEQ ID NO: 26521 - DNA, 25 bp, Homo sapien
ccacctgctgaggtcgctgtggagc

SEQ ID NO: 26522 - DNA, 25 bp, Homo sapien
tcccaagggccctggcagagggtgg

SEQ ID NO: 26523 - DNA, 25 bp, Homo sapien
tgagccgccacaaagaccaaagaag

SEQ ID NO: 26524 - DNA, 25 bp, Homo sapien
agaagtgatggcttttctctgtccc

SEQ ID NO: 26525 - DNA, 25 bp, Homo sapien
tgtcccctgctgctctgaggggaga

SEQ ID NO: 26526 - DNA, 25 bp, Homo sapien
ggtctcctgagccactcagatggga

SEQ ID NO: 26527 - DNA, 25 bp, Homo sapien
cagccccaagctttacactggatgc

SEQ ID NO: 26528 - DNA, 25 bp, Homo sapien
acactggatgcagcgatcaacccac

SEQ ID NO: 26529 - DNA, 25 bp, Homo sapien
ggagccgagcctttttgttgctccg

SEQ ID NO: 26530 - DNA, 25 bp, Homo sapien
ttgctccgctcccaggagagtgagg

SEQ ID NO: 26531 - DNA, 25 bp, Homo sapien
gagtggttacttgctgagaagtcag

SEQ ID NO: 26532 - DNA, 25 bp, Homo sapien
agtcaggtgagatgggacgtgagcc

SEQ ID NO: 26533 - DNA, 25 bp, Homo sapien
aggtgagatgggacgtgagcctcag

SEQ ID NO: 26534 - DNA, 25 bp, Homo sapien
tgagcctcaggaacgctggggtcac

SEQ ID NO: 26535 - DNA, 25 bp, Homo sapien
cctcaggaacgctggggtcactaca

SEQ ID NO: 26536 - DNA, 25 bp, Homo sapien
gaacgctggggtcactacaaggaac

SEQ ID NO: 26537 - DNA, 25 bp, Homo sapien
ctggggtcactacaaggaacacctt

SEQ ID NO: 26538 - DNA, 25 bp, Homo sapien
caccttgtagtgttgaggggcacac

SEQ ID NO: 26539 - DNA, 25 bp, Homo sapien
gttgaggggcacactacaaaaacat

SEQ ID NO: 26540 - DNA, 25 bp, Homo sapien
ggcacactacaaaaacatgttacca

SEQ ID NO: 26541 - DNA, 25 bp, Homo sapien
tttttcctgtagagtcagggccagg

SEQ ID NO: 26542 - DNA, 25 bp, Homo sapien
ggtacttcttatggcagctacttcg

SEQ ID NO: 26543 - DNA, 25 bp, Homo sapien
tacttcgtcccagcattttcggggt

SEQ ID NO: 26544 - DNA, 25 bp, Homo sapien
tatatgcaccttattgggagcccag

SEQ ID NO: 26545 - DNA, 25 bp, Homo sapien
atctgtggactcactcagtttacca

SEQ ID NO: 26546 - DNA, 25 bp, Homo sapien
aattcttccacatgttcggagttct

SEQ ID NO: 26547 - DNA, 25 bp, Homo sapien
ggagttcttctgagatctatggcct

SEQ ID NO: 26548 - DNA, 25 bp, Homo sapien
gctggggccttggaaggtgtgccaa

SEQ ID NO: 26549 - DNA, 25 bp, Homo sapien
ggaccagtctgctgcactggtggga

SEQ ID NO: 26550 - DNA, 25 bp, Homo sapien
gtgtattttctgatcatggccttct

SEQ ID NO: 26551 - DNA, 25 bp, Homo sapien
gccttctcaccacaatggcttacaa

SEQ ID NO: 26552 - DNA, 25 bp, Homo sapien
tagctggtgctgttattcgctggct

SEQ ID NO: 26553 - DNA, 25 bp, Homo sapien
tggatctcttgacgtggttcacatg

SEQ ID NO: 26554 - DNA, 25 bp, Homo sapien
acttcatcaggttcgacactggtaa

SEQ ID NO: 26555 - DNA, 25 bp, Homo sapien
gccaatggcaacagctttgccactt

SEQ ID NO: 26556 - DNA, 25 bp, Homo sapien
ttgccacttgactttccaacatttt

SEQ ID NO: 26557 - DNA, 25 bp, Homo sapien
aacataccatggatttctcttcccc

SEQ ID NO: 26558 - DNA, 25 bp, Homo sapien
tggatttctcttccccaaggaaaag

SEQ ID NO: 26559 - DNA, 25 bp, Homo sapien
aaggaaaaggtatctgcctcaccat

SEQ ID NO: 26560 - DNA, 25 bp, Homo sapien
tctgcctcaccattgctgaagagag

SEQ ID NO: 26561 - DNA, 25 bp, Homo sapien
ggtaacctgtgtatggtgactggag

SEQ ID NO: 26562 - DNA, 25 bp, Homo sapien
gtgactggaggtgccaacctgggaa

SEQ ID NO: 26563 - DNA, 25 bp, Homo sapien
cagagagaggcaccctggatctctt

SEQ ID NO: 26564 - DNA, 25 bp, Homo sapien
cagccaaatccctctaaatctttta

SEQ ID NO: 26565 - DNA, 25 bp, Homo sapien
atccctctaaatcttttaactagca

SEQ ID NO: 26566 - DNA, 25 bp, Homo sapien
ttaagatttgcttagcatctacaca

SEQ ID NO: 26567 - DNA, 25 bp, Homo sapien
tgcttagcatctacacaatggcacc

SEQ ID NO: 26568 - DNA, 25 bp, Homo sapien
acaatggcacctgctaaatcaacag

SEQ ID NO: 26569 - DNA, 25 bp, Homo sapien
aggtgaagtttctctataacatgca

SEQ ID NO: 26570 - DNA, 25 bp, Homo sapien
gtttctctataacatgcaatattct

SEQ ID NO: 26571 - DNA, 25 bp, Homo sapien
tccttttaaaagttccatggtatag

SEQ ID NO: 26572 - DNA, 25 bp, Homo sapien
atatatcatcatgcagagaccaaga

SEQ ID NO: 26573 - DNA, 25 bp, Homo sapien
tttacattgcaaaaaccacaagaac

SEQ ID NO: 26574 - DNA, 25 bp, Homo sapien
agaacaataacatcctgtatcataa

SEQ ID NO: 26575 - DNA, 25 bp, Homo sapien
ccacaccaggcaaatttttgtcttt

SEQ ID NO: 26576 - DNA, 25 bp, Homo sapien
gcaatgatgaaaacagtctgtatct

SEQ ID NO: 26577 - DNA, 25 bp, Homo sapien
gtgtggtccaatatgctagccacta

SEQ ID NO: 26578 - DNA, 25 bp, Homo sapien
tgctagccactagccatttgtagct

SEQ ID NO: 26579 - DNA, 25 bp, Homo sapien
agccactagccatttgtagctactg

SEQ ID NO: 26580 - DNA, 25 bp, Homo sapien
gtagctactgaaccttgaaatgggg

SEQ ID NO: 26581 - DNA, 25 bp, Homo sapien
atggggttattttgactgaagaact

SEQ ID NO: 26582 - DNA, 25 bp, Homo sapien
atagcacagctctagaagaaccacc

SEQ ID NO: 26583 - DNA, 25 bp, Homo sapien
gctctagaagaaccaccatttacaa

SEQ ID NO: 26584 - DNA, 25 bp, Homo sapien
aggacaaaagacagccatcataatg

SEQ ID NO: 26585 - DNA, 25 bp, Homo sapien
catcataatgtccattttcctttcc

SEQ ID NO: 26586 - DNA, 25 bp, Homo sapien
taggaagacagcagtgtttgttcac

SEQ ID NO: 26587 - DNA, 25 bp, Homo sapien
gagatgcgagttggaaagctcgata

SEQ ID NO: 26588 - DNA, 25 bp, Homo sapien
ctgttaagatggcagttctccccca

SEQ ID NO: 26589 - DNA, 25 bp, Homo sapien
ttctcccccagtagatctataggtt

SEQ ID NO: 26590 - DNA, 25 bp, Homo sapien
gatctataggttcaacacaatccct

SEQ ID NO: 26591 - DNA, 25 bp, Homo sapien
aggttcaacacaatccctatcaaaa

SEQ ID NO: 26592 - DNA, 25 bp, Homo sapien
aatccctatcaaaatcccagcagga

SEQ ID NO: 26593 - DNA, 25 bp, Homo sapien
aattgacaaaataggccgggcgcgg

SEQ ID NO: 26594 - DNA, 25 bp, Homo sapien
gaggcgggcggatcatgagatcagg

SEQ ID NO: 26595 - DNA, 25 bp, Homo sapien
gagatcaggagatccagaccatcct

SEQ ID NO: 26596 - DNA, 25 bp, Homo sapien
aaatggcatgaacccggtaggcaga

SEQ ID NO: 26597 - DNA, 25 bp, Homo sapien
ctactctgaagccatctcggtaaat

SEQ ID NO: 26598 - DNA, 25 bp, Homo sapien
gccatctcggtaaattttcccaaca

SEQ ID NO: 26599 - DNA, 25 bp, Homo sapien
tctcggtaaattttcccaacagtgt

SEQ ID NO: 26600 - DNA, 25 bp, Homo sapien
tttatatgcaacctgcttgggcgga

SEQ ID NO: 26601 - DNA, 25 bp, Homo sapien
tatatgcaacctgcttgggcggaga

SEQ ID NO: 26602 - DNA, 25 bp, Homo sapien
tatgcaacctgcttgggcggagaag

SEQ ID NO: 26603 - DNA, 25 bp, Homo sapien
aagggattactcaagcaaaatcgtg

SEQ ID NO: 26604 - DNA, 25 bp, Homo sapien
attactcaagcaaaatcgtggaatt

SEQ ID NO: 26605 - DNA, 25 bp, Homo sapien
aaaatcgtggaattattggtgataa

SEQ ID NO: 26606 - DNA, 25 bp, Homo sapien
gaatgaagcttgtgtgtcatccatt

SEQ ID NO: 26607 - DNA, 25 bp, Homo sapien
gaagcttgtgtgtcatccattatca

SEQ ID NO: 26608 - DNA, 25 bp, Homo sapien
agaacggaactggggactttcgcag

SEQ ID NO: 26609 - DNA, 25 bp, Homo sapien
ggaactggggactttcgcagtgaga

SEQ ID NO: 26610 - DNA, 25 bp, Homo sapien
ggggactttcgcagtgagagttaca

SEQ ID NO: 26611 - DNA, 25 bp, Homo sapien
actttcgcagtgagagttacagctc

SEQ ID NO: 26612 - DNA, 25 bp, Homo sapien
agctcttaaagatggcaccgaccca

SEQ ID NO: 26613 - DNA, 25 bp, Homo sapien
cttaaagatggcaccgacccaggcc

SEQ ID NO: 26614 - DNA, 25 bp, Homo sapien
ccggagcaggcttttacgcatgccc

SEQ ID NO: 26615 - DNA, 25 bp, Homo sapien
caggaaagtggcatgaacccgcgag

SEQ ID NO: 26616 - DNA, 25 bp, Homo sapien
acccgcgaggcagagcttgcaataa

SEQ ID NO: 26617 - DNA, 25 bp, Homo sapien
ggttcgcggtctagctgaccaagaa

SEQ ID NO: 26618 - DNA, 25 bp, Homo sapien
ggtctagctgaccaagaacggaact

SEQ ID NO: 26619 - DNA, 25 bp, Homo sapien
acaagttgtggaatgtcttctttaa

SEQ ID NO: 26620 - DNA, 25 bp, Homo sapien
tcttctttaagattagcatgcagtc

SEQ ID NO: 26621 - DNA, 25 bp, Homo sapien
catgcagtctcattgtacctgttac

SEQ ID NO: 26622 - DNA, 25 bp, Homo sapien
ctcattgtacctgttacctgttctt

SEQ ID NO: 26623 - DNA, 25 bp, Homo sapien
gaatgtgttcaaagctcatcccacc

SEQ ID NO: 26624 - DNA, 25 bp, Homo sapien
gagtgtgttagaaactgtgctggat

SEQ ID NO: 26625 - DNA, 25 bp, Homo sapien
tcccatgacagccatataggttctc

SEQ ID NO: 26626 - DNA, 25 bp, Homo sapien
ccatataggttctcttggttgcata

SEQ ID NO: 26627 - DNA, 25 bp, Homo sapien
ggttctcttggttgcataagtaaac

SEQ ID NO: 26628 - DNA, 25 bp, Homo sapien
tgctttctgtgtgaatacgttgtca

SEQ ID NO: 26629 - DNA, 25 bp, Homo sapien
tacgttgtcatttgatgtcatggtg

SEQ ID NO: 26630 - DNA, 25 bp, Homo sapien
aagatgagcagagaaagatccttca

SEQ ID NO: 26631 - DNA, 25 bp, Homo sapien
gagcagagaaagatccttcaagcct

SEQ ID NO: 26632 - DNA, 25 bp, Homo sapien
gagaaagatccttcaagcctttcct

SEQ ID NO: 26633 - DNA, 25 bp, Homo sapien
gaaagatccttcaagcctttcctgg

SEQ ID NO: 26634 - DNA, 25 bp, Homo sapien
ttcaagcctttcctggcatgcgtga

SEQ ID NO: 26635 - DNA, 25 bp, Homo sapien
gcatgcgtgactccaacatcagcaa

SEQ ID NO: 26636 - DNA, 25 bp, Homo sapien
atgcgtgactccaacatcagcaaga

SEQ ID NO: 26637 - DNA, 25 bp, Homo sapien
gcgtgactccaacatcagcaagata

SEQ ID NO: 26638 - DNA, 25 bp, Homo sapien
gtgactccaacatcagcaagatatt

SEQ ID NO: 26639 - DNA, 25 bp, Homo sapien
atcagcaagatattgggatctcact

SEQ ID NO: 26640 - DNA, 25 bp, Homo sapien
gatattgggatctcactggaaagct

SEQ ID NO: 26641 - DNA, 25 bp, Homo sapien
cctgggtcggtgccatctttaagag

SEQ ID NO: 26642 - DNA, 25 bp, Homo sapien
ctgggtcggtgccatctttaagagc

SEQ ID NO: 26643 - DNA, 25 bp, Homo sapien
gagctgtaactctcactgcgaaagt

SEQ ID NO: 26644 - DNA, 25 bp, Homo sapien
gctgtaactctcactgcgaaagtcc

SEQ ID NO: 26645 - DNA, 25 bp, Homo sapien
ctgtaactctcactgcgaaagtccc

SEQ ID NO: 26646 - DNA, 25 bp, Homo sapien
gttccgttcttggtcagctagaccg

SEQ ID NO: 26647 - DNA, 25 bp, Homo sapien
tccgttcttggtcagctagaccgcg

SEQ ID NO: 26648 - DNA, 25 bp, Homo sapien
ccgttcttggtcagctagaccgcga

SEQ ID NO: 26649 - DNA, 25 bp, Homo sapien
gttcttggtcagctagaccgcgaac

SEQ ID NO: 26650 - DNA, 25 bp, Homo sapien
cttggtcagctagaccgcgaaccca

SEQ ID NO: 26651 - DNA, 25 bp, Homo sapien
taaattccggacacaagggggcgcg

SEQ ID NO: 26652 - DNA, 25 bp, Homo sapien
accccagaggccacagtaatgctgg

SEQ ID NO: 26653 - DNA, 25 bp, Homo sapien
aatgctggtggaatgcatcaccaca

SEQ ID NO: 26654 - DNA, 25 bp, Homo sapien
aatgcatcaccacaggatcaacttc

SEQ ID NO: 26655 - DNA, 25 bp, Homo sapien
gatcaacttcaacaaatactaccca

SEQ ID NO: 26656 - DNA, 25 bp, Homo sapien
ttaaagagaaaccagactgtcagcc

SEQ ID NO: 26657 - DNA, 25 bp, Homo sapien
agggtgtcaaggggacctgtgtcct

SEQ ID NO: 26658 - DNA, 25 bp, Homo sapien
gtcaaggggacctgtgtcctggtgg

SEQ ID NO: 26659 - DNA, 25 bp, Homo sapien
gaagacccagaaacttcggggccat

SEQ ID NO: 26660 - DNA, 25 bp, Homo sapien
aaacttcggggccatgtgagccatg

SEQ ID NO: 26661 - DNA, 25 bp, Homo sapien
gagccatggccatggccgcataggc

SEQ ID NO: 26662 - DNA, 25 bp, Homo sapien
gccgcataggcaagctccaaaagca

SEQ ID NO: 26663 - DNA, 25 bp, Homo sapien
gcccctgctcacgggaatgctaatg

SEQ ID NO: 26664 - DNA, 25 bp, Homo sapien
atgtcagacgcagccgtagacacca

SEQ ID NO: 26665 - DNA, 25 bp, Homo sapien
gaggaaaatggggagccggaggctg

SEQ ID NO: 26666 - DNA, 25 bp, Homo sapien
gagccggaggctgacaacgaggtag

SEQ ID NO: 26667 - DNA, 25 bp, Homo sapien
ggtggggaggaagaaggtgatggtg

SEQ ID NO: 26668 - DNA, 25 bp, Homo sapien
gagctgagtcagctacgggcaagcg

SEQ ID NO: 26669 - DNA, 25 bp, Homo sapien
acgggcaagcgggcagctgaagatg

SEQ ID NO: 26670 - DNA, 25 bp, Homo sapien
agatgatgaggatgacgatgtcgat

SEQ ID NO: 26671 - DNA, 25 bp, Homo sapien
ctccgaaatcaccaccgaggactta

SEQ ID NO: 26672 - DNA, 25 bp, Homo sapien
gaaggaagttgtggaagaggcggaa

SEQ ID NO: 26673 - DNA, 25 bp, Homo sapien
gaaaatggaagagacgcccctgctc

SEQ ID NO: 26674 - DNA, 25 bp, Homo sapien
gaatgagttcatagactgtccaaga

SEQ ID NO: 26675 - DNA, 25 bp, Homo sapien
gactgtccaagatctttatcccaaa

SEQ ID NO: 26676 - DNA, 25 bp, Homo sapien
aagatctttatcccaaaaacatttg

SEQ ID NO: 26677 - DNA, 25 bp, Homo sapien
atttggattgtttattttcagtatt

SEQ ID NO: 26678 - DNA, 25 bp, Homo sapien
ttccctactacctggatactccaaa

SEQ ID NO: 26679 - DNA, 25 bp, Homo sapien
aatattaatatacagttcctttgca

SEQ ID NO: 26680 - DNA, 25 bp, Homo sapien
tatacagttcctttgcaatatttat

SEQ ID NO: 26681 - DNA, 25 bp, Homo sapien
gttgcttcttagagaaacccaacta

SEQ ID NO: 26682 - DNA, 25 bp, Homo sapien
aaaaaatctgtgaaagggctgggca

SEQ ID NO: 26683 - DNA, 25 bp, Homo sapien
gaatatgcagcaatggaaagtatca

SEQ ID NO: 26684 - DNA, 25 bp, Homo sapien
ggaaagtatcagtatccatacaaag

SEQ ID NO: 26685 - DNA, 25 bp, Homo sapien
tctggcagtgctattatgaggagtg

SEQ ID NO: 26686 - DNA, 25 bp, Homo sapien
ctggcagtgctattatgaggagtga

SEQ ID NO: 26687 - DNA, 25 bp, Homo sapien
ggcagtgctattatgaggagtgaag

SEQ ID NO: 26688 - DNA, 25 bp, Homo sapien
gctattatgaggagtgaagacccca

SEQ ID NO: 26689 - DNA, 25 bp, Homo sapien
tattatgaggagtgaagaccccaga

SEQ ID NO: 26690 - DNA, 25 bp, Homo sapien
tgaggagtgaagaccccagatctgt

SEQ ID NO: 26691 - DNA, 25 bp, Homo sapien
aggagtgaagaccccagatctgtga

SEQ ID NO: 26692 - DNA, 25 bp, Homo sapien
ggagtgaagaccccagatctgtgat

SEQ ID NO: 26693 - DNA, 25 bp, Homo sapien
gagtgaagaccccagatctgtgatc

SEQ ID NO: 26694 - DNA, 25 bp, Homo sapien
agtgaagaccccagatctgtgatca

SEQ ID NO: 26695 - DNA, 25 bp, Homo sapien
gtgaagaccccagatctgtgatcaa

SEQ ID NO: 26696 - DNA, 25 bp, Homo sapien
gaagaatttactgaggacagcgtag

SEQ ID NO: 26697 - DNA, 25 bp, Homo sapien
gaggacagcgtaggcttgaaaaaga

SEQ ID NO: 26698 - DNA, 25 bp, Homo sapien
gaaagaatgctgccgggcactcacg

SEQ ID NO: 26699 - DNA, 25 bp, Homo sapien
aactgggcatgccagcatgtgcctg

SEQ ID NO: 26700 - DNA, 25 bp, Homo sapien
aataggcaatcggaatcagcttaga

SEQ ID NO: 26701 - DNA, 25 bp, Homo sapien
ccctgctctcctttattaggtgtgc

SEQ ID NO: 26702 - DNA, 25 bp, Homo sapien
taggtgtgcttttggtacaggtctg

SEQ ID NO: 26703 - DNA, 25 bp, Homo sapien
tgcttttggtacaggtctgggcagc

SEQ ID NO: 26704 - DNA, 25 bp, Homo sapien
gtaaactttgccttgctaagaaact

SEQ ID NO: 26705 - DNA, 25 bp, Homo sapien
agaaacttttctccgagtgctggtc

SEQ ID NO: 26706 - DNA, 25 bp, Homo sapien
tctctctctgtggcaccaagaactt

SEQ ID NO: 26707 - DNA, 25 bp, Homo sapien
cagagtcaccctgaaatccagcagc

SEQ ID NO: 26708 - DNA, 25 bp, Homo sapien
ggtcacatccctgctaaagctgaat

SEQ ID NO: 26709 - DNA, 25 bp, Homo sapien
aagaagctggcacggagcgttgggc

SEQ ID NO: 26710 - DNA, 25 bp, Homo sapien
ggagatccgcaaatacagcatcatc

SEQ ID NO: 26711 - DNA, 25 bp, Homo sapien
atacagcatcatctatggccgtttc

SEQ ID NO: 26712 - DNA, 25 bp, Homo sapien
ggccgtttcgactctaagcggcggg

SEQ ID NO: 26713 - DNA, 25 bp, Homo sapien
taagcggcgggagggcaagcagctc

SEQ ID NO: 26714 - DNA, 25 bp, Homo sapien
tgctgcccagttctgcatgagggac

SEQ ID NO: 26715 - DNA, 25 bp, Homo sapien
cggagagtggagctcttctctttgt

SEQ ID NO: 26716 - DNA, 25 bp, Homo sapien
ccaagtagcccgagagagcacctac

SEQ ID NO: 26717 - DNA, 25 bp, Homo sapien
gaagaactgggaggccctccactga

SEQ ID NO: 26718 - DNA, 25 bp, Homo sapien
ggtgggcgagggaatagtcagaggg

SEQ ID NO: 26719 - DNA, 25 bp, Homo sapien
gagggatcacaatctttcagctaac

SEQ ID NO: 26720 - DNA, 25 bp, Homo sapien
ctttcagctaacttattctactccg

SEQ ID NO: 26721 - DNA, 25 bp, Homo sapien
gatgatcggctgaatgtaacagagg

SEQ ID NO: 26722 - DNA, 25 bp, Homo sapien
acagaggaactaacgtccaacgaca

SEQ ID NO: 26723 - DNA, 25 bp, Homo sapien
gtccaacgacaagacgaggattctc

SEQ ID NO: 26724 - DNA, 25 bp, Homo sapien
gacgaggattctcaacgtccagtcc

SEQ ID NO: 26725 - DNA, 25 bp, Homo sapien
gctcacagacgccaaacgcattaac

SEQ ID NO: 26726 - DNA, 25 bp, Homo sapien
aacgcattaactggcgaacagtgct

SEQ ID NO: 26727 - DNA, 25 bp, Homo sapien
ggcgaacagtgctgagtggcggcag

SEQ ID NO: 26728 - DNA, 25 bp, Homo sapien
gttctcctggagttcgctgaggagc

SEQ ID NO: 26729 - DNA, 25 bp, Homo sapien
agagtctttccaatagcctatacct

SEQ ID NO: 26730 - DNA, 25 bp, Homo sapien
atagcctatacctttcaacttgtga

SEQ ID NO: 26731 - DNA, 25 bp, Homo sapien
aagaacatatggtttgtctcaacat

SEQ ID NO: 26732 - DNA, 25 bp, Homo sapien
agagagttgtcttaggtaccctgaa

SEQ ID NO: 26733 - DNA, 25 bp, Homo sapien
ttaggtaccctgaagttcttataca

SEQ ID NO: 26734 - DNA, 25 bp, Homo sapien
atacaggatatttgctcttcattca

SEQ ID NO: 26735 - DNA, 25 bp, Homo sapien
tgctcttcattcaacgtttattgac

SEQ ID NO: 26736 - DNA, 25 bp, Homo sapien
tattgactacctactgtgttccagg

SEQ ID NO: 26737 - DNA, 25 bp, Homo sapien
ccagaccctgtgttagaggttagag

SEQ ID NO: 26738 - DNA, 25 bp, Homo sapien
aaaactctagtaacttatgtattat

SEQ ID NO: 26739 - DNA, 25 bp, Homo sapien
tagcatttttgggctgagtgcggtg

SEQ ID NO: 26740 - DNA, 25 bp, Homo sapien
ctgctgggccgggagaactccaact

SEQ ID NO: 26741 - DNA, 25 bp, Homo sapien
tgctgggccgggagaactccaactg

SEQ ID NO: 26742 - DNA, 25 bp, Homo sapien
agaactccaactgctcgaagctaga

SEQ ID NO: 26743 - DNA, 25 bp, Homo sapien
aactccaactgctcgaagctagaga

SEQ ID NO: 26744 - DNA, 25 bp, Homo sapien
ccaactgctcgaagctagagaaggc

SEQ ID NO: 26745 - DNA, 25 bp, Homo sapien
gctagagaaggcagacgtcctggaa

SEQ ID NO: 26746 - DNA, 25 bp, Homo sapien
gaaggcagacgtcctggaaatgacc

SEQ ID NO: 26747 - DNA, 25 bp, Homo sapien
gcagacgtcctggaaatgaccgtgc

SEQ ID NO: 26748 - DNA, 25 bp, Homo sapien
gacgtcctggaaatgaccgtgcgct

SEQ ID NO: 26749 - DNA, 25 bp, Homo sapien
tcctggaaatgaccgtgcgcttcct

SEQ ID NO: 26750 - DNA, 25 bp, Homo sapien
gagggctacagcgcctgtgtggcgc

SEQ ID NO: 26751 - DNA, 25 bp, Homo sapien
gaggatattgttgaaatggtgtctt

SEQ ID NO: 26752 - DNA, 25 bp, Homo sapien
gaaatggtgtctttagctgctgagg

SEQ ID NO: 26753 - DNA, 25 bp, Homo sapien
agctgctgaggaatcatctttaatg

SEQ ID NO: 26754 - DNA, 25 bp, Homo sapien
gaaattgaatatagtccagttgaat

SEQ ID NO: 26755 - DNA, 25 bp, Homo sapien
ccagttgaattggagtcattgagca

SEQ ID NO: 26756 - DNA, 25 bp, Homo sapien
gaatacttcagatgttaaatcgttt

SEQ ID NO: 26757 - DNA, 25 bp, Homo sapien
aaatcgtttacgggtcgctgatcag

SEQ ID NO: 26758 - DNA, 25 bp, Homo sapien
aagagccaaattaccagcaagagtt

SEQ ID NO: 26759 - DNA, 25 bp, Homo sapien
ggatgtgattggtggatctcagcat

SEQ ID NO: 26760 - DNA, 25 bp, Homo sapien
gtggatctcagcatagctctcatga

SEQ ID NO: 26761 - DNA, 25 bp, Homo sapien
gcatagctctcatgaggataccaat

SEQ ID NO: 26762 - DNA, 25 bp, Homo sapien
ttcctccagctatctccaaggatag

SEQ ID NO: 26763 - DNA, 25 bp, Homo sapien
tatctccaaggatagctcccataga

SEQ ID NO: 26764 - DNA, 25 bp, Homo sapien
gatagctcccatagatcctttaggt

SEQ ID NO: 26765 - DNA, 25 bp, Homo sapien
agctcccatagatcctttaggtctt

SEQ ID NO: 26766 - DNA, 25 bp, Homo sapien
atcctttaggtctttgctcactaat

SEQ ID NO: 26767 - DNA, 25 bp, Homo sapien
ctttgctcactaataccttgtcaat

SEQ ID NO: 26768 - DNA, 25 bp, Homo sapien
gctcactaataccttgtcaatgagg

SEQ ID NO: 26769 - DNA, 25 bp, Homo sapien
caatgaggtttaccttgaccaccct

SEQ ID NO: 26770 - DNA, 25 bp, Homo sapien
ttttcactgatgagtccccagtact

SEQ ID NO: 26771 - DNA, 25 bp, Homo sapien
gatgagtccccagtacttagaacag

SEQ ID NO: 26772 - DNA, 25 bp, Homo sapien
agtccccagtacttagaacagtatc

SEQ ID NO: 26773 - DNA, 25 bp, Homo sapien
gttgggttagctcaattgtggataa

SEQ ID NO: 26774 - DNA, 25 bp, Homo sapien
tacatttttttcccactgcattaag

SEQ ID NO: 26775 - DNA, 25 bp, Homo sapien
aaacttttcatgtttcatgtctctc

SEQ ID NO: 26776 - DNA, 25 bp, Homo sapien
tttcatgtctctcaacgctttttgt

SEQ ID NO: 26777 - DNA, 25 bp, Homo sapien
ctcaacgctttttgtcctcaaactt

SEQ ID NO: 26778 - DNA, 25 bp, Homo sapien
gtcctcaaactttattgctggagta

SEQ ID NO: 26779 - DNA, 25 bp, Homo sapien
aaacgattcctatagacttttgtat

SEQ ID NO: 26780 - DNA, 25 bp, Homo sapien
gaggctgaggtgggccaatcacctg

SEQ ID NO: 26781 - DNA, 25 bp, Homo sapien
cagctcctcgggaggctgagtcagg

SEQ ID NO: 26782 - DNA, 25 bp, Homo sapien
gaggtggaggtagcagtgagctgag

SEQ ID NO: 26783 - DNA, 25 bp, Homo sapien
agctgagatcataccatcgtgctcc

SEQ ID NO: 26784 - DNA, 25 bp, Homo sapien
agccatgaacactactgcctgtagt

SEQ ID NO: 26785 - DNA, 25 bp, Homo sapien
ctactgcctgtagtctgatgacgat

SEQ ID NO: 26786 - DNA, 25 bp, Homo sapien
gcctgtagtctgatgacgatagcaa

SEQ ID NO: 26787 - DNA, 25 bp, Homo sapien
taatattcgttttctgggttctggc

SEQ ID NO: 26788 - DNA, 25 bp, Homo sapien
ggggaatcatgttgctgtaacagtt

SEQ ID NO: 26789 - DNA, 25 bp, Homo sapien
gctgtaacagttggaggcagcagtg

SEQ ID NO: 26790 - DNA, 25 bp, Homo sapien
cagctctcaatcctcgtatagcgta

SEQ ID NO: 26791 - DNA, 25 bp, Homo sapien
ctcgtatagcgtatgacaaggcagc

SEQ ID NO: 26792 - DNA, 25 bp, Homo sapien
aactgttattgaacttggctatctc

SEQ ID NO: 26793 - DNA, 25 bp, Homo sapien
ggctatctcacaccagaacagtttg

SEQ ID NO: 26794 - DNA, 25 bp, Homo sapien
aaactaaggacatgctgagtccaaa

SEQ ID NO: 26795 - DNA, 25 bp, Homo sapien
tgatgggaaagagctgtgccccccg

SEQ ID NO: 26796 - DNA, 25 bp, Homo sapien
ctggacccacagactgcgtgagaga

SEQ ID NO: 26797 - DNA, 25 bp, Homo sapien
gagtaactccctcaggatacgacac

SEQ ID NO: 26798 - DNA, 25 bp, Homo sapien
gaagcagaacgtggtgacctttcac

SEQ ID NO: 26799 - DNA, 25 bp, Homo sapien
gacctttcacgaacatgggcatggc

SEQ ID NO: 26800 - DNA, 25 bp, Homo sapien
cccctcgtcatcaggtgcatagcaa

SEQ ID NO: 26801 - DNA, 25 bp, Homo sapien
gagcgtcatttttcttagtgtgcca

SEQ ID NO: 26802 - DNA, 25 bp, Homo sapien
tggtttgtgtatccatgcacctacc

SEQ ID NO: 26803 - DNA, 25 bp, Homo sapien
gtattgtcggttacctctgcatgga

SEQ ID NO: 26804 - DNA, 25 bp, Homo sapien
ctgcatggaacagcattaccctcct

SEQ ID NO: 26805 - DNA, 25 bp, Homo sapien
tctctccccagatgtgactactgag

SEQ ID NO: 26806 - DNA, 25 bp, Homo sapien
tagcctgaaaatagaaagtggaccc

SEQ ID NO: 26807 - DNA, 25 bp, Homo sapien
aagtggacccaaatacccagaagct

SEQ ID NO: 26808 - DNA, 25 bp, Homo sapien
gcaatggtatgattaactggggcct

SEQ ID NO: 26809 - DNA, 25 bp, Homo sapien
agctcccccatcagttagatttgta

SEQ ID NO: 26810 - DNA, 25 bp, Homo sapien
ggtatgattaactggggccttaaag

SEQ ID NO: 26811 - DNA, 25 bp, Homo sapien
gtgggatggtggatgaccgcagcac

SEQ ID NO: 26812 - DNA, 25 bp, Homo sapien
ggatggtggatgaccgcagcacacc

SEQ ID NO: 26813 - DNA, 25 bp, Homo sapien
tggtggatgaccgcagcacaccagt

SEQ ID NO: 26814 - DNA, 25 bp, Homo sapien
tgaccgcagcacaccagtgttagca

SEQ ID NO: 26815 - DNA, 25 bp, Homo sapien
accgcagcacaccagtgttagcaaa

SEQ ID NO: 26816 - DNA, 25 bp, Homo sapien
gattaactggggccttaaagatgat

SEQ ID NO: 26817 - DNA, 25 bp, Homo sapien
tcactcctcttgtacacttgatacc

SEQ ID NO: 26818 - DNA, 25 bp, Homo sapien
cctcttgtacacttgatacctgtgc

SEQ ID NO: 26819 - DNA, 25 bp, Homo sapien
gatacctgtgcagcatagtagagta

SEQ ID NO: 26820 - DNA, 25 bp, Homo sapien
agtagagtagccattagccacctgc

SEQ ID NO: 26821 - DNA, 25 bp, Homo sapien
attagccacctgcagctatttaaac

SEQ ID NO: 26822 - DNA, 25 bp, Homo sapien
ttcctgatcattcctttcttcatga

SEQ ID NO: 26823 - DNA, 25 bp, Homo sapien
tgagcctcagtagtatgtttttccc

SEQ ID NO: 26824 - DNA, 25 bp, Homo sapien
cattctttccttgtagccattgata

SEQ ID NO: 26825 - DNA, 25 bp, Homo sapien
gccattgatatacttacctcatttc

SEQ ID NO: 26826 - DNA, 25 bp, Homo sapien
acctcatttctgaattggaagagtt

SEQ ID NO: 26827 - DNA, 25 bp, Homo sapien
agactacatgaagggctgggtgcgg

SEQ ID NO: 26828 - DNA, 25 bp, Homo sapien
aactacggacgtaaagctggtctct

SEQ ID NO: 26829 - DNA, 25 bp, Homo sapien
agctggtctctaaattgccggtgaa

SEQ ID NO: 26830 - DNA, 25 bp, Homo sapien
gctggtctctaaattgccggtgaaa

SEQ ID NO: 26831 - DNA, 25 bp, Homo sapien
ctggtctctaaattgccggtgaaaa

SEQ ID NO: 26832 - DNA, 25 bp, Homo sapien
gtctctaaattgccggtgaaaatcc

SEQ ID NO: 26833 - DNA, 25 bp, Homo sapien
ctaaattgccggtgaaaatcctatt

SEQ ID NO: 26834 - DNA, 25 bp, Homo sapien
aattgccggtgaaaatcctatttat

SEQ ID NO: 26835 - DNA, 25 bp, Homo sapien
atcctatttataagagtgccgtaac

SEQ ID NO: 26836 - DNA, 25 bp, Homo sapien
ttcatgacagaagggagtttgctaa

SEQ ID NO: 26837 - DNA, 25 bp, Homo sapien
cagaagggagtttgctaaatttgaa

SEQ ID NO: 26838 - DNA, 25 bp, Homo sapien
aaatgaatgccaaatgggacacgca

SEQ ID NO: 26839 - DNA, 25 bp, Homo sapien
caccctgacgctccataaaactcag

SEQ ID NO: 26840 - DNA, 25 bp, Homo sapien
cataaaactcagcctctgaaccacc

SEQ ID NO: 26841 - DNA, 25 bp, Homo sapien
tctgaaccaccccagacaagactac

SEQ ID NO: 26842 - DNA, 25 bp, Homo sapien
aaatgtggggagacaatctgggaga

SEQ ID NO: 26843 - DNA, 25 bp, Homo sapien
atctgggagaagagctcctccccct

SEQ ID NO: 26844 - DNA, 25 bp, Homo sapien
tcccaaaccggaacttgagattaat

SEQ ID NO: 26845 - DNA, 25 bp, Homo sapien
taaacctgttaattatccattactt

SEQ ID NO: 26846 - DNA, 25 bp, Homo sapien
cattacttattagttggggtccagg

SEQ ID NO: 26847 - DNA, 25 bp, Homo sapien
gggccagagtggggtctgaggggga

SEQ ID NO: 26848 - DNA, 25 bp, Homo sapien
aaggggtgctgttgagtgcctggat

SEQ ID NO: 26849 - DNA, 25 bp, Homo sapien
tccaagttccctctctgtatatata

SEQ ID NO: 26850 - DNA, 25 bp, Homo sapien
atatcatggaattatttcatcagta

SEQ ID NO: 26851 - DNA, 25 bp, Homo sapien
ttgagtaatcgtggatgacctctcc

SEQ ID NO: 26852 - DNA, 25 bp, Homo sapien
gatgacctctcctattgtatgtaag

SEQ ID NO: 26853 - DNA, 25 bp, Homo sapien
gacctctcctattgtatgtaagcac

SEQ ID NO: 26854 - DNA, 25 bp, Homo sapien
atgtaagcacattcacatcttaatc

SEQ ID NO: 26855 - DNA, 25 bp, Homo sapien
agcacattcacatcttaatctttta

SEQ ID NO: 26856 - DNA, 25 bp, Homo sapien
tttgcacataacttactgtcaatac

SEQ ID NO: 26857 - DNA, 25 bp, Homo sapien
aacttactgtcaatacggcactaat

SEQ ID NO: 26858 - DNA, 25 bp, Homo sapien
atacggcactaatttgggggtagct

SEQ ID NO: 26859 - DNA, 25 bp, Homo sapien
ggcactaatttgggggtagctattt

SEQ ID NO: 26860 - DNA, 25 bp, Homo sapien
tattttcttattgttaccaaatagg

SEQ ID NO: 26861 - DNA, 25 bp, Homo sapien
tatatattggggtccattagttttt

SEQ ID NO: 26862 - DNA, 25 bp, Homo sapien
ttccaccctgggtggactctgacct

SEQ ID NO: 26863 - DNA, 25 bp, Homo sapien
ccccatgaagccatcggaactgcag

SEQ ID NO: 26864 - DNA, 25 bp, Homo sapien
tgaagccatcggaactgcagctcgt

SEQ ID NO: 26865 - DNA, 25 bp, Homo sapien
atcggaactgcagctcgttttccgc

SEQ ID NO: 26866 - DNA, 25 bp, Homo sapien
tcgccatttctttcagctgacaaat

SEQ ID NO: 26867 - DNA, 25 bp, Homo sapien
gctgacaaatgctgtttacctcact

SEQ ID NO: 26868 - DNA, 25 bp, Homo sapien
tggcttctcctttattcttaggttt

SEQ ID NO: 26869 - DNA, 25 bp, Homo sapien
taggttttggcctgacagttgctat

SEQ ID NO: 26870 - DNA, 25 bp, Homo sapien
gaaaatggtttttaggccatgcaca

SEQ ID NO: 26871 - DNA, 25 bp, Homo sapien
gaggcaaaggtggcagtaagccgag

SEQ ID NO: 26872 - DNA, 25 bp, Homo sapien
gcatggagagccaagcctacagcgg

SEQ ID NO: 26873 - DNA, 25 bp, Homo sapien
tacagcgggtcccagtagccaagat

SEQ ID NO: 26874 - DNA, 25 bp, Homo sapien
cctgccccctgaatggtatgtggtg

SEQ ID NO: 26875 - DNA, 25 bp, Homo sapien
gtgcctccagggaccaagtgtgaga

SEQ ID NO: 26876 - DNA, 25 bp, Homo sapien
atgtggccttgctgaatgtcatctc

SEQ ID NO: 26877 - DNA, 25 bp, Homo sapien
tgcactgagggactgttggcccctg

SEQ ID NO: 26878 - DNA, 25 bp, Homo sapien
tgtgagggtgactacgggggcccac

SEQ ID NO: 26879 - DNA, 25 bp, Homo sapien
gctttacccacaactgctgggtcct

SEQ ID NO: 26880 - DNA, 25 bp, Homo sapien
taatccccaaccgagtatgcgcaag

SEQ ID NO: 26881 - DNA, 25 bp, Homo sapien
tcacgcgtgtctctgtgtttgtgga

SEQ ID NO: 26882 - DNA, 25 bp, Homo sapien
ttaggcccagccttgatgccatatg

SEQ ID NO: 26883 - DNA, 25 bp, Homo sapien
aatagtaagctaccctaagttatat

SEQ ID NO: 26884 - DNA, 25 bp, Homo sapien
gtaagctaccctaagttatataata

SEQ ID NO: 26885 - DNA, 25 bp, Homo sapien
aaattcaaattgcaggccggcacgt

SEQ ID NO: 26886 - DNA, 25 bp, Homo sapien
tcaaattgcaggccggcacgtggct

SEQ ID NO: 26887 - DNA, 25 bp, Homo sapien
gtttttagtacaatatgtctcactt

SEQ ID NO: 26888 - DNA, 25 bp, Homo sapien
gtacaatatgtctcacttcaaagca

SEQ ID NO: 26889 - DNA, 25 bp, Homo sapien
gtctcacttcaaagcattcagcata

SEQ ID NO: 26890 - DNA, 25 bp, Homo sapien
gcattcagcatatgaaaatctgcat

SEQ ID NO: 26891 - DNA, 25 bp, Homo sapien
gttggctgatatacattcactttac

SEQ ID NO: 26892 - DNA, 25 bp, Homo sapien
aaaatgcttcgctttataagccaga

SEQ ID NO: 26893 - DNA, 25 bp, Homo sapien
gcttcgctttataagccagatattc

SEQ ID NO: 26894 - DNA, 25 bp, Homo sapien
gagcatttgctcaaagtttccaagc

SEQ ID NO: 26895 - DNA, 25 bp, Homo sapien
atttgctcaaagtttccaagccaaa

SEQ ID NO: 26896 - DNA, 25 bp, Homo sapien
gtttccaagccaaatggggaagcct

SEQ ID NO: 26897 - DNA, 25 bp, Homo sapien
caaatggggaagccttttggtcatt

SEQ ID NO: 26898 - DNA, 25 bp, Homo sapien
atttcttccagctgggtctaaaaat

SEQ ID NO: 26899 - DNA, 25 bp, Homo sapien
agctgggtctaaaaatactggtagt

SEQ ID NO: 26900 - DNA, 25 bp, Homo sapien
aatactggtagttggacaagtgatg

SEQ ID NO: 26901 - DNA, 25 bp, Homo sapien
ccctttccaatcggctgtaaatacg

SEQ ID NO: 26902 - DNA, 25 bp, Homo sapien
ggctgtaaatacgaaccattggctg

SEQ ID NO: 26903 - DNA, 25 bp, Homo sapien
aaatacgaaccattggctgggcacg

SEQ ID NO: 26904 - DNA, 25 bp, Homo sapien
tggctaaggcttactagaattttaa

SEQ ID NO: 26905 - DNA, 25 bp, Homo sapien
aatgagttattgaatgtctgatatc

SEQ ID NO: 26906 - DNA, 25 bp, Homo sapien
ctgatatctgcatggcactgtaatg

SEQ ID NO: 26907 - DNA, 25 bp, Homo sapien
atggcactgtaatggatttagcttg

SEQ ID NO: 26908 - DNA, 25 bp, Homo sapien
ggatttagcttgcaacttgataaat

SEQ ID NO: 26909 - DNA, 25 bp, Homo sapien
ataaataaaggtacttgaggctggg

SEQ ID NO: 26910 - DNA, 25 bp, Homo sapien
gaaggcttaatgaatgttctcatct

SEQ ID NO: 26911 - DNA, 25 bp, Homo sapien
gaatgttctcatctaaattaatatc

SEQ ID NO: 26912 - DNA, 25 bp, Homo sapien
ggtaatatgcccttaaccattcatt

SEQ ID NO: 26913 - DNA, 25 bp, Homo sapien
atatgcccttaaccattcattttta

SEQ ID NO: 26914 - DNA, 25 bp, Homo sapien
aattctgaagcactattcagctcaa

SEQ ID NO: 26915 - DNA, 25 bp, Homo sapien
gaagcactattcagctcaacaaatg

SEQ ID NO: 26916 - DNA, 25 bp, Homo sapien
accaggcctggtgtaatgatcattt

SEQ ID NO: 26917 - DNA, 25 bp, Homo sapien
atacaaacataagagcctttacctc

SEQ ID NO: 26918 - DNA, 25 bp, Homo sapien
gagcctttacctcttatgtgaaatt

SEQ ID NO: 26919 - DNA, 25 bp, Homo sapien
tacagaattgatatttgtgtctcat

SEQ ID NO: 26920 - DNA, 25 bp, Homo sapien
gtgtctcatacacacaagtattttg

SEQ ID NO: 26921 - DNA, 25 bp, Homo sapien
gtattttgttcttaccaggggagtg

SEQ ID NO: 26922 - DNA, 25 bp, Homo sapien
accaggggagtggaaactctgcaca

SEQ ID NO: 26923 - DNA, 25 bp, Homo sapien
aactctgcacaaaagtaactccact

SEQ ID NO: 26924 - DNA, 25 bp, Homo sapien
gtaactccacttttatttgagacag

SEQ ID NO: 26925 - DNA, 25 bp, Homo sapien
gaatgcagtggtgcaatctcggctc

SEQ ID NO: 26926 - DNA, 25 bp, Homo sapien
cactcctgcctgggcgaaagagcga

SEQ ID NO: 26927 - DNA, 25 bp, Homo sapien
agggaagacggtgagctctctgtgt

SEQ ID NO: 26928 - DNA, 25 bp, Homo sapien
ggatgggactggggatgcgtcacag

SEQ ID NO: 26929 - DNA, 25 bp, Homo sapien
gactggggatgcgtcacagtgtggc

SEQ ID NO: 26930 - DNA, 25 bp, Homo sapien
tggggatgcgtcacagtgtggctca

SEQ ID NO: 26931 - DNA, 25 bp, Homo sapien
ggatgcgtcacagtgtggctcatcc

SEQ ID NO: 26932 - DNA, 25 bp, Homo sapien
atcccagagtccgtgctcaggattt

SEQ ID NO: 26933 - DNA, 25 bp, Homo sapien
cagagtccgtgctcaggatttttgg

SEQ ID NO: 26934 - DNA, 25 bp, Homo sapien
gtccgtgctcaggatttttggggtt

SEQ ID NO: 26935 - DNA, 25 bp, Homo sapien
ccagcccatgctcaggtttaactaa

SEQ ID NO: 26936 - DNA, 25 bp, Homo sapien
agcccatgctcaggtttaactaagc

SEQ ID NO: 26937 - DNA, 25 bp, Homo sapien
ggtttaactaagcacatttattatt

SEQ ID NO: 26938 - DNA, 25 bp, Homo sapien
tgccctctcaagacttcagtctttt

SEQ ID NO: 26939 - DNA, 25 bp, Homo sapien
agacttcagtcttttcacttgtaaa

SEQ ID NO: 26940 - DNA, 25 bp, Homo sapien
gtaactgcttcatacagctgctatg

SEQ ID NO: 26941 - DNA, 25 bp, Homo sapien
aatgtaaagcacctatataacccag

SEQ ID NO: 26942 - DNA, 25 bp, Homo sapien
tataacccaggtacttggcaaggaa

SEQ ID NO: 26943 - DNA, 25 bp, Homo sapien
gttttagctgtcatcgttagtgtca

SEQ ID NO: 26944 - DNA, 25 bp, Homo sapien
aagtgacctgtcagacatgacctga

SEQ ID NO: 26945 - DNA, 25 bp, Homo sapien
tgggaatgaagtttctggctcaccc

SEQ ID NO: 26946 - DNA, 25 bp, Homo sapien
ccccttgtattggtccattcttgca

SEQ ID NO: 26947 - DNA, 25 bp, Homo sapien
gggtatggtggctcaagcatgtaat

SEQ ID NO: 26948 - DNA, 25 bp, Homo sapien
gtgggaggatacgaggtcagcagtt

SEQ ID NO: 26949 - DNA, 25 bp, Homo sapien
tcagcacaccgttccggaaggcaaa

SEQ ID NO: 26950 - DNA, 25 bp, Homo sapien
aactttcgttcacagcaggcacggt

SEQ ID NO: 26951 - DNA, 25 bp, Homo sapien
acccatctcaggagcctggctggtt

SEQ ID NO: 26952 - DNA, 25 bp, Homo sapien
ggtatccatgacaactgctgattcc

SEQ ID NO: 26953 - DNA, 25 bp, Homo sapien
tgctgattccagtgtcgaggccatt

SEQ ID NO: 26954 - DNA, 25 bp, Homo sapien
tgcagcgtgactgactctgttgcta

SEQ ID NO: 26955 - DNA, 25 bp, Homo sapien
gaatgtttctgtgagctctggtgtc

SEQ ID NO: 26956 - DNA, 25 bp, Homo sapien
gatgacaggccaacggctgctttag

SEQ ID NO: 26957 - DNA, 25 bp, Homo sapien
gctttagagatggtgtcgacgcggc

SEQ ID NO: 26958 - DNA, 25 bp, Homo sapien
gtagtagtaggcggccgctctagag

SEQ ID NO: 26959 - DNA, 25 bp, Homo sapien
gatccaagcttacgtacgcgtgcat

SEQ ID NO: 26960 - DNA, 25 bp, Homo sapien
tactatgaaagctgctctggcctcg

SEQ ID NO: 26961 - DNA, 25 bp, Homo sapien
tcgtcttctagcttgtgcctagttg

SEQ ID NO: 26962 - DNA, 25 bp, Homo sapien
aagtctcacctttacaggatcattt

SEQ ID NO: 26963 - DNA, 25 bp, Homo sapien
atgcagggaactcacaagctgtgtc

SEQ ID NO: 26964 - DNA, 25 bp, Homo sapien
ggggggcacaggccaactatatgga

SEQ ID NO: 26965 - DNA, 25 bp, Homo sapien
gtcccaaattagcaaacccttcatt

SEQ ID NO: 26966 - DNA, 25 bp, Homo sapien
ccttgtcaagcctaccagagcagct

SEQ ID NO: 26967 - DNA, 25 bp, Homo sapien
cattgtgtcctggatcgtctgggag

SEQ ID NO: 26968 - DNA, 25 bp, Homo sapien
gaatcgccacaggactgttctgggg

SEQ ID NO: 26969 - DNA, 25 bp, Homo sapien
tcccttaactctgtagcctggcagt

SEQ ID NO: 26970 - DNA, 25 bp, Homo sapien
gcctggcagtctgacccaaagttgc

SEQ ID NO: 26971 - DNA, 25 bp, Homo sapien
cccccctggcagcagtattggaggg

SEQ ID NO: 26972 - DNA, 25 bp, Homo sapien
tggagaaagaggcccagccactgac

SEQ ID NO: 26973 - DNA, 25 bp, Homo sapien
ctgtaaccttagggtttggcccatg

SEQ ID NO: 26974 - DNA, 25 bp, Homo sapien
gcccagataatcttgtgtctcctgc

SEQ ID NO: 26975 - DNA, 25 bp, Homo sapien
gctgcttctcagtcatgaacgtggc

SEQ ID NO: 26976 - DNA, 25 bp, Homo sapien
cctgtccctgggcaggagtgctggt

SEQ ID NO: 26977 - DNA, 25 bp, Homo sapien
aggcctggagcctgtagggctggac

SEQ ID NO: 26978 - DNA, 25 bp, Homo sapien
ggctggactgaggttcaggtctccc

SEQ ID NO: 26979 - DNA, 25 bp, Homo sapien
ctttgtccccactctagagcaggga

SEQ ID NO: 26980 - DNA, 25 bp, Homo sapien
tgggggaggagttgtgtcttgtctt

SEQ ID NO: 26981 - DNA, 25 bp, Homo sapien
tcttctgtctccatgtggtttttgg

SEQ ID NO: 26982 - DNA, 25 bp, Homo sapien
ggaggacatcaagacaggtggcatt

SEQ ID NO: 26983 - DNA, 25 bp, Homo sapien
ggtggcatttgtcattgaagtgcta

SEQ ID NO: 26984 - DNA, 25 bp, Homo sapien
gggcaggaggggtctatgaagcagt

SEQ ID NO: 26985 - DNA, 25 bp, Homo sapien
gggtctatgaagcagtcctggggag

SEQ ID NO: 26986 - DNA, 25 bp, Homo sapien
ggggaggacagattcgcagtgtttg

SEQ ID NO: 26987 - DNA, 25 bp, Homo sapien
aagccaagtttatcttcgatctcct

SEQ ID NO: 26988 - DNA, 25 bp, Homo sapien
tcctgcagtttctgatagttcaaaa

SEQ ID NO: 26989 - DNA, 25 bp, Homo sapien
tccatcaagtagttctgacttcctg

SEQ ID NO: 26990 - DNA, 25 bp, Homo sapien
ccctaagccttatctgcacataaac

SEQ ID NO: 26991 - DNA, 25 bp, Homo sapien
ctgcacataaactgggggccgggcg

SEQ ID NO: 26992 - DNA, 25 bp, Homo sapien
gtggtggagcacacctgttatccta

SEQ ID NO: 26993 - DNA, 25 bp, Homo sapien
agcagggggcacaggacagagaaga

SEQ ID NO: 26994 - DNA, 25 bp, Homo sapien
cacaggacagagaagaggaagcggc

SEQ ID NO: 26995 - DNA, 25 bp, Homo sapien
gagaagaggaagcggctgcagcccc

SEQ ID NO: 26996 - DNA, 25 bp, Homo sapien
tccagtgccaaccagcagggggcac

SEQ ID NO: 26997 - DNA, 25 bp, Homo sapien
caaccagcagggggcacaggacaga

SEQ ID NO: 26998 - DNA, 25 bp, Homo sapien
cagggggcacaggacagagaagagg

SEQ ID NO: 26999 - DNA, 25 bp, Homo sapien
acagagaagaggaagcggcagcagc

SEQ ID NO: 27000 - DNA, 25 bp, Homo sapien
gggcacaggacagagaagaggaagc

SEQ ID NO: 27001 - DNA, 25 bp, Homo sapien
gagaagaggaagcggcagcagcccc

SEQ ID NO: 27002 - DNA, 25 bp, Homo sapien
cagcagggggcacaggacagagaag

SEQ ID NO: 27003 - DNA, 25 bp, Homo sapien
gcagggggcacaggacagagaagag

SEQ ID NO: 27004 - DNA, 25 bp, Homo sapien
gtctgttttctaaggaatgtgctca

SEQ ID NO: 27005 - DNA, 25 bp, Homo sapien
taggagatgtctttcttttcccacc

SEQ ID NO: 27006 - DNA, 25 bp, Homo sapien
cccaccatttctccactgttgagat

SEQ ID NO: 27007 - DNA, 25 bp, Homo sapien
tccactgttgagatttgttcatttg

SEQ ID NO: 27008 - DNA, 25 bp, Homo sapien
ttaacgaaaatctgcacttctgttt

SEQ ID NO: 27009 - DNA, 25 bp, Homo sapien
tgcacttctgtttttagcaggaatt

SEQ ID NO: 27010 - DNA, 25 bp, Homo sapien
ataactgggtttgtgatgctgaggt

SEQ ID NO: 27011 - DNA, 25 bp, Homo sapien
gatgctgaggtgtattgggctgtga

SEQ ID NO: 27012 - DNA, 25 bp, Homo sapien
gggctgtgataaaatatactgtctt

SEQ ID NO: 27013 - DNA, 25 bp, Homo sapien
tctggccaggcacagtagctcatgc

SEQ ID NO: 27014 - DNA, 25 bp, Homo sapien
gtgagtcgagatcacgccattgcac

SEQ ID NO: 27015 - DNA, 25 bp, Homo sapien
ttacacttacaaaacatctcaattt

SEQ ID NO: 27016 - DNA, 25 bp, Homo sapien
agccacagtggctctaatagcgacc

SEQ ID NO: 27017 - DNA, 25 bp, Homo sapien
ggctctaatagcgaccacattggac

SEQ ID NO: 27018 - DNA, 25 bp, Homo sapien
gcgaccacattggacagtgcagatc

SEQ ID NO: 27019 - DNA, 25 bp, Homo sapien
agtgcagatctagactgtgtccata

SEQ ID NO: 27020 - DNA, 25 bp, Homo sapien
gactgtgtccatatagattgctgaa

SEQ ID NO: 27021 - DNA, 25 bp, Homo sapien
gtgtctatatacagttgctattggg

SEQ ID NO: 27022 - DNA, 25 bp, Homo sapien
aagaaaaaaggatcagccgggtgtg

SEQ ID NO: 27023 - DNA, 25 bp, Homo sapien
tccaggccagtgctcgtaacaaaaa

SEQ ID NO: 27024 - DNA, 25 bp, Homo sapien
tacaaaccacacaagtaagtaattt

SEQ ID NO: 27025 - DNA, 25 bp, Homo sapien
aaaattttctaggtcaccagattag

SEQ ID NO: 27026 - DNA, 25 bp, Homo sapien
gtcatatggatggtaggtgcctttt

SEQ ID NO: 27027 - DNA, 25 bp, Homo sapien
ggagatagggtgtttaagcagtaat

SEQ ID NO: 27028 - DNA, 25 bp, Homo sapien
gcgatgatgaatcttttcttcttga

SEQ ID NO: 27029 - DNA, 25 bp, Homo sapien
taggcagactcttcaaaacgcactc

SEQ ID NO: 27030 - DNA, 25 bp, Homo sapien
aacgcactcattcagtttgctacta

SEQ ID NO: 27031 - DNA, 25 bp, Homo sapien
tgtgcacttcccccaaagatgaaga

SEQ ID NO: 27032 - DNA, 25 bp, Homo sapien
gggatttgtgtgaggtcttactata

SEQ ID NO: 27033 - DNA, 25 bp, Homo sapien
tactatatttattgctacctcctgg

SEQ ID NO: 27034 - DNA, 25 bp, Homo sapien
gctacctcctggagatttccagaac

SEQ ID NO: 27035 - DNA, 25 bp, Homo sapien
agatcatgcgatactttgtcaggga

SEQ ID NO: 27036 - DNA, 25 bp, Homo sapien
ttgtcagggaaatccttgcacgagg

SEQ ID NO: 27037 - DNA, 25 bp, Homo sapien
aatggtaattagtgcttctcttgaa

SEQ ID NO: 27038 - DNA, 25 bp, Homo sapien
aaacacttaacctagacttgtgagg

SEQ ID NO: 27039 - DNA, 25 bp, Homo sapien
gaaaagctgagtttgggtatggcac

SEQ ID NO: 27040 - DNA, 25 bp, Homo sapien
ggtatggcactgagaggcacccaag

SEQ ID NO: 27041 - DNA, 25 bp, Homo sapien
aaggcttttctagaaacaacactga

SEQ ID NO: 27042 - DNA, 25 bp, Homo sapien
gaaaagcctcagaagccacatagat

SEQ ID NO: 27043 - DNA, 25 bp, Homo sapien
gatagtgatacattccagtaacaga

SEQ ID NO: 27044 - DNA, 25 bp, Homo sapien
tagagagatgattttaagccttatc

SEQ ID NO: 27045 - DNA, 25 bp, Homo sapien
aagccttatcatgctaggttttgtg

SEQ ID NO: 27046 - DNA, 25 bp, Homo sapien
gaaaaaggggcagggtgcggtagct

SEQ ID NO: 27047 - DNA, 25 bp, Homo sapien
aaattagtcagcgtggtggcgtgtg

SEQ ID NO: 27048 - DNA, 25 bp, Homo sapien
cctgttcttgtcgtctatggtaaaa

SEQ ID NO: 27049 - DNA, 25 bp, Homo sapien
ctgttgtgtctgtggccatgggaca

SEQ ID NO: 27050 - DNA, 25 bp, Homo sapien
gaatcccagaccgattctctggctc

SEQ ID NO: 27051 - DNA, 25 bp, Homo sapien
attctctggctccagctcagggaac

SEQ ID NO: 27052 - DNA, 25 bp, Homo sapien
tcagggaacacagcttccttgacca

SEQ ID NO: 27053 - DNA, 25 bp, Homo sapien
catcactggggctcaggcggaagat

SEQ ID NO: 27054 - DNA, 25 bp, Homo sapien
actgtaattctcgggacagcagtgg

SEQ ID NO: 27055 - DNA, 25 bp, Homo sapien
ggacagacaatcaagatcacatgcc

SEQ ID NO: 27056 - DNA, 25 bp, Homo sapien
atcacatgccaaggagacagcctca

SEQ ID NO: 27057 - DNA, 25 bp, Homo sapien
aagttttatgcaacctggtaccagc

SEQ ID NO: 27058 - DNA, 25 bp, Homo sapien
gtaccagcagaagccagggcaggcc

SEQ ID NO: 27059 - DNA, 25 bp, Homo sapien
tgtggctgtggatttcacccaggag

SEQ ID NO: 27060 - DNA, 25 bp, Homo sapien
cacccaggaggagtggcggcaactg

SEQ ID NO: 27061 - DNA, 25 bp, Homo sapien
cggcaactggaccctgatgagaaga

SEQ ID NO: 27062 - DNA, 25 bp, Homo sapien
agccatctagtttctgtggggtatg

SEQ ID NO: 27063 - DNA, 25 bp, Homo sapien
ttatcaccaagccaaacatcatcat

SEQ ID NO: 27064 - DNA, 25 bp, Homo sapien
atgtcaacatagtccagaacctgct

SEQ ID NO: 27065 - DNA, 25 bp, Homo sapien
gaacctgctaaggccatcaaaccta

SEQ ID NO: 27066 - DNA, 25 bp, Homo sapien
gaagtcagtccatcagatttgctct

SEQ ID NO: 27067 - DNA, 25 bp, Homo sapien
gatttgctctgggccagtggtactg

SEQ ID NO: 27068 - DNA, 25 bp, Homo sapien
gtggtactgagtctaagcactgcag

SEQ ID NO: 27069 - DNA, 25 bp, Homo sapien
aacagtctggatgctggtgccacta

SEQ ID NO: 27070 - DNA, 25 bp, Homo sapien
cttatctggctttgtcttaatgtaa

SEQ ID NO: 27071 - DNA, 25 bp, Homo sapien
ctatttattagtgtttatcagtttt

SEQ ID NO: 27072 - DNA, 25 bp, Homo sapien
atcagttttctttaaactcaccact

SEQ ID NO: 27073 - DNA, 25 bp, Homo sapien
taaactcaccactttttgatgaata

SEQ ID NO: 27074 - DNA, 25 bp, Homo sapien
aatctaaaaacttggccgggcgcag

SEQ ID NO: 27075 - DNA, 25 bp, Homo sapien
gtgcctgtaattgtagctactcggg

SEQ ID NO: 27076 - DNA, 25 bp, Homo sapien
atcacttgaacccagaaagcagagg

SEQ ID NO: 27077 - DNA, 25 bp, Homo sapien
gagactccgtctctaaataaataaa

SEQ ID NO: 27078 - DNA, 25 bp, Homo sapien
aataaatttagccttctactcaaga

SEQ ID NO: 27079 - DNA, 25 bp, Homo sapien
ttagccttctactcaagaacttatc

SEQ ID NO: 27080 - DNA, 25 bp, Homo sapien
ctactcaagaacttatctggctttg

SEQ ID NO: 27081 - DNA, 25 bp, Homo sapien
gaggaagactggtagcggggagggg

SEQ ID NO: 27082 - DNA, 25 bp, Homo sapien
gagacaaacagttgcactcttttga

SEQ ID NO: 27083 - DNA, 25 bp, Homo sapien
aacagttgcactcttttgagtttct

SEQ ID NO: 27084 - DNA, 25 bp, Homo sapien
gattagcttttccaaaggagacagt

SEQ ID NO: 27085 - DNA, 25 bp, Homo sapien
ggagacagtcagatctgcatttatc

SEQ ID NO: 27086 - DNA, 25 bp, Homo sapien
agatctgcatttatcttagtgagca

SEQ ID NO: 27087 - DNA, 25 bp, Homo sapien
gtgagcagagaggtaactttgaata

SEQ ID NO: 27088 - DNA, 25 bp, Homo sapien
ccctaagcagtttccagcctgagtt

SEQ ID NO: 27089 - DNA, 25 bp, Homo sapien
gcttagtgattttggaggcccaaga

SEQ ID NO: 27090 - DNA, 25 bp, Homo sapien
tttcctttcacagtacttaccagaa

SEQ ID NO: 27091 - DNA, 25 bp, Homo sapien
gcagatgtaggccgggcactgtagc

SEQ ID NO: 27092 - DNA, 25 bp, Homo sapien
tttggtggcacttgatgagcccttc

SEQ ID NO: 27093 - DNA, 25 bp, Homo sapien
tggtggcacttgatgagcccttcag

SEQ ID NO: 27094 - DNA, 25 bp, Homo sapien
gaggtgtggaggaagaagcgccagc

SEQ ID NO: 27095 - DNA, 25 bp, Homo sapien
gaggaagaagcgccagcgggaaccg

SEQ ID NO: 27096 - DNA, 25 bp, Homo sapien
cagcggctgcggagtgtgtactggg

SEQ ID NO: 27097 - DNA, 25 bp, Homo sapien
cttcctgcgggacagggcttgagac

SEQ ID NO: 27098 - DNA, 25 bp, Homo sapien
gggacagggcttgagacctgcagcc

SEQ ID NO: 27099 - DNA, 25 bp, Homo sapien
gggctgaggagtacaggcccacagc

SEQ ID NO: 27100 - DNA, 25 bp, Homo sapien
gctgaggagtacaggcccacagcgt

SEQ ID NO: 27101 - DNA, 25 bp, Homo sapien
gagtacaggcccacagcgtgggact

SEQ ID NO: 27102 - DNA, 25 bp, Homo sapien
caggcccacagcgtgggactggcag

SEQ ID NO: 27103 - DNA, 25 bp, Homo sapien
aggggctggaatgggtgacttttat

SEQ ID NO: 27104 - DNA, 25 bp, Homo sapien
ggggctggaatgggtgacttttata

SEQ ID NO: 27105 - DNA, 25 bp, Homo sapien
gggctggaatgggtgacttttatag

SEQ ID NO: 27106 - DNA, 25 bp, Homo sapien
aatgggtgacttttataggattcat

SEQ ID NO: 27107 - DNA, 25 bp, Homo sapien
gtgacttttataggattcatagaag

SEQ ID NO: 27108 - DNA, 25 bp, Homo sapien
gtcatgaattctatagagacttcgt

SEQ ID NO: 27109 - DNA, 25 bp, Homo sapien
gaattctatagagacttcgtgaagg

SEQ ID NO: 27110 - DNA, 25 bp, Homo sapien
atagagacttcgtgaagggccgatt

SEQ ID NO: 27111 - DNA, 25 bp, Homo sapien
agacttcgtgaagggccgatttatc

SEQ ID NO: 27112 - DNA, 25 bp, Homo sapien
gtgaagggccgatttatcatctcca

SEQ ID NO: 27113 - DNA, 25 bp, Homo sapien
tgaagggccgatttatcatctccag

SEQ ID NO: 27114 - DNA, 25 bp, Homo sapien
ctcccgctggctctatgaagcgatg

SEQ ID NO: 27115 - DNA, 25 bp, Homo sapien
gatggccaaggcttgggagccctgg

SEQ ID NO: 27116 - DNA, 25 bp, Homo sapien
ctcaggtacttatcgtccgtggaaa

SEQ ID NO: 27117 - DNA, 25 bp, Homo sapien
tatcgtccgtggaaacccaggaagg

SEQ ID NO: 27118 - DNA, 25 bp, Homo sapien
ctcaatatgaatttttgttcccgtg

SEQ ID NO: 27119 - DNA, 25 bp, Homo sapien
tgttcccgtgagaacttctggctct

SEQ ID NO: 27120 - DNA, 25 bp, Homo sapien
agaacttctggctcttgatcaactc

SEQ ID NO: 27121 - DNA, 25 bp, Homo sapien
gggagcttcaggctgctgaggatcg

SEQ ID NO: 27122 - DNA, 25 bp, Homo sapien
gtgcatataattggccacattcccc

SEQ ID NO: 27123 - DNA, 25 bp, Homo sapien
gtgggtaaccatgaaagcacacctg

SEQ ID NO: 27124 - DNA, 25 bp, Homo sapien
cttcattgagggcaaccactcctcc

SEQ ID NO: 27125 - DNA, 25 bp, Homo sapien
gacaattccaagaacacgctgtatc

SEQ ID NO: 27126 - DNA, 25 bp, Homo sapien
caagaacacgctgtatctgcaaatg

SEQ ID NO: 27127 - DNA, 25 bp, Homo sapien
ctgagagccgaggacacggccgtat

SEQ ID NO: 27128 - DNA, 25 bp, Homo sapien
gacacggccgtatattactgtgcga

SEQ ID NO: 27129 - DNA, 25 bp, Homo sapien
gccgtatattactgtgcgaaatccc

SEQ ID NO: 27130 - DNA, 25 bp, Homo sapien
agtgggtctcagctattagtgggag

SEQ ID NO: 27131 - DNA, 25 bp, Homo sapien
tcagctattagtgggagtgcaggta

SEQ ID NO: 27132 - DNA, 25 bp, Homo sapien
ggagtgcaggtaccacatactacgc

SEQ ID NO: 27133 - DNA, 25 bp, Homo sapien
caggtaccacatactacgcagactc

SEQ ID NO: 27134 - DNA, 25 bp, Homo sapien
tacgcagactccgtgaagggccggt

SEQ ID NO: 27135 - DNA, 25 bp, Homo sapien
ttcaccacctccagagacaattcca

SEQ ID NO: 27136 - DNA, 25 bp, Homo sapien
ctgcatacccacaggtgagaccagt

SEQ ID NO: 27137 - DNA, 25 bp, Homo sapien
gtgagaccagtgttctgctgggggg

SEQ ID NO: 27138 - DNA, 25 bp, Homo sapien
gttctgctggggggtaaggcatggg

SEQ ID NO: 27139 - DNA, 25 bp, Homo sapien
taaggcatgggaaaatactgggaat

SEQ ID NO: 27140 - DNA, 25 bp, Homo sapien
tactgggaattcatagggggttgga

SEQ ID NO: 27141 - DNA, 25 bp, Homo sapien
ggggttggagtgggtactctgggag

SEQ ID NO: 27142 - DNA, 25 bp, Homo sapien
gggagtataattggtcagtcggaga

SEQ ID NO: 27143 - DNA, 25 bp, Homo sapien
ggtcagtcggagagtcctggtgagg

SEQ ID NO: 27144 - DNA, 25 bp, Homo sapien
gtcggagagtcctggtgaggtggtg

SEQ ID NO: 27145 - DNA, 25 bp, Homo sapien
tgaggtggtgggagtctgggggacc

SEQ ID NO: 27146 - DNA, 25 bp, Homo sapien
aaataagaaatgacggccgggcatg

SEQ ID NO: 27147 - DNA, 25 bp, Homo sapien
aaatatcagacagtctttatgtctc

SEQ ID NO: 27148 - DNA, 25 bp, Homo sapien
tctctctcactcttgacatacatat

SEQ ID NO: 27149 - DNA, 25 bp, Homo sapien
ctctcactcttgacatacatataca

SEQ ID NO: 27150 - DNA, 25 bp, Homo sapien
cataaatctattcattgtaccagga

SEQ ID NO: 27151 - DNA, 25 bp, Homo sapien
atctattcattgtaccaggagtgtt

SEQ ID NO: 27152 - DNA, 25 bp, Homo sapien
gtaccaggagtgttttgtcatctta

SEQ ID NO: 27153 - DNA, 25 bp, Homo sapien
caggagtgttttgtcatcttattta

SEQ ID NO: 27154 - DNA, 25 bp, Homo sapien
tatagtcccagcagagtgggagcca

SEQ ID NO: 27155 - DNA, 25 bp, Homo sapien
ccagcagagtgggagccaaggcaga

SEQ ID NO: 27156 - DNA, 25 bp, Homo sapien
ccctcccctggataagaatccctgg

SEQ ID NO: 27157 - DNA, 25 bp, Homo sapien
tcccctggataagaatccctgggcc

SEQ ID NO: 27158 - DNA, 25 bp, Homo sapien
tttcctctttaacttacactgtgac

SEQ ID NO: 27159 - DNA, 25 bp, Homo sapien
tttaacttacactgtgaccttacaa

SEQ ID NO: 27160 - DNA, 25 bp, Homo sapien
gaccttacaaaacactcttattcaa

SEQ ID NO: 27161 - DNA, 25 bp, Homo sapien
aagtcttgaatttgagtgaatacct

SEQ ID NO: 27162 - DNA, 25 bp, Homo sapien
gtgaatacctttttatagatccaaa

SEQ ID NO: 27163 - DNA, 25 bp, Homo sapien
gatgttaacgtgcttgttccttttc

SEQ ID NO: 27164 - DNA, 25 bp, Homo sapien
tagtacttgggtagactttcctttg

SEQ ID NO: 27165 - DNA, 25 bp, Homo sapien
tcctttggttggggagcggggtgct

SEQ ID NO: 27166 - DNA, 25 bp, Homo sapien
gcggggtgcttaccatataacttgt

SEQ ID NO: 27167 - DNA, 25 bp, Homo sapien
tatatgtttctgtttaagcatcaaa

SEQ ID NO: 27168 - DNA, 25 bp, Homo sapien
gcatcaaaagtcttttgctgggcac

SEQ ID NO: 27169 - DNA, 25 bp, Homo sapien
gcttgccccaacaaatatttgcttc

SEQ ID NO: 27170 - DNA, 25 bp, Homo sapien
attcttcaagatttctttcaagaca

SEQ ID NO: 27171 - DNA, 25 bp, Homo sapien
ttcaagacattgttctgtgcctccc

SEQ ID NO: 27172 - DNA, 25 bp, Homo sapien
tgcctcccaatccaagctaggatgt

SEQ ID NO: 27173 - DNA, 25 bp, Homo sapien
tccacccatagataaacttcaccct

SEQ ID NO: 27174 - DNA, 25 bp, Homo sapien
ttcaccctacaagtttaatcccaga

SEQ ID NO: 27175 - DNA, 25 bp, Homo sapien
caagtttaatcccagaaccactcag

SEQ ID NO: 27176 - DNA, 25 bp, Homo sapien
gtcaaacctcatgaatacctttctc

SEQ ID NO: 27177 - DNA, 25 bp, Homo sapien
ctcatgaatacctttctctaatttc

SEQ ID NO: 27178 - DNA, 25 bp, Homo sapien
gaaactgctaagactctattaaggt

SEQ ID NO: 27179 - DNA, 25 bp, Homo sapien
gtagcattctaccttttagtaattc

SEQ ID NO: 27180 - DNA, 25 bp, Homo sapien
acaatctaacaactgtagcccttca

SEQ ID NO: 27181 - DNA, 25 bp, Homo sapien
aacaactgtagcccttcatgactgg

SEQ ID NO: 27182 - DNA, 25 bp, Homo sapien
cacatcttcccagtcagactttgga

SEQ ID NO: 27183 - DNA, 25 bp, Homo sapien
gtcagactttggaacagggccttga

SEQ ID NO: 27184 - DNA, 25 bp, Homo sapien
cagggccttgatgttttagaaatta

SEQ ID NO: 27185 - DNA, 25 bp, Homo sapien
tcatatatttgtgtcccgatacctc

SEQ ID NO: 27186 - DNA, 25 bp, Homo sapien
gtcccgatacctctataatctcaac

SEQ ID NO: 27187 - DNA, 25 bp, Homo sapien
cgatacctctataatctcaacaatc

SEQ ID NO: 27188 - DNA, 25 bp, Homo sapien
tcggcatattgctaattcaattcga

SEQ ID NO: 27189 - DNA, 25 bp, Homo sapien
ttcaattcgaacacatggcacggga

SEQ ID NO: 27190 - DNA, 25 bp, Homo sapien
atggcacgggaattatgaatacaac

SEQ ID NO: 27191 - DNA, 25 bp, Homo sapien
tagtagaggcagggtttccccacat

SEQ ID NO: 27192 - DNA, 25 bp, Homo sapien
cccacattggccaggctggtgtcga

SEQ ID NO: 27193 - DNA, 25 bp, Homo sapien
cctcggcctctcaaagggctgggat

SEQ ID NO: 27194 - DNA, 25 bp, Homo sapien
tgcacccggcccatttatggtaaat

SEQ ID NO: 27195 - DNA, 25 bp, Homo sapien
aaaaactcaagaactctcaggtata

SEQ ID NO: 27196 - DNA, 25 bp, Homo sapien
tataagcaggtaattctcaaaagaa

SEQ ID NO: 27197 - DNA, 25 bp, Homo sapien
aatgtttcactacacaatttacaat

SEQ ID NO: 27198 - DNA, 25 bp, Homo sapien
gagaaacttttctccccatcaaaat

SEQ ID NO: 27199 - DNA, 25 bp, Homo sapien
cttttctccccatcaaaatagcaaa

SEQ ID NO: 27200 - DNA, 25 bp, Homo sapien
gaaacagtagtctcatatatcattt

SEQ ID NO: 27201 - DNA, 25 bp, Homo sapien
gaaggcaatttggggatatttatct

SEQ ID NO: 27202 - DNA, 25 bp, Homo sapien
tctcactggcatccagagaccttcc

SEQ ID NO: 27203 - DNA, 25 bp, Homo sapien
gcctctttctctcgagatataaaca

SEQ ID NO: 27204 - DNA, 25 bp, Homo sapien
tgcctgacttgttctcacgggcatg

SEQ ID NO: 27205 - DNA, 25 bp, Homo sapien
tacgctcctctcaagagcacacttt

SEQ ID NO: 27206 - DNA, 25 bp, Homo sapien
gctcctctcaagagcacactttcgc

SEQ ID NO: 27207 - DNA, 25 bp, Homo sapien
ctcaagagcacactttcgctttgca

SEQ ID NO: 27208 - DNA, 25 bp, Homo sapien
gagcacactttcgctttgcaatgga

SEQ ID NO: 27209 - DNA, 25 bp, Homo sapien
gcacactttcgctttgcaatggaag

SEQ ID NO: 27210 - DNA, 25 bp, Homo sapien
ttgcaatggaagcttctcgccttgc

SEQ ID NO: 27211 - DNA, 25 bp, Homo sapien
ccccctgaattcgttcttgtgatgc

SEQ ID NO: 27212 - DNA, 25 bp, Homo sapien
gaattcgttcttgtgatgctgtcaa

SEQ ID NO: 27213 - DNA, 25 bp, Homo sapien
gccggctcctgcaagtgcaaagagt

SEQ ID NO: 27214 - DNA, 25 bp, Homo sapien
caagaagagctgctgctcctgctgc

SEQ ID NO: 27215 - DNA, 25 bp, Homo sapien
caagtgtgcccagggctgcatctgc

SEQ ID NO: 27216 - DNA, 25 bp, Homo sapien
gctgcatctgcaaaggggcgttgga

SEQ ID NO: 27217 - DNA, 25 bp, Homo sapien
ccaactgcctgactgcttgttggcc

SEQ ID NO: 27218 - DNA, 25 bp, Homo sapien
gaagtgcaactgctatgcctgacgt

SEQ ID NO: 27219 - DNA, 25 bp, Homo sapien
caactgctatgcctgacgtggggac

SEQ ID NO: 27220 - DNA, 25 bp, Homo sapien
gacagctctgctcccagatgtaaat

SEQ ID NO: 27221 - DNA, 25 bp, Homo sapien
gtaacctgcacaaacctggattttt

SEQ ID NO: 27222 - DNA, 25 bp, Homo sapien
acaacactgagccatttgcttcatt

SEQ ID NO: 27223 - DNA, 25 bp, Homo sapien
tctcctttgctcgaaatggacccca

SEQ ID NO: 27224 - DNA, 25 bp, Homo sapien
ggggcagtctggtacggaacatatt

SEQ ID NO: 27225 - DNA, 25 bp, Homo sapien
ggaacatatttattgcctccatgca

SEQ ID NO: 27226 - DNA, 25 bp, Homo sapien
gcctccatgcatgtgtgtgtgtgtc

SEQ ID NO: 27227 - DNA, 25 bp, Homo sapien
tggtgaggactggtgtgcgtggaca

SEQ ID NO: 27228 - DNA, 25 bp, Homo sapien
gtgtggggctctttcagggaccaca

SEQ ID NO: 27229 - DNA, 25 bp, Homo sapien
ggagggagcagtttgcagtgcccag

SEQ ID NO: 27230 - DNA, 25 bp, Homo sapien
gccaccctgaaatccccaataatgg

SEQ ID NO: 27231 - DNA, 25 bp, Homo sapien
atatgcacaggttcttggactgatt

SEQ ID NO: 27232 - DNA, 25 bp, Homo sapien
tacccaattcgccctatagtgagtc

SEQ ID NO: 27233 - DNA, 25 bp, Homo sapien
ttggaccagcggttgtgaccatctt

SEQ ID NO: 27234 - DNA, 25 bp, Homo sapien
ccatctttcctgagcaccaagggct

SEQ ID NO: 27235 - DNA, 25 bp, Homo sapien
agctcacctgcactctgagcagtgg

SEQ ID NO: 27236 - DNA, 25 bp, Homo sapien
acctgcactctgagcagtgggcaca

SEQ ID NO: 27237 - DNA, 25 bp, Homo sapien
tgcactctgagcagtgggcacagta

SEQ ID NO: 27238 - DNA, 25 bp, Homo sapien
tgggcacagtagctacatcatcgca

SEQ ID NO: 27239 - DNA, 25 bp, Homo sapien
gtagctacatcatcgcatggcatca

SEQ ID NO: 27240 - DNA, 25 bp, Homo sapien
gctacatcatcgcatggcatcagca

SEQ ID NO: 27241 - DNA, 25 bp, Homo sapien
catcatcgcatggcatcagcagcag

SEQ ID NO: 27242 - DNA, 25 bp, Homo sapien
ggaagctacaacaaggggagcggag

SEQ ID NO: 27243 - DNA, 25 bp, Homo sapien
aggggagcggagttcctgatcgctt

SEQ ID NO: 27244 - DNA, 25 bp, Homo sapien
tgattattactgtgagacctgggac

SEQ ID NO: 27245 - DNA, 25 bp, Homo sapien
tactgtgagacctgggacagtaaca

SEQ ID NO: 27246 - DNA, 25 bp, Homo sapien
taaatccaattgctgttatcttttg

SEQ ID NO: 27247 - DNA, 25 bp, Homo sapien
gtttttcatggaatatctcgcatct

SEQ ID NO: 27248 - DNA, 25 bp, Homo sapien
ggaatatctcgcatctcagaacaca

SEQ ID NO: 27249 - DNA, 25 bp, Homo sapien
tcgcatctcagaacacagtttggga

SEQ ID NO: 27250 - DNA, 25 bp, Homo sapien
tttagtgttttcagatgctatctat

SEQ ID NO: 27251 - DNA, 25 bp, Homo sapien
atatttcacatttagccattcgttt

SEQ ID NO: 27252 - DNA, 25 bp, Homo sapien
ttcacatttagccattcgttttata

SEQ ID NO: 27253 - DNA, 25 bp, Homo sapien
taaaaaactccaggcaaactcagct

SEQ ID NO: 27254 - DNA, 25 bp, Homo sapien
aggcaaactcagctggacttttctt

SEQ ID NO: 27255 - DNA, 25 bp, Homo sapien
tcagctggacttttcttgctttaat

SEQ ID NO: 27256 - DNA, 25 bp, Homo sapien
ttcacatatcacgaaattcttttta

SEQ ID NO: 27257 - DNA, 25 bp, Homo sapien
cgtctacatgggtgactccgatgtc

SEQ ID NO: 27258 - DNA, 25 bp, Homo sapien
acatgggtgactccgatgtctacac

SEQ ID NO: 27259 - DNA, 25 bp, Homo sapien
tgggtgactccgatgtctacaccgt

SEQ ID NO: 27260 - DNA, 25 bp, Homo sapien
tgtctacaccgtgcaccatatggtg

SEQ ID NO: 27261 - DNA, 25 bp, Homo sapien
gcacgtggaggatggaggtccggcc

SEQ ID NO: 27262 - DNA, 25 bp, Homo sapien
cgtggaggatggaggtccggccagt

SEQ ID NO: 27263 - DNA, 25 bp, Homo sapien
cagggcttcgtcaaggtgacctcat

SEQ ID NO: 27264 - DNA, 25 bp, Homo sapien
tcgtcaaggtgacctcatcacccat

SEQ ID NO: 27265 - DNA, 25 bp, Homo sapien
caaggtgacctcatcacccatgtca

SEQ ID NO: 27266 - DNA, 25 bp, Homo sapien
tgacctcatcacccatgtcaatggg

SEQ ID NO: 27267 - DNA, 25 bp, Homo sapien
atgtcaatggggaacctgtgcatgg

SEQ ID NO: 27268 - DNA, 25 bp, Homo sapien
actctttggtgaactatagggtatt

SEQ ID NO: 27269 - DNA, 25 bp, Homo sapien
agactgggacaacaaatctgtattt

SEQ ID NO: 27270 - DNA, 25 bp, Homo sapien
aaagcatgaggttcaggttttgact

SEQ ID NO: 27271 - DNA, 25 bp, Homo sapien
caggttttgactgtactgcttgctg

SEQ ID NO: 27272 - DNA, 25 bp, Homo sapien
cttgctgcctgtgtcatcttaagta

SEQ ID NO: 27273 - DNA, 25 bp, Homo sapien
gtgtcatcttaagtaggtcacctac

SEQ ID NO: 27274 - DNA, 25 bp, Homo sapien
cctgcttcgagcctcagaggacatc

SEQ ID NO: 27275 - DNA, 25 bp, Homo sapien
gaggacatctgtcattggctaatgg

SEQ ID NO: 27276 - DNA, 25 bp, Homo sapien
aagaacaatgactaccacacgaggt

SEQ ID NO: 27277 - DNA, 25 bp, Homo sapien
accacacgaggttttgtgagccctg

SEQ ID NO: 27278 - DNA, 25 bp, Homo sapien
ttttgtgagccctgaaatatttcca

SEQ ID NO: 27279 - DNA, 25 bp, Homo sapien
tgtggtggcatgtgcctatagttcc

SEQ ID NO: 27280 - DNA, 25 bp, Homo sapien
ggattagttgagcccagaagttcga

SEQ ID NO: 27281 - DNA, 25 bp, Homo sapien
tgacatagtgagaccctgccttaaa

SEQ ID NO: 27282 - DNA, 25 bp, Homo sapien
agagggtaagcatcatgacatctcc

SEQ ID NO: 27283 - DNA, 25 bp, Homo sapien
atctccttaccctgattaatctcaa

SEQ ID NO: 27284 - DNA, 25 bp, Homo sapien
accctgattaatctcaaactgttca

SEQ ID NO: 27285 - DNA, 25 bp, Homo sapien
atatatacacacatccgcatacctt

SEQ ID NO: 27286 - DNA, 25 bp, Homo sapien
cgcataccttcgcatacacatatac

SEQ ID NO: 27287 - DNA, 25 bp, Homo sapien
agcaaatgcaggctgggcacggttg

SEQ ID NO: 27288 - DNA, 25 bp, Homo sapien
ttagctggatgtagtggcgggcgcc

SEQ ID NO: 27289 - DNA, 25 bp, Homo sapien
gttgcagtgaacggagatggcgcca

SEQ ID NO: 27290 - DNA, 25 bp, Homo sapien
ggcacccggccttaagagaaattct

SEQ ID NO: 27291 - DNA, 25 bp, Homo sapien
gagaaattcttaatcagtccttagt

SEQ ID NO: 27292 - DNA, 25 bp, Homo sapien
atcagtccttagtgggtacttttca

SEQ ID NO: 27293 - DNA, 25 bp, Homo sapien
gtacttttcagtcccgagatggtta

SEQ ID NO: 27294 - DNA, 25 bp, Homo sapien
ggatgtttagaggccagagggatgg

SEQ ID NO: 27295 - DNA, 25 bp, Homo sapien
aggtgacctgaagagataagccgaa

SEQ ID NO: 27296 - DNA, 25 bp, Homo sapien
gagataagccgaattcctacaaaga

SEQ ID NO: 27297 - DNA, 25 bp, Homo sapien
attcctacaaagaactacttgcaca

SEQ ID NO: 27298 - DNA, 25 bp, Homo sapien
ctacttgcacagacaccaaagccaa

SEQ ID NO: 27299 - DNA, 25 bp, Homo sapien
caaagccaaaaatatctggccttta

SEQ ID NO: 27300 - DNA, 25 bp, Homo sapien
agaaaaagtttgctgccgggcacgg

SEQ ID NO: 27301 - DNA, 25 bp, Homo sapien
tccatctgccaccgtggcactggta

SEQ ID NO: 27302 - DNA, 25 bp, Homo sapien
ctgccaccgtggcactggtattgct

SEQ ID NO: 27303 - DNA, 25 bp, Homo sapien
accgtggcactggtattgctttgag

SEQ ID NO: 27304 - DNA, 25 bp, Homo sapien
actggtattgctttgagtgcagggg

SEQ ID NO: 27305 - DNA, 25 bp, Homo sapien
gttactccctgggaactttgagtct

SEQ ID NO: 27306 - DNA, 25 bp, Homo sapien
ctccctgggaactttgagtcttatt

SEQ ID NO: 27307 - DNA, 25 bp, Homo sapien
tgggaactttgagtcttatttggaa

SEQ ID NO: 27308 - DNA, 25 bp, Homo sapien
ccagcactgatccacacagctaagt

SEQ ID NO: 27309 - DNA, 25 bp, Homo sapien
tgatccacacagctaagtttgcact

SEQ ID NO: 27310 - DNA, 25 bp, Homo sapien
gacacttgatgtgggacctaggaaa

SEQ ID NO: 27311 - DNA, 25 bp, Homo sapien
gtgggacctaggaaaaggcctgaag

SEQ ID NO: 27312 - DNA, 25 bp, Homo sapien
gcaaaaagatagcaatggcccattt

SEQ ID NO: 27313 - DNA, 25 bp, Homo sapien
gcaatggcccatttgggaaaaacac

SEQ ID NO: 27314 - DNA, 25 bp, Homo sapien
aagttcttgcttatattactgggaa

SEQ ID NO: 27315 - DNA, 25 bp, Homo sapien
aaaagaggtcctgatcagatcccaa

SEQ ID NO: 27316 - DNA, 25 bp, Homo sapien
agagttcttggatctcatacaggaa

SEQ ID NO: 27317 - DNA, 25 bp, Homo sapien
aggaaggaattcaagacgagtcgga

SEQ ID NO: 27318 - DNA, 25 bp, Homo sapien
gacgagtcggaaagtacagtgcaaa

SEQ ID NO: 27319 - DNA, 25 bp, Homo sapien
ggccagcatgatggcttgggcctgt

SEQ ID NO: 27320 - DNA, 25 bp, Homo sapien
gcatgatggcttgggcctgtggtct

SEQ ID NO: 27321 - DNA, 25 bp, Homo sapien
tgggcctgtggtctaagcactttgg

SEQ ID NO: 27322 - DNA, 25 bp, Homo sapien
gaggctggatgggacagtcgcttga

SEQ ID NO: 27323 - DNA, 25 bp, Homo sapien
ggctgtacaattgatgtggttctta

SEQ ID NO: 27324 - DNA, 25 bp, Homo sapien
ggttcttacaccagatgtcaagcat

SEQ ID NO: 27325 - DNA, 25 bp, Homo sapien
ggatgagttaactgacccaaagtcc

SEQ ID NO: 27326 - DNA, 25 bp, Homo sapien
tgtgaagtaccttggtgtctctcaa

SEQ ID NO: 27327 - DNA, 25 bp, Homo sapien
ggtgtctctcaaattggtagtgatg

SEQ ID NO: 27328 - DNA, 25 bp, Homo sapien
gtgatgggggtcaactcacactttg

SEQ ID NO: 27329 - DNA, 25 bp, Homo sapien
cacactttgcatcaggaaacttcgg

SEQ ID NO: 27330 - DNA, 25 bp, Homo sapien
aaaaagggtccctgatttgtgtgct

SEQ ID NO: 27331 - DNA, 25 bp, Homo sapien
gtgtgctggtatgttggaatgtgtc

SEQ ID NO: 27332 - DNA, 25 bp, Homo sapien
caggcactgtgcaagacactgggga

SEQ ID NO: 27333 - DNA, 25 bp, Homo sapien
aatgagacacatggaccaggcacag

SEQ ID NO: 27334 - DNA, 25 bp, Homo sapien
ctcctccagggccatggttgtgaag

SEQ ID NO: 27335 - DNA, 25 bp, Homo sapien
tcctccagggccatggttgtgaaga

SEQ ID NO: 27336 - DNA, 25 bp, Homo sapien
cctccagggccatggttgtgaagaa

SEQ ID NO: 27337 - DNA, 25 bp, Homo sapien
ctccagggccatggttgtgaagaag

SEQ ID NO: 27338 - DNA, 25 bp, Homo sapien
ccagggccatggttgtgaagaagat

SEQ ID NO: 27339 - DNA, 25 bp, Homo sapien
cagggccatggttgtgaagaagatt

SEQ ID NO: 27340 - DNA, 25 bp, Homo sapien
gggccatggttgtgaagaagattga

SEQ ID NO: 27341 - DNA, 25 bp, Homo sapien
ggccatggttgtgaagaagattgaa

SEQ ID NO: 27342 - DNA, 25 bp, Homo sapien
aagaagattgaaacccgtgatggga

SEQ ID NO: 27343 - DNA, 25 bp, Homo sapien
gattgaaacccgtgatgggaagctg

SEQ ID NO: 27344 - DNA, 25 bp, Homo sapien
tgaaacccgtgatgggaagctggtg

SEQ ID NO: 27345 - DNA, 25 bp, Homo sapien
aggccctgcgtgtggatggtgacac

SEQ ID NO: 27346 - DNA, 25 bp, Homo sapien
ggccctgcgttgtggatggtgacac

SEQ ID NO: 27347 - DNA, 25 bp, Homo sapien
gtggaatgtcatccttacttcaacc

SEQ ID NO: 27348 - DNA, 25 bp, Homo sapien
tctggttgcctatagtgctctggga

SEQ ID NO: 27349 - DNA, 25 bp, Homo sapien
tctgggatccctccgagaagaacca

SEQ ID NO: 27350 - DNA, 25 bp, Homo sapien
cttggaggacccagtcctttgtgcc

SEQ ID NO: 27351 - DNA, 25 bp, Homo sapien
gctaccagctacagcgtggggttgt

SEQ ID NO: 27352 - DNA, 25 bp, Homo sapien
tgtggtcctggccaagagctacaat

SEQ ID NO: 27353 - DNA, 25 bp, Homo sapien
tgacccttgatatttttgctggccc

SEQ ID NO: 27354 - DNA, 25 bp, Homo sapien
ccccctaattatccgatctctgatg

SEQ ID NO: 27355 - DNA, 25 bp, Homo sapien
gcatgaggtctgccagaaggccctg

SEQ ID NO: 27356 - DNA, 25 bp, Homo sapien
tgggccagaccgctaggagcggccc

SEQ ID NO: 27357 - DNA, 25 bp, Homo sapien
taccgcacagtagtgccctggaaaa

SEQ ID NO: 27358 - DNA, 25 bp, Homo sapien
acagtagtgccctggaaaacgaaca

SEQ ID NO: 27359 - DNA, 25 bp, Homo sapien
aaacgaacatgagcctgtgcttccc

SEQ ID NO: 27360 - DNA, 25 bp, Homo sapien
ggccttccatctaatcttcgaggct

SEQ ID NO: 27361 - DNA, 25 bp, Homo sapien
tctaatcttcgaggctgtcacgggc

SEQ ID NO: 27362 - DNA, 25 bp, Homo sapien
gtggccagctactcggacatagggc

SEQ ID NO: 27363 - DNA, 25 bp, Homo sapien
tactcggacatagggcgtcggctac

SEQ ID NO: 27364 - DNA, 25 bp, Homo sapien
gacatagggcgtcggctacaggccc

SEQ ID NO: 27365 - DNA, 25 bp, Homo sapien
ttagggctcgtggggaagcggctga

SEQ ID NO: 27366 - DNA, 25 bp, Homo sapien
ggctcgtggggaagcggctgagcct

SEQ ID NO: 27367 - DNA, 25 bp, Homo sapien
ttcctaaatggtcttccttttccat

SEQ ID NO: 27368 - DNA, 25 bp, Homo sapien
tctgcttttaatttagcgagctctt

SEQ ID NO: 27369 - DNA, 25 bp, Homo sapien
gcgagctcttctcatgtgtttatca

SEQ ID NO: 27370 - DNA, 25 bp, Homo sapien
gagggcagtttgcttactggttaag

SEQ ID NO: 27371 - DNA, 25 bp, Homo sapien
aaggatgcaggctttagggctggaa

SEQ ID NO: 27372 - DNA, 25 bp, Homo sapien
tagggctggaagcacctggtttcaa

SEQ ID NO: 27373 - DNA, 25 bp, Homo sapien
agcacctggtttcaaagcctggctc

SEQ ID NO: 27374 - DNA, 25 bp, Homo sapien
ctcttatcagctgcgtaacctttgg

SEQ ID NO: 27375 - DNA, 25 bp, Homo sapien
gctgcgtaacctttggacaagttgc

SEQ ID NO: 27376 - DNA, 25 bp, Homo sapien
gttgctttattgctctaagtttcag

SEQ ID NO: 27377 - DNA, 25 bp, Homo sapien
ctcctgtgtcaactctagaggactg

SEQ ID NO: 27378 - DNA, 25 bp, Homo sapien
cggagagattaactctgttggctga

SEQ ID NO: 27379 - DNA, 25 bp, Homo sapien
tgttggctgaagccctatcccaatt

SEQ ID NO: 27380 - DNA, 25 bp, Homo sapien
cctatcccaattccttggctagacc

SEQ ID NO: 27381 - DNA, 25 bp, Homo sapien
cccaattccttggctagaccctggg

SEQ ID NO: 27382 - DNA, 25 bp, Homo sapien
tagaccctgggtccttcatgttaga

SEQ ID NO: 27383 - DNA, 25 bp, Homo sapien
tgggtccttcatgttagaaaacctg

SEQ ID NO: 27384 - DNA, 25 bp, Homo sapien
tatattatcttattttactatttga

SEQ ID NO: 27385 - DNA, 25 bp, Homo sapien
tatatttttccatacttcctcatac

SEQ ID NO: 27386 - DNA, 25 bp, Homo sapien
taataataaaacagacttcacctcg

SEQ ID NO: 27387 - DNA, 25 bp, Homo sapien
tgcagaactgggaccccaatgacca

SEQ ID NO: 27388 - DNA, 25 bp, Homo sapien
gactcccagcttccacggagagatt

SEQ ID NO: 27389 - DNA, 25 bp, Homo sapien
tttccgttttcttggacatcaggat

SEQ ID NO: 27390 - DNA, 25 bp, Homo sapien
atcaggattctcttgcaggcatttt

SEQ ID NO: 27391 - DNA, 25 bp, Homo sapien
attttggcaagcatggtcttcagct

SEQ ID NO: 27392 - DNA, 25 bp, Homo sapien
ggtcttcagctctgtcacagcaata

SEQ ID NO: 27393 - DNA, 25 bp, Homo sapien
acccatcaacctgtcatctacatta

SEQ ID NO: 27394 - DNA, 25 bp, Homo sapien
aggtatttctcctaatgctatccct

SEQ ID NO: 27395 - DNA, 25 bp, Homo sapien
tgacaggccctggtgtgtgatgttc

SEQ ID NO: 27396 - DNA, 25 bp, Homo sapien
atgtgttctcatagttcaactccca

SEQ ID NO: 27397 - DNA, 25 bp, Homo sapien
tgatggtttccagcttcatccatgt

SEQ ID NO: 27398 - DNA, 25 bp, Homo sapien
gaactcatccttttttatggctgca

SEQ ID NO: 27399 - DNA, 25 bp, Homo sapien
gatgtgccacattttctttattcag

SEQ ID NO: 27400 - DNA, 25 bp, Homo sapien
tatcttcaacacttatgtgcacagt

SEQ ID NO: 27401 - DNA, 25 bp, Homo sapien
gctgatctccatcgggggagccaag

SEQ ID NO: 27402 - DNA, 25 bp, Homo sapien
cgagtgctggggattcaccacatct

SEQ ID NO: 27403 - DNA, 25 bp, Homo sapien
ctccatcttcagcttgctgggtctg

SEQ ID NO: 27404 - DNA, 25 bp, Homo sapien
gctgggtctgcttggagagatcacc

SEQ ID NO: 27405 - DNA, 25 bp, Homo sapien
gagatcacctacattgtgctgctgg

SEQ ID NO: 27406 - DNA, 25 bp, Homo sapien
ggtgcttcatactgtctggaacggc

SEQ ID NO: 27407 - DNA, 25 bp, Homo sapien
gaacggcaatggcatgtttgctcct

SEQ ID NO: 27408 - DNA, 25 bp, Homo sapien
ggaagtttcctcatttggctgttgg

SEQ ID NO: 27409 - DNA, 25 bp, Homo sapien
aaacaagacaacttcctctcactgt

SEQ ID NO: 27410 - DNA, 25 bp, Homo sapien
ctcactgttgcctgcatttgtacgt

SEQ ID NO: 27411 - DNA, 25 bp, Homo sapien
agtagctatggcatgcactgggtcc

SEQ ID NO: 27412 - DNA, 25 bp, Homo sapien
gccaggctccaggcaaggggctgga

SEQ ID NO: 27413 - DNA, 25 bp, Homo sapien
caggtgcagctggtggagtctgggg

SEQ ID NO: 27414 - DNA, 25 bp, Homo sapien
aggcaaggggctggagtgggtggca

SEQ ID NO: 27415 - DNA, 25 bp, Homo sapien
aaggggctggagtgggtggcagtta

SEQ ID NO: 27416 - DNA, 25 bp, Homo sapien
gggctggagtgggtggcagttatat

SEQ ID NO: 27417 - DNA, 25 bp, Homo sapien
gcagctggtggagtctgggggaggc

SEQ ID NO: 27418 - DNA, 25 bp, Homo sapien
tggagtctgggggaggcgtggtcca

SEQ ID NO: 27419 - DNA, 25 bp, Homo sapien
cctctggattcaccttcagtagcta

SEQ ID NO: 27420 - DNA, 25 bp, Homo sapien
gattcaccttcagtagctatggcat

SEQ ID NO: 27421 - DNA, 25 bp, Homo sapien
caccttcagtagctatggcatgcac

SEQ ID NO: 27422 - DNA, 25 bp, Homo sapien
gttataaccttatcaaccgtgccag

SEQ ID NO: 27423 - DNA, 25 bp, Homo sapien
accgtgccaggtaggaccatattgc

SEQ ID NO: 27424 - DNA, 25 bp, Homo sapien
agtcccactcagtcatagcagttta

SEQ ID NO: 27425 - DNA, 25 bp, Homo sapien
ttatctagtccatcaccacatcaga

SEQ ID NO: 27426 - DNA, 25 bp, Homo sapien
cgaggccactcaggtttgcaggctg

SEQ ID NO: 27427 - DNA, 25 bp, Homo sapien
caggtttgcaggctgccattcgacc

SEQ ID NO: 27428 - DNA, 25 bp, Homo sapien
gccattcgaccttgtcaagttccaa

SEQ ID NO: 27429 - DNA, 25 bp, Homo sapien
aaaagcagaggcggccttggcgtca

SEQ ID NO: 27430 - DNA, 25 bp, Homo sapien
tagttgagctgagacgatgccctcc

SEQ ID NO: 27431 - DNA, 25 bp, Homo sapien
tccacgccgctcttaaggtagtact

SEQ ID NO: 27432 - DNA, 25 bp, Homo sapien
accagggaggcggcggttgtggtga

SEQ ID NO: 27433 - DNA, 25 bp, Homo sapien
gtctgaaaatttttaccacagggat

SEQ ID NO: 27434 - DNA, 25 bp, Homo sapien
gtggtacatggacgtattcctcaac

SEQ ID NO: 27435 - DNA, 25 bp, Homo sapien
attcctcaacttttgcaattcagca

SEQ ID NO: 27436 - DNA, 25 bp, Homo sapien
cagcatggttggtgagtctttggat

SEQ ID NO: 27437 - DNA, 25 bp, Homo sapien
gtctttggattacatgtggctcaag

SEQ ID NO: 27438 - DNA, 25 bp, Homo sapien
ggctcaagatgggtgtttctcactg

SEQ ID NO: 27439 - DNA, 25 bp, Homo sapien
gaggtatgaacagactccagtttct

SEQ ID NO: 27440 - DNA, 25 bp, Homo sapien
gattggaggtggtttagggcttttg

SEQ ID NO: 27441 - DNA, 25 bp, Homo sapien
cttttgctctgctacatgatactgc

SEQ ID NO: 27442 - DNA, 25 bp, Homo sapien
atgatactgctctaagcactcctgg

SEQ ID NO: 27443 - DNA, 25 bp, Homo sapien
aagcactcctggatgtgtcttattt

SEQ ID NO: 27444 - DNA, 25 bp, Homo sapien
tagtcccagccacacgggaggctgc

SEQ ID NO: 27445 - DNA, 25 bp, Homo sapien
cccagccacacgggaggctgcggca

SEQ ID NO: 27446 - DNA, 25 bp, Homo sapien
aggctgcggcaggaaaatggcgtga

SEQ ID NO: 27447 - DNA, 25 bp, Homo sapien
gcggcaggaaaatggcgtgaacccg

SEQ ID NO: 27448 - DNA, 25 bp, Homo sapien
gagcttgcagtgagcggagatggcg

SEQ ID NO: 27449 - DNA, 25 bp, Homo sapien
gcagtgagcggagatggcgccactg

SEQ ID NO: 27450 - DNA, 25 bp, Homo sapien
aattagccgtgcgtggtggcacgca

SEQ ID NO: 27451 - DNA, 25 bp, Homo sapien
tgcgtggtggcacgcacctgtaatc

SEQ ID NO: 27452 - DNA, 25 bp, Homo sapien
ggcgacagagcgagatttcatctcg

SEQ ID NO: 27453 - DNA, 25 bp, Homo sapien
gcgagatttcatctcgccgtgggcg

SEQ ID NO: 27454 - DNA, 25 bp, Homo sapien
atttcatctcgccgtgggcggcgac

SEQ ID NO: 27455 - DNA, 25 bp, Homo sapien
attggctggggatgatggcgagtgc

SEQ ID NO: 27456 - DNA, 25 bp, Homo sapien
agctcgacgggggaggattgcctga

SEQ ID NO: 27457 - DNA, 25 bp, Homo sapien
acaaaataacggcagggtgcggtgg

SEQ ID NO: 27458 - DNA, 25 bp, Homo sapien
aaacacaaaatattggccgggcatg

SEQ ID NO: 27459 - DNA, 25 bp, Homo sapien
aggaggtggagcatgcattgggccg

SEQ ID NO: 27460 - DNA, 25 bp, Homo sapien
tggagcatgcattgggccgagatcg

SEQ ID NO: 27461 - DNA, 25 bp, Homo sapien
cagaaaagccttgaatgcctcaccc

SEQ ID NO: 27462 - DNA, 25 bp, Homo sapien
tcacccaggcgcctagatttggagc

SEQ ID NO: 27463 - DNA, 25 bp, Homo sapien
gagcagggagcgctgaggggttctg

SEQ ID NO: 27464 - DNA, 25 bp, Homo sapien
gggttctgagaagccgcattctagg

SEQ ID NO: 27465 - DNA, 25 bp, Homo sapien
gaagccgcattctagggaatcagaa

SEQ ID NO: 27466 - DNA, 25 bp, Homo sapien
gggctactgattaaggctatctaca

SEQ ID NO: 27467 - DNA, 25 bp, Homo sapien
gaatacgtcagaaaacctaatcact

SEQ ID NO: 27468 - DNA, 25 bp, Homo sapien
acctaatcactgtctttcaaactgg

SEQ ID NO: 27469 - DNA, 25 bp, Homo sapien
caaactggattccttagggtgctag

SEQ ID NO: 27470 - DNA, 25 bp, Homo sapien
gattccttagggtgctagggcttcc

SEQ ID NO: 27471 - DNA, 25 bp, Homo sapien
ctagggcttcctcggggtagataga

SEQ ID NO: 27472 - DNA, 25 bp, Homo sapien
tcctcggggtagatagagctgagca

SEQ ID NO: 27473 - DNA, 25 bp, Homo sapien
agctgagcaaacaggcgcaattctg

SEQ ID NO: 27474 - DNA, 25 bp, Homo sapien
acaggcgcaattctggggcactgtc

SEQ ID NO: 27475 - DNA, 25 bp, Homo sapien
tagtaagacctgatttcctaaaaag

SEQ ID NO: 27476 - DNA, 25 bp, Homo sapien
gaaggaggtagttatcatctttaaa

SEQ ID NO: 27477 - DNA, 25 bp, Homo sapien
aaactgtctgggactgggaacttat

SEQ ID NO: 27478 - DNA, 25 bp, Homo sapien
gatatcgttcataaactttcctatt

SEQ ID NO: 27479 - DNA, 25 bp, Homo sapien
gagcagcaagactgaaactgttgag

SEQ ID NO: 27480 - DNA, 25 bp, Homo sapien
gaaactgttgaggagcccatggagg

SEQ ID NO: 27481 - DNA, 25 bp, Homo sapien
aactgtctgggactgggaacttatg

SEQ ID NO: 27482 - DNA, 25 bp, Homo sapien
atatcgttcataaactttcctattt

SEQ ID NO: 27483 - DNA, 25 bp, Homo sapien
ggagcagcaagactgaaactgttga

SEQ ID NO: 27484 - DNA, 25 bp, Homo sapien
aactgttgaggagcccatggaggaa

SEQ ID NO: 27485 - DNA, 25 bp, Homo sapien
actgtctgggactgggaacttatga

SEQ ID NO: 27486 - DNA, 25 bp, Homo sapien
aatgatatcgttcataaactttcct

SEQ ID NO: 27487 - DNA, 25 bp, Homo sapien
aaactgttgaggagcccatggagga

SEQ ID NO: 27488 - DNA, 25 bp, Homo sapien
cattttctctaactttatctcctat

SEQ ID NO: 27489 - DNA, 25 bp, Homo sapien
tttctctaactttatctcctatgca

SEQ ID NO: 27490 - DNA, 25 bp, Homo sapien
ttatctcctatgcatttccttatgt

SEQ ID NO: 27491 - DNA, 25 bp, Homo sapien
tgcatttccttatgtgtcctgtaca

SEQ ID NO: 27492 - DNA, 25 bp, Homo sapien
gtgtcctgtacagcagtatattcca

SEQ ID NO: 27493 - DNA, 25 bp, Homo sapien
gaaaaccacatatagtaccaaactg

SEQ ID NO: 27494 - DNA, 25 bp, Homo sapien
gtaccaaactgtatatatgctatgt

SEQ ID NO: 27495 - DNA, 25 bp, Homo sapien
tgttttgtttcatacatacctataa

SEQ ID NO: 27496 - DNA, 25 bp, Homo sapien
ggcacaataagagataagcaggctg

SEQ ID NO: 27497 - DNA, 25 bp, Homo sapien
taagcaggctggacgtgctggctca

SEQ ID NO: 27498 - DNA, 25 bp, Homo sapien
aatgtggaaattaatcaggtgtggt

SEQ ID NO: 27499 - DNA, 25 bp, Homo sapien
gctccaggtgaatttagcagaccag

SEQ ID NO: 27500 - DNA, 25 bp, Homo sapien
agcagaccagaatagcacttcagca

SEQ ID NO: 27501 - DNA, 25 bp, Homo sapien
aattgtcattggaaccgtagcctcc

SEQ ID NO: 27502 - DNA, 25 bp, Homo sapien
gaacaggctgtacacgcgaaaccta

SEQ ID NO: 27503 - DNA, 25 bp, Homo sapien
agggtgacagcctgctcaaatagag

SEQ ID NO: 27504 - DNA, 25 bp, Homo sapien
tccaaaatgcccaggatactgcaga

SEQ ID NO: 27505 - DNA, 25 bp, Homo sapien
gcagaaaaattacccgtcacaccaa

SEQ ID NO: 27506 - DNA, 25 bp, Homo sapien
gtcacaccaagaacaccgaagatca

SEQ ID NO: 27507 - DNA, 25 bp, Homo sapien
gccgaggaggacggatcagatcacc

SEQ ID NO: 27508 - DNA, 25 bp, Homo sapien
tcaggagttgaagacgagcccgatc

SEQ ID NO: 27509 - DNA, 25 bp, Homo sapien
agacgagcccgatcaacatggagaa

SEQ ID NO: 27510 - DNA, 25 bp, Homo sapien
ttgtttttggaggcactttcactgt

SEQ ID NO: 27511 - DNA, 25 bp, Homo sapien
ttggaggcactttcactgtgttgcc

SEQ ID NO: 27512 - DNA, 25 bp, Homo sapien
aggcctgtctgttggcctcaagtga

SEQ ID NO: 27513 - DNA, 25 bp, Homo sapien
actgtgctcagcccattttttattt

SEQ ID NO: 27514 - DNA, 25 bp, Homo sapien
tgctcagcccattttttatttgttt

SEQ ID NO: 27515 - DNA, 25 bp, Homo sapien
gtttcttgaaggaaggtagcagtat

SEQ ID NO: 27516 - DNA, 25 bp, Homo sapien
ggaaggtagcagtattaattaattt

SEQ ID NO: 27517 - DNA, 25 bp, Homo sapien
attaattttggactttgctcactaa

SEQ ID NO: 27518 - DNA, 25 bp, Homo sapien
tggactttgctcactaaagtttgaa

SEQ ID NO: 27519 - DNA, 25 bp, Homo sapien
gaatagatgtatacagtctggatgc

SEQ ID NO: 27520 - DNA, 25 bp, Homo sapien
tgtatacagtctggatgcagtggtg

SEQ ID NO: 27521 - DNA, 25 bp, Homo sapien
gaaacagtgttgccatattctccaa

SEQ ID NO: 27522 - DNA, 25 bp, Homo sapien
ccaccattcctggccacagaatgct

SEQ ID NO: 27523 - DNA, 25 bp, Homo sapien
ccattcctggccacagaatgctaat

SEQ ID NO: 27524 - DNA, 25 bp, Homo sapien
taccaaaagagtatcaaggccagag

SEQ ID NO: 27525 - DNA, 25 bp, Homo sapien
ccagagtggtgggtggcacatgctt

SEQ ID NO: 27526 - DNA, 25 bp, Homo sapien
gagtggtgggtggcacatgcttata

SEQ ID NO: 27527 - DNA, 25 bp, Homo sapien
tggtgggtggcacatgcttataaca

SEQ ID NO: 27528 - DNA, 25 bp, Homo sapien
gtcctagctactcagtagtcttagg

SEQ ID NO: 27529 - DNA, 25 bp, Homo sapien
gctactcagtagtcttaggtgggaa

SEQ ID NO: 27530 - DNA, 25 bp, Homo sapien
gcagggagctgaattcgtgccagtg

SEQ ID NO: 27531 - DNA, 25 bp, Homo sapien
ggagctgaattcgtgccagtgcatt

SEQ ID NO: 27532 - DNA, 25 bp, Homo sapien
tcaggacgccacggtggactgaaca

SEQ ID NO: 27533 - DNA, 25 bp, Homo sapien
tggactgaacatgttgctgcctttc

SEQ ID NO: 27534 - DNA, 25 bp, Homo sapien
ttgctgcctttctggagggtagtgt

SEQ ID NO: 27535 - DNA, 25 bp, Homo sapien
tctggagggtagtgtgaccatcagc

SEQ ID NO: 27536 - DNA, 25 bp, Homo sapien
cacacacgcacatgacctttgattt

SEQ ID NO: 27537 - DNA, 25 bp, Homo sapien
gacctttgatttctagggatgcatc

SEQ ID NO: 27538 - DNA, 25 bp, Homo sapien
tctagggatgcatcccacacacacc

SEQ ID NO: 27539 - DNA, 25 bp, Homo sapien
gacctggcagccttgaaaaattgaa

SEQ ID NO: 27540 - DNA, 25 bp, Homo sapien
gaagccatagatcacaggcaccgct

SEQ ID NO: 27541 - DNA, 25 bp, Homo sapien
tagatcacaggcaccgctgtgctgt

SEQ ID NO: 27542 - DNA, 25 bp, Homo sapien
accgctgtgctgtcatcacagccct

SEQ ID NO: 27543 - DNA, 25 bp, Homo sapien
ccagatcgtcctgacctttgagtat

SEQ ID NO: 27544 - DNA, 25 bp, Homo sapien
agatcgtcctgacctttgagtatct

SEQ ID NO: 27545 - DNA, 25 bp, Homo sapien
actcgctggatctcatctacaggga

SEQ ID NO: 27546 - DNA, 25 bp, Homo sapien
tcgctggatctcatctacagggacc

SEQ ID NO: 27547 - DNA, 25 bp, Homo sapien
ccggagaatctgctcattgaccagc

SEQ ID NO: 27548 - DNA, 25 bp, Homo sapien
gctcattgaccagcagggctacatt

SEQ ID NO: 27549 - DNA, 25 bp, Homo sapien
agcagggctacattcaggtgacaga

SEQ ID NO: 27550 - DNA, 25 bp, Homo sapien
ggctacattcaggtgacagacttcg

SEQ ID NO: 27551 - DNA, 25 bp, Homo sapien
gcccctgagattatcctgagcaaag

SEQ ID NO: 27552 - DNA, 25 bp, Homo sapien
gccctgggggttcttatctatgaaa

SEQ ID NO: 27553 - DNA, 25 bp, Homo sapien
cttatctatgaaatggccgctggct

SEQ ID NO: 27554 - DNA, 25 bp, Homo sapien
attcagtgaagcatgtgtttggcag

SEQ ID NO: 27555 - DNA, 25 bp, Homo sapien
aagccaacaaggccacactggtgtg

SEQ ID NO: 27556 - DNA, 25 bp, Homo sapien
gcaacatgcaggttcctgctccagc

SEQ ID NO: 27557 - DNA, 25 bp, Homo sapien
caagtacatggccagcagctacctg

SEQ ID NO: 27558 - DNA, 25 bp, Homo sapien
aagctacagctgccaggtcatgcat

SEQ ID NO: 27559 - DNA, 25 bp, Homo sapien
ggtcatgcatgaagggagcactgca

SEQ ID NO: 27560 - DNA, 25 bp, Homo sapien
gagcactgcagagaagacggtggcc

SEQ ID NO: 27561 - DNA, 25 bp, Homo sapien
gtggcccctgcagaatgttcatagg

SEQ ID NO: 27562 - DNA, 25 bp, Homo sapien
ccacaggggcctggagctgcaggat

SEQ ID NO: 27563 - DNA, 25 bp, Homo sapien
gctgcaggatcccaggggaggcgtc

SEQ ID NO: 27564 - DNA, 25 bp, Homo sapien
gggggtttcaatccaagcataattc

SEQ ID NO: 27565 - DNA, 25 bp, Homo sapien
gtttctgttcaatatgtacctcacc

SEQ ID NO: 27566 - DNA, 25 bp, Homo sapien
tcaatatgtacctcaccagggaccg

SEQ ID NO: 27567 - DNA, 25 bp, Homo sapien
ctcaccagggaccgtaggcacgaag

SEQ ID NO: 27568 - DNA, 25 bp, Homo sapien
cagggaccgtaggcacgaagtggcc

SEQ ID NO: 27569 - DNA, 25 bp, Homo sapien
taggcacgaagtggccagactcctc

SEQ ID NO: 27570 - DNA, 25 bp, Homo sapien
ggccagactcctcaatctgagtgag

SEQ ID NO: 27571 - DNA, 25 bp, Homo sapien
gagacaagtcaaaatctggtttcag

SEQ ID NO: 27572 - DNA, 25 bp, Homo sapien
atctggtttcagaaccggcggatga

SEQ ID NO: 27573 - DNA, 25 bp, Homo sapien
cgctcgctcttcccggaaaaagcgc

SEQ ID NO: 27574 - DNA, 25 bp, Homo sapien
ctgtccctacaccaaataccagacg

SEQ ID NO: 27575 - DNA, 25 bp, Homo sapien
agacgctggagctagagaaggagtt

SEQ ID NO: 27576 - DNA, 25 bp, Homo sapien
tgtccaggtcacttaagcatgccat

SEQ ID NO: 27577 - DNA, 25 bp, Homo sapien
aggtcacttaagcatgccatgagga

SEQ ID NO: 27578 - DNA, 25 bp, Homo sapien
taagcatgccatgaggagttggatg

SEQ ID NO: 27579 - DNA, 25 bp, Homo sapien
gaggagttggatggcgtggcttgtc

SEQ ID NO: 27580 - DNA, 25 bp, Homo sapien
ttggatggcgtggcttgtcaggccc

SEQ ID NO: 27581 - DNA, 25 bp, Homo sapien
attaaattcctttactgtacatcat

SEQ ID NO: 27582 - DNA, 25 bp, Homo sapien
aattcctttactgtacatcatattg

SEQ ID NO: 27583 - DNA, 25 bp, Homo sapien
cctttactgtacatcatattgaatt

SEQ ID NO: 27584 - DNA, 25 bp, Homo sapien
agaatgtagacatctctgagttaaa

SEQ ID NO: 27585 - DNA, 25 bp, Homo sapien
gtgcttggatgctttaaacatatac

SEQ ID NO: 27586 - DNA, 25 bp, Homo sapien
ggatgctttaaacatatactcaaaa

SEQ ID NO: 27587 - DNA, 25 bp, Homo sapien
gtccccctggaaactatctttgaca

SEQ ID NO: 27588 - DNA, 25 bp, Homo sapien
actatctttgacattgacaatccga

SEQ ID NO: 27589 - DNA, 25 bp, Homo sapien
aaatttagcttgtgggccggacgcg

SEQ ID NO: 27590 - DNA, 25 bp, Homo sapien
ggacgcggtggttcacgtctgtaat

SEQ ID NO: 27591 - DNA, 25 bp, Homo sapien
gatcacctgaggtcgagagttccag

SEQ ID NO: 27592 - DNA, 25 bp, Homo sapien
ggtcgagagttccagaccagcctga

SEQ ID NO: 27593 - DNA, 25 bp, Homo sapien
tacctgggtcataaatgcactgctg

SEQ ID NO: 27594 - DNA, 25 bp, Homo sapien
tgcactgctgtccatttatttctga

SEQ ID NO: 27595 - DNA, 25 bp, Homo sapien
ctgaagtttattgcatagccatgga

SEQ ID NO: 27596 - DNA, 25 bp, Homo sapien
ctatttttctaaccacgtaagcagt

SEQ ID NO: 27597 - DNA, 25 bp, Homo sapien
aaccacgtaagcagtcagaattgat

SEQ ID NO: 27598 - DNA, 25 bp, Homo sapien
ggaccctctttctatttggtgtcac

SEQ ID NO: 27599 - DNA, 25 bp, Homo sapien
tacggaacccagtgagtgccagccg

SEQ ID NO: 27600 - DNA, 25 bp, Homo sapien
aggacctctaccattacattacatc

SEQ ID NO: 27601 - DNA, 25 bp, Homo sapien
gcatccctgctgatccagaatgtca

SEQ ID NO: 27602 - DNA, 25 bp, Homo sapien
gatcctacaccttacacatcgtaaa

SEQ ID NO: 27603 - DNA, 25 bp, Homo sapien
ttcaccttcaccttatacctggaga

SEQ ID NO: 27604 - DNA, 25 bp, Homo sapien
ctccatctccagcagcaacttatac

SEQ ID NO: 27605 - DNA, 25 bp, Homo sapien
ttaacctgtgatcctgagactccgg

SEQ ID NO: 27606 - DNA, 25 bp, Homo sapien
cggacgcaagctacctgtggtggat

SEQ ID NO: 27607 - DNA, 25 bp, Homo sapien
tgaatggtcagagcctccctatgac

SEQ ID NO: 27608 - DNA, 25 bp, Homo sapien
atgactcacagcttgcagttgtcca

SEQ ID NO: 27609 - DNA, 25 bp, Homo sapien
ccaccctctggatcccaatattgag

SEQ ID NO: 27610 - DNA, 25 bp, Homo sapien
ttatcctcagggaatcctcacttag

SEQ ID NO: 27611 - DNA, 25 bp, Homo sapien
cctcacttagacccctgtaacaggt

SEQ ID NO: 27612 - DNA, 25 bp, Homo sapien
aaatcttcatggtgttctgtttcct

SEQ ID NO: 27613 - DNA, 25 bp, Homo sapien
gtgttctgtttcctaggaacttctt

SEQ ID NO: 27614 - DNA, 25 bp, Homo sapien
taataagtgtttatctttcccacct

SEQ ID NO: 27615 - DNA, 25 bp, Homo sapien
atctttcccacctactcaaagtagt

SEQ ID NO: 27616 - DNA, 25 bp, Homo sapien
gtagttccaagattagggctagttt

SEQ ID NO: 27617 - DNA, 25 bp, Homo sapien
gtggaccactgtaaacgagggccta

SEQ ID NO: 27618 - DNA, 25 bp, Homo sapien
cgagggcctagttcagtgtctgcct

SEQ ID NO: 27619 - DNA, 25 bp, Homo sapien
gggaagcttccaataaatacctttg

SEQ ID NO: 27620 - DNA, 25 bp, Homo sapien
aaacaatcggagacctatacagaag

SEQ ID NO: 27621 - DNA, 25 bp, Homo sapien
gatataactgcatgtggccaacaca

SEQ ID NO: 27622 - DNA, 25 bp, Homo sapien
ggccaacacaaggtatgtcactccc

SEQ ID NO: 27623 - DNA, 25 bp, Homo sapien
ggtatgtcactcccgagaatgcaga

SEQ ID NO: 27624 - DNA, 25 bp, Homo sapien
aattgtggacagaatgggatttgca

SEQ ID NO: 27625 - DNA, 25 bp, Homo sapien
gggatttgcaatgaacatttccatt

SEQ ID NO: 27626 - DNA, 25 bp, Homo sapien
tccagattgtgagccagcaatgtca

SEQ ID NO: 27627 - DNA, 25 bp, Homo sapien
gccagcaatgtcatcaccaggagga

SEQ ID NO: 27628 - DNA, 25 bp, Homo sapien
gtatcaatgatggattttggcttac

SEQ ID NO: 27629 - DNA, 25 bp, Homo sapien
acagtaagcagcagatctatctcag

SEQ ID NO: 27630 - DNA, 25 bp, Homo sapien
taccaagaaactcacgattaactta

SEQ ID NO: 27631 - DNA, 25 bp, Homo sapien
ctttcttcttccaggtggagtcatt

SEQ ID NO: 27632 - DNA, 25 bp, Homo sapien
gagtcatttgttcatttgtccattc

SEQ ID NO: 27633 - DNA, 25 bp, Homo sapien
aagactaactcttgaagtgtagccc

SEQ ID NO: 27634 - DNA, 25 bp, Homo sapien
gtgtagcccacatgagaacttctgg

SEQ ID NO: 27635 - DNA, 25 bp, Homo sapien
gaacttctgggcgaggggtggtata

SEQ ID NO: 27636 - DNA, 25 bp, Homo sapien
ggtggtataataacttgggtctgga

SEQ ID NO: 27637 - DNA, 25 bp, Homo sapien
caagactgactgggttccaattcca

SEQ ID NO: 27638 - DNA, 25 bp, Homo sapien
caattccagtccactagttgctacc

SEQ ID NO: 27639 - DNA, 25 bp, Homo sapien
agttgctacctgtgtgagctagagc

SEQ ID NO: 27640 - DNA, 25 bp, Homo sapien
gctagagcaaattaattacctccca

SEQ ID NO: 27641 - DNA, 25 bp, Homo sapien
cacctgttaactcagctactggggg

SEQ ID NO: 27642 - DNA, 25 bp, Homo sapien
cactaccgagtcatcatgaatcctc

SEQ ID NO: 27643 - DNA, 25 bp, Homo sapien
accgagtcatcatgaatcctcacct

SEQ ID NO: 27644 - DNA, 25 bp, Homo sapien
ttcccagctgcacagctggattgtg

SEQ ID NO: 27645 - DNA, 25 bp, Homo sapien
gcacagctggattgtgttacacaac

SEQ ID NO: 27646 - DNA, 25 bp, Homo sapien
atgtattttagatatccctatattt

SEQ ID NO: 27647 - DNA, 25 bp, Homo sapien
tagatatccctatatttggttttct

SEQ ID NO: 27648 - DNA, 25 bp, Homo sapien
ccattccaagaattccatcgtcaga

SEQ ID NO: 27649 - DNA, 25 bp, Homo sapien
attccaagaattccatcgtcagatg

SEQ ID NO: 27650 - DNA, 25 bp, Homo sapien
tgtgtcatcatctcccaggaatgga

SEQ ID NO: 27651 - DNA, 25 bp, Homo sapien
catcatctcccaggaatggagtggt

SEQ ID NO: 27652 - DNA, 25 bp, Homo sapien
atggagtggtggcatcagtgatgta

SEQ ID NO: 27653 - DNA, 25 bp, Homo sapien
caccacacttagcctattgtgactt

SEQ ID NO: 27654 - DNA, 25 bp, Homo sapien
attgtgactttttagagtctctaat

SEQ ID NO: 27655 - DNA, 25 bp, Homo sapien
gtctctaatactttcttttagggca

SEQ ID NO: 27656 - DNA, 25 bp, Homo sapien
gatccagttggtattcatttgggtg

SEQ ID NO: 27657 - DNA, 25 bp, Homo sapien
gttccagatactcaaagcgacctag

SEQ ID NO: 27658 - DNA, 25 bp, Homo sapien
caaagcgacctagatcagtgatgaa

SEQ ID NO: 27659 - DNA, 25 bp, Homo sapien
tgggatctccttttactgatttctc

SEQ ID NO: 27660 - DNA, 25 bp, Homo sapien
tactgatttctctgtatattcatga

SEQ ID NO: 27661 - DNA, 25 bp, Homo sapien
gtatattcatgagcaaccttaaatt

SEQ ID NO: 27662 - DNA, 25 bp, Homo sapien
ttaattattatgttctattttctgg

SEQ ID NO: 27663 - DNA, 25 bp, Homo sapien
gaatcaactggttttgaacctcaat

SEQ ID NO: 27664 - DNA, 25 bp, Homo sapien
cagggaggaagggcacaaagataaa

SEQ ID NO: 27665 - DNA, 25 bp, Homo sapien
aagagagggcacggttatcacatgg

SEQ ID NO: 27666 - DNA, 25 bp, Homo sapien
atcacatggtgatcgaggaacagat

SEQ ID NO: 27667 - DNA, 25 bp, Homo sapien
gaaaagcaagcagagatagtaggaa

SEQ ID NO: 27668 - DNA, 25 bp, Homo sapien
ggaatgtagacaagaagccagataa

SEQ ID NO: 27669 - DNA, 25 bp, Homo sapien
gaagccagataaacctaaaagtgaa

SEQ ID NO: 27670 - DNA, 25 bp, Homo sapien
aagtgaagactatgagaaggacaaa

SEQ ID NO: 27671 - DNA, 25 bp, Homo sapien
actgttaaaatgttgtatcttgtaa

SEQ ID NO: 27672 - DNA, 25 bp, Homo sapien
aaaagaaagattgcctgctaggatt

SEQ ID NO: 27673 - DNA, 25 bp, Homo sapien
cctgctaggattgtgccatctttaa

SEQ ID NO: 27674 - DNA, 25 bp, Homo sapien
gctaggattgtgccatctttaaaat

SEQ ID NO: 27675 - DNA, 25 bp, Homo sapien
aattgcttcaattccctgcttgaac

SEQ ID NO: 27676 - DNA, 25 bp, Homo sapien
aaattgttttggcttcagctctctg

SEQ ID NO: 27677 - DNA, 25 bp, Homo sapien
tgagtttggctgcctagctcagttt

SEQ ID NO: 27678 - DNA, 25 bp, Homo sapien
ctcagttttcagttggtcaccaaaa

SEQ ID NO: 27679 - DNA, 25 bp, Homo sapien
tttttgtgtggtatggggtctgctg

SEQ ID NO: 27680 - DNA, 25 bp, Homo sapien
ctgctggagtcatgtggtagtgcgt

SEQ ID NO: 27681 - DNA, 25 bp, Homo sapien
gtcatgtggtagtgcgtttggccct

SEQ ID NO: 27682 - DNA, 25 bp, Homo sapien
gtttggcccttcattgagtggtgga

SEQ ID NO: 27683 - DNA, 25 bp, Homo sapien
ggcccttcattgagtggtggagcca

SEQ ID NO: 27684 - DNA, 25 bp, Homo sapien
agctgagggctgtggcagaattttg

SEQ ID NO: 27685 - DNA, 25 bp, Homo sapien
aaaataacaatgtctggccgggcgt

SEQ ID NO: 27686 - DNA, 25 bp, Homo sapien
cattctcttccacatgtagccagag

SEQ ID NO: 27687 - DNA, 25 bp, Homo sapien
ttctcttccacatgtagccagaggg

SEQ ID NO: 27688 - DNA, 25 bp, Homo sapien
tcttccacatgtagccagagggacc

SEQ ID NO: 27689 - DNA, 25 bp, Homo sapien
ccacatgtagccagagggacctttc

SEQ ID NO: 27690 - DNA, 25 bp, Homo sapien
atgtagccagagggacctttctaaa

SEQ ID NO: 27691 - DNA, 25 bp, Homo sapien
gccagagggacctttctaaaacgca

SEQ ID NO: 27692 - DNA, 25 bp, Homo sapien
gagggacctttctaaaacgcacatc

SEQ ID NO: 27693 - DNA, 25 bp, Homo sapien
gacctttctaaaacgcacatctggc

SEQ ID NO: 27694 - DNA, 25 bp, Homo sapien
taaaacgcacatctggctacttccc

SEQ ID NO: 27695 - DNA, 25 bp, Homo sapien
ccacctctgcgggagtggcgtgtga

SEQ ID NO: 27696 - DNA, 25 bp, Homo sapien
ctctgcgggagtggcgtgtgaggct

SEQ ID NO: 27697 - DNA, 25 bp, Homo sapien
ggagtgatttcaactttcaagtctt

SEQ ID NO: 27698 - DNA, 25 bp, Homo sapien
gctgcaatggatagtgatttttctg

SEQ ID NO: 27699 - DNA, 25 bp, Homo sapien
tttctgacatatctgggcaaaatac

SEQ ID NO: 27700 - DNA, 25 bp, Homo sapien
aagcattcatcattctagatgccat

SEQ ID NO: 27701 - DNA, 25 bp, Homo sapien
atgccattaagaacacttgtgagct

SEQ ID NO: 27702 - DNA, 25 bp, Homo sapien
gaacacttgtgagctgagcacggta

SEQ ID NO: 27703 - DNA, 25 bp, Homo sapien
gagcacggtagctcacacctgtaat

SEQ ID NO: 27704 - DNA, 25 bp, Homo sapien
acctgaggttaggagttccagacca

SEQ ID NO: 27705 - DNA, 25 bp, Homo sapien
tggtgacacactcctataatcctag

SEQ ID NO: 27706 - DNA, 25 bp, Homo sapien
aaaaattagctaggcctggtggcag

SEQ ID NO: 27707 - DNA, 25 bp, Homo sapien
gcctggtggcagaggcctgtaatcc

SEQ ID NO: 27708 - DNA, 25 bp, Homo sapien
gcttaattgtcaaggtcaagcactg

SEQ ID NO: 27709 - DNA, 25 bp, Homo sapien
tctatcactcacccaaggaactcac

SEQ ID NO: 27710 - DNA, 25 bp, Homo sapien
aaatccagggacatgtagatggtgg

SEQ ID NO: 27711 - DNA, 25 bp, Homo sapien
gtggtagaatctcacctttcaggtg

SEQ ID NO: 27712 - DNA, 25 bp, Homo sapien
cacctttcaggtggaagtgtaggaa

SEQ ID NO: 27713 - DNA, 25 bp, Homo sapien
tgtgcaggcaaaactactaggccct

SEQ ID NO: 27714 - DNA, 25 bp, Homo sapien
aaaactactaggccctgcatttggt

SEQ ID NO: 27715 - DNA, 25 bp, Homo sapien
ctactaggccctgcatttggtagga

SEQ ID NO: 27716 - DNA, 25 bp, Homo sapien
gtctttggacaaatttgatcactta

SEQ ID NO: 27717 - DNA, 25 bp, Homo sapien
aactgacacaaaattgtggccagag

SEQ ID NO: 27718 - DNA, 25 bp, Homo sapien
aacagggtgtggtagcctgcacctg

SEQ ID NO: 27719 - DNA, 25 bp, Homo sapien
tccccagcccttagcacagagaggg

SEQ ID NO: 27720 - DNA, 25 bp, Homo sapien
gcacttctagtggtctcacctgaag

SEQ ID NO: 27721 - DNA, 25 bp, Homo sapien
gtggtctcacctgaaggcaagaggg

SEQ ID NO: 27722 - DNA, 25 bp, Homo sapien
agagggaggggacagaggccctgcc

SEQ ID NO: 27723 - DNA, 25 bp, Homo sapien
gcctcctgctctctggaggtactga

SEQ ID NO: 27724 - DNA, 25 bp, Homo sapien
ggaggtactgagacagggtgctgat

SEQ ID NO: 27725 - DNA, 25 bp, Homo sapien
gacagggtgctgatgggaaggaggg

SEQ ID NO: 27726 - DNA, 25 bp, Homo sapien
ctggacctatgcagggaggccacgt

SEQ ID NO: 27727 - DNA, 25 bp, Homo sapien
ctgctcccctttgggggtgtgtgtg

SEQ ID NO: 27728 - DNA, 25 bp, Homo sapien
ggggtgtgtgtgtgtgttttaattt

SEQ ID NO: 27729 - DNA, 25 bp, Homo sapien
aactgcaataaactgccccatgtgg

SEQ ID NO: 27730 - DNA, 25 bp, Homo sapien
gcgccagcggtactggctgggggaa

SEQ ID NO: 27731 - DNA, 25 bp, Homo sapien
cgcagtgcaggatggtgtgcgggtg

SEQ ID NO: 27732 - DNA, 25 bp, Homo sapien
gagcttgagcgcagccatagacaac

SEQ ID NO: 27733 - DNA, 25 bp, Homo sapien
cgctcagtcctggccaaggagctgg

SEQ ID NO: 27734 - DNA, 25 bp, Homo sapien
gccacactgcaacgggacatgctgc

SEQ ID NO: 27735 - DNA, 25 bp, Homo sapien
gagaaggccgaggtggccgaggcgc

SEQ ID NO: 27736 - DNA, 25 bp, Homo sapien
ggacaagttggatctgaaccgcctt

SEQ ID NO: 27737 - DNA, 25 bp, Homo sapien
gaggcgctgcggttggaacaggagg

SEQ ID NO: 27738 - DNA, 25 bp, Homo sapien
gagcaggcccaggaggcagtggagc

SEQ ID NO: 27739 - DNA, 25 bp, Homo sapien
tccccacgctgcatcatgagtgcag

SEQ ID NO: 27740 - DNA, 25 bp, Homo sapien
tgcatcatgagtgcagccggctgca

SEQ ID NO: 27741 - DNA, 25 bp, Homo sapien
ttgtcagtgcaaagcaggtttacta

SEQ ID NO: 27742 - DNA, 25 bp, Homo sapien
gcaggtttactaattaccagtccca

SEQ ID NO: 27743 - DNA, 25 bp, Homo sapien
tcccaagagaggactcccattgcat

SEQ ID NO: 27744 - DNA, 25 bp, Homo sapien
gaggactcccattgcatggggaata

SEQ ID NO: 27745 - DNA, 25 bp, Homo sapien
ggggaatagcaaagatcatccttag

SEQ ID NO: 27746 - DNA, 25 bp, Homo sapien
agggttttccagggttgcagacaag

SEQ ID NO: 27747 - DNA, 25 bp, Homo sapien
gcaccatcattagctccagagggaa

SEQ ID NO: 27748 - DNA, 25 bp, Homo sapien
gacaatgcgtgtttttagttcccta

SEQ ID NO: 27749 - DNA, 25 bp, Homo sapien
gttccctagatatgtatttctatac

SEQ ID NO: 27750 - DNA, 25 bp, Homo sapien
tttctatactttaatatttctgtga

SEQ ID NO: 27751 - DNA, 25 bp, Homo sapien
gggtgttgccatttggtgtaatctt

SEQ ID NO: 27752 - DNA, 25 bp, Homo sapien
taaatctgggtgcatagcttgagcc

SEQ ID NO: 27753 - DNA, 25 bp, Homo sapien
gggtgcatagcttgagccagtaatt

SEQ ID NO: 27754 - DNA, 25 bp, Homo sapien
gcatagcttgagccagtaatttggg

SEQ ID NO: 27755 - DNA, 25 bp, Homo sapien
gtaatttgggctaaagtgtgtttcg

SEQ ID NO: 27756 - DNA, 25 bp, Homo sapien
ggctaaagtgtgtttcggacttaga

SEQ ID NO: 27757 - DNA, 25 bp, Homo sapien
gaaatttgtgcaatagtcaactgtc

SEQ ID NO: 27758 - DNA, 25 bp, Homo sapien
gtcaactgtctaaagcagtgttgtt

SEQ ID NO: 27759 - DNA, 25 bp, Homo sapien
aatagaactataatgtgagacacac

SEQ ID NO: 27760 - DNA, 25 bp, Homo sapien
aaggacttaacccaatatgttgcaa

SEQ ID NO: 27761 - DNA, 25 bp, Homo sapien
ccagcactttcggagtaatcccagc

SEQ ID NO: 27762 - DNA, 25 bp, Homo sapien
gcactttcggagtaatcccagcact

SEQ ID NO: 27763 - DNA, 25 bp, Homo sapien
agtgggggagggcagggggagagca

SEQ ID NO: 27764 - DNA, 25 bp, Homo sapien
agcaggctgcacagggagccgactg

SEQ ID NO: 27765 - DNA, 25 bp, Homo sapien
ggagccgactgcattaggagacgtg

SEQ ID NO: 27766 - DNA, 25 bp, Homo sapien
taggagacgtggagggggccttctc

SEQ ID NO: 27767 - DNA, 25 bp, Homo sapien
cctctagaaccactgttttcaggtg

SEQ ID NO: 27768 - DNA, 25 bp, Homo sapien
cactgttttcaggtgtttgggggct

SEQ ID NO: 27769 - DNA, 25 bp, Homo sapien
gggggctgtcttagtcagtttgggt

SEQ ID NO: 27770 - DNA, 25 bp, Homo sapien
aagtgccacagacaggccgggcacg

SEQ ID NO: 27771 - DNA, 25 bp, Homo sapien
taatatggtgaaactccgcctctac

SEQ ID NO: 27772 - DNA, 25 bp, Homo sapien
cgtggtggtgggtacctgtgatccc

SEQ ID NO: 27773 - DNA, 25 bp, Homo sapien
tgatcccggctagtcgggagcctga

SEQ ID NO: 27774 - DNA, 25 bp, Homo sapien
cttcattgccaagaaagtggagcac

SEQ ID NO: 27775 - DNA, 25 bp, Homo sapien
caagaaagtggagcacaaccagtgc

SEQ ID NO: 27776 - DNA, 25 bp, Homo sapien
caaaggctatggagtgacctgccgc

SEQ ID NO: 27777 - DNA, 25 bp, Homo sapien
gcaagcgcggcatcaaggaggtatc

SEQ ID NO: 27778 - DNA, 25 bp, Homo sapien
agcgcggcatcaaggaggtatccag

SEQ ID NO: 27779 - DNA, 25 bp, Homo sapien
gcggcatcaaggaggtatccaggag

SEQ ID NO: 27780 - DNA, 25 bp, Homo sapien
atcaaggaggtatccaggagaaggc

SEQ ID NO: 27781 - DNA, 25 bp, Homo sapien
ttcctcatcaaggccgtctagggca

SEQ ID NO: 27782 - DNA, 25 bp, Homo sapien
tcatcaaggccgtctagggcacgcg

SEQ ID NO: 27783 - DNA, 25 bp, Homo sapien
gtcactgctgtgcatgatgctggaa

SEQ ID NO: 27784 - DNA, 25 bp, Homo sapien
actgctgtgcatgatgctggaaagc

SEQ ID NO: 27785 - DNA, 25 bp, Homo sapien
ctcgctcagccagatgcaatcaatg

SEQ ID NO: 27786 - DNA, 25 bp, Homo sapien
cagatgcaatcaatgccccagtcac

SEQ ID NO: 27787 - DNA, 25 bp, Homo sapien
tcagtgcagaggctcgcgagctata

SEQ ID NO: 27788 - DNA, 25 bp, Homo sapien
gctcgcgagctatagaagaatcacc

SEQ ID NO: 27789 - DNA, 25 bp, Homo sapien
accagcagcaagtgtcccaaagaag

SEQ ID NO: 27790 - DNA, 25 bp, Homo sapien
attccatggaccacctggacaagca

SEQ ID NO: 27791 - DNA, 25 bp, Homo sapien
caagcaaacccaaactccgaagact

SEQ ID NO: 27792 - DNA, 25 bp, Homo sapien
tccgaagacttgaacactcactcca

SEQ ID NO: 27793 - DNA, 25 bp, Homo sapien
actccacaacccaagaatctgcagc

SEQ ID NO: 27794 - DNA, 25 bp, Homo sapien
caagaatctgcagctaacttatttt

SEQ ID NO: 27795 - DNA, 25 bp, Homo sapien
ttcctcttgaaccacagttctaccc

SEQ ID NO: 27796 - DNA, 25 bp, Homo sapien
agcaaatatttaccactcttgtgtg

SEQ ID NO: 27797 - DNA, 25 bp, Homo sapien
ttaccactcttgtgtgtgtgtgtgt

SEQ ID NO: 27798 - DNA, 25 bp, Homo sapien
gtgtgtgtgtatttttttcttttgt

SEQ ID NO: 27799 - DNA, 25 bp, Homo sapien
agggctagcgcaatatataacaagt

SEQ ID NO: 27800 - DNA, 25 bp, Homo sapien
aagtgattcatggtggcgtcttctg

SEQ ID NO: 27801 - DNA, 25 bp, Homo sapien
ggtggcgtcttctggtagattgatt

SEQ ID NO: 27802 - DNA, 25 bp, Homo sapien
gattgattgtattttgtcccttctt

SEQ ID NO: 27803 - DNA, 25 bp, Homo sapien
ttgattgtattttgtcccttctttt

SEQ ID NO: 27804 - DNA, 25 bp, Homo sapien
cgcccggctaattttatatatatat

SEQ ID NO: 27805 - DNA, 25 bp, Homo sapien
tgggttttcaccatgttagccagga

SEQ ID NO: 27806 - DNA, 25 bp, Homo sapien
atttctcttaagcaaaaggccaaca

SEQ ID NO: 27807 - DNA, 25 bp, Homo sapien
atctaggcagcaaacttcacagcag

SEQ ID NO: 27808 - DNA, 25 bp, Homo sapien
gcaaacttcacagcagacaaacagg

SEQ ID NO: 27809 - DNA, 25 bp, Homo sapien
aaggggcaacctcagtgtaaatcaa

SEQ ID NO: 27810 - DNA, 25 bp, Homo sapien
gtgtaaatcaaagtcctctggtgga

SEQ ID NO: 27811 - DNA, 25 bp, Homo sapien
tggtggaacaaagggtcccacggct

SEQ ID NO: 27812 - DNA, 25 bp, Homo sapien
gctctcctccaggatgttcatggac

SEQ ID NO: 27813 - DNA, 25 bp, Homo sapien
gcaagaccgaatccagcctggagtt

SEQ ID NO: 27814 - DNA, 25 bp, Homo sapien
tccacctcttctgttgaacctataa

SEQ ID NO: 27815 - DNA, 25 bp, Homo sapien
tataagccaagttccacacctggac

SEQ ID NO: 27816 - DNA, 25 bp, Homo sapien
cacacctggacacatgctccatgtt

SEQ ID NO: 27817 - DNA, 25 bp, Homo sapien
atgctccatgttcatgtgtcatatc

SEQ ID NO: 27818 - DNA, 25 bp, Homo sapien
gaagaggcaggcattgacacgcatg

SEQ ID NO: 27819 - DNA, 25 bp, Homo sapien
gacacgcatgcacaggtggaggctc

SEQ ID NO: 27820 - DNA, 25 bp, Homo sapien
tagggcaaacgcagctgcacacagt

SEQ ID NO: 27821 - DNA, 25 bp, Homo sapien
tgcacacagtacagtcaccgcagtg

SEQ ID NO: 27822 - DNA, 25 bp, Homo sapien
gacttcggctggttgctgagggaag

SEQ ID NO: 27823 - DNA, 25 bp, Homo sapien
gagggaagagtacagtgcgccggca

SEQ ID NO: 27824 - DNA, 25 bp, Homo sapien
gacactgagccctacgggatctgaa

SEQ ID NO: 27825 - DNA, 25 bp, Homo sapien
ttcttcagtgtctggcgtcgattac

SEQ ID NO: 27826 - DNA, 25 bp, Homo sapien
gtcgattacagaaccagaccctcac

SEQ ID NO: 27827 - DNA, 25 bp, Homo sapien
tgaaggaagtgcgccgcttgcgttt

SEQ ID NO: 27828 - DNA, 25 bp, Homo sapien
cctccccagggtgtgacatatgtgg

SEQ ID NO: 27829 - DNA, 25 bp, Homo sapien
ggcggtgaaaaatgtggctttagtc

SEQ ID NO: 27830 - DNA, 25 bp, Homo sapien
tggctttagtcatcacatgggccta

SEQ ID NO: 27831 - DNA, 25 bp, Homo sapien
catgggcctacgggtttgtgaaagt

SEQ ID NO: 27832 - DNA, 25 bp, Homo sapien
gtgtgtactgcatgtatgtcatctt

SEQ ID NO: 27833 - DNA, 25 bp, Homo sapien
gcatgtatgtcatcttgcatctaag

SEQ ID NO: 27834 - DNA, 25 bp, Homo sapien
acatgagtgcatcttggcttgccac

SEQ ID NO: 27835 - DNA, 25 bp, Homo sapien
tggcttgccactaactgcctgtggc

SEQ ID NO: 27836 - DNA, 25 bp, Homo sapien
ctgtcactcaacttttcatctggaa

SEQ ID NO: 27837 - DNA, 25 bp, Homo sapien
attatccttctggaattgtgtgcat

SEQ ID NO: 27838 - DNA, 25 bp, Homo sapien
aaagtactcagtgagggccgggcgc

SEQ ID NO: 27839 - DNA, 25 bp, Homo sapien
gccgaggggtgcagattacgaggtc

SEQ ID NO: 27840 - DNA, 25 bp, Homo sapien
atagcagcgagattcacttcaaagt

SEQ ID NO: 27841 - DNA, 25 bp, Homo sapien
atgacaacacatctcaagaaactca

SEQ ID NO: 27842 - DNA, 25 bp, Homo sapien
gaaactcaaagaatcatactgtcaa

SEQ ID NO: 27843 - DNA, 25 bp, Homo sapien
atactgtcaaaggcagggagttcca

SEQ ID NO: 27844 - DNA, 25 bp, Homo sapien
aaggcagggagttccaatgaattca

SEQ ID NO: 27845 - DNA, 25 bp, Homo sapien
aatgaattcactcagatttgtcttt

SEQ ID NO: 27846 - DNA, 25 bp, Homo sapien
gatcaggaggcaaaaccttcaactg

SEQ ID NO: 27847 - DNA, 25 bp, Homo sapien
gaagatcagagaattgctgctactc

SEQ ID NO: 27848 - DNA, 25 bp, Homo sapien
gaattgctgctactcatactataaa

SEQ ID NO: 27849 - DNA, 25 bp, Homo sapien
aaccttcaactgatgacttggagga

SEQ ID NO: 27850 - DNA, 25 bp, Homo sapien
aagtcattggacaggatagcagcga

SEQ ID NO: 27851 - DNA, 25 bp, Homo sapien
gtgagaagctggtttgtgaagcacc

SEQ ID NO: 27852 - DNA, 25 bp, Homo sapien
gtgaagcacctgccatgaaatcctg

SEQ ID NO: 27853 - DNA, 25 bp, Homo sapien
aagcacctgccatgaaatcctgtgg

SEQ ID NO: 27854 - DNA, 25 bp, Homo sapien
gccttgctggtggtagtctgcaggg

SEQ ID NO: 27855 - DNA, 25 bp, Homo sapien
cttgctggtggtagtctgcagggct

SEQ ID NO: 27856 - DNA, 25 bp, Homo sapien
tgcctcaggtttcctagtggccaga

SEQ ID NO: 27857 - DNA, 25 bp, Homo sapien
tcctagtggccagagaagggaaagg

SEQ ID NO: 27858 - DNA, 25 bp, Homo sapien
ggaaaggataagtcattgcatctgt

SEQ ID NO: 27859 - DNA, 25 bp, Homo sapien
gataagtcattgcatctgtgagaga

SEQ ID NO: 27860 - DNA, 25 bp, Homo sapien
aagccattagctcagaagaacttta

SEQ ID NO: 27861 - DNA, 25 bp, Homo sapien
ataggaaaaatgtgtccaggcacgg

SEQ ID NO: 27862 - DNA, 25 bp, Homo sapien
tcgtccagctaaagtgtgccatgtc

SEQ ID NO: 27863 - DNA, 25 bp, Homo sapien
gctaaagtgtgccatgtcaccacgc

SEQ ID NO: 27864 - DNA, 25 bp, Homo sapien
tgccatgtcaccacgcatatttggt

SEQ ID NO: 27865 - DNA, 25 bp, Homo sapien
ggtggtaacctagtgaatcagaatc

SEQ ID NO: 27866 - DNA, 25 bp, Homo sapien
gaatctgcacgtatctgagtgtttc

SEQ ID NO: 27867 - DNA, 25 bp, Homo sapien
tgagtgtttcaacaacttccccact

SEQ ID NO: 27868 - DNA, 25 bp, Homo sapien
cagaagatatggagcaggtaccctg

SEQ ID NO: 27869 - DNA, 25 bp, Homo sapien
gcaggtaccctgattcagggagggg

SEQ ID NO: 27870 - DNA, 25 bp, Homo sapien
gagcatgggccattgtggaaccaag

SEQ ID NO: 27871 - DNA, 25 bp, Homo sapien
tggaaccaaggtcacgagctgtatg

SEQ ID NO: 27872 - DNA, 25 bp, Homo sapien
gaaggatttcgaaagtctaccagat

SEQ ID NO: 27873 - DNA, 25 bp, Homo sapien
cagatttccttactttttacatact

SEQ ID NO: 27874 - DNA, 25 bp, Homo sapien
tttagtcatgtctcctaatgctcct

SEQ ID NO: 27875 - DNA, 25 bp, Homo sapien
ctcctaatgctccttgtggctgtaa

SEQ ID NO: 27876 - DNA, 25 bp, Homo sapien
gctgtaatagtttctctggctttcc

SEQ ID NO: 27877 - DNA, 25 bp, Homo sapien
gacttgttatttatggccttgatgg

SEQ ID NO: 27878 - DNA, 25 bp, Homo sapien
tgtggaatgctcctcaactgggatt

SEQ ID NO: 27879 - DNA, 25 bp, Homo sapien
aactgggatttgtctaacttctcat

SEQ ID NO: 27880 - DNA, 25 bp, Homo sapien
gtaaaggtaccattctcataacatc

SEQ ID NO: 27881 - DNA, 25 bp, Homo sapien
cccctttctatactgtactctttgg

SEQ ID NO: 27882 - DNA, 25 bp, Homo sapien
ggatgtcactatacaaaacccacac

SEQ ID NO: 27883 - DNA, 25 bp, Homo sapien
gagttatactatacctccttaagag

SEQ ID NO: 27884 - DNA, 25 bp, Homo sapien
ccctgacttctgtgctacatgacaa

SEQ ID NO: 27885 - DNA, 25 bp, Homo sapien
agatgtttgaccctcatcactttct

SEQ ID NO: 27886 - DNA, 25 bp, Homo sapien
gtaaatacttcatgcctttctcagc

SEQ ID NO: 27887 - DNA, 25 bp, Homo sapien
ggagctgtttttattcctgacctcc

SEQ ID NO: 27888 - DNA, 25 bp, Homo sapien
ttgtcaatggatttgcctctgtgcc

SEQ ID NO: 27889 - DNA, 25 bp, Homo sapien
gagcagatggcctggctgctgctca

SEQ ID NO: 27890 - DNA, 25 bp, Homo sapien
tcctctggggcattatccatctttc

SEQ ID NO: 27891 - DNA, 25 bp, Homo sapien
cactatctgtaatgccttttctcac

SEQ ID NO: 27892 - DNA, 25 bp, Homo sapien
acattttcccttccctgaagatcta

SEQ ID NO: 27893 - DNA, 25 bp, Homo sapien
gaacattcgaccttcattacggaga

SEQ ID NO: 27894 - DNA, 25 bp, Homo sapien
gagtttcctatgtttcactgtgcaa

SEQ ID NO: 27895 - DNA, 25 bp, Homo sapien
ttggaggcagaagctctgaccccta

SEQ ID NO: 27896 - DNA, 25 bp, Homo sapien
ctctgacccctatggtggtggagga

SEQ ID NO: 27897 - DNA, 25 bp, Homo sapien
ggaggacaatactttgccaaaccac

SEQ ID NO: 27898 - DNA, 25 bp, Homo sapien
gtggccatggaggttccagtagcag

SEQ ID NO: 27899 - DNA, 25 bp, Homo sapien
gcagtagtagctatggcagtggcag

SEQ ID NO: 27900 - DNA, 25 bp, Homo sapien
attactgccgggaaacaaagcttag

SEQ ID NO: 27901 - DNA, 25 bp, Homo sapien
gacagggaagctacaggttacaaca

SEQ ID NO: 27902 - DNA, 25 bp, Homo sapien
gtgaatgcagccaagcacagtggtg

SEQ ID NO: 27903 - DNA, 25 bp, Homo sapien
tggtggcagggcctagctgctacaa

SEQ ID NO: 27904 - DNA, 25 bp, Homo sapien
agtagattttttttttgcacccatg

SEQ ID NO: 27905 - DNA, 25 bp, Homo sapien
ttgcacccatgctgttgattgctaa

SEQ ID NO: 27906 - DNA, 25 bp, Homo sapien
ctatgcttcacctccatgagagcag

SEQ ID NO: 27907 - DNA, 25 bp, Homo sapien
atgagagcagactacctacctaact

SEQ ID NO: 27908 - DNA, 25 bp, Homo sapien
cagactacctacctaactatttact

SEQ ID NO: 27909 - DNA, 25 bp, Homo sapien
gagattcccatgcttactctgaaat

SEQ ID NO: 27910 - DNA, 25 bp, Homo sapien
ggaatcagtcattaaagcttcgtaa

SEQ ID NO: 27911 - DNA, 25 bp, Homo sapien
atttattgtacacactactgttcaa

SEQ ID NO: 27912 - DNA, 25 bp, Homo sapien
ataacatgctcttagcccaaccaaa

SEQ ID NO: 27913 - DNA, 25 bp, Homo sapien
gatcatgctaattagttttcttcaa

SEQ ID NO: 27914 - DNA, 25 bp, Homo sapien
tcctaccttgagtattcagccaata

SEQ ID NO: 27915 - DNA, 25 bp, Homo sapien
gagttatgcctggtggggtgtggtg

SEQ ID NO: 27916 - DNA, 25 bp, Homo sapien
tgggggaccaagtcaggcagatcac

SEQ ID NO: 27917 - DNA, 25 bp, Homo sapien
gaagaggcactgcattatttgacca

SEQ ID NO: 27918 - DNA, 25 bp, Homo sapien
ggcactgcattatttgaccagagtt

SEQ ID NO: 27919 - DNA, 25 bp, Homo sapien
atttgaccagagttgaagtgacaga

SEQ ID NO: 27920 - DNA, 25 bp, Homo sapien
gaggcagcatgaggaaccagagagc

SEQ ID NO: 27921 - DNA, 25 bp, Homo sapien
agagagcttctttacctggtttact

SEQ ID NO: 27922 - DNA, 25 bp, Homo sapien
gcttctttacctggtttactgacca

SEQ ID NO: 27923 - DNA, 25 bp, Homo sapien
ggtttactgaccattctgatgcagg

SEQ ID NO: 27924 - DNA, 25 bp, Homo sapien
tgaccattctgatgcaggtgctgat

SEQ ID NO: 27925 - DNA, 25 bp, Homo sapien
gatatttggccaaacccattacagt

SEQ ID NO: 27926 - DNA, 25 bp, Homo sapien
tggccaaacccattacagtactact

SEQ ID NO: 27927 - DNA, 25 bp, Homo sapien
caaacccattacagtactacttggt

SEQ ID NO: 27928 - DNA, 25 bp, Homo sapien
tgtggccggaagggcgtatctgcga

SEQ ID NO: 27929 - DNA, 25 bp, Homo sapien
gccggaagggcgtatctgcgattgc

SEQ ID NO: 27930 - DNA, 25 bp, Homo sapien
gggtgtgtgtgatttgaggtgggga

SEQ ID NO: 27931 - DNA, 25 bp, Homo sapien
gtgtgatttgaggtggggacggggc

SEQ ID NO: 27932 - DNA, 25 bp, Homo sapien
cctaggcttcagttactcacaacag

SEQ ID NO: 27933 - DNA, 25 bp, Homo sapien
ggcttcagttactcacaacaggacg

SEQ ID NO: 27934 - DNA, 25 bp, Homo sapien
ttcagttactcacaacaggacggac

SEQ ID NO: 27935 - DNA, 25 bp, Homo sapien
actcacaacaggacggacaaaggaa

SEQ ID NO: 27936 - DNA, 25 bp, Homo sapien
aacaggacggacaaaggaaacagag

SEQ ID NO: 27937 - DNA, 25 bp, Homo sapien
ggaaacagagtttacccgttctgct

SEQ ID NO: 27938 - DNA, 25 bp, Homo sapien
gaaacagagtttacccgttctgcta

SEQ ID NO: 27939 - DNA, 25 bp, Homo sapien
gctgaccaacaatagccagacaccc

SEQ ID NO: 27940 - DNA, 25 bp, Homo sapien
tcgtcatccacagggacaacaccac

SEQ ID NO: 27941 - DNA, 25 bp, Homo sapien
gaaaggcgcagacctcaatgcgtga

SEQ ID NO: 27942 - DNA, 25 bp, Homo sapien
cagacctcaatgcgtgagtccagcc

SEQ ID NO: 27943 - DNA, 25 bp, Homo sapien
ttcaggagggaggcttcgggcacag

SEQ ID NO: 27944 - DNA, 25 bp, Homo sapien
caggcaaatccatgcaggacaagca

SEQ ID NO: 27945 - DNA, 25 bp, Homo sapien
aggacaagcagaggggttgctggag

SEQ ID NO: 27946 - DNA, 25 bp, Homo sapien
aggggttgctggaggtgacaaggat

SEQ ID NO: 27947 - DNA, 25 bp, Homo sapien
gaggtgacaaggattgggtcccaca

SEQ ID NO: 27948 - DNA, 25 bp, Homo sapien
gattgggtcccacataaagcagtca

SEQ ID NO: 27949 - DNA, 25 bp, Homo sapien
aagcagtcaggaatccacatggtgt

SEQ ID NO: 27950 - DNA, 25 bp, Homo sapien
agagaaaggacattcagtgacatcc

SEQ ID NO: 27951 - DNA, 25 bp, Homo sapien
ttcagtgacatccacgtgcagtatg

SEQ ID NO: 27952 - DNA, 25 bp, Homo sapien
gtgacatccacgtgcagtatgaata

SEQ ID NO: 27953 - DNA, 25 bp, Homo sapien
cagtatgaatacgtagcacaggcta

SEQ ID NO: 27954 - DNA, 25 bp, Homo sapien
ggctaagcaagttacctgttgaaga

SEQ ID NO: 27955 - DNA, 25 bp, Homo sapien
gaagaaattgcagcacggtgaaggc

SEQ ID NO: 27956 - DNA, 25 bp, Homo sapien
tgaaggcaggccatttgtgtcgtag

SEQ ID NO: 27957 - DNA, 25 bp, Homo sapien
ccatttgtgtcgtagtcttccgttt

SEQ ID NO: 27958 - DNA, 25 bp, Homo sapien
ttgtgtcgtagtcttccgtttgaag

SEQ ID NO: 27959 - DNA, 25 bp, Homo sapien
gtagtcttccgtttgaagacctgga

SEQ ID NO: 27960 - DNA, 25 bp, Homo sapien
aagacctggagatgtcattgtgaga

SEQ ID NO: 27961 - DNA, 25 bp, Homo sapien
ggaaccaagaagcgggtgctcaccc

SEQ ID NO: 27962 - DNA, 25 bp, Homo sapien
tggtgcagatgaaacggcaggctct

SEQ ID NO: 27963 - DNA, 25 bp, Homo sapien
ttaagttcattgacaccacctccaa

SEQ ID NO: 27964 - DNA, 25 bp, Homo sapien
accacctccaagtttggccatggct

SEQ ID NO: 27965 - DNA, 25 bp, Homo sapien
caaaggggtcaccagtcgttggcac

SEQ ID NO: 27966 - DNA, 25 bp, Homo sapien
ttggcacaccaagaagctgccctgc

SEQ ID NO: 27967 - DNA, 25 bp, Homo sapien
tgtattggggcatggcatcctgctc

SEQ ID NO: 27968 - DNA, 25 bp, Homo sapien
ctggggagaaaggctaccgtcaccg

SEQ ID NO: 27969 - DNA, 25 bp, Homo sapien
gattggccagggctaccttatcaag

SEQ ID NO: 27970 - DNA, 25 bp, Homo sapien
gatcaagaacaatgcctccactgac

SEQ ID NO: 27971 - DNA, 25 bp, Homo sapien
agagcaccaatcctctgggtggctt

SEQ ID NO: 27972 - DNA, 25 bp, Homo sapien
tatatgtatggcttatgctatttca

SEQ ID NO: 27973 - DNA, 25 bp, Homo sapien
gtatggcttatgctatttcaattag

SEQ ID NO: 27974 - DNA, 25 bp, Homo sapien
ttcaattagtcatctttattctttt

SEQ ID NO: 27975 - DNA, 25 bp, Homo sapien
atagctttgtcttaatgcagatcta

SEQ ID NO: 27976 - DNA, 25 bp, Homo sapien
atagttttccctatatctcgcatgg

SEQ ID NO: 27977 - DNA, 25 bp, Homo sapien
tccctatatctcgcatggtgctcta

SEQ ID NO: 27978 - DNA, 25 bp, Homo sapien
ctcgcatggtgctctaaagattaat

SEQ ID NO: 27979 - DNA, 25 bp, Homo sapien
gagaaaacacagatgataaccaact

SEQ ID NO: 27980 - DNA, 25 bp, Homo sapien
atctgaaatgttccaaaacctgaaa

SEQ ID NO: 27981 - DNA, 25 bp, Homo sapien
gtgacactcaaagaactactcattg

SEQ ID NO: 27982 - DNA, 25 bp, Homo sapien
gaactactcattggagcagttcaga

SEQ ID NO: 27983 - DNA, 25 bp, Homo sapien
ggatagtgccaaagaactgcagagg

SEQ ID NO: 27984 - DNA, 25 bp, Homo sapien
gtgatgaaactgaagatctcttttt

SEQ ID NO: 27985 - DNA, 25 bp, Homo sapien
ggaacatgaatccttaacattagaa

SEQ ID NO: 27986 - DNA, 25 bp, Homo sapien
gaaagcgagaatttacttctttggg

SEQ ID NO: 27987 - DNA, 25 bp, Homo sapien
acttctttggggtatgagtgccatt

SEQ ID NO: 27988 - DNA, 25 bp, Homo sapien
gagtgccattgaggaatctataggg

SEQ ID NO: 27989 - DNA, 25 bp, Homo sapien
gaatctatagggcttcatttagtgg

SEQ ID NO: 27990 - DNA, 25 bp, Homo sapien
aggacaagcttatattcgcatcaca

SEQ ID NO: 27991 - DNA, 25 bp, Homo sapien
cgcatcacacagacaaaatggccat

SEQ ID NO: 27992 - DNA, 25 bp, Homo sapien
aaatggccatacaagaagggtgaga

SEQ ID NO: 27993 - DNA, 25 bp, Homo sapien
gaaggagcaaaaatactgctgctta

SEQ ID NO: 27994 - DNA, 25 bp, Homo sapien
agaggtgatggtagcagacagtgct

SEQ ID NO: 27995 - DNA, 25 bp, Homo sapien
ggtagcagacagtgcttgtcactaa

SEQ ID NO: 27996 - DNA, 25 bp, Homo sapien
gacagtgcttgtcactaagtcctct

SEQ ID NO: 27997 - DNA, 25 bp, Homo sapien
cagtgcttgtcactaagtcctctct

SEQ ID NO: 27998 - DNA, 25 bp, Homo sapien
aaaggcaggcaagtgaggagcaggc

SEQ ID NO: 27999 - DNA, 25 bp, Homo sapien
gcaggcaagtgaggagcaggccgaa

SEQ ID NO: 28000 - DNA, 25 bp, Homo sapien
tgcggaaggtaaaaactccaggcca

SEQ ID NO: 28001 - DNA, 25 bp, Homo sapien
ggattctagaaatatgggcacaggg

SEQ ID NO: 28002 - DNA, 25 bp, Homo sapien
tgggcacaggggtcatattttcatg

SEQ ID NO: 28003 - DNA, 25 bp, Homo sapien
ggcacaggggtcatattttcatgaa

SEQ ID NO: 28004 - DNA, 25 bp, Homo sapien
taaaagcacagggtgggccgggcac

SEQ ID NO: 28005 - DNA, 25 bp, Homo sapien
ggatgccatgaatcgagactgtgga

SEQ ID NO: 28006 - DNA, 25 bp, Homo sapien
gtggaattccactcagtcatttgca

SEQ ID NO: 28007 - DNA, 25 bp, Homo sapien
aattcttatgcagctacaagcagac

SEQ ID NO: 28008 - DNA, 25 bp, Homo sapien
gcagacattctgtatattccagtag

SEQ ID NO: 28009 - DNA, 25 bp, Homo sapien
tccagtagtgaagcccttgatgccc

SEQ ID NO: 28010 - DNA, 25 bp, Homo sapien
cgaaaccactgcactgggtgctgcc

SEQ ID NO: 28011 - DNA, 25 bp, Homo sapien
tgctgccatggcggcaggggctgca

SEQ ID NO: 28012 - DNA, 25 bp, Homo sapien
gccgtcacgatggagcggtttgaac

SEQ ID NO: 28013 - DNA, 25 bp, Homo sapien
gcggtttgaacctcagattaatgct

SEQ ID NO: 28014 - DNA, 25 bp, Homo sapien
gttgggttacaactcaatctccaga

SEQ ID NO: 28015 - DNA, 25 bp, Homo sapien
gcaaggtacatctcaggtattccat

SEQ ID NO: 28016 - DNA, 25 bp, Homo sapien
gctggaattaccgatgcgagccacc

SEQ ID NO: 28017 - DNA, 25 bp, Homo sapien
cctgaatacacaatacatacctgac

SEQ ID NO: 28018 - DNA, 25 bp, Homo sapien
atacacaatacatacctgacattaa

SEQ ID NO: 28019 - DNA, 25 bp, Homo sapien
aatacatacctgacattaagaaatc

SEQ ID NO: 28020 - DNA, 25 bp, Homo sapien
taagaaatcatccctattttttact

SEQ ID NO: 28021 - DNA, 25 bp, Homo sapien
aacacatttttaacagagtccattc

SEQ ID NO: 28022 - DNA, 25 bp, Homo sapien
aacagagtccattcggttcagagca

SEQ ID NO: 28023 - DNA, 25 bp, Homo sapien
agtccattcggttcagagcagagtc

SEQ ID NO: 28024 - DNA, 25 bp, Homo sapien
cattcggttcagagcagagtctctc

SEQ ID NO: 28025 - DNA, 25 bp, Homo sapien
ggccagactgttctctgaggtgggg

SEQ ID NO: 28026 - DNA, 25 bp, Homo sapien
ccagactgttctctgaggtggggct

SEQ ID NO: 28027 - DNA, 25 bp, Homo sapien
ataaattgagtcctggagcaccccg

SEQ ID NO: 28028 - DNA, 25 bp, Homo sapien
gagcaccccgtctgtagacaataag

SEQ ID NO: 28029 - DNA, 25 bp, Homo sapien
gcagaatttgtcttagaacttttgt

SEQ ID NO: 28030 - DNA, 25 bp, Homo sapien
gaacttttgtcccagatatcttaat

SEQ ID NO: 28031 - DNA, 25 bp, Homo sapien
gtcccagatatcttaatttcctgtt

SEQ ID NO: 28032 - DNA, 25 bp, Homo sapien
cagatatcttaatttcctgttttta

SEQ ID NO: 28033 - DNA, 25 bp, Homo sapien
gttctgattttttggatcatggaac

SEQ ID NO: 28034 - DNA, 25 bp, Homo sapien
aaactctagaatttggcagtaaaca

SEQ ID NO: 28035 - DNA, 25 bp, Homo sapien
cacagaaattacacaggtgattttt

SEQ ID NO: 28036 - DNA, 25 bp, Homo sapien
aaaggtatactattcagctgggcgt

SEQ ID NO: 28037 - DNA, 25 bp, Homo sapien
ggtatactattcagctgggcgtagt

SEQ ID NO: 28038 - DNA, 25 bp, Homo sapien
acacaatctttgtatccacatggct

SEQ ID NO: 28039 - DNA, 25 bp, Homo sapien
gtatccacatggcttacaattgaag

SEQ ID NO: 28040 - DNA, 25 bp, Homo sapien
agcagatattaatcagtcttcacgt

SEQ ID NO: 28041 - DNA, 25 bp, Homo sapien
taatcagtcttcacgttgaaacata

SEQ ID NO: 28042 - DNA, 25 bp, Homo sapien
gataaattccatgatctaatctgaa

SEQ ID NO: 28043 - DNA, 25 bp, Homo sapien
atctgaagatgcagagtttctctga

SEQ ID NO: 28044 - DNA, 25 bp, Homo sapien
gaagtacaggagttacctaggcact

SEQ ID NO: 28045 - DNA, 25 bp, Homo sapien
ggagttacctaggcactgaagatga

SEQ ID NO: 28046 - DNA, 25 bp, Homo sapien
tgggcaaaggacctgtggtggaaca

SEQ ID NO: 28047 - DNA, 25 bp, Homo sapien
gtggtggaacaactgcagcatgttc

SEQ ID NO: 28048 - DNA, 25 bp, Homo sapien
actgcagcatgttccaggatctaag

SEQ ID NO: 28049 - DNA, 25 bp, Homo sapien
agccagggtgtcagcacagcgggct

SEQ ID NO: 28050 - DNA, 25 bp, Homo sapien
ggctactcctagggataagcccccg

SEQ ID NO: 28051 - DNA, 25 bp, Homo sapien
ctgggcctggactttcaactgcagg

SEQ ID NO: 28052 - DNA, 25 bp, Homo sapien
ctgcaggcagcctggaccttgaggc

SEQ ID NO: 28053 - DNA, 25 bp, Homo sapien
gcagcaactactgcactaccagacc

SEQ ID NO: 28054 - DNA, 25 bp, Homo sapien
cagaccaccaagcagaacctctggt

SEQ ID NO: 28055 - DNA, 25 bp, Homo sapien
cgagcagcctgcgcaggtggctgga

SEQ ID NO: 28056 - DNA, 25 bp, Homo sapien
agccggggcctgaggaccaggaagt

SEQ ID NO: 28057 - DNA, 25 bp, Homo sapien
gctgctggcagaggagctccaggct

SEQ ID NO: 28058 - DNA, 25 bp, Homo sapien
gtgctagcgtgttcgcaccaggaac

SEQ ID NO: 28059 - DNA, 25 bp, Homo sapien
ccaggaacgcaggtgctgggctgtc

SEQ ID NO: 28060 - DNA, 25 bp, Homo sapien
actgttttctgcaatggctgcacca

SEQ ID NO: 28061 - DNA, 25 bp, Homo sapien
gtacaggattccagtttctccatat

SEQ ID NO: 28062 - DNA, 25 bp, Homo sapien
catatccctgccaacacttggtatt

SEQ ID NO: 28063 - DNA, 25 bp, Homo sapien
gttagttactctagtgggtatgtgg

SEQ ID NO: 28064 - DNA, 25 bp, Homo sapien
gtgggtatgtggtggttgtcccatt

SEQ ID NO: 28065 - DNA, 25 bp, Homo sapien
tgattttcattgtccctaatgacta

SEQ ID NO: 28066 - DNA, 25 bp, Homo sapien
tgagcatctaatatccagttgtccc

SEQ ID NO: 28067 - DNA, 25 bp, Homo sapien
gagactattctttcctgtgtaaatg

SEQ ID NO: 28068 - DNA, 25 bp, Homo sapien
tgtgtaaatggtcttggcatctttg

SEQ ID NO: 28069 - DNA, 25 bp, Homo sapien
gttgaaaatcgattggcagccaggt

SEQ ID NO: 28070 - DNA, 25 bp, Homo sapien
ctgcgctgggcagatcgcttaagct

SEQ ID NO: 28071 - DNA, 25 bp, Homo sapien
ctgctgctcagctgctggacgagtc

SEQ ID NO: 28072 - DNA, 25 bp, Homo sapien
tgctcagctgctggacgagtcgctg

SEQ ID NO: 28073 - DNA, 25 bp, Homo sapien
cagctgctggacgagtcgctgtctg

SEQ ID NO: 28074 - DNA, 25 bp, Homo sapien
gtgcctaagcttgccaatcatacgc

SEQ ID NO: 28075 - DNA, 25 bp, Homo sapien
gcctaagcttgccaatcatacgcat

SEQ ID NO: 28076 - DNA, 25 bp, Homo sapien
taagcttgccaatcatacgcatctc

SEQ ID NO: 28077 - DNA, 25 bp, Homo sapien
aagcttgccaatcatacgcatctct

SEQ ID NO: 28078 - DNA, 25 bp, Homo sapien
ttcttccagcacttccagaacagtg

SEQ ID NO: 28079 - DNA, 25 bp, Homo sapien
cttccagcacttccagaacagtggt

SEQ ID NO: 28080 - DNA, 25 bp, Homo sapien
ccccggagcagctgctgctcagctg

SEQ ID NO: 28081 - DNA, 25 bp, Homo sapien
gcagctgctgctcagctgctggacg

SEQ ID NO: 28082 - DNA, 25 bp, Homo sapien
gcctcagctgacaagttactaacac

SEQ ID NO: 28083 - DNA, 25 bp, Homo sapien
caagttactaacaccccagaatgag

SEQ ID NO: 28084 - DNA, 25 bp, Homo sapien
gtgtgcataatgtgtcaattctccc

SEQ ID NO: 28085 - DNA, 25 bp, Homo sapien
atgtgtcaattctcccaatttttat

SEQ ID NO: 28086 - DNA, 25 bp, Homo sapien
agtgaacttctaatgctgtaatttc

SEQ ID NO: 28087 - DNA, 25 bp, Homo sapien
atttcagactcacatggttgcgcac

SEQ ID NO: 28088 - DNA, 25 bp, Homo sapien
ggttgcgcacatggatggtgtgtct

SEQ ID NO: 28089 - DNA, 25 bp, Homo sapien
catggatggtgtgtctgtggggtgt

SEQ ID NO: 28090 - DNA, 25 bp, Homo sapien
gggtagggccaggtgattgtttaga

SEQ ID NO: 28091 - DNA, 25 bp, Homo sapien
ttagaggtcagaagtccaggccggc

SEQ ID NO: 28092 - DNA, 25 bp, Homo sapien
tgtgaagtaagcccgggagcctgtc

SEQ ID NO: 28093 - DNA, 25 bp, Homo sapien
gcctctctcgtgagcttacatgagc

SEQ ID NO: 28094 - DNA, 25 bp, Homo sapien
ctctcgtgagcttacatgagctgtg

SEQ ID NO: 28095 - DNA, 25 bp, Homo sapien
atgagctgtgtggactgatccttcc

SEQ ID NO: 28096 - DNA, 25 bp, Homo sapien
agctcacacgtgcactcaggaagct

SEQ ID NO: 28097 - DNA, 25 bp, Homo sapien
cacacgtgcactcaggaagcttgcc

SEQ ID NO: 28098 - DNA, 25 bp, Homo sapien
aggaagcttgcccatactcaagcct

SEQ ID NO: 28099 - DNA, 25 bp, Homo sapien
agcctcactctagcattgcagacac

SEQ ID NO: 28100 - DNA, 25 bp, Homo sapien
ctctagcattgcagacacatcaggt

SEQ ID NO: 28101 - DNA, 25 bp, Homo sapien
gacacatcaggttttatcttcagaa

SEQ ID NO: 28102 - DNA, 25 bp, Homo sapien
tttatcttcagaaagacaccttaaa

SEQ ID NO: 28103 - DNA, 25 bp, Homo sapien
gaaaatagtttgacttctatacaga

SEQ ID NO: 28104 - DNA, 25 bp, Homo sapien
gagtgacctgcagcagtttccttca

SEQ ID NO: 28105 - DNA, 25 bp, Homo sapien
ttccttcactctgtgagccatgcat

SEQ ID NO: 28106 - DNA, 25 bp, Homo sapien
cactctgtgagccatgcatgcaaat

SEQ ID NO: 28107 - DNA, 25 bp, Homo sapien
cccacccgcattcaagtgcaattga

SEQ ID NO: 28108 - DNA, 25 bp, Homo sapien
tcaagtgcaattgatggggccattg

SEQ ID NO: 28109 - DNA, 25 bp, Homo sapien
cctagctgctgctggtagacttgta

SEQ ID NO: 28110 - DNA, 25 bp, Homo sapien
gctgctggtagacttgtaggatcct

SEQ ID NO: 28111 - DNA, 25 bp, Homo sapien
tataatttaggcttctcattaattc

SEQ ID NO: 28112 - DNA, 25 bp, Homo sapien
atgaaccgtgactttggtgtgccct

SEQ ID NO: 28113 - DNA, 25 bp, Homo sapien
cccttctccattccagttatgtgga

SEQ ID NO: 28114 - DNA, 25 bp, Homo sapien
atagcaacgctagtggctcatgcct

SEQ ID NO: 28115 - DNA, 25 bp, Homo sapien
gtgcatttacacaatcatttacctt

SEQ ID NO: 28116 - DNA, 25 bp, Homo sapien
ttaccttatcagtcccttcagaaga

SEQ ID NO: 28117 - DNA, 25 bp, Homo sapien
ttatcacttacatccttgcagctaa

SEQ ID NO: 28118 - DNA, 25 bp, Homo sapien
gcagctaaatctttgagtacatcct

SEQ ID NO: 28119 - DNA, 25 bp, Homo sapien
gagtacatcctaatacctgtctgtt

SEQ ID NO: 28120 - DNA, 25 bp, Homo sapien
acctgtctgtttttaatgacctatc

SEQ ID NO: 28121 - DNA, 25 bp, Homo sapien
gaatcctttgaaacctatacactta

SEQ ID NO: 28122 - DNA, 25 bp, Homo sapien
gaaacctatacacttaaccactgtg

SEQ ID NO: 28123 - DNA, 25 bp, Homo sapien
aaccactgtgttagctaagagcctc

SEQ ID NO: 28124 - DNA, 25 bp, Homo sapien
gggagtccgaggcgagtgaatcact

SEQ ID NO: 28125 - DNA, 25 bp, Homo sapien
ggaaggatggcttaagctcaggagg

SEQ ID NO: 28126 - DNA, 25 bp, Homo sapien
gattcaattattagccccacttaca

SEQ ID NO: 28127 - DNA, 25 bp, Homo sapien
attagccccacttacagattgggaa

SEQ ID NO: 28128 - DNA, 25 bp, Homo sapien
actgagactcagccaaggttacaca

SEQ ID NO: 28129 - DNA, 25 bp, Homo sapien
gagcaggaatctgcttgcttccaga

SEQ ID NO: 28130 - DNA, 25 bp, Homo sapien
tgcttccagaggctgcacacttatg

SEQ ID NO: 28131 - DNA, 25 bp, Homo sapien
agaggctgcacacttatgtaccaca

SEQ ID NO: 28132 - DNA, 25 bp, Homo sapien
tatgtaccacattagactcaccacc

SEQ ID NO: 28133 - DNA, 25 bp, Homo sapien
ccctcaatcccagccaaaggagtcc

SEQ ID NO: 28134 - DNA, 25 bp, Homo sapien
ggcttttcaatccttagaacctttg

SEQ ID NO: 28135 - DNA, 25 bp, Homo sapien
tccttagaacctttgtctcaaccac

SEQ ID NO: 28136 - DNA, 25 bp, Homo sapien
acaccagtcacatgtgcctgttgaa

SEQ ID NO: 28137 - DNA, 25 bp, Homo sapien
ccagaagacagaccagctgctccag

SEQ ID NO: 28138 - DNA, 25 bp, Homo sapien
gcagaccatctgcaaacgctttgcc

SEQ ID NO: 28139 - DNA, 25 bp, Homo sapien
tgctgaccattgcccataggctcaa

SEQ ID NO: 28140 - DNA, 25 bp, Homo sapien
ataggctcaacacgatcctgaactc

SEQ ID NO: 28141 - DNA, 25 bp, Homo sapien
tgaactcagaccgggtgctggtgct

SEQ ID NO: 28142 - DNA, 25 bp, Homo sapien
gagagtggtagagctggactccccg

SEQ ID NO: 28143 - DNA, 25 bp, Homo sapien
gccgggcctatacagaggtgctggc

SEQ ID NO: 28144 - DNA, 25 bp, Homo sapien
gcaccctggattactctttggaaat

SEQ ID NO: 28145 - DNA, 25 bp, Homo sapien
tggaaatcactccttggtgggcagc

SEQ ID NO: 28146 - DNA, 25 bp, Homo sapien
ccctcttgcatctggaacgccaggt

SEQ ID NO: 28147 - DNA, 25 bp, Homo sapien
ataggagcccacttgcattttcata

SEQ ID NO: 28148 - DNA, 25 bp, Homo sapien
tctcttctacttccttcaatggagg

SEQ ID NO: 28149 - DNA, 25 bp, Homo sapien
tccttcaatggaggcgtctctcctc

SEQ ID NO: 28150 - DNA, 25 bp, Homo sapien
ggaaaaagatatgtaccctgcccag

SEQ ID NO: 28151 - DNA, 25 bp, Homo sapien
agagatcatcgtgctctcagactct

SEQ ID NO: 28152 - DNA, 25 bp, Homo sapien
ctcagactctgatttagctgcctcc

SEQ ID NO: 28153 - DNA, 25 bp, Homo sapien
ccctgcctcccagaatgtttctggg

SEQ ID NO: 28154 - DNA, 25 bp, Homo sapien
gaatgtttctgggattaccatttgg

SEQ ID NO: 28155 - DNA, 25 bp, Homo sapien
ctgggattaccatttggaggaaggt

SEQ ID NO: 28156 - DNA, 25 bp, Homo sapien
aggtgggaacccagatgactgagga

SEQ ID NO: 28157 - DNA, 25 bp, Homo sapien
agatgactgaggaagggatggacta

SEQ ID NO: 28158 - DNA, 25 bp, Homo sapien
ggatggactaagcttatcccctttt

SEQ ID NO: 28159 - DNA, 25 bp, Homo sapien
aggtaaaatcctagcccaagttcat

SEQ ID NO: 28160 - DNA, 25 bp, Homo sapien
aaatcctagcccaagttcatagttt

SEQ ID NO: 28161 - DNA, 25 bp, Homo sapien
tagcccaagttcatagtttattgta

SEQ ID NO: 28162 - DNA, 25 bp, Homo sapien
attacagtttaactccaactatcct

SEQ ID NO: 28163 - DNA, 25 bp, Homo sapien
aactccaactatcctttttaagctg

SEQ ID NO: 28164 - DNA, 25 bp, Homo sapien
actatcctttttaagctgtgtagat

SEQ ID NO: 28165 - DNA, 25 bp, Homo sapien
ataagaatattgagcttcaggccag

SEQ ID NO: 28166 - DNA, 25 bp, Homo sapien
atgcctgtaattcccaaagtgggga

SEQ ID NO: 28167 - DNA, 25 bp, Homo sapien
ctttgtaggattgttgtttgtgtgt

SEQ ID NO: 28168 - DNA, 25 bp, Homo sapien
tttgtgtgtataacttcctcttctc

SEQ ID NO: 28169 - DNA, 25 bp, Homo sapien
cctcttctcttgggaaacacatttt

SEQ ID NO: 28170 - DNA, 25 bp, Homo sapien
ccactgtaggggcagctctaacact

SEQ ID NO: 28171 - DNA, 25 bp, Homo sapien
ggggcagctctaacactttgaggaa

SEQ ID NO: 28172 - DNA, 25 bp, Homo sapien
ctttgaggaacttcagcttctctct

SEQ ID NO: 28173 - DNA, 25 bp, Homo sapien
tctctctgctttagtgtgtgatttc

SEQ ID NO: 28174 - DNA, 25 bp, Homo sapien
cttggtttgttcttaccttatgatg

SEQ ID NO: 28175 - DNA, 25 bp, Homo sapien
tcttaccttatgatgaactttccaa

SEQ ID NO: 28176 - DNA, 25 bp, Homo sapien
tgaactttccaaggtgatacaccac

SEQ ID NO: 28177 - DNA, 25 bp, Homo sapien
tgtcccctgctagccttttagggat

SEQ ID NO: 28178 - DNA, 25 bp, Homo sapien
gggataggtttgaccacttgattcc

SEQ ID NO: 28179 - DNA, 25 bp, Homo sapien
ttgaccacttgattccttcttagga

SEQ ID NO: 28180 - DNA, 25 bp, Homo sapien
atgacatctcaagggtctctgaatg

SEQ ID NO: 28181 - DNA, 25 bp, Homo sapien
ccgccgctgtgattgggtggaagat

SEQ ID NO: 28182 - DNA, 25 bp, Homo sapien
attgggtggaagatggcgctggccg

SEQ ID NO: 28183 - DNA, 25 bp, Homo sapien
gcacgagcgggctcggtggttgggt

SEQ ID NO: 28184 - DNA, 25 bp, Homo sapien
gatggcgctggccggatggaaatcc

SEQ ID NO: 28185 - DNA, 25 bp, Homo sapien
ggccggatggaaatcctaatgacag

SEQ ID NO: 28186 - DNA, 25 bp, Homo sapien
aatgagcactattttggattagtca

SEQ ID NO: 28187 - DNA, 25 bp, Homo sapien
ttttgggaatacctgctactgcaat

SEQ ID NO: 28188 - DNA, 25 bp, Homo sapien
gggaatacctgctactgcaattcag

SEQ ID NO: 28189 - DNA, 25 bp, Homo sapien
acctgctactgcaattcagttcttc

SEQ ID NO: 28190 - DNA, 25 bp, Homo sapien
gcaattcagttcttcaagcacttta

SEQ ID NO: 28191 - DNA, 25 bp, Homo sapien
agttcttcaagcactttatttttgt

SEQ ID NO: 28192 - DNA, 25 bp, Homo sapien
ctcccacagggggctttcgtgagcc

SEQ ID NO: 28193 - DNA, 25 bp, Homo sapien
cacagggggctttcgtgagccaggc

SEQ ID NO: 28194 - DNA, 25 bp, Homo sapien
ggctttcgtgagccaggcagcgagg

SEQ ID NO: 28195 - DNA, 25 bp, Homo sapien
gctttcgtgagccaggcagcgaggg

SEQ ID NO: 28196 - DNA, 25 bp, Homo sapien
tttcgtgagccaggcagcgagggcc

SEQ ID NO: 28197 - DNA, 25 bp, Homo sapien
tccgcacccgggcaaaagccgggag

SEQ ID NO: 28198 - DNA, 25 bp, Homo sapien
ccacgtcccaggggagtccgtggtg

SEQ ID NO: 28199 - DNA, 25 bp, Homo sapien
ccaggggagtccgtggtggggctgg

SEQ ID NO: 28200 - DNA, 25 bp, Homo sapien
gcgcggcaggggcagatgcaaggca

SEQ ID NO: 28201 - DNA, 25 bp, Homo sapien
gcggcaggggcagatgcaaggcatc

SEQ ID NO: 28202 - DNA, 25 bp, Homo sapien
aggggcagatgcaaggcatcccggc

SEQ ID NO: 28203 - DNA, 25 bp, Homo sapien
agtagtgagtgaggtggggcggccc

SEQ ID NO: 28204 - DNA, 25 bp, Homo sapien
ctgggctgggaagggcatcagaaag

SEQ ID NO: 28205 - DNA, 25 bp, Homo sapien
gaagggcatcagaaagagccttgtc

SEQ ID NO: 28206 - DNA, 25 bp, Homo sapien
gcatcagaaagagccttgtcaagga

SEQ ID NO: 28207 - DNA, 25 bp, Homo sapien
gagccttgtcaaggaaccaaggagg

SEQ ID NO: 28208 - DNA, 25 bp, Homo sapien
ggaagtacctggaaggggtcactgg

SEQ ID NO: 28209 - DNA, 25 bp, Homo sapien
gtacctggaaggggtcactgggaga

SEQ ID NO: 28210 - DNA, 25 bp, Homo sapien
cctggaaggggtcactgggagaagc

SEQ ID NO: 28211 - DNA, 25 bp, Homo sapien
gaaggggtcactgggagaagcccca

SEQ ID NO: 28212 - DNA, 25 bp, Homo sapien
attagccgggggtaatggcacgtgc

SEQ ID NO: 28213 - DNA, 25 bp, Homo sapien
ggggtaatggcacgtgcctgcaatc

SEQ ID NO: 28214 - DNA, 25 bp, Homo sapien
cctgccttccttggtagatgatctg

SEQ ID NO: 28215 - DNA, 25 bp, Homo sapien
agatgatctggttccacgactgggc

SEQ ID NO: 28216 - DNA, 25 bp, Homo sapien
acgactgggcttaaagatcagctta

SEQ ID NO: 28217 - DNA, 25 bp, Homo sapien
caaggaggagaggccaggtgtggtg

SEQ ID NO: 28218 - DNA, 25 bp, Homo sapien
gctgaaagtgcaaacggacaaaccc

SEQ ID NO: 28219 - DNA, 25 bp, Homo sapien
caccctcctgccgctggaggaaggt

SEQ ID NO: 28220 - DNA, 25 bp, Homo sapien
ctgccgctggaggaaggtaagtgtg

SEQ ID NO: 28221 - DNA, 25 bp, Homo sapien
gtgtgaacagggcatctcactcacc

SEQ ID NO: 28222 - DNA, 25 bp, Homo sapien
ccctctatccttataggcattcctg

SEQ ID NO: 28223 - DNA, 25 bp, Homo sapien
ctatccttataggcattcctgccct

SEQ ID NO: 28224 - DNA, 25 bp, Homo sapien
cttataggcattcctgccctggagg

SEQ ID NO: 28225 - DNA, 25 bp, Homo sapien
ccacacctggccatcttaagcaatt

SEQ ID NO: 28226 - DNA, 25 bp, Homo sapien
acacctggccatcttaagcaatttt

SEQ ID NO: 28227 - DNA, 25 bp, Homo sapien
acctggccatcttaagcaattttaa

SEQ ID NO: 28228 - DNA, 25 bp, Homo sapien
gcaattttaagctcacgtttatttt

SEQ ID NO: 28229 - DNA, 25 bp, Homo sapien
taaacttcagtagatccttaaaact

SEQ ID NO: 28230 - DNA, 25 bp, Homo sapien
cagcacaagccccgcgtttaaaaat

SEQ ID NO: 28231 - DNA, 25 bp, Homo sapien
aaaattatagacccgtgctcacttc

SEQ ID NO: 28232 - DNA, 25 bp, Homo sapien
acactaaaattggaaccttatagag

SEQ ID NO: 28233 - DNA, 25 bp, Homo sapien
acacacaaattcgtgaagcattcca

SEQ ID NO: 28234 - DNA, 25 bp, Homo sapien
gaggcagtaattaatagcctaccaa

SEQ ID NO: 28235 - DNA, 25 bp, Homo sapien
gccacaggtacaaagaggagctggt

SEQ ID NO: 28236 - DNA, 25 bp, Homo sapien
gacagggaagataattgggcctcca

SEQ ID NO: 28237 - DNA, 25 bp, Homo sapien
ttgggcctccaaggacaatttatga

SEQ ID NO: 28238 - DNA, 25 bp, Homo sapien
aaccaggtacacagcctgagaatag

SEQ ID NO: 28239 - DNA, 25 bp, Homo sapien
acagtcccttacaatttccgtctgt

SEQ ID NO: 28240 - DNA, 25 bp, Homo sapien
ggacacaagagccacatcagtgcta

SEQ ID NO: 28241 - DNA, 25 bp, Homo sapien
ggcagaattcatatagcaccaaagt

SEQ ID NO: 28242 - DNA, 25 bp, Homo sapien
atttccgtctgttggacgaactcga

SEQ ID NO: 28243 - DNA, 25 bp, Homo sapien
atagcaccaaagttgtcctgcaaga

SEQ ID NO: 28244 - DNA, 25 bp, Homo sapien
gtcctgcaagagctttggtgcctaa

SEQ ID NO: 28245 - DNA, 25 bp, Homo sapien
gagctttggtgcctaattatgtcta

SEQ ID NO: 28246 - DNA, 25 bp, Homo sapien
gagatggcacagttagctggggtct

SEQ ID NO: 28247 - DNA, 25 bp, Homo sapien
tgcctaagcacccggagctggcaga

SEQ ID NO: 28248 - DNA, 25 bp, Homo sapien
acaagaatgtgcccaaccttcacgt

SEQ ID NO: 28249 - DNA, 25 bp, Homo sapien
tcccggggctgcgtgaaggaacagt

SEQ ID NO: 28250 - DNA, 25 bp, Homo sapien
gagacatttctactggtaccttacc

SEQ ID NO: 28251 - DNA, 25 bp, Homo sapien
tagccagtatctccgtgattacctt

SEQ ID NO: 28252 - DNA, 25 bp, Homo sapien
ctgccaagatgctgatgcctaagaa

SEQ ID NO: 28253 - DNA, 25 bp, Homo sapien
cgcagccgtccagagactggcaggc

SEQ ID NO: 28254 - DNA, 25 bp, Homo sapien
ggagggtaagcgacctgcaagactc

SEQ ID NO: 28255 - DNA, 25 bp, Homo sapien
atacctacagacggtgttctgtgcc

SEQ ID NO: 28256 - DNA, 25 bp, Homo sapien
agaggcagatgtggtcgtggacgtg

SEQ ID NO: 28257 - DNA, 25 bp, Homo sapien
gattgccattcatgaactccttttt

SEQ ID NO: 28258 - DNA, 25 bp, Homo sapien
tcctggggaaggttccagtccctgg

SEQ ID NO: 28259 - DNA, 25 bp, Homo sapien
gaatacccagggcctcaaacttgaa

SEQ ID NO: 28260 - DNA, 25 bp, Homo sapien
tcactcctccaatgtctgggacttg

SEQ ID NO: 28261 - DNA, 25 bp, Homo sapien
ccagctcagcccgttaggatgaggg

SEQ ID NO: 28262 - DNA, 25 bp, Homo sapien
acaagactgcgaatggcgctcaggc

SEQ ID NO: 28263 - DNA, 25 bp, Homo sapien
atggcgctcaggcagggagcaggga

SEQ ID NO: 28264 - DNA, 25 bp, Homo sapien
ggagcagggagtggcgtttggcttg

SEQ ID NO: 28265 - DNA, 25 bp, Homo sapien
ttcccatgtggccagatgctggggc

SEQ ID NO: 28266 - DNA, 25 bp, Homo sapien
ctggcttataaaggtgcctggcctg

SEQ ID NO: 28267 - DNA, 25 bp, Homo sapien
aagagaacctcagatgatgtacctg

SEQ ID NO: 28268 - DNA, 25 bp, Homo sapien
tcagggttttgtttcagagggatat

SEQ ID NO: 28269 - DNA, 25 bp, Homo sapien
tcaggggtttgacgtccatcagtag

SEQ ID NO: 28270 - DNA, 25 bp, Homo sapien
cagtaggaaccagctccaatgcacc

SEQ ID NO: 28271 - DNA, 25 bp, Homo sapien
gaaatacttttcttcttgcaacttt

SEQ ID NO: 28272 - DNA, 25 bp, Homo sapien
tgtggtaacccaactataacctgcc

SEQ ID NO: 28273 - DNA, 25 bp, Homo sapien
caactataacctgccctcataacag

SEQ ID NO: 28274 - DNA, 25 bp, Homo sapien
caattgtcatcatagtggagtccag

SEQ ID NO: 28275 - DNA, 25 bp, Homo sapien
catagtggagtccaggtgcctttaa

SEQ ID NO: 28276 - DNA, 25 bp, Homo sapien
gacaacagggatcaacgacgggacc

SEQ ID NO: 28277 - DNA, 25 bp, Homo sapien
ttcacctgcataccatcatctaagc

SEQ ID NO: 28278 - DNA, 25 bp, Homo sapien
tgtactctgggtgtcagcatctgtc

SEQ ID NO: 28279 - DNA, 25 bp, Homo sapien
ccttccacttgcctgagctgaagtg

SEQ ID NO: 28280 - DNA, 25 bp, Homo sapien
atgcctcagtcaacttctcagagtt

SEQ ID NO: 28281 - DNA, 25 bp, Homo sapien
ggtggaaggccatgtctgctaaaga

SEQ ID NO: 28282 - DNA, 25 bp, Homo sapien
ggagaccctaagaagccgagaggca

SEQ ID NO: 28283 - DNA, 25 bp, Homo sapien
gaaatgaaaacctatatccctccta

SEQ ID NO: 28284 - DNA, 25 bp, Homo sapien
gttcgaggattccaatgcacccaag

SEQ ID NO: 28285 - DNA, 25 bp, Homo sapien
tttttgctgttctgctctgagtatt

SEQ ID NO: 28286 - DNA, 25 bp, Homo sapien
ttctgctctgagtattgcccaaaaa

SEQ ID NO: 28287 - DNA, 25 bp, Homo sapien
tcaaaggagagcatcctggcctgcc

SEQ ID NO: 28288 - DNA, 25 bp, Homo sapien
tggcctgcctattagcgatgttgca

SEQ ID NO: 28289 - DNA, 25 bp, Homo sapien
ggatacagctacatatcgagctaaa

SEQ ID NO: 28290 - DNA, 25 bp, Homo sapien
agaagaagcacccagatgcctcagt

SEQ ID NO: 28291 - DNA, 25 bp, Homo sapien
agacaaggattttaaggcagttata

SEQ ID NO: 28292 - DNA, 25 bp, Homo sapien
gaatggcagaagaggccggggcaca

SEQ ID NO: 28293 - DNA, 25 bp, Homo sapien
agaagaggccggggcacagtggctc

SEQ ID NO: 28294 - DNA, 25 bp, Homo sapien
gagaatgatgtgaacccgggaggcc

SEQ ID NO: 28295 - DNA, 25 bp, Homo sapien
tgatgtgaacccgggaggccagagc

SEQ ID NO: 28296 - DNA, 25 bp, Homo sapien
gaaatgctagccaaactgcaggcag

SEQ ID NO: 28297 - DNA, 25 bp, Homo sapien
gctagccaaactgcaggcagatcaa

SEQ ID NO: 28298 - DNA, 25 bp, Homo sapien
acaacagtcaatagaaacaagccct

SEQ ID NO: 28299 - DNA, 25 bp, Homo sapien
acaagccctgagattaaatgccttt

SEQ ID NO: 28300 - DNA, 25 bp, Homo sapien
gccctgagattaaatgcctttgatg

SEQ ID NO: 28301 - DNA, 25 bp, Homo sapien
atgcctttgatgttgaaattttcag

SEQ ID NO: 28302 - DNA, 25 bp, Homo sapien
tttatggacaacacgagccgctcca

SEQ ID NO: 28303 - DNA, 25 bp, Homo sapien
gctccagcatccgcagtgtaaaagg

SEQ ID NO: 28304 - DNA, 25 bp, Homo sapien
gcagtgtaaaaggccccgtgtgtga

SEQ ID NO: 28305 - DNA, 25 bp, Homo sapien
ggccccgtgtgtgagggggacgtgc

SEQ ID NO: 28306 - DNA, 25 bp, Homo sapien
tgtgtgagggggacgtgctcaccct

SEQ ID NO: 28307 - DNA, 25 bp, Homo sapien
cagccacgtgcagcctatcaagctg

SEQ ID NO: 28308 - DNA, 25 bp, Homo sapien
gcagcctatcaagctggccagggtc

SEQ ID NO: 28309 - DNA, 25 bp, Homo sapien
ggtcaccgaggtcctgggcaggacc

SEQ ID NO: 28310 - DNA, 25 bp, Homo sapien
gaggtcctgggcaggaccggctctc

SEQ ID NO: 28311 - DNA, 25 bp, Homo sapien
tcagggacactgcacgcaggtgcgc

SEQ ID NO: 28312 - DNA, 25 bp, Homo sapien
ggtgcgcgtggaatttatggacaac

SEQ ID NO: 28313 - DNA, 25 bp, Homo sapien
gtcttgactgatctcatattccttc

SEQ ID NO: 28314 - DNA, 25 bp, Homo sapien
tcatattccttcttgggcatagctc

SEQ ID NO: 28315 - DNA, 25 bp, Homo sapien
caagcagtaaatcttcactctccca

SEQ ID NO: 28316 - DNA, 25 bp, Homo sapien
cactgccgtcagccaagtgttcatt

SEQ ID NO: 28317 - DNA, 25 bp, Homo sapien
gttcattttgtccaccacaaagata

SEQ ID NO: 28318 - DNA, 25 bp, Homo sapien
aagataggtgtttttgggatttgat

SEQ ID NO: 28319 - DNA, 25 bp, Homo sapien
ggatttgataggttgcatgaaggaa

SEQ ID NO: 28320 - DNA, 25 bp, Homo sapien
aatagaccgtaaatgcagaatctct

SEQ ID NO: 28321 - DNA, 25 bp, Homo sapien
gcagaatctctgtgtttacttggaa

SEQ ID NO: 28322 - DNA, 25 bp, Homo sapien
tggaaacaggctagtcattgacaac

SEQ ID NO: 28323 - DNA, 25 bp, Homo sapien
agtcattgacaacacctttaaggat

SEQ ID NO: 28324 - DNA, 25 bp, Homo sapien
tgcccagctgaagcttgcattttaa

SEQ ID NO: 28325 - DNA, 25 bp, Homo sapien
taaacacccagtttagtactcacct

SEQ ID NO: 28326 - DNA, 25 bp, Homo sapien
ctttccactgcttctaacaaatccg

SEQ ID NO: 28327 - DNA, 25 bp, Homo sapien
ttccactgcttctaacaaatccgcc

SEQ ID NO: 28328 - DNA, 25 bp, Homo sapien
tgcatatgctttctcaacattcact

SEQ ID NO: 28329 - DNA, 25 bp, Homo sapien
atatgctttctcaacattcactgtc

SEQ ID NO: 28330 - DNA, 25 bp, Homo sapien
tgctttctcaacattcactgtcaaa

SEQ ID NO: 28331 - DNA, 25 bp, Homo sapien
tgtcaaaaatgccctaccaggacac

SEQ ID NO: 28332 - DNA, 25 bp, Homo sapien
gacacaacatagtgacaataacaca

SEQ ID NO: 28333 - DNA, 25 bp, Homo sapien
ataacacattcaatttaaggataat

SEQ ID NO: 28334 - DNA, 25 bp, Homo sapien
gagagggaaccagctaagaacttac

SEQ ID NO: 28335 - DNA, 25 bp, Homo sapien
ggaagaggcggctcatcttcacagt

SEQ ID NO: 28336 - DNA, 25 bp, Homo sapien
cacgtccagcaccacgggtgagacg

SEQ ID NO: 28337 - DNA, 25 bp, Homo sapien
gcaccacgggtgagacggacaccgt

SEQ ID NO: 28338 - DNA, 25 bp, Homo sapien
gagacggacaccgtggtatggaacg

SEQ ID NO: 28339 - DNA, 25 bp, Homo sapien
gatccaccacaagacagagatggac

SEQ ID NO: 28340 - DNA, 25 bp, Homo sapien
gacagagatggaccgcaacattacg

SEQ ID NO: 28341 - DNA, 25 bp, Homo sapien
atggaccgcaacattacgggccacg

SEQ ID NO: 28342 - DNA, 25 bp, Homo sapien
ggaagtgcccagcccgagaggctgg

SEQ ID NO: 28343 - DNA, 25 bp, Homo sapien
ggctgggaggtttgttgagggtgtg

SEQ ID NO: 28344 - DNA, 25 bp, Homo sapien
tcctcccctctgggaattgggcagc

SEQ ID NO: 28345 - DNA, 25 bp, Homo sapien
ggtgtggggcgagtagagacttccc

SEQ ID NO: 28346 - DNA, 25 bp, Homo sapien
gagacacttgaactcgagaaagact

SEQ ID NO: 28347 - DNA, 25 bp, Homo sapien
ggggcctggagattaagagcttgga

SEQ ID NO: 28348 - DNA, 25 bp, Homo sapien
gagcttggactctggattggaaagg

SEQ ID NO: 28349 - DNA, 25 bp, Homo sapien
attggaaaggctcagtttcagtatc

SEQ ID NO: 28350 - DNA, 25 bp, Homo sapien
atctgataccttgtactatacgcct

SEQ ID NO: 28351 - DNA, 25 bp, Homo sapien
gtactatacgccttggacagattcc

SEQ ID NO: 28352 - DNA, 25 bp, Homo sapien
cttggacagattccttaatttctct

SEQ ID NO: 28353 - DNA, 25 bp, Homo sapien
aatactgacagtaggctgggcacag

SEQ ID NO: 28354 - DNA, 25 bp, Homo sapien
cagcactttggcacctgaggctggc

SEQ ID NO: 28355 - DNA, 25 bp, Homo sapien
actttggcacctgaggctggcagat

SEQ ID NO: 28356 - DNA, 25 bp, Homo sapien
ggaggcggagattgtggtgagtcga

SEQ ID NO: 28357 - DNA, 25 bp, Homo sapien
ctcacacacagcctcgtgggtaggg

SEQ ID NO: 28358 - DNA, 25 bp, Homo sapien
gcctcgtgggtagggtcagcagacc

SEQ ID NO: 28359 - DNA, 25 bp, Homo sapien
gaggtctggttgatgatctagcact

SEQ ID NO: 28360 - DNA, 25 bp, Homo sapien
atggacgtggagaggatcagagtga

SEQ ID NO: 28361 - DNA, 25 bp, Homo sapien
aagagtgtatgaagtgcattccaat

SEQ ID NO: 28362 - DNA, 25 bp, Homo sapien
gtgcattccaatggtgggcaaaaca

SEQ ID NO: 28363 - DNA, 25 bp, Homo sapien
aaaacaggctcctgctcttgtggag

SEQ ID NO: 28364 - DNA, 25 bp, Homo sapien
gaggtcacaatctagtggaggaggg

SEQ ID NO: 28365 - DNA, 25 bp, Homo sapien
aggagggatgttactagaaatgcac

SEQ ID NO: 28366 - DNA, 25 bp, Homo sapien
caaagtgggctgaacacagtggctc

SEQ ID NO: 28367 - DNA, 25 bp, Homo sapien
ttgaggttagaagttagagtccagc

SEQ ID NO: 28368 - DNA, 25 bp, Homo sapien
ggaaagcccctaaagtcctgatcta

SEQ ID NO: 28369 - DNA, 25 bp, Homo sapien
agtcctgatctacgatgcatccaat

SEQ ID NO: 28370 - DNA, 25 bp, Homo sapien
aggggtcccatcaaggttcagtgga

SEQ ID NO: 28371 - DNA, 25 bp, Homo sapien
gaagtggttctgggacagattttac

SEQ ID NO: 28372 - DNA, 25 bp, Homo sapien
gacagattttactttcaccatcgcc

SEQ ID NO: 28373 - DNA, 25 bp, Homo sapien
ctgcagcctgacgattttgcaacat

SEQ ID NO: 28374 - DNA, 25 bp, Homo sapien
tcctccctgtctgcatctgtaggag

SEQ ID NO: 28375 - DNA, 25 bp, Homo sapien
cactttcggccctgggaccaaagtg

SEQ ID NO: 28376 - DNA, 25 bp, Homo sapien
aggagacagagtcaccatcacttgc

SEQ ID NO: 28377 - DNA, 25 bp, Homo sapien
tcaccatcacttgccaggcgagtca

SEQ ID NO: 28378 - DNA, 25 bp, Homo sapien
acttgccaggcgagtcaggacatta

SEQ ID NO: 28379 - DNA, 25 bp, Homo sapien
taaaaactggtccaggcgcagtggc

SEQ ID NO: 28380 - DNA, 25 bp, Homo sapien
aaaaactggtccaggcgcagtggct

SEQ ID NO: 28381 - DNA, 25 bp, Homo sapien
aatactagagattaggccaggcaca

SEQ ID NO: 28382 - DNA, 25 bp, Homo sapien
tactagagattaggccaggcacagt

SEQ ID NO: 28383 - DNA, 25 bp, Homo sapien
ctagagattaggccaggcacagtga

SEQ ID NO: 28384 - DNA, 25 bp, Homo sapien
tgtgatcccaacactcggggaggtt

SEQ ID NO: 28385 - DNA, 25 bp, Homo sapien
gtgatcccaacactcggggaggttg

SEQ ID NO: 28386 - DNA, 25 bp, Homo sapien
tgatcccaacactcggggaggttga

SEQ ID NO: 28387 - DNA, 25 bp, Homo sapien
gatcccaacactcggggaggttgag

SEQ ID NO: 28388 - DNA, 25 bp, Homo sapien
tcccaacactcggggaggttgaggc

SEQ ID NO: 28389 - DNA, 25 bp, Homo sapien
ccaacactcggggaggttgaggcta

SEQ ID NO: 28390 - DNA, 25 bp, Homo sapien
tgctctcagcgcagttttagtcctg

SEQ ID NO: 28391 - DNA, 25 bp, Homo sapien
accaggcttgtgtgtcttgtgttgt

SEQ ID NO: 28392 - DNA, 25 bp, Homo sapien
ttcgtggccatcctgcagatgagca

SEQ ID NO: 28393 - DNA, 25 bp, Homo sapien
gcagatgagcaccgtgtccagtgcc

SEQ ID NO: 28394 - DNA, 25 bp, Homo sapien
tgtccagtgccacagcacaaggcgc

SEQ ID NO: 28395 - DNA, 25 bp, Homo sapien
cctttgggctggacgggaacacacg

SEQ ID NO: 28396 - DNA, 25 bp, Homo sapien
aaagctcagcctggactgtggcagc

SEQ ID NO: 28397 - DNA, 25 bp, Homo sapien
gaagttggcgtgaacgtggcgtttg

SEQ ID NO: 28398 - DNA, 25 bp, Homo sapien
gaacgtggcgtttgtgggagtgtca

SEQ ID NO: 28399 - DNA, 25 bp, Homo sapien
gggagtgtcactgagatggcccgtg

SEQ ID NO: 28400 - DNA, 25 bp, Homo sapien
gctgcagaggggccctcagtgtggc

SEQ ID NO: 28401 - DNA, 25 bp, Homo sapien
tgggttaagtcatgtttgatacagg

SEQ ID NO: 28402 - DNA, 25 bp, Homo sapien
tttgaataataactgatcccctttt

SEQ ID NO: 28403 - DNA, 25 bp, Homo sapien
ttccctgaatgtactgatcttttca

SEQ ID NO: 28404 - DNA, 25 bp, Homo sapien
gatcttttcagtttaagatttggcc

SEQ ID NO: 28405 - DNA, 25 bp, Homo sapien
attatatcatttcccacatagttgt

SEQ ID NO: 28406 - DNA, 25 bp, Homo sapien
atttcccacatagttgtaacagttt

SEQ ID NO: 28407 - DNA, 25 bp, Homo sapien
aagtttaaagactattctgcacaat

SEQ ID NO: 28408 - DNA, 25 bp, Homo sapien
tctgcacaatagaaagcttggctgt

SEQ ID NO: 28409 - DNA, 25 bp, Homo sapien
cttggctgtgtccagactttcttgt

SEQ ID NO: 28410 - DNA, 25 bp, Homo sapien
cagactttcttgtgaggcagcagga

SEQ ID NO: 28411 - DNA, 25 bp, Homo sapien
gcaggaagctgtaagactttaaggg

SEQ ID NO: 28412 - DNA, 25 bp, Homo sapien
catgtcaaatactgtgtttctggca

SEQ ID NO: 28413 - DNA, 25 bp, Homo sapien
gtaatagatctaaatagcagcccac

SEQ ID NO: 28414 - DNA, 25 bp, Homo sapien
atagcagcccacaaacttggccagg

SEQ ID NO: 28415 - DNA, 25 bp, Homo sapien
cagcccacaaacttggccaggcaac

SEQ ID NO: 28416 - DNA, 25 bp, Homo sapien
tggccaggcaacaaacatcccattc

SEQ ID NO: 28417 - DNA, 25 bp, Homo sapien
aacatcccattcttgattgtcttta

SEQ ID NO: 28418 - DNA, 25 bp, Homo sapien
taaaccaatgtaattctacttctga

SEQ ID NO: 28419 - DNA, 25 bp, Homo sapien
cctcctgagtggcaagacatttcaa

SEQ ID NO: 28420 - DNA, 25 bp, Homo sapien
gtggcaagacatttcaagtcagaat

SEQ ID NO: 28421 - DNA, 25 bp, Homo sapien
gtcagaattactggggtctggttgg

SEQ ID NO: 28422 - DNA, 25 bp, Homo sapien
aatacaaacattatctggttatggt

SEQ ID NO: 28423 - DNA, 25 bp, Homo sapien
tatgagcaccgcgaggagttccaga

SEQ ID NO: 28424 - DNA, 25 bp, Homo sapien
gcacctctgagtccatagaccaggc

SEQ ID NO: 28425 - DNA, 25 bp, Homo sapien
tgagtccatagaccaggcctgggag

SEQ ID NO: 28426 - DNA, 25 bp, Homo sapien
ggcctgggagaatgccaagctgcct

SEQ ID NO: 28427 - DNA, 25 bp, Homo sapien
ccctttccctgactgtcaaggacaa

SEQ ID NO: 28428 - DNA, 25 bp, Homo sapien
tgactgtcaaggacaactgactccc

SEQ ID NO: 28429 - DNA, 25 bp, Homo sapien
caccccatcagctgggaaagcccag

SEQ ID NO: 28430 - DNA, 25 bp, Homo sapien
cagctgggaaagcccaggccgcagg

SEQ ID NO: 28431 - DNA, 25 bp, Homo sapien
gcccaggccgcaggagtgggatgcc

SEQ ID NO: 28432 - DNA, 25 bp, Homo sapien
agctctcaaaggtcactcctgggag

SEQ ID NO: 28433 - DNA, 25 bp, Homo sapien
gagtttcttcttcccaatggaagtg

SEQ ID NO: 28434 - DNA, 25 bp, Homo sapien
atattttcactgtggcttggaaatc

SEQ ID NO: 28435 - DNA, 25 bp, Homo sapien
gtggcttggaaatcataacttatgc

SEQ ID NO: 28436 - DNA, 25 bp, Homo sapien
cttatgcatttatcgacacagtttt

SEQ ID NO: 28437 - DNA, 25 bp, Homo sapien
atcgacacagttttcaatgcacata

SEQ ID NO: 28438 - DNA, 25 bp, Homo sapien
gataatgtgtattgggcaggttttg

SEQ ID NO: 28439 - DNA, 25 bp, Homo sapien
attgggcaggttttgtatgctaaaa

SEQ ID NO: 28440 - DNA, 25 bp, Homo sapien
gagaacaaccagatcattactgaaa

SEQ ID NO: 28441 - DNA, 25 bp, Homo sapien
attacattatatttcaacatccttg

SEQ ID NO: 28442 - DNA, 25 bp, Homo sapien
aggagatcgagaccactgtggctaa

SEQ ID NO: 28443 - DNA, 25 bp, Homo sapien
gagaccactgtggctaacatggtga

SEQ ID NO: 28444 - DNA, 25 bp, Homo sapien
ttagccaggtggcaggcgtctgtag

SEQ ID NO: 28445 - DNA, 25 bp, Homo sapien
ggaaattagattgcttgtagaagtt

SEQ ID NO: 28446 - DNA, 25 bp, Homo sapien
atgggaaggatgctgagtgtttctt

SEQ ID NO: 28447 - DNA, 25 bp, Homo sapien
tgaatgcccacaaaaaagtttacac

SEQ ID NO: 28448 - DNA, 25 bp, Homo sapien
gtttacacctacgtagagtcactag

SEQ ID NO: 28449 - DNA, 25 bp, Homo sapien
gagtcactagaggttggaatggccg

SEQ ID NO: 28450 - DNA, 25 bp, Homo sapien
gaggttggaatggccgtgttgtccc

SEQ ID NO: 28451 - DNA, 25 bp, Homo sapien
gtgttgtcccgaaagagcttcagta

SEQ ID NO: 28452 - DNA, 25 bp, Homo sapien
tccttctctctaaccttgatacagg

SEQ ID NO: 28453 - DNA, 25 bp, Homo sapien
gggttttatggtttgctgaaggctt

SEQ ID NO: 28454 - DNA, 25 bp, Homo sapien
gctgaaggcttgcattttcatcaga

SEQ ID NO: 28455 - DNA, 25 bp, Homo sapien
tgactgtgatcgcccagagtctgtc

SEQ ID NO: 28456 - DNA, 25 bp, Homo sapien
gtgaacctgggagtcggatcttgca

SEQ ID NO: 28457 - DNA, 25 bp, Homo sapien
gggagtcggatcttgcagtgagccg

SEQ ID NO: 28458 - DNA, 25 bp, Homo sapien
tgttgtcgttgttttaattataagg

SEQ ID NO: 28459 - DNA, 25 bp, Homo sapien
gagctgaagtaggctaagtaccctg

SEQ ID NO: 28460 - DNA, 25 bp, Homo sapien
aggctaagtaccctgttctgttgct

SEQ ID NO: 28461 - DNA, 25 bp, Homo sapien
tgttctgttgctctggtgatctcag

SEQ ID NO: 28462 - DNA, 25 bp, Homo sapien
gctctggtgatctcagtaaaatcct

SEQ ID NO: 28463 - DNA, 25 bp, Homo sapien
gcagggccctatgcatcagaattta

SEQ ID NO: 28464 - DNA, 25 bp, Homo sapien
aagacaaagcaactcactgtatttt

SEQ ID NO: 28465 - DNA, 25 bp, Homo sapien
aaagcaactcactgtattttttgga

SEQ ID NO: 28466 - DNA, 25 bp, Homo sapien
gacaatgtaggcttgatgatagatc

SEQ ID NO: 28467 - DNA, 25 bp, Homo sapien
taactgataccatatattctgcccc

SEQ ID NO: 28468 - DNA, 25 bp, Homo sapien
gaaggtactttgtaatattcctcgc

SEQ ID NO: 28469 - DNA, 25 bp, Homo sapien
tcgcccgccttaagaaggtactttg

SEQ ID NO: 28470 - DNA, 25 bp, Homo sapien
gtactttgtaatattctccccaact

SEQ ID NO: 28471 - DNA, 25 bp, Homo sapien
tttgtaatattctccccaactttag

SEQ ID NO: 28472 - DNA, 25 bp, Homo sapien
taatattctccccaactttagaagg

SEQ ID NO: 28473 - DNA, 25 bp, Homo sapien
tagaaggtactttgtaatattctcc

SEQ ID NO: 28474 - DNA, 25 bp, Homo sapien
taagaaggtactttgtaatattctc

SEQ ID NO: 28475 - DNA, 25 bp, Homo sapien
tattctcccccacaactttagaagg

SEQ ID NO: 28476 - DNA, 25 bp, Homo sapien
ttagaaggtactttgtaatattctc

SEQ ID NO: 28477 - DNA, 25 bp, Homo sapien
agaaggtacttcgaggctgggtgcg

SEQ ID NO: 28478 - DNA, 25 bp, Homo sapien
tgacaaatgagaatcctctccaccc

SEQ ID NO: 28479 - DNA, 25 bp, Homo sapien
tacccaagtgtttcatgcctcatgg

SEQ ID NO: 28480 - DNA, 25 bp, Homo sapien
ggaaagagatacttgcacatgcatt

SEQ ID NO: 28481 - DNA, 25 bp, Homo sapien
accagcccaaatactcatcagtcaa

SEQ ID NO: 28482 - DNA, 25 bp, Homo sapien
atggcattcgctgcaaactggatgg

SEQ ID NO: 28483 - DNA, 25 bp, Homo sapien
atgggactggggactattatctaag

SEQ ID NO: 28484 - DNA, 25 bp, Homo sapien
aagccaaatgtcgtatgttctcact

SEQ ID NO: 28485 - DNA, 25 bp, Homo sapien
ggactttggcgagtcagggggctga

SEQ ID NO: 28486 - DNA, 25 bp, Homo sapien
gggctgaaagggtgggaggacggtg

SEQ ID NO: 28487 - DNA, 25 bp, Homo sapien
gggtgcacgaaaatctcataaatca

SEQ ID NO: 28488 - DNA, 25 bp, Homo sapien
aacttactcatataaccaaacacca

SEQ ID NO: 28489 - DNA, 25 bp, Homo sapien
tcctgaggaacatgcgctttgccaa

SEQ ID NO: 28490 - DNA, 25 bp, Homo sapien
atggccaagtccaagaaccacacca

SEQ ID NO: 28491 - DNA, 25 bp, Homo sapien
gccaaggccatgagtgcacgtgcaa

SEQ ID NO: 28492 - DNA, 25 bp, Homo sapien
gctatcaaggccctggtaaagccca

SEQ ID NO: 28493 - DNA, 25 bp, Homo sapien
ccaaagggtgtcagccacaagctcc

SEQ ID NO: 28494 - DNA, 25 bp, Homo sapien
acattgcccactccaagcttgggaa

SEQ ID NO: 28495 - DNA, 25 bp, Homo sapien
aagcatgatcatgcccacattgcca

SEQ ID NO: 28496 - DNA, 25 bp, Homo sapien
gccaaagggctcaggctgtgtgggc

SEQ ID NO: 28497 - DNA, 25 bp, Homo sapien
ccaaggatcaaaccaaggcccagcc

SEQ ID NO: 28498 - DNA, 25 bp, Homo sapien
acacaactggtcccgaatatggcac

SEQ ID NO: 28499 - DNA, 25 bp, Homo sapien
ttgcctcaagaaaccccaatcacaa

SEQ ID NO: 28500 - DNA, 25 bp, Homo sapien
ggagttcaagatcaaccaacatagc

SEQ ID NO: 28501 - DNA, 25 bp, Homo sapien
caaccaacatagcaagaccctgtct

SEQ ID NO: 28502 - DNA, 25 bp, Homo sapien
taagctacctaaagtgttatgagaa

SEQ ID NO: 28503 - DNA, 25 bp, Homo sapien
aatgaggccggacatggtggctcac

SEQ ID NO: 28504 - DNA, 25 bp, Homo sapien
aatcccaacactttgcgaggctaag

SEQ ID NO: 28505 - DNA, 25 bp, Homo sapien
tgcgaggctaaggcgggtgggtcac

SEQ ID NO: 28506 - DNA, 25 bp, Homo sapien
gaccagcctgaccaagaatgataag

SEQ ID NO: 28507 - DNA, 25 bp, Homo sapien
gaatgataagaccctgtctctacta

SEQ ID NO: 28508 - DNA, 25 bp, Homo sapien
ccaactactagggaggctgaggcag

SEQ ID NO: 28509 - DNA, 25 bp, Homo sapien
cagaggttgcaatgagccaagatga

SEQ ID NO: 28510 - DNA, 25 bp, Homo sapien
agatgatgccattgcatgccagccc

SEQ ID NO: 28511 - DNA, 25 bp, Homo sapien
cgcggctgctgcgatgaccaaaata

SEQ ID NO: 28512 - DNA, 25 bp, Homo sapien
tagattcgatgggcccgaggctcag

SEQ ID NO: 28513 - DNA, 25 bp, Homo sapien
tcaggaggaggcgtgctccggggag

SEQ ID NO: 28514 - DNA, 25 bp, Homo sapien
cgcacctaccaggagctgctggtta

SEQ ID NO: 28515 - DNA, 25 bp, Homo sapien
agatctgtgcttcgccgtaaggaaa

SEQ ID NO: 28516 - DNA, 25 bp, Homo sapien
ctcacgcggaacctctacaaatgca

SEQ ID NO: 28517 - DNA, 25 bp, Homo sapien
gaagcagaagcagcttcggcgcggg

SEQ ID NO: 28518 - DNA, 25 bp, Homo sapien
gaagacacactgcccattgaggtat

SEQ ID NO: 28519 - DNA, 25 bp, Homo sapien
cattgaggtatactgccatcttcca

SEQ ID NO: 28520 - DNA, 25 bp, Homo sapien
tgccatcttccagtcatgtgtgagg

SEQ ID NO: 28521 - DNA, 25 bp, Homo sapien
gcaggcaagtgtttggggcatttca

SEQ ID NO: 28522 - DNA, 25 bp, Homo sapien
aaatctctttaatatatgtctggct

SEQ ID NO: 28523 - DNA, 25 bp, Homo sapien
gcttattagaagacagctggctggc

SEQ ID NO: 28524 - DNA, 25 bp, Homo sapien
ctggctggctttgcatatcacacat

SEQ ID NO: 28525 - DNA, 25 bp, Homo sapien
tatcacacattatgcagcctttgga

SEQ ID NO: 28526 - DNA, 25 bp, Homo sapien
aaaaccccactatacactcaagaga

SEQ ID NO: 28527 - DNA, 25 bp, Homo sapien
gagtgaagtggcagacaatgtctta

SEQ ID NO: 28528 - DNA, 25 bp, Homo sapien
atacttttgacccaatggactgcat

SEQ ID NO: 28529 - DNA, 25 bp, Homo sapien
tggactgcattaaatggtctcgggg

SEQ ID NO: 28530 - DNA, 25 bp, Homo sapien
taaatggtctcggggatctccagag

SEQ ID NO: 28531 - DNA, 25 bp, Homo sapien
ggtccccagaccatacactgaggac

SEQ ID NO: 28532 - DNA, 25 bp, Homo sapien
catacactgaggaccagcgatgcaa

SEQ ID NO: 28533 - DNA, 25 bp, Homo sapien
caagggctgttgttcaccatattgg

SEQ ID NO: 28534 - DNA, 25 bp, Homo sapien
accatattgggtgggcaactgcacg

SEQ ID NO: 28535 - DNA, 25 bp, Homo sapien
gggtgggcaactgcacgatagaaca

SEQ ID NO: 28536 - DNA, 25 bp, Homo sapien
tgtggaatgtggcacagcccaggtc

SEQ ID NO: 28537 - DNA, 25 bp, Homo sapien
gagaagtcagtgttcacaagggcga

SEQ ID NO: 28538 - DNA, 25 bp, Homo sapien
gttcacaagggcgagggcagcccgg

SEQ ID NO: 28539 - DNA, 25 bp, Homo sapien
ggtttcgtgcttctaggacagggaa

SEQ ID NO: 28540 - DNA, 25 bp, Homo sapien
ggactctccgtctctgagggagtag

SEQ ID NO: 28541 - DNA, 25 bp, Homo sapien
cgtctctgagggagtagccagcagg

SEQ ID NO: 28542 - DNA, 25 bp, Homo sapien
aatgccttgtactaatagaatgctt

SEQ ID NO: 28543 - DNA, 25 bp, Homo sapien
gaataccgagtatttggccaggtgc

SEQ ID NO: 28544 - DNA, 25 bp, Homo sapien
gtctgattaatttgttattggatgt

SEQ ID NO: 28545 - DNA, 25 bp, Homo sapien
ttggatgtattctgtatctttcttt

SEQ ID NO: 28546 - DNA, 25 bp, Homo sapien
acttttatccacttagcacgaatga

SEQ ID NO: 28547 - DNA, 25 bp, Homo sapien
tccacttagcacgaatgattctatt

SEQ ID NO: 28548 - DNA, 25 bp, Homo sapien
gagtgcttacacttatggagctaac

SEQ ID NO: 28549 - DNA, 25 bp, Homo sapien
acttatggagctaacattttcagag

SEQ ID NO: 28550 - DNA, 25 bp, Homo sapien
gtagtttaagtttccttgtgattag

SEQ ID NO: 28551 - DNA, 25 bp, Homo sapien
agtttccttgtgattagtcaaaaat

SEQ ID NO: 28552 - DNA, 25 bp, Homo sapien
tgaagtctattatttgttgtcccat

SEQ ID NO: 28553 - DNA, 25 bp, Homo sapien
attctagcttagtctacacagattt

SEQ ID NO: 28554 - DNA, 25 bp, Homo sapien
acacagatttttatatcaatttgtt

SEQ ID NO: 28555 - DNA, 25 bp, Homo sapien
atagattaaatttgggccgggcacg

SEQ ID NO: 28556 - DNA, 25 bp, Homo sapien
ttagccaagcatggtggcgggcgcc

SEQ ID NO: 28557 - DNA, 25 bp, Homo sapien
gattaaatttgtacccacaaaatgg

SEQ ID NO: 28558 - DNA, 25 bp, Homo sapien
aagtactgatacatgttaccacatg

SEQ ID NO: 28559 - DNA, 25 bp, Homo sapien
catgttaccacatggatggacatta

SEQ ID NO: 28560 - DNA, 25 bp, Homo sapien
tattatgccaagtgagagaggccac

SEQ ID NO: 28561 - DNA, 25 bp, Homo sapien
gagaggccaccacgaaaggcaacac

SEQ ID NO: 28562 - DNA, 25 bp, Homo sapien
accacgaaaggcaacacatactata

SEQ ID NO: 28563 - DNA, 25 bp, Homo sapien
ggcaacacatactatattatttcat

SEQ ID NO: 28564 - DNA, 25 bp, Homo sapien
ataaatgttcaggggcaggtccaga

SEQ ID NO: 28565 - DNA, 25 bp, Homo sapien
tgttcaggggcaggtccagagggca

SEQ ID NO: 28566 - DNA, 25 bp, Homo sapien
tagtctctcagtgtattgatttgct

SEQ ID NO: 28567 - DNA, 25 bp, Homo sapien
cagtgtattgatttgctagggcagc

SEQ ID NO: 28568 - DNA, 25 bp, Homo sapien
tgctagggcagccatgacagtctca

SEQ ID NO: 28569 - DNA, 25 bp, Homo sapien
gacagtctcacagatggagaggctt

SEQ ID NO: 28570 - DNA, 25 bp, Homo sapien
tggagaggcttgaaaacagacattt

SEQ ID NO: 28571 - DNA, 25 bp, Homo sapien
atgctgccataattctggaagccag

SEQ ID NO: 28572 - DNA, 25 bp, Homo sapien
gatgaaggtgtgagtagggctgggt

SEQ ID NO: 28573 - DNA, 25 bp, Homo sapien
tcctcctgaggctgacggggatctg

SEQ ID NO: 28574 - DNA, 25 bp, Homo sapien
gtccttgatgttccttggcttggag

SEQ ID NO: 28575 - DNA, 25 bp, Homo sapien
gcttggagaagcgtcagccgcatct

SEQ ID NO: 28576 - DNA, 25 bp, Homo sapien
ttattttaagagatgaggggccggg

SEQ ID NO: 28577 - DNA, 25 bp, Homo sapien
gaataattcttacatgccaggctca

SEQ ID NO: 28578 - DNA, 25 bp, Homo sapien
attcttacatgccaggctcatgtcc

SEQ ID NO: 28579 - DNA, 25 bp, Homo sapien
cttacatgccaggctcatgtccagt

SEQ ID NO: 28580 - DNA, 25 bp, Homo sapien
tacatgccaggctcatgtccagtca

SEQ ID NO: 28581 - DNA, 25 bp, Homo sapien
tcatgtccagtcaggccaatatgga

SEQ ID NO: 28582 - DNA, 25 bp, Homo sapien
cagtcaggccaatatggacaatgtt

SEQ ID NO: 28583 - DNA, 25 bp, Homo sapien
gtgtgagtgtgcatgcgcgtatgca

SEQ ID NO: 28584 - DNA, 25 bp, Homo sapien
gagtgtgcatgcgcgtatgcagtta

SEQ ID NO: 28585 - DNA, 25 bp, Homo sapien
gcatgcgcgtatgcagttaagagca

SEQ ID NO: 28586 - DNA, 25 bp, Homo sapien
gttaagagcaagtgccttggccggg

SEQ ID NO: 28587 - DNA, 25 bp, Homo sapien
aagagcaagtgccttggccgggcac

SEQ ID NO: 28588 - DNA, 25 bp, Homo sapien
aacagtctggatgctggtgccacta

SEQ ID NO: 28589 - DNA, 25 bp, Homo sapien
gaaggcttaactctttcagctctga

SEQ ID NO: 28590 - DNA, 25 bp, Homo sapien
ctctgagctcactgtgtgcactgag

SEQ ID NO: 28591 - DNA, 25 bp, Homo sapien
tgcactgagcgatgtcaccatttct

SEQ ID NO: 28592 - DNA, 25 bp, Homo sapien
ctgccacgcgtcggtgaaggttggg

SEQ ID NO: 28593 - DNA, 25 bp, Homo sapien
gttgggactcgactggtgtttgatc

SEQ ID NO: 28594 - DNA, 25 bp, Homo sapien
gaagcagttattttctacgctacct

SEQ ID NO: 28595 - DNA, 25 bp, Homo sapien
ctacgctacctgtgcgccataagga

SEQ ID NO: 28596 - DNA, 25 bp, Homo sapien
attaagaagacgtgcctgcttcccc

SEQ ID NO: 28597 - DNA, 25 bp, Homo sapien
tctgccgtgattgtcagtttcctga

SEQ ID NO: 28598 - DNA, 25 bp, Homo sapien
gtccatcagatttgctctgggccag

SEQ ID NO: 28599 - DNA, 25 bp, Homo sapien
ctcccttataatctagagaggctgg

SEQ ID NO: 28600 - DNA, 25 bp, Homo sapien
ggaagcaacagtagattggagatgc

SEQ ID NO: 28601 - DNA, 25 bp, Homo sapien
ttggagatgctctactgtcagctct

SEQ ID NO: 28602 - DNA, 25 bp, Homo sapien
gatgctctactgtcagctctgaaga

SEQ ID NO: 28603 - DNA, 25 bp, Homo sapien
tgctctactgtcagctctgaagatg

SEQ ID NO: 28604 - DNA, 25 bp, Homo sapien
gaagatggacggagccacggaacaa

SEQ ID NO: 28605 - DNA, 25 bp, Homo sapien
ggagccacggaacaaggaaacggat

SEQ ID NO: 28606 - DNA, 25 bp, Homo sapien
gattctccctaagggagcacagccc

SEQ ID NO: 28607 - DNA, 25 bp, Homo sapien
tgattggcccagtgaaacccatttc

SEQ ID NO: 28608 - DNA, 25 bp, Homo sapien
ccatttctgacttttgacctccaga

SEQ ID NO: 28609 - DNA, 25 bp, Homo sapien
atttctgacttttgacctccagaac

SEQ ID NO: 28610 - DNA, 25 bp, Homo sapien
tggaagaaagcctgccagcggttcc

SEQ ID NO: 28611 - DNA, 25 bp, Homo sapien
cctgccagcggttcctggactaagt

SEQ ID NO: 28612 - DNA, 25 bp, Homo sapien
tcctggactaagtccggctcgttca

SEQ ID NO: 28613 - DNA, 25 bp, Homo sapien
cgttcaagaacataagctaccacct

SEQ ID NO: 28614 - DNA, 25 bp, Homo sapien
ggggctgaaacagcccgaggacagc

SEQ ID NO: 28615 - DNA, 25 bp, Homo sapien
ctgcagggtctgcttttacttgggg

SEQ ID NO: 28616 - DNA, 25 bp, Homo sapien
cccaccactcaaagtgcctctaaag

SEQ ID NO: 28617 - DNA, 25 bp, Homo sapien
aaagtgcctctaaagaaaccagctt

SEQ ID NO: 28618 - DNA, 25 bp, Homo sapien
gaaaccagctttttgcactaaagcc

SEQ ID NO: 28619 - DNA, 25 bp, Homo sapien
aagggtgttatgggcccagctttgg

SEQ ID NO: 28620 - DNA, 25 bp, Homo sapien
ccagtcccgatgcactttgaggggt

SEQ ID NO: 28621 - DNA, 25 bp, Homo sapien
ccccgcgagaagtacctgacttggg

SEQ ID NO: 28622 - DNA, 25 bp, Homo sapien
gagaagtacctgacttgggcatccc

SEQ ID NO: 28623 - DNA, 25 bp, Homo sapien
caccttcgctgtgaccagcatactg

SEQ ID NO: 28624 - DNA, 25 bp, Homo sapien
tcgctgtgaccagcatactgcgcgt

SEQ ID NO: 28625 - DNA, 25 bp, Homo sapien
tgaccagcatactgcgcgtggcagc

SEQ ID NO: 28626 - DNA, 25 bp, Homo sapien
tcaatgtgtctgttgtcatggcgga

SEQ ID NO: 28627 - DNA, 25 bp, Homo sapien
tcaagtgggaagagcgctgttcaag

SEQ ID NO: 28628 - DNA, 25 bp, Homo sapien
gtgggaagagcgctgttcaaggacc

SEQ ID NO: 28629 - DNA, 25 bp, Homo sapien
atccggaaacacattccggcccgag

SEQ ID NO: 28630 - DNA, 25 bp, Homo sapien
ccctgaacgagctggtgacgctgac

SEQ ID NO: 28631 - DNA, 25 bp, Homo sapien
gaacgagctggtgacgctgacgtgc

SEQ ID NO: 28632 - DNA, 25 bp, Homo sapien
aaaggtgtgttcgaccagacaaatc

SEQ ID NO: 28633 - DNA, 25 bp, Homo sapien
gtgtgttcgaccagacaaatcctag

SEQ ID NO: 28634 - DNA, 25 bp, Homo sapien
tgtccaaacatcagaatgtgaggcc

SEQ ID NO: 28635 - DNA, 25 bp, Homo sapien
cccttctatcagagttaaacttttg

SEQ ID NO: 28636 - DNA, 25 bp, Homo sapien
gaacaaatctcaaactgatccatca

SEQ ID NO: 28637 - DNA, 25 bp, Homo sapien
ctgatccatcagtcatgtagctagc

SEQ ID NO: 28638 - DNA, 25 bp, Homo sapien
tcatgtagctagctgtagagcttcc

SEQ ID NO: 28639 - DNA, 25 bp, Homo sapien
cccccggttcagacactagcgggtg

SEQ ID NO: 28640 - DNA, 25 bp, Homo sapien
ccggttcagacactagcgggtgcgc

SEQ ID NO: 28641 - DNA, 25 bp, Homo sapien
ttcagacactagcgggtgcgcgggg

SEQ ID NO: 28642 - DNA, 25 bp, Homo sapien
gcccaggacggcgggagaggacggg

SEQ ID NO: 28643 - DNA, 25 bp, Homo sapien
gcatagacgcagagacagaagccaa

SEQ ID NO: 28644 - DNA, 25 bp, Homo sapien
agagagggcacggttatcacatggt

SEQ ID NO: 28645 - DNA, 25 bp, Homo sapien
ggacagggataggtaccacaaagat

SEQ ID NO: 28646 - DNA, 25 bp, Homo sapien
agatagggaccacactgacagaact

SEQ ID NO: 28647 - DNA, 25 bp, Homo sapien
aaaggtaaaatttgcaggctgcttc

SEQ ID NO: 28648 - DNA, 25 bp, Homo sapien
aggctgcttcaggattacatttaaa

SEQ ID NO: 28649 - DNA, 25 bp, Homo sapien
gattgcctgctaggattgtgccatc

SEQ ID NO: 28650 - DNA, 25 bp, Homo sapien
gctaggattgtgccatctttaaaat

SEQ ID NO: 28651 - DNA, 25 bp, Homo sapien
tttactattggtcatttgcagaaca

SEQ ID NO: 28652 - DNA, 25 bp, Homo sapien
tacagagtgctctgtaccagtgctc

SEQ ID NO: 28653 - DNA, 25 bp, Homo sapien
tcttcataccaacggtccctagtta

SEQ ID NO: 28654 - DNA, 25 bp, Homo sapien
agggctctgtattgtatgataccat

SEQ ID NO: 28655 - DNA, 25 bp, Homo sapien
caggcaaaaccttagatcagatcag

SEQ ID NO: 28656 - DNA, 25 bp, Homo sapien
gatcagtactttgcctgggtgtagg

SEQ ID NO: 28657 - DNA, 25 bp, Homo sapien
gggtggcagcatggagattggtttt

SEQ ID NO: 28658 - DNA, 25 bp, Homo sapien
acaggcacagcggaacagtttgggt

SEQ ID NO: 28659 - DNA, 25 bp, Homo sapien
aatgttcctggtgatagttgtgtat

SEQ ID NO: 28660 - DNA, 25 bp, Homo sapien
gaaaacgtgtgcaattgtgtactta

SEQ ID NO: 28661 - DNA, 25 bp, Homo sapien
catgacatgcaaattatacctcaag

SEQ ID NO: 28662 - DNA, 25 bp, Homo sapien
atacctcaagaaagccactaaacgt

SEQ ID NO: 28663 - DNA, 25 bp, Homo sapien
agccactaaacgtgggtggccactc

SEQ ID NO: 28664 - DNA, 25 bp, Homo sapien
attctctttaagatgaccattcagg

SEQ ID NO: 28665 - DNA, 25 bp, Homo sapien
ggactagcagtcttcttcttcagac

SEQ ID NO: 28666 - DNA, 25 bp, Homo sapien
gttccctgctggacaaggtctgacg

SEQ ID NO: 28667 - DNA, 25 bp, Homo sapien
cctaccacaaggactttgcctctga

SEQ ID NO: 28668 - DNA, 25 bp, Homo sapien
gtccagccccatctgaatgtgttgg

SEQ ID NO: 28669 - DNA, 25 bp, Homo sapien
gcacttgaaggcaggaccctcagac

SEQ ID NO: 28670 - DNA, 25 bp, Homo sapien
accctcagacctcgctggtaaaggt

SEQ ID NO: 28671 - DNA, 25 bp, Homo sapien
tcaaatggggtcatctgctcctttt

SEQ ID NO: 28672 - DNA, 25 bp, Homo sapien
acataccttaacctctgaactctga

SEQ ID NO: 28673 - DNA, 25 bp, Homo sapien
ctgacctcaggaggctctgggcact

SEQ ID NO: 28674 - DNA, 25 bp, Homo sapien
cctcccgtcactctgactaaaaaga

SEQ ID NO: 28675 - DNA, 25 bp, Homo sapien
gattgttcagttaccctaaagactt

SEQ ID NO: 28676 - DNA, 25 bp, Homo sapien
cctggagctgtcagacaagaatgtg

SEQ ID NO: 28677 - DNA, 25 bp, Homo sapien
gtccaaccttcctgtcataaaggcc

SEQ ID NO: 28678 - DNA, 25 bp, Homo sapien
aaccttcctgtcataaaggccatgc

SEQ ID NO: 28679 - DNA, 25 bp, Homo sapien
tcctgtcataaaggccatgcagtct

SEQ ID NO: 28680 - DNA, 25 bp, Homo sapien
agaaccagattgccatttatgactc

SEQ ID NO: 28681 - DNA, 25 bp, Homo sapien
accagattgccatttatgactcctt

SEQ ID NO: 28682 - DNA, 25 bp, Homo sapien
gaagggtgagtgacctgcaagactc

SEQ ID NO: 28683 - DNA, 25 bp, Homo sapien
agggaaagccgacagagatacctac

SEQ ID NO: 28684 - DNA, 25 bp, Homo sapien
gggactgggtcagcaactgaattcc

SEQ ID NO: 28685 - DNA, 25 bp, Homo sapien
tcatggtggccaaggacatccacat

SEQ ID NO: 28686 - DNA, 25 bp, Homo sapien
gccaaggacatccacatgcctaagc

SEQ ID NO: 28687 - DNA, 25 bp, Homo sapien
acctttctactgcgcttcagtgaat

SEQ ID NO: 28688 - DNA, 25 bp, Homo sapien
ttctactgcgcttcagtgaatcgtc

SEQ ID NO: 28689 - DNA, 25 bp, Homo sapien
actgcgcttcagtgaatcgtcagaa

SEQ ID NO: 28690 - DNA, 25 bp, Homo sapien
gcgcttcagtgaatcgtcagaaggg

SEQ ID NO: 28691 - DNA, 25 bp, Homo sapien
gtgaatcgtcagaagggggcattac

SEQ ID NO: 28692 - DNA, 25 bp, Homo sapien
gtcagaagggggcattacctgctcc

SEQ ID NO: 28693 - DNA, 25 bp, Homo sapien
tcagaagggggcattacctgctcct

SEQ ID NO: 28694 - DNA, 25 bp, Homo sapien
ggcattacctgctcctgggtggagc

SEQ ID NO: 28695 - DNA, 25 bp, Homo sapien
attacctgctcctgggtggagcacc

SEQ ID NO: 28696 - DNA, 25 bp, Homo sapien
acctgctcctgggtggagcaccagg

SEQ ID NO: 28697 - DNA, 25 bp, Homo sapien
ctgctcctgggtggagcaccaggat

SEQ ID NO: 28698 - DNA, 25 bp, Homo sapien
ttcaggtctgccctggagagcagcc

SEQ ID NO: 28699 - DNA, 25 bp, Homo sapien
tcagtgaggacgaagcgcgcctcct

SEQ ID NO: 28700 - DNA, 25 bp, Homo sapien
tcatgggcttccaaaagttctcccc

SEQ ID NO: 28701 - DNA, 25 bp, Homo sapien
gagagagggctccagaatcattgcc

SEQ ID NO: 28702 - DNA, 25 bp, Homo sapien
agaagagagcctgtgacactgccac

SEQ ID NO: 28703 - DNA, 25 bp, Homo sapien
cctgtgtgactcatcggctggcagg

SEQ ID NO: 28704 - DNA, 25 bp, Homo sapien
gctggcaggcttgctgagcagatca

SEQ ID NO: 28705 - DNA, 25 bp, Homo sapien
gaacaactttgtgcccaccaatgtg

SEQ ID NO: 28706 - DNA, 25 bp, Homo sapien
ggttccaaagcctttggcaggcgcc

SEQ ID NO: 28707 - DNA, 25 bp, Homo sapien
tctcagcatcttggtcctgttgcag

SEQ ID NO: 28708 - DNA, 25 bp, Homo sapien
catgcagcaccattcaggtctgccc

SEQ ID NO: 28709 - DNA, 25 bp, Homo sapien
tcctctgtcctctatattcagcatg

SEQ ID NO: 28710 - DNA, 25 bp, Homo sapien
ctatattcagcatgttccttgtcag

SEQ ID NO: 28711 - DNA, 25 bp, Homo sapien
cagcatgttccttgtcagctgctgg

SEQ ID NO: 28712 - DNA, 25 bp, Homo sapien
cttctcaggtctccctaatggagac

SEQ ID NO: 28713 - DNA, 25 bp, Homo sapien
ctccctaatggagacaccaggctac

SEQ ID NO: 28714 - DNA, 25 bp, Homo sapien
gacaccaggctactaggacactggc

SEQ ID NO: 28715 - DNA, 25 bp, Homo sapien
ggctactaggacactggctggggcc

SEQ ID NO: 28716 - DNA, 25 bp, Homo sapien
gaatggcccagagtcaccaaggcaa

SEQ ID NO: 28717 - DNA, 25 bp, Homo sapien
cagagagggggtgccccatctagct

SEQ ID NO: 28718 - DNA, 25 bp, Homo sapien
cagagtcaagggctgcagcactgcc

SEQ ID NO: 28719 - DNA, 25 bp, Homo sapien
aaagctgcaacctttctgttttatt

SEQ ID NO: 28720 - DNA, 25 bp, Homo sapien
cgcgacaccacgtccagataatttt

SEQ ID NO: 28721 - DNA, 25 bp, Homo sapien
agcttcccaagagagacatttccct

SEQ ID NO: 28722 - DNA, 25 bp, Homo sapien
ccctcacggtgccactgttttataa

SEQ ID NO: 28723 - DNA, 25 bp, Homo sapien
cacggtgccactgttttataatctg

SEQ ID NO: 28724 - DNA, 25 bp, Homo sapien
ttaaaatctatcaactgcagtggga

SEQ ID NO: 28725 - DNA, 25 bp, Homo sapien
aatgcagttcatgctttttagttca

SEQ ID NO: 28726 - DNA, 25 bp, Homo sapien
cttgacaaagcatgactcagctgct

SEQ ID NO: 28727 - DNA, 25 bp, Homo sapien
gactcagctgctttgagggattcct

SEQ ID NO: 28728 - DNA, 25 bp, Homo sapien
gagggattcctatttaattttcttg

SEQ ID NO: 28729 - DNA, 25 bp, Homo sapien
taattttcttgggtcagcttgtaat

SEQ ID NO: 28730 - DNA, 25 bp, Homo sapien
aaagaacctgtcaaggccaagcaca

SEQ ID NO: 28731 - DNA, 25 bp, Homo sapien
gtgggtactgtgaacaaacaccaga

SEQ ID NO: 28732 - DNA, 25 bp, Homo sapien
aacaccagaggtagaacaagctgtg

SEQ ID NO: 28733 - DNA, 25 bp, Homo sapien
tagaacaagctgtgttatgtgtttg

SEQ ID NO: 28734 - DNA, 25 bp, Homo sapien
tggtgtatcataggcgaggcaggaa

SEQ ID NO: 28735 - DNA, 25 bp, Homo sapien
aggcgaggcaggaagtggtaagaat

SEQ ID NO: 28736 - DNA, 25 bp, Homo sapien
gaattgagactaccattttaagttc

SEQ ID NO: 28737 - DNA, 25 bp, Homo sapien
gaaggagtcgtgtgttccgtgtttg

SEQ ID NO: 28738 - DNA, 25 bp, Homo sapien
gtgtgttccgtgtttgggagcttga

SEQ ID NO: 28739 - DNA, 25 bp, Homo sapien
ttgggagcttgaactgtaatgtgta

SEQ ID NO: 28740 - DNA, 25 bp, Homo sapien
atgagggttatggcagttcctgaca

SEQ ID NO: 28741 - DNA, 25 bp, Homo sapien
ggcagttcctgacagagtgggtact

SEQ ID NO: 28742 - DNA, 25 bp, Homo sapien
gtaataaatactatgcagactccat

SEQ ID NO: 28743 - DNA, 25 bp, Homo sapien
gcagactccataagggccgattcac

SEQ ID NO: 28744 - DNA, 25 bp, Homo sapien
actccataagggccgattcaccatc

SEQ ID NO: 28745 - DNA, 25 bp, Homo sapien
ccgattcaccatctccagagactat

SEQ ID NO: 28746 - DNA, 25 bp, Homo sapien
caccatctccagagactattccaag

SEQ ID NO: 28747 - DNA, 25 bp, Homo sapien
atttatcttcagcaactatggcatg

SEQ ID NO: 28748 - DNA, 25 bp, Homo sapien
ctatggcatgcagtgggtccgccag

SEQ ID NO: 28749 - DNA, 25 bp, Homo sapien
ccaggttccaggcgaggggctggag

SEQ ID NO: 28750 - DNA, 25 bp, Homo sapien
gaggggctggagtgggtggcagtta

SEQ ID NO: 28751 - DNA, 25 bp, Homo sapien
gggtggcagttatatgctctgatgg

SEQ ID NO: 28752 - DNA, 25 bp, Homo sapien
gttatatgctctgatggaagtaata

SEQ ID NO: 28753 - DNA, 25 bp, Homo sapien
agtagctgggaccacaggtgcacac

SEQ ID NO: 28754 - DNA, 25 bp, Homo sapien
cacacccagccaatttttgtatttt

SEQ ID NO: 28755 - DNA, 25 bp, Homo sapien
ggccaacatctatctttttaaacca

SEQ ID NO: 28756 - DNA, 25 bp, Homo sapien
ctttttaaaccaacagaatgcctgc

SEQ ID NO: 28757 - DNA, 25 bp, Homo sapien
aaaccaacagaatgcctgctaattt

SEQ ID NO: 28758 - DNA, 25 bp, Homo sapien
caacagaatgcctgctaatttaaga

SEQ ID NO: 28759 - DNA, 25 bp, Homo sapien
agaatgcctgctaatttaagaaaca

SEQ ID NO: 28760 - DNA, 25 bp, Homo sapien
ggaattgagaataatctgacttaat

SEQ ID NO: 28761 - DNA, 25 bp, Homo sapien
aatctgacttaatttatactctgtg

SEQ ID NO: 28762 - DNA, 25 bp, Homo sapien
ctgacttaatttatactctgtgaaa

SEQ ID NO: 28763 - DNA, 25 bp, Homo sapien
atttatactctgtgaaatcaatgaa

SEQ ID NO: 28764 - DNA, 25 bp, Homo sapien
agaagaatcagactccagtgaggag

SEQ ID NO: 28765 - DNA, 25 bp, Homo sapien
cccaggaacctctgcagctaaagaa

SEQ ID NO: 28766 - DNA, 25 bp, Homo sapien
ggaacctctgcagctaaagaacggg

SEQ ID NO: 28767 - DNA, 25 bp, Homo sapien
ggccacctttctggagacagggagg

SEQ ID NO: 28768 - DNA, 25 bp, Homo sapien
gggtgggtgggaaggctgatgatct

SEQ ID NO: 28769 - DNA, 25 bp, Homo sapien
ggtgggaaggctgatgatctgtctc

SEQ ID NO: 28770 - DNA, 25 bp, Homo sapien
tgggcaactggacagatctgggagc

SEQ ID NO: 28771 - DNA, 25 bp, Homo sapien
caactggacagatctgggagccagc

SEQ ID NO: 28772 - DNA, 25 bp, Homo sapien
ccagcagctggatgctgtggctggc

SEQ ID NO: 28773 - DNA, 25 bp, Homo sapien
ggatgctgtggctggccagagacac

SEQ ID NO: 28774 - DNA, 25 bp, Homo sapien
tgctgtggctggccagagacacctc

SEQ ID NO: 28775 - DNA, 25 bp, Homo sapien
gaggttggctgtcaatggatgcagg

SEQ ID NO: 28776 - DNA, 25 bp, Homo sapien
gcctggcaggcattgcagtctgcat

SEQ ID NO: 28777 - DNA, 25 bp, Homo sapien
gacaagtgtttttccgtgattgagg

SEQ ID NO: 28778 - DNA, 25 bp, Homo sapien
cgtgattgagggtgtctgcaggcca

SEQ ID NO: 28779 - DNA, 25 bp, Homo sapien
agtgtgttcccatgtgaatgcacgt

SEQ ID NO: 28780 - DNA, 25 bp, Homo sapien
gtgaatgcacgtatctgtgtgtgtg

SEQ ID NO: 28781 - DNA, 25 bp, Homo sapien
tgtgtgcacgactgcttgtgtgagc

SEQ ID NO: 28782 - DNA, 25 bp, Homo sapien
tgtgagcagatccctagtgcgtgtc

SEQ ID NO: 28783 - DNA, 25 bp, Homo sapien
gatccctagtgcgtgtctgggtgtg

SEQ ID NO: 28784 - DNA, 25 bp, Homo sapien
ggtgtgtatcggttgtgcatgcatt

SEQ ID NO: 28785 - DNA, 25 bp, Homo sapien
tttctctgaaactcttagggccata

SEQ ID NO: 28786 - DNA, 25 bp, Homo sapien
tttatcctccacaactgcctggaga

SEQ ID NO: 28787 - DNA, 25 bp, Homo sapien
gagaccagcagaaatctaccactgt

SEQ ID NO: 28788 - DNA, 25 bp, Homo sapien
gaggaatgtctattgaccaggcttt

SEQ ID NO: 28789 - DNA, 25 bp, Homo sapien
caggctttggctcagttggaattca

SEQ ID NO: 28790 - DNA, 25 bp, Homo sapien
atttatatatagctgagtccacctc

SEQ ID NO: 28791 - DNA, 25 bp, Homo sapien
ggacgaggccagtgcctgaaacgca

SEQ ID NO: 28792 - DNA, 25 bp, Homo sapien
cgctaccatggcagaggtcgctttg

SEQ ID NO: 28793 - DNA, 25 bp, Homo sapien
gagccaccaaagacggcagttgccc

SEQ ID NO: 28794 - DNA, 25 bp, Homo sapien
gcagttgcccatgccaaagagtata

SEQ ID NO: 28795 - DNA, 25 bp, Homo sapien
agtatattcagcagttcgcagccgg

SEQ ID NO: 28796 - DNA, 25 bp, Homo sapien
gagattcagactccacagtgtatat

SEQ ID NO: 28797 - DNA, 25 bp, Homo sapien
gccatccagcacgtcatcaattatg

SEQ ID NO: 28798 - DNA, 25 bp, Homo sapien
gaactatgtacaccggattggccgc

SEQ ID NO: 28799 - DNA, 25 bp, Homo sapien
ggcgctcgggaaacacaggcatcgc

SEQ ID NO: 28800 - DNA, 25 bp, Homo sapien
gtgctgatggacctcaaagcgctgc

SEQ ID NO: 28801 - DNA, 25 bp, Homo sapien
aaagcgctgctgctagaagccaagc

SEQ ID NO: 28802 - DNA, 25 bp, Homo sapien
ctgggtcatcggatcactgactgcc

SEQ ID NO: 28803 - DNA, 25 bp, Homo sapien
ccccaaactcgaggctatgcagacc

SEQ ID NO: 28804 - DNA, 25 bp, Homo sapien
caagcaggtcagcaacatcggtcgc

SEQ ID NO: 28805 - DNA, 25 bp, Homo sapien
cagctccatggacttctgagccgac

SEQ ID NO: 28806 - DNA, 25 bp, Homo sapien
tgccaccagtctacacatacagcag

SEQ ID NO: 28807 - DNA, 25 bp, Homo sapien
cagcatttcagctcagctggcctgg

SEQ ID NO: 28808 - DNA, 25 bp, Homo sapien
gaccctgtctaaaaactatatatat

SEQ ID NO: 28809 - DNA, 25 bp, Homo sapien
ttatttttgcaccttttgtactcct

SEQ ID NO: 28810 - DNA, 25 bp, Homo sapien
gacagaggtttgtctggagccagag

SEQ ID NO: 28811 - DNA, 25 bp, Homo sapien
ggagccagagctcacaaatagttgg

SEQ ID NO: 28812 - DNA, 25 bp, Homo sapien
gctcacaaatagttggaactgccct

SEQ ID NO: 28813 - DNA, 25 bp, Homo sapien
ataactagcaaatattactcaaagc

SEQ ID NO: 28814 - DNA, 25 bp, Homo sapien
cctggtccccaataatttgaataat

SEQ ID NO: 28815 - DNA, 25 bp, Homo sapien
ggtattgagatgggaaccctcctgt

SEQ ID NO: 28816 - DNA, 25 bp, Homo sapien
atgggaaccctcctgtgtggtatat

SEQ ID NO: 28817 - DNA, 25 bp, Homo sapien
ccctcctgtgtggtatatcttgctc

SEQ ID NO: 28818 - DNA, 25 bp, Homo sapien
ctgtgtggtatatcttgctcttatc

SEQ ID NO: 28819 - DNA, 25 bp, Homo sapien
tggaggggctgatcagtgcccgtgt

SEQ ID NO: 28820 - DNA, 25 bp, Homo sapien
tgcccgtgtggactcacacagcaag

SEQ ID NO: 28821 - DNA, 25 bp, Homo sapien
ctatacgcccgggacgtggatcagc

SEQ ID NO: 28822 - DNA, 25 bp, Homo sapien
cgcagcaccacctttgagaagtctc

SEQ ID NO: 28823 - DNA, 25 bp, Homo sapien
tgagaagtctctgttgatgggcaag

SEQ ID NO: 28824 - DNA, 25 bp, Homo sapien
tgttgatgggcaaggagttccagcg

SEQ ID NO: 28825 - DNA, 25 bp, Homo sapien
ccgcgccaaggccatgatgctgcgg

SEQ ID NO: 28826 - DNA, 25 bp, Homo sapien
caaggccatgatgctgcgggcagct

SEQ ID NO: 28827 - DNA, 25 bp, Homo sapien
ccccgcccagagaagggagccaggg

SEQ ID NO: 28828 - DNA, 25 bp, Homo sapien
aacatgtgaggggtgaaccttggcc

SEQ ID NO: 28829 - DNA, 25 bp, Homo sapien
tggaaggagaggcctgcagggctcg

SEQ ID NO: 28830 - DNA, 25 bp, Homo sapien
atgtattctgtatctttcttttgta

SEQ ID NO: 28831 - DNA, 25 bp, Homo sapien
gtaacttttatccacttagcacgaa

SEQ ID NO: 28832 - DNA, 25 bp, Homo sapien
tttaaatcgccccagagtttgcctg

SEQ ID NO: 28833 - DNA, 25 bp, Homo sapien
gagtttgcctgtttccatattttat

SEQ ID NO: 28834 - DNA, 25 bp, Homo sapien
taccttataatcttcgggagtgctt

SEQ ID NO: 28835 - DNA, 25 bp, Homo sapien
gagtgcttacacttatggagctaac

SEQ ID NO: 28836 - DNA, 25 bp, Homo sapien
tggagctaacattttcagagataca

SEQ ID NO: 28837 - DNA, 25 bp, Homo sapien
gatacagcttcttatagtaacacta

SEQ ID NO: 28838 - DNA, 25 bp, Homo sapien
aactttcttcctctttggactgaat

SEQ ID NO: 28839 - DNA, 25 bp, Homo sapien
tgaagtctattatttgttgtcccat

SEQ ID NO: 28840 - DNA, 25 bp, Homo sapien
aattctagcttagtctacacagatt

SEQ ID NO: 28841 - DNA, 25 bp, Homo sapien
cccgggctgctgtctcaagacagcc

SEQ ID NO: 28842 - DNA, 25 bp, Homo sapien
ctcctcgatgagcaggcctttgggg

SEQ ID NO: 28843 - DNA, 25 bp, Homo sapien
ctcgatgagcaggcctttggggatc

SEQ ID NO: 28844 - DNA, 25 bp, Homo sapien
tgcccaaggccacgtacgggctgaa

SEQ ID NO: 28845 - DNA, 25 bp, Homo sapien
ggccacgtacgggctgaagcatgcg

SEQ ID NO: 28846 - DNA, 25 bp, Homo sapien
tgaagcatgcggagtccatcatgtc

SEQ ID NO: 28847 - DNA, 25 bp, Homo sapien
tccatgctgggtgacgtcctcagca

SEQ ID NO: 28848 - DNA, 25 bp, Homo sapien
ggacaaggaggagtgggaccccgag

SEQ ID NO: 28849 - DNA, 25 bp, Homo sapien
gggagggtggttaccatggcgatga

SEQ ID NO: 28850 - DNA, 25 bp, Homo sapien
accatggcgatgagggcgccgctgg

SEQ ID NO: 28851 - DNA, 25 bp, Homo sapien
tcccatgctctggaggatgaggggt

SEQ ID NO: 28852 - DNA, 25 bp, Homo sapien
aaatttctagtcttgatttctgacc

SEQ ID NO: 28853 - DNA, 25 bp, Homo sapien
tagtcttgatttctgacctccagct

SEQ ID NO: 28854 - DNA, 25 bp, Homo sapien
gaattattatgccttgcttgtattt

SEQ ID NO: 28855 - DNA, 25 bp, Homo sapien
gccttgcttgtattttcaaatccaa

SEQ ID NO: 28856 - DNA, 25 bp, Homo sapien
caaacgcttttattatccgtctcgg

SEQ ID NO: 28857 - DNA, 25 bp, Homo sapien
tgatctcagtttactgcagcctctg

SEQ ID NO: 28858 - DNA, 25 bp, Homo sapien
ttattatccgtctcggcaacctata

SEQ ID NO: 28859 - DNA, 25 bp, Homo sapien
ttacaggtgtgtgccaccatgcctg

SEQ ID NO: 28860 - DNA, 25 bp, Homo sapien
atccgtctcggcaacctataatata

SEQ ID NO: 28861 - DNA, 25 bp, Homo sapien
accatgcctggcaaatttttgtatt

SEQ ID NO: 28862 - DNA, 25 bp, Homo sapien
agagattgggtttcgccatcttggc

SEQ ID NO: 28863 - DNA, 25 bp, Homo sapien
ccaggagttcataccagtctagggg

SEQ ID NO: 28864 - DNA, 25 bp, Homo sapien
gagttcataccagtctaggggcaac

SEQ ID NO: 28865 - DNA, 25 bp, Homo sapien
tcataccagtctaggggcaacatgg

SEQ ID NO: 28866 - DNA, 25 bp, Homo sapien
aggagatgaggctgcaatagcatga

SEQ ID NO: 28867 - DNA, 25 bp, Homo sapien
tgcaatagcatgatcacgccgctgc

SEQ ID NO: 28868 - DNA, 25 bp, Homo sapien
aatatgttcattttgcaactagcaa

SEQ ID NO: 28869 - DNA, 25 bp, Homo sapien
gaaaaatactcaggctggtctaggt

SEQ ID NO: 28870 - DNA, 25 bp, Homo sapien
tactcaggctggtctaggtgaagtg

SEQ ID NO: 28871 - DNA, 25 bp, Homo sapien
gctggtctaggtgaagtggtgttta

SEQ ID NO: 28872 - DNA, 25 bp, Homo sapien
gaagtggtgtttacagtaactgatc

SEQ ID NO: 28873 - DNA, 25 bp, Homo sapien
actgatcaccaccagttacagattt

SEQ ID NO: 28874 - DNA, 25 bp, Homo sapien
gaaggtgggaagccattgtcatgca

SEQ ID NO: 28875 - DNA, 25 bp, Homo sapien
tgggaagccattgtcatgcaagccg

SEQ ID NO: 28876 - DNA, 25 bp, Homo sapien
ttgtcatgcaagccgtccagtggca

SEQ ID NO: 28877 - DNA, 25 bp, Homo sapien
tgcaagccgtccagtggcaaacacg

SEQ ID NO: 28878 - DNA, 25 bp, Homo sapien
gtccagtggcaaacacgtctacaaa

SEQ ID NO: 28879 - DNA, 25 bp, Homo sapien
gtgaaatcaagcaacgacgtcgagg

SEQ ID NO: 28880 - DNA, 25 bp, Homo sapien
aacgacgtcgaggagttgcctccat

SEQ ID NO: 28881 - DNA, 25 bp, Homo sapien
ccagcatcttttggatgaccgggag

SEQ ID NO: 28882 - DNA, 25 bp, Homo sapien
ggatgaccgggagacttgcaatctg

SEQ ID NO: 28883 - DNA, 25 bp, Homo sapien
gaccgggagacttgcaatctgaatg

SEQ ID NO: 28884 - DNA, 25 bp, Homo sapien
gggagacttgcaatctgaatgcaga

SEQ ID NO: 28885 - DNA, 25 bp, Homo sapien
ggaatccttgcatgttagaaacctt

SEQ ID NO: 28886 - DNA, 25 bp, Homo sapien
gaaaccttaaccctcgtaatatgtg

SEQ ID NO: 28887 - DNA, 25 bp, Homo sapien
taaccctcgtaatatgtgttgtaga

SEQ ID NO: 28888 - DNA, 25 bp, Homo sapien
cctcgcctatgagttgtctttcatc

SEQ ID NO: 28889 - DNA, 25 bp, Homo sapien
gcctatgagttgtctttcatccttg

SEQ ID NO: 28890 - DNA, 25 bp, Homo sapien
catgttacgttattttctagttgtc

SEQ ID NO: 28891 - DNA, 25 bp, Homo sapien
tctagttgtcgtattttttatttct

SEQ ID NO: 28892 - DNA, 25 bp, Homo sapien
cagcctcttagaatcttagtttcct

SEQ ID NO: 28893 - DNA, 25 bp, Homo sapien
ttagccaggtacagcggggcatgcc

SEQ ID NO: 28894 - DNA, 25 bp, Homo sapien
caggtacagcggggcatgcctgtag

SEQ ID NO: 28895 - DNA, 25 bp, Homo sapien
ccggcctgagtggtagggcgagact

SEQ ID NO: 28896 - DNA, 25 bp, Homo sapien
tgaggtactcactggaaacttttgt

SEQ ID NO: 28897 - DNA, 25 bp, Homo sapien
cactggaaacttttgtgttggtgta

SEQ ID NO: 28898 - DNA, 25 bp, Homo sapien
agaatatcttagtagctccctttcc

SEQ ID NO: 28899 - DNA, 25 bp, Homo sapien
gctccctttcctaggagttgttctg

SEQ ID NO: 28900 - DNA, 25 bp, Homo sapien
ttcctaggagttgttctgtccacct

SEQ ID NO: 28901 - DNA, 25 bp, Homo sapien
gttctgtccacctgtagacctataa

SEQ ID NO: 28902 - DNA, 25 bp, Homo sapien
gacctataagcttctgagctccagg

SEQ ID NO: 28903 - DNA, 25 bp, Homo sapien
ctccaggagaccattttgtctcgtt

SEQ ID NO: 28904 - DNA, 25 bp, Homo sapien
accattttgtctcgttcatcattat

SEQ ID NO: 28905 - DNA, 25 bp, Homo sapien
atcattataataccagtgcctgcca

SEQ ID NO: 28906 - DNA, 25 bp, Homo sapien
gatagatgccaaaaacctgtttgat

SEQ ID NO: 28907 - DNA, 25 bp, Homo sapien
gatggtcagggaggccgtgttgcca

SEQ ID NO: 28908 - DNA, 25 bp, Homo sapien
ccgtgttgccagacttggagccaga

SEQ ID NO: 28909 - DNA, 25 bp, Homo sapien
gacttggagccagagaagcgattag

SEQ ID NO: 28910 - DNA, 25 bp, Homo sapien
gaagcgattagaaacccctgagggc

SEQ ID NO: 28911 - DNA, 25 bp, Homo sapien
gaaacccctgagggccgattactga

SEQ ID NO: 28912 - DNA, 25 bp, Homo sapien
tcatgagtttgggggctttgcctgg

SEQ ID NO: 28913 - DNA, 25 bp, Homo sapien
caacgtcactgctggttccagtgca

SEQ ID NO: 28914 - DNA, 25 bp, Homo sapien
gctggttccagtgcaggagatggtg

SEQ ID NO: 28915 - DNA, 25 bp, Homo sapien
ggagatggtgatcgactgtccagga

SEQ ID NO: 28916 - DNA, 25 bp, Homo sapien
tggtgatcgactgtccaggagaccc

SEQ ID NO: 28917 - DNA, 25 bp, Homo sapien
agcctggagcccagagatggtcagg

SEQ ID NO: 28918 - DNA, 25 bp, Homo sapien
gccctgtgccttgcagagagaggag

SEQ ID NO: 28919 - DNA, 25 bp, Homo sapien
aagtctgcgaaagccgggagcgagc

SEQ ID NO: 28920 - DNA, 25 bp, Homo sapien
gagagaggagtagcttgctggcttt

SEQ ID NO: 28921 - DNA, 25 bp, Homo sapien
tagcttgctggctttgaacgcgtgg

SEQ ID NO: 28922 - DNA, 25 bp, Homo sapien
aacgcgtggcgtggcagatatttca

SEQ ID NO: 28923 - DNA, 25 bp, Homo sapien
gaagagttattcctccatattcacc

SEQ ID NO: 28924 - DNA, 25 bp, Homo sapien
catattcacctgcttcaactactat

SEQ ID NO: 28925 - DNA, 25 bp, Homo sapien
acctgcttcaactactattcttatt

SEQ ID NO: 28926 - DNA, 25 bp, Homo sapien
ggacaatggaatgttctctggtttt

SEQ ID NO: 28927 - DNA, 25 bp, Homo sapien
tgttctctggttttatcatgatcaa

SEQ ID NO: 28928 - DNA, 25 bp, Homo sapien
tcatgatcaaaaacctccttctctt

SEQ ID NO: 28929 - DNA, 25 bp, Homo sapien
tgggcagccccagagtgggagctac

SEQ ID NO: 28930 - DNA, 25 bp, Homo sapien
tacagccagcagcctagctatggtg

SEQ ID NO: 28931 - DNA, 25 bp, Homo sapien
cagcagcaaagctataatccccctc

SEQ ID NO: 28932 - DNA, 25 bp, Homo sapien
ccccctcagggctatggacagcaga

SEQ ID NO: 28933 - DNA, 25 bp, Homo sapien
ggccaagatcaatcctccatgagta

SEQ ID NO: 28934 - DNA, 25 bp, Homo sapien
ggtggcagtggtggcggttatggca

SEQ ID NO: 28935 - DNA, 25 bp, Homo sapien
ggcagcggtggctatggacagcagg

SEQ ID NO: 28936 - DNA, 25 bp, Homo sapien
gttacaaccgcagcagtggtggcta

SEQ ID NO: 28937 - DNA, 25 bp, Homo sapien
tcatacatcaccactcctgaaagca

SEQ ID NO: 28938 - DNA, 25 bp, Homo sapien
agatgtgcttttccagactgatcca

SEQ ID NO: 28939 - DNA, 25 bp, Homo sapien
ccagcagcacctcgggaagttacgg

SEQ ID NO: 28940 - DNA, 25 bp, Homo sapien
gtgagaggtggagctggggttggaa

SEQ ID NO: 28941 - DNA, 25 bp, Homo sapien
ggttggaacctaagcagtctgggtc

SEQ ID NO: 28942 - DNA, 25 bp, Homo sapien
aagcagtctgggtcagagcctgatt

SEQ ID NO: 28943 - DNA, 25 bp, Homo sapien
gagcctgatttgatcttctcttggg

SEQ ID NO: 28944 - DNA, 25 bp, Homo sapien
tcttctcttgggatacgttgtcatt

SEQ ID NO: 28945 - DNA, 25 bp, Homo sapien
gatacgttgtcattgaggcagagga

SEQ ID NO: 28946 - DNA, 25 bp, Homo sapien
gaggaactagttggacttaggtggg

SEQ ID NO: 28947 - DNA, 25 bp, Homo sapien
gtggggaaagcaagacttaggggct

SEQ ID NO: 28948 - DNA, 25 bp, Homo sapien
ggggcttgaaattttctgagtttct

SEQ ID NO: 28949 - DNA, 25 bp, Homo sapien
gaaccatgtcattgtacagcattct

SEQ ID NO: 28950 - DNA, 25 bp, Homo sapien
cgcataggcacccgactagtgagag

SEQ ID NO: 28951 - DNA, 25 bp, Homo sapien
gtttccagtggacacaaggtgcccg

SEQ ID NO: 28952 - DNA, 25 bp, Homo sapien
tccagtggacacaaggtgcccgttc

SEQ ID NO: 28953 - DNA, 25 bp, Homo sapien
gacacaaggtgcccgttcatgagaa

SEQ ID NO: 28954 - DNA, 25 bp, Homo sapien
caacctcctccaggaacgatgtttg

SEQ ID NO: 28955 - DNA, 25 bp, Homo sapien
ggaacgatgtttggagcttcacaag

SEQ ID NO: 28956 - DNA, 25 bp, Homo sapien
tttggagcttcacaaggttattttc

SEQ ID NO: 28957 - DNA, 25 bp, Homo sapien
tctgtccactgaggggtttacctcc

SEQ ID NO: 28958 - DNA, 25 bp, Homo sapien
tccttactttcatccaagacctgga

SEQ ID NO: 28959 - DNA, 25 bp, Homo sapien
cccttcatggttgattctgccttta

SEQ ID NO: 28960 - DNA, 25 bp, Homo sapien
catggttgattctgcctttaaagga

SEQ ID NO: 28961 - DNA, 25 bp, Homo sapien
tgattctgcctttaaaggagcctgc

SEQ ID NO: 28962 - DNA, 25 bp, Homo sapien
cgcgcgacacggctgcgagaagacg

SEQ ID NO: 28963 - DNA, 25 bp, Homo sapien
gcgacacggctgcgagaagacgaca

SEQ ID NO: 28964 - DNA, 25 bp, Homo sapien
gacacggctgcgagaagacgacaga

SEQ ID NO: 28965 - DNA, 25 bp, Homo sapien
acacggctgcgagaagacgacagaa

SEQ ID NO: 28966 - DNA, 25 bp, Homo sapien
gacgacagaaggggagagtgtggtc

SEQ ID NO: 28967 - DNA, 25 bp, Homo sapien
gaaggggagagtgtggtcaggcggc

SEQ ID NO: 28968 - DNA, 25 bp, Homo sapien
tcaggcggctcggactgagcaggac

SEQ ID NO: 28969 - DNA, 25 bp, Homo sapien
acccatcccaatcttaccagatgct

SEQ ID NO: 28970 - DNA, 25 bp, Homo sapien
ccatcccaatcttaccagatgctac

SEQ ID NO: 28971 - DNA, 25 bp, Homo sapien
atcccaatcttaccagatgctactg

SEQ ID NO: 28972 - DNA, 25 bp, Homo sapien
cccaatcttaccagatgctactgga

SEQ ID NO: 28973 - DNA, 25 bp, Homo sapien
tatagggaatttggccctcgaggcc

SEQ ID NO: 28974 - DNA, 25 bp, Homo sapien
ggccctcgaggccaagaattcggca

SEQ ID NO: 28975 - DNA, 25 bp, Homo sapien
tcggcacgaggtgttaccaatttga

SEQ ID NO: 28976 - DNA, 25 bp, Homo sapien
gaagtgggagcagccgctcattttt

SEQ ID NO: 28977 - DNA, 25 bp, Homo sapien
tgctttaaatcatgaatcccgccag

SEQ ID NO: 28978 - DNA, 25 bp, Homo sapien
atgaatcccgccaggtacggtggct

SEQ ID NO: 28979 - DNA, 25 bp, Homo sapien
caaggcgggcggattacttaatact

SEQ ID NO: 28980 - DNA, 25 bp, Homo sapien
gagaatcccttgaaccgaggaggcg

SEQ ID NO: 28981 - DNA, 25 bp, Homo sapien
attaaatcatgaatccccatcctgg

SEQ ID NO: 28982 - DNA, 25 bp, Homo sapien
cccatcctggaagaggtaggtccca

SEQ ID NO: 28983 - DNA, 25 bp, Homo sapien
ccagcatccagccagattttctgca

SEQ ID NO: 28984 - DNA, 25 bp, Homo sapien
gatgagctttgactgcggttttgga

SEQ ID NO: 28985 - DNA, 25 bp, Homo sapien
ctccttagcccaatatgctgtcttg

SEQ ID NO: 28986 - DNA, 25 bp, Homo sapien
caagcttcagatgccatgttgtact

SEQ ID NO: 28987 - DNA, 25 bp, Homo sapien
ctgggggaatgtagcccttgtgctc

SEQ ID NO: 28988 - DNA, 25 bp, Homo sapien
gttgagccctgagtggctaggggaa

SEQ ID NO: 28989 - DNA, 25 bp, Homo sapien
gggaagaggattgccatggcctggc

SEQ ID NO: 28990 - DNA, 25 bp, Homo sapien
ttgccatggcctggccatcttgttg

SEQ ID NO: 28991 - DNA, 25 bp, Homo sapien
cttgttgctgcttggttagatcata

SEQ ID NO: 28992 - DNA, 25 bp, Homo sapien
ggcaggggagctattttttgaagat

SEQ ID NO: 28993 - DNA, 25 bp, Homo sapien
cccagcaggccttttgttggttgca

SEQ ID NO: 28994 - DNA, 25 bp, Homo sapien
ggttgcactaactgcaaggttgctg

SEQ ID NO: 28995 - DNA, 25 bp, Homo sapien
tacccaaaggtggctctgagggtcc

SEQ ID NO: 28996 - DNA, 25 bp, Homo sapien
ttccgccccagcgagacagtggggg

SEQ ID NO: 28997 - DNA, 25 bp, Homo sapien
gacagtgggggacttgcgagacttc

SEQ ID NO: 28998 - DNA, 25 bp, Homo sapien
gggacttgcgagacttcgtgaggag

SEQ ID NO: 28999 - DNA, 25 bp, Homo sapien
gacttgcgagacttcgtgaggagcc

SEQ ID NO: 29000 - DNA, 25 bp, Homo sapien
tgcgagacttcgtgaggagccacct

SEQ ID NO: 29001 - DNA, 25 bp, Homo sapien
agctgtcattttacctgttcatcac

SEQ ID NO: 29002 - DNA, 25 bp, Homo sapien
ctccaaaaacagtcctggacgacca

SEQ ID NO: 29003 - DNA, 25 bp, Homo sapien
aaaacagtcctggacgaccacacgc

SEQ ID NO: 29004 - DNA, 25 bp, Homo sapien
cgtgctggtggccaggtacatgtcc

SEQ ID NO: 29005 - DNA, 25 bp, Homo sapien
tgctggtggccaggtacatgtccag

SEQ ID NO: 29006 - DNA, 25 bp, Homo sapien
cgtcgacgtaagcacttctcagaga

SEQ ID NO: 29007 - DNA, 25 bp, Homo sapien
tgggtgccttggggtgtattttact

SEQ ID NO: 29008 - DNA, 25 bp, Homo sapien
aacctgtgtgttttccacagtccct

SEQ ID NO: 29009 - DNA, 25 bp, Homo sapien
ctgcttcccgaggttgtggtattgg

SEQ ID NO: 29010 - DNA, 25 bp, Homo sapien
ggtaggggtaacaggccaatcggtg

SEQ ID NO: 29011 - DNA, 25 bp, Homo sapien
caggccaatcggtgtggcttcagct

SEQ ID NO: 29012 - DNA, 25 bp, Homo sapien
tctctcaaactccttgcacaattcc

SEQ ID NO: 29013 - DNA, 25 bp, Homo sapien
actccttgcacaattccgtcaaatt

SEQ ID NO: 29014 - DNA, 25 bp, Homo sapien
ttattttggtcctggtcagggccct

SEQ ID NO: 29015 - DNA, 25 bp, Homo sapien
cagggccctcaaggtgatttgactg

SEQ ID NO: 29016 - DNA, 25 bp, Homo sapien
gccgagggggatgggtcatgaggtc

SEQ ID NO: 29017 - DNA, 25 bp, Homo sapien
tgacaggccagtgcgactttggctc

SEQ ID NO: 29018 - DNA, 25 bp, Homo sapien
ttggctccaactgcagattttccca

SEQ ID NO: 29019 - DNA, 25 bp, Homo sapien
gattttcccacatgtcagagcgaga

SEQ ID NO: 29020 - DNA, 25 bp, Homo sapien
gagtggctactagatgctcctgagc

SEQ ID NO: 29021 - DNA, 25 bp, Homo sapien
cccgagggccatctggaggactggc

SEQ ID NO: 29022 - DNA, 25 bp, Homo sapien
agagagccaagcggctgagctcagc

SEQ ID NO: 29023 - DNA, 25 bp, Homo sapien
tgagctcagccccaagtagcagggc

SEQ ID NO: 29024 - DNA, 25 bp, Homo sapien
gtagcagggctgaacccatcagaac

SEQ ID NO: 29025 - DNA, 25 bp, Homo sapien
atcagaaccactgtcttccagtacc

SEQ ID NO: 29026 - DNA, 25 bp, Homo sapien
gcccagagtccagtggggctgagcc

SEQ ID NO: 29027 - DNA, 25 bp, Homo sapien
tgcccccctgcttcttaagaagatg

SEQ ID NO: 29028 - DNA, 25 bp, Homo sapien
acacttctgctcaagacgctgggag

SEQ ID NO: 29029 - DNA, 25 bp, Homo sapien
cccccatcggctctggggaggacga

SEQ ID NO: 29030 - DNA, 25 bp, Homo sapien
gggaggacgaagtccagcagactgc

SEQ ID NO: 29031 - DNA, 25 bp, Homo sapien
gtccagcagactgcagcgcggattg

SEQ ID NO: 29032 - DNA, 25 bp, Homo sapien
acttggcaggctcctagctgcctgc

SEQ ID NO: 29033 - DNA, 25 bp, Homo sapien
cctccaggggccctgaggtctgttc

SEQ ID NO: 29034 - DNA, 25 bp, Homo sapien
gtgtccccagctgcaaggtggggcc

SEQ ID NO: 29035 - DNA, 25 bp, Homo sapien
gccgagtttctgcctcagaactgtc

SEQ ID NO: 29036 - DNA, 25 bp, Homo sapien
gccattgtctccgaagcgtatgtgc

SEQ ID NO: 29037 - DNA, 25 bp, Homo sapien
gtgccaggtttgagtggcgagggtg

SEQ ID NO: 29038 - DNA, 25 bp, Homo sapien
tgctggctgctcttctgaacaaata

SEQ ID NO: 29039 - DNA, 25 bp, Homo sapien
atatgcacgtagatgtatacatgta

SEQ ID NO: 29040 - DNA, 25 bp, Homo sapien
gcctggaaaaatgcacctgaaactt

SEQ ID NO: 29041 - DNA, 25 bp, Homo sapien
acctgaaacttttacagtgatcttc

SEQ ID NO: 29042 - DNA, 25 bp, Homo sapien
acagtgatcttctgggttgggagtg

SEQ ID NO: 29043 - DNA, 25 bp, Homo sapien
tgggttgggagtgacaaaagggcct

SEQ ID NO: 29044 - DNA, 25 bp, Homo sapien
acagaatgtaccatgtattacttat

SEQ ID NO: 29045 - DNA, 25 bp, Homo sapien
attttaccctcacactgtatttact

SEQ ID NO: 29046 - DNA, 25 bp, Homo sapien
accctcacactgtatttactcttac

SEQ ID NO: 29047 - DNA, 25 bp, Homo sapien
tttactcttacaattggcgtacagt

SEQ ID NO: 29048 - DNA, 25 bp, Homo sapien
attcagtctgttaataatggtcatt

SEQ ID NO: 29049 - DNA, 25 bp, Homo sapien
ggtcatttaagtttttctccagttg

SEQ ID NO: 29050 - DNA, 25 bp, Homo sapien
gagagtgagcatgaggagcggcctg

SEQ ID NO: 29051 - DNA, 25 bp, Homo sapien
agcccaacatgaaccctaagcttga

SEQ ID NO: 29052 - DNA, 25 bp, Homo sapien
ctaagcttgaggacccaaggcgccc

SEQ ID NO: 29053 - DNA, 25 bp, Homo sapien
tacctccccatacaagaccatgaag

SEQ ID NO: 29054 - DNA, 25 bp, Homo sapien
ccatgaagttcatcctgtggcggcg

SEQ ID NO: 29055 - DNA, 25 bp, Homo sapien
ttcccgaactatgctgccatgaagc

SEQ ID NO: 29056 - DNA, 25 bp, Homo sapien
gactctcctgccctgtagaaggggc

SEQ ID NO: 29057 - DNA, 25 bp, Homo sapien
cctgattgtcctgccagggtgggca

SEQ ID NO: 29058 - DNA, 25 bp, Homo sapien
cccacactcccagagttgctaacat

SEQ ID NO: 29059 - DNA, 25 bp, Homo sapien
acccaacgcttttttggatcagctc

SEQ ID NO: 29060 - DNA, 25 bp, Homo sapien
ggatcagctcagacatatttcagta

SEQ ID NO: 29061 - DNA, 25 bp, Homo sapien
ggggaggcattttaaaatccacatc

SEQ ID NO: 29062 - DNA, 25 bp, Homo sapien
aaaatgttgttctgtttgggagtgg

SEQ ID NO: 29063 - DNA, 25 bp, Homo sapien
ggagttcgagatcaacctgagcaac

SEQ ID NO: 29064 - DNA, 25 bp, Homo sapien
agatcaacctgagcaacatggtgaa

SEQ ID NO: 29065 - DNA, 25 bp, Homo sapien
tacaaacattagctgagcatggggg

SEQ ID NO: 29066 - DNA, 25 bp, Homo sapien
gctacttgggaggcttaggcacttg

SEQ ID NO: 29067 - DNA, 25 bp, Homo sapien
aggcttaggcacttgaatgagaatc

SEQ ID NO: 29068 - DNA, 25 bp, Homo sapien
tgaatgagaatcacttggacccagg

SEQ ID NO: 29069 - DNA, 25 bp, Homo sapien
actcattgagagttgggactatttc

SEQ ID NO: 29070 - DNA, 25 bp, Homo sapien
gagttgggactatttcacacataca

SEQ ID NO: 29071 - DNA, 25 bp, Homo sapien
cctggcatgtagaagggacttaatg

SEQ ID NO: 29072 - DNA, 25 bp, Homo sapien
aggttgatgatggagaccctggcca

SEQ ID NO: 29073 - DNA, 25 bp, Homo sapien
agggtcactaatgagaacactggtc

SEQ ID NO: 29074 - DNA, 25 bp, Homo sapien
gagaacactggtcaaggttactcat

SEQ ID NO: 29075 - DNA, 25 bp, Homo sapien
cactggtcaaggttactcatgagtc

SEQ ID NO: 29076 - DNA, 25 bp, Homo sapien
aaggttactcatgagtcactgggcc

SEQ ID NO: 29077 - DNA, 25 bp, Homo sapien
aatgggaagttggtcaaaatcacag

SEQ ID NO: 29078 - DNA, 25 bp, Homo sapien
aaatcacagatggctggcggggcac

SEQ ID NO: 29079 - DNA, 25 bp, Homo sapien
ggaggccgaagagggcagatccctt

SEQ ID NO: 29080 - DNA, 25 bp, Homo sapien
gaagagggcagatcccttgaaccca

SEQ ID NO: 29081 - DNA, 25 bp, Homo sapien
tctctacaaaatagttcgctgcgtg

SEQ ID NO: 29082 - DNA, 25 bp, Homo sapien
aaaatagttcgctgcgtgtggtggt

SEQ ID NO: 29083 - DNA, 25 bp, Homo sapien
ggcacaggtgtaaccgtccatgttc

SEQ ID NO: 29084 - DNA, 25 bp, Homo sapien
gtccatgttccgtgtgagcagagtc

SEQ ID NO: 29085 - DNA, 25 bp, Homo sapien
taccaacgggcaggtctgcatccgg

SEQ ID NO: 29086 - DNA, 25 bp, Homo sapien
cttctggcgacaatcctgctagtaa

SEQ ID NO: 29087 - DNA, 25 bp, Homo sapien
gcatgcccactttctgggaggggtt

SEQ ID NO: 29088 - DNA, 25 bp, Homo sapien
gggttagtgcaggtgccgtggacaa

SEQ ID NO: 29089 - DNA, 25 bp, Homo sapien
caaaggacaacatttctctggggct

SEQ ID NO: 29090 - DNA, 25 bp, Homo sapien
gagaatcttctcgacagttacttat

SEQ ID NO: 29091 - DNA, 25 bp, Homo sapien
taggatactccagactccagtcatc

SEQ ID NO: 29092 - DNA, 25 bp, Homo sapien
cccatccatggtttctgttactcat

SEQ ID NO: 29093 - DNA, 25 bp, Homo sapien
gttactcatagccaactgcagaccg

SEQ ID NO: 29094 - DNA, 25 bp, Homo sapien
gagggcatggacatcattacccaca

SEQ ID NO: 29095 - DNA, 25 bp, Homo sapien
ttgtcagcagctggcttcagagccg

SEQ ID NO: 29096 - DNA, 25 bp, Homo sapien
gacctgtaccttaatcttgtggctg

SEQ ID NO: 29097 - DNA, 25 bp, Homo sapien
ccccggttcctgcatatccggaggt

SEQ ID NO: 29098 - DNA, 25 bp, Homo sapien
tccggaggtctgggccatagcatgg

SEQ ID NO: 29099 - DNA, 25 bp, Homo sapien
gaggtggatggcactttccagagcc

SEQ ID NO: 29100 - DNA, 25 bp, Homo sapien
gagcccaggttcttatggcatttcc

SEQ ID NO: 29101 - DNA, 25 bp, Homo sapien
tccccatgctctgcatttctaggat

SEQ ID NO: 29102 - DNA, 25 bp, Homo sapien
taggacacctggattggctccatca

SEQ ID NO: 29103 - DNA, 25 bp, Homo sapien
atggacctgattgtcagcaaccctc

SEQ ID NO: 29104 - DNA, 25 bp, Homo sapien
tccgcagctatgaagaccccgcggc

SEQ ID NO: 29105 - DNA, 25 bp, Homo sapien
tagggtccaaccagatcattcttaa

SEQ ID NO: 29106 - DNA, 25 bp, Homo sapien
ggtccaaccagatcattcttaaaac

SEQ ID NO: 29107 - DNA, 25 bp, Homo sapien
aaggaatgggcggatccagtgcacg

SEQ ID NO: 29108 - DNA, 25 bp, Homo sapien
gcggatccagtgcacggatggcatt

SEQ ID NO: 29109 - DNA, 25 bp, Homo sapien
gcacggatggcattacttcactatt

SEQ ID NO: 29110 - DNA, 25 bp, Homo sapien
ggcattacttcactattaatccgat

SEQ ID NO: 29111 - DNA, 25 bp, Homo sapien
taatccgataactaacaaagcatgg

SEQ ID NO: 29112 - DNA, 25 bp, Homo sapien
gcatggaaatgtggttggcttgtct

SEQ ID NO: 29113 - DNA, 25 bp, Homo sapien
taagtctcttagttgaattgattca

SEQ ID NO: 29114 - DNA, 25 bp, Homo sapien
ttgtcttttgagggaggggcatttc

SEQ ID NO: 29115 - DNA, 25 bp, Homo sapien
ttgagggaggggcatttctaatcac

SEQ ID NO: 29116 - DNA, 25 bp, Homo sapien
gggattaccaaaggctggagcgatt

SEQ ID NO: 29117 - DNA, 25 bp, Homo sapien
ttaagctatgcactagccttgccct

SEQ ID NO: 29118 - DNA, 25 bp, Homo sapien
ccctcttaggttgcattctctttag

SEQ ID NO: 29119 - DNA, 25 bp, Homo sapien
ttctctttaggccactggttctcaa

SEQ ID NO: 29120 - DNA, 25 bp, Homo sapien
ggccactggttctcaaacattaggg

SEQ ID NO: 29121 - DNA, 25 bp, Homo sapien
aacattagggtgcactgtaaccatt

SEQ ID NO: 29122 - DNA, 25 bp, Homo sapien
tgaaaagtgcagaaacctgagcctc

SEQ ID NO: 29123 - DNA, 25 bp, Homo sapien
gtatttttcatagcaacctcaagta

SEQ ID NO: 29124 - DNA, 25 bp, Homo sapien
agggtctcgggattgcaggttgaaa

SEQ ID NO: 29125 - DNA, 25 bp, Homo sapien
gaaaaacacaaccttaatcagcagt

SEQ ID NO: 29126 - DNA, 25 bp, Homo sapien
gcagtaaattcttctctactcggcc

SEQ ID NO: 29127 - DNA, 25 bp, Homo sapien
gcaacatgtcacaacaataacctcc

SEQ ID NO: 29128 - DNA, 25 bp, Homo sapien
gtcacaacaataacctccatagcac

SEQ ID NO: 29129 - DNA, 25 bp, Homo sapien
cacaacaataacctccatagcacct

SEQ ID NO: 29130 - DNA, 25 bp, Homo sapien
ttttgcaaaagaagaggtctccctc

SEQ ID NO: 29131 - DNA, 25 bp, Homo sapien
aaagaagaggtctccctcaatcctc

SEQ ID NO: 29132 - DNA, 25 bp, Homo sapien
tcaatcctcccctttagggaaggag

SEQ ID NO: 29133 - DNA, 25 bp, Homo sapien
agggaaggagtcaacagtgtaacta

SEQ ID NO: 29134 - DNA, 25 bp, Homo sapien
aacagtgtaactaaatttctctagg

SEQ ID NO: 29135 - DNA, 25 bp, Homo sapien
cggtccagaagaatcccttctagaa

SEQ ID NO: 29136 - DNA, 25 bp, Homo sapien
aagaatcccttctagaaagcatttt

SEQ ID NO: 29137 - DNA, 25 bp, Homo sapien
agaaagcattttaggccagccatgg

SEQ ID NO: 29138 - DNA, 25 bp, Homo sapien
aggaagaggaagcccctgtatcacc

SEQ ID NO: 29139 - DNA, 25 bp, Homo sapien
ggccccactgtgatgcttggtggat

SEQ ID NO: 29140 - DNA, 25 bp, Homo sapien
gcttggtggatgcgagttcagccgc

SEQ ID NO: 29141 - DNA, 25 bp, Homo sapien
ttggtggatgcgagttcagccgcca

SEQ ID NO: 29142 - DNA, 25 bp, Homo sapien
ctgggccggcagcggaggaaacaac

SEQ ID NO: 29143 - DNA, 25 bp, Homo sapien
ggccggcagcggaggaaacaacagg

SEQ ID NO: 29144 - DNA, 25 bp, Homo sapien
gcagcggaggaaacaacaggggccc

SEQ ID NO: 29145 - DNA, 25 bp, Homo sapien
aacaggggcccaagaacagctcctg

SEQ ID NO: 29146 - DNA, 25 bp, Homo sapien
tctcctcaaatcaagccctggacag

SEQ ID NO: 29147 - DNA, 25 bp, Homo sapien
cctcaaatcaagccctggacaggtc

SEQ ID NO: 29148 - DNA, 25 bp, Homo sapien
aatcaagccctggacaggtctcgca

SEQ ID NO: 29149 - DNA, 25 bp, Homo sapien
agcatgcgtcagctaacttcagcct

SEQ ID NO: 29150 - DNA, 25 bp, Homo sapien
gagcccctcgtgcaatgcaatgaat

SEQ ID NO: 29151 - DNA, 25 bp, Homo sapien
tgcaatgaatggaccctcctgtcac

SEQ ID NO: 29152 - DNA, 25 bp, Homo sapien
cctcctgtcactctgctgaacagaa

SEQ ID NO: 29153 - DNA, 25 bp, Homo sapien
tgatcttcagccttcgtttgcaaga

SEQ ID NO: 29154 - DNA, 25 bp, Homo sapien
ttccatggcggggtaccctagggat

SEQ ID NO: 29155 - DNA, 25 bp, Homo sapien
agggattcatctgttttcttcactt

SEQ ID NO: 29156 - DNA, 25 bp, Homo sapien
gaaaccacagcaacctgtatccact

SEQ ID NO: 29157 - DNA, 25 bp, Homo sapien
ggcccattcatttgtgttgtagctc

SEQ ID NO: 29158 - DNA, 25 bp, Homo sapien
ggacagttgcagtctcacttgggac

SEQ ID NO: 29159 - DNA, 25 bp, Homo sapien
tcacttgggacaggccacagccagg

SEQ ID NO: 29160 - DNA, 25 bp, Homo sapien
gtgctgatcaagtttacagagttac

SEQ ID NO: 29161 - DNA, 25 bp, Homo sapien
gctttcctaaccattcagtcaggaa

SEQ ID NO: 29162 - DNA, 25 bp, Homo sapien
ctgggaagaagctcatagtggatat

SEQ ID NO: 29163 - DNA, 25 bp, Homo sapien
caccttgatagcctctgtttacatt

SEQ ID NO: 29164 - DNA, 25 bp, Homo sapien
cttgatagcctctgtttacattact

SEQ ID NO: 29165 - DNA, 25 bp, Homo sapien
aaataattattacctatacgtgtat

SEQ ID NO: 29166 - DNA, 25 bp, Homo sapien
cctatacgtgtatttaagcttaatt

SEQ ID NO: 29167 - DNA, 25 bp, Homo sapien
aaaagtgtgatctctaggtagtcct

SEQ ID NO: 29168 - DNA, 25 bp, Homo sapien
gtgatctctaggtagtccttagttt

SEQ ID NO: 29169 - DNA, 25 bp, Homo sapien
gtccttagtttattagtactgtact

SEQ ID NO: 29170 - DNA, 25 bp, Homo sapien
ttaaataggtccggcacggtggctc

SEQ ID NO: 29171 - DNA, 25 bp, Homo sapien
gactccatgatccccgaggaggagg

SEQ ID NO: 29172 - DNA, 25 bp, Homo sapien
cgggtgctggcacccggagggcaag

SEQ ID NO: 29173 - DNA, 25 bp, Homo sapien
ctgagcgggggtacacaggcgctgc

SEQ ID NO: 29174 - DNA, 25 bp, Homo sapien
gggcagccgaggaaatgttcgtcgc

SEQ ID NO: 29175 - DNA, 25 bp, Homo sapien
gcagccgaggaaatgttcgtcgcgg

SEQ ID NO: 29176 - DNA, 25 bp, Homo sapien
cgaggaaatgttcgtcgcggcggaa

SEQ ID NO: 29177 - DNA, 25 bp, Homo sapien
tctccgctcgaagtggagctggacc

SEQ ID NO: 29178 - DNA, 25 bp, Homo sapien
ccgctcgaagtggagctggacccgg

SEQ ID NO: 29179 - DNA, 25 bp, Homo sapien
gctcgaagtggagctggacccggag

SEQ ID NO: 29180 - DNA, 25 bp, Homo sapien
tcactctgtcccagatctacgagtg

SEQ ID NO: 29181 - DNA, 25 bp, Homo sapien
cactctgtcccagatctacgagtgg

SEQ ID NO: 29182 - DNA, 25 bp, Homo sapien
ttcctctttagaaatggcagttact

SEQ ID NO: 29183 - DNA, 25 bp, Homo sapien
acggcaaagaaacccggaggagcag

SEQ ID NO: 29184 - DNA, 25 bp, Homo sapien
gcaagagatagcatgacattctttc

SEQ ID NO: 29185 - DNA, 25 bp, Homo sapien
cctggagagcaagatagccttccac

SEQ ID NO: 29186 - DNA, 25 bp, Homo sapien
gatagccttccactgattggctggt

SEQ ID NO: 29187 - DNA, 25 bp, Homo sapien
gccttccactgattggctggtgtag

SEQ ID NO: 29188 - DNA, 25 bp, Homo sapien
tccactgattggctggtgtagcagt

SEQ ID NO: 29189 - DNA, 25 bp, Homo sapien
actgaacttcagtggagggtggtga

SEQ ID NO: 29190 - DNA, 25 bp, Homo sapien
acttcagtggagggtggtgagcagt

SEQ ID NO: 29191 - DNA, 25 bp, Homo sapien
tggtgagcagtgtccttatccaccc

SEQ ID NO: 29192 - DNA, 25 bp, Homo sapien
cattgtccagctgaactacctgtcc

SEQ ID NO: 29193 - DNA, 25 bp, Homo sapien
ggatggggttttactatgttggcca

SEQ ID NO: 29194 - DNA, 25 bp, Homo sapien
aactcctgacctcagatggatccgc

SEQ ID NO: 29195 - DNA, 25 bp, Homo sapien
ccagctgccactgatttttccaaaa

SEQ ID NO: 29196 - DNA, 25 bp, Homo sapien
gctgccactgatttttccaaaataa

SEQ ID NO: 29197 - DNA, 25 bp, Homo sapien
caaaataattatgcatccctgggaa

SEQ ID NO: 29198 - DNA, 25 bp, Homo sapien
aataattatgcatccctgggaagga

SEQ ID NO: 29199 - DNA, 25 bp, Homo sapien
ataggaaatgaaacgttttgtatat

SEQ ID NO: 29200 - DNA, 25 bp, Homo sapien
aatttggatttgtaggtggcctttg

SEQ ID NO: 29201 - DNA, 25 bp, Homo sapien
ggatttgtaggtggcctttgtaagt

SEQ ID NO: 29202 - DNA, 25 bp, Homo sapien
taggtggcctttgtaagtaatttat

SEQ ID NO: 29203 - DNA, 25 bp, Homo sapien
attatgtagaaagaacctggttggt

SEQ ID NO: 29204 - DNA, 25 bp, Homo sapien
gcctttaaccagttctcaaatctta

SEQ ID NO: 29205 - DNA, 25 bp, Homo sapien
acttaaccaatgtttaccaactatg

SEQ ID NO: 29206 - DNA, 25 bp, Homo sapien
atgtttaccaactatgcagagcaaa

SEQ ID NO: 29207 - DNA, 25 bp, Homo sapien
cattttgcatgctttcacacctaac

SEQ ID NO: 29208 - DNA, 25 bp, Homo sapien
ttcacacctaactcgacatgaaaga

SEQ ID NO: 29209 - DNA, 25 bp, Homo sapien
aatttatacttgtgagaaactctac

SEQ ID NO: 29210 - DNA, 25 bp, Homo sapien
gaatgtgacagaacttttaaccaat

SEQ ID NO: 29211 - DNA, 25 bp, Homo sapien
tttaaccaattctcaaaccttactg

SEQ ID NO: 29212 - DNA, 25 bp, Homo sapien
gattatgctcgagagaaaccataca

SEQ ID NO: 29213 - DNA, 25 bp, Homo sapien
gtggcaaagcctttaaccagtcctc

SEQ ID NO: 29214 - DNA, 25 bp, Homo sapien
tcctcacaccttactacacataaga

SEQ ID NO: 29215 - DNA, 25 bp, Homo sapien
gatacaggggacacaaacagctctg

SEQ ID NO: 29216 - DNA, 25 bp, Homo sapien
acagctctgtgtttatgaactacaa

SEQ ID NO: 29217 - DNA, 25 bp, Homo sapien
gtgtttatgaactacaaccagttgt

SEQ ID NO: 29218 - DNA, 25 bp, Homo sapien
cttccccagtgctgtgtggacgatg

SEQ ID NO: 29219 - DNA, 25 bp, Homo sapien
gtgctgtgtggacgatggactgaag

SEQ ID NO: 29220 - DNA, 25 bp, Homo sapien
ggagaaggctgggagcaagggacca

SEQ ID NO: 29221 - DNA, 25 bp, Homo sapien
gtgcaggtgagatatgaggcctcaa

SEQ ID NO: 29222 - DNA, 25 bp, Homo sapien
atatgaggcctcaactctgcagtgt

SEQ ID NO: 29223 - DNA, 25 bp, Homo sapien
gacaaccatagagagcagagagcag

SEQ ID NO: 29224 - DNA, 25 bp, Homo sapien
gagagcagagagcagaattcatcaa

SEQ ID NO: 29225 - DNA, 25 bp, Homo sapien
agaattcatcaatatttatcagcac

SEQ ID NO: 29226 - DNA, 25 bp, Homo sapien
aaagtaggcaaaggacatggacact

SEQ ID NO: 29227 - DNA, 25 bp, Homo sapien
aagccaacagacacacataatccca

SEQ ID NO: 29228 - DNA, 25 bp, Homo sapien
acataatcccaaatcatgctactat

SEQ ID NO: 29229 - DNA, 25 bp, Homo sapien
aatcccaaatcatgctactataaag

SEQ ID NO: 29230 - DNA, 25 bp, Homo sapien
tcattctccgcaaactgtcacaagg

SEQ ID NO: 29231 - DNA, 25 bp, Homo sapien
acatcacacactggggcctttcagt

SEQ ID NO: 29232 - DNA, 25 bp, Homo sapien
ggggcctttcagtgggtgggaggct

SEQ ID NO: 29233 - DNA, 25 bp, Homo sapien
cagtgggtgggaggctgggggaggg

SEQ ID NO: 29234 - DNA, 25 bp, Homo sapien
gatgagttgatgggtgtggcaaacc

SEQ ID NO: 29235 - DNA, 25 bp, Homo sapien
atggcacatatatacctatgcaaca

SEQ ID NO: 29236 - DNA, 25 bp, Homo sapien
tatgcaacaaacctgcatgttgtgc

SEQ ID NO: 29237 - DNA, 25 bp, Homo sapien
ctgacaggttcccttctaacaacta

SEQ ID NO: 29238 - DNA, 25 bp, Homo sapien
ttcccttctaacaactatttgacca

SEQ ID NO: 29239 - DNA, 25 bp, Homo sapien
gaccaagagaggcaatcagggggtt

SEQ ID NO: 29240 - DNA, 25 bp, Homo sapien
tcagggggttgtatactgcactgga

SEQ ID NO: 29241 - DNA, 25 bp, Homo sapien
atactgcactggattcgccagagaa

SEQ ID NO: 29242 - DNA, 25 bp, Homo sapien
caaatcagtgtttagtcttctgctt

SEQ ID NO: 29243 - DNA, 25 bp, Homo sapien
tgcttggcaccatagcttaacctgc

SEQ ID NO: 29244 - DNA, 25 bp, Homo sapien
gtttcttcaaaatgcccaatgcctt

SEQ ID NO: 29245 - DNA, 25 bp, Homo sapien
tgccttgtttcctattaccttagat

SEQ ID NO: 29246 - DNA, 25 bp, Homo sapien
tattaccttagattgcaaaccagtc

SEQ ID NO: 29247 - DNA, 25 bp, Homo sapien
gcaaaccagtctagggaagtctatg

SEQ ID NO: 29248 - DNA, 25 bp, Homo sapien
gcaaaatttggaggcggtggaggta

SEQ ID NO: 29249 - DNA, 25 bp, Homo sapien
ggtggaggtaattttggctgtggtg

SEQ ID NO: 29250 - DNA, 25 bp, Homo sapien
gaggaggctatgatggaggtgctgg

SEQ ID NO: 29251 - DNA, 25 bp, Homo sapien
gatggtggcaactatggtggtggtc

SEQ ID NO: 29252 - DNA, 25 bp, Homo sapien
gtggtggtcttggttatagtaaaat

SEQ ID NO: 29253 - DNA, 25 bp, Homo sapien
ggggctatggtggtggtggaccagg

SEQ ID NO: 29254 - DNA, 25 bp, Homo sapien
ggtggaggatgtgatggttgcaatg

SEQ ID NO: 29255 - DNA, 25 bp, Homo sapien
ggtggtgggaagtatagtgattttg

SEQ ID NO: 29256 - DNA, 25 bp, Homo sapien
gaaaggaggctttctgggtggaaga

SEQ ID NO: 29257 - DNA, 25 bp, Homo sapien
gggtggaagaagctcgggcagtccc

SEQ ID NO: 29258 - DNA, 25 bp, Homo sapien
gggcagtccctatggtggtgattat

SEQ ID NO: 29259 - DNA, 25 bp, Homo sapien
gtctactatagcccggagaccatcg

SEQ ID NO: 29260 - DNA, 25 bp, Homo sapien
agaccatcggcaggcgagtggctgt

SEQ ID NO: 29261 - DNA, 25 bp, Homo sapien
gctcaagctccagcgacgttggaag

SEQ ID NO: 29262 - DNA, 25 bp, Homo sapien
gggcttcaggagaattccagcggcc

SEQ ID NO: 29263 - DNA, 25 bp, Homo sapien
cactccctgggatgctacaatccaa

SEQ ID NO: 29264 - DNA, 25 bp, Homo sapien
aagatggcattagctacaccaccct

SEQ ID NO: 29265 - DNA, 25 bp, Homo sapien
tgcgctttcccgagatgaacatacc

SEQ ID NO: 29266 - DNA, 25 bp, Homo sapien
gacacggtcacttattcagcattgc

SEQ ID NO: 29267 - DNA, 25 bp, Homo sapien
agcattgcacaagcgccaagtgggc

SEQ ID NO: 29268 - DNA, 25 bp, Homo sapien
gagaacgtcattccagattttccag

SEQ ID NO: 29269 - DNA, 25 bp, Homo sapien
agagctgatccagtttggggtcggg

SEQ ID NO: 29270 - DNA, 25 bp, Homo sapien
cctgggcgacaaagcaagactcttt

SEQ ID NO: 29271 - DNA, 25 bp, Homo sapien
ctgggcgacaaagcaagactctttc

SEQ ID NO: 29272 - DNA, 25 bp, Homo sapien
tgggcgacaaagcaagactctttct

SEQ ID NO: 29273 - DNA, 25 bp, Homo sapien
gagacagaaaagatgggtttttgtt

SEQ ID NO: 29274 - DNA, 25 bp, Homo sapien
gcactttgggaagctgaggcggtgg

SEQ ID NO: 29275 - DNA, 25 bp, Homo sapien
actttgggaagctgaggcggtggat

SEQ ID NO: 29276 - DNA, 25 bp, Homo sapien
ctttgggaagctgaggcggtggatc

SEQ ID NO: 29277 - DNA, 25 bp, Homo sapien
ttgggaagctgaggcggtggatcac

SEQ ID NO: 29278 - DNA, 25 bp, Homo sapien
tgggaagctgaggcggtggatcacc

SEQ ID NO: 29279 - DNA, 25 bp, Homo sapien
ctgaggcggtggatcacctgagctc

SEQ ID NO: 29280 - DNA, 25 bp, Homo sapien
tgaggcggtggatcacctgagctca

SEQ ID NO: 29281 - DNA, 25 bp, Homo sapien
agcacagacagtgggtggcttgcat

SEQ ID NO: 29282 - DNA, 25 bp, Homo sapien
gtggcttgcatggattaggaccgtg

SEQ ID NO: 29283 - DNA, 25 bp, Homo sapien
ggaccgtgaattggatatggctcgt

SEQ ID NO: 29284 - DNA, 25 bp, Homo sapien
ggctcgttgcacatgggtctaagaa

SEQ ID NO: 29285 - DNA, 25 bp, Homo sapien
tatgtggctggacaagttacttggg

SEQ ID NO: 29286 - DNA, 25 bp, Homo sapien
gttacttggggttcaacactagaag

SEQ ID NO: 29287 - DNA, 25 bp, Homo sapien
agaagtgcacacttattccctaaac

SEQ ID NO: 29288 - DNA, 25 bp, Homo sapien
aagacttcaactttgggggagcaag

SEQ ID NO: 29289 - DNA, 25 bp, Homo sapien
gtgggacagatccatgttttaggta

SEQ ID NO: 29290 - DNA, 25 bp, Homo sapien
gaaagtgcaagcagagccaggcgcg

SEQ ID NO: 29291 - DNA, 25 bp, Homo sapien
gaagaagattccaagctgagcaagg

SEQ ID NO: 29292 - DNA, 25 bp, Homo sapien
ttcttttatgtttactgtttatgtg

SEQ ID NO: 29293 - DNA, 25 bp, Homo sapien
ataaggctcttggatgtataacata

SEQ ID NO: 29294 - DNA, 25 bp, Homo sapien
aaagctgttacactttctctgatct

SEQ ID NO: 29295 - DNA, 25 bp, Homo sapien
tctctgatctgctgtgatccactga

SEQ ID NO: 29296 - DNA, 25 bp, Homo sapien
gatccactgaaaatgtgctggggtt

SEQ ID NO: 29297 - DNA, 25 bp, Homo sapien
gtttatgctgctggaacttagcact

SEQ ID NO: 29298 - DNA, 25 bp, Homo sapien
ggaacttagcactgtcttgatttga

SEQ ID NO: 29299 - DNA, 25 bp, Homo sapien
ttgagagccatttgaagcaatcttc

SEQ ID NO: 29300 - DNA, 25 bp, Homo sapien
gacatgttcaattctgtaagtggtg

SEQ ID NO: 29301 - DNA, 25 bp, Homo sapien
gtgactttttgagcacctttcagta

SEQ ID NO: 29302 - DNA, 25 bp, Homo sapien
tgttgacacacagcttatatgtatt

SEQ ID NO: 29303 - DNA, 25 bp, Homo sapien
cttccctccatcctgtaggattttg

SEQ ID NO: 29304 - DNA, 25 bp, Homo sapien
aggattttgtagatgctggtagggg

SEQ ID NO: 29305 - DNA, 25 bp, Homo sapien
gctggggctaccttgtttttaacat

SEQ ID NO: 29306 - DNA, 25 bp, Homo sapien
gagacttaattactaactccaaggg

SEQ ID NO: 29307 - DNA, 25 bp, Homo sapien
tttacttccttgttggagaagggca

SEQ ID NO: 29308 - DNA, 25 bp, Homo sapien
gaagggcaggagagtacctgggaat

SEQ ID NO: 29309 - DNA, 25 bp, Homo sapien
agagtacctgggaatcattacgatc

SEQ ID NO: 29310 - DNA, 25 bp, Homo sapien
aggcctggctcagaatctaacctat

SEQ ID NO: 29311 - DNA, 25 bp, Homo sapien
ggctcagaatctaacctatttattg

SEQ ID NO: 29312 - DNA, 25 bp, Homo sapien
ggctggctcttactcaggaaactgc

SEQ ID NO: 29313 - DNA, 25 bp, Homo sapien
ctggctcttactcaggaaactgctg

SEQ ID NO: 29314 - DNA, 25 bp, Homo sapien
aaaattgccaattcactgacagtgc

SEQ ID NO: 29315 - DNA, 25 bp, Homo sapien
ttcactgacagtgctttgcaatgaa

SEQ ID NO: 29316 - DNA, 25 bp, Homo sapien
gaaaggtgtggttcctggaggagga

SEQ ID NO: 29317 - DNA, 25 bp, Homo sapien
gaggaggattaaaagccaccatgaa

SEQ ID NO: 29318 - DNA, 25 bp, Homo sapien
gccaccatgaaagatgatccggcag

SEQ ID NO: 29319 - DNA, 25 bp, Homo sapien
gatccggcagattatggtggttatg

SEQ ID NO: 29320 - DNA, 25 bp, Homo sapien
aaagtcactatattatgccagtttt

SEQ ID NO: 29321 - DNA, 25 bp, Homo sapien
atgccagttttttggaagtcttagt

SEQ ID NO: 29322 - DNA, 25 bp, Homo sapien
ggaagtcttagtttgagatgtgtgt

SEQ ID NO: 29323 - DNA, 25 bp, Homo sapien
ttgagatgtgtgtatttccttggaa

SEQ ID NO: 29324 - DNA, 25 bp, Homo sapien
tttccttggaaattgatgacttgaa

SEQ ID NO: 29325 - DNA, 25 bp, Homo sapien
tccctgttggtcaggcttgtctcaa

SEQ ID NO: 29326 - DNA, 25 bp, Homo sapien
tgttggtcaggcttgtctcaaactc

SEQ ID NO: 29327 - DNA, 25 bp, Homo sapien
accagcctccttaggttcaagcaat

SEQ ID NO: 29328 - DNA, 25 bp, Homo sapien
tgccttgacctcccaaagtactggg

SEQ ID NO: 29329 - DNA, 25 bp, Homo sapien
accgtgctcagcctataatgtattt

SEQ ID NO: 29330 - DNA, 25 bp, Homo sapien
tgctcagcctataatgtatttttac

SEQ ID NO: 29331 - DNA, 25 bp, Homo sapien
ttttactccaacaaacaacctgcct

SEQ ID NO: 29332 - DNA, 25 bp, Homo sapien
tactccaacaaacaacctgccttat

SEQ ID NO: 29333 - DNA, 25 bp, Homo sapien
cccatttcccaaagatttaaatcat

SEQ ID NO: 29334 - DNA, 25 bp, Homo sapien
tcattcaaaaagtaccctttcttct

SEQ ID NO: 29335 - DNA, 25 bp, Homo sapien
tcaaaaagtaccctttcttctccag

SEQ ID NO: 29336 - DNA, 25 bp, Homo sapien
aatgaatggcttaagattttatctt

SEQ ID NO: 29337 - DNA, 25 bp, Homo sapien
ggcgcgatcttggctaactgcagcc

SEQ ID NO: 29338 - DNA, 25 bp, Homo sapien
ccacttcccaagttcaagcgattct

SEQ ID NO: 29339 - DNA, 25 bp, Homo sapien
cacgcctggcctatgtttaataatg

SEQ ID NO: 29340 - DNA, 25 bp, Homo sapien
ttcctcctctcattgtaacgaaatt

SEQ ID NO: 29341 - DNA, 25 bp, Homo sapien
gtaacgaaattaattccagctgcag

SEQ ID NO: 29342 - DNA, 25 bp, Homo sapien
cgaaattaattccagctgcagtgag

SEQ ID NO: 29343 - DNA, 25 bp, Homo sapien
aattccagctgcagtgagaaaactt

SEQ ID NO: 29344 - DNA, 25 bp, Homo sapien
gtgacttaaccatttgctctatgtg

SEQ ID NO: 29345 - DNA, 25 bp, Homo sapien
aaccatttgctctatgtgatgttta

SEQ ID NO: 29346 - DNA, 25 bp, Homo sapien
atttgctctatgtgatgtttattat

SEQ ID NO: 29347 - DNA, 25 bp, Homo sapien
gtttgatgtctattatctcacttca

SEQ ID NO: 29348 - DNA, 25 bp, Homo sapien
cccatccgagccttaatttcagttg

SEQ ID NO: 29349 - DNA, 25 bp, Homo sapien
tgacagtaactattggatccccagg

SEQ ID NO: 29350 - DNA, 25 bp, Homo sapien
ttggatccccaggaatatgtttgca

SEQ ID NO: 29351 - DNA, 25 bp, Homo sapien
aatgctactaagggtctcactgtgt

SEQ ID NO: 29352 - DNA, 25 bp, Homo sapien
gtacagattgtgtctccttatgttg

SEQ ID NO: 29353 - DNA, 25 bp, Homo sapien
aagcgatctttccatcttagcttcc

SEQ ID NO: 29354 - DNA, 25 bp, Homo sapien
tccatcttagcttcccaaattgttg

SEQ ID NO: 29355 - DNA, 25 bp, Homo sapien
gagccagtgtgcttggcctgatttt

SEQ ID NO: 29356 - DNA, 25 bp, Homo sapien
ttgtaagacgaggacttgctatgtt

SEQ ID NO: 29357 - DNA, 25 bp, Homo sapien
ccaaagcgtttgggccggcagatgt

SEQ ID NO: 29358 - DNA, 25 bp, Homo sapien
aaatctcgtctcgaccaagagctga

SEQ ID NO: 29359 - DNA, 25 bp, Homo sapien
agagctgaagctgatcggcgagtat

SEQ ID NO: 29360 - DNA, 25 bp, Homo sapien
gatcggcgagtatgggctccggaac

SEQ ID NO: 29361 - DNA, 25 bp, Homo sapien
ggctccggaacaaacgtgaggtctg

SEQ ID NO: 29362 - DNA, 25 bp, Homo sapien
gtcaaatttaccctggccaagatcc

SEQ ID NO: 29363 - DNA, 25 bp, Homo sapien
ccgggaactgctgacgcttgatgag

SEQ ID NO: 29364 - DNA, 25 bp, Homo sapien
gcttgatgagaaggacccacggcgt

SEQ ID NO: 29365 - DNA, 25 bp, Homo sapien
cacggcgtctgttcgaaggcaacgc

SEQ ID NO: 29366 - DNA, 25 bp, Homo sapien
gaagctggattacatcctgggcctg

SEQ ID NO: 29367 - DNA, 25 bp, Homo sapien
ttcttagagagacgcctgcagaccc

SEQ ID NO: 29368 - DNA, 25 bp, Homo sapien
tcaagctgggcttggccaagtccat

SEQ ID NO: 29369 - DNA, 25 bp, Homo sapien
gatgaaatctcactgctaatgctca

SEQ ID NO: 29370 - DNA, 25 bp, Homo sapien
ttgccttggttattatggatgatag

SEQ ID NO: 29371 - DNA, 25 bp, Homo sapien
atagcccttataatgccttaactaa

SEQ ID NO: 29372 - DNA, 25 bp, Homo sapien
aaagatgttattctgagtttgtttt

SEQ ID NO: 29373 - DNA, 25 bp, Homo sapien
agcagggagatactaacctttggaa

SEQ ID NO: 29374 - DNA, 25 bp, Homo sapien
ctttggaaatgattagctggctctg

SEQ ID NO: 29375 - DNA, 25 bp, Homo sapien
gaaatgattagctggctctgttttt

SEQ ID NO: 29376 - DNA, 25 bp, Homo sapien
ctttctccatcaagagttacttacc

SEQ ID NO: 29377 - DNA, 25 bp, Homo sapien
caagagttacttaccaagggcaggg

SEQ ID NO: 29378 - DNA, 25 bp, Homo sapien
ggggaagggggatatagaggtcaca

SEQ ID NO: 29379 - DNA, 25 bp, Homo sapien
gaaataaaaatcatctttcatcttt

SEQ ID NO: 29380 - DNA, 25 bp, Homo sapien
tggtggagcagatgggtgctctggg

SEQ ID NO: 29381 - DNA, 25 bp, Homo sapien
cagatgggtgctctgggagtcctgt

SEQ ID NO: 29382 - DNA, 25 bp, Homo sapien
tgcttcctgatccaatggtgccaaa

SEQ ID NO: 29383 - DNA, 25 bp, Homo sapien
atccaatggtgccaaacccttcatc

SEQ ID NO: 29384 - DNA, 25 bp, Homo sapien
cccagaagcgcagcatacccctggg

SEQ ID NO: 29385 - DNA, 25 bp, Homo sapien
ctgattcccaccccacataggaata

SEQ ID NO: 29386 - DNA, 25 bp, Homo sapien
ataggaatagcctgactgaggggga

SEQ ID NO: 29387 - DNA, 25 bp, Homo sapien
aatagcctgactgagggggaagggg

SEQ ID NO: 29388 - DNA, 25 bp, Homo sapien
gatacagacatggaggaggggaggc

SEQ ID NO: 29389 - DNA, 25 bp, Homo sapien
ggcaaagtcttcaaggcttttgggg

SEQ ID NO: 29390 - DNA, 25 bp, Homo sapien
gtcttcaaggcttttgggggtccag

SEQ ID NO: 29391 - DNA, 25 bp, Homo sapien
acaaagtgagattgttcctacaaaa

SEQ ID NO: 29392 - DNA, 25 bp, Homo sapien
gccgtgattacaggcgtgtgccacc

SEQ ID NO: 29393 - DNA, 25 bp, Homo sapien
gtctcgaacttctgacctcatgatc

SEQ ID NO: 29394 - DNA, 25 bp, Homo sapien
tcgaacttctgacctcatgatctgc

SEQ ID NO: 29395 - DNA, 25 bp, Homo sapien
ccacccaaagtgctgggaccacaag

SEQ ID NO: 29396 - DNA, 25 bp, Homo sapien
ggaccacaagtgtgagccaccatgc

SEQ ID NO: 29397 - DNA, 25 bp, Homo sapien
aaattaggtgggcatggtggtgtac

SEQ ID NO: 29398 - DNA, 25 bp, Homo sapien
gcatggtggtgtacacctgcggtcc

SEQ ID NO: 29399 - DNA, 25 bp, Homo sapien
ggaggatggattgaggccaggagtt

SEQ ID NO: 29400 - DNA, 25 bp, Homo sapien
aaagagagatcctaggttgatgaga

SEQ ID NO: 29401 - DNA, 25 bp, Homo sapien
aggttgatgagaatgatccagtaga

SEQ ID NO: 29402 - DNA, 25 bp, Homo sapien
tgcctcctgtctcaacactgacagc

SEQ ID NO: 29403 - DNA, 25 bp, Homo sapien
cctcctgtctcaacactgacagctg

SEQ ID NO: 29404 - DNA, 25 bp, Homo sapien
cctgtctcaacactgacagctgtgc

SEQ ID NO: 29405 - DNA, 25 bp, Homo sapien
tccttgcagggatctgagccaccct

SEQ ID NO: 29406 - DNA, 25 bp, Homo sapien
cagggagaggatggttgtccctggg

SEQ ID NO: 29407 - DNA, 25 bp, Homo sapien
tctcttgtagcttcctggggtggga

SEQ ID NO: 29408 - DNA, 25 bp, Homo sapien
acaggggcaaagcaataccccaggg

SEQ ID NO: 29409 - DNA, 25 bp, Homo sapien
gggcaaagcaataccccagggaaag

SEQ ID NO: 29410 - DNA, 25 bp, Homo sapien
caaagcaataccccagggaaagtgg

SEQ ID NO: 29411 - DNA, 25 bp, Homo sapien
gggactgctgtgatggggtatcacg

SEQ ID NO: 29412 - DNA, 25 bp, Homo sapien
gctgtgatggggtatcacggtgatg

SEQ ID NO: 29413 - DNA, 25 bp, Homo sapien
ggagcattttgtgaagaaggtggag

SEQ ID NO: 29414 - DNA, 25 bp, Homo sapien
cttcattcccatgcagtttgggatc

SEQ ID NO: 29415 - DNA, 25 bp, Homo sapien
agtttgggatcatccagaagcatct

SEQ ID NO: 29416 - DNA, 25 bp, Homo sapien
aagcatctgaagaccatggatcaca

SEQ ID NO: 29417 - DNA, 25 bp, Homo sapien
agaccatggatcacaaccggaaccg

SEQ ID NO: 29418 - DNA, 25 bp, Homo sapien
acaaccggaaccgcaggctcatgat

SEQ ID NO: 29419 - DNA, 25 bp, Homo sapien
gaaccgcaggctcatgatggagcag

SEQ ID NO: 29420 - DNA, 25 bp, Homo sapien
gatggagcagtccaagaagtcctcc

SEQ ID NO: 29421 - DNA, 25 bp, Homo sapien
gcccgcagtattctcaacaacaagc

SEQ ID NO: 29422 - DNA, 25 bp, Homo sapien
aacaacaagctcatcagcaagaagc

SEQ ID NO: 29423 - DNA, 25 bp, Homo sapien
tgaagggcgagaaccctttcaccga

SEQ ID NO: 29424 - DNA, 25 bp, Homo sapien
tcctcccatggagggttttgtgggg

SEQ ID NO: 29425 - DNA, 25 bp, Homo sapien
tcccctgctgccattttgatagtat

SEQ ID NO: 29426 - DNA, 25 bp, Homo sapien
gagtcatctcttcctatatttggtg

SEQ ID NO: 29427 - DNA, 25 bp, Homo sapien
atttgggagggaatcttcctgccgc

SEQ ID NO: 29428 - DNA, 25 bp, Homo sapien
tcccccccagatgtttatttttgat

SEQ ID NO: 29429 - DNA, 25 bp, Homo sapien
caaatgtgtattttcagttccctcc

SEQ ID NO: 29430 - DNA, 25 bp, Homo sapien
gacactttcaatgtccctggaggtg

SEQ ID NO: 29431 - DNA, 25 bp, Homo sapien
gacataaagcctgtcctgtctctat

SEQ ID NO: 29432 - DNA, 25 bp, Homo sapien
gtgggttcaaaagactcctgggctt

SEQ ID NO: 29433 - DNA, 25 bp, Homo sapien
tgatttgggggacggtgctacactc

SEQ ID NO: 29434 - DNA, 25 bp, Homo sapien
ccactgttttgcttccccaaaatgg

SEQ ID NO: 29435 - DNA, 25 bp, Homo sapien
ctgaataaattgactggtgtgtttg

SEQ ID NO: 29436 - DNA, 25 bp, Homo sapien
ccagtccccacaatttgagagagtg

SEQ ID NO: 29437 - DNA, 25 bp, Homo sapien
acagacttaagtatgtcctcactgg

SEQ ID NO: 29438 - DNA, 25 bp, Homo sapien
agacttaagtatgtcctcactggaa

SEQ ID NO: 29439 - DNA, 25 bp, Homo sapien
gcagcggttcattaagatcaatggc

SEQ ID NO: 29440 - DNA, 25 bp, Homo sapien
agatcaatggcaaggtccgtactga

SEQ ID NO: 29441 - DNA, 25 bp, Homo sapien
ggtccgtactgatataacctactct

SEQ ID NO: 29442 - DNA, 25 bp, Homo sapien
gtactgatataacctactctgctgg

SEQ ID NO: 29443 - DNA, 25 bp, Homo sapien
tcaacagcattgacaagtcgggaga

SEQ ID NO: 29444 - DNA, 25 bp, Homo sapien
gaagcatctgaagcaggtagcagct

SEQ ID NO: 29445 - DNA, 25 bp, Homo sapien
gaagcaggtagcagctccaaagcat

SEQ ID NO: 29446 - DNA, 25 bp, Homo sapien
aatgataaaaaacgtcagttctcct

SEQ ID NO: 29447 - DNA, 25 bp, Homo sapien
gtcagttctccttaaagaagttaga

SEQ ID NO: 29448 - DNA, 25 bp, Homo sapien
gaagttagaaatctctggcattgaa

SEQ ID NO: 29449 - DNA, 25 bp, Homo sapien
tcatgaaccaggaaaaactcgccaa

SEQ ID NO: 29450 - DNA, 25 bp, Homo sapien
gaaaaactcgccaaactgcaggcaa

SEQ ID NO: 29451 - DNA, 25 bp, Homo sapien
actgcaggcaaaagtgcccattggt

SEQ ID NO: 29452 - DNA, 25 bp, Homo sapien
agtgcccattggtggaactgctcac

SEQ ID NO: 29453 - DNA, 25 bp, Homo sapien
gcccattggtggaactgctcacaga

SEQ ID NO: 29454 - DNA, 25 bp, Homo sapien
ggaactgctcacagaaagaaggtgg

SEQ ID NO: 29455 - DNA, 25 bp, Homo sapien
gaaggtggttcacagaacagccaca

SEQ ID NO: 29456 - DNA, 25 bp, Homo sapien
ggttcacagaacagccacagcaaat

SEQ ID NO: 29457 - DNA, 25 bp, Homo sapien
gcctcagcctctctgagaagctggg

SEQ ID NO: 29458 - DNA, 25 bp, Homo sapien
cgcacccggcctgaaaatattttct

SEQ ID NO: 29459 - DNA, 25 bp, Homo sapien
ggaggatgtgcctaggttatatgca

SEQ ID NO: 29460 - DNA, 25 bp, Homo sapien
gttatatgcaaatactgtgccattt

SEQ ID NO: 29461 - DNA, 25 bp, Homo sapien
tgtgccattttatatcaggaacttg

SEQ ID NO: 29462 - DNA, 25 bp, Homo sapien
aggaacttgagcatctgcagatatt

SEQ ID NO: 29463 - DNA, 25 bp, Homo sapien
tggtatcggagggcggtcctggaac

SEQ ID NO: 29464 - DNA, 25 bp, Homo sapien
gtcctggaaccaagcatccacggat

SEQ ID NO: 29465 - DNA, 25 bp, Homo sapien
gcatccacggatactgaggggtgac

SEQ ID NO: 29466 - DNA, 25 bp, Homo sapien
gaggggtgacatttcatgaagtgta

SEQ ID NO: 29467 - DNA, 25 bp, Homo sapien
gattttttttctgacaatgtgacca

SEQ ID NO: 29468 - DNA, 25 bp, Homo sapien
gatgttttgtttctgttttttactg

SEQ ID NO: 29469 - DNA, 25 bp, Homo sapien
atgttaaccaagtcacagtgttttt

SEQ ID NO: 29470 - DNA, 25 bp, Homo sapien
gtttttctgaaatcttggtttgatc

SEQ ID NO: 29471 - DNA, 25 bp, Homo sapien
tgatcaaatctttttttttttctct

SEQ ID NO: 29472 - DNA, 25 bp, Homo sapien
tctcttgagatggagtcttactctg

SEQ ID NO: 29473 - DNA, 25 bp, Homo sapien
ccacctcacaggttcaagcgattct

SEQ ID NO: 29474 - DNA, 25 bp, Homo sapien
gatggggtttcaccaagttggctag

SEQ ID NO: 29475 - DNA, 25 bp, Homo sapien
ggctagactagtcttgaactcctga

SEQ ID NO: 29476 - DNA, 25 bp, Homo sapien
ccactatacccgaccagatcaaatc

SEQ ID NO: 29477 - DNA, 25 bp, Homo sapien
attttcctaatgttcttgatttaat

SEQ ID NO: 29478 - DNA, 25 bp, Homo sapien
gtgtattttatttgcctctagcttt

SEQ ID NO: 29479 - DNA, 25 bp, Homo sapien
ggagggaggtgatggtttgtgggga

SEQ ID NO: 29480 - DNA, 25 bp, Homo sapien
ggggaccatgagttaatctgcctcc

SEQ ID NO: 29481 - DNA, 25 bp, Homo sapien
ccctgtcagcattttcgcactatgc

SEQ ID NO: 29482 - DNA, 25 bp, Homo sapien
gcactatgcaggtagcttcaatggc

SEQ ID NO: 29483 - DNA, 25 bp, Homo sapien
aagagtatgtaccttgcaattccaa

SEQ ID NO: 29484 - DNA, 25 bp, Homo sapien
gaatgcatctcctggtcaacagatt

SEQ ID NO: 29485 - DNA, 25 bp, Homo sapien
ttaaccagagtcccaacattgccaa

SEQ ID NO: 29486 - DNA, 25 bp, Homo sapien
gaataggccagtctgagaaccacca

SEQ ID NO: 29487 - DNA, 25 bp, Homo sapien
gagaaccaccaatctgtgtttgtgc

SEQ ID NO: 29488 - DNA, 25 bp, Homo sapien
aatctgtgtttgtgcattcattcat

SEQ ID NO: 29489 - DNA, 25 bp, Homo sapien
gaaacaagcactctaggctgggctt

SEQ ID NO: 29490 - DNA, 25 bp, Homo sapien
ccccaaactcctcatctatggtaac

SEQ ID NO: 29491 - DNA, 25 bp, Homo sapien
atctatggtaacaccgatcggccct

SEQ ID NO: 29492 - DNA, 25 bp, Homo sapien
ccatcactgggctccaggctgagga

SEQ ID NO: 29493 - DNA, 25 bp, Homo sapien
gggctccaggctgaggatgaggctg

SEQ ID NO: 29494 - DNA, 25 bp, Homo sapien
gatgaggctgattattactgcaagt

SEQ ID NO: 29495 - DNA, 25 bp, Homo sapien
ggctgattattactgcaagtcctat

SEQ ID NO: 29496 - DNA, 25 bp, Homo sapien
gcaagtcctatgacagcagcctgag

SEQ ID NO: 29497 - DNA, 25 bp, Homo sapien
tcctgcactgggagcagctcctaca

SEQ ID NO: 29498 - DNA, 25 bp, Homo sapien
agctcctacatcggggcaggttatg

SEQ ID NO: 29499 - DNA, 25 bp, Homo sapien
ggggcaggttatgatgtacactggt

SEQ ID NO: 29500 - DNA, 25 bp, Homo sapien
atgtacactggtaccggcaacttcc

SEQ ID NO: 29501 - DNA, 25 bp, Homo sapien
tcctggctggggatcctggagtttt

SEQ ID NO: 29502 - DNA, 25 bp, Homo sapien
ttctctctccaggggacagtcctga

SEQ ID NO: 29503 - DNA, 25 bp, Homo sapien
gatgaagctcctcagaatactcctc

SEQ ID NO: 29504 - DNA, 25 bp, Homo sapien
accatgcttctacctgagggcagac

SEQ ID NO: 29505 - DNA, 25 bp, Homo sapien
tgagggcagactaaccttcagctcc

SEQ ID NO: 29506 - DNA, 25 bp, Homo sapien
taaaccccacctccacaaaggtgag

SEQ ID NO: 29507 - DNA, 25 bp, Homo sapien
aagggccagggctctagagataagc

SEQ ID NO: 29508 - DNA, 25 bp, Homo sapien
gataagcagcccttgtttcgaatcc

SEQ ID NO: 29509 - DNA, 25 bp, Homo sapien
ctgtgatcttatagaaggccgggca

SEQ ID NO: 29510 - DNA, 25 bp, Homo sapien
gggaggccgcggcagaaggatcacc

SEQ ID NO: 29511 - DNA, 25 bp, Homo sapien
tgcagggagccaagagcgtgccact

SEQ ID NO: 29512 - DNA, 25 bp, Homo sapien
gacccaggtgggacttagcagtgag

SEQ ID NO: 29513 - DNA, 25 bp, Homo sapien
ggaagacttgggttgatctcttaga

SEQ ID NO: 29514 - DNA, 25 bp, Homo sapien
tccctcattcatcttgcaagcaaat

SEQ ID NO: 29515 - DNA, 25 bp, Homo sapien
atcttgcaagcaaatcccatttctt

SEQ ID NO: 29516 - DNA, 25 bp, Homo sapien
gaaaagccttggagaactcggtttg

SEQ ID NO: 29517 - DNA, 25 bp, Homo sapien
gaactcggtttggtagacttggaca

SEQ ID NO: 29518 - DNA, 25 bp, Homo sapien
ttggtagacttggacatctctctgg

SEQ ID NO: 29519 - DNA, 25 bp, Homo sapien
gacatctctctggcttctgaagagc

SEQ ID NO: 29520 - DNA, 25 bp, Homo sapien
ccctttgttaccatactgtctctgg

SEQ ID NO: 29521 - DNA, 25 bp, Homo sapien
catgctcagtgccttttggtttcac

SEQ ID NO: 29522 - DNA, 25 bp, Homo sapien
tttatcaaatttgccatgacatttc

SEQ ID NO: 29523 - DNA, 25 bp, Homo sapien
ctcagcctcccgagaagctaggact

SEQ ID NO: 29524 - DNA, 25 bp, Homo sapien
gctaggactacaggcgtgtgccacc

SEQ ID NO: 29525 - DNA, 25 bp, Homo sapien
tctcactttgttgtccaggctgaca

SEQ ID NO: 29526 - DNA, 25 bp, Homo sapien
gtccaggctgacagaactgcatttt

SEQ ID NO: 29527 - DNA, 25 bp, Homo sapien
gctgacagaactgcatttttaattc

SEQ ID NO: 29528 - DNA, 25 bp, Homo sapien
tataattctttataggacttcctgg

SEQ ID NO: 29529 - DNA, 25 bp, Homo sapien
ttctttataggacttcctggtcaat

SEQ ID NO: 29530 - DNA, 25 bp, Homo sapien
ggacttcctggtcaatacagtaatg

SEQ ID NO: 29531 - DNA, 25 bp, Homo sapien
taatttaagtggtctcactctgtta

SEQ ID NO: 29532 - DNA, 25 bp, Homo sapien
gtctcactctgttacccaggatgga

SEQ ID NO: 29533 - DNA, 25 bp, Homo sapien
gttacccaggatggagtgcagtggt

SEQ ID NO: 29534 - DNA, 25 bp, Homo sapien
ctactactactactgctcgaattca

SEQ ID NO: 29535 - DNA, 25 bp, Homo sapien
actactactactgctcgaattcaag

SEQ ID NO: 29536 - DNA, 25 bp, Homo sapien
actactgctcgaattcaagcttcta

SEQ ID NO: 29537 - DNA, 25 bp, Homo sapien
ctgctcgaattcaagcttctaacga

SEQ ID NO: 29538 - DNA, 25 bp, Homo sapien
aattcaagcttctaacgatgtacgg

SEQ ID NO: 29539 - DNA, 25 bp, Homo sapien
aagcttctaacgatgtacggggaca

SEQ ID NO: 29540 - DNA, 25 bp, Homo sapien
gatgtacggggacatgagggcttcc

SEQ ID NO: 29541 - DNA, 25 bp, Homo sapien
gtacggggacatgagggcttccaat

SEQ ID NO: 29542 - DNA, 25 bp, Homo sapien
ggggacatgagggcttccaatgtgc

SEQ ID NO: 29543 - DNA, 25 bp, Homo sapien
gacatgagggcttccaatgtgctgc

SEQ ID NO: 29544 - DNA, 25 bp, Homo sapien
atgagggcttccaatgtgctgcccc

SEQ ID NO: 29545 - DNA, 25 bp, Homo sapien
ttcttctaggggagccattccagtt

SEQ ID NO: 29546 - DNA, 25 bp, Homo sapien
tcttctaggggagccattccagtta

SEQ ID NO: 29547 - DNA, 25 bp, Homo sapien
ttctaggggagccattccagttaaa

SEQ ID NO: 29548 - DNA, 25 bp, Homo sapien
ctaggggagccattccagttaaaag

SEQ ID NO: 29549 - DNA, 25 bp, Homo sapien
aggggagccattccagttaaaagag

SEQ ID NO: 29550 - DNA, 25 bp, Homo sapien
ggagccattccagttaaaagaggtc

SEQ ID NO: 29551 - DNA, 25 bp, Homo sapien
gccattccagttaaaagaggtccct

SEQ ID NO: 29552 - DNA, 25 bp, Homo sapien
cattccagttaaaagaggtccctct

SEQ ID NO: 29553 - DNA, 25 bp, Homo sapien
aagaggtccctcttcaagaagtcga

SEQ ID NO: 29554 - DNA, 25 bp, Homo sapien
agaggtccctcttcaagaagtcgag

SEQ ID NO: 29555 - DNA, 25 bp, Homo sapien
gaggtccctcttcaagaagtcgagt

SEQ ID NO: 29556 - DNA, 25 bp, Homo sapien
gtgaaggtatgcaaaagcctacttt

SEQ ID NO: 29557 - DNA, 25 bp, Homo sapien
cgagcctgcaaaagcctaaactctt

SEQ ID NO: 29558 - DNA, 25 bp, Homo sapien
gcctaaactcttttttgtggcatta

SEQ ID NO: 29559 - DNA, 25 bp, Homo sapien
aactcttttttgtggcattacttgt

SEQ ID NO: 29560 - DNA, 25 bp, Homo sapien
tcttttttgtggcattacttgttac

SEQ ID NO: 29561 - DNA, 25 bp, Homo sapien
gtggcattacttgttacatggtttc

SEQ ID NO: 29562 - DNA, 25 bp, Homo sapien
gttacatggtttctacatctgcgtt

SEQ ID NO: 29563 - DNA, 25 bp, Homo sapien
acatggtttctacatctgcgtttgc

SEQ ID NO: 29564 - DNA, 25 bp, Homo sapien
ctacatctgcgtttgcctttttgta

SEQ ID NO: 29565 - DNA, 25 bp, Homo sapien
gtaagttctctgatcccaaactgtt

SEQ ID NO: 29566 - DNA, 25 bp, Homo sapien
ttctctgatcccaaactgtttatat

SEQ ID NO: 29567 - DNA, 25 bp, Homo sapien
aacactcacatgggacagactgggc

SEQ ID NO: 29568 - DNA, 25 bp, Homo sapien
cactcacatgggacagactgggcga

SEQ ID NO: 29569 - DNA, 25 bp, Homo sapien
cacatgggacagactgggcgagggg

SEQ ID NO: 29570 - DNA, 25 bp, Homo sapien
tgggacagactgggcgagggggagc

SEQ ID NO: 29571 - DNA, 25 bp, Homo sapien
gatatacatccatacagatttgggg

SEQ ID NO: 29572 - DNA, 25 bp, Homo sapien
ggggatgcttaagaaccacccccag

SEQ ID NO: 29573 - DNA, 25 bp, Homo sapien
agcctgagaaacatggcgaaccctg

SEQ ID NO: 29574 - DNA, 25 bp, Homo sapien
tgggctatagagcgatacctccatc

SEQ ID NO: 29575 - DNA, 25 bp, Homo sapien
ggctatagagcgatacctccatctc

SEQ ID NO: 29576 - DNA, 25 bp, Homo sapien
caagatacaacactcacatgggaca

SEQ ID NO: 29577 - DNA, 25 bp, Homo sapien
gatacaacactcacatgggacagac

SEQ ID NO: 29578 - DNA, 25 bp, Homo sapien
tcctgatacctctcactcaagggga

SEQ ID NO: 29579 - DNA, 25 bp, Homo sapien
cccgtgttcatcccttgtaaggtga

SEQ ID NO: 29580 - DNA, 25 bp, Homo sapien
gtgagttcagtctacgttgtctctt

SEQ ID NO: 29581 - DNA, 25 bp, Homo sapien
gttgtctctttccagtcactggatg

SEQ ID NO: 29582 - DNA, 25 bp, Homo sapien
tccagtcactggatgcgtggcacca

SEQ ID NO: 29583 - DNA, 25 bp, Homo sapien
gatgcgtggcaccaactggtcaatg

SEQ ID NO: 29584 - DNA, 25 bp, Homo sapien
actggtcaatgggtgcttggtgcca

SEQ ID NO: 29585 - DNA, 25 bp, Homo sapien
caggccatgtcctgaagggttcctc

SEQ ID NO: 29586 - DNA, 25 bp, Homo sapien
gttcctcaggaggtcgggactaggg

SEQ ID NO: 29587 - DNA, 25 bp, Homo sapien
gagacctgcaatcactcttgttggt

SEQ ID NO: 29588 - DNA, 25 bp, Homo sapien
tcttgttggtcttgagcccattcat

SEQ ID NO: 29589 - DNA, 25 bp, Homo sapien
tacttccagtctctgacgactctag

SEQ ID NO: 29590 - DNA, 25 bp, Homo sapien
agtctctgacgactctagtgacctc

SEQ ID NO: 29591 - DNA, 25 bp, Homo sapien
tgacgactctagtgacctcctagga

SEQ ID NO: 29592 - DNA, 25 bp, Homo sapien
gactctagtgacctcctaggagtga

SEQ ID NO: 29593 - DNA, 25 bp, Homo sapien
gacctcctaggagtgacatcagtgt

SEQ ID NO: 29594 - DNA, 25 bp, Homo sapien
gagtgacatcagtgtttgtcccttt

SEQ ID NO: 29595 - DNA, 25 bp, Homo sapien
ggtctggcttgctttggccaagaca

SEQ ID NO: 29596 - DNA, 25 bp, Homo sapien
ggcttgctttggccaagacaatttt

SEQ ID NO: 29597 - DNA, 25 bp, Homo sapien
gaaggggaagcactgtccccatcac

SEQ ID NO: 29598 - DNA, 25 bp, Homo sapien
ctgctgcacagaacagtgggcgcgt

SEQ ID NO: 29599 - DNA, 25 bp, Homo sapien
aacagtgggcgcgttacagaccacc

SEQ ID NO: 29600 - DNA, 25 bp, Homo sapien
ggggcggagctgatccgagaggaca

SEQ ID NO: 29601 - DNA, 25 bp, Homo sapien
cgagaggacatccagggggctctgc

SEQ ID NO: 29602 - DNA, 25 bp, Homo sapien
ggccacgcaggaggagttgcagcgc

SEQ ID NO: 29603 - DNA, 25 bp, Homo sapien
tgatcagcaccgtagagcggggcgc

SEQ ID NO: 29604 - DNA, 25 bp, Homo sapien
agcccattcccgaggcagaggaggc

SEQ ID NO: 29605 - DNA, 25 bp, Homo sapien
cagaggaggcgcagaggcctgagcc

SEQ ID NO: 29606 - DNA, 25 bp, Homo sapien
gcaggcggagcgggaagtggacatc

SEQ ID NO: 29607 - DNA, 25 bp, Homo sapien
tggacatcctgaaccacgtgttcga

SEQ ID NO: 29608 - DNA, 25 bp, Homo sapien
gaaccacgtgttcgacgacgtagag

SEQ ID NO: 29609 - DNA, 25 bp, Homo sapien
gacgtagagagctttgtatcgaggc

SEQ ID NO: 29610 - DNA, 25 bp, Homo sapien
ggtttgagattggacccagggtcaa

SEQ ID NO: 29611 - DNA, 25 bp, Homo sapien
catcctggatcatgagtgttctgaa

SEQ ID NO: 29612 - DNA, 25 bp, Homo sapien
gagtgttctgaattccatgttacaa

SEQ ID NO: 29613 - DNA, 25 bp, Homo sapien
gaattccatgttacaaagcttaatg

SEQ ID NO: 29614 - DNA, 25 bp, Homo sapien
aagcttaatggtgttgccactgccc

SEQ ID NO: 29615 - DNA, 25 bp, Homo sapien
ccactgcccttttgtacacacatgg

SEQ ID NO: 29616 - DNA, 25 bp, Homo sapien
actgcccttttgtacacacatggaa

SEQ ID NO: 29617 - DNA, 25 bp, Homo sapien
acacacatggaaatccctcattttt

SEQ ID NO: 29618 - DNA, 25 bp, Homo sapien
gtgaaattaatcaggtggtccacct

SEQ ID NO: 29619 - DNA, 25 bp, Homo sapien
tagtgatgtattttgcagtagcgct

SEQ ID NO: 29620 - DNA, 25 bp, Homo sapien
ttttgcagtagcgctgctgggcggt

SEQ ID NO: 29621 - DNA, 25 bp, Homo sapien
attttatggtacatgcttaggggtg

SEQ ID NO: 29622 - DNA, 25 bp, Homo sapien
cttacagtgatctcatctcctatta

SEQ ID NO: 29623 - DNA, 25 bp, Homo sapien
ggttcttggccagtttctcaatgac

SEQ ID NO: 29624 - DNA, 25 bp, Homo sapien
atctggaggccatcctttaagcttc

SEQ ID NO: 29625 - DNA, 25 bp, Homo sapien
taagcttcttgcaacagtctgggag

SEQ ID NO: 29626 - DNA, 25 bp, Homo sapien
agagtttactcgccactgggtagtg

SEQ ID NO: 29627 - DNA, 25 bp, Homo sapien
tgggtagtgggccatggacacccca

SEQ ID NO: 29628 - DNA, 25 bp, Homo sapien
ccagtctccaccagaagttcgggat

SEQ ID NO: 29629 - DNA, 25 bp, Homo sapien
agacctggccctttgcagagttaaa

SEQ ID NO: 29630 - DNA, 25 bp, Homo sapien
cacacctgtaatccctggactttgg

SEQ ID NO: 29631 - DNA, 25 bp, Homo sapien
gaggctgaggccagagaatcacctg

SEQ ID NO: 29632 - DNA, 25 bp, Homo sapien
caagggtttgaaaccagcgtggcca

SEQ ID NO: 29633 - DNA, 25 bp, Homo sapien
tggattttaacctaggactgccggg

SEQ ID NO: 29634 - DNA, 25 bp, Homo sapien
taacctaggactgccgggagctggc

SEQ ID NO: 29635 - DNA, 25 bp, Homo sapien
tgtctaactggcttgtttctcttta

SEQ ID NO: 29636 - DNA, 25 bp, Homo sapien
gcttgtttctctttatggcttggct

SEQ ID NO: 29637 - DNA, 25 bp, Homo sapien
gttcctaccaggggtagccaggatc

SEQ ID NO: 29638 - DNA, 25 bp, Homo sapien
ggggtagccaggatctgggaaacag

SEQ ID NO: 29639 - DNA, 25 bp, Homo sapien
gggaaacagatcagcgactctagtc

SEQ ID NO: 29640 - DNA, 25 bp, Homo sapien
cagcgactctagtctgaagtggctg

SEQ ID NO: 29641 - DNA, 25 bp, Homo sapien
cttcagcaagattcaggcaggagag

SEQ ID NO: 29642 - DNA, 25 bp, Homo sapien
gagacggaaatagccaccttccagg

SEQ ID NO: 29643 - DNA, 25 bp, Homo sapien
ccaccttccaggcgtgagtcctgga

SEQ ID NO: 29644 - DNA, 25 bp, Homo sapien
ccaccggcgaaagagctttgacgcc

SEQ ID NO: 29645 - DNA, 25 bp, Homo sapien
cgaaagagctttgacgcctctgaca

SEQ ID NO: 29646 - DNA, 25 bp, Homo sapien
gtctgagaaaagctcagcccccagg

SEQ ID NO: 29647 - DNA, 25 bp, Homo sapien
taggttgggcaggtgggtggaccca

SEQ ID NO: 29648 - DNA, 25 bp, Homo sapien
aggtgggtggacccaagcttgtctg

SEQ ID NO: 29649 - DNA, 25 bp, Homo sapien
ttgtctgctgcctgagttccagaga

SEQ ID NO: 29650 - DNA, 25 bp, Homo sapien
gtctgctgcctgagttccagagagg

SEQ ID NO: 29651 - DNA, 25 bp, Homo sapien
gagttccagagagggaggaccctgg

SEQ ID NO: 29652 - DNA, 25 bp, Homo sapien
cagagagggaggaccctggggtgga

SEQ ID NO: 29653 - DNA, 25 bp, Homo sapien
ggggtggagggtgagggattctgtg

SEQ ID NO: 29654 - DNA, 25 bp, Homo sapien
gtggagggtgagggattctgtggaa

SEQ ID NO: 29655 - DNA, 25 bp, Homo sapien
tcgtggctctggaatgtgtctggac

SEQ ID NO: 29656 - DNA, 25 bp, Homo sapien
ggctctggaatgtgtctggacttgc

SEQ ID NO: 29657 - DNA, 25 bp, Homo sapien
ccattatctcaagtaacagagcaga

SEQ ID NO: 29658 - DNA, 25 bp, Homo sapien
gagcagatgctaaaccgtcacagct

SEQ ID NO: 29659 - DNA, 25 bp, Homo sapien
gatgctaaaccgtcacagctgtaaa

SEQ ID NO: 29660 - DNA, 25 bp, Homo sapien
gtcacagctgtaaatcatgtgctta

SEQ ID NO: 29661 - DNA, 25 bp, Homo sapien
catgtgcttaatgcaacatgccctt

SEQ ID NO: 29662 - DNA, 25 bp, Homo sapien
atcaccaataaataatctgcacttc

SEQ ID NO: 29663 - DNA, 25 bp, Homo sapien
aataatctgcacttccagagctcgg

SEQ ID NO: 29664 - DNA, 25 bp, Homo sapien
cccacaacctggtgttgggtccgat

SEQ ID NO: 29665 - DNA, 25 bp, Homo sapien
tgttgggtccgataaccccaacatc

SEQ ID NO: 29666 - DNA, 25 bp, Homo sapien
gccccccacgcttctggaggtgggg

SEQ ID NO: 29667 - DNA, 25 bp, Homo sapien
cccccacgcttctggaggtggggag

SEQ ID NO: 29668 - DNA, 25 bp, Homo sapien
acgcttctggaggtggggagggcct

SEQ ID NO: 29669 - DNA, 25 bp, Homo sapien
aggtggggagggcctctggacagat

SEQ ID NO: 29670 - DNA, 25 bp, Homo sapien
gagggcctctggacagatgggtgtc

SEQ ID NO: 29671 - DNA, 25 bp, Homo sapien
tctggacagatgggtgtcccctggt

SEQ ID NO: 29672 - DNA, 25 bp, Homo sapien
tggacagatgggtgtcccctggtgc

SEQ ID NO: 29673 - DNA, 25 bp, Homo sapien
ggggagaaacctcggaatttctatg

SEQ ID NO: 29674 - DNA, 25 bp, Homo sapien
gaaacctcggaatttctatgagacc

SEQ ID NO: 29675 - DNA, 25 bp, Homo sapien
tcggaatttctatgagacctccccc

SEQ ID NO: 29676 - DNA, 25 bp, Homo sapien
tatgagacctcccccagggaggggg

SEQ ID NO: 29677 - DNA, 25 bp, Homo sapien
gaacaagatcggttccttcacttct

SEQ ID NO: 29678 - DNA, 25 bp, Homo sapien
ccttcacttcttcatgccacaagtg

SEQ ID NO: 29679 - DNA, 25 bp, Homo sapien
cctcacagactcccagttgggttga

SEQ ID NO: 29680 - DNA, 25 bp, Homo sapien
gactgagtttgattcttcctgtacc

SEQ ID NO: 29681 - DNA, 25 bp, Homo sapien
tcggtcgtctgagctgtgtgcagac

SEQ ID NO: 29682 - DNA, 25 bp, Homo sapien
caagagggagggtagctcttccgcc

SEQ ID NO: 29683 - DNA, 25 bp, Homo sapien
catgttagcccccctggagggggcg

SEQ ID NO: 29684 - DNA, 25 bp, Homo sapien
ccctggagggggcgccagttggaga

SEQ ID NO: 29685 - DNA, 25 bp, Homo sapien
cagttggagacgggggctgggtgtc

SEQ ID NO: 29686 - DNA, 25 bp, Homo sapien
tttaggggacccagctgcactgggg

SEQ ID NO: 29687 - DNA, 25 bp, Homo sapien
gtaggacatttcccagcaagggctg

SEQ ID NO: 29688 - DNA, 25 bp, Homo sapien
ttagtagaggcggggcttcaccgtg

SEQ ID NO: 29689 - DNA, 25 bp, Homo sapien
ccggctgttttatttcttataactg

SEQ ID NO: 29690 - DNA, 25 bp, Homo sapien
aactgtacaggaatctacaatgatt

SEQ ID NO: 29691 - DNA, 25 bp, Homo sapien
atttcaattaaggccactctaggca

SEQ ID NO: 29692 - DNA, 25 bp, Homo sapien
aattaaggccactctaggcacatgg

SEQ ID NO: 29693 - DNA, 25 bp, Homo sapien
gccactctaggcacatggcctgtgg

SEQ ID NO: 29694 - DNA, 25 bp, Homo sapien
actctaggcacatggcctgtggggt

SEQ ID NO: 29695 - DNA, 25 bp, Homo sapien
taggcacatggcctgtggggtagcc

SEQ ID NO: 29696 - DNA, 25 bp, Homo sapien
gtagccctgctcaacaagaagccgt

SEQ ID NO: 29697 - DNA, 25 bp, Homo sapien
gccctgctcaacaagaagccgtcaa

SEQ ID NO: 29698 - DNA, 25 bp, Homo sapien
ttttttttggagacgctctgtcgcc

SEQ ID NO: 29699 - DNA, 25 bp, Homo sapien
gatattgcagacatcaagggaaggg

SEQ ID NO: 29700 - DNA, 25 bp, Homo sapien
cccagcatgcttttggcattgtttt

SEQ ID NO: 29701 - DNA, 25 bp, Homo sapien
atgcttttggcattgttttaaacaa

SEQ ID NO: 29702 - DNA, 25 bp, Homo sapien
gcatattgagcacattaaacactct

SEQ ID NO: 29703 - DNA, 25 bp, Homo sapien
agccgaggtagcttcctgaaatgcg

SEQ ID NO: 29704 - DNA, 25 bp, Homo sapien
ggtagcttcctgaaatgcgtgaagg

SEQ ID NO: 29705 - DNA, 25 bp, Homo sapien
aaaggcactggatatatgttctcta

SEQ ID NO: 29706 - DNA, 25 bp, Homo sapien
actgtgtgagaaccaacgggaaaga

SEQ ID NO: 29707 - DNA, 25 bp, Homo sapien
agaaccaacgggaaagagcttgagc

SEQ ID NO: 29708 - DNA, 25 bp, Homo sapien
gttctctaggcctttacaaaaacat

SEQ ID NO: 29709 - DNA, 25 bp, Homo sapien
tctaggcctttacaaaaacatggag

SEQ ID NO: 29710 - DNA, 25 bp, Homo sapien
gatattgaataccagataccactat

SEQ ID NO: 29711 - DNA, 25 bp, Homo sapien
accactatgtagtaagtcttttagg

SEQ ID NO: 29712 - DNA, 25 bp, Homo sapien
gatgattttaatttagtcgtgcgtc

SEQ ID NO: 29713 - DNA, 25 bp, Homo sapien
tagtcgtgcgtcattttctgattct

SEQ ID NO: 29714 - DNA, 25 bp, Homo sapien
gtgcgtcattttctgattctcatca

SEQ ID NO: 29715 - DNA, 25 bp, Homo sapien
attttctgattctcatcattgggag

SEQ ID NO: 29716 - DNA, 25 bp, Homo sapien
tgggagatcttaaatcttagcaagc

SEQ ID NO: 29717 - DNA, 25 bp, Homo sapien
aatcttagcaagcattagcaatatt

SEQ ID NO: 29718 - DNA, 25 bp, Homo sapien
ctgtcttgtttcaggagccaccatg

SEQ ID NO: 29719 - DNA, 25 bp, Homo sapien
attaaaacactagtttgttcacttg

SEQ ID NO: 29720 - DNA, 25 bp, Homo sapien
atccccattccaagaaatataagtg

SEQ ID NO: 29721 - DNA, 25 bp, Homo sapien
tgagggaaggtacgagctccctgct

SEQ ID NO: 29722 - DNA, 25 bp, Homo sapien
cctgggacccatggcacaggccagg

SEQ ID NO: 29723 - DNA, 25 bp, Homo sapien
atcgactccctgagcgagcagattt

SEQ ID NO: 29724 - DNA, 25 bp, Homo sapien
cctgagcgagcagatttccttcctg

SEQ ID NO: 29725 - DNA, 25 bp, Homo sapien
ggtcctgctcctgcaagaaagactc

SEQ ID NO: 29726 - DNA, 25 bp, Homo sapien
gcaagaaagactcgtgactgcccag

SEQ ID NO: 29727 - DNA, 25 bp, Homo sapien
ctgcccaacatgctgggggtccaga

SEQ ID NO: 29728 - DNA, 25 bp, Homo sapien
catgctgggggtccagaagccacct

SEQ ID NO: 29729 - DNA, 25 bp, Homo sapien
tccagaagccacctcggggtgactg

SEQ ID NO: 29730 - DNA, 25 bp, Homo sapien
ccacctcggggtgactgagcggaag

SEQ ID NO: 29731 - DNA, 25 bp, Homo sapien
cggggtgactgagcggaaggccagg

SEQ ID NO: 29732 - DNA, 25 bp, Homo sapien
gcatttgtccccaaatacgcttagc

SEQ ID NO: 29733 - DNA, 25 bp, Homo sapien
aaatacgcttagctgtgtgccgctt

SEQ ID NO: 29734 - DNA, 25 bp, Homo sapien
tagctgtgtgccgcttagaacgatg

SEQ ID NO: 29735 - DNA, 25 bp, Homo sapien
ttctggggtgcacagcgccaggtta

SEQ ID NO: 29736 - DNA, 25 bp, Homo sapien
ggtgcacagcgccaggttaacgctg

SEQ ID NO: 29737 - DNA, 25 bp, Homo sapien
ccaggttaacgctgaagcctgcccc

SEQ ID NO: 29738 - DNA, 25 bp, Homo sapien
acccagaatccgatcatgcacctgt

SEQ ID NO: 29739 - DNA, 25 bp, Homo sapien
tcctcatgccagcggctttggctgg

SEQ ID NO: 29740 - DNA, 25 bp, Homo sapien
ggctggggttggtctgaagcctgca

SEQ ID NO: 29741 - DNA, 25 bp, Homo sapien
tctttgttaaagatctgagggactc

SEQ ID NO: 29742 - DNA, 25 bp, Homo sapien
caacctgcaaaaacggagctgggct

SEQ ID NO: 29743 - DNA, 25 bp, Homo sapien
gattgccagcagtgagtatccctgt

SEQ ID NO: 29744 - DNA, 25 bp, Homo sapien
agcagtgagtatccctgttgcactc

SEQ ID NO: 29745 - DNA, 25 bp, Homo sapien
cctgttgcactctcaaaccaagggt

SEQ ID NO: 29746 - DNA, 25 bp, Homo sapien
gcactctcaaaccaagggttgccaa

SEQ ID NO: 29747 - DNA, 25 bp, Homo sapien
gggttgccaataggactgcagttta

SEQ ID NO: 29748 - DNA, 25 bp, Homo sapien
ctgcagtttattggacgtgcgtttt

SEQ ID NO: 29749 - DNA, 25 bp, Homo sapien
tggacgtgcgttttgtgaccagcag

SEQ ID NO: 29750 - DNA, 25 bp, Homo sapien
accagcagcttcttacagtagccaa

SEQ ID NO: 29751 - DNA, 25 bp, Homo sapien
tcaacttcaagaactcatggatgat

SEQ ID NO: 29752 - DNA, 25 bp, Homo sapien
atggatgattgttcagcagtccttg

SEQ ID NO: 29753 - DNA, 25 bp, Homo sapien
atgaaaagttagcctctgtctctct

SEQ ID NO: 29754 - DNA, 25 bp, Homo sapien
caaccgagagggccggcaggagctt

SEQ ID NO: 29755 - DNA, 25 bp, Homo sapien
ggccggcaggagcttgaaatcatta

SEQ ID NO: 29756 - DNA, 25 bp, Homo sapien
gaacacatttcttttacaacatcaa

SEQ ID NO: 29757 - DNA, 25 bp, Homo sapien
tgatgtcagtcaatccaaggatcca

SEQ ID NO: 29758 - DNA, 25 bp, Homo sapien
atgagtattttattatcctgtccag

SEQ ID NO: 29759 - DNA, 25 bp, Homo sapien
atcctgtccaggaccctgaagtgtt

SEQ ID NO: 29760 - DNA, 25 bp, Homo sapien
aagtgtttggtcttcagtcttactg

SEQ ID NO: 29761 - DNA, 25 bp, Homo sapien
cagtcttactggattacacttcaag

SEQ ID NO: 29762 - DNA, 25 bp, Homo sapien
gatgtggacatgggggggtgggagt

SEQ ID NO: 29763 - DNA, 25 bp, Homo sapien
ttaatcaatgacttctcttcctcaa

SEQ ID NO: 29764 - DNA, 25 bp, Homo sapien
atgacttctcttcctcaaaagacat

SEQ ID NO: 29765 - DNA, 25 bp, Homo sapien
ccacctcctccaggaaagccagaaa

SEQ ID NO: 29766 - DNA, 25 bp, Homo sapien
cacaaggaggtaaccagtcccaagg

SEQ ID NO: 29767 - DNA, 25 bp, Homo sapien
cccacctcatccaggaaagccagaa

SEQ ID NO: 29768 - DNA, 25 bp, Homo sapien
cgatctcctccaggaaagccacaag

SEQ ID NO: 29769 - DNA, 25 bp, Homo sapien
ggaccaccccaacaagaaggcaaca

SEQ ID NO: 29770 - DNA, 25 bp, Homo sapien
gaaggcaacaagcctcaaggtcccc

SEQ ID NO: 29771 - DNA, 25 bp, Homo sapien
acctcctggaaagccacaaggccca

SEQ ID NO: 29772 - DNA, 25 bp, Homo sapien
tgctggaaagccccaggggccacct

SEQ ID NO: 29773 - DNA, 25 bp, Homo sapien
acagcctccccagtaatctaggatt

SEQ ID NO: 29774 - DNA, 25 bp, Homo sapien
ttcaattgctacaaatgccgtgaca

SEQ ID NO: 29775 - DNA, 25 bp, Homo sapien
ggaacaaggtcatcatagctctaac

SEQ ID NO: 29776 - DNA, 25 bp, Homo sapien
ccttcagttcccggtagggcgagtg

SEQ ID NO: 29777 - DNA, 25 bp, Homo sapien
gcatcgcttgctgcgcaaaggcaac

SEQ ID NO: 29778 - DNA, 25 bp, Homo sapien
tcctcgagtatctgaccgccgagat

SEQ ID NO: 29779 - DNA, 25 bp, Homo sapien
cgccgagatcctggagctggcgggc

SEQ ID NO: 29780 - DNA, 25 bp, Homo sapien
caggcaggagtttctctcggtgact

SEQ ID NO: 29781 - DNA, 25 bp, Homo sapien
aagctgctgggcaaagtcaccatcg

SEQ ID NO: 29782 - DNA, 25 bp, Homo sapien
tcttgcctaacatccaggccgtact

SEQ ID NO: 29783 - DNA, 25 bp, Homo sapien
aaagggcaagtgaggctgacgtccg

SEQ ID NO: 29784 - DNA, 25 bp, Homo sapien
gcgtctcgaaggggcacctgtgaac

SEQ ID NO: 29785 - DNA, 25 bp, Homo sapien
tactatcgctgtcatgtctggtcgt

SEQ ID NO: 29786 - DNA, 25 bp, Homo sapien
gcaagcaaggaggcaaggcccgcgc

SEQ ID NO: 29787 - DNA, 25 bp, Homo sapien
ggtgcagtacaagaatcgtcaggcc

SEQ ID NO: 29788 - DNA, 25 bp, Homo sapien
acaagaatcgtcaggccatcctggc

SEQ ID NO: 29789 - DNA, 25 bp, Homo sapien
gtcaaatccacgcggcagaagcagc

SEQ ID NO: 29790 - DNA, 25 bp, Homo sapien
actgcacttctccaacatgaagacc

SEQ ID NO: 29791 - DNA, 25 bp, Homo sapien
gaagaccgtggactgtgtggagcgc

SEQ ID NO: 29792 - DNA, 25 bp, Homo sapien
gactgtgtggagcgcaagggcaagt

SEQ ID NO: 29793 - DNA, 25 bp, Homo sapien
gggcaagtacatgtacttcactgtg

SEQ ID NO: 29794 - DNA, 25 bp, Homo sapien
gcagagggcaaggagatcgactttc

SEQ ID NO: 29795 - DNA, 25 bp, Homo sapien
caaggagatcgactttcggtgcccg

SEQ ID NO: 29796 - DNA, 25 bp, Homo sapien
gaccagggctggaacgccgagatca

SEQ ID NO: 29797 - DNA, 25 bp, Homo sapien
gccgagatcacgctgcagatggtgc

SEQ ID NO: 29798 - DNA, 25 bp, Homo sapien
acaagcatttctgtttagagattct

SEQ ID NO: 29799 - DNA, 25 bp, Homo sapien
tagcccatgggttatctggctagtt

SEQ ID NO: 29800 - DNA, 25 bp, Homo sapien
tatctggctagttattacctctcct

SEQ ID NO: 29801 - DNA, 25 bp, Homo sapien
ctttattattgctcacaggctgggg

SEQ ID NO: 29802 - DNA, 25 bp, Homo sapien
ttattgctcacaggctggggaggca

SEQ ID NO: 29803 - DNA, 25 bp, Homo sapien
tttctggggacactagccctcattt

SEQ ID NO: 29804 - DNA, 25 bp, Homo sapien
tctgtggtacagtggggcaaattat

SEQ ID NO: 29805 - DNA, 25 bp, Homo sapien
gtaaagcacaaccctgaaagattat

SEQ ID NO: 29806 - DNA, 25 bp, Homo sapien
gcacaaccctgaaagattatgaact

SEQ ID NO: 29807 - DNA, 25 bp, Homo sapien
tctctggtgattaagaagttccttt

SEQ ID NO: 29808 - DNA, 25 bp, Homo sapien
ttttaaccatagagttaggcatcat

SEQ ID NO: 29809 - DNA, 25 bp, Homo sapien
ccatcagccccaggtgctaatgaga

SEQ ID NO: 29810 - DNA, 25 bp, Homo sapien
tcagccccaggtgctaatgagagaa

SEQ ID NO: 29811 - DNA, 25 bp, Homo sapien
gccccaggtgctaatgagagaaaga

SEQ ID NO: 29812 - DNA, 25 bp, Homo sapien
cggccgcctactactactatacggc

SEQ ID NO: 29813 - DNA, 25 bp, Homo sapien
cctactactactatacggctgcgag

SEQ ID NO: 29814 - DNA, 25 bp, Homo sapien
actactatacggctgcgagaagacg

SEQ ID NO: 29815 - DNA, 25 bp, Homo sapien
atacggctgcgagaagacgacagaa

SEQ ID NO: 29816 - DNA, 25 bp, Homo sapien
gacgacagaaggggactatagggac

SEQ ID NO: 29817 - DNA, 25 bp, Homo sapien
taaaagactataacaatttcctcat

SEQ ID NO: 29818 - DNA, 25 bp, Homo sapien
aacaatttcctcataagccatcagc

SEQ ID NO: 29819 - DNA, 25 bp, Homo sapien
acaatttcctcataagccatcagcc

SEQ ID NO: 29820 - DNA, 25 bp, Homo sapien
gaggttgtagcgagccgagatcacg

SEQ ID NO: 29821 - DNA, 25 bp, Homo sapien
gcctgggcaacattgagcattgagt

SEQ ID NO: 29822 - DNA, 25 bp, Homo sapien
agcattgagtgaacgagactccctc

SEQ ID NO: 29823 - DNA, 25 bp, Homo sapien
ggcagatcactcgcggttaggagct

SEQ ID NO: 29824 - DNA, 25 bp, Homo sapien
ttaggagctggagaccagcccggcc

SEQ ID NO: 29825 - DNA, 25 bp, Homo sapien
gaaaaaccagtcaggcgtggcggcg

SEQ ID NO: 29826 - DNA, 25 bp, Homo sapien
cccaggcacttggcaggctgaggca

SEQ ID NO: 29827 - DNA, 25 bp, Homo sapien
agatggcgggagtacagtccagctt

SEQ ID NO: 29828 - DNA, 25 bp, Homo sapien
agcttcggcttggcatcagagggag

SEQ ID NO: 29829 - DNA, 25 bp, Homo sapien
gccgggcagaggctgcaatctcggc

SEQ ID NO: 29830 - DNA, 25 bp, Homo sapien
tgcaatctcggcactttgggaggcc

SEQ ID NO: 29831 - DNA, 25 bp, Homo sapien
ctctgggcacattcgaatcttccca

SEQ ID NO: 29832 - DNA, 25 bp, Homo sapien
tctgggcacattcgaatcttcccaa

SEQ ID NO: 29833 - DNA, 25 bp, Homo sapien
atggttgttgggcgtaggacaggtt

SEQ ID NO: 29834 - DNA, 25 bp, Homo sapien
cggggaccctgagcgaaaggtgcgg

SEQ ID NO: 29835 - DNA, 25 bp, Homo sapien
gggaccctgagcgaaaggtgcggag

SEQ ID NO: 29836 - DNA, 25 bp, Homo sapien
gaccctgagcgaaaggtgcggaggc

SEQ ID NO: 29837 - DNA, 25 bp, Homo sapien
tgagcgaaaggtgcggaggcggcct

SEQ ID NO: 29838 - DNA, 25 bp, Homo sapien
cccctgccagagttccaaggctgtg

SEQ ID NO: 29839 - DNA, 25 bp, Homo sapien
cctgccagagttccaaggctgtgga

SEQ ID NO: 29840 - DNA, 25 bp, Homo sapien
ggctgtggaccccagagaaggtggc

SEQ ID NO: 29841 - DNA, 25 bp, Homo sapien
gtggaccccagagaaggtggcaggt

SEQ ID NO: 29842 - DNA, 25 bp, Homo sapien
gttcttggggtacttattcattact

SEQ ID NO: 29843 - DNA, 25 bp, Homo sapien
gtatggaaaatcctgtgaatgcttc

SEQ ID NO: 29844 - DNA, 25 bp, Homo sapien
tgtgaatgcttcctttcatatatgt

SEQ ID NO: 29845 - DNA, 25 bp, Homo sapien
gaactggtgttctgaaagattcttc

SEQ ID NO: 29846 - DNA, 25 bp, Homo sapien
aaagattcttctattgcacattttc

SEQ ID NO: 29847 - DNA, 25 bp, Homo sapien
gcacattttccttagggcagcaagt

SEQ ID NO: 29848 - DNA, 25 bp, Homo sapien
gatatgttttcacagcaaatttgcc

SEQ ID NO: 29849 - DNA, 25 bp, Homo sapien
agattggctttaatcttgctgcagt

SEQ ID NO: 29850 - DNA, 25 bp, Homo sapien
ggattgtcacctggggatagtcttc

SEQ ID NO: 29851 - DNA, 25 bp, Homo sapien
agtcttcaagaatagcagccaggca

SEQ ID NO: 29852 - DNA, 25 bp, Homo sapien
atagtgaaagcccatttgtactaaa

SEQ ID NO: 29853 - DNA, 25 bp, Homo sapien
cctctctccaggacttgtcagctgg

SEQ ID NO: 29854 - DNA, 25 bp, Homo sapien
aaccccttcataagcttgggccact

SEQ ID NO: 29855 - DNA, 25 bp, Homo sapien
caggactctttagtgcactcactct

SEQ ID NO: 29856 - DNA, 25 bp, Homo sapien
ggaaccacactacttgaatcaccat

SEQ ID NO: 29857 - DNA, 25 bp, Homo sapien
tgcctcgctggcagagttgggtcaa

SEQ ID NO: 29858 - DNA, 25 bp, Homo sapien
agagcacagggaccaggccttggtt

SEQ ID NO: 29859 - DNA, 25 bp, Homo sapien
gccttggttaggctgagctcccagc

SEQ ID NO: 29860 - DNA, 25 bp, Homo sapien
aggacaccgcctgcagaaaggacct

SEQ ID NO: 29861 - DNA, 25 bp, Homo sapien
cttccccagattctcaagcagatgc

SEQ ID NO: 29862 - DNA, 25 bp, Homo sapien
gtatgaattcagcgggtctcactcc

SEQ ID NO: 29863 - DNA, 25 bp, Homo sapien
ggtctcactccagagggtcagaacg

SEQ ID NO: 29864 - DNA, 25 bp, Homo sapien
cccagacccaatgcttagccaaacg

SEQ ID NO: 29865 - DNA, 25 bp, Homo sapien
gacccaatgcttagccaaacgaagt

SEQ ID NO: 29866 - DNA, 25 bp, Homo sapien
caaacgaagtggctcccatgtggca

SEQ ID NO: 29867 - DNA, 25 bp, Homo sapien
agcctctcaccatgagtgagccacc

SEQ ID NO: 29868 - DNA, 25 bp, Homo sapien
tcaccatgagtgagccaccagctct

SEQ ID NO: 29869 - DNA, 25 bp, Homo sapien
gagcctcagttgagagtgagcgggg

SEQ ID NO: 29870 - DNA, 25 bp, Homo sapien
gagtgagcggggtacagtaaggcag

SEQ ID NO: 29871 - DNA, 25 bp, Homo sapien
cggggtacagtaaggcagtgcttcc

SEQ ID NO: 29872 - DNA, 25 bp, Homo sapien
tttcctggttctcttttgcaataca

SEQ ID NO: 29873 - DNA, 25 bp, Homo sapien
ggttctcttttgcaatacattaaca

SEQ ID NO: 29874 - DNA, 25 bp, Homo sapien
aacagaccctttatcaacataaaca

SEQ ID NO: 29875 - DNA, 25 bp, Homo sapien
ctcttcccactgcaaactggaagcc

SEQ ID NO: 29876 - DNA, 25 bp, Homo sapien
cttcccactgcaaactggaagcccc

SEQ ID NO: 29877 - DNA, 25 bp, Homo sapien
ttcctcagagtgaccctaggcttca

SEQ ID NO: 29878 - DNA, 25 bp, Homo sapien
tcctcagagtgaccctaggcttcag

SEQ ID NO: 29879 - DNA, 25 bp, Homo sapien
cctcagagtgaccctaggcttcagg

SEQ ID NO: 29880 - DNA, 25 bp, Homo sapien
cagagtgaccctaggcttcaggggg

SEQ ID NO: 29881 - DNA, 25 bp, Homo sapien
gagtgaccctaggcttcagggggaa

SEQ ID NO: 29882 - DNA, 25 bp, Homo sapien
gtgaccctaggcttcagggggaact

SEQ ID NO: 29883 - DNA, 25 bp, Homo sapien
cctaggcttcagggggaacttctgc

SEQ ID NO: 29884 - DNA, 25 bp, Homo sapien
ctaggcttcagggggaacttctgcc

SEQ ID NO: 29885 - DNA, 25 bp, Homo sapien
taggcttcagggggaacttctgccc

SEQ ID NO: 29886 - DNA, 25 bp, Homo sapien
aaggtcagtgtgcgaaatggcttgc

SEQ ID NO: 29887 - DNA, 25 bp, Homo sapien
gcgaaatggcttgcaggggacagga

SEQ ID NO: 29888 - DNA, 25 bp, Homo sapien
gataggagacaatgtgtaccaggac

SEQ ID NO: 29889 - DNA, 25 bp, Homo sapien
agcagaaagacatcccgggtagcct

SEQ ID NO: 29890 - DNA, 25 bp, Homo sapien
acatcccgggtagcctggaacaggg

SEQ ID NO: 29891 - DNA, 25 bp, Homo sapien
gcctggaacagggagacggtgtgga

SEQ ID NO: 29892 - DNA, 25 bp, Homo sapien
gagatggtggcagtccgataatgag

SEQ ID NO: 29893 - DNA, 25 bp, Homo sapien
gagagccgtagggcaaggccagcag

SEQ ID NO: 29894 - DNA, 25 bp, Homo sapien
aggccagcaggatcctagagtgaga

SEQ ID NO: 29895 - DNA, 25 bp, Homo sapien
gaggtaaagtcaccgggacttggtg

SEQ ID NO: 29896 - DNA, 25 bp, Homo sapien
taaagatgggaccggggccagacgc

SEQ ID NO: 29897 - DNA, 25 bp, Homo sapien
atgaaactgattacaacaggctgta

SEQ ID NO: 29898 - DNA, 25 bp, Homo sapien
acaggctgtaagaatcaaagtcaac

SEQ ID NO: 29899 - DNA, 25 bp, Homo sapien
actgagctattgaagtcccattaac

SEQ ID NO: 29900 - DNA, 25 bp, Homo sapien
gaagtcccattaacttaaagtatat

SEQ ID NO: 29901 - DNA, 25 bp, Homo sapien
tcaaattgccattgctactattgct

SEQ ID NO: 29902 - DNA, 25 bp, Homo sapien
ttgctactattgcttgtcggtgtat

SEQ ID NO: 29903 - DNA, 25 bp, Homo sapien
actattgcttgtcggtgtattttat

SEQ ID NO: 29904 - DNA, 25 bp, Homo sapien
tgcttgtcggtgtattttattttat

SEQ ID NO: 29905 - DNA, 25 bp, Homo sapien
ttacatgtccttgctacttttaaaa

SEQ ID NO: 29906 - DNA, 25 bp, Homo sapien
aaaaacttgcatttattcctcagat

SEQ ID NO: 29907 - DNA, 25 bp, Homo sapien
aacttgcatttattcctcagatttt

SEQ ID NO: 29908 - DNA, 25 bp, Homo sapien
tcctgtgatactcgagaaagcctgt

SEQ ID NO: 29909 - DNA, 25 bp, Homo sapien
gcctgtgagttcatagagcttcttt

SEQ ID NO: 29910 - DNA, 25 bp, Homo sapien
gccctgaccatttctatgtgtttgc

SEQ ID NO: 29911 - DNA, 25 bp, Homo sapien
tgcaaacacagtagacctcgccgat

SEQ ID NO: 29912 - DNA, 25 bp, Homo sapien
gtagacctcgccgatgagggtagtg

SEQ ID NO: 29913 - DNA, 25 bp, Homo sapien
gggtagtgatgacacgggcaggcct

SEQ ID NO: 29914 - DNA, 25 bp, Homo sapien
acgggcaggcctgagaactgcctcc

SEQ ID NO: 29915 - DNA, 25 bp, Homo sapien
gctgaaggcaataggggtgtatgct

SEQ ID NO: 29916 - DNA, 25 bp, Homo sapien
gaaagcaccaagcagaaagtactag

SEQ ID NO: 29917 - DNA, 25 bp, Homo sapien
gagtttttggccaagctatacaata

SEQ ID NO: 29918 - DNA, 25 bp, Homo sapien
tatacaatagtatccctatttcctt

SEQ ID NO: 29919 - DNA, 25 bp, Homo sapien
aagaggatgatgaagggcccgcgct

SEQ ID NO: 29920 - DNA, 25 bp, Homo sapien
ccgcgctgaagagagctgccgaaga

SEQ ID NO: 29921 - DNA, 25 bp, Homo sapien
gagagctgccgaagaggaggatgaa

SEQ ID NO: 29922 - DNA, 25 bp, Homo sapien
gaggatgaagcggatcccaaacggc

SEQ ID NO: 29923 - DNA, 25 bp, Homo sapien
gaagcggatcccaaacggcagaaga

SEQ ID NO: 29924 - DNA, 25 bp, Homo sapien
ggatcccaaacggcagaagacagaa

SEQ ID NO: 29925 - DNA, 25 bp, Homo sapien
aaaatggggcatcggcgtgacgcct

SEQ ID NO: 29926 - DNA, 25 bp, Homo sapien
tgacgcctgccaacaggctgggttg

SEQ ID NO: 29927 - DNA, 25 bp, Homo sapien
aacaggctgggttgggaggcctctc

SEQ ID NO: 29928 - DNA, 25 bp, Homo sapien
gcctctctgggctggaggtgggggt

SEQ ID NO: 29929 - DNA, 25 bp, Homo sapien
gctggaggtgggggtgggggcagcc

SEQ ID NO: 29930 - DNA, 25 bp, Homo sapien
ctgtgtttcctgagctggagccaga

SEQ ID NO: 29931 - DNA, 25 bp, Homo sapien
cagagaatcggtctgggatccctga

SEQ ID NO: 29932 - DNA, 25 bp, Homo sapien
tgagggccggttgtttttaccatag

SEQ ID NO: 29933 - DNA, 25 bp, Homo sapien
tgacaagtagaggggcctgtcctgg

SEQ ID NO: 29934 - DNA, 25 bp, Homo sapien
ggcttctgctggtaccagcttgcat

SEQ ID NO: 29935 - DNA, 25 bp, Homo sapien
taatagcttctgaggctgtctcctt

SEQ ID NO: 29936 - DNA, 25 bp, Homo sapien
gtctccttggcatgtgatcctgact

SEQ ID NO: 29937 - DNA, 25 bp, Homo sapien
ggtcccaactccgaagacatacttc

SEQ ID NO: 29938 - DNA, 25 bp, Homo sapien
ccactgctgtcccgggagtgacagt

SEQ ID NO: 29939 - DNA, 25 bp, Homo sapien
acagtaatagtcagcctcatcttcc

SEQ ID NO: 29940 - DNA, 25 bp, Homo sapien
gcctgagccccagtgatggtcaagg

SEQ ID NO: 29941 - DNA, 25 bp, Homo sapien
atcctggcccctagcaaggtataga

SEQ ID NO: 29942 - DNA, 25 bp, Homo sapien
ggtatagatagcctctgtgtcttag

SEQ ID NO: 29943 - DNA, 25 bp, Homo sapien
gtcttaggataccccgggtgctgtt

SEQ ID NO: 29944 - DNA, 25 bp, Homo sapien
tggagccctgcgggtgggggcaggg

SEQ ID NO: 29945 - DNA, 25 bp, Homo sapien
tgggggcagggcatgagttccccag

SEQ ID NO: 29946 - DNA, 25 bp, Homo sapien
ttccccagtccccaaggaaaggcag

SEQ ID NO: 29947 - DNA, 25 bp, Homo sapien
gtgtcacctggattcctgcagtaat

SEQ ID NO: 29948 - DNA, 25 bp, Homo sapien
gtaattctgagcccttgaaatcctc

SEQ ID NO: 29949 - DNA, 25 bp, Homo sapien
tcctcagtcgccttggcggggaaga

SEQ ID NO: 29950 - DNA, 25 bp, Homo sapien
gattggctttggggacaggaggtcg

SEQ ID NO: 29951 - DNA, 25 bp, Homo sapien
acaggaggtcggcacatctccaggt

SEQ ID NO: 29952 - DNA, 25 bp, Homo sapien
cccggcctgataaagtgcaccgact

SEQ ID NO: 29953 - DNA, 25 bp, Homo sapien
gataaagtgcaccgactgggctaca

SEQ ID NO: 29954 - DNA, 25 bp, Homo sapien
gcaccgactgggctacaaacaaggc

SEQ ID NO: 29955 - DNA, 25 bp, Homo sapien
attcgtgttcgccgttatatatagg

SEQ ID NO: 29956 - DNA, 25 bp, Homo sapien
aaattttctgaggttgtcctcattg

SEQ ID NO: 29957 - DNA, 25 bp, Homo sapien
tctgaggttgtcctcattgatccat

SEQ ID NO: 29958 - DNA, 25 bp, Homo sapien
aaatcctgacacccaatggatcatc

SEQ ID NO: 29959 - DNA, 25 bp, Homo sapien
gacacccaatggatcatcaaaccac

SEQ ID NO: 29960 - DNA, 25 bp, Homo sapien
tggatcatcaaaccactccacaagc

SEQ ID NO: 29961 - DNA, 25 bp, Homo sapien
gccctgggcttggaaagggccataa

SEQ ID NO: 29962 - DNA, 25 bp, Homo sapien
accacactgttggtggttctcgccg

SEQ ID NO: 29963 - DNA, 25 bp, Homo sapien
ctgccccttaagtgtcggtgaatag

SEQ ID NO: 29964 - DNA, 25 bp, Homo sapien
tgaggctggaggccgcaatctcagc

SEQ ID NO: 29965 - DNA, 25 bp, Homo sapien
tgagacagagtttcgctttgtcgcc

SEQ ID NO: 29966 - DNA, 25 bp, Homo sapien
tgcaatgcacgatctcagttcactg

SEQ ID NO: 29967 - DNA, 25 bp, Homo sapien
cctctgcctcctaagttcaggcgat

SEQ ID NO: 29968 - DNA, 25 bp, Homo sapien
tgcctcagcttcccgagtaactgag

SEQ ID NO: 29969 - DNA, 25 bp, Homo sapien
taactgagattacaggcacccacca

SEQ ID NO: 29970 - DNA, 25 bp, Homo sapien
ccatgcccagctgcttttttgtatt

SEQ ID NO: 29971 - DNA, 25 bp, Homo sapien
gagattacagacatgagcctccgcg

SEQ ID NO: 29972 - DNA, 25 bp, Homo sapien
tcttcactctgaatcctcatgaggc

SEQ ID NO: 29973 - DNA, 25 bp, Homo sapien
acaactagcgcctgggcagggcagg

SEQ ID NO: 29974 - DNA, 25 bp, Homo sapien
tggtttctccatcagtagttactac

SEQ ID NO: 29975 - DNA, 25 bp, Homo sapien
cagcccgccggtaagggactggagt

SEQ ID NO: 29976 - DNA, 25 bp, Homo sapien
ggtgcagctgcagtctagagaggtg

SEQ ID NO: 29977 - DNA, 25 bp, Homo sapien
tccagagtcgagtcaccatgtcagt

SEQ ID NO: 29978 - DNA, 25 bp, Homo sapien
agacacgtccaagaaccagttctcc

SEQ ID NO: 29979 - DNA, 25 bp, Homo sapien
ctctatgaccgccgtggacacggcc

SEQ ID NO: 29980 - DNA, 25 bp, Homo sapien
gacacggccgtatattactgtgcga

SEQ ID NO: 29981 - DNA, 25 bp, Homo sapien
gtgcgagagggccggagtggttact

SEQ ID NO: 29982 - DNA, 25 bp, Homo sapien
agtggttactcggtatggacgtctg

SEQ ID NO: 29983 - DNA, 25 bp, Homo sapien
gaggtgcagttgctggagtctggcc

SEQ ID NO: 29984 - DNA, 25 bp, Homo sapien
ggactggtcaagccttcggagaccc

SEQ ID NO: 29985 - DNA, 25 bp, Homo sapien
ggggctcgaagggtccttgtagccg

SEQ ID NO: 29986 - DNA, 25 bp, Homo sapien
tgctgctggggggatcacagaccat

SEQ ID NO: 29987 - DNA, 25 bp, Homo sapien
ttctttctttcggccaggctgaggc

SEQ ID NO: 29988 - DNA, 25 bp, Homo sapien
ggctgaggccctgacgtggatgggc

SEQ ID NO: 29989 - DNA, 25 bp, Homo sapien
ggatgggcaaactgcaggcctggga

SEQ ID NO: 29990 - DNA, 25 bp, Homo sapien
ggttcgcaaagtgcaaagctttctt

SEQ ID NO: 29991 - DNA, 25 bp, Homo sapien
gcaaagctttcttgtgcatgacgcc

SEQ ID NO: 29992 - DNA, 25 bp, Homo sapien
ccctgggctgcattgggttggtggc

SEQ ID NO: 29993 - DNA, 25 bp, Homo sapien
gggctgcattgggttggtggcccac

SEQ ID NO: 29994 - DNA, 25 bp, Homo sapien
gggccccgttggaagactgagtgcc

SEQ ID NO: 29995 - DNA, 25 bp, Homo sapien
ccgttggaagactgagtgcccgggg

SEQ ID NO: 29996 - DNA, 25 bp, Homo sapien
tccctgccgaacacagcgtgaggag

SEQ ID NO: 29997 - DNA, 25 bp, Homo sapien
ctgccgaacacagcgtgaggagccc

SEQ ID NO: 29998 - DNA, 25 bp, Homo sapien
tctctgggcttgccgagcactaagt

SEQ ID NO: 29999 - DNA, 25 bp, Homo sapien
ttgccgagcactaagtcctctgagt

SEQ ID NO: 30000 - DNA, 25 bp, Homo sapien
gccgagcactaagtcctctgagttc

SEQ ID NO: 30001 - DNA, 25 bp, Homo sapien
gcgcttgcgcagtagctgaacgcgg

SEQ ID NO: 30002 - DNA, 25 bp, Homo sapien
gcttgcgcagtagctgaacgcgggc

SEQ ID NO: 30003 - DNA, 25 bp, Homo sapien
tgcgcagtagctgaacgcgggcgtt

SEQ ID NO: 30004 - DNA, 25 bp, Homo sapien
gcagtagctgaacgcgggcgtttct

SEQ ID NO: 30005 - DNA, 25 bp, Homo sapien
agctgaacgcgggcgtttctttcct

SEQ ID NO: 30006 - DNA, 25 bp, Homo sapien
tgggggtagattcgagttacaaaat

SEQ ID NO: 30007 - DNA, 25 bp, Homo sapien
gatgcctgttgcaaagtggaccatg

SEQ ID NO: 30008 - DNA, 25 bp, Homo sapien
tggaccatggtctagcagtagcatc

SEQ ID NO: 30009 - DNA, 25 bp, Homo sapien
atggtctagcagtagcatcagtgtc

SEQ ID NO: 30010 - DNA, 25 bp, Homo sapien
ctagcagtagcatcagtgtcaagga

SEQ ID NO: 30011 - DNA, 25 bp, Homo sapien
aacacccactacttagcagactggg

SEQ ID NO: 30012 - DNA, 25 bp, Homo sapien
ccactacttagcagactgggaaaag

SEQ ID NO: 30013 - DNA, 25 bp, Homo sapien
gaaagtactaaatgtctgatatgca

SEQ ID NO: 30014 - DNA, 25 bp, Homo sapien
ggacacatgacccatgtgaccttac

SEQ ID NO: 30015 - DNA, 25 bp, Homo sapien
cacatgacccatgtgaccttaccta

SEQ ID NO: 30016 - DNA, 25 bp, Homo sapien
catgtgaccttacctattattggag

SEQ ID NO: 30017 - DNA, 25 bp, Homo sapien
attggagatggttcacattccttac

SEQ ID NO: 30018 - DNA, 25 bp, Homo sapien
gactagtaaattgtctgcctcctat

SEQ ID NO: 30019 - DNA, 25 bp, Homo sapien
aaactgttggtggccctgaatccat

SEQ ID NO: 30020 - DNA, 25 bp, Homo sapien
ccagctgctggtatctgccaggact

SEQ ID NO: 30021 - DNA, 25 bp, Homo sapien
gagccgctgataggttaggtctcat

SEQ ID NO: 30022 - DNA, 25 bp, Homo sapien
tagaatacgcctgcatttaccagcc

SEQ ID NO: 30023 - DNA, 25 bp, Homo sapien
atcacacggatctcaaattcacaaa

SEQ ID NO: 30024 - DNA, 25 bp, Homo sapien
gatcatggtgtgcgagtggtcaatt

SEQ ID NO: 30025 - DNA, 25 bp, Homo sapien
aatgcataacctaattttcctggga

SEQ ID NO: 30026 - DNA, 25 bp, Homo sapien
tttcctgggactgccatattttctt

SEQ ID NO: 30027 - DNA, 25 bp, Homo sapien
ggtgcatggaactgtggttgccaag

SEQ ID NO: 30028 - DNA, 25 bp, Homo sapien
aacgacctccactgaactgggtttg

SEQ ID NO: 30029 - DNA, 25 bp, Homo sapien
tgagcgtaactgtgtgggctcctcg

SEQ ID NO: 30030 - DNA, 25 bp, Homo sapien
ctagactcggtcccgagacgttccg

SEQ ID NO: 30031 - DNA, 25 bp, Homo sapien
gcagttccgctaccaggatgcggcg

SEQ ID NO: 30032 - DNA, 25 bp, Homo sapien
cctgacatccgcaccaaggagcaga

SEQ ID NO: 30033 - DNA, 25 bp, Homo sapien
atccgcaccaaggagcagatcgtgg

SEQ ID NO: 30034 - DNA, 25 bp, Homo sapien
gcagatcgtggagatgctggtgcaa

SEQ ID NO: 30035 - DNA, 25 bp, Homo sapien
tggtgcaagagcagctgctcgccat

SEQ ID NO: 30036 - DNA, 25 bp, Homo sapien
gccgcacggatgtgcgcatcactgg

SEQ ID NO: 30037 - DNA, 25 bp, Homo sapien
gcatcactggctgagcggtggagct

SEQ ID NO: 30038 - DNA, 25 bp, Homo sapien
tgcggactggggccatgatcgggcc

SEQ ID NO: 30039 - DNA, 25 bp, Homo sapien
ccaccccgtgttaatgaaaaatgag

SEQ ID NO: 30040 - DNA, 25 bp, Homo sapien
atctgtggcctgggttatgagtctg

SEQ ID NO: 30041 - DNA, 25 bp, Homo sapien
gtggcctgggttatgagtctggttc

SEQ ID NO: 30042 - DNA, 25 bp, Homo sapien
atgagtctggttcaatcgatagtcc

SEQ ID NO: 30043 - DNA, 25 bp, Homo sapien
tcaatcgatagtccagacaccatcc

SEQ ID NO: 30044 - DNA, 25 bp, Homo sapien
ctgtccccaccagcagatagatgac

SEQ ID NO: 30045 - DNA, 25 bp, Homo sapien
cccaccagcagatagatgacttttt

SEQ ID NO: 30046 - DNA, 25 bp, Homo sapien
atgactttttatgtgaggtcccatc

SEQ ID NO: 30047 - DNA, 25 bp, Homo sapien
tcgactctcctgtggagatacctcc

SEQ ID NO: 30048 - DNA, 25 bp, Homo sapien
ctctcctgtggagatacctcctaca

SEQ ID NO: 30049 - DNA, 25 bp, Homo sapien
cctgtggagatacctcctacaatga

SEQ ID NO: 30050 - DNA, 25 bp, Homo sapien
cctacaatgaaatccagttggctgt

SEQ ID NO: 30051 - DNA, 25 bp, Homo sapien
cgcccagcctatagttcttatttaa

SEQ ID NO: 30052 - DNA, 25 bp, Homo sapien
gacctaaaaaccttgtaggttcatg

SEQ ID NO: 30053 - DNA, 25 bp, Homo sapien
ggggtgtatatgtattctgatttca

SEQ ID NO: 30054 - DNA, 25 bp, Homo sapien
gatttcaacagaggtaggaggttct

SEQ ID NO: 30055 - DNA, 25 bp, Homo sapien
ggtaggaggttcttatttctatgca

SEQ ID NO: 30056 - DNA, 25 bp, Homo sapien
gaggttcttatttctatgcaactga

SEQ ID NO: 30057 - DNA, 25 bp, Homo sapien
atgcaactgaaatccatcttgtagc

SEQ ID NO: 30058 - DNA, 25 bp, Homo sapien
tgaaatccatcttgtagccatcacc

SEQ ID NO: 30059 - DNA, 25 bp, Homo sapien
gaagtgtggttaagagtgctggctc

SEQ ID NO: 30060 - DNA, 25 bp, Homo sapien
tggttaagagtgctggctctggagc

SEQ ID NO: 30061 - DNA, 25 bp, Homo sapien
gggttcaagtgagtattttgtattt

SEQ ID NO: 30062 - DNA, 25 bp, Homo sapien
ggctcatctttgcagtcaagcaggt

SEQ ID NO: 30063 - DNA, 25 bp, Homo sapien
atctttgcagtcaagcaggtggaag

SEQ ID NO: 30064 - DNA, 25 bp, Homo sapien
caggtggaagatgaccgcactcatt

SEQ ID NO: 30065 - DNA, 25 bp, Homo sapien
ggaagatgaccgcactcattctgac

SEQ ID NO: 30066 - DNA, 25 bp, Homo sapien
atgaccgcactcattctgactataa

SEQ ID NO: 30067 - DNA, 25 bp, Homo sapien
accgcactcattctgactataacat

SEQ ID NO: 30068 - DNA, 25 bp, Homo sapien
gcactcattctgactataacatcca

SEQ ID NO: 30069 - DNA, 25 bp, Homo sapien
actcattctgactataacatccaga

SEQ ID NO: 30070 - DNA, 25 bp, Homo sapien
cttcgtgaagacccttaccagcaag

SEQ ID NO: 30071 - DNA, 25 bp, Homo sapien
tcgtgaagacccttaccagcaagac

SEQ ID NO: 30072 - DNA, 25 bp, Homo sapien
cttaccagcaagaccattgcccttg

SEQ ID NO: 30073 - DNA, 25 bp, Homo sapien
atactgtaagcggctccaggtgctg

SEQ ID NO: 30074 - DNA, 25 bp, Homo sapien
cagctgacgaggtatgcgggtgccc

SEQ ID NO: 30075 - DNA, 25 bp, Homo sapien
cccccttgtacgtgatgtctttgag

SEQ ID NO: 30076 - DNA, 25 bp, Homo sapien
tttgagctcacgggtgacttctgcc

SEQ ID NO: 30077 - DNA, 25 bp, Homo sapien
gccagtgcaatcgccattactgctg

SEQ ID NO: 30078 - DNA, 25 bp, Homo sapien
tgcggcgtgcggaagtggacttgga

SEQ ID NO: 30079 - DNA, 25 bp, Homo sapien
agcgcgtgcgtgtgtggtacaagct

SEQ ID NO: 30080 - DNA, 25 bp, Homo sapien
tgacaaaccgcgcgggattgctggc

SEQ ID NO: 30081 - DNA, 25 bp, Homo sapien
gatgctgcaccagacgatccagcac

SEQ ID NO: 30082 - DNA, 25 bp, Homo sapien
taaaccctgcattccagatggggga

SEQ ID NO: 30083 - DNA, 25 bp, Homo sapien
tatcagagggactgtccccgtcgac

SEQ ID NO: 30084 - DNA, 25 bp, Homo sapien
tgaccaggcttgttctggatcccta

SEQ ID NO: 30085 - DNA, 25 bp, Homo sapien
agcggaaaacctactttgctcacga

SEQ ID NO: 30086 - DNA, 25 bp, Homo sapien
cagttggggatattgtgcttctcag

SEQ ID NO: 30087 - DNA, 25 bp, Homo sapien
tattgtgcttctcagagctttacct

SEQ ID NO: 30088 - DNA, 25 bp, Homo sapien
ttacctgttccacgagcaaagcatg

SEQ ID NO: 30089 - DNA, 25 bp, Homo sapien
gaactggctgagatcgttttcaaag

SEQ ID NO: 30090 - DNA, 25 bp, Homo sapien
aggaaagccctgtgctggaactacc

SEQ ID NO: 30091 - DNA, 25 bp, Homo sapien
gaactacctacctggagagtccgtt

SEQ ID NO: 30092 - DNA, 25 bp, Homo sapien
gccacgtaatgtccgtagttcgctc

SEQ ID NO: 30093 - DNA, 25 bp, Homo sapien
tccgttgagttcggaaaccacccag

SEQ ID NO: 30094 - DNA, 25 bp, Homo sapien
ctcatccgtccatgccagatggatt

SEQ ID NO: 30095 - DNA, 25 bp, Homo sapien
actcatctggcttcagcagattgcc

SEQ ID NO: 30096 - DNA, 25 bp, Homo sapien
gcagattgccaccaagaggatacag

SEQ ID NO: 30097 - DNA, 25 bp, Homo sapien
aggatacaggtggtcaggtcctggc

SEQ ID NO: 30098 - DNA, 25 bp, Homo sapien
ggcctgggcaggcttaggatttgac

SEQ ID NO: 30099 - DNA, 25 bp, Homo sapien
ggcttaggatttgactttctttgaa

SEQ ID NO: 30100 - DNA, 25 bp, Homo sapien
ctttctttgaagtacctgatgctga

SEQ ID NO: 30101 - DNA, 25 bp, Homo sapien
gtacctgatgctgattgattccact

SEQ ID NO: 30102 - DNA, 25 bp, Homo sapien
gagggacgttatgtgaatcttaagt

SEQ ID NO: 30103 - DNA, 25 bp, Homo sapien
atcttaagtcttaccagtccttgca

SEQ ID NO: 30104 - DNA, 25 bp, Homo sapien
accagtccttgcattagtacattaa

SEQ ID NO: 30105 - DNA, 25 bp, Homo sapien
atacgatcgtgagtgatttctccaa

SEQ ID NO: 30106 - DNA, 25 bp, Homo sapien
tgtaatgtgccacaacaccctcaat

SEQ ID NO: 30107 - DNA, 25 bp, Homo sapien
cagggcaactggtggagcatggaag

SEQ ID NO: 30108 - DNA, 25 bp, Homo sapien
gaagtcgaatttccttttctgttag

SEQ ID NO: 30109 - DNA, 25 bp, Homo sapien
tcagggctgcagcttacaggtgggc

SEQ ID NO: 30110 - DNA, 25 bp, Homo sapien
gtgattgcacaacttgaagggccat

SEQ ID NO: 30111 - DNA, 25 bp, Homo sapien
gaagggccatcattcacatctattc

SEQ ID NO: 30112 - DNA, 25 bp, Homo sapien
tggggtccctgggattgggcagtgt

SEQ ID NO: 30113 - DNA, 25 bp, Homo sapien
aggtttacttccagcatctgagctc

SEQ ID NO: 30114 - DNA, 25 bp, Homo sapien
ctctcacccctgaagctcagttata

SEQ ID NO: 30115 - DNA, 25 bp, Homo sapien
cccattctggggttctctgatgcag

SEQ ID NO: 30116 - DNA, 25 bp, Homo sapien
agatatggtaccttctcaagtgtag

SEQ ID NO: 30117 - DNA, 25 bp, Homo sapien
aggatatggaattcctgggcctccc

SEQ ID NO: 30118 - DNA, 25 bp, Homo sapien
cctccccaggtttctaacatgcaaa

SEQ ID NO: 30119 - DNA, 25 bp, Homo sapien
taagcaggccaggcactgtagccca

SEQ ID NO: 30120 - DNA, 25 bp, Homo sapien
aggcactgtagcccatgcctgtaat

SEQ ID NO: 30121 - DNA, 25 bp, Homo sapien
ccagccctttgggagtccaaggtgg

SEQ ID NO: 30122 - DNA, 25 bp, Homo sapien
ggcagatcacccgaggtcaggaatt

SEQ ID NO: 30123 - DNA, 25 bp, Homo sapien
ggtggcagggacctgtaattccagc

SEQ ID NO: 30124 - DNA, 25 bp, Homo sapien
gaattgcttgaaccctggaggtgga

SEQ ID NO: 30125 - DNA, 25 bp, Homo sapien
gtgccagggagattgtacacccttc

SEQ ID NO: 30126 - DNA, 25 bp, Homo sapien
tacacccttctgctctagaatcata

SEQ ID NO: 30127 - DNA, 25 bp, Homo sapien
gagtcactggcagaaagcacctcag

SEQ ID NO: 30128 - DNA, 25 bp, Homo sapien
aagtataaattcttcctggcctatt

SEQ ID NO: 30129 - DNA, 25 bp, Homo sapien
tgtccctcagctgtggtctgaatgt

SEQ ID NO: 30130 - DNA, 25 bp, Homo sapien
gtctgaatgtgtcccttcaaaattc

SEQ ID NO: 30131 - DNA, 25 bp, Homo sapien
gaaatcctaacccctgaggtgatgg

SEQ ID NO: 30132 - DNA, 25 bp, Homo sapien
gggaggagccctcatcaatgggatt

SEQ ID NO: 30133 - DNA, 25 bp, Homo sapien
aagagatcccaaagagctgccttgt

SEQ ID NO: 30134 - DNA, 25 bp, Homo sapien
ccttgtccctttcactatgtgagga

SEQ ID NO: 30135 - DNA, 25 bp, Homo sapien
tatgaaccaggaagtgggcccctca

SEQ ID NO: 30136 - DNA, 25 bp, Homo sapien
gcccctcaccagagaccaaatgtac

SEQ ID NO: 30137 - DNA, 25 bp, Homo sapien
agagaccaaatgtaccagcacctta

SEQ ID NO: 30138 - DNA, 25 bp, Homo sapien
taccagcaccttagtcttgtacttc

SEQ ID NO: 30139 - DNA, 25 bp, Homo sapien
tgcaaaagtcaaaattccctctccc

SEQ ID NO: 30140 - DNA, 25 bp, Homo sapien
gaccctttaggtgcttcctatttag

SEQ ID NO: 30141 - DNA, 25 bp, Homo sapien
aggtgcttcctatttaggtggccgc

SEQ ID NO: 30142 - DNA, 25 bp, Homo sapien
tttaggtggccgcgtttattctcac

SEQ ID NO: 30143 - DNA, 25 bp, Homo sapien
cagtccttccaggaatggtggtacg

SEQ ID NO: 30144 - DNA, 25 bp, Homo sapien
ggtggtacgtgaatctcaacagcct

SEQ ID NO: 30145 - DNA, 25 bp, Homo sapien
gaatctcaacagcctaatggaccag

SEQ ID NO: 30146 - DNA, 25 bp, Homo sapien
gttccggaggcgaccagatgattgg

SEQ ID NO: 30147 - DNA, 25 bp, Homo sapien
atgattggaatctgtctgctggtgg

SEQ ID NO: 30148 - DNA, 25 bp, Homo sapien
ggttggggacatgatcataggggcc

SEQ ID NO: 30149 - DNA, 25 bp, Homo sapien
acatgatcataggggccagctcggg

SEQ ID NO: 30150 - DNA, 25 bp, Homo sapien
agctactctcaggctgcaagcagcc

SEQ ID NO: 30151 - DNA, 25 bp, Homo sapien
aagcagccaaagtgcccagggctct

SEQ ID NO: 30152 - DNA, 25 bp, Homo sapien
tacctggagggcacctgcatggagt

SEQ ID NO: 30153 - DNA, 25 bp, Homo sapien
gaacgggaaggagacgctgcagcgc

SEQ ID NO: 30154 - DNA, 25 bp, Homo sapien
agatcacattgacctggcagcggga

SEQ ID NO: 30155 - DNA, 25 bp, Homo sapien
ggaccagacccaggacatggagctc

SEQ ID NO: 30156 - DNA, 25 bp, Homo sapien
gagaccaggcccacaggggatggaa

SEQ ID NO: 30157 - DNA, 25 bp, Homo sapien
ggttgtggtagtgccttctggagag

SEQ ID NO: 30158 - DNA, 25 bp, Homo sapien
agcccctcatcctgagatgggagcc

SEQ ID NO: 30159 - DNA, 25 bp, Homo sapien
gcccaccatccccattgtgggtatc

SEQ ID NO: 30160 - DNA, 25 bp, Homo sapien
cctggttctccttggagctgtggtc

SEQ ID NO: 30161 - DNA, 25 bp, Homo sapien
tggccgctttcgatattttctaaac

SEQ ID NO: 30162 - DNA, 25 bp, Homo sapien
ggccgctttcgatattttctaaact

SEQ ID NO: 30163 - DNA, 25 bp, Homo sapien
gccgctttcgatattttctaaactt

SEQ ID NO: 30164 - DNA, 25 bp, Homo sapien
tcgatattttctaaactttaattca

SEQ ID NO: 30165 - DNA, 25 bp, Homo sapien
actttaattcaaaagcactttgtgc

SEQ ID NO: 30166 - DNA, 25 bp, Homo sapien
agcactttgtgctgtgttctatata

SEQ ID NO: 30167 - DNA, 25 bp, Homo sapien
ttgtgctgtgttctatataaaaaac

SEQ ID NO: 30168 - DNA, 25 bp, Homo sapien
gtactagcttacttttgtatggatt

SEQ ID NO: 30169 - DNA, 25 bp, Homo sapien
ctagcttacttttgtatggattcag

SEQ ID NO: 30170 - DNA, 25 bp, Homo sapien
tacttttgtatggattcagaatata

SEQ ID NO: 30171 - DNA, 25 bp, Homo sapien
atggattcagaatatactaaattaa

SEQ ID NO: 30172 - DNA, 25 bp, Homo sapien
ccgaatctcgctgatttggcggtgt

SEQ ID NO: 30173 - DNA, 25 bp, Homo sapien
gatttggcggtgtatggcgtgctgc

SEQ ID NO: 30174 - DNA, 25 bp, Homo sapien
gtatggcgtgctgcgtgtgatggag

SEQ ID NO: 30175 - DNA, 25 bp, Homo sapien
gaggggctggatgcattcgatgacc

SEQ ID NO: 30176 - DNA, 25 bp, Homo sapien
atgacctgatgcagcacacgcacat

SEQ ID NO: 30177 - DNA, 25 bp, Homo sapien
ggtggagagggccatcaccgaggcc

SEQ ID NO: 30178 - DNA, 25 bp, Homo sapien
gggaaggcagcggaagacgccagct

SEQ ID NO: 30179 - DNA, 25 bp, Homo sapien
gcgcctggcgatactggttgggggc

SEQ ID NO: 30180 - DNA, 25 bp, Homo sapien
ggggcaggatcattctgccccttgt

SEQ ID NO: 30181 - DNA, 25 bp, Homo sapien
agccctctcgcttctaacacagggc

SEQ ID NO: 30182 - DNA, 25 bp, Homo sapien
gcctcccgggactgggacatgtttg

SEQ ID NO: 30183 - DNA, 25 bp, Homo sapien
gtgtctctgcgggattgtttcaacc

SEQ ID NO: 30184 - DNA, 25 bp, Homo sapien
gctagagtcggagaatgccccagtg

SEQ ID NO: 30185 - DNA, 25 bp, Homo sapien
gccccagtgtgtgaccgatgtcggc

SEQ ID NO: 30186 - DNA, 25 bp, Homo sapien
caaagattccctcgaatcctcgtgc

SEQ ID NO: 30187 - DNA, 25 bp, Homo sapien
ccatctgaatcgattttctgcctcc

SEQ ID NO: 30188 - DNA, 25 bp, Homo sapien
gtaggtgtagactttccactgcagc

SEQ ID NO: 30189 - DNA, 25 bp, Homo sapien
ccactgcagcgactgagcctagggg

SEQ ID NO: 30190 - DNA, 25 bp, Homo sapien
agccggaagtcctgtataccagctg

SEQ ID NO: 30191 - DNA, 25 bp, Homo sapien
tgtctacaatgactctcgtgtctcc

SEQ ID NO: 30192 - DNA, 25 bp, Homo sapien
ctacgtgctgttctaccaactgatg

SEQ ID NO: 30193 - DNA, 25 bp, Homo sapien
taagctctggcacctgtgaagccct

SEQ ID NO: 30194 - DNA, 25 bp, Homo sapien
gtggatggtgatggctacaagatgg

SEQ ID NO: 30195 - DNA, 25 bp, Homo sapien
gatggatttcagttgcatagaaata

SEQ ID NO: 30196 - DNA, 25 bp, Homo sapien
tagaaataagaacctcctacctctg

SEQ ID NO: 30197 - DNA, 25 bp, Homo sapien
aacctcctacctctgttgaaatcag

SEQ ID NO: 30198 - DNA, 25 bp, Homo sapien
aaatcagaatacatatacacccctt

SEQ ID NO: 30199 - DNA, 25 bp, Homo sapien
gaatacatatacaccccttcattca

SEQ ID NO: 30200 - DNA, 25 bp, Homo sapien
caccccttcattcactctatgaata

SEQ ID NO: 30201 - DNA, 25 bp, Homo sapien
cattcactctatgaatattcattca

SEQ ID NO: 30202 - DNA, 25 bp, Homo sapien
ttcattcattccatgaacctacaag

SEQ ID NO: 30203 - DNA, 25 bp, Homo sapien
ttcattccatgaacctacaaggttt

SEQ ID NO: 30204 - DNA, 25 bp, Homo sapien
aatacaaaatactcacttgaaccca

SEQ ID NO: 30205 - DNA, 25 bp, Homo sapien
gcacgagggacgagcttagctgagc

SEQ ID NO: 30206 - DNA, 25 bp, Homo sapien
gggacgagcttagctgagctgggag

SEQ ID NO: 30207 - DNA, 25 bp, Homo sapien
gagcagggtgagggtgggcgaccca

SEQ ID NO: 30208 - DNA, 25 bp, Homo sapien
ggaatgtttagcacaagacacagcg

SEQ ID NO: 30209 - DNA, 25 bp, Homo sapien
gcacaagacacagcggagctcggga

SEQ ID NO: 30210 - DNA, 25 bp, Homo sapien
tcccctgcagcctggttaggtggat

SEQ ID NO: 30211 - DNA, 25 bp, Homo sapien
ctggttaggtggatacctgccctga

SEQ ID NO: 30212 - DNA, 25 bp, Homo sapien
acctgccctgacatgtgaggcaagc

SEQ ID NO: 30213 - DNA, 25 bp, Homo sapien
gcaagctaaggcctggagggtcaga

SEQ ID NO: 30214 - DNA, 25 bp, Homo sapien
gggtcagatgggagaccaggtccca

SEQ ID NO: 30215 - DNA, 25 bp, Homo sapien
agatgggagaccaggtcccaaggga

SEQ ID NO: 30216 - DNA, 25 bp, Homo sapien
accagtggcaccgatcagctgggga

SEQ ID NO: 30217 - DNA, 25 bp, Homo sapien
aggaagaggatggcccagtcctgac

SEQ ID NO: 30218 - DNA, 25 bp, Homo sapien
atgagcagaagtcccgaatccaggc

SEQ ID NO: 30219 - DNA, 25 bp, Homo sapien
aggccatgaagcccatgaccaagga

SEQ ID NO: 30220 - DNA, 25 bp, Homo sapien
gtgggatgcccggcagagcatcatc

SEQ ID NO: 30221 - DNA, 25 bp, Homo sapien
tcatccgcaaggtggtggaccctga

SEQ ID NO: 30222 - DNA, 25 bp, Homo sapien
acaagcaagccacccgaggggactg

SEQ ID NO: 30223 - DNA, 25 bp, Homo sapien
cgctggccaaggcctgtggacgacg

SEQ ID NO: 30224 - DNA, 25 bp, Homo sapien
gcctgggcaggtttcagggtgccag

SEQ ID NO: 30225 - DNA, 25 bp, Homo sapien
aagcctgatgggtgctggtggcctt

SEQ ID NO: 30226 - DNA, 25 bp, Homo sapien
gcacccccatctgaaagagcagcac

SEQ ID NO: 30227 - DNA, 25 bp, Homo sapien
gtcattgcttcttgctgatcttgac

SEQ ID NO: 30228 - DNA, 25 bp, Homo sapien
attgcttcttgctgatcttgacaaa

SEQ ID NO: 30229 - DNA, 25 bp, Homo sapien
gcttcttgctgatcttgacaaagaa

SEQ ID NO: 30230 - DNA, 25 bp, Homo sapien
aggaaaaagactggtattacgctca

SEQ ID NO: 30231 - DNA, 25 bp, Homo sapien
aagactggtattacgctcaacttca

SEQ ID NO: 30232 - DNA, 25 bp, Homo sapien
gactggtattacgctcaacttcaga

SEQ ID NO: 30233 - DNA, 25 bp, Homo sapien
ggtattacgctcaacttcagaatct

SEQ ID NO: 30234 - DNA, 25 bp, Homo sapien
tattacgctcaacttcagaatctca

SEQ ID NO: 30235 - DNA, 25 bp, Homo sapien
tacgctcaacttcagaatctcacta

SEQ ID NO: 30236 - DNA, 25 bp, Homo sapien
gctcaacttcagaatctcactaaaa

SEQ ID NO: 30237 - DNA, 25 bp, Homo sapien
aacttcagaatctcactaaaagaat

SEQ ID NO: 30238 - DNA, 25 bp, Homo sapien
gcaatgggttatcctggtatcagca

SEQ ID NO: 30239 - DNA, 25 bp, Homo sapien
cagaaaccagggcaagcccctacgc

SEQ ID NO: 30240 - DNA, 25 bp, Homo sapien
ctcctgatctatgctgcatccagtt

SEQ ID NO: 30241 - DNA, 25 bp, Homo sapien
tgcatccagtttgcagtcgggggtc

SEQ ID NO: 30242 - DNA, 25 bp, Homo sapien
gatgtgacatccaggtgacccagtc

SEQ ID NO: 30243 - DNA, 25 bp, Homo sapien
tcccatctcggttcagtggcagtgg

SEQ ID NO: 30244 - DNA, 25 bp, Homo sapien
ctgggacagatttcactctcaccat

SEQ ID NO: 30245 - DNA, 25 bp, Homo sapien
gcagcctgcagcctgaagatgttgc

SEQ ID NO: 30246 - DNA, 25 bp, Homo sapien
ttccctgtctgcgtctgtaggagac

SEQ ID NO: 30247 - DNA, 25 bp, Homo sapien
taggagacagagtcaccatcacctg

SEQ ID NO: 30248 - DNA, 25 bp, Homo sapien
atcacctgccgggcaagtcagggca

SEQ ID NO: 30249 - DNA, 25 bp, Homo sapien
tgctggtgcccctggtgacaagggg

SEQ ID NO: 30250 - DNA, 25 bp, Homo sapien
tggtgcccctggtgacaagggggac

SEQ ID NO: 30251 - DNA, 25 bp, Homo sapien
agggcctaagggtgacagaggtgat

SEQ ID NO: 30252 - DNA, 25 bp, Homo sapien
ccccattcccgaggagctttatgag

SEQ ID NO: 30253 - DNA, 25 bp, Homo sapien
gtgacagaggtgatgctggtcccaa

SEQ ID NO: 30254 - DNA, 25 bp, Homo sapien
gaggtgatgctggtcccaaaggtgc

SEQ ID NO: 30255 - DNA, 25 bp, Homo sapien
gatgctggtcccaaaggtgctgatg

SEQ ID NO: 30256 - DNA, 25 bp, Homo sapien
tcccaaaggtgctgatggctctcct

SEQ ID NO: 30257 - DNA, 25 bp, Homo sapien
tgatggctctcctggcaaagatggc

SEQ ID NO: 30258 - DNA, 25 bp, Homo sapien
tggctctcctggcaaagatggcgtc

SEQ ID NO: 30259 - DNA, 25 bp, Homo sapien
gcaaagatggcgtccgtggtctgac

SEQ ID NO: 30260 - DNA, 25 bp, Homo sapien
gctggagaaaagatgccctctgaat

SEQ ID NO: 30261 - DNA, 25 bp, Homo sapien
ccctctgaatctttgtgtttggctg

SEQ ID NO: 30262 - DNA, 25 bp, Homo sapien
ctcgccttgacaccgaatggttgaa

SEQ ID NO: 30263 - DNA, 25 bp, Homo sapien
aactcctgcacctgtatatagggcc

SEQ ID NO: 30264 - DNA, 25 bp, Homo sapien
agggccaagtcaattctggagacct

SEQ ID NO: 30265 - DNA, 25 bp, Homo sapien
caattctggagacctgggtgtgggt

SEQ ID NO: 30266 - DNA, 25 bp, Homo sapien
gggtgtgggtcaagcaaccaggtaa

SEQ ID NO: 30267 - DNA, 25 bp, Homo sapien
tggaaagcttgatctgacgctcctt

SEQ ID NO: 30268 - DNA, 25 bp, Homo sapien
tgatctgacgctccttttctaaata

SEQ ID NO: 30269 - DNA, 25 bp, Homo sapien
ctgacgctccttttctaaataactt

SEQ ID NO: 30270 - DNA, 25 bp, Homo sapien
ggatggattattcgtattttttggt

SEQ ID NO: 30271 - DNA, 25 bp, Homo sapien
aaccacaacattgcctgcatgtcta

SEQ ID NO: 30272 - DNA, 25 bp, Homo sapien
caacattgcctgcatgtctaaaaga

SEQ ID NO: 30273 - DNA, 25 bp, Homo sapien
gcctggccaacctggtgaaatgcag

SEQ ID NO: 30274 - DNA, 25 bp, Homo sapien
acctggtgaaatgcagtgtcaacta

SEQ ID NO: 30275 - DNA, 25 bp, Homo sapien
aataggaaaatcagccaggcgtggt

SEQ ID NO: 30276 - DNA, 25 bp, Homo sapien
gaatcacttgaacttgggaggggta

SEQ ID NO: 30277 - DNA, 25 bp, Homo sapien
aacttgggaggggtaggttgcagtg

SEQ ID NO: 30278 - DNA, 25 bp, Homo sapien
tgggaggggtaggttgcagtgagct

SEQ ID NO: 30279 - DNA, 25 bp, Homo sapien
gctgagatcacaccaaaatggggtg

SEQ ID NO: 30280 - DNA, 25 bp, Homo sapien
caaaatggggtggggcgcagtggct

SEQ ID NO: 30281 - DNA, 25 bp, Homo sapien
ggcggatcacgaggtagggagatca

SEQ ID NO: 30282 - DNA, 25 bp, Homo sapien
gctgcaggccaagggctttagctcc

SEQ ID NO: 30283 - DNA, 25 bp, Homo sapien
tgtgtacagccaggtcatcgtgcag

SEQ ID NO: 30284 - DNA, 25 bp, Homo sapien
agcgctcgctgctggaggacaaaga

SEQ ID NO: 30285 - DNA, 25 bp, Homo sapien
caggcgcccttcgcaaagagtgacg

SEQ ID NO: 30286 - DNA, 25 bp, Homo sapien
gtgggagaacggactcctcagactc

SEQ ID NO: 30287 - DNA, 25 bp, Homo sapien
tcagactctccccaatagcggaagt

SEQ ID NO: 30288 - DNA, 25 bp, Homo sapien
ctgaaggatggccaatctgctccgg

SEQ ID NO: 30289 - DNA, 25 bp, Homo sapien
cagacttaacgatccttgctgcagt

SEQ ID NO: 30290 - DNA, 25 bp, Homo sapien
gcagtccctccggagaggatctgga

SEQ ID NO: 30291 - DNA, 25 bp, Homo sapien
agcagacccccgagagggtgcagtg

SEQ ID NO: 30292 - DNA, 25 bp, Homo sapien
tatgcggcccagcctataaacagcc

SEQ ID NO: 30293 - DNA, 25 bp, Homo sapien
gaccctgatcctctatgatgtcata

SEQ ID NO: 30294 - DNA, 25 bp, Homo sapien
gatgtcatatagagcaactcagggc

SEQ ID NO: 30295 - DNA, 25 bp, Homo sapien
aactcagggctatacttgctagatt

SEQ ID NO: 30296 - DNA, 25 bp, Homo sapien
aatattaatcatcatcctctcatct

SEQ ID NO: 30297 - DNA, 25 bp, Homo sapien
gccaaagtctttgtcaaaactccaa

SEQ ID NO: 30298 - DNA, 25 bp, Homo sapien
tttgccattctcatttataatgcag

SEQ ID NO: 30299 - DNA, 25 bp, Homo sapien
aatgcagtttctccttaagcctgga

SEQ ID NO: 30300 - DNA, 25 bp, Homo sapien
tgaagtatctaacatgtgccaagca

SEQ ID NO: 30301 - DNA, 25 bp, Homo sapien
gtgcctggcactttcaatcattaga

SEQ ID NO: 30302 - DNA, 25 bp, Homo sapien
ttatgtgattccacagcattttctg

SEQ ID NO: 30303 - DNA, 25 bp, Homo sapien
aatacttgatttctgatgcaacttt

SEQ ID NO: 30304 - DNA, 25 bp, Homo sapien
gaaggggaccaaactctcggtcata

SEQ ID NO: 30305 - DNA, 25 bp, Homo sapien
ctcggtcataccaaaggcctgagtc

SEQ ID NO: 30306 - DNA, 25 bp, Homo sapien
aaggcctgagtcaaggttattgcaa

SEQ ID NO: 30307 - DNA, 25 bp, Homo sapien
gactgtgtaacaccaatgcaggcaa

SEQ ID NO: 30308 - DNA, 25 bp, Homo sapien
accaatgcaggcaaatcagcctttg

SEQ ID NO: 30309 - DNA, 25 bp, Homo sapien
tcttctggaaaccctcagtccatat

SEQ ID NO: 30310 - DNA, 25 bp, Homo sapien
accctcagtccatataagcgacacg

SEQ ID NO: 30311 - DNA, 25 bp, Homo sapien
aagcgacacggctgagtacttctgt

SEQ ID NO: 30312 - DNA, 25 bp, Homo sapien
tgagtacttctgtgctgtggtgctc

SEQ ID NO: 30313 - DNA, 25 bp, Homo sapien
tgctctctggggctgggagttacca

SEQ ID NO: 30314 - DNA, 25 bp, Homo sapien
tgggagttaccaactcactttcggg

SEQ ID NO: 30315 - DNA, 25 bp, Homo sapien
ggagctgttatcactaccagtttct

SEQ ID NO: 30316 - DNA, 25 bp, Homo sapien
gtttctggcacaattccagcacaat

SEQ ID NO: 30317 - DNA, 25 bp, Homo sapien
agcaagtcaaaggactgggcacctg

SEQ ID NO: 30318 - DNA, 25 bp, Homo sapien
acagacaccagaccaggtccagggc

SEQ ID NO: 30319 - DNA, 25 bp, Homo sapien
tcagcaccaaagaacgaggggccca

SEQ ID NO: 30320 - DNA, 25 bp, Homo sapien
agaacgaggggcccaggtcttgttg

SEQ ID NO: 30321 - DNA, 25 bp, Homo sapien
gccactgcccagggtgatggtggcc

SEQ ID NO: 30322 - DNA, 25 bp, Homo sapien
ccaggtgccattcatgactaatcag

SEQ ID NO: 30323 - DNA, 25 bp, Homo sapien
ggagctgtattttggcagcacccca

SEQ ID NO: 30324 - DNA, 25 bp, Homo sapien
ttggggcacctaagacagcaccccc

SEQ ID NO: 30325 - DNA, 25 bp, Homo sapien
ttttgtattcacaggcatcccatct

SEQ ID NO: 30326 - DNA, 25 bp, Homo sapien
ggactcccaccagggtctgggagag

SEQ ID NO: 30327 - DNA, 25 bp, Homo sapien
tacttggtttttaagcgactggttg

SEQ ID NO: 30328 - DNA, 25 bp, Homo sapien
tggtttttaagcgactggttgggat

SEQ ID NO: 30329 - DNA, 25 bp, Homo sapien
aagcgactggttgggatagaaccct

SEQ ID NO: 30330 - DNA, 25 bp, Homo sapien
ccccgacatgctgcgtgatggtgtg

SEQ ID NO: 30331 - DNA, 25 bp, Homo sapien
acatgctgcgtgatggtgtggcttc

SEQ ID NO: 30332 - DNA, 25 bp, Homo sapien
agtctcctgccggaagaaatgggtt

SEQ ID NO: 30333 - DNA, 25 bp, Homo sapien
tgccggaagaaatgggttgatcccg

SEQ ID NO: 30334 - DNA, 25 bp, Homo sapien
gggttgatcccgaaaggaggctgtc

SEQ ID NO: 30335 - DNA, 25 bp, Homo sapien
gatcccgaaaggaggctgtctgagg

SEQ ID NO: 30336 - DNA, 25 bp, Homo sapien
tcccgaaaggaggctgtctgaggaa

SEQ ID NO: 30337 - DNA, 25 bp, Homo sapien
gtaccagcagcttccaggaacagcc

SEQ ID NO: 30338 - DNA, 25 bp, Homo sapien
ccccaaactcctcatctatagtaat

SEQ ID NO: 30339 - DNA, 25 bp, Homo sapien
atagtaataatcagcggccctcagg

SEQ ID NO: 30340 - DNA, 25 bp, Homo sapien
actgggctccagtctgaggatgagg

SEQ ID NO: 30341 - DNA, 25 bp, Homo sapien
gaggctgattattactggcagtcct

SEQ ID NO: 30342 - DNA, 25 bp, Homo sapien
ctggcagtcctatgacaggagtctg

SEQ ID NO: 30343 - DNA, 25 bp, Homo sapien
gacaggagtctgagtggtgtggtat

SEQ ID NO: 30344 - DNA, 25 bp, Homo sapien
gggaccccagggcagagggtcacca

SEQ ID NO: 30345 - DNA, 25 bp, Homo sapien
gtcaccatctcttgttctggaagca

SEQ ID NO: 30346 - DNA, 25 bp, Homo sapien
gaagcagctccaacatcggggaaga

SEQ ID NO: 30347 - DNA, 25 bp, Homo sapien
aattactgtaaactggtaccagcag

SEQ ID NO: 30348 - DNA, 25 bp, Homo sapien
gatagttcggatgtcgctgtggcaa

SEQ ID NO: 30349 - DNA, 25 bp, Homo sapien
gtcgctgtggcaaagtccgagggcc

SEQ ID NO: 30350 - DNA, 25 bp, Homo sapien
ccagcgctgccctggagattgagcg

SEQ ID NO: 30351 - DNA, 25 bp, Homo sapien
ttgagcgcctggaggacagggctgg

SEQ ID NO: 30352 - DNA, 25 bp, Homo sapien
agggctggagattgagcgcctggag

SEQ ID NO: 30353 - DNA, 25 bp, Homo sapien
tggagattgagcgcctggaggacag

SEQ ID NO: 30354 - DNA, 25 bp, Homo sapien
gacagggctggagattgagcgcctg

SEQ ID NO: 30355 - DNA, 25 bp, Homo sapien
agcgacgtgggcaagggcgagatcc

SEQ ID NO: 30356 - DNA, 25 bp, Homo sapien
gggctggagattgagcgcctggagg

SEQ ID NO: 30357 - DNA, 25 bp, Homo sapien
gattgagcgcctggaggacagggct

SEQ ID NO: 30358 - DNA, 25 bp, Homo sapien
cagtgagggatgaaccctaccagag

SEQ ID NO: 30359 - DNA, 25 bp, Homo sapien
gggagaacttcaacggggaactgca

SEQ ID NO: 30360 - DNA, 25 bp, Homo sapien
ggggaactgcaatttctgatccacc

SEQ ID NO: 30361 - DNA, 25 bp, Homo sapien
gcaatttctgatccaccagagctga

SEQ ID NO: 30362 - DNA, 25 bp, Homo sapien
cgtcgtggacgatcctgtgacagag

SEQ ID NO: 30363 - DNA, 25 bp, Homo sapien
agtgaggaagaacacccaggtggtc

SEQ ID NO: 30364 - DNA, 25 bp, Homo sapien
ggtggtcagcgatgctgcctataaa

SEQ ID NO: 30365 - DNA, 25 bp, Homo sapien
tgctgcctataaaggggtccaccct

SEQ ID NO: 30366 - DNA, 25 bp, Homo sapien
ctataaaggggtccaccctcacatc

SEQ ID NO: 30367 - DNA, 25 bp, Homo sapien
gacctggaatcattgttgacctcaa

SEQ ID NO: 30368 - DNA, 25 bp, Homo sapien
caaagtttggcgcacagatcctggc

SEQ ID NO: 30369 - DNA, 25 bp, Homo sapien
cgaccttgatcccctggaagacaat

SEQ ID NO: 30370 - DNA, 25 bp, Homo sapien
gccctgactgactgtattctctggc

SEQ ID NO: 30371 - DNA, 25 bp, Homo sapien
cacattcaagtcccccattggtggg

SEQ ID NO: 30372 - DNA, 25 bp, Homo sapien
cgtccttggctccagagctcgaaga

SEQ ID NO: 30373 - DNA, 25 bp, Homo sapien
acagagagcctgggctcagccttct

SEQ ID NO: 30374 - DNA, 25 bp, Homo sapien
agccttctgcatcaggacatggcct

SEQ ID NO: 30375 - DNA, 25 bp, Homo sapien
aggaccaagggctggcggtgtggcc

SEQ ID NO: 30376 - DNA, 25 bp, Homo sapien
cctgctccttgcagtgaagccacca

SEQ ID NO: 30377 - DNA, 25 bp, Homo sapien
tgaagccaccatgggtgaccgtcca

SEQ ID NO: 30378 - DNA, 25 bp, Homo sapien
ccggtggcctgcacagtgagggaag

SEQ ID NO: 30379 - DNA, 25 bp, Homo sapien
tctgctcccagggcaggggacaggc

SEQ ID NO: 30380 - DNA, 25 bp, Homo sapien
gacaggccaccaaggacctttggca

SEQ ID NO: 30381 - DNA, 25 bp, Homo sapien
gagtgggtgggcatgattccagtca

SEQ ID NO: 30382 - DNA, 25 bp, Homo sapien
tgattccagtcaatgggggaccgcc

SEQ ID NO: 30383 - DNA, 25 bp, Homo sapien
cgcccgtgtctaagcatgtgcaaag

SEQ ID NO: 30384 - DNA, 25 bp, Homo sapien
attgtttgtcattgagtcttctctc

SEQ ID NO: 30385 - DNA, 25 bp, Homo sapien
gtcttctctcagaatcagcgagccc

SEQ ID NO: 30386 - DNA, 25 bp, Homo sapien
cagcgagcccagctgtagggtgggg

SEQ ID NO: 30387 - DNA, 25 bp, Homo sapien
taagtagggcttgccccacttcaga

SEQ ID NO: 30388 - DNA, 25 bp, Homo sapien
cagaggttttggggttcagggtgct

SEQ ID NO: 30389 - DNA, 25 bp, Homo sapien
ctcagcctcatacagatgtgccatc

SEQ ID NO: 30390 - DNA, 25 bp, Homo sapien
gtgccatcatggggggcatgggtgg

SEQ ID NO: 30391 - DNA, 25 bp, Homo sapien
accccgggcaggcaaaggcagtggg

SEQ ID NO: 30392 - DNA, 25 bp, Homo sapien
atcacaggtgtgagttaccactcgt

SEQ ID NO: 30393 - DNA, 25 bp, Homo sapien
gttaccactcgtatgtacttcagtt

SEQ ID NO: 30394 - DNA, 25 bp, Homo sapien
ttcagttaattcccaaagagcccgt

SEQ ID NO: 30395 - DNA, 25 bp, Homo sapien
cccaaagagcccgtattctcttgcc

SEQ ID NO: 30396 - DNA, 25 bp, Homo sapien
tcatccatctctggtgtccgtaaga

SEQ ID NO: 30397 - DNA, 25 bp, Homo sapien
gtgtccgtaagaagctcactggtcc

SEQ ID NO: 30398 - DNA, 25 bp, Homo sapien
cactggtcccagtggtgggttggtt

SEQ ID NO: 30399 - DNA, 25 bp, Homo sapien
gatgttgaccaatgacgggtacaga

SEQ ID NO: 30400 - DNA, 25 bp, Homo sapien
atgacgggtacagaggcttttagag

SEQ ID NO: 30401 - DNA, 25 bp, Homo sapien
ggcttttagagaatgcagaccgacc

SEQ ID NO: 30402 - DNA, 25 bp, Homo sapien
gagtgtgatagtgtgaccacagctc

SEQ ID NO: 30403 - DNA, 25 bp, Homo sapien
gagaaatcagattgttgctgtgtct

SEQ ID NO: 30404 - DNA, 25 bp, Homo sapien
gattgttgctgtgtctgtgtagaaa

SEQ ID NO: 30405 - DNA, 25 bp, Homo sapien
gaagtagacacaggagactccactt

SEQ ID NO: 30406 - DNA, 25 bp, Homo sapien
gacacaggagactccactttgttct

SEQ ID NO: 30407 - DNA, 25 bp, Homo sapien
acaggagactccactttgttctgta

SEQ ID NO: 30408 - DNA, 25 bp, Homo sapien
agacctctgttcacttgtttatttg

SEQ ID NO: 30409 - DNA, 25 bp, Homo sapien
tctgttcacttgtttatttgctgac

SEQ ID NO: 30410 - DNA, 25 bp, Homo sapien
ccaacagctcactgagaacgggtca

SEQ ID NO: 30411 - DNA, 25 bp, Homo sapien
acagctcactgagaacgggtcatga

SEQ ID NO: 30412 - DNA, 25 bp, Homo sapien
agctcactgagaacgggtcatgatg

SEQ ID NO: 30413 - DNA, 25 bp, Homo sapien
cactgagaacgggtcatgatgacga

SEQ ID NO: 30414 - DNA, 25 bp, Homo sapien
cggagcctccgacggaagggaagca

SEQ ID NO: 30415 - DNA, 25 bp, Homo sapien
gacggaagggaagcaggctgcccca

SEQ ID NO: 30416 - DNA, 25 bp, Homo sapien
cagacccagggcaaacgcatcaaag

SEQ ID NO: 30417 - DNA, 25 bp, Homo sapien
aaacgcatcaaagtggagcccggcc

SEQ ID NO: 30418 - DNA, 25 bp, Homo sapien
gggaaaccaaaggctccgaggacag

SEQ ID NO: 30419 - DNA, 25 bp, Homo sapien
gaggacagtggcgacgaggatccct

SEQ ID NO: 30420 - DNA, 25 bp, Homo sapien
tcatccgggcaggggtcctgaagca

SEQ ID NO: 30421 - DNA, 25 bp, Homo sapien
gtcctgaagcaggatccggtgcggc

SEQ ID NO: 30422 - DNA, 25 bp, Homo sapien
ctgccgcggaagggggactgaggac

SEQ ID NO: 30423 - DNA, 25 bp, Homo sapien
tgaggactggcagagctgccggcgc

SEQ ID NO: 30424 - DNA, 25 bp, Homo sapien
gccctgagaattaaacgccggctct

SEQ ID NO: 30425 - DNA, 25 bp, Homo sapien
cccggaagacagcgccattgaggat

SEQ ID NO: 30426 - DNA, 25 bp, Homo sapien
aagacagcgccattgaggatccgga

SEQ ID NO: 30427 - DNA, 25 bp, Homo sapien
ctccaggaaatgctggcccagtgat

SEQ ID NO: 30428 - DNA, 25 bp, Homo sapien
aatgctggcccagtgatcatgtcat

SEQ ID NO: 30429 - DNA, 25 bp, Homo sapien
ggcccagtgatcatgtcattgagga

SEQ ID NO: 30430 - DNA, 25 bp, Homo sapien
tggccattccaaagggtttgcatat

SEQ ID NO: 30431 - DNA, 25 bp, Homo sapien
gaccaggaatcagcacaacagatcg

SEQ ID NO: 30432 - DNA, 25 bp, Homo sapien
ggaatcagcacaacagatcggggtt

SEQ ID NO: 30433 - DNA, 25 bp, Homo sapien
caacagatcggggttttccaggagc

SEQ ID NO: 30434 - DNA, 25 bp, Homo sapien
cagatcggggttttccaggagcccg

SEQ ID NO: 30435 - DNA, 25 bp, Homo sapien
cctctctcgattccacagtggtttt

SEQ ID NO: 30436 - DNA, 25 bp, Homo sapien
tggagcgggtcaccgactatgcaga

SEQ ID NO: 30437 - DNA, 25 bp, Homo sapien
gttccaatctggagacggccatgtc

SEQ ID NO: 30438 - DNA, 25 bp, Homo sapien
gaaggtcccgggagcagaaagccaa

SEQ ID NO: 30439 - DNA, 25 bp, Homo sapien
gatacctcgagcagcagcagaacgc

SEQ ID NO: 30440 - DNA, 25 bp, Homo sapien
acgcagtttgcgggaacacatgggc

SEQ ID NO: 30441 - DNA, 25 bp, Homo sapien
ggtagaggcgcttattgccctaacc

SEQ ID NO: 30442 - DNA, 25 bp, Homo sapien
cctaaccaactgatgcgtgctttct

SEQ ID NO: 30443 - DNA, 25 bp, Homo sapien
gcgtgctttctcaaatatacctact

SEQ ID NO: 30444 - DNA, 25 bp, Homo sapien
gaccgagggggatgtggagctggag

SEQ ID NO: 30445 - DNA, 25 bp, Homo sapien
tgagaccagtggaccagagcggcct

SEQ ID NO: 30446 - DNA, 25 bp, Homo sapien
ggcctccggagaagccacggaaaca

SEQ ID NO: 30447 - DNA, 25 bp, Homo sapien
tttccccactatgttaacaggtaat

SEQ ID NO: 30448 - DNA, 25 bp, Homo sapien
taaatgtggactgaaattttcatct

SEQ ID NO: 30449 - DNA, 25 bp, Homo sapien
tttcatcttttgtttgagaatctat

SEQ ID NO: 30450 - DNA, 25 bp, Homo sapien
tgaagtgtatcatatacgtggccta

SEQ ID NO: 30451 - DNA, 25 bp, Homo sapien
gtatcatatacgtggcctaaagcaa

SEQ ID NO: 30452 - DNA, 25 bp, Homo sapien
ggcctaaagcaaggtgtgtattttg

SEQ ID NO: 30453 - DNA, 25 bp, Homo sapien
tgttttgcatctggacaaatactaa

SEQ ID NO: 30454 - DNA, 25 bp, Homo sapien
aatactaaatatcccagtggccttt

SEQ ID NO: 30455 - DNA, 25 bp, Homo sapien
tactaaatatcccagtggccttttt

SEQ ID NO: 30456 - DNA, 25 bp, Homo sapien
gttgggtctccactttggattatta

SEQ ID NO: 30457 - DNA, 25 bp, Homo sapien
gcctgagtatacgtggatttcattg

SEQ ID NO: 30458 - DNA, 25 bp, Homo sapien
ccttttgcctccatgctgaggtcgg

SEQ ID NO: 30459 - DNA, 25 bp, Homo sapien
ttcattctccttgctttgtatttaa

SEQ ID NO: 30460 - DNA, 25 bp, Homo sapien
ggggcatagcatgggggcagtcccc

SEQ ID NO: 30461 - DNA, 25 bp, Homo sapien
cctgcttttttcatggtggggatcc

SEQ ID NO: 30462 - DNA, 25 bp, Homo sapien
tcatctagctctggccctagttgaa

SEQ ID NO: 30463 - DNA, 25 bp, Homo sapien
ggattccaacacagtttcttccaca

SEQ ID NO: 30464 - DNA, 25 bp, Homo sapien
catcccctgacttgggctagtgggc

SEQ ID NO: 30465 - DNA, 25 bp, Homo sapien
ggcagaggaatgcctgtgctggggc

SEQ ID NO: 30466 - DNA, 25 bp, Homo sapien
ggctgcatcagaccctggtagggag

SEQ ID NO: 30467 - DNA, 25 bp, Homo sapien
agccactaacggtatgtgctctcct

SEQ ID NO: 30468 - DNA, 25 bp, Homo sapien
gccctctccttcggagggacgtggt

SEQ ID NO: 30469 - DNA, 25 bp, Homo sapien
cttgtctggcactggagcatgcaga

SEQ ID NO: 30470 - DNA, 25 bp, Homo sapien
gcatgcagaggaggtgagagtggga

SEQ ID NO: 30471 - DNA, 25 bp, Homo sapien
tgggagggaggtaacgggtgcctgc

SEQ ID NO: 30472 - DNA, 25 bp, Homo sapien
gacgggaggggaaaggctgccgagg

SEQ ID NO: 30473 - DNA, 25 bp, Homo sapien
gaggggaaaggctgccgaggaccct

SEQ ID NO: 30474 - DNA, 25 bp, Homo sapien
ctccccaccctgaacaaatcttggg

SEQ ID NO: 30475 - DNA, 25 bp, Homo sapien
ccctgaacaaatcttgggtgggtga

SEQ ID NO: 30476 - DNA, 25 bp, Homo sapien
cctggctggaagagggtgaaaggca

SEQ ID NO: 30477 - DNA, 25 bp, Homo sapien
ggcaccccagcctgaagtttgtggg

SEQ ID NO: 30478 - DNA, 25 bp, Homo sapien
ccagcctgaagtttgtgggggccaa

SEQ ID NO: 30479 - DNA, 25 bp, Homo sapien
tgaagtttgtgggggccaaacctgg

SEQ ID NO: 30480 - DNA, 25 bp, Homo sapien
ggcaaagctggaggtcaggtctagg

SEQ ID NO: 30481 - DNA, 25 bp, Homo sapien
tggaggtcaggtctaggtggtcagg

SEQ ID NO: 30482 - DNA, 25 bp, Homo sapien
ggctccagagttctgcggatttcac

SEQ ID NO: 30483 - DNA, 25 bp, Homo sapien
ttcacagcacggcagtggcagtcgg

SEQ ID NO: 30484 - DNA, 25 bp, Homo sapien
agcacggcagtggcagtcggaagaa

SEQ ID NO: 30485 - DNA, 25 bp, Homo sapien
ggcagtcggaagaaccatttgtcag

SEQ ID NO: 30486 - DNA, 25 bp, Homo sapien
ccatttgtcaggtgattgtgggcaa

SEQ ID NO: 30487 - DNA, 25 bp, Homo sapien
gtgggcaaatgacgtcagcccttca

SEQ ID NO: 30488 - DNA, 25 bp, Homo sapien
ccttcaaacctctgttttgcatctg

SEQ ID NO: 30489 - DNA, 25 bp, Homo sapien
gttttgcatctgcaagctgcttgct

SEQ ID NO: 30490 - DNA, 25 bp, Homo sapien
caaattaccagaaacttagtgactt

SEQ ID NO: 30491 - DNA, 25 bp, Homo sapien
tgaagtaccgggaccgtgcagctga

SEQ ID NO: 30492 - DNA, 25 bp, Homo sapien
gaagtacggcggcatatccacagcc

SEQ ID NO: 30493 - DNA, 25 bp, Homo sapien
cagcctctgtagacttcgagcagcc

SEQ ID NO: 30494 - DNA, 25 bp, Homo sapien
gatgctgcaggccatgggctggaaa

SEQ ID NO: 30495 - DNA, 25 bp, Homo sapien
gggcattgtaacgcctatcgaggcc

SEQ ID NO: 30496 - DNA, 25 bp, Homo sapien
gaggcccaaacacgggtgcggggct

SEQ ID NO: 30497 - DNA, 25 bp, Homo sapien
tcacctcaaccgagtcctacaagga

SEQ ID NO: 30498 - DNA, 25 bp, Homo sapien
cttcaacgaggcccagtgagcagct

SEQ ID NO: 30499 - DNA, 25 bp, Homo sapien
gcagcttcaagagcaacttctccac

SEQ ID NO: 30500 - DNA, 25 bp, Homo sapien
acttctccacatgttgggtgtccat

SEQ ID NO: 30501 - DNA, 25 bp, Homo sapien
cactccccagccagagagggcttga

SEQ ID NO: 30502 - DNA, 25 bp, Homo sapien
cccacccctcttgagtgtcttgggg

SEQ ID NO: 30503 - DNA, 25 bp, Homo sapien
tgagtgtcttggggacagctctttc

SEQ ID NO: 30504 - DNA, 25 bp, Homo sapien
ctctttccacccctggaagatggaa

SEQ ID NO: 30505 - DNA, 25 bp, Homo sapien
caaggacctggaaacccatgcttcg

SEQ ID NO: 30506 - DNA, 25 bp, Homo sapien
acccatgcttcgagacaacgtgact

SEQ ID NO: 30507 - DNA, 25 bp, Homo sapien
tccctgcagcggcatagcattcgta

SEQ ID NO: 30508 - DNA, 25 bp, Homo sapien
agcattcgtagcaggggcaggcgct

SEQ ID NO: 30509 - DNA, 25 bp, Homo sapien
gcaggcgctgcatggagggggctgc

SEQ ID NO: 30510 - DNA, 25 bp, Homo sapien
ctgtgccagggtggcctctgaaatg

SEQ ID NO: 30511 - DNA, 25 bp, Homo sapien
tctgaaatgtgccagggagccccta

SEQ ID NO: 30512 - DNA, 25 bp, Homo sapien
ttaatgggagggtgggtgggccgca

SEQ ID NO: 30513 - DNA, 25 bp, Homo sapien
atccagctagattgcagtttaataa

SEQ ID NO: 30514 - DNA, 25 bp, Homo sapien
taaactgtacatactgtgcatataa

SEQ ID NO: 30515 - DNA, 25 bp, Homo sapien
ggcttctgttcatttcgtttaatta

SEQ ID NO: 30516 - DNA, 25 bp, Homo sapien
taattaaagctacctcctaaactat

SEQ ID NO: 30517 - DNA, 25 bp, Homo sapien
tacctcctaaactatagtggctgcc

SEQ ID NO: 30518 - DNA, 25 bp, Homo sapien
agtggctgccagtagcagactgtta

SEQ ID NO: 30519 - DNA, 25 bp, Homo sapien
ttgcattgtaaatagtctttgttgt

SEQ ID NO: 30520 - DNA, 25 bp, Homo sapien
gtctttgttgtacattgtcagtgta

SEQ ID NO: 30521 - DNA, 25 bp, Homo sapien
ggaaggatttatttacagtgtgttg

SEQ ID NO: 30522 - DNA, 25 bp, Homo sapien
gtgttaatctttgtgctatatggta

SEQ ID NO: 30523 - DNA, 25 bp, Homo sapien
atacaatattgtactcagtgttttg

SEQ ID NO: 30524 - DNA, 25 bp, Homo sapien
tggcgagtatggtgcggaggccctg

SEQ ID NO: 30525 - DNA, 25 bp, Homo sapien
ggctctgcccaagttaagggccacg

SEQ ID NO: 30526 - DNA, 25 bp, Homo sapien
ggtccccacagactcagagagaacc

SEQ ID NO: 30527 - DNA, 25 bp, Homo sapien
cgcacaagcttcgggtggacccggt

SEQ ID NO: 30528 - DNA, 25 bp, Homo sapien
acccggtcaacttcaagctaagcca

SEQ ID NO: 30529 - DNA, 25 bp, Homo sapien
agagaacccaccatggtgctgtctc

SEQ ID NO: 30530 - DNA, 25 bp, Homo sapien
gacaagttcctggcttctgtgagca

SEQ ID NO: 30531 - DNA, 25 bp, Homo sapien
ctgacctccaaataccgttaagctg

SEQ ID NO: 30532 - DNA, 25 bp, Homo sapien
ccgttaagctggagcctcggtagcc

SEQ ID NO: 30533 - DNA, 25 bp, Homo sapien
tcctgccgacaagaccaacgtcaag

SEQ ID NO: 30534 - DNA, 25 bp, Homo sapien
tcaaggccgcctggggtaaggtcgg

SEQ ID NO: 30535 - DNA, 25 bp, Homo sapien
ggttctggccttttccttgaaggca

SEQ ID NO: 30536 - DNA, 25 bp, Homo sapien
agctgcttgtacaaccaaacacctt

SEQ ID NO: 30537 - DNA, 25 bp, Homo sapien
tgcttgtacaaccaaacacctttcc

SEQ ID NO: 30538 - DNA, 25 bp, Homo sapien
ccagctgtaacctggagagtcagcc

SEQ ID NO: 30539 - DNA, 25 bp, Homo sapien
ctgtaacctggagagtcagccatgc

SEQ ID NO: 30540 - DNA, 25 bp, Homo sapien
gtcttttgttctcataaatagtcac

SEQ ID NO: 30541 - DNA, 25 bp, Homo sapien
ctcataaatagtcactggggccggg

SEQ ID NO: 30542 - DNA, 25 bp, Homo sapien
ccaaatgagtgccctccttgttatg

SEQ ID NO: 30543 - DNA, 25 bp, Homo sapien
aaatgagtgccctccttgttatgac

SEQ ID NO: 30544 - DNA, 25 bp, Homo sapien
tgccctccttgttatgacaccaagt

SEQ ID NO: 30545 - DNA, 25 bp, Homo sapien
ccttgttatgacaccaagtgactac

SEQ ID NO: 30546 - DNA, 25 bp, Homo sapien
aggtgctttcagaacctgagaccaa

SEQ ID NO: 30547 - DNA, 25 bp, Homo sapien
tcagaatacgcagaacaccagcccg

SEQ ID NO: 30548 - DNA, 25 bp, Homo sapien
accttacaccaatgggactgcctcg

SEQ ID NO: 30549 - DNA, 25 bp, Homo sapien
actgcctcgaccaatcaggttgaac

SEQ ID NO: 30550 - DNA, 25 bp, Homo sapien
caggaggacctttgagaccatcttt

SEQ ID NO: 30551 - DNA, 25 bp, Homo sapien
ttgaggaaccccgggagcgcaatgg

SEQ ID NO: 30552 - DNA, 25 bp, Homo sapien
atgggactctgattttcaccagctc

SEQ ID NO: 30553 - DNA, 25 bp, Homo sapien
ctccggcgggctgtggaatttcggg

SEQ ID NO: 30554 - DNA, 25 bp, Homo sapien
tggaatttcgggacagcagccttcc

SEQ ID NO: 30555 - DNA, 25 bp, Homo sapien
aacagtagatcgggagcagccccac

SEQ ID NO: 30556 - DNA, 25 bp, Homo sapien
catctgttggtcatccatcctgaag

SEQ ID NO: 30557 - DNA, 25 bp, Homo sapien
agtatactcttcgcatactggctac

SEQ ID NO: 30558 - DNA, 25 bp, Homo sapien
ggctacccaggtggatttagacaag

SEQ ID NO: 30559 - DNA, 25 bp, Homo sapien
ttagacaagtaacagctgctcagct

SEQ ID NO: 30560 - DNA, 25 bp, Homo sapien
cagcttcacctgagggatccagtgg

SEQ ID NO: 30561 - DNA, 25 bp, Homo sapien
gggatccagtggcaattgtaaaact

SEQ ID NO: 30562 - DNA, 25 bp, Homo sapien
actagctatttatggcatgctgcca

SEQ ID NO: 30563 - DNA, 25 bp, Homo sapien
ggaaaggttgcatctttttccagat

SEQ ID NO: 30564 - DNA, 25 bp, Homo sapien
gtagaggagcttcctcaaccacgaa

SEQ ID NO: 30565 - DNA, 25 bp, Homo sapien
tacctaaacgtctagatgagtacac

SEQ ID NO: 30566 - DNA, 25 bp, Homo sapien
ccaagattgtggactccacctgaag

SEQ ID NO: 30567 - DNA, 25 bp, Homo sapien
aagtgattgaaactttcttctgatg

SEQ ID NO: 30568 - DNA, 25 bp, Homo sapien
ttagatgcagcatctaggaccccac

SEQ ID NO: 30569 - DNA, 25 bp, Homo sapien
agcatctaggaccccacaagagaat

SEQ ID NO: 30570 - DNA, 25 bp, Homo sapien
ggaccccacaagagaatgagtggct

SEQ ID NO: 30571 - DNA, 25 bp, Homo sapien
ggcccagtcccacattaaggcatgc

SEQ ID NO: 30572 - DNA, 25 bp, Homo sapien
gtcccacattaaggcatgcagcatc

SEQ ID NO: 30573 - DNA, 25 bp, Homo sapien
taaggcatgcagcatcccatgcact

SEQ ID NO: 30574 - DNA, 25 bp, Homo sapien
cgttggcctcctagaacacaaacac

SEQ ID NO: 30575 - DNA, 25 bp, Homo sapien
gcctcctagaacacaaacacgcagc

SEQ ID NO: 30576 - DNA, 25 bp, Homo sapien
acaaacacgcagcagtctatccagc

SEQ ID NO: 30577 - DNA, 25 bp, Homo sapien
ccactgtctctggtgactacaccta

SEQ ID NO: 30578 - DNA, 25 bp, Homo sapien
ctggtgactacacctatctttgcac

SEQ ID NO: 30579 - DNA, 25 bp, Homo sapien
gggtaggaggaagaatcaatctcgt

SEQ ID NO: 30580 - DNA, 25 bp, Homo sapien
taggaggaagaatcaatctcgtgaa

SEQ ID NO: 30581 - DNA, 25 bp, Homo sapien
gaaccaaaagagagccctcattgcc

SEQ ID NO: 30582 - DNA, 25 bp, Homo sapien
aaccaaaagagagccctcattgcca

SEQ ID NO: 30583 - DNA, 25 bp, Homo sapien
accaaaagagagccctcattgccaa

SEQ ID NO: 30584 - DNA, 25 bp, Homo sapien
ccaaaagagagccctcattgccaag

SEQ ID NO: 30585 - DNA, 25 bp, Homo sapien
aaaagagagccctcattgccaagtc

SEQ ID NO: 30586 - DNA, 25 bp, Homo sapien
aggctacagtaaccaaaacatcatg

SEQ ID NO: 30587 - DNA, 25 bp, Homo sapien
aaatggtggtggaaagctggctagc

SEQ ID NO: 30588 - DNA, 25 bp, Homo sapien
ggtggtggaaagctggctagccata

SEQ ID NO: 30589 - DNA, 25 bp, Homo sapien
tggtggaaagctggctagccatatg

SEQ ID NO: 30590 - DNA, 25 bp, Homo sapien
tctctcattagcacctggggctgat

SEQ ID NO: 30591 - DNA, 25 bp, Homo sapien
cattagcacctggggctgatggctt

SEQ ID NO: 30592 - DNA, 25 bp, Homo sapien
gcacctggggctgatggcttatgag

SEQ ID NO: 30593 - DNA, 25 bp, Homo sapien
ctggggctgatggcttatgaggaaa

SEQ ID NO: 30594 - DNA, 25 bp, Homo sapien
ggctgatggcttatgaggaaattgt

SEQ ID NO: 30595 - DNA, 25 bp, Homo sapien
gaggaaattgttatagtcttttagt

SEQ ID NO: 30596 - DNA, 25 bp, Homo sapien
ttgttatagtcttttagtaggtaag

SEQ ID NO: 30597 - DNA, 25 bp, Homo sapien
tagtaggtaagttttgtccctatag

SEQ ID NO: 30598 - DNA, 25 bp, Homo sapien
tgagatggcgtctcattctgtcacc

SEQ ID NO: 30599 - DNA, 25 bp, Homo sapien
tcactgtaacctctttcttaatctt

SEQ ID NO: 30600 - DNA, 25 bp, Homo sapien
cactgtaacctctttcttaatcttt

SEQ ID NO: 30601 - DNA, 25 bp, Homo sapien
tctcctttctcaccaatgggcaata

SEQ ID NO: 30602 - DNA, 25 bp, Homo sapien
tcctttctcaccaatgggcaatagc

SEQ ID NO: 30603 - DNA, 25 bp, Homo sapien
tatttttcccaaagatagctttact

SEQ ID NO: 30604 - DNA, 25 bp, Homo sapien
gtcaaattaatgcatgctccttaca

SEQ ID NO: 30605 - DNA, 25 bp, Homo sapien
aatgcatgctccttacaacaaacaa

SEQ ID NO: 30606 - DNA, 25 bp, Homo sapien
atgctccttacaacaaacaaatatc

SEQ ID NO: 30607 - DNA, 25 bp, Homo sapien
gagtttaggaattctactagccaga

SEQ ID NO: 30608 - DNA, 25 bp, Homo sapien
actagccagagatagtcacttggag

SEQ ID NO: 30609 - DNA, 25 bp, Homo sapien
gatagtcacttggagaaactttcta

SEQ ID NO: 30610 - DNA, 25 bp, Homo sapien
gaaactttctatatatccttctaaa

SEQ ID NO: 30611 - DNA, 25 bp, Homo sapien
caccccactgataaccaaatcacag

SEQ ID NO: 30612 - DNA, 25 bp, Homo sapien
aatatgatcccatttactccttgct

SEQ ID NO: 30613 - DNA, 25 bp, Homo sapien
tcccatttactccttgctttatgaa

SEQ ID NO: 30614 - DNA, 25 bp, Homo sapien
gtgagatactagaagtttccaaacc

SEQ ID NO: 30615 - DNA, 25 bp, Homo sapien
aagtttccaaacctagcgagtctca

SEQ ID NO: 30616 - DNA, 25 bp, Homo sapien
ttccaaacctagcgagtctcagtaa

SEQ ID NO: 30617 - DNA, 25 bp, Homo sapien
gagtctcagtaagaagtttcacttc

SEQ ID NO: 30618 - DNA, 25 bp, Homo sapien
gtttcacttcacaaacagataggag

SEQ ID NO: 30619 - DNA, 25 bp, Homo sapien
gatagtggatcagaagcatgattta

SEQ ID NO: 30620 - DNA, 25 bp, Homo sapien
gaaaaataatagcttactcttgtga

SEQ ID NO: 30621 - DNA, 25 bp, Homo sapien
aatagcttactcttgtgagcgtatt

SEQ ID NO: 30622 - DNA, 25 bp, Homo sapien
gcttactcttgtgagcgtattacaa

SEQ ID NO: 30623 - DNA, 25 bp, Homo sapien
cctcctccagtacacatcgtatggg

SEQ ID NO: 30624 - DNA, 25 bp, Homo sapien
cctccagtacacatcgtatggggtg

SEQ ID NO: 30625 - DNA, 25 bp, Homo sapien
gtacacatcgtatggggtgacaccg

SEQ ID NO: 30626 - DNA, 25 bp, Homo sapien
cacatcgtatggggtgacaccgcct

SEQ ID NO: 30627 - DNA, 25 bp, Homo sapien
tcgtatggggtgacaccgcctagcc

SEQ ID NO: 30628 - DNA, 25 bp, Homo sapien
cctcccagtggagcaggctcagtca

SEQ ID NO: 30629 - DNA, 25 bp, Homo sapien
cccagtggagcaggctcagtcactc

SEQ ID NO: 30630 - DNA, 25 bp, Homo sapien
cagtggagcaggctcagtcactcca

SEQ ID NO: 30631 - DNA, 25 bp, Homo sapien
aggaaaccatcttcatcggtactcc

SEQ ID NO: 30632 - DNA, 25 bp, Homo sapien
ggaaaccatcttcatcggtactcca

SEQ ID NO: 30633 - DNA, 25 bp, Homo sapien
catcttcatcggtactccaaggttc

SEQ ID NO: 30634 - DNA, 25 bp, Homo sapien
gaaatgaccggagacaatggcagat

SEQ ID NO: 30635 - DNA, 25 bp, Homo sapien
accggagacaatggcagatgagagt

SEQ ID NO: 30636 - DNA, 25 bp, Homo sapien
agctgcagcttccaaactagtgcca

SEQ ID NO: 30637 - DNA, 25 bp, Homo sapien
agcttccaaactagtgccatttcaa

SEQ ID NO: 30638 - DNA, 25 bp, Homo sapien
ccaaactagtgccatttcaagggac

SEQ ID NO: 30639 - DNA, 25 bp, Homo sapien
caagggacatagacatggcagccaa

SEQ ID NO: 30640 - DNA, 25 bp, Homo sapien
acatggcagccaaattcattggggc

SEQ ID NO: 30641 - DNA, 25 bp, Homo sapien
ccaaattcattggggctggggctac

SEQ ID NO: 30642 - DNA, 25 bp, Homo sapien
ctgagccatccactatctgcagtgg

SEQ ID NO: 30643 - DNA, 25 bp, Homo sapien
gccatccactatctgcagtggtgtt

SEQ ID NO: 30644 - DNA, 25 bp, Homo sapien
gcagtggtgttgaaatgaccggaga

SEQ ID NO: 30645 - DNA, 25 bp, Homo sapien
cgacagtgcccaggggtctgagtct

SEQ ID NO: 30646 - DNA, 25 bp, Homo sapien
aaagcctgagacagctgccttgtgt

SEQ ID NO: 30647 - DNA, 25 bp, Homo sapien
gctgccttgtgtgcgactgagatgc

SEQ ID NO: 30648 - DNA, 25 bp, Homo sapien
tgagatgcaggatttcctcacgcct

SEQ ID NO: 30649 - DNA, 25 bp, Homo sapien
ggcttctctttttgcaagggcctct

SEQ ID NO: 30650 - DNA, 25 bp, Homo sapien
tctgtctgtgtccctgttagcacaa

SEQ ID NO: 30651 - DNA, 25 bp, Homo sapien
gaacctgggcagagtgcggcagtca

SEQ ID NO: 30652 - DNA, 25 bp, Homo sapien
atcgaaaccatcctgctaagaggtg

SEQ ID NO: 30653 - DNA, 25 bp, Homo sapien
gctaagaggtgaaccgtctctacta

SEQ ID NO: 30654 - DNA, 25 bp, Homo sapien
tggcgcagaggcaggctgtgatcca

SEQ ID NO: 30655 - DNA, 25 bp, Homo sapien
gtgatccagctactcaggagcgagc

SEQ ID NO: 30656 - DNA, 25 bp, Homo sapien
agctgttggggaagggccaggacct

SEQ ID NO: 30657 - DNA, 25 bp, Homo sapien
acctgtctcttatgccttatgggaa

SEQ ID NO: 30658 - DNA, 25 bp, Homo sapien
gaaggcccagccataactcgggggc

SEQ ID NO: 30659 - DNA, 25 bp, Homo sapien
gagctggggaccagcttaggcctcc

SEQ ID NO: 30660 - DNA, 25 bp, Homo sapien
tgactggggggtgacgcctacaccc

SEQ ID NO: 30661 - DNA, 25 bp, Homo sapien
agctatttgcactctggtgtgtggt

SEQ ID NO: 30662 - DNA, 25 bp, Homo sapien
tgtgtggttagactctgcttttctt

SEQ ID NO: 30663 - DNA, 25 bp, Homo sapien
ggactgtgggggctcaagggtaatg

SEQ ID NO: 30664 - DNA, 25 bp, Homo sapien
tcaagggtaatgccagaggcccatg

SEQ ID NO: 30665 - DNA, 25 bp, Homo sapien
gggcacctagagttctcggtgtgtc

SEQ ID NO: 30666 - DNA, 25 bp, Homo sapien
tcctatgggtgtcttacgtctgtcc

SEQ ID NO: 30667 - DNA, 25 bp, Homo sapien
cgcctgccggcggggacaagaaggt

SEQ ID NO: 30668 - DNA, 25 bp, Homo sapien
gcctgccggcggggacaagaaggtc

SEQ ID NO: 30669 - DNA, 25 bp, Homo sapien
gccggcggggacaagaaggtcatcg

SEQ ID NO: 30670 - DNA, 25 bp, Homo sapien
ggcggggacaagaaggtcatcggtg

SEQ ID NO: 30671 - DNA, 25 bp, Homo sapien
acaagaaggtcatcggtgaggaccg

SEQ ID NO: 30672 - DNA, 25 bp, Homo sapien
gaaggtcatcggtgaggaccgacag

SEQ ID NO: 30673 - DNA, 25 bp, Homo sapien
aggtcatcggtgaggaccgacaggg

SEQ ID NO: 30674 - DNA, 25 bp, Homo sapien
gtcatcggtgaggaccgacagggac

SEQ ID NO: 30675 - DNA, 25 bp, Homo sapien
tcggtgaggaccgacagggacgggg

SEQ ID NO: 30676 - DNA, 25 bp, Homo sapien
gtgaggaccgacagggacgggggtg

SEQ ID NO: 30677 - DNA, 25 bp, Homo sapien
tgaggaccgacagggacgggggtgg

SEQ ID NO: 30678 - DNA, 25 bp, Homo sapien
tggagagaatcctgtcactgtgctt

SEQ ID NO: 30679 - DNA, 25 bp, Homo sapien
gagaatcctgtcactgtgctttaag

SEQ ID NO: 30680 - DNA, 25 bp, Homo sapien
tcctgtcactgtgctttaagagcct

SEQ ID NO: 30681 - DNA, 25 bp, Homo sapien
ccaacagcttctgtactgtctatgc

SEQ ID NO: 30682 - DNA, 25 bp, Homo sapien
aacagcttctgtactgtctatgcta

SEQ ID NO: 30683 - DNA, 25 bp, Homo sapien
gtactgtctatgctaaaactatcaa

SEQ ID NO: 30684 - DNA, 25 bp, Homo sapien
aaactatcaattaacaacagactat

SEQ ID NO: 30685 - DNA, 25 bp, Homo sapien
cactattatgaagttggcatcgttc

SEQ ID NO: 30686 - DNA, 25 bp, Homo sapien
agttggcatcgttcagttggttagt

SEQ ID NO: 30687 - DNA, 25 bp, Homo sapien
tcaaacactgtcagataccacgttc

SEQ ID NO: 30688 - DNA, 25 bp, Homo sapien
acactgtcagataccacgttcaagg

SEQ ID NO: 30689 - DNA, 25 bp, Homo sapien
cggtaccacacgtccaaagttagat

SEQ ID NO: 30690 - DNA, 25 bp, Homo sapien
agcaatggtaaatttgtcgaagcat

SEQ ID NO: 30691 - DNA, 25 bp, Homo sapien
tgtcgaagcattaaacagcctcatt

SEQ ID NO: 30692 - DNA, 25 bp, Homo sapien
ataggagcaaataaccatgtcaaat

SEQ ID NO: 30693 - DNA, 25 bp, Homo sapien
aaccatgtcaaataccctgttcaga

SEQ ID NO: 30694 - DNA, 25 bp, Homo sapien
actatgtgcccagcattgactaatg

SEQ ID NO: 30695 - DNA, 25 bp, Homo sapien
gcccagcattgactaatgttcagtg

SEQ ID NO: 30696 - DNA, 25 bp, Homo sapien
atgttcagtgaaatccttttgttaa

SEQ ID NO: 30697 - DNA, 25 bp, Homo sapien
gaaatccttttgttaagagattctt

SEQ ID NO: 30698 - DNA, 25 bp, Homo sapien
tatgctataaaaaggccgggtgcgg

SEQ ID NO: 30699 - DNA, 25 bp, Homo sapien
attagcggggccaggtggcaggcac

SEQ ID NO: 30700 - DNA, 25 bp, Homo sapien
acagcgacgacgtgatccgtcgtga

SEQ ID NO: 30701 - DNA, 25 bp, Homo sapien
gcgacgacgtgatccgtcgtgagcg

SEQ ID NO: 30702 - DNA, 25 bp, Homo sapien
cgacgtgatccgtcgtgagcgggtc

SEQ ID NO: 30703 - DNA, 25 bp, Homo sapien
tgctcctcctggttggagcgcagtg

SEQ ID NO: 30704 - DNA, 25 bp, Homo sapien
cctcctggttggagcgcagtgtccg

SEQ ID NO: 30705 - DNA, 25 bp, Homo sapien
gagagagcccgagagcagggttcgg

SEQ ID NO: 30706 - DNA, 25 bp, Homo sapien
gagcccgagagcagggttcggtgcc

SEQ ID NO: 30707 - DNA, 25 bp, Homo sapien
ccgagagcagggttcggtgcctttt

SEQ ID NO: 30708 - DNA, 25 bp, Homo sapien
caggaccacaattcccagagacttc

SEQ ID NO: 30709 - DNA, 25 bp, Homo sapien
gaccacaattcccagagacttcggc

SEQ ID NO: 30710 - DNA, 25 bp, Homo sapien
cacaattcccagagacttcggcttc

SEQ ID NO: 30711 - DNA, 25 bp, Homo sapien
aacttctgaggtaggggctgtacca

SEQ ID NO: 30712 - DNA, 25 bp, Homo sapien
gtaggggctgtaccatatttttgcc

SEQ ID NO: 30713 - DNA, 25 bp, Homo sapien
aagcgaataccaaaaacaacttgtg

SEQ ID NO: 30714 - DNA, 25 bp, Homo sapien
ttatttgggcaggattggcatttac

SEQ ID NO: 30715 - DNA, 25 bp, Homo sapien
gcaggattggcatttaccatgcttt

SEQ ID NO: 30716 - DNA, 25 bp, Homo sapien
tgcttttccctattgctggcagtaa

SEQ ID NO: 30717 - DNA, 25 bp, Homo sapien
ttttccctattgctggcagtaaaac

SEQ ID NO: 30718 - DNA, 25 bp, Homo sapien
attgctggcagtaaaacatgggttt

SEQ ID NO: 30719 - DNA, 25 bp, Homo sapien
gtttttcagaatttacactgtatat

SEQ ID NO: 30720 - DNA, 25 bp, Homo sapien
ttacactgtatatctctgatttgga

SEQ ID NO: 30721 - DNA, 25 bp, Homo sapien
gtatatctctgatttggaagttata

SEQ ID NO: 30722 - DNA, 25 bp, Homo sapien
cgcggggctggtctgtggccccgcg

SEQ ID NO: 30723 - DNA, 25 bp, Homo sapien
tccctcgaaatcgtggcatctcact

SEQ ID NO: 30724 - DNA, 25 bp, Homo sapien
gtggcatctcacttctgagaacgaa

SEQ ID NO: 30725 - DNA, 25 bp, Homo sapien
agaacgaaatctcgcttcagtcact

SEQ ID NO: 30726 - DNA, 25 bp, Homo sapien
tcactctgccgaaggcgctgacggc

SEQ ID NO: 30727 - DNA, 25 bp, Homo sapien
tgccgaaggcgctgacggcatcgcg

SEQ ID NO: 30728 - DNA, 25 bp, Homo sapien
cgccgctccgtgggaaaaaacagct

SEQ ID NO: 30729 - DNA, 25 bp, Homo sapien
ggaaaaaacagctcctccatttcct

SEQ ID NO: 30730 - DNA, 25 bp, Homo sapien
gctcctccatttccttggaaactga

SEQ ID NO: 30731 - DNA, 25 bp, Homo sapien
gccaggaagttcaggggagggtccg

SEQ ID NO: 30732 - DNA, 25 bp, Homo sapien
ccgcagctgcctctgagaaaatcca

SEQ ID NO: 30733 - DNA, 25 bp, Homo sapien
tcaagtgagtgagttcccctctact

SEQ ID NO: 30734 - DNA, 25 bp, Homo sapien
gccttccacccaaactggaagcctc

SEQ ID NO: 30735 - DNA, 25 bp, Homo sapien
ggaagcctctaggtgctatcaatta

SEQ ID NO: 30736 - DNA, 25 bp, Homo sapien
attggctgaataattactcctctgc

SEQ ID NO: 30737 - DNA, 25 bp, Homo sapien
gaatactggcacaggcaatgctcac

SEQ ID NO: 30738 - DNA, 25 bp, Homo sapien
tggcacaggcaatgctcactcgaaa

SEQ ID NO: 30739 - DNA, 25 bp, Homo sapien
tctagttggttttggaatgcttgat

SEQ ID NO: 30740 - DNA, 25 bp, Homo sapien
agctaatgaactcatcaccaggaca

SEQ ID NO: 30741 - DNA, 25 bp, Homo sapien
ggacagttggagggggtaggccgag

SEQ ID NO: 30742 - DNA, 25 bp, Homo sapien
gtaggccgaggttaaatggtccacg

SEQ ID NO: 30743 - DNA, 25 bp, Homo sapien
tggtccacgtttcaaaaatgttaat

SEQ ID NO: 30744 - DNA, 25 bp, Homo sapien
cgaccactttgtcaagctcatttcc

SEQ ID NO: 30745 - DNA, 25 bp, Homo sapien
caacgaatttggccacactcagtcc

SEQ ID NO: 30746 - DNA, 25 bp, Homo sapien
tcctcacagttgccatgtagacccc

SEQ ID NO: 30747 - DNA, 25 bp, Homo sapien
cgcaccttgtcatgtaccatcaata

SEQ ID NO: 30748 - DNA, 25 bp, Homo sapien
ggactcatgaccacagtccatgcca

SEQ ID NO: 30749 - DNA, 25 bp, Homo sapien
ccctccgggaaactgtggcgtgatg

SEQ ID NO: 30750 - DNA, 25 bp, Homo sapien
caaggtcatccctgagctgaacggg

SEQ ID NO: 30751 - DNA, 25 bp, Homo sapien
cactgccaacgtgtcggtggtggac

SEQ ID NO: 30752 - DNA, 25 bp, Homo sapien
gacctgccgtctagaaaaacctgcc

SEQ ID NO: 30753 - DNA, 25 bp, Homo sapien
acactgagcaccaggtggtctcctc

SEQ ID NO: 30754 - DNA, 25 bp, Homo sapien
tctcctctgacttcaacagcgacac

SEQ ID NO: 30755 - DNA, 25 bp, Homo sapien
tgggtgagtcagtaagtggttagtg

SEQ ID NO: 30756 - DNA, 25 bp, Homo sapien
aggccatgatattactgtgcactac

SEQ ID NO: 30757 - DNA, 25 bp, Homo sapien
ttcactatgatgttaccatggctgt

SEQ ID NO: 30758 - DNA, 25 bp, Homo sapien
tcagctccattgtaatcttacggga

SEQ ID NO: 30759 - DNA, 25 bp, Homo sapien
gtaatcttacgggatcatcatcgta

SEQ ID NO: 30760 - DNA, 25 bp, Homo sapien
catcatcgtatatttggccattgtt

SEQ ID NO: 30761 - DNA, 25 bp, Homo sapien
gttgaccaaaagttatgcagcacgt

SEQ ID NO: 30762 - DNA, 25 bp, Homo sapien
atgcagcacgtcattataattttga

SEQ ID NO: 30763 - DNA, 25 bp, Homo sapien
gatgtgtcacaaaacattactcatt

SEQ ID NO: 30764 - DNA, 25 bp, Homo sapien
aaagtttgccggctaggtgcggtgg

SEQ ID NO: 30765 - DNA, 25 bp, Homo sapien
gctgggtgtaacggcggatgcctgt

SEQ ID NO: 30766 - DNA, 25 bp, Homo sapien
agtcgctccatttatcgcttgagat

SEQ ID NO: 30767 - DNA, 25 bp, Homo sapien
gctccatttatcgcttgagatctcc

SEQ ID NO: 30768 - DNA, 25 bp, Homo sapien
atttatcgcttgagatctccagcct

SEQ ID NO: 30769 - DNA, 25 bp, Homo sapien
ttatcgcttgagatctccagcctta

SEQ ID NO: 30770 - DNA, 25 bp, Homo sapien
gccttaccgcggctcgaaatggacc

SEQ ID NO: 30771 - DNA, 25 bp, Homo sapien
ctgtgtctgcaaagggacgttggag

SEQ ID NO: 30772 - DNA, 25 bp, Homo sapien
ggacgttggagaactgcagctgctg

SEQ ID NO: 30773 - DNA, 25 bp, Homo sapien
cgttggagaactgcagctgctgtgc

SEQ ID NO: 30774 - DNA, 25 bp, Homo sapien
gttaatagaacaagctgcacaacct

SEQ ID NO: 30775 - DNA, 25 bp, Homo sapien
ggattttttttcaatacgatactga

SEQ ID NO: 30776 - DNA, 25 bp, Homo sapien
tcaatacgatactgagccatttgct

SEQ ID NO: 30777 - DNA, 25 bp, Homo sapien
ctgctgggcttaagtgatggttggc

SEQ ID NO: 30778 - DNA, 25 bp, Homo sapien
cacatgcaaccgtgcctgactaatt

SEQ ID NO: 30779 - DNA, 25 bp, Homo sapien
ttatgggtatccagtggtccagcac

SEQ ID NO: 30780 - DNA, 25 bp, Homo sapien
gtggtccagcactgtttaaaaaact

SEQ ID NO: 30781 - DNA, 25 bp, Homo sapien
ttctttttctcctgagctgcatttt

SEQ ID NO: 30782 - DNA, 25 bp, Homo sapien
atcagttgaccatttatcatagatg

SEQ ID NO: 30783 - DNA, 25 bp, Homo sapien
gatgtgtggttctatttctggactc

SEQ ID NO: 30784 - DNA, 25 bp, Homo sapien
ttctggactctctgatttgtctatc

SEQ ID NO: 30785 - DNA, 25 bp, Homo sapien
gatttgtctatcttagttggcatta

SEQ ID NO: 30786 - DNA, 25 bp, Homo sapien
agttggcattactacatgtcttgat

SEQ ID NO: 30787 - DNA, 25 bp, Homo sapien
ctacatgtcttgattactataactt

SEQ ID NO: 30788 - DNA, 25 bp, Homo sapien
tccctggacaactccgagcagaagt

SEQ ID NO: 30789 - DNA, 25 bp, Homo sapien
ggacaactccgagcagaagtgcatc

SEQ ID NO: 30790 - DNA, 25 bp, Homo sapien
caactccgagcagaagtgcatcgcc

SEQ ID NO: 30791 - DNA, 25 bp, Homo sapien
actccgagcagaagtgcatcgccat

SEQ ID NO: 30792 - DNA, 25 bp, Homo sapien
gcccaagtcagcctcatattctggg

SEQ ID NO: 30793 - DNA, 25 bp, Homo sapien
agcctcatattctgggcggacagct

SEQ ID NO: 30794 - DNA, 25 bp, Homo sapien
cctcatattctgggcggacagcttg

SEQ ID NO: 30795 - DNA, 25 bp, Homo sapien
tattctgggcggacagcttgtctgg

SEQ ID NO: 30796 - DNA, 25 bp, Homo sapien
ttctgggcggacagcttgtctggac

SEQ ID NO: 30797 - DNA, 25 bp, Homo sapien
ttgggggtggtcagacaccacagga

SEQ ID NO: 30798 - DNA, 25 bp, Homo sapien
ggggtggtcagacaccacaggagct

SEQ ID NO: 30799 - DNA, 25 bp, Homo sapien
tgaatgaggcagtcacgtgcccgca

SEQ ID NO: 30800 - DNA, 25 bp, Homo sapien
cagtcacgtgcccgcaagaggggat

SEQ ID NO: 30801 - DNA, 25 bp, Homo sapien
tcacgtgcccgcaagaggggatctt

SEQ ID NO: 30802 - DNA, 25 bp, Homo sapien
atgaacggtattttagcaagtctga

SEQ ID NO: 30803 - DNA, 25 bp, Homo sapien
gagggagacattggagccgtcttcg

SEQ ID NO: 30804 - DNA, 25 bp, Homo sapien
acattggagccgtcttcgggctcag

SEQ ID NO: 30805 - DNA, 25 bp, Homo sapien
gatagtggacgggctcaagaagtat

SEQ ID NO: 30806 - DNA, 25 bp, Homo sapien
gggctcaagaagtatgaggctgcct

SEQ ID NO: 30807 - DNA, 25 bp, Homo sapien
gaggctgcctatggaaaagagttca

SEQ ID NO: 30808 - DNA, 25 bp, Homo sapien
agcaagtctgaagatgcctcctaag

SEQ ID NO: 30809 - DNA, 25 bp, Homo sapien
tggaaaagagttcaccccaagccag

SEQ ID NO: 30810 - DNA, 25 bp, Homo sapien
gacgtcaaactataaacatcctgga

SEQ ID NO: 30811 - DNA, 25 bp, Homo sapien
taaacatcctggaagacaacgtctt

SEQ ID NO: 30812 - DNA, 25 bp, Homo sapien
gacaacgtcttcttgactttggcgt

SEQ ID NO: 30813 - DNA, 25 bp, Homo sapien
aacgtcttcttgactttggcgttgg

SEQ ID NO: 30814 - DNA, 25 bp, Homo sapien
tggcgttggcaaagaacgctggcta

SEQ ID NO: 30815 - DNA, 25 bp, Homo sapien
gtgatacctaattaaactgaagagc

SEQ ID NO: 30816 - DNA, 25 bp, Homo sapien
gaagaaactgccaacggaggaaaca

SEQ ID NO: 30817 - DNA, 25 bp, Homo sapien
agaaaatgtctgcaaactatgcatc

SEQ ID NO: 30818 - DNA, 25 bp, Homo sapien
tatccagcatctataggacgcttac

SEQ ID NO: 30819 - DNA, 25 bp, Homo sapien
gcatctataggacgcttacacaaat

SEQ ID NO: 30820 - DNA, 25 bp, Homo sapien
ataggacgcttacacaaatcaacaa

SEQ ID NO: 30821 - DNA, 25 bp, Homo sapien
ctcattggcctctctagctaggccg

SEQ ID NO: 30822 - DNA, 25 bp, Homo sapien
ctctgccaagagcctccagatgtgc

SEQ ID NO: 30823 - DNA, 25 bp, Homo sapien
gtggtagagcccactataggcccag

SEQ ID NO: 30824 - DNA, 25 bp, Homo sapien
atccctcacctgccagttatgtggc

SEQ ID NO: 30825 - DNA, 25 bp, Homo sapien
gccccacaggctgtcatggtggctc

SEQ ID NO: 30826 - DNA, 25 bp, Homo sapien
ccacctcttgcattgggatcctgag

SEQ ID NO: 30827 - DNA, 25 bp, Homo sapien
gcccgtcaagccctggtgaaggagc

SEQ ID NO: 30828 - DNA, 25 bp, Homo sapien
gcttagcttgtcttcttggcaattc

SEQ ID NO: 30829 - DNA, 25 bp, Homo sapien
tggcaattcacaatgcctcactcca

SEQ ID NO: 30830 - DNA, 25 bp, Homo sapien
ctaaaactggagcgtcccctatggt

SEQ ID NO: 30831 - DNA, 25 bp, Homo sapien
cccattaaagctctgccactcaaaa

SEQ ID NO: 30832 - DNA, 25 bp, Homo sapien
gtaggctctaaattccagccatcaa

SEQ ID NO: 30833 - DNA, 25 bp, Homo sapien
cagccatcaaatccaattcctggtg

SEQ ID NO: 30834 - DNA, 25 bp, Homo sapien
tcctggtggggaaaaccttctggag

SEQ ID NO: 30835 - DNA, 25 bp, Homo sapien
ccccaaccttctgataaaagagtct

SEQ ID NO: 30836 - DNA, 25 bp, Homo sapien
aagccttcttaccacactggcatat

SEQ ID NO: 30837 - DNA, 25 bp, Homo sapien
atgaaagcattgcactgtacctctc

SEQ ID NO: 30838 - DNA, 25 bp, Homo sapien
tgtacctctcgtaacacagcaatac

SEQ ID NO: 30839 - DNA, 25 bp, Homo sapien
gtaacacagcaatacagtcctcttg

SEQ ID NO: 30840 - DNA, 25 bp, Homo sapien
agtcctcttgaggcactcaagcctg

SEQ ID NO: 30841 - DNA, 25 bp, Homo sapien
tttcctcacaagtcatcatgatttt

SEQ ID NO: 30842 - DNA, 25 bp, Homo sapien
gtttttcctgaactccaaccagaat

SEQ ID NO: 30843 - DNA, 25 bp, Homo sapien
gaattttctttgtctgcatttgtga

SEQ ID NO: 30844 - DNA, 25 bp, Homo sapien
ataccacacatgatggtgtctctga

SEQ ID NO: 30845 - DNA, 25 bp, Homo sapien
gtgtctctgagccgaccagattatg

SEQ ID NO: 30846 - DNA, 25 bp, Homo sapien
gaaactcaattgtcagaggacccaa

SEQ ID NO: 30847 - DNA, 25 bp, Homo sapien
gtgatttggatattgcctctctgtc

SEQ ID NO: 30848 - DNA, 25 bp, Homo sapien
cctctctgtcaatgctgaaccttaa

SEQ ID NO: 30849 - DNA, 25 bp, Homo sapien
cattttaagtaaacatcctcctcct

SEQ ID NO: 30850 - DNA, 25 bp, Homo sapien
tacacccccaggatttgtgcgttca

SEQ ID NO: 30851 - DNA, 25 bp, Homo sapien
ggaagtgtcatagcactcgtggact

SEQ ID NO: 30852 - DNA, 25 bp, Homo sapien
gcactcgtggactaggtttcatggg

SEQ ID NO: 30853 - DNA, 25 bp, Homo sapien
aagaagtagaagcttgtggccgggt

SEQ ID NO: 30854 - DNA, 25 bp, Homo sapien
cttctgtctcttgcataagcctcag

SEQ ID NO: 30855 - DNA, 25 bp, Homo sapien
tctgtctcttgcataagcctcaggc

SEQ ID NO: 30856 - DNA, 25 bp, Homo sapien
tctcttgcataagcctcaggcctgg

SEQ ID NO: 30857 - DNA, 25 bp, Homo sapien
ctcttgcataagcctcaggcctggc

SEQ ID NO: 30858 - DNA, 25 bp, Homo sapien
tctctgcccccaaaagtgtcaaggg

SEQ ID NO: 30859 - DNA, 25 bp, Homo sapien
gtgtcaaggggccctaggaacctcg

SEQ ID NO: 30860 - DNA, 25 bp, Homo sapien
tgtcaaggggccctaggaacctcga

SEQ ID NO: 30861 - DNA, 25 bp, Homo sapien
gccctaggaacctcgaagctgttct

SEQ ID NO: 30862 - DNA, 25 bp, Homo sapien
taggaacctcgaagctgttctctgc

SEQ ID NO: 30863 - DNA, 25 bp, Homo sapien
cttttccattctgggtgttttcaga

SEQ ID NO: 30864 - DNA, 25 bp, Homo sapien
tccattctgggtgttttcagaaaga

SEQ ID NO: 30865 - DNA, 25 bp, Homo sapien
acatgaagcaacactttatccattt

SEQ ID NO: 30866 - DNA, 25 bp, Homo sapien
gaatgtgcaggaggggttagtgaag

SEQ ID NO: 30867 - DNA, 25 bp, Homo sapien
gaagtaaagatcagctggaagtcat

SEQ ID NO: 30868 - DNA, 25 bp, Homo sapien
cagctggaagtcatgtgtgaatcat

SEQ ID NO: 30869 - DNA, 25 bp, Homo sapien
gaggagccataaggaatgatttcaa

SEQ ID NO: 30870 - DNA, 25 bp, Homo sapien
gagaggtgtgtacagcaaggaagca

SEQ ID NO: 30871 - DNA, 25 bp, Homo sapien
ggccaaaaggtagccgggtgtagtg

SEQ ID NO: 30872 - DNA, 25 bp, Homo sapien
aggtagccgggtgtagtggctcacg

SEQ ID NO: 30873 - DNA, 25 bp, Homo sapien
gggaggctgatgtgggtggattacc

SEQ ID NO: 30874 - DNA, 25 bp, Homo sapien
gacgtcaggaattcgagaccggcct

SEQ ID NO: 30875 - DNA, 25 bp, Homo sapien
ggagaatctcttgaacctgagaggc

SEQ ID NO: 30876 - DNA, 25 bp, Homo sapien
taacgaccagagtattgccctgcca

SEQ ID NO: 30877 - DNA, 25 bp, Homo sapien
gagtcagagcagccacattgcttgc

SEQ ID NO: 30878 - DNA, 25 bp, Homo sapien
ctgggccactgtatccaggacatca

SEQ ID NO: 30879 - DNA, 25 bp, Homo sapien
atcatctctgccaggtcaactggag

SEQ ID NO: 30880 - DNA, 25 bp, Homo sapien
aggtcaactggagtccctggtgact

SEQ ID NO: 30881 - DNA, 25 bp, Homo sapien
tccctggtgactccattctgaggtg

SEQ ID NO: 30882 - DNA, 25 bp, Homo sapien
gtgtgacaggggaaccgtagacttt

SEQ ID NO: 30883 - DNA, 25 bp, Homo sapien
atcccgacagagtcatgctcgagcc

SEQ ID NO: 30884 - DNA, 25 bp, Homo sapien
aagatccagaacttgcgtgcagctt

SEQ ID NO: 30885 - DNA, 25 bp, Homo sapien
taatggagccctgggcgatcgctga

SEQ ID NO: 30886 - DNA, 25 bp, Homo sapien
tgggcgatcgctgaatttcttccct

SEQ ID NO: 30887 - DNA, 25 bp, Homo sapien
ataaaaaataggggccaggcacagt

SEQ ID NO: 30888 - DNA, 25 bp, Homo sapien
taaaaaataggggccaggcacagtg

SEQ ID NO: 30889 - DNA, 25 bp, Homo sapien
aaaaaataggggccaggcacagtgg

SEQ ID NO: 30890 - DNA, 25 bp, Homo sapien
aaaacaaacataaagttggcacaga

SEQ ID NO: 30891 - DNA, 25 bp, Homo sapien
aaacaaacataaagttggcacagaa

SEQ ID NO: 30892 - DNA, 25 bp, Homo sapien
aacataaagttggcacagaaaaggg

SEQ ID NO: 30893 - DNA, 25 bp, Homo sapien
cataaagttggcacagaaaagggac

SEQ ID NO: 30894 - DNA, 25 bp, Homo sapien
taaagttggcacagaaaagggacca

SEQ ID NO: 30895 - DNA, 25 bp, Homo sapien
aagttggcacagaaaagggaccaag

SEQ ID NO: 30896 - DNA, 25 bp, Homo sapien
gttggcacagaaaagggaccaagtt

SEQ ID NO: 30897 - DNA, 25 bp, Homo sapien
tggcacagaaaagggaccaagttta

SEQ ID NO: 30898 - DNA, 25 bp, Homo sapien
tgagtctagcagtttgagcccagcc

SEQ ID NO: 30899 - DNA, 25 bp, Homo sapien
aattgcccagggatggtggtgcaca

SEQ ID NO: 30900 - DNA, 25 bp, Homo sapien
ttgcccagggatggtggtgcacact

SEQ ID NO: 30901 - DNA, 25 bp, Homo sapien
gaaattctgtattgcagcagcctaa

SEQ ID NO: 30902 - DNA, 25 bp, Homo sapien
attgcagcagcctaagagagtcatt

SEQ ID NO: 30903 - DNA, 25 bp, Homo sapien
gagagtcattagttaagagatttgt

SEQ ID NO: 30904 - DNA, 25 bp, Homo sapien
ttaagagatttgtagtaggcatttt

SEQ ID NO: 30905 - DNA, 25 bp, Homo sapien
gtagtaggcattttttagaaagttg

SEQ ID NO: 30906 - DNA, 25 bp, Homo sapien
gaaagttgcattgagggctaggtac

SEQ ID NO: 30907 - DNA, 25 bp, Homo sapien
gttgcattgagggctaggtacggtg

SEQ ID NO: 30908 - DNA, 25 bp, Homo sapien
attgagggctaggtacggtggctca

SEQ ID NO: 30909 - DNA, 25 bp, Homo sapien
atatttttgtttacctcgctagctt

SEQ ID NO: 30910 - DNA, 25 bp, Homo sapien
acctcgctagcttcagaattttgcc

SEQ ID NO: 30911 - DNA, 25 bp, Homo sapien
cagaattttgccaacctctgaattt

SEQ ID NO: 30912 - DNA, 25 bp, Homo sapien
aacctctgaatttgcacattttgta

SEQ ID NO: 30913 - DNA, 25 bp, Homo sapien
tttttttctttgagcagtgttgatc

SEQ ID NO: 30914 - DNA, 25 bp, Homo sapien
gagcagtgttgatcaagccaagttg

SEQ ID NO: 30915 - DNA, 25 bp, Homo sapien
aatatttgccatgaaattccagtga

SEQ ID NO: 30916 - DNA, 25 bp, Homo sapien
gaatgtgtagctcaaatgcaaacca

SEQ ID NO: 30917 - DNA, 25 bp, Homo sapien
aaccataagtttgctgtcagttatt

SEQ ID NO: 30918 - DNA, 25 bp, Homo sapien
tattgtatggtcagtaccccagtcc

SEQ ID NO: 30919 - DNA, 25 bp, Homo sapien
accccagtcctagtacacatatttt

SEQ ID NO: 30920 - DNA, 25 bp, Homo sapien
ttttgtattttcactggagacgggg

SEQ ID NO: 30921 - DNA, 25 bp, Homo sapien
tgtgttagccacgatggtctccatc

SEQ ID NO: 30922 - DNA, 25 bp, Homo sapien
cgcgcctggccaaaatgcagacatt

SEQ ID NO: 30923 - DNA, 25 bp, Homo sapien
ggaactgagtgttagtgactttggc

SEQ ID NO: 30924 - DNA, 25 bp, Homo sapien
gactttggcatttgtgtagctgagc

SEQ ID NO: 30925 - DNA, 25 bp, Homo sapien
gctgagcacagcaagggaggggtta

SEQ ID NO: 30926 - DNA, 25 bp, Homo sapien
gcagatggcaagtgcaccaaggaga

SEQ ID NO: 30927 - DNA, 25 bp, Homo sapien
ggaacactggagcctgcaataaggg

SEQ ID NO: 30928 - DNA, 25 bp, Homo sapien
agagggggagcttgcaggaaccagc

SEQ ID NO: 30929 - DNA, 25 bp, Homo sapien
agaagaaacagcagctccactaccg

SEQ ID NO: 30930 - DNA, 25 bp, Homo sapien
cccaggtttgatgtccttccaagaa

SEQ ID NO: 30931 - DNA, 25 bp, Homo sapien
ggacgaggtgatcgacttctcgcac

SEQ ID NO: 30932 - DNA, 25 bp, Homo sapien
gcacaacgacatcgagctctacagc

SEQ ID NO: 30933 - DNA, 25 bp, Homo sapien
tctacagccagtacctggagcgcct

SEQ ID NO: 30934 - DNA, 25 bp, Homo sapien
cggccggacctcagcaataaggcgg

SEQ ID NO: 30935 - DNA, 25 bp, Homo sapien
cacccaggggctgcatgtggacccc

SEQ ID NO: 30936 - DNA, 25 bp, Homo sapien
ggggctgtggacgatgtacaggcaa

SEQ ID NO: 30937 - DNA, 25 bp, Homo sapien
tacaggcaacagagctacgcactcc

SEQ ID NO: 30938 - DNA, 25 bp, Homo sapien
caagaagacctactgcttcgacgcc

SEQ ID NO: 30939 - DNA, 25 bp, Homo sapien
agaaggtgtccaagatcacgtctcc

SEQ ID NO: 30940 - DNA, 25 bp, Homo sapien
ccgtgctcatcatccacggcacgga

SEQ ID NO: 30941 - DNA, 25 bp, Homo sapien
tcatcatccacggcacggaggacga

SEQ ID NO: 30942 - DNA, 25 bp, Homo sapien
gtaaaaatttctgcagttgtaaacg

SEQ ID NO: 30943 - DNA, 25 bp, Homo sapien
aaacgtttaacattgctcccattct

SEQ ID NO: 30944 - DNA, 25 bp, Homo sapien
tcttccacagggccttagttcttta

SEQ ID NO: 30945 - DNA, 25 bp, Homo sapien
ttgactacatattgttgacctcagt

SEQ ID NO: 30946 - DNA, 25 bp, Homo sapien
tgacctcagtgatcctaaacgtaga

SEQ ID NO: 30947 - DNA, 25 bp, Homo sapien
gtgtatatacctcgttaaattaaat

SEQ ID NO: 30948 - DNA, 25 bp, Homo sapien
ggttaattggaagctattccttaga

SEQ ID NO: 30949 - DNA, 25 bp, Homo sapien
attccttagacagatcatttcttta

SEQ ID NO: 30950 - DNA, 25 bp, Homo sapien
gatgatgagaaattgtgcgcctgca

SEQ ID NO: 30951 - DNA, 25 bp, Homo sapien
ttgtgcgcctgcatcacaagacttg

SEQ ID NO: 30952 - DNA, 25 bp, Homo sapien
ggttgctgtaagttgagatcgccac

SEQ ID NO: 30953 - DNA, 25 bp, Homo sapien
acacaccacaatgccaggctatttt

SEQ ID NO: 30954 - DNA, 25 bp, Homo sapien
agacagggcttttgccatgtcgccc

SEQ ID NO: 30955 - DNA, 25 bp, Homo sapien
actcctgagctcaggcaatccactc

SEQ ID NO: 30956 - DNA, 25 bp, Homo sapien
cgcgcctggccaaaaggcatttcat

SEQ ID NO: 30957 - DNA, 25 bp, Homo sapien
tgtgccatgttggtgtgctgcaccc

SEQ ID NO: 30958 - DNA, 25 bp, Homo sapien
ctgcacccattaactcatcatttac

SEQ ID NO: 30959 - DNA, 25 bp, Homo sapien
aggtgtatctcctaatgctatcctt

SEQ ID NO: 30960 - DNA, 25 bp, Homo sapien
ccacgacaggcccaggtgtgtgatg

SEQ ID NO: 30961 - DNA, 25 bp, Homo sapien
caggtgtgtgatgttccctttcctg

SEQ ID NO: 30962 - DNA, 25 bp, Homo sapien
gttctcattgttcaattccgaccta

SEQ ID NO: 30963 - DNA, 25 bp, Homo sapien
gaacgaaggcatttcattcttgatg

SEQ ID NO: 30964 - DNA, 25 bp, Homo sapien
aagagctaattatttgacaagtcca

SEQ ID NO: 30965 - DNA, 25 bp, Homo sapien
gagctaattatttgacaagtccaat

SEQ ID NO: 30966 - DNA, 25 bp, Homo sapien
gacaagtccaattagataaactgcc

SEQ ID NO: 30967 - DNA, 25 bp, Homo sapien
agtccaattagataaactgccaact

SEQ ID NO: 30968 - DNA, 25 bp, Homo sapien
gataaactgccaactatctaataat

SEQ ID NO: 30969 - DNA, 25 bp, Homo sapien
taaactgccaactatctaataatgg

SEQ ID NO: 30970 - DNA, 25 bp, Homo sapien
aactgccaactatctaataatggga

SEQ ID NO: 30971 - DNA, 25 bp, Homo sapien
tgccaactatctaataatgggaaaa

SEQ ID NO: 30972 - DNA, 25 bp, Homo sapien
gggttaaacttcgacacaaaatgtg

SEQ ID NO: 30973 - DNA, 25 bp, Homo sapien
aatgtggaagaaggccaggcgcggt

SEQ ID NO: 30974 - DNA, 25 bp, Homo sapien
tgtggaagaaggccaggcgcggtgg

SEQ ID NO: 30975 - DNA, 25 bp, Homo sapien
gatgacagaacagttgatccactac

SEQ ID NO: 30976 - DNA, 25 bp, Homo sapien
gaacagttgatccactactatctaa

SEQ ID NO: 30977 - DNA, 25 bp, Homo sapien
tgatccactactatctaaatctcag

SEQ ID NO: 30978 - DNA, 25 bp, Homo sapien
tctcagagtatcttaatatctacca

SEQ ID NO: 30979 - DNA, 25 bp, Homo sapien
atctaccagtgcaacagcatcttca

SEQ ID NO: 30980 - DNA, 25 bp, Homo sapien
accagtgcaacagcatcttcaaaga

SEQ ID NO: 30981 - DNA, 25 bp, Homo sapien
tgcatctgccaggagtggttagaaa

SEQ ID NO: 30982 - DNA, 25 bp, Homo sapien
ggagaagcactacaagcttttgaaa

SEQ ID NO: 30983 - DNA, 25 bp, Homo sapien
gaaagaggaggaaactgttgccgag

SEQ ID NO: 30984 - DNA, 25 bp, Homo sapien
gaggaaactgttgccgagaaaaaga

SEQ ID NO: 30985 - DNA, 25 bp, Homo sapien
gaaagataatttaactgctgttgag

SEQ ID NO: 30986 - DNA, 25 bp, Homo sapien
gagttgcccttgactcagagaaagt

SEQ ID NO: 30987 - DNA, 25 bp, Homo sapien
atgtcagcagttgttgttaccagat

SEQ ID NO: 30988 - DNA, 25 bp, Homo sapien
ggcaacatagtgagcatcagttctg

SEQ ID NO: 30989 - DNA, 25 bp, Homo sapien
gcatcagttctgggtatgtgtcatt

SEQ ID NO: 30990 - DNA, 25 bp, Homo sapien
gtgtcattaccagttaagagccagt

SEQ ID NO: 30991 - DNA, 25 bp, Homo sapien
taagagccagtcaactccttatcac

SEQ ID NO: 30992 - DNA, 25 bp, Homo sapien
acaaatgcccagtatctgttgctga

SEQ ID NO: 30993 - DNA, 25 bp, Homo sapien
gttgctgatcgagctgtcagtcttg

SEQ ID NO: 30994 - DNA, 25 bp, Homo sapien
agtcttggtagacttacttctgccc

SEQ ID NO: 30995 - DNA, 25 bp, Homo sapien
acttctgccctcggattcagagagt

SEQ ID NO: 30996 - DNA, 25 bp, Homo sapien
gttggaacaccaaggttgcatgagc

SEQ ID NO: 30997 - DNA, 25 bp, Homo sapien
tcccacttccgactgtagtacaaaa

SEQ ID NO: 30998 - DNA, 25 bp, Homo sapien
agagggaggcaaggctcagccgtct

SEQ ID NO: 30999 - DNA, 25 bp, Homo sapien
tcaacgcttctcaacctgagcacta

SEQ ID NO: 31000 - DNA, 25 bp, Homo sapien
ggggcaggataattcttcgctgaga

SEQ ID NO: 31001 - DNA, 25 bp, Homo sapien
tatcttgggcactgcaggaccttca

SEQ ID NO: 31002 - DNA, 25 bp, Homo sapien
tcagcagcctctatacactgggtgc

SEQ ID NO: 31003 - DNA, 25 bp, Homo sapien
ccaacaacagccccttctaggagaa

SEQ ID NO: 31004 - DNA, 25 bp, Homo sapien
caaaatcgcctccggtggatctagc

SEQ ID NO: 31005 - DNA, 25 bp, Homo sapien
cgccgcgattctcaagttgcaaggt

SEQ ID NO: 31006 - DNA, 25 bp, Homo sapien
gaacgcagggcagacaccctgacgc

SEQ ID NO: 31007 - DNA, 25 bp, Homo sapien
cccttccctgaatcggcaatgcagc

SEQ ID NO: 31008 - DNA, 25 bp, Homo sapien
agggtctggagtggatctccaacaa

SEQ ID NO: 31009 - DNA, 25 bp, Homo sapien
gagtggatctccaacaaactccagc

SEQ ID NO: 31010 - DNA, 25 bp, Homo sapien
tggatctccaacaaactccagcaga

SEQ ID NO: 31011 - DNA, 25 bp, Homo sapien
agaaaggaatagcgtcaacatcaac

SEQ ID NO: 31012 - DNA, 25 bp, Homo sapien
aggaatagcgtcaacatcaacaaaa

SEQ ID NO: 31013 - DNA, 25 bp, Homo sapien
gaacaccttttctcctgcaaaggat

SEQ ID NO: 31014 - DNA, 25 bp, Homo sapien
ttttctcctgcaaaggatcacaact

SEQ ID NO: 31015 - DNA, 25 bp, Homo sapien
gtttgacgaatttacagaaggaggc

SEQ ID NO: 31016 - DNA, 25 bp, Homo sapien
aaaaaggctggaggaattgctaact

SEQ ID NO: 31017 - DNA, 25 bp, Homo sapien
gaaaaacacagcacgagaccttcgt

SEQ ID NO: 31018 - DNA, 25 bp, Homo sapien
acacagcacgagaccttcgtgaagc

SEQ ID NO: 31019 - DNA, 25 bp, Homo sapien
gacttgggctcatatgacataagga

SEQ ID NO: 31020 - DNA, 25 bp, Homo sapien
gacataaggatgatcatctctggca

SEQ ID NO: 31021 - DNA, 25 bp, Homo sapien
tgatcatctctggcacaacagctca

SEQ ID NO: 31022 - DNA, 25 bp, Homo sapien
tctggcacaacagctcacttttctt

SEQ ID NO: 31023 - DNA, 25 bp, Homo sapien
agctcacttttcttccaaggataag

SEQ ID NO: 31024 - DNA, 25 bp, Homo sapien
ttttgaatctcttgaggctcaagga

SEQ ID NO: 31025 - DNA, 25 bp, Homo sapien
gaggctcaaggatcacatctggata

SEQ ID NO: 31026 - DNA, 25 bp, Homo sapien
tcaaactgttctggaaacgataacc

SEQ ID NO: 31027 - DNA, 25 bp, Homo sapien
ggctggagaagaatcttccgactct

SEQ ID NO: 31028 - DNA, 25 bp, Homo sapien
atcttccgactctgaggacttggct

SEQ ID NO: 31029 - DNA, 25 bp, Homo sapien
aggacttggctaatggttaatactt

SEQ ID NO: 31030 - DNA, 25 bp, Homo sapien
gtaaatacttcatgcctttctcagc

SEQ ID NO: 31031 - DNA, 25 bp, Homo sapien
ggagctgtttttattcctgacctcc

SEQ ID NO: 31032 - DNA, 25 bp, Homo sapien
ttgtcaatggatttgcctctgtgcc

SEQ ID NO: 31033 - DNA, 25 bp, Homo sapien
gctgtgcttcattcctgtctgaaga

SEQ ID NO: 31034 - DNA, 25 bp, Homo sapien
aagagcagatggcctggctgctgct

SEQ ID NO: 31035 - DNA, 25 bp, Homo sapien
cattatccatctttgcactatctgt

SEQ ID NO: 31036 - DNA, 25 bp, Homo sapien
cactatctgtaatgccttttctcac

SEQ ID NO: 31037 - DNA, 25 bp, Homo sapien
acattttcccttccctgaagatcta

SEQ ID NO: 31038 - DNA, 25 bp, Homo sapien
tagtgaacattcgacctccattacg

SEQ ID NO: 31039 - DNA, 25 bp, Homo sapien
gagtttcctatgtttcactgtgcaa

SEQ ID NO: 31040 - DNA, 25 bp, Homo sapien
gctattctccatactctgtaacagt

SEQ ID NO: 31041 - DNA, 25 bp, Homo sapien
gatgccattgaagataaagctactg

SEQ ID NO: 31042 - DNA, 25 bp, Homo sapien
tcactggttattgcaccaatccgaa

SEQ ID NO: 31043 - DNA, 25 bp, Homo sapien
tattgcaccaatccgaatcgtcatc

SEQ ID NO: 31044 - DNA, 25 bp, Homo sapien
caatccgaatcgtcatcagatgggg

SEQ ID NO: 31045 - DNA, 25 bp, Homo sapien
ggggtgggctaaactcaatgtagac

SEQ ID NO: 31046 - DNA, 25 bp, Homo sapien
tcaatgtagaccaccaccctaaaaa

SEQ ID NO: 31047 - DNA, 25 bp, Homo sapien
cagtaaggtggatgtgtgcccagtg

SEQ ID NO: 31048 - DNA, 25 bp, Homo sapien
gctgcccagtactgcagaggatcat

SEQ ID NO: 31049 - DNA, 25 bp, Homo sapien
gatggcagtgttggtaactaattga

SEQ ID NO: 31050 - DNA, 25 bp, Homo sapien
gtaactaattgactgatctcacttc

SEQ ID NO: 31051 - DNA, 25 bp, Homo sapien
aggaaaaagagtcccaagaggctgg

SEQ ID NO: 31052 - DNA, 25 bp, Homo sapien
ctctggcccaggagttatgtgtcca

SEQ ID NO: 31053 - DNA, 25 bp, Homo sapien
ttatgtgtccataaccaaagggagc

SEQ ID NO: 31054 - DNA, 25 bp, Homo sapien
caaagggagcacagtctgcacccag

SEQ ID NO: 31055 - DNA, 25 bp, Homo sapien
cccagctctcatcccatcagagctg

SEQ ID NO: 31056 - DNA, 25 bp, Homo sapien
agctctcatcccatcagagctgctg

SEQ ID NO: 31057 - DNA, 25 bp, Homo sapien
tcccgcaggttcttccagaactggt

SEQ ID NO: 31058 - DNA, 25 bp, Homo sapien
ccagaactggtttagcttgcctgca

SEQ ID NO: 31059 - DNA, 25 bp, Homo sapien
tggtttagcttgcctgcaggatcag

SEQ ID NO: 31060 - DNA, 25 bp, Homo sapien
gcttgcctgcaggatcaggaaagtt

SEQ ID NO: 31061 - DNA, 25 bp, Homo sapien
aagagcagagcttacttcattgtct

SEQ ID NO: 31062 - DNA, 25 bp, Homo sapien
cagagcttacttcattgtctgtccc

SEQ ID NO: 31063 - DNA, 25 bp, Homo sapien
aacctttaaaagctacagacacaag

SEQ ID NO: 31064 - DNA, 25 bp, Homo sapien
tatgagtcacttaaggggggaggta

SEQ ID NO: 31065 - DNA, 25 bp, Homo sapien
cacttaaggggggaggtaatatgct

SEQ ID NO: 31066 - DNA, 25 bp, Homo sapien
aacctgaaaccaaagtggtctccat

SEQ ID NO: 31067 - DNA, 25 bp, Homo sapien
tggtctccatttaaagttacttaat

SEQ ID NO: 31068 - DNA, 25 bp, Homo sapien
ccttgccatgatggtaatggattgg

SEQ ID NO: 31069 - DNA, 25 bp, Homo sapien
gatggtaatggattggaactatgaa

SEQ ID NO: 31070 - DNA, 25 bp, Homo sapien
gctctcagtgtattggcttctgtaa

SEQ ID NO: 31071 - DNA, 25 bp, Homo sapien
ctcagtgtattggcttctgtaatat

SEQ ID NO: 31072 - DNA, 25 bp, Homo sapien
tctgtaatattatgaggcgtctcct

SEQ ID NO: 31073 - DNA, 25 bp, Homo sapien
tatgaggcgtctcctcagaaacaaa

SEQ ID NO: 31074 - DNA, 25 bp, Homo sapien
aacccatgggaatacctgacctagg

SEQ ID NO: 31075 - DNA, 25 bp, Homo sapien
tgataaatgatggcacctcctgtgg

SEQ ID NO: 31076 - DNA, 25 bp, Homo sapien
aattgcgtcaatagctcagtcctgc

SEQ ID NO: 31077 - DNA, 25 bp, Homo sapien
agtcctgcagtttgactgtttgcct

SEQ ID NO: 31078 - DNA, 25 bp, Homo sapien
atacccggggtgtttgcaacaacag

SEQ ID NO: 31079 - DNA, 25 bp, Homo sapien
actgcatgtatgggtgggcacctcc

SEQ ID NO: 31080 - DNA, 25 bp, Homo sapien
gggcacctccattctgtgaggaagt

SEQ ID NO: 31081 - DNA, 25 bp, Homo sapien
ggactgctcagaggggcgattccct

SEQ ID NO: 31082 - DNA, 25 bp, Homo sapien
gcgattccctcgtcaatttgggttg

SEQ ID NO: 31083 - DNA, 25 bp, Homo sapien
gtgtccatcataatgtttcgcctta

SEQ ID NO: 31084 - DNA, 25 bp, Homo sapien
tttttgtgtttttccggcaagtgat

SEQ ID NO: 31085 - DNA, 25 bp, Homo sapien
cgctgatgacaccactgcgggagcg

SEQ ID NO: 31086 - DNA, 25 bp, Homo sapien
ttgtggtcaaatacgcaccgggcca

SEQ ID NO: 31087 - DNA, 25 bp, Homo sapien
ctgccactatgataatgccgagctc

SEQ ID NO: 31088 - DNA, 25 bp, Homo sapien
gccttgggcaaggtcttcacagggg

SEQ ID NO: 31089 - DNA, 25 bp, Homo sapien
cccttgggcactggtgagcgttgga

SEQ ID NO: 31090 - DNA, 25 bp, Homo sapien
tggtgagcgttggaaccttgtcgtc

SEQ ID NO: 31091 - DNA, 25 bp, Homo sapien
atgagggcttcggtgatggcttcac

SEQ ID NO: 31092 - DNA, 25 bp, Homo sapien
tgatggcttcacccgagaggagccc

SEQ ID NO: 31093 - DNA, 25 bp, Homo sapien
gagcccgccacggtggatgtatgtg

SEQ ID NO: 31094 - DNA, 25 bp, Homo sapien
atgtatgtgcgctcacctgagcttg

SEQ ID NO: 31095 - DNA, 25 bp, Homo sapien
ggcagaaataaaatccccgcagcct

SEQ ID NO: 31096 - DNA, 25 bp, Homo sapien
acaagaatcactccaaacttcccaa

SEQ ID NO: 31097 - DNA, 25 bp, Homo sapien
tggacccagcaatttccaggagttc

SEQ ID NO: 31098 - DNA, 25 bp, Homo sapien
aggtgtgcacacgttagtaacaagg

SEQ ID NO: 31099 - DNA, 25 bp, Homo sapien
taacaaggaggcctggtgaccgcct

SEQ ID NO: 31100 - DNA, 25 bp, Homo sapien
ccaccgggtcgaggccgagaggatg

SEQ ID NO: 31101 - DNA, 25 bp, Homo sapien
cgagaggatggagaccgcgtcacag

SEQ ID NO: 31102 - DNA, 25 bp, Homo sapien
tcgctgctggaatggagggtggtgg

SEQ ID NO: 31103 - DNA, 25 bp, Homo sapien
ccagccgccctggtaagcagaaact

SEQ ID NO: 31104 - DNA, 25 bp, Homo sapien
gaaacttctagggtcctgttttctg

SEQ ID NO: 31105 - DNA, 25 bp, Homo sapien
ggtcgtatgatcccaggagtgcaca

SEQ ID NO: 31106 - DNA, 25 bp, Homo sapien
aagggcataggagggagggccgcag

SEQ ID NO: 31107 - DNA, 25 bp, Homo sapien
tacatcggagttaccaggagctagt

SEQ ID NO: 31108 - DNA, 25 bp, Homo sapien
ggagctagtgaaggtctggcaccca

SEQ ID NO: 31109 - DNA, 25 bp, Homo sapien
agatccaggctgcgtatgaagtcct

SEQ ID NO: 31110 - DNA, 25 bp, Homo sapien
gtcctgagtcaacccaggaagccct

SEQ ID NO: 31111 - DNA, 25 bp, Homo sapien
cctgaggactgactcttcctagcag

SEQ ID NO: 31112 - DNA, 25 bp, Homo sapien
ctagcagagctgggcaacttgtccc

SEQ ID NO: 31113 - DNA, 25 bp, Homo sapien
ggcaacttgtcccaaatctagcttt

SEQ ID NO: 31114 - DNA, 25 bp, Homo sapien
ccaaatctagctttgcccacgaatg

SEQ ID NO: 31115 - DNA, 25 bp, Homo sapien
ttgcccacgaatggcatcccaacag

SEQ ID NO: 31116 - DNA, 25 bp, Homo sapien
gtcagctggcttaccaggttttggg

SEQ ID NO: 31117 - DNA, 25 bp, Homo sapien
ttaccaggttttgggcctctcagaa

SEQ ID NO: 31118 - DNA, 25 bp, Homo sapien
ggccaatatggtgacaccctgtttc

SEQ ID NO: 31119 - DNA, 25 bp, Homo sapien
aatatggtgacaccctgtttctccc

SEQ ID NO: 31120 - DNA, 25 bp, Homo sapien
gcttgaacccaggatgtggcggttg

SEQ ID NO: 31121 - DNA, 25 bp, Homo sapien
aggatgtggcggttgcagtgagccg

SEQ ID NO: 31122 - DNA, 25 bp, Homo sapien
gggtgacagagggagactccgtgtc

SEQ ID NO: 31123 - DNA, 25 bp, Homo sapien
gacagagggagactccgtgtcaaaa

SEQ ID NO: 31124 - DNA, 25 bp, Homo sapien
aaaaaaacgtgcgctgcctgggtgt

SEQ ID NO: 31125 - DNA, 25 bp, Homo sapien
tgggtgtggtggcttacgcctataa

SEQ ID NO: 31126 - DNA, 25 bp, Homo sapien
tggtggcttacgcctataatcccag

SEQ ID NO: 31127 - DNA, 25 bp, Homo sapien
aggccaaggtgtgtgaatcattcga

SEQ ID NO: 31128 - DNA, 25 bp, Homo sapien
gtgtgtgaatcattcgaggtcagga

SEQ ID NO: 31129 - DNA, 25 bp, Homo sapien
cgggcaggcgagactggcggagccc

SEQ ID NO: 31130 - DNA, 25 bp, Homo sapien
gcctggcctgggaagagcacagctg

SEQ ID NO: 31131 - DNA, 25 bp, Homo sapien
cccactcaagactaccaaagccagg

SEQ ID NO: 31132 - DNA, 25 bp, Homo sapien
accaaagccaggacacctcaagtct

SEQ ID NO: 31133 - DNA, 25 bp, Homo sapien
tttagacagggtcttgctccgttgc

SEQ ID NO: 31134 - DNA, 25 bp, Homo sapien
ggagtgcagtggcccatcagggctc

SEQ ID NO: 31135 - DNA, 25 bp, Homo sapien
tggcccatcagggctcactgtaacc

SEQ ID NO: 31136 - DNA, 25 bp, Homo sapien
aaagaggggggtctcactgtgttgc

SEQ ID NO: 31137 - DNA, 25 bp, Homo sapien
attgcaggcatgagccactgcaccc

SEQ ID NO: 31138 - DNA, 25 bp, Homo sapien
ccagccctgtattcttattcttcag

SEQ ID NO: 31139 - DNA, 25 bp, Homo sapien
gatatttatttttcttttcactgtt

SEQ ID NO: 31140 - DNA, 25 bp, Homo sapien
aatggatttatcaaactgtcccaaa

SEQ ID NO: 31141 - DNA, 25 bp, Homo sapien
gaggaagaccagacattatgggcct

SEQ ID NO: 31142 - DNA, 25 bp, Homo sapien
gacattatgggcctggaagtactat

SEQ ID NO: 31143 - DNA, 25 bp, Homo sapien
tataggagtgcacacatcacccgtg

SEQ ID NO: 31144 - DNA, 25 bp, Homo sapien
gtcttgccaaataattaaacctgaa

SEQ ID NO: 31145 - DNA, 25 bp, Homo sapien
gaatttgatcaggtctctggatctt

SEQ ID NO: 31146 - DNA, 25 bp, Homo sapien
ggtctctggatcttatttgcaattc

SEQ ID NO: 31147 - DNA, 25 bp, Homo sapien
tcctactaacaccaccacaaatatg

SEQ ID NO: 31148 - DNA, 25 bp, Homo sapien
acaccaccacaaatatgcaatcagc

SEQ ID NO: 31149 - DNA, 25 bp, Homo sapien
gcaatcagcaatatccagaaagggg

SEQ ID NO: 31150 - DNA, 25 bp, Homo sapien
gggcaacatatagactttagatcct

SEQ ID NO: 31151 - DNA, 25 bp, Homo sapien
tcccttgtccttctgggggtgtatc

SEQ ID NO: 31152 - DNA, 25 bp, Homo sapien
cttgtccttctgggggtgtatcaca

SEQ ID NO: 31153 - DNA, 25 bp, Homo sapien
gtccttctgggggtgtatcacagtc

SEQ ID NO: 31154 - DNA, 25 bp, Homo sapien
tctgggggtgtatcacagtcagcca

SEQ ID NO: 31155 - DNA, 25 bp, Homo sapien
tgggggtgtatcacagtcagccagt

SEQ ID NO: 31156 - DNA, 25 bp, Homo sapien
tcttcatgatggtggttggggtggt

SEQ ID NO: 31157 - DNA, 25 bp, Homo sapien
gcttgaaccctgagaggcaggtggt

SEQ ID NO: 31158 - DNA, 25 bp, Homo sapien
gagaggcaggtggtaggccatggcc

SEQ ID NO: 31159 - DNA, 25 bp, Homo sapien
gaggcaggtggtaggccatggccac

SEQ ID NO: 31160 - DNA, 25 bp, Homo sapien
ggcaggtggtaggccatggccacaa

SEQ ID NO: 31161 - DNA, 25 bp, Homo sapien
ggtggtaggccatggccacaatccc

SEQ ID NO: 31162 - DNA, 25 bp, Homo sapien
ctgcccccagaagctcaaaatccag

SEQ ID NO: 31163 - DNA, 25 bp, Homo sapien
cacagctccctggagcactgctgga

SEQ ID NO: 31164 - DNA, 25 bp, Homo sapien
ggagcactgctggaaaaagatgaag

SEQ ID NO: 31165 - DNA, 25 bp, Homo sapien
gtctgtgaacttgatgttcctggga

SEQ ID NO: 31166 - DNA, 25 bp, Homo sapien
gatgttcctgggatgtttaatcaag

SEQ ID NO: 31167 - DNA, 25 bp, Homo sapien
gagacaaaattgctgaggagctcag

SEQ ID NO: 31168 - DNA, 25 bp, Homo sapien
gaggagctcagggctggattggcag

SEQ ID NO: 31169 - DNA, 25 bp, Homo sapien
gggctggattggcaggtgtgggctc

SEQ ID NO: 31170 - DNA, 25 bp, Homo sapien
ctcacccaggacctctgggggttgt

SEQ ID NO: 31171 - DNA, 25 bp, Homo sapien
caggacctctgggggttgttgggag

SEQ ID NO: 31172 - DNA, 25 bp, Homo sapien
gcaggggcggtccagaggaggtgcc

SEQ ID NO: 31173 - DNA, 25 bp, Homo sapien
caatgggccaacaatccagtgtccg

SEQ ID NO: 31174 - DNA, 25 bp, Homo sapien
caatccagtgtccgcaggctgaaga

SEQ ID NO: 31175 - DNA, 25 bp, Homo sapien
gtcaccaggagggtatgcataggga

SEQ ID NO: 31176 - DNA, 25 bp, Homo sapien
gaggccaacgaggccaatgaggcca

SEQ ID NO: 31177 - DNA, 25 bp, Homo sapien
gaggccaacaagacgatgccggaga

SEQ ID NO: 31178 - DNA, 25 bp, Homo sapien
catagggagggcaagagctctgggc

SEQ ID NO: 31179 - DNA, 25 bp, Homo sapien
agaagctacatccctcaaacttcgg

SEQ ID NO: 31180 - DNA, 25 bp, Homo sapien
gggccactgcgaagattcaaaagct

SEQ ID NO: 31181 - DNA, 25 bp, Homo sapien
tcaaaagctccaaaaacctactgta

SEQ ID NO: 31182 - DNA, 25 bp, Homo sapien
aagctccaaaaacctactgtagaca

SEQ ID NO: 31183 - DNA, 25 bp, Homo sapien
ctactgtagacatcgaagaaccaat

SEQ ID NO: 31184 - DNA, 25 bp, Homo sapien
aaggatatacctatgccagcttcta

SEQ ID NO: 31185 - DNA, 25 bp, Homo sapien
tgccagcttctatagctgcacctgc

SEQ ID NO: 31186 - DNA, 25 bp, Homo sapien
tatagctgcacctgctttattggca

SEQ ID NO: 31187 - DNA, 25 bp, Homo sapien
gctttattggcaggtcacttgccac

SEQ ID NO: 31188 - DNA, 25 bp, Homo sapien
tcacttgccacaattgcatctgccc

SEQ ID NO: 31189 - DNA, 25 bp, Homo sapien
attttcacactgtatcctagacatg

SEQ ID NO: 31190 - DNA, 25 bp, Homo sapien
atacagtgtctggcgggataatgca

SEQ ID NO: 31191 - DNA, 25 bp, Homo sapien
tggcgggataatgcagagaggtacc

SEQ ID NO: 31192 - DNA, 25 bp, Homo sapien
gagaggtaccatcttgattttcccc

SEQ ID NO: 31193 - DNA, 25 bp, Homo sapien
ttgattttccccagttacattcacc

SEQ ID NO: 31194 - DNA, 25 bp, Homo sapien
ctggtctggtctctgtaagcttaga

SEQ ID NO: 31195 - DNA, 25 bp, Homo sapien
acctgtacacgttgattatttttgt

SEQ ID NO: 31196 - DNA, 25 bp, Homo sapien
gagtttaagctatcatttccagatg

SEQ ID NO: 31197 - DNA, 25 bp, Homo sapien
ggagagttccatagatgtctgttag

SEQ ID NO: 31198 - DNA, 25 bp, Homo sapien
atccttgttaattttctgtcttgtt

SEQ ID NO: 31199 - DNA, 25 bp, Homo sapien
taaagtctcccactattattatatg

SEQ ID NO: 31200 - DNA, 25 bp, Homo sapien
gtctaagtctccttgtaggtctcta

SEQ ID NO: 31201 - DNA, 25 bp, Homo sapien
gggtgctcctgtattaggtgcatac

SEQ ID NO: 31202 - DNA, 25 bp, Homo sapien
ttatataatgcccttctttgtcttt

SEQ ID NO: 31203 - DNA, 25 bp, Homo sapien
taaatattcctgtatccctttattt

SEQ ID NO: 31204 - DNA, 25 bp, Homo sapien
gtctttgcacgtgaggtgggtctcc

SEQ ID NO: 31205 - DNA, 25 bp, Homo sapien
ctgaatacagcacaccgatgggttt

SEQ ID NO: 31206 - DNA, 25 bp, Homo sapien
gtcctcatctgttctgactgaagga

SEQ ID NO: 31207 - DNA, 25 bp, Homo sapien
gactgaaggatggaggtgctgaata

SEQ ID NO: 31208 - DNA, 25 bp, Homo sapien
gctgaataaattaggcctcaggcct

SEQ ID NO: 31209 - DNA, 25 bp, Homo sapien
ggcctctaccaccagagagctggag

SEQ ID NO: 31210 - DNA, 25 bp, Homo sapien
gagctggagaatgggtccacgtcat

SEQ ID NO: 31211 - DNA, 25 bp, Homo sapien
gtccacgtcattcaaggacctgaat

SEQ ID NO: 31212 - DNA, 25 bp, Homo sapien
ggagcattggaatcctcttcttcca

SEQ ID NO: 31213 - DNA, 25 bp, Homo sapien
tcttccagggaggaattagcctgca

SEQ ID NO: 31214 - DNA, 25 bp, Homo sapien
gaattagcctgcaaggttaggactt

SEQ ID NO: 31215 - DNA, 25 bp, Homo sapien
gaaggtatttaataactgggcgagg

SEQ ID NO: 31216 - DNA, 25 bp, Homo sapien
actgggcgaggatgggtgtggtggc

SEQ ID NO: 31217 - DNA, 25 bp, Homo sapien
aaaggtcattattgtctatattcca

SEQ ID NO: 31218 - DNA, 25 bp, Homo sapien
gtcacagagattcctaacattttcc

SEQ ID NO: 31219 - DNA, 25 bp, Homo sapien
taatcagaactgtgatgctctaatt

SEQ ID NO: 31220 - DNA, 25 bp, Homo sapien
gaaacaactcatctggccaactatt

SEQ ID NO: 31221 - DNA, 25 bp, Homo sapien
tggccaactatttgctgctcagagt

SEQ ID NO: 31222 - DNA, 25 bp, Homo sapien
gctgctcagagtttcttatttctta

SEQ ID NO: 31223 - DNA, 25 bp, Homo sapien
aaactcatcagttatattcatgtga

SEQ ID NO: 31224 - DNA, 25 bp, Homo sapien
atattcatgtgatcgcggctaaaaa

SEQ ID NO: 31225 - DNA, 25 bp, Homo sapien
gtgatcgcggctaaaaagtcagtat

SEQ ID NO: 31226 - DNA, 25 bp, Homo sapien
tttgttctaatgtggcttcatttga

SEQ ID NO: 31227 - DNA, 25 bp, Homo sapien
aatttctcagattctacattgtact

SEQ ID NO: 31228 - DNA, 25 bp, Homo sapien
ttaccacattgctcaggttgttctg

SEQ ID NO: 31229 - DNA, 25 bp, Homo sapien
tcaggttgttctggaacttctgggc

SEQ ID NO: 31230 - DNA, 25 bp, Homo sapien
ctggcccctggaaaacttttgatga

SEQ ID NO: 31231 - DNA, 25 bp, Homo sapien
cttcccctactgtcatttggtgtgt

SEQ ID NO: 31232 - DNA, 25 bp, Homo sapien
ccctactgtcatttggtgtgtcctt

SEQ ID NO: 31233 - DNA, 25 bp, Homo sapien
tttggtgtgtccttaaagattgtca

SEQ ID NO: 31234 - DNA, 25 bp, Homo sapien
gattgtcaactagttttaaactact

SEQ ID NO: 31235 - DNA, 25 bp, Homo sapien
gtgtacaaataattacctttttcat

SEQ ID NO: 31236 - DNA, 25 bp, Homo sapien
ttaagagattgatcattttgaggct

SEQ ID NO: 31237 - DNA, 25 bp, Homo sapien
ggcacctgtagtcacggttactgca

SEQ ID NO: 31238 - DNA, 25 bp, Homo sapien
cacctgtagtcacggttactgcaga

SEQ ID NO: 31239 - DNA, 25 bp, Homo sapien
tgaccctaagccttctcaatacaga

SEQ ID NO: 31240 - DNA, 25 bp, Homo sapien
cagaaagccttcgctttttcatcaa

SEQ ID NO: 31241 - DNA, 25 bp, Homo sapien
atcaatcaacctcaagcccatatgt

SEQ ID NO: 31242 - DNA, 25 bp, Homo sapien
caacctcaagcccatatgtatcaaa

SEQ ID NO: 31243 - DNA, 25 bp, Homo sapien
gtgaaacacatcagccaatgacttc

SEQ ID NO: 31244 - DNA, 25 bp, Homo sapien
atcagccaatgacttctggttcttt

SEQ ID NO: 31245 - DNA, 25 bp, Homo sapien
ggttcttttccaattaatgggctgc

SEQ ID NO: 31246 - DNA, 25 bp, Homo sapien
aatgggctgcattctcattcagaag

SEQ ID NO: 31247 - DNA, 25 bp, Homo sapien
ttaactgcaagaccacagtctatgg

SEQ ID NO: 31248 - DNA, 25 bp, Homo sapien
cagtctatggagaattcaccaacca

SEQ ID NO: 31249 - DNA, 25 bp, Homo sapien
tcaccaaccatcaatgaacccaaag

SEQ ID NO: 31250 - DNA, 25 bp, Homo sapien
tgctttggagctatcagatttgcat

SEQ ID NO: 31251 - DNA, 25 bp, Homo sapien
agaaatgactctggtctcagtggag

SEQ ID NO: 31252 - DNA, 25 bp, Homo sapien
ggaagccgggaagagtgaacagaag

SEQ ID NO: 31253 - DNA, 25 bp, Homo sapien
tcttgggctttgattgggtcggaaa

SEQ ID NO: 31254 - DNA, 25 bp, Homo sapien
tccgcacctgtgcctaagaagctgc

SEQ ID NO: 31255 - DNA, 25 bp, Homo sapien
gaagctgctcatgatggctggtatc

SEQ ID NO: 31256 - DNA, 25 bp, Homo sapien
atggctggtatcgatgactgctaca

SEQ ID NO: 31257 - DNA, 25 bp, Homo sapien
aaggccacctttgatgccatttcta

SEQ ID NO: 31258 - DNA, 25 bp, Homo sapien
tctaagacctacagctacctgaccc

SEQ ID NO: 31259 - DNA, 25 bp, Homo sapien
attcaccaagtctccctatcaggag

SEQ ID NO: 31260 - DNA, 25 bp, Homo sapien
tatcaggagttcactgaccacctcg

SEQ ID NO: 31261 - DNA, 25 bp, Homo sapien
gactaatgttacaccaatggccacc

SEQ ID NO: 31262 - DNA, 25 bp, Homo sapien
agcgttctggtgcaggagtagccct

SEQ ID NO: 31263 - DNA, 25 bp, Homo sapien
ccacctttcttccgttgaagcatac

SEQ ID NO: 31264 - DNA, 25 bp, Homo sapien
aactgtcaccagtatgaccactcca

SEQ ID NO: 31265 - DNA, 25 bp, Homo sapien
gaccactccacgatgctatgtaggg

SEQ ID NO: 31266 - DNA, 25 bp, Homo sapien
cacagtgcttcgggggagactctat

SEQ ID NO: 31267 - DNA, 25 bp, Homo sapien
gatggtaattccctgctaagtagca

SEQ ID NO: 31268 - DNA, 25 bp, Homo sapien
atgaccctatcatcgacagctggga

SEQ ID NO: 31269 - DNA, 25 bp, Homo sapien
acatccatgggaacccagcgctgtg

SEQ ID NO: 31270 - DNA, 25 bp, Homo sapien
agtgaccattgttggagcaccatcc

SEQ ID NO: 31271 - DNA, 25 bp, Homo sapien
catccagagctagtgaccagtccag

SEQ ID NO: 31272 - DNA, 25 bp, Homo sapien
taaattacaactcgattgccccagt

SEQ ID NO: 31273 - DNA, 25 bp, Homo sapien
tcgattgccccagttctgatttgca

SEQ ID NO: 31274 - DNA, 25 bp, Homo sapien
gatttgcaaacatctggtgagacca

SEQ ID NO: 31275 - DNA, 25 bp, Homo sapien
gagtagcatgctatttcctgacagg

SEQ ID NO: 31276 - DNA, 25 bp, Homo sapien
atgctatttcctgacaggctgccct

SEQ ID NO: 31277 - DNA, 25 bp, Homo sapien
tgccctttacacaaagaatgttcac

SEQ ID NO: 31278 - DNA, 25 bp, Homo sapien
caacaaactcaaaattactcttact

SEQ ID NO: 31279 - DNA, 25 bp, Homo sapien
atcactgtctacctcagaaagcgga

SEQ ID NO: 31280 - DNA, 25 bp, Homo sapien
gctagacggacactatttggtcatc

SEQ ID NO: 31281 - DNA, 25 bp, Homo sapien
gaaatatttctgcagtaccaaccat

SEQ ID NO: 31282 - DNA, 25 bp, Homo sapien
accaaccatatatctggtactgtgc

SEQ ID NO: 31283 - DNA, 25 bp, Homo sapien
aatcaattatcatttaccctcttcc

SEQ ID NO: 31284 - DNA, 25 bp, Homo sapien
tcctgtggttttgggaggccaccct

SEQ ID NO: 31285 - DNA, 25 bp, Homo sapien
ctttttgtctaagcctttctaatca

SEQ ID NO: 31286 - DNA, 25 bp, Homo sapien
agcctttctaatcagcatttacctc

SEQ ID NO: 31287 - DNA, 25 bp, Homo sapien
ccactttgacttcaaggctttggga

SEQ ID NO: 31288 - DNA, 25 bp, Homo sapien
agtagctcctctcctgaagtaaatt

SEQ ID NO: 31289 - DNA, 25 bp, Homo sapien
tatgtaacctattcccttcattgag

SEQ ID NO: 31290 - DNA, 25 bp, Homo sapien
tgagcaccacagactgactctcaac

SEQ ID NO: 31291 - DNA, 25 bp, Homo sapien
ttccaccagccaatcagtgcacatc

SEQ ID NO: 31292 - DNA, 25 bp, Homo sapien
gtgcacatcctgtgtcatcaatgta

SEQ ID NO: 31293 - DNA, 25 bp, Homo sapien
atctgcatttaggttgggcacggtg

SEQ ID NO: 31294 - DNA, 25 bp, Homo sapien
gggaggacacagcctaggaaccagc

SEQ ID NO: 31295 - DNA, 25 bp, Homo sapien
gacacagcctaggaaccagctgcct

SEQ ID NO: 31296 - DNA, 25 bp, Homo sapien
gagctgcaggatagagcttcctctt

SEQ ID NO: 31297 - DNA, 25 bp, Homo sapien
atagagcttcctcttgatctctgtt

SEQ ID NO: 31298 - DNA, 25 bp, Homo sapien
tcctcttgatctctgtttttaagca

SEQ ID NO: 31299 - DNA, 25 bp, Homo sapien
aattcattgtgctgaaaagtcctcc

SEQ ID NO: 31300 - DNA, 25 bp, Homo sapien
gctgaaaagtcctccagagctctgt

SEQ ID NO: 31301 - DNA, 25 bp, Homo sapien
tcccggagttcctgggagaaaggcg

SEQ ID NO: 31302 - DNA, 25 bp, Homo sapien
gcaccgtctgctttagcatgggacc

SEQ ID NO: 31303 - DNA, 25 bp, Homo sapien
aacgtgggggcactgggtgtgctga

SEQ ID NO: 31304 - DNA, 25 bp, Homo sapien
gggggcactgggtgtgctgatataa

SEQ ID NO: 31305 - DNA, 25 bp, Homo sapien
gcccggagaacctggtggaccagat

SEQ ID NO: 31306 - DNA, 25 bp, Homo sapien
accagatcctggagtccgtggactc

SEQ ID NO: 31307 - DNA, 25 bp, Homo sapien
ccgtggactcggattctgaagggat

SEQ ID NO: 31308 - DNA, 25 bp, Homo sapien
ggattttcattgactttggccgggg

SEQ ID NO: 31309 - DNA, 25 bp, Homo sapien
ctctggcatgtccgacttggagggc

SEQ ID NO: 31310 - DNA, 25 bp, Homo sapien
gggccggcagagtgtcgtgtgaggc

SEQ ID NO: 31311 - DNA, 25 bp, Homo sapien
tgtcgtgtgaggcctcacagctggc

SEQ ID NO: 31312 - DNA, 25 bp, Homo sapien
cacagctggccttgagtttttactg

SEQ ID NO: 31313 - DNA, 25 bp, Homo sapien
agtgagacttttttactgcgtcccg

SEQ ID NO: 31314 - DNA, 25 bp, Homo sapien
cccaggtctgtttcaggcatctgag

SEQ ID NO: 31315 - DNA, 25 bp, Homo sapien
aatgtaaacccagtgggctctgccc

SEQ ID NO: 31316 - DNA, 25 bp, Homo sapien
gcgcgtctctgtggttgggagatgc

SEQ ID NO: 31317 - DNA, 25 bp, Homo sapien
tgggagatgctttctaaggccctgc

SEQ ID NO: 31318 - DNA, 25 bp, Homo sapien
atgctttctaaggccctgctgaact

SEQ ID NO: 31319 - DNA, 25 bp, Homo sapien
gaactccaagaggccatgagaagca

SEQ ID NO: 31320 - DNA, 25 bp, Homo sapien
aaagcattaactctagcactctctg

SEQ ID NO: 31321 - DNA, 25 bp, Homo sapien
gcctcaaacagcatcactgggtggg

SEQ ID NO: 31322 - DNA, 25 bp, Homo sapien
actgggtgggggctgagtaccaaga

SEQ ID NO: 31323 - DNA, 25 bp, Homo sapien
caagaagtgtggtgacctgcccagg

SEQ ID NO: 31324 - DNA, 25 bp, Homo sapien
gaaaacctttcttagttcaatactg

SEQ ID NO: 31325 - DNA, 25 bp, Homo sapien
aatactgttgcccagattgttcccc

SEQ ID NO: 31326 - DNA, 25 bp, Homo sapien
cccagattgttccccacaaaatcac

SEQ ID NO: 31327 - DNA, 25 bp, Homo sapien
ggctgtggcaacggacaaaactctg

SEQ ID NO: 31328 - DNA, 25 bp, Homo sapien
aacggacaaaactctggcaccatcc

SEQ ID NO: 31329 - DNA, 25 bp, Homo sapien
acctctacatcccctggaagtacaa

SEQ ID NO: 31330 - DNA, 25 bp, Homo sapien
acatcccctggaagtacaaggactc

SEQ ID NO: 31331 - DNA, 25 bp, Homo sapien
acaaggactcatctgtggtccctgc

SEQ ID NO: 31332 - DNA, 25 bp, Homo sapien
ttcccaagcagctggacttccagag

SEQ ID NO: 31333 - DNA, 25 bp, Homo sapien
ggctcagatcctggatttgcaggga

SEQ ID NO: 31334 - DNA, 25 bp, Homo sapien
gggagttggggccactgaactccaa

SEQ ID NO: 31335 - DNA, 25 bp, Homo sapien
gaactccaagataaagacaccatga

SEQ ID NO: 31336 - DNA, 25 bp, Homo sapien
atgaggggactgaaggtgggcaagg

SEQ ID NO: 31337 - DNA, 25 bp, Homo sapien
ggtgggcaaggtgagagttaaggat

SEQ ID NO: 31338 - DNA, 25 bp, Homo sapien
tgccctggacttgttctcagaggta

SEQ ID NO: 31339 - DNA, 25 bp, Homo sapien
aggctttctgttttgatctggagct

SEQ ID NO: 31340 - DNA, 25 bp, Homo sapien
gatctggagctgtaagggtcacata

SEQ ID NO: 31341 - DNA, 25 bp, Homo sapien
gggtcacataatcatgggactgccg

SEQ ID NO: 31342 - DNA, 25 bp, Homo sapien
taatcatgggactgccggtggccat

SEQ ID NO: 31343 - DNA, 25 bp, Homo sapien
ccatcttttcctactacctagagaa

SEQ ID NO: 31344 - DNA, 25 bp, Homo sapien
gtaacactgtttagatgtctcaatt

SEQ ID NO: 31345 - DNA, 25 bp, Homo sapien
tgattaagcctgtttgtgttggttt

SEQ ID NO: 31346 - DNA, 25 bp, Homo sapien
gtgttggttttctgacttacaattg

SEQ ID NO: 31347 - DNA, 25 bp, Homo sapien
agccaaaaggtggccaggcttggtg

SEQ ID NO: 31348 - DNA, 25 bp, Homo sapien
gtgagcaaagatcgtaccgctgcac

SEQ ID NO: 31349 - DNA, 25 bp, Homo sapien
ccccaaccagagatccaaggcctgt

SEQ ID NO: 31350 - DNA, 25 bp, Homo sapien
ccaaccagagatccaaggcctgtgg

SEQ ID NO: 31351 - DNA, 25 bp, Homo sapien
accagagatccaaggcctgtgggcc

SEQ ID NO: 31352 - DNA, 25 bp, Homo sapien
ccagagatccaaggcctgtgggcca

SEQ ID NO: 31353 - DNA, 25 bp, Homo sapien
agagatccaaggcctgtgggccacg

SEQ ID NO: 31354 - DNA, 25 bp, Homo sapien
agcagcccagcggattgaacgcaaa

SEQ ID NO: 31355 - DNA, 25 bp, Homo sapien
cagcccagcggattgaacgcaaaag

SEQ ID NO: 31356 - DNA, 25 bp, Homo sapien
ttgaacgcaaaagacagccaccctc

SEQ ID NO: 31357 - DNA, 25 bp, Homo sapien
cctgctccggatcctgggaggaggc

SEQ ID NO: 31358 - DNA, 25 bp, Homo sapien
tgctccggatcctgggaggaggcta

SEQ ID NO: 31359 - DNA, 25 bp, Homo sapien
atcctgggaggaggctacacgctgg

SEQ ID NO: 31360 - DNA, 25 bp, Homo sapien
gacagcctgtcattgaatctaaaca

SEQ ID NO: 31361 - DNA, 25 bp, Homo sapien
atcaggcacactttcttcagaggca

SEQ ID NO: 31362 - DNA, 25 bp, Homo sapien
gtagacggggtggcatcatggcatc

SEQ ID NO: 31363 - DNA, 25 bp, Homo sapien
tggcatctttatatacatcccatcc

SEQ ID NO: 31364 - DNA, 25 bp, Homo sapien
tacatcccatccagctgacaatgga

SEQ ID NO: 31365 - DNA, 25 bp, Homo sapien
tacaggctgttttggaggatacgtt

SEQ ID NO: 31366 - DNA, 25 bp, Homo sapien
gaaaacctaaaacaagcctcttgct

SEQ ID NO: 31367 - DNA, 25 bp, Homo sapien
acaggagtaggtgccactgacctct

SEQ ID NO: 31368 - DNA, 25 bp, Homo sapien
actgacctctattgttggagacttt

SEQ ID NO: 31369 - DNA, 25 bp, Homo sapien
tccactttttgtttcagccagtaaa

SEQ ID NO: 31370 - DNA, 25 bp, Homo sapien
tattgttttgcttcatctgtacaca

SEQ ID NO: 31371 - DNA, 25 bp, Homo sapien
tcatcttgcacctttacaaacaagg

SEQ ID NO: 31372 - DNA, 25 bp, Homo sapien
tgcacctttacaaacaaggaattcc

SEQ ID NO: 31373 - DNA, 25 bp, Homo sapien
atcaaagccatttcaacaacctgca

SEQ ID NO: 31374 - DNA, 25 bp, Homo sapien
aagccatttcaacaacctgcatacc

SEQ ID NO: 31375 - DNA, 25 bp, Homo sapien
ttcaacaacctgcatacccaattat

SEQ ID NO: 31376 - DNA, 25 bp, Homo sapien
cgatatttgtttacctggaaggaga

SEQ ID NO: 31377 - DNA, 25 bp, Homo sapien
gatatcaaggctcagtttattggtc

SEQ ID NO: 31378 - DNA, 25 bp, Homo sapien
aaggctcagtttattggtcctctgg

SEQ ID NO: 31379 - DNA, 25 bp, Homo sapien
ctcagtttattggtcctctggtgtt

SEQ ID NO: 31380 - DNA, 25 bp, Homo sapien
aaactgtctgaatctggagcaatta

SEQ ID NO: 31381 - DNA, 25 bp, Homo sapien
ctgtctgaatctggagcaattatga

SEQ ID NO: 31382 - DNA, 25 bp, Homo sapien
ccccagtgtccgagctggatcgtgc

SEQ ID NO: 31383 - DNA, 25 bp, Homo sapien
cagtgtccgagctggatcgtgcgga

SEQ ID NO: 31384 - DNA, 25 bp, Homo sapien
gtccgagctggatcgtgcggacgcc

SEQ ID NO: 31385 - DNA, 25 bp, Homo sapien
ctcctccgaaaagcgcacgagacag

SEQ ID NO: 31386 - DNA, 25 bp, Homo sapien
ccgaaaagcgcacgagacagccttc

SEQ ID NO: 31387 - DNA, 25 bp, Homo sapien
atctccttcatgcagagtgacatgg

SEQ ID NO: 31388 - DNA, 25 bp, Homo sapien
tgcagagtgacatgggtcgggaagc

SEQ ID NO: 31389 - DNA, 25 bp, Homo sapien
gtgacatgggtcgggaagcagcata

SEQ ID NO: 31390 - DNA, 25 bp, Homo sapien
catgggtcgggaagcagcatatggc

SEQ ID NO: 31391 - DNA, 25 bp, Homo sapien
ggaagcagcatatggcttcttcctg

SEQ ID NO: 31392 - DNA, 25 bp, Homo sapien
aaggccctgatgaggcgggtcggcc

SEQ ID NO: 31393 - DNA, 25 bp, Homo sapien
cgaggtgaatgagacgatgccggag

SEQ ID NO: 31394 - DNA, 25 bp, Homo sapien
tgccggagaccccaactggggactc

SEQ ID NO: 31395 - DNA, 25 bp, Homo sapien
aatgaaaacatctgagtcctcgacc

SEQ ID NO: 31396 - DNA, 25 bp, Homo sapien
gcctgccgcagacattgaagaacca

SEQ ID NO: 31397 - DNA, 25 bp, Homo sapien
gtcctcgaccatactagtggttcgc

SEQ ID NO: 31398 - DNA, 25 bp, Homo sapien
agaggaactgctgaatgaccacgcc

SEQ ID NO: 31399 - DNA, 25 bp, Homo sapien
gaccacgcccgagagaacagaatca

SEQ ID NO: 31400 - DNA, 25 bp, Homo sapien
gcaagaagctacatctctcaacctt

SEQ ID NO: 31401 - DNA, 25 bp, Homo sapien
aacaatccagtgccggcggggtgaa

SEQ ID NO: 31402 - DNA, 25 bp, Homo sapien
tgaagaggagcgtcccctgtgaatc

SEQ ID NO: 31403 - DNA, 25 bp, Homo sapien
gtcccctgtgaatccaacgaggtga

SEQ ID NO: 31404 - DNA, 25 bp, Homo sapien
gaatggaattatgctcactctgcca

SEQ ID NO: 31405 - DNA, 25 bp, Homo sapien
tcactctgccaatgagggaaccaag

SEQ ID NO: 31406 - DNA, 25 bp, Homo sapien
aggtcaggtagtactgaggagctgt

SEQ ID NO: 31407 - DNA, 25 bp, Homo sapien
tgcttggatacaaaaccaggtcatc

SEQ ID NO: 31408 - DNA, 25 bp, Homo sapien
aggtcatccaacctggaatcttagc

SEQ ID NO: 31409 - DNA, 25 bp, Homo sapien
caacctggaatcttagctttgaccc

SEQ ID NO: 31410 - DNA, 25 bp, Homo sapien
cttctcccggcaactttgatgataa

SEQ ID NO: 31411 - DNA, 25 bp, Homo sapien
atggaaataccttagactcttgact

SEQ ID NO: 31412 - DNA, 25 bp, Homo sapien
gactcttgacttgactttactttct

SEQ ID NO: 31413 - DNA, 25 bp, Homo sapien
tcttctctgttataaaatctgctac

SEQ ID NO: 31414 - DNA, 25 bp, Homo sapien
atagattatgccaaaagttctgatt

SEQ ID NO: 31415 - DNA, 25 bp, Homo sapien
aaagcttatccaccacgattaagcc

SEQ ID NO: 31416 - DNA, 25 bp, Homo sapien
caccacgattaagccggcttcatcc

SEQ ID NO: 31417 - DNA, 25 bp, Homo sapien
gcaaggctggttcagcatacacaaa

SEQ ID NO: 31418 - DNA, 25 bp, Homo sapien
aaaagccacatgatatttacctgta

SEQ ID NO: 31419 - DNA, 25 bp, Homo sapien
tgatatttacctgtataccttttta

SEQ ID NO: 31420 - DNA, 25 bp, Homo sapien
gctgtcattatttatgctaacactg

SEQ ID NO: 31421 - DNA, 25 bp, Homo sapien
gctaacactggttttgtgtccctgg

SEQ ID NO: 31422 - DNA, 25 bp, Homo sapien
gtgtccctggaatctatctatctaa

SEQ ID NO: 31423 - DNA, 25 bp, Homo sapien
ttttccattttccagtacctattag

SEQ ID NO: 31424 - DNA, 25 bp, Homo sapien
agacagaatggctttcaattttttc

SEQ ID NO: 31425 - DNA, 25 bp, Homo sapien
tttctcttacttccaaacttagtca

SEQ ID NO: 31426 - DNA, 25 bp, Homo sapien
ctcctctttatgcctctggtaggat

SEQ ID NO: 31427 - DNA, 25 bp, Homo sapien
tggacatttttggttggtaggctaa

SEQ ID NO: 31428 - DNA, 25 bp, Homo sapien
ttgctacctcaatttcagaacttgt

SEQ ID NO: 31429 - DNA, 25 bp, Homo sapien
ttcttcctggtttagtcttgggagg

SEQ ID NO: 31430 - DNA, 25 bp, Homo sapien
atgtgtccaggaacttacccatttc

SEQ ID NO: 31431 - DNA, 25 bp, Homo sapien
aggaacttacccatttcttctagat

SEQ ID NO: 31432 - DNA, 25 bp, Homo sapien
tatcattttctattgcatctatttg

SEQ ID NO: 31433 - DNA, 25 bp, Homo sapien
taacacttccactgctgcagctttt

SEQ ID NO: 31434 - DNA, 25 bp, Homo sapien
gctttcgatttgcttatttcggcgc

SEQ ID NO: 31435 - DNA, 25 bp, Homo sapien
ttatttcggcgcatggctggttgaa

SEQ ID NO: 31436 - DNA, 25 bp, Homo sapien
taattataccctattctttttatgt

SEQ ID NO: 31437 - DNA, 25 bp, Homo sapien
tcttttttttgagacagcctcgctc

SEQ ID NO: 31438 - DNA, 25 bp, Homo sapien
agtacagtggcataatctcggctca

SEQ ID NO: 31439 - DNA, 25 bp, Homo sapien
gcctccctaatagctgggactacag

SEQ ID NO: 31440 - DNA, 25 bp, Homo sapien
gtttcaccctgttagccaggaagtt

SEQ ID NO: 31441 - DNA, 25 bp, Homo sapien
caggaagttctcaatctcctgacct

SEQ ID NO: 31442 - DNA, 25 bp, Homo sapien
ccttggcctctcaaagtgttgggat

SEQ ID NO: 31443 - DNA, 25 bp, Homo sapien
ctgctcctggcttgaattttcttat

SEQ ID NO: 31444 - DNA, 25 bp, Homo sapien
tatcacctttgtattcacctggagc

SEQ ID NO: 31445 - DNA, 25 bp, Homo sapien
agtttttctctatgcagacaaccat

SEQ ID NO: 31446 - DNA, 25 bp, Homo sapien
gacaaccattgatttactctgctgt

SEQ ID NO: 31447 - DNA, 25 bp, Homo sapien
gatttactctgctgtataatacttt

SEQ ID NO: 31448 - DNA, 25 bp, Homo sapien
cactcactccatcttgtaagactat

SEQ ID NO: 31449 - DNA, 25 bp, Homo sapien
cactccatcttgtaagactatgccc

SEQ ID NO: 31450 - DNA, 25 bp, Homo sapien
tccatcttgtaagactatgcccagc

SEQ ID NO: 31451 - DNA, 25 bp, Homo sapien
catcttgtaagactatgcccagccc

SEQ ID NO: 31452 - DNA, 25 bp, Homo sapien
gccccactcacaacatcttgtaaga

SEQ ID NO: 31453 - DNA, 25 bp, Homo sapien
aacatcttgtaagactgtgcccggc

SEQ ID NO: 31454 - DNA, 25 bp, Homo sapien
cccactcactctatcctgtgagacc

SEQ ID NO: 31455 - DNA, 25 bp, Homo sapien
ctcactctatcctgtgagaccacgc

SEQ ID NO: 31456 - DNA, 25 bp, Homo sapien
tccactcgcacgtgattacagtctg

SEQ ID NO: 31457 - DNA, 25 bp, Homo sapien
ccactcgcacgtgattacagtctgt

SEQ ID NO: 31458 - DNA, 25 bp, Homo sapien
actcgcacgtgattacagtctgtaa

SEQ ID NO: 31459 - DNA, 25 bp, Homo sapien
cgctggacgtggccagcgacagcca

SEQ ID NO: 31460 - DNA, 25 bp, Homo sapien
tggccagcgacagccagtcggagat

SEQ ID NO: 31461 - DNA, 25 bp, Homo sapien
gccagcgacagccagtcggagatgc

SEQ ID NO: 31462 - DNA, 25 bp, Homo sapien
ggcgctcatggggggcaagcgggac

SEQ ID NO: 31463 - DNA, 25 bp, Homo sapien
tcatggggggcaagcgggaccccga

SEQ ID NO: 31464 - DNA, 25 bp, Homo sapien
gaccccgaggactcggacgtgttcg

SEQ ID NO: 31465 - DNA, 25 bp, Homo sapien
ggactcggacgtgttcgaggaggac

SEQ ID NO: 31466 - DNA, 25 bp, Homo sapien
ttcgaggaggacacgcacctgtgag

SEQ ID NO: 31467 - DNA, 25 bp, Homo sapien
cacctgtgagcgcagcgaggcgcag

SEQ ID NO: 31468 - DNA, 25 bp, Homo sapien
cctgtgagcgcagcgaggcgcaggc

SEQ ID NO: 31469 - DNA, 25 bp, Homo sapien
cgccaggaccaagcgaggtggaccc

SEQ ID NO: 31470 - DNA, 25 bp, Homo sapien
gttattttaggcccagaaatcaagg

SEQ ID NO: 31471 - DNA, 25 bp, Homo sapien
aatcaaggattgttccaaccatgaa

SEQ ID NO: 31472 - DNA, 25 bp, Homo sapien
gggtaagacacctgccttaagcaaa

SEQ ID NO: 31473 - DNA, 25 bp, Homo sapien
cctgccttaagcaaatctaacctgc

SEQ ID NO: 31474 - DNA, 25 bp, Homo sapien
tctaacctgctattacttgccaaat

SEQ ID NO: 31475 - DNA, 25 bp, Homo sapien
ttttctcttgcctgtatttctaatt

SEQ ID NO: 31476 - DNA, 25 bp, Homo sapien
gtagagcaattaactgggcctaaga

SEQ ID NO: 31477 - DNA, 25 bp, Homo sapien
aaatttcgaagctttccatgacata

SEQ ID NO: 31478 - DNA, 25 bp, Homo sapien
aaaaatgctttgacagtcttcttct

SEQ ID NO: 31479 - DNA, 25 bp, Homo sapien
cttcttctgccattagttcaactgc

SEQ ID NO: 31480 - DNA, 25 bp, Homo sapien
cattagttcaactgcctttacgctt

SEQ ID NO: 31481 - DNA, 25 bp, Homo sapien
ccctgagcagaagcatgggtccccc

SEQ ID NO: 31482 - DNA, 25 bp, Homo sapien
cctttcctggtctgctaagtagcgg

SEQ ID NO: 31483 - DNA, 25 bp, Homo sapien
taagtagcgggtgttttccttgaca

SEQ ID NO: 31484 - DNA, 25 bp, Homo sapien
gtagcgggtgttttccttgacacta

SEQ ID NO: 31485 - DNA, 25 bp, Homo sapien
gggtgttttccttgacactaacgct

SEQ ID NO: 31486 - DNA, 25 bp, Homo sapien
tttccttgacactaacgctacagct

SEQ ID NO: 31487 - DNA, 25 bp, Homo sapien
gacactaacgctacagctagaccac

SEQ ID NO: 31488 - DNA, 25 bp, Homo sapien
ctaacgctacagctagaccacggtg

SEQ ID NO: 31489 - DNA, 25 bp, Homo sapien
tacagctagaccacggtgggcttgg

SEQ ID NO: 31490 - DNA, 25 bp, Homo sapien
ccagatgctggcgttaccgctagac

SEQ ID NO: 31491 - DNA, 25 bp, Homo sapien
tcctaggttatgattgtagagcgag

SEQ ID NO: 31492 - DNA, 25 bp, Homo sapien
taaaatttaacccacaagcatatta

SEQ ID NO: 31493 - DNA, 25 bp, Homo sapien
tcctttagtcttttgggtcgcgtag

SEQ ID NO: 31494 - DNA, 25 bp, Homo sapien
gggtcgcgtagttgctgaaacctaa

SEQ ID NO: 31495 - DNA, 25 bp, Homo sapien
tgaaacctaagtacctgcagcctac

SEQ ID NO: 31496 - DNA, 25 bp, Homo sapien
gtacctgcagcctacaggataagga

SEQ ID NO: 31497 - DNA, 25 bp, Homo sapien
taaggaagttcacagcctgcggggt

SEQ ID NO: 31498 - DNA, 25 bp, Homo sapien
cagcctgcggggtgaatgaacccat

SEQ ID NO: 31499 - DNA, 25 bp, Homo sapien
gaatgaacccatgtgtgaactgcac

SEQ ID NO: 31500 - DNA, 25 bp, Homo sapien
gtaacactttggtcacatctgtctc

SEQ ID NO: 31501 - DNA, 25 bp, Homo sapien
actttggtcacatctgtctctagat

SEQ ID NO: 31502 - DNA, 25 bp, Homo sapien
tctgtctctagatggtcattgaatt

SEQ ID NO: 31503 - DNA, 25 bp, Homo sapien
tccctgaaattctcgctgatctgta

SEQ ID NO: 31504 - DNA, 25 bp, Homo sapien
attaaaaatgtggccgagcgcggtg

SEQ ID NO: 31505 - DNA, 25 bp, Homo sapien
ggtcctcgaactaagcaaggtatgg

SEQ ID NO: 31506 - DNA, 25 bp, Homo sapien
gaagtgccttcaatggtcaggaaag

SEQ ID NO: 31507 - DNA, 25 bp, Homo sapien
gaatagcctacatagcaacagaatg

SEQ ID NO: 31508 - DNA, 25 bp, Homo sapien
ggagaagtgtcttcttccaacttca

SEQ ID NO: 31509 - DNA, 25 bp, Homo sapien
tcttccaacttcatttcaacccaag

SEQ ID NO: 31510 - DNA, 25 bp, Homo sapien
aacatactaatttggcagcctgaat

SEQ ID NO: 31511 - DNA, 25 bp, Homo sapien
gcctgaatttggccctgaatataat

SEQ ID NO: 31512 - DNA, 25 bp, Homo sapien
ataattccattaacctctagactag

SEQ ID NO: 31513 - DNA, 25 bp, Homo sapien
agactaggtcatccctgaaattctc

SEQ ID NO: 31514 - DNA, 25 bp, Homo sapien
tgtatagacaattttcccaggaatg

SEQ ID NO: 31515 - DNA, 25 bp, Homo sapien
aatgcttgaaagttcaaacttcttt

SEQ ID NO: 31516 - DNA, 25 bp, Homo sapien
agatccagtggcccattcttttatc

SEQ ID NO: 31517 - DNA, 25 bp, Homo sapien
atccagtggcccattcttttatctt

SEQ ID NO: 31518 - DNA, 25 bp, Homo sapien
ttatctttatcctgtgaaggtgttt

SEQ ID NO: 31519 - DNA, 25 bp, Homo sapien
ccaaaaatcatttaggaccaagtct

SEQ ID NO: 31520 - DNA, 25 bp, Homo sapien
gtggccaagttggattccgattgta

SEQ ID NO: 31521 - DNA, 25 bp, Homo sapien
gatactaattttctagcatggctct

SEQ ID NO: 31522 - DNA, 25 bp, Homo sapien
tagaagagttttgaggctgggcgca

SEQ ID NO: 31523 - DNA, 25 bp, Homo sapien
agcattttgggtgactgaggcgggt

SEQ ID NO: 31524 - DNA, 25 bp, Homo sapien
aggctgcagtgagttctaattgcgc

SEQ ID NO: 31525 - DNA, 25 bp, Homo sapien
acatgaagaagctaagtgtcctgcc

SEQ ID NO: 31526 - DNA, 25 bp, Homo sapien
tgtcctgcccaaccagtaagtcaaa

SEQ ID NO: 31527 - DNA, 25 bp, Homo sapien
gaaccccaagatagttctctaaggg

SEQ ID NO: 31528 - DNA, 25 bp, Homo sapien
gggtgggaaatccatctcagtagga

SEQ ID NO: 31529 - DNA, 25 bp, Homo sapien
aaagcggctgggcatggtggttcat

SEQ ID NO: 31530 - DNA, 25 bp, Homo sapien
gggcaacaaattgaggcccccatct

SEQ ID NO: 31531 - DNA, 25 bp, Homo sapien
aggagtctgagctgggaggatcact

SEQ ID NO: 31532 - DNA, 25 bp, Homo sapien
ggatcactcaagccctgggaggtca

SEQ ID NO: 31533 - DNA, 25 bp, Homo sapien
agtgagctgcaatcacaccactact

SEQ ID NO: 31534 - DNA, 25 bp, Homo sapien
tactctccaacctgggtgacagacc

SEQ ID NO: 31535 - DNA, 25 bp, Homo sapien
gaaaatcaggatccccatttgacaa

SEQ ID NO: 31536 - DNA, 25 bp, Homo sapien
agaaggctacggggaggactgagag

SEQ ID NO: 31537 - DNA, 25 bp, Homo sapien
ggaggcagccaagtaacgtagtcat

SEQ ID NO: 31538 - DNA, 25 bp, Homo sapien
taacgtagtcatatcatcgcgctct

SEQ ID NO: 31539 - DNA, 25 bp, Homo sapien
atctggctgtgcaaggaagacccgg

SEQ ID NO: 31540 - DNA, 25 bp, Homo sapien
gctttgccctcacaagtcttatggg

SEQ ID NO: 31541 - DNA, 25 bp, Homo sapien
aagtcttatgggcaccacagggaac

SEQ ID NO: 31542 - DNA, 25 bp, Homo sapien
gggcaccacagggaacatcctggac

SEQ ID NO: 31543 - DNA, 25 bp, Homo sapien
ggacttaaaaagccagggcaggccg

SEQ ID NO: 31544 - DNA, 25 bp, Homo sapien
gcaggtggattacccaaggccagga

SEQ ID NO: 31545 - DNA, 25 bp, Homo sapien
tgggaacaggcagctcctatctgca

SEQ ID NO: 31546 - DNA, 25 bp, Homo sapien
gctcctatctgcaaactgtgttcac

SEQ ID NO: 31547 - DNA, 25 bp, Homo sapien
ttctcactctacagggtcctggtga

SEQ ID NO: 31548 - DNA, 25 bp, Homo sapien
tgaagagccagtgaggcccctggta

SEQ ID NO: 31549 - DNA, 25 bp, Homo sapien
tgcaggggcagcacagctggggtgc

SEQ ID NO: 31550 - DNA, 25 bp, Homo sapien
tctgcagcggggccttatgctgcca

SEQ ID NO: 31551 - DNA, 25 bp, Homo sapien
ggcaggtggctgagcaggagctccc

SEQ ID NO: 31552 - DNA, 25 bp, Homo sapien
cacccctgggcatcatgtgtgtggg

SEQ ID NO: 31553 - DNA, 25 bp, Homo sapien
caggtgtgggagctggtgaccccag

SEQ ID NO: 31554 - DNA, 25 bp, Homo sapien
agacccagaattctcagggctctac

SEQ ID NO: 31555 - DNA, 25 bp, Homo sapien
ctttcctggtcctaggtggccagtg

SEQ ID NO: 31556 - DNA, 25 bp, Homo sapien
gccgtttccgtggttgtagcagagg

SEQ ID NO: 31557 - DNA, 25 bp, Homo sapien
gaggaccggaggttgggttcctgat

SEQ ID NO: 31558 - DNA, 25 bp, Homo sapien
ccgctcccaagatccaactacgagc

SEQ ID NO: 31559 - DNA, 25 bp, Homo sapien
ttacctgcagcaactttactatacg

SEQ ID NO: 31560 - DNA, 25 bp, Homo sapien
actcattccaattacagggcctcga

SEQ ID NO: 31561 - DNA, 25 bp, Homo sapien
tattgttattttcgtcactacctcc

SEQ ID NO: 31562 - DNA, 25 bp, Homo sapien
tcgggagtgggtaatttgcgcgcct

SEQ ID NO: 31563 - DNA, 25 bp, Homo sapien
gctgccttccttggatgtggtagcc

SEQ ID NO: 31564 - DNA, 25 bp, Homo sapien
gcacggcgactaccatcgaaagttg

SEQ ID NO: 31565 - DNA, 25 bp, Homo sapien
agacgttcgaatgggtcgtcgtccg

SEQ ID NO: 31566 - DNA, 25 bp, Homo sapien
ggggctgagggttggttttgatctg

SEQ ID NO: 31567 - DNA, 25 bp, Homo sapien
gatctgataaatgcaccgatccccc

SEQ ID NO: 31568 - DNA, 25 bp, Homo sapien
cccgtcggcatgtattagctctaga

SEQ ID NO: 31569 - DNA, 25 bp, Homo sapien
tgaactacgacaagctgagccgctc

SEQ ID NO: 31570 - DNA, 25 bp, Homo sapien
gggcatcatccggaagccagacatc

SEQ ID NO: 31571 - DNA, 25 bp, Homo sapien
ggaaaacgggcagtctgctctgctg

SEQ ID NO: 31572 - DNA, 25 bp, Homo sapien
ctgctctgaccttccagagcccaag

SEQ ID NO: 31573 - DNA, 25 bp, Homo sapien
gctgctcccctggaggacagaggga

SEQ ID NO: 31574 - DNA, 25 bp, Homo sapien
agagggagacagggctgctccccaa

SEQ ID NO: 31575 - DNA, 25 bp, Homo sapien
ccagcatttccagagcagagcctac

SEQ ID NO: 31576 - DNA, 25 bp, Homo sapien
gggcagtgactcgacaaaggccaca

SEQ ID NO: 31577 - DNA, 25 bp, Homo sapien
aaaggccacaggcagtccaggcctc

SEQ ID NO: 31578 - DNA, 25 bp, Homo sapien
tgcagggagacatctgcacccctga

SEQ ID NO: 31579 - DNA, 25 bp, Homo sapien
gagttgggcagccaggagtgccccc

SEQ ID NO: 31580 - DNA, 25 bp, Homo sapien
tttccctctaagtttacactaacat

SEQ ID NO: 31581 - DNA, 25 bp, Homo sapien
gtttacactaacatctacccaagat

SEQ ID NO: 31582 - DNA, 25 bp, Homo sapien
acatctacccaagatagactgtttt

SEQ ID NO: 31583 - DNA, 25 bp, Homo sapien
acagtcaatttcagttcagctaaca

SEQ ID NO: 31584 - DNA, 25 bp, Homo sapien
ttgtaactctttgctatggcttttg

SEQ ID NO: 31585 - DNA, 25 bp, Homo sapien
gctatggcttttgttatcacaccaa

SEQ ID NO: 31586 - DNA, 25 bp, Homo sapien
gttatcacaccaaaactatgcaatt

SEQ ID NO: 31587 - DNA, 25 bp, Homo sapien
tatgcaattggtacatggttgttta

SEQ ID NO: 31588 - DNA, 25 bp, Homo sapien
gaaaccgtatttttccatgataaat

SEQ ID NO: 31589 - DNA, 25 bp, Homo sapien
gaaatatttggttcatggtatgatc

SEQ ID NO: 31590 - DNA, 25 bp, Homo sapien
cataattaacacattggctgctagt

SEQ ID NO: 31591 - DNA, 25 bp, Homo sapien
taatcttctctaaacactaatgcca

SEQ ID NO: 31592 - DNA, 25 bp, Homo sapien
taatgccatttctgtcctttcattt

SEQ ID NO: 31593 - DNA, 25 bp, Homo sapien
gtcctttcatttctattggtaatcc

SEQ ID NO: 31594 - DNA, 25 bp, Homo sapien
gaggcacattttccactaatagctg

SEQ ID NO: 31595 - DNA, 25 bp, Homo sapien
agaatccaaaggctgcttagtaact

SEQ ID NO: 31596 - DNA, 25 bp, Homo sapien
gctgcttagtaactgtagtgcctaa

SEQ ID NO: 31597 - DNA, 25 bp, Homo sapien
gtttagagtctgttcaaggtggtgt

SEQ ID NO: 31598 - DNA, 25 bp, Homo sapien
ggcatttccctcaaaagcacgtgga

SEQ ID NO: 31599 - DNA, 25 bp, Homo sapien
agaaggaacctattgaccctctgga

SEQ ID NO: 31600 - DNA, 25 bp, Homo sapien
cctattgaccctctggaatgccaga

SEQ ID NO: 31601 - DNA, 25 bp, Homo sapien
gatttggcccagactgaggcagatg

SEQ ID NO: 31602 - DNA, 25 bp, Homo sapien
ctaccaccctacaagctgaagctgg

SEQ ID NO: 31603 - DNA, 25 bp, Homo sapien
gaagctggacctgaccaagctgtag

SEQ ID NO: 31604 - DNA, 25 bp, Homo sapien
ctggacctgaccaagctgtaggcct

SEQ ID NO: 31605 - DNA, 25 bp, Homo sapien
ccccatcactgccaactgcaggggg

SEQ ID NO: 31606 - DNA, 25 bp, Homo sapien
ccatcactgccaactgcagggggcc

SEQ ID NO: 31607 - DNA, 25 bp, Homo sapien
ggagtccaagggcagggtgggtcca

SEQ ID NO: 31608 - DNA, 25 bp, Homo sapien
caagggcagggtgggtccagccttg

SEQ ID NO: 31609 - DNA, 25 bp, Homo sapien
ccccacggagtcctggggacgcagt

SEQ ID NO: 31610 - DNA, 25 bp, Homo sapien
ccacggagtcctggggacgcagtgc

SEQ ID NO: 31611 - DNA, 25 bp, Homo sapien
gcttcatgatggagcccgattggcc

SEQ ID NO: 31612 - DNA, 25 bp, Homo sapien
ttcatgatggagcccgattggcccc

SEQ ID NO: 31613 - DNA, 25 bp, Homo sapien
gtggcttcactgaggagcgaactgg

SEQ ID NO: 31614 - DNA, 25 bp, Homo sapien
actgaaacccattctggaggagttc

SEQ ID NO: 31615 - DNA, 25 bp, Homo sapien
tggaggagttcgggcggcaatttca

SEQ ID NO: 31616 - DNA, 25 bp, Homo sapien
tcgggcggcaatttcagaactctcg

SEQ ID NO: 31617 - DNA, 25 bp, Homo sapien
gaactctcgaagagggcctgacctc

SEQ ID NO: 31618 - DNA, 25 bp, Homo sapien
acctctccatgaacctggatcggtc

SEQ ID NO: 31619 - DNA, 25 bp, Homo sapien
gggtcgcagttgtctacggagtccc

SEQ ID NO: 31620 - DNA, 25 bp, Homo sapien
cgagcactgacctcactagtggacg

SEQ ID NO: 31621 - DNA, 25 bp, Homo sapien
gtggacgaggtgaagcagaggggcc

SEQ ID NO: 31622 - DNA, 25 bp, Homo sapien
tgtcccagctgtcagaggctacaca

SEQ ID NO: 31623 - DNA, 25 bp, Homo sapien
gccaagaacctactgctgacagaca

SEQ ID NO: 31624 - DNA, 25 bp, Homo sapien
gagagctaacgtttgatagttctaa

SEQ ID NO: 31625 - DNA, 25 bp, Homo sapien
gaatccttatagaatttgtctttta

SEQ ID NO: 31626 - DNA, 25 bp, Homo sapien
aaattactcttctttaatgctaagt

SEQ ID NO: 31627 - DNA, 25 bp, Homo sapien
aatgctaagtattgacacatcgttg

SEQ ID NO: 31628 - DNA, 25 bp, Homo sapien
ttgacacatcgttgtttgtttttca

SEQ ID NO: 31629 - DNA, 25 bp, Homo sapien
tttcattgtttttgcggattgagag

SEQ ID NO: 31630 - DNA, 25 bp, Homo sapien
gcggattgagagacttggtccatct

SEQ ID NO: 31631 - DNA, 25 bp, Homo sapien
acttggtccatcttgtctcaggaga

SEQ ID NO: 31632 - DNA, 25 bp, Homo sapien
gaaacctttctccaatgtagcagaa

SEQ ID NO: 31633 - DNA, 25 bp, Homo sapien
tatcctcttccctgtattatagcaa

SEQ ID NO: 31634 - DNA, 25 bp, Homo sapien
ttaaagatttttgaggccgggcaca

SEQ ID NO: 31635 - DNA, 25 bp, Homo sapien
cagtataatgactcacccggaaggt

SEQ ID NO: 31636 - DNA, 25 bp, Homo sapien
tgactcacccggaaggtttcttaat

SEQ ID NO: 31637 - DNA, 25 bp, Homo sapien
tttcttaattcgttcttccatttat

SEQ ID NO: 31638 - DNA, 25 bp, Homo sapien
gtttgaacgcctactaagttctggg

SEQ ID NO: 31639 - DNA, 25 bp, Homo sapien
aacgcctactaagttctgggtgcag

SEQ ID NO: 31640 - DNA, 25 bp, Homo sapien
gcctactaagttctgggtgcagggt

SEQ ID NO: 31641 - DNA, 25 bp, Homo sapien
gggtgcagggtataacacagcaagc

SEQ ID NO: 31642 - DNA, 25 bp, Homo sapien
ggtataacacagcaagcaccatgga

SEQ ID NO: 31643 - DNA, 25 bp, Homo sapien
agtgctcacactccaataagaagaa

SEQ ID NO: 31644 - DNA, 25 bp, Homo sapien
catttcgggaggcctgggcaggcag

SEQ ID NO: 31645 - DNA, 25 bp, Homo sapien
cagatcacctggggtaaggaatttg

SEQ ID NO: 31646 - DNA, 25 bp, Homo sapien
gaacagagcagaaaaatcgtgaaag

SEQ ID NO: 31647 - DNA, 25 bp, Homo sapien
atcgtgaaagttataatggctccca

SEQ ID NO: 31648 - DNA, 25 bp, Homo sapien
gttataatggctcccaattttccaa

SEQ ID NO: 31649 - DNA, 25 bp, Homo sapien
taatggctcccaattttccaaaagt

SEQ ID NO: 31650 - DNA, 25 bp, Homo sapien
ccccaagccacggatccagtaagct

SEQ ID NO: 31651 - DNA, 25 bp, Homo sapien
gccacggatccagtaagcttagaga

SEQ ID NO: 31652 - DNA, 25 bp, Homo sapien
gatccagtaagcttagagaacacca

SEQ ID NO: 31653 - DNA, 25 bp, Homo sapien
gaacaccaaataggatacatactta

SEQ ID NO: 31654 - DNA, 25 bp, Homo sapien
acccagcttacttatacaggaaacg

SEQ ID NO: 31655 - DNA, 25 bp, Homo sapien
cttcttgtcagaacacgcaagcaag

SEQ ID NO: 31656 - DNA, 25 bp, Homo sapien
gtcagaacacgcaagcaagaagaga

SEQ ID NO: 31657 - DNA, 25 bp, Homo sapien
tgatcttactttgttaatccagggc

SEQ ID NO: 31658 - DNA, 25 bp, Homo sapien
gggcatagggaaatctctgcagcct

SEQ ID NO: 31659 - DNA, 25 bp, Homo sapien
tctctgcagccttgattagtactcc

SEQ ID NO: 31660 - DNA, 25 bp, Homo sapien
ccttgattagtactccctggatgtt

SEQ ID NO: 31661 - DNA, 25 bp, Homo sapien
atctttctgtgcatgcatcacctat

SEQ ID NO: 31662 - DNA, 25 bp, Homo sapien
atcacctatgacatctacttttctt

SEQ ID NO: 31663 - DNA, 25 bp, Homo sapien
atatcaccactctaggctatttggt

SEQ ID NO: 31664 - DNA, 25 bp, Homo sapien
aaactggtccttgagcagaatcagc

SEQ ID NO: 31665 - DNA, 25 bp, Homo sapien
gcagaatcagctaaaggtccccttg

SEQ ID NO: 31666 - DNA, 25 bp, Homo sapien
cagctaaaggtccccttgaagcctc

SEQ ID NO: 31667 - DNA, 25 bp, Homo sapien
catcaagaagcagtgggctctccag

SEQ ID NO: 31668 - DNA, 25 bp, Homo sapien
aatgccacggccgtcgtgagacata

SEQ ID NO: 31669 - DNA, 25 bp, Homo sapien
atgagaaaactacacctcggcagca

SEQ ID NO: 31670 - DNA, 25 bp, Homo sapien
cagcctggacagttcaaatgcaagt

SEQ ID NO: 31671 - DNA, 25 bp, Homo sapien
tttcgagcagcctcagtttggccag

SEQ ID NO: 31672 - DNA, 25 bp, Homo sapien
tggccagccaaaaagactgtgcgta

SEQ ID NO: 31673 - DNA, 25 bp, Homo sapien
tgtagcaaaaccagaatccctcagc

SEQ ID NO: 31674 - DNA, 25 bp, Homo sapien
gaatccctcagctgacactgaagac

SEQ ID NO: 31675 - DNA, 25 bp, Homo sapien
actgaagacgagcctggggtggaga

SEQ ID NO: 31676 - DNA, 25 bp, Homo sapien
gccaggcgctttctatacttaatcc

SEQ ID NO: 31677 - DNA, 25 bp, Homo sapien
acttaatcccatgtcatgcgaccct

SEQ ID NO: 31678 - DNA, 25 bp, Homo sapien
tcatgcgaccctaggacttttttta

SEQ ID NO: 31679 - DNA, 25 bp, Homo sapien
ggctcatgctgtcctgtgagagccc

SEQ ID NO: 31680 - DNA, 25 bp, Homo sapien
cccactaagcgcatgtggctcctgg

SEQ ID NO: 31681 - DNA, 25 bp, Homo sapien
tcaccactcactcaaccagtggcac

SEQ ID NO: 31682 - DNA, 25 bp, Homo sapien
tcaaccagtggcacagtgtccttgt

SEQ ID NO: 31683 - DNA, 25 bp, Homo sapien
cacactgagccagcaagtcctgctg

SEQ ID NO: 31684 - DNA, 25 bp, Homo sapien
gaccttggggcttgtgtcgagccct

SEQ ID NO: 31685 - DNA, 25 bp, Homo sapien
cttgtgtcgagcccttgggtggggc

SEQ ID NO: 31686 - DNA, 25 bp, Homo sapien
ggaggaggtgatggcgtcagaggag

SEQ ID NO: 31687 - DNA, 25 bp, Homo sapien
gatggcgtcagaggaggtgtggtca

SEQ ID NO: 31688 - DNA, 25 bp, Homo sapien
gaggtgtggtcagaggtgacttgtt

SEQ ID NO: 31689 - DNA, 25 bp, Homo sapien
ggagcaaattgcaccacagctcccc

SEQ ID NO: 31690 - DNA, 25 bp, Homo sapien
ccttacggcacagggctgagggccc

SEQ ID NO: 31691 - DNA, 25 bp, Homo sapien
acggcacagggctgagggccctggc

SEQ ID NO: 31692 - DNA, 25 bp, Homo sapien
acagggctgagggccctggcaatgc

SEQ ID NO: 31693 - DNA, 25 bp, Homo sapien
gatggagcagcaggtaagcggtcgc

SEQ ID NO: 31694 - DNA, 25 bp, Homo sapien
tggagcagcaggtaagcggtcgcag

SEQ ID NO: 31695 - DNA, 25 bp, Homo sapien
gcaggtaagcggtcgcaggcaggca

SEQ ID NO: 31696 - DNA, 25 bp, Homo sapien
cggtcgcaggcaggcaggggagaat

SEQ ID NO: 31697 - DNA, 25 bp, Homo sapien
gcaggggagaatggcttgggggggg

SEQ ID NO: 31698 - DNA, 25 bp, Homo sapien
ctggactctcagaacgccagggtcc

SEQ ID NO: 31699 - DNA, 25 bp, Homo sapien
actctcagaacgccagggtccaggc

SEQ ID NO: 31700 - DNA, 25 bp, Homo sapien
tctcagaacgccagggtccaggcag

SEQ ID NO: 31701 - DNA, 25 bp, Homo sapien
ctccctctctggggtcgatgaagag

SEQ ID NO: 31702 - DNA, 25 bp, Homo sapien
cccgaggacgacgacgaggacgagg

SEQ ID NO: 31703 - DNA, 25 bp, Homo sapien
cgaggaggacacggtgactcggctg

SEQ ID NO: 31704 - DNA, 25 bp, Homo sapien
tcttcacgtcggcggaggagctgga

SEQ ID NO: 31705 - DNA, 25 bp, Homo sapien
cgcagcggctggaggagcgcgaacg

SEQ ID NO: 31706 - DNA, 25 bp, Homo sapien
ctggaggagcgcgaacggatcctgc

SEQ ID NO: 31707 - DNA, 25 bp, Homo sapien
cggatcctgcgggagatctggcgca

SEQ ID NO: 31708 - DNA, 25 bp, Homo sapien
ggccgcatgcactattactgatggg

SEQ ID NO: 31709 - DNA, 25 bp, Homo sapien
gggtaccggacctgtacatgagctc

SEQ ID NO: 31710 - DNA, 25 bp, Homo sapien
tacatgagctcagagctaccccaca

SEQ ID NO: 31711 - DNA, 25 bp, Homo sapien
acagctcccaggtgctactgggcgt

SEQ ID NO: 31712 - DNA, 25 bp, Homo sapien
aggagcaagcggtcaacctttcata

SEQ ID NO: 31713 - DNA, 25 bp, Homo sapien
acctttcataattctccaacgctga

SEQ ID NO: 31714 - DNA, 25 bp, Homo sapien
aattctccaacgctgaggatgcaaa

SEQ ID NO: 31715 - DNA, 25 bp, Homo sapien
ggatgcaaaaccacagaattctaac

SEQ ID NO: 31716 - DNA, 25 bp, Homo sapien
gccttaaattctaagattccttcca

SEQ ID NO: 31717 - DNA, 25 bp, Homo sapien
gattccttccagctgtaaaattcaa

SEQ ID NO: 31718 - DNA, 25 bp, Homo sapien
attcaataatcctgtgactcactat

SEQ ID NO: 31719 - DNA, 25 bp, Homo sapien
tgtgactcactattaggactcctct

SEQ ID NO: 31720 - DNA, 25 bp, Homo sapien
ccctccttctagactcataatcttg

SEQ ID NO: 31721 - DNA, 25 bp, Homo sapien
ttatggttatttctagcccactccg

SEQ ID NO: 31722 - DNA, 25 bp, Homo sapien
tctagcccactccgaacaatgagtt

SEQ ID NO: 31723 - DNA, 25 bp, Homo sapien
caaggcaggtggatcccttgagctc

SEQ ID NO: 31724 - DNA, 25 bp, Homo sapien
aaactagccaggcagggctgggcgc

SEQ ID NO: 31725 - DNA, 25 bp, Homo sapien
gcggatctcgaggtcaggagattga

SEQ ID NO: 31726 - DNA, 25 bp, Homo sapien
gaggcagaagaatggcgtgaacttg

SEQ ID NO: 31727 - DNA, 25 bp, Homo sapien
gtgaacttgggaggtggagcttaca

SEQ ID NO: 31728 - DNA, 25 bp, Homo sapien
aactagccaggcgggcatggtggtg

SEQ ID NO: 31729 - DNA, 25 bp, Homo sapien
catggtggtggcacccatctgtagt

SEQ ID NO: 31730 - DNA, 25 bp, Homo sapien
gatcgcctgagcctgagggggatgt

SEQ ID NO: 31731 - DNA, 25 bp, Homo sapien
agcctgagggggatgttgccgtgag

SEQ ID NO: 31732 - DNA, 25 bp, Homo sapien
tgccgtgagccaagagcttgtgact

SEQ ID NO: 31733 - DNA, 25 bp, Homo sapien
agccaagagcttgtgactggactcc

SEQ ID NO: 31734 - DNA, 25 bp, Homo sapien
cctggtttttattctcagtacctca

SEQ ID NO: 31735 - DNA, 25 bp, Homo sapien
gtttttattctcagtacctcaggct

SEQ ID NO: 31736 - DNA, 25 bp, Homo sapien
ctgtgtacttggaggggcagggagc

SEQ ID NO: 31737 - DNA, 25 bp, Homo sapien
cacagccaccgaggcaggggctgca

SEQ ID NO: 31738 - DNA, 25 bp, Homo sapien
cagccacccactgggagtcttgttt

SEQ ID NO: 31739 - DNA, 25 bp, Homo sapien
cacccactgggagtcttgtttttat

SEQ ID NO: 31740 - DNA, 25 bp, Homo sapien
gtccagtcccagaccaatggaggcc

SEQ ID NO: 31741 - DNA, 25 bp, Homo sapien
acctgggagatgccgggtgctacgg

SEQ ID NO: 31742 - DNA, 25 bp, Homo sapien
gccgggtgctacggttatgccaggc

SEQ ID NO: 31743 - DNA, 25 bp, Homo sapien
ctggaagagagtgtggtgtgatgga

SEQ ID NO: 31744 - DNA, 25 bp, Homo sapien
gtggtgtgatggacgggcagcttcc

SEQ ID NO: 31745 - DNA, 25 bp, Homo sapien
cattggctacacacccactaattga

SEQ ID NO: 31746 - DNA, 25 bp, Homo sapien
ggctacacacccactaattgattcc

SEQ ID NO: 31747 - DNA, 25 bp, Homo sapien
tacacacccactaattgattcccag

SEQ ID NO: 31748 - DNA, 25 bp, Homo sapien
acccactaattgattcccagagctc

SEQ ID NO: 31749 - DNA, 25 bp, Homo sapien
ctaattgattcccagagctcacagc

SEQ ID NO: 31750 - DNA, 25 bp, Homo sapien
attcccagagctcacagcctggatc

SEQ ID NO: 31751 - DNA, 25 bp, Homo sapien
cagagctcacagcctggatcaaagt

SEQ ID NO: 31752 - DNA, 25 bp, Homo sapien
acagcctggatcaaagttgtttctt

SEQ ID NO: 31753 - DNA, 25 bp, Homo sapien
aggtgcatgccatcatacttggcta

SEQ ID NO: 31754 - DNA, 25 bp, Homo sapien
atcatacttggctaatattttcgaa

SEQ ID NO: 31755 - DNA, 25 bp, Homo sapien
tcgaaattttcctaaggctgggcgc

SEQ ID NO: 31756 - DNA, 25 bp, Homo sapien
gtgataggaataagtagctggtgtt

SEQ ID NO: 31757 - DNA, 25 bp, Homo sapien
gcgggtgaggaggtgacacctgaga

SEQ ID NO: 31758 - DNA, 25 bp, Homo sapien
gaggtgacacctgagaattcctccc

SEQ ID NO: 31759 - DNA, 25 bp, Homo sapien
ctgaccctgccggaaagcgaaactg

SEQ ID NO: 31760 - DNA, 25 bp, Homo sapien
gaccctgccggaaagcgaaactgag

SEQ ID NO: 31761 - DNA, 25 bp, Homo sapien
aagcgaaactgagatgcgggcattg

SEQ ID NO: 31762 - DNA, 25 bp, Homo sapien
ctgagatgcgggcattgggccctgg

SEQ ID NO: 31763 - DNA, 25 bp, Homo sapien
gcaggcccttccatgaggcctggac

SEQ ID NO: 31764 - DNA, 25 bp, Homo sapien
cccttccatgaggcctggactggag

SEQ ID NO: 31765 - DNA, 25 bp, Homo sapien
cttccatgaggcctggactggaggc

SEQ ID NO: 31766 - DNA, 25 bp, Homo sapien
gaggcctggactggaggccttctct

SEQ ID NO: 31767 - DNA, 25 bp, Homo sapien
cttcattactgaacaaaactacggt

SEQ ID NO: 31768 - DNA, 25 bp, Homo sapien
aaactacggttcacaatatacctgg

SEQ ID NO: 31769 - DNA, 25 bp, Homo sapien
aatatacctggattcgacagcataa

SEQ ID NO: 31770 - DNA, 25 bp, Homo sapien
gcaggatggtagtgtgcaggtcatt

SEQ ID NO: 31771 - DNA, 25 bp, Homo sapien
gtgcaggtcattaaagatcatgtga

SEQ ID NO: 31772 - DNA, 25 bp, Homo sapien
gatcatgtgaccaattgtgcattca

SEQ ID NO: 31773 - DNA, 25 bp, Homo sapien
gaccaattgtgcattcagttttcag

SEQ ID NO: 31774 - DNA, 25 bp, Homo sapien
ttctttgctatatgatttggattaa

SEQ ID NO: 31775 - DNA, 25 bp, Homo sapien
gattctgttaactgttgtcttaaaa

SEQ ID NO: 31776 - DNA, 25 bp, Homo sapien
attgcaattttgattctcatggggg

SEQ ID NO: 31777 - DNA, 25 bp, Homo sapien
acatttagttttaatacaacctatg

SEQ ID NO: 31778 - DNA, 25 bp, Homo sapien
gaaaaacggtggatctgggctctgg

SEQ ID NO: 31779 - DNA, 25 bp, Homo sapien
ctatcgccgcaaggatctctggaag

SEQ ID NO: 31780 - DNA, 25 bp, Homo sapien
ggatctctggaaggtgagcctgagg

SEQ ID NO: 31781 - DNA, 25 bp, Homo sapien
ggaaggtgagcctgagggactgccg

SEQ ID NO: 31782 - DNA, 25 bp, Homo sapien
tcccgctgctggaggacaagctgcg

SEQ ID NO: 31783 - DNA, 25 bp, Homo sapien
gacaagctgcggacagagctgcctg

SEQ ID NO: 31784 - DNA, 25 bp, Homo sapien
gagggcctggaccgagtatgggctt

SEQ ID NO: 31785 - DNA, 25 bp, Homo sapien
gggcttatgatgttcctgagggtgg

SEQ ID NO: 31786 - DNA, 25 bp, Homo sapien
tgagggtgggcaggctggggaggcc

SEQ ID NO: 31787 - DNA, 25 bp, Homo sapien
ggccttatttctcaggccagctgag

SEQ ID NO: 31788 - DNA, 25 bp, Homo sapien
aggccagctgagtattagacacgat

SEQ ID NO: 31789 - DNA, 25 bp, Homo sapien
gagaatttggccacatgtctgttga

SEQ ID NO: 31790 - DNA, 25 bp, Homo sapien
tgtctgttgaatgtggtgcgttgaa

SEQ ID NO: 31791 - DNA, 25 bp, Homo sapien
gtgcgttgaatcctatcaccatagt

SEQ ID NO: 31792 - DNA, 25 bp, Homo sapien
tgaatcctatcaccatagtcaccct

SEQ ID NO: 31793 - DNA, 25 bp, Homo sapien
tgaaaaagtctttcttctccaccat

SEQ ID NO: 31794 - DNA, 25 bp, Homo sapien
ccaaacttaggggcttctgtgtctt

SEQ ID NO: 31795 - DNA, 25 bp, Homo sapien
ttctgtgtcttgtaaaatgcctttc

SEQ ID NO: 31796 - DNA, 25 bp, Homo sapien
aatgcctttctcccttgtagaaaag

SEQ ID NO: 31797 - DNA, 25 bp, Homo sapien
agtgggttcaattctgtaagctaca

SEQ ID NO: 31798 - DNA, 25 bp, Homo sapien
gctacacattaaaccagctggagtt

SEQ ID NO: 31799 - DNA, 25 bp, Homo sapien
gctggagttggttgtaggtaaaata

SEQ ID NO: 31800 - DNA, 25 bp, Homo sapien
gaagatttagttttcatatcgtata

SEQ ID NO: 31801 - DNA, 25 bp, Homo sapien
aatttgtgtcacttactatttttgt

SEQ ID NO: 31802 - DNA, 25 bp, Homo sapien
gtactgttatctaagctactgtgtt

SEQ ID NO: 31803 - DNA, 25 bp, Homo sapien
agatactgcgaataggccctcaaac

SEQ ID NO: 31804 - DNA, 25 bp, Homo sapien
tttgccagttttaaggacatatttt

SEQ ID NO: 31805 - DNA, 25 bp, Homo sapien
cactattattgggtttgttttatgc

SEQ ID NO: 31806 - DNA, 25 bp, Homo sapien
atgccattattgattcttgatattc

SEQ ID NO: 31807 - DNA, 25 bp, Homo sapien
acaatgtagcatatttgattttctt

SEQ ID NO: 31808 - DNA, 25 bp, Homo sapien
ttgtgttgtttagctttcatttgct

SEQ ID NO: 31809 - DNA, 25 bp, Homo sapien
atgtacctttattttccagtatgcc

SEQ ID NO: 31810 - DNA, 25 bp, Homo sapien
tttccagtatgcctacattttgtat

SEQ ID NO: 31811 - DNA, 25 bp, Homo sapien
gacggcgtcaaggtcgtgggacgtg

SEQ ID NO: 31812 - DNA, 25 bp, Homo sapien
caactgctggcagaatcttcgtccg

SEQ ID NO: 31813 - DNA, 25 bp, Homo sapien
gtcgccacgggaggtgcaagtgacc

SEQ ID NO: 31814 - DNA, 25 bp, Homo sapien
tgcaagtgaccatgtgcatcggcgc

SEQ ID NO: 31815 - DNA, 25 bp, Homo sapien
gccagttccgggcggcaaacatgca

SEQ ID NO: 31816 - DNA, 25 bp, Homo sapien
tgcacgcgcagatcaagacgagcct

SEQ ID NO: 31817 - DNA, 25 bp, Homo sapien
cagctacaatcccatggtgctcatt

SEQ ID NO: 31818 - DNA, 25 bp, Homo sapien
tgctcattcaaaagaccgacaccgg

SEQ ID NO: 31819 - DNA, 25 bp, Homo sapien
ccgacaccggggtgtcgctccagac

SEQ ID NO: 31820 - DNA, 25 bp, Homo sapien
cgctccagacctatgatgacttgtt

SEQ ID NO: 31821 - DNA, 25 bp, Homo sapien
ttgttagccaaagactgccactgca

SEQ ID NO: 31822 - DNA, 25 bp, Homo sapien
gaagtaccaccactgtgtgggtgag

SEQ ID NO: 31823 - DNA, 25 bp, Homo sapien
agtaccgctgggtggagcagcacct

SEQ ID NO: 31824 - DNA, 25 bp, Homo sapien
gtagaacgaattatcctgacaaggg

SEQ ID NO: 31825 - DNA, 25 bp, Homo sapien
tcttgggggacctgctcattgatga

SEQ ID NO: 31826 - DNA, 25 bp, Homo sapien
gacaaggacacagttcgaggccagg

SEQ ID NO: 31827 - DNA, 25 bp, Homo sapien
gccaggaggagaccccaagctggga

SEQ ID NO: 31828 - DNA, 25 bp, Homo sapien
caagctgggagcacatcttgttcac

SEQ ID NO: 31829 - DNA, 25 bp, Homo sapien
gatagcaagcgcggagctgcgcagc

SEQ ID NO: 31830 - DNA, 25 bp, Homo sapien
gctgcgcagcgggaatgagcgggga

SEQ ID NO: 31831 - DNA, 25 bp, Homo sapien
ggaatgagcggggatgccgcgggca

SEQ ID NO: 31832 - DNA, 25 bp, Homo sapien
aggaagggcaggcccacaggggcca

SEQ ID NO: 31833 - DNA, 25 bp, Homo sapien
gcatcagtgaatcgggccacatctg

SEQ ID NO: 31834 - DNA, 25 bp, Homo sapien
tcagtgaatcgggccacatctgcag

SEQ ID NO: 31835 - DNA, 25 bp, Homo sapien
atctgcagccagatgttcgaaggcc

SEQ ID NO: 31836 - DNA, 25 bp, Homo sapien
gcagccagatgttcgaaggccagat

SEQ ID NO: 31837 - DNA, 25 bp, Homo sapien
ccgggaccacgtggtgctatgggag

SEQ ID NO: 31838 - DNA, 25 bp, Homo sapien
gtggtgctatgggagccggatgagg

SEQ ID NO: 31839 - DNA, 25 bp, Homo sapien
gatgaggacagggcatcccagatct

SEQ ID NO: 31840 - DNA, 25 bp, Homo sapien
gggcatcccagatctggactatcca

SEQ ID NO: 31841 - DNA, 25 bp, Homo sapien
agatctggactatccacgtgctttg

SEQ ID NO: 31842 - DNA, 25 bp, Homo sapien
ggactatccacgtgctttgaaactt

SEQ ID NO: 31843 - DNA, 25 bp, Homo sapien
tccagccctggaggcttttgctggg

SEQ ID NO: 31844 - DNA, 25 bp, Homo sapien
caagaagctcaaccggtattccgac

SEQ ID NO: 31845 - DNA, 25 bp, Homo sapien
agaagctcaaccggtattccgacgg

SEQ ID NO: 31846 - DNA, 25 bp, Homo sapien
ctccggtcacggcaaggccatgacc

SEQ ID NO: 31847 - DNA, 25 bp, Homo sapien
ggcaaggccatgaccagatgtcctc

SEQ ID NO: 31848 - DNA, 25 bp, Homo sapien
cttccagcatgagcggctcgtgtgg

SEQ ID NO: 31849 - DNA, 25 bp, Homo sapien
gcatgagcggctcgtgtggaaggag

SEQ ID NO: 31850 - DNA, 25 bp, Homo sapien
gagcggctcgtgtggaaggaggaga

SEQ ID NO: 31851 - DNA, 25 bp, Homo sapien
cactgccgggcttcgcagtacaagc

SEQ ID NO: 31852 - DNA, 25 bp, Homo sapien
tgccgggcttcgcagtacaagctgc

SEQ ID NO: 31853 - DNA, 25 bp, Homo sapien
gcagtacaagctgcgcaagtcctcc

SEQ ID NO: 31854 - DNA, 25 bp, Homo sapien
cccacctcaagaagctcaaccggta

SEQ ID NO: 31855 - DNA, 25 bp, Homo sapien
aaacacagtcagactcttcccattg

SEQ ID NO: 31856 - DNA, 25 bp, Homo sapien
cttcccattgtcatctgattgcaga

SEQ ID NO: 31857 - DNA, 25 bp, Homo sapien
gagagaaagcacaccttatttccag

SEQ ID NO: 31858 - DNA, 25 bp, Homo sapien
ggaaagctacaacaagcccaaggtc

SEQ ID NO: 31859 - DNA, 25 bp, Homo sapien
aagcccaaggtcaaagtgtattatt

SEQ ID NO: 31860 - DNA, 25 bp, Homo sapien
tgtcttgttgttgtctattttctcc

SEQ ID NO: 31861 - DNA, 25 bp, Homo sapien
ttgttgttgtctattttctcccaat

SEQ ID NO: 31862 - DNA, 25 bp, Homo sapien
ttggggaagtacagcccatgctgac

SEQ ID NO: 31863 - DNA, 25 bp, Homo sapien
gtacagcccatgctgacattatttt

SEQ ID NO: 31864 - DNA, 25 bp, Homo sapien
acattattttcaggctattcttaga

SEQ ID NO: 31865 - DNA, 25 bp, Homo sapien
tatacaagttgttaggccaggtgca

SEQ ID NO: 31866 - DNA, 25 bp, Homo sapien
gtttggtggctaaaatgcccgcctt

SEQ ID NO: 31867 - DNA, 25 bp, Homo sapien
ctgcccccaatttcacacatggatg

SEQ ID NO: 31868 - DNA, 25 bp, Homo sapien
cagggaagattctcttggacccgtg

SEQ ID NO: 31869 - DNA, 25 bp, Homo sapien
gacccgtgtctgctggttgggaagt

SEQ ID NO: 31870 - DNA, 25 bp, Homo sapien
gggaagtggagaaagccgccctgtt

SEQ ID NO: 31871 - DNA, 25 bp, Homo sapien
tgcctccattttgaaacgtcttttc

SEQ ID NO: 31872 - DNA, 25 bp, Homo sapien
gctggttcagatgttcatgagcacc

SEQ ID NO: 31873 - DNA, 25 bp, Homo sapien
cccgtcacacttgaggacaccaagg

SEQ ID NO: 31874 - DNA, 25 bp, Homo sapien
ggacaccaaggctgtggtctgtgca

SEQ ID NO: 31875 - DNA, 25 bp, Homo sapien
ggtctgtgcagtgaatcggggcagt

SEQ ID NO: 31876 - DNA, 25 bp, Homo sapien
gcagtggggggacttcatggttaga

SEQ ID NO: 31877 - DNA, 25 bp, Homo sapien
gaacctgagagggcagcagcggacc

SEQ ID NO: 31878 - DNA, 25 bp, Homo sapien
agcggacccggcttctgaataaatt

SEQ ID NO: 31879 - DNA, 25 bp, Homo sapien
gggtgcaatgcaggtggcggacaag

SEQ ID NO: 31880 - DNA, 25 bp, Homo sapien
gaaaaacacgacatggtccggcgag

SEQ ID NO: 31881 - DNA, 25 bp, Homo sapien
ggtccggcgaggagagatcatcgac

SEQ ID NO: 31882 - DNA, 25 bp, Homo sapien
cgaggaggagttctacctccggcgc

SEQ ID NO: 31883 - DNA, 25 bp, Homo sapien
tcccccagattcgccagagggttca

SEQ ID NO: 31884 - DNA, 25 bp, Homo sapien
agagggttcaccagatcctaaacat

SEQ ID NO: 31885 - DNA, 25 bp, Homo sapien
ggaagctccatcaaaattgtcaggc

SEQ ID NO: 31886 - DNA, 25 bp, Homo sapien
agagaacatcggggacggccggagc

SEQ ID NO: 31887 - DNA, 25 bp, Homo sapien
gagcaaaagcgcatcctgggcttgc

SEQ ID NO: 31888 - DNA, 25 bp, Homo sapien
caatgtgatcaagccttcagtcgcc

SEQ ID NO: 31889 - DNA, 25 bp, Homo sapien
tcccttcacctccacgaaagaattc

SEQ ID NO: 31890 - DNA, 25 bp, Homo sapien
tcacctccacgaaagaattcatact

SEQ ID NO: 31891 - DNA, 25 bp, Homo sapien
aatgcggtaaagcctacactcgttc

SEQ ID NO: 31892 - DNA, 25 bp, Homo sapien
agtcaccttactcgccatgaaagaa

SEQ ID NO: 31893 - DNA, 25 bp, Homo sapien
accttactcgccatgaaagaagtca

SEQ ID NO: 31894 - DNA, 25 bp, Homo sapien
gaagtcatgatatagaggctgggtg

SEQ ID NO: 31895 - DNA, 25 bp, Homo sapien
gctgggtgtagtgactcagcctata

SEQ ID NO: 31896 - DNA, 25 bp, Homo sapien
ggtgtagtgactcagcctataatcc

SEQ ID NO: 31897 - DNA, 25 bp, Homo sapien
aacaatgtgaaacaacctgggcaac

SEQ ID NO: 31898 - DNA, 25 bp, Homo sapien
aataaaataatgccgggcacggtgg

SEQ ID NO: 31899 - DNA, 25 bp, Homo sapien
acgccaagacagacacgctgcagat

SEQ ID NO: 31900 - DNA, 25 bp, Homo sapien
agacacgctgcagatcgaggacttt

SEQ ID NO: 31901 - DNA, 25 bp, Homo sapien
acacgctgcagatcgaggactttct

SEQ ID NO: 31902 - DNA, 25 bp, Homo sapien
gctgcagatcgaggactttctggag

SEQ ID NO: 31903 - DNA, 25 bp, Homo sapien
cgaggactttctggaggagacgctg

SEQ ID NO: 31904 - DNA, 25 bp, Homo sapien
gcctcgttacagggagtccaacacc

SEQ ID NO: 31905 - DNA, 25 bp, Homo sapien
tcgttacagggagtccaacaccgcc

SEQ ID NO: 31906 - DNA, 25 bp, Homo sapien
gcaacgacgttttccacaagttctc

SEQ ID NO: 31907 - DNA, 25 bp, Homo sapien
caagttctccgcgttcatcaagaac

SEQ ID NO: 31908 - DNA, 25 bp, Homo sapien
ttctccgcgttcatcaagaacccgg

SEQ ID NO: 31909 - DNA, 25 bp, Homo sapien
tccgcgttcatcaagaacccggtgc

SEQ ID NO: 31910 - DNA, 25 bp, Homo sapien
tatggattggggtgtatttttaata

SEQ ID NO: 31911 - DNA, 25 bp, Homo sapien
tcctgagttacttcattagcaactg

SEQ ID NO: 31912 - DNA, 25 bp, Homo sapien
gttacttcattagcaactgttactt

SEQ ID NO: 31913 - DNA, 25 bp, Homo sapien
agcaactgttacttcaaccatctag

SEQ ID NO: 31914 - DNA, 25 bp, Homo sapien
aactgttacttcaaccatctaggtt

SEQ ID NO: 31915 - DNA, 25 bp, Homo sapien
taggttgaggttttccagtaattct

SEQ ID NO: 31916 - DNA, 25 bp, Homo sapien
ttttccagtaattctaggtcagcaa

SEQ ID NO: 31917 - DNA, 25 bp, Homo sapien
aggtcagcaattatggaccctactt

SEQ ID NO: 31918 - DNA, 25 bp, Homo sapien
caattatggaccctacttattttct

SEQ ID NO: 31919 - DNA, 25 bp, Homo sapien
ttctgtctttgcgatagtttgctca

SEQ ID NO: 31920 - DNA, 25 bp, Homo sapien
ctgtctttgcgatagtttgctcaga

SEQ ID NO: 31921 - DNA, 25 bp, Homo sapien
aaagctgtggtggatctgaatggga

SEQ ID NO: 31922 - DNA, 25 bp, Homo sapien
gggtcttggatctagcagagcaagt

SEQ ID NO: 31923 - DNA, 25 bp, Homo sapien
gaggagccggacagaccaagatctc

SEQ ID NO: 31924 - DNA, 25 bp, Homo sapien
actccttccttgctaacatgggtgg

SEQ ID NO: 31925 - DNA, 25 bp, Homo sapien
gtatggcttccgggaaggtcaggga

SEQ ID NO: 31926 - DNA, 25 bp, Homo sapien
ggtcagggactggggaaacacgagc

SEQ ID NO: 31927 - DNA, 25 bp, Homo sapien
aagggctgagtactgcattgtctgt

SEQ ID NO: 31928 - DNA, 25 bp, Homo sapien
ggcggcaagatcattgtgggggatg

SEQ ID NO: 31929 - DNA, 25 bp, Homo sapien
gtgggggatgcgacagagaagggcg

SEQ ID NO: 31930 - DNA, 25 bp, Homo sapien
gaagggcgaggctcaggatgcatcc

SEQ ID NO: 31931 - DNA, 25 bp, Homo sapien
gaaattcttaagtgccctactaaag

SEQ ID NO: 31932 - DNA, 25 bp, Homo sapien
gaaattccatcaatacatctagaca

SEQ ID NO: 31933 - DNA, 25 bp, Homo sapien
atctagacagatgtttgcttgtagt

SEQ ID NO: 31934 - DNA, 25 bp, Homo sapien
tttgcttgtagtttttggtatccaa

SEQ ID NO: 31935 - DNA, 25 bp, Homo sapien
tttccacacatcgcacagatgcctt

SEQ ID NO: 31936 - DNA, 25 bp, Homo sapien
ccttttttgtaggcacagccctggc

SEQ ID NO: 31937 - DNA, 25 bp, Homo sapien
cagccctggcagtaatgagaacctg

SEQ ID NO: 31938 - DNA, 25 bp, Homo sapien
gagaacctggttggtgcacagaact

SEQ ID NO: 31939 - DNA, 25 bp, Homo sapien
ggttggtgcacagaacttttacaaa

SEQ ID NO: 31940 - DNA, 25 bp, Homo sapien
agaacttattctttccatatggatc

SEQ ID NO: 31941 - DNA, 25 bp, Homo sapien
catatggatcaaatcttgctttttt

SEQ ID NO: 31942 - DNA, 25 bp, Homo sapien
aacagtaccaagtttcttttcacat

SEQ ID NO: 31943 - DNA, 25 bp, Homo sapien
taggggggagatttgaccggcaggc

SEQ ID NO: 31944 - DNA, 25 bp, Homo sapien
cttctacaacgctgactacctggcg

SEQ ID NO: 31945 - DNA, 25 bp, Homo sapien
cccggctggcaggtgaactggcagg

SEQ ID NO: 31946 - DNA, 25 bp, Homo sapien
tggcaggtgaactggcaggccagga

SEQ ID NO: 31947 - DNA, 25 bp, Homo sapien
aggggctggaggtgatggatgtttt

SEQ ID NO: 31948 - DNA, 25 bp, Homo sapien
gccgtagagccagggctggtgcaga

SEQ ID NO: 31949 - DNA, 25 bp, Homo sapien
cagggctggtgcagaagttctccct

SEQ ID NO: 31950 - DNA, 25 bp, Homo sapien
gcccacggctcagtgaagaactcta

SEQ ID NO: 31951 - DNA, 25 bp, Homo sapien
tcagtgaagaactctaccaccgctg

SEQ ID NO: 31952 - DNA, 25 bp, Homo sapien
ctggctatggctctctttgagcagg

SEQ ID NO: 31953 - DNA, 25 bp, Homo sapien
agcaggccaatagcacttagcccgc

SEQ ID NO: 31954 - DNA, 25 bp, Homo sapien
cgccggccgcagtgatggcgaacac

SEQ ID NO: 31955 - DNA, 25 bp, Homo sapien
tgatggcgaacacgaaggccgtctc

SEQ ID NO: 31956 - DNA, 25 bp, Homo sapien
tctcccgaatgtcctgttgcaggat

SEQ ID NO: 31957 - DNA, 25 bp, Homo sapien
gtcctgttgcaggatgcgtccaaag

SEQ ID NO: 31958 - DNA, 25 bp, Homo sapien
atgcgtccaaaggccttgctgtggc

SEQ ID NO: 31959 - DNA, 25 bp, Homo sapien
gctgtggctggagcaattccagcgg

SEQ ID NO: 31960 - DNA, 25 bp, Homo sapien
gagcaattccagcggcggaagcgga

SEQ ID NO: 31961 - DNA, 25 bp, Homo sapien
gcggcggaagcggaactggaactgg

SEQ ID NO: 31962 - DNA, 25 bp, Homo sapien
ccttcctgcagatgctggtagggtc

SEQ ID NO: 31963 - DNA, 25 bp, Homo sapien
tggtagggtccataaccaaggggct

SEQ ID NO: 31964 - DNA, 25 bp, Homo sapien
ttcagtgcgagcgcggcgagcgcaa

SEQ ID NO: 31965 - DNA, 25 bp, Homo sapien
aaactatttcaactactgtaattag

SEQ ID NO: 31966 - DNA, 25 bp, Homo sapien
tgtaattagtcagctttcctcaaaa

SEQ ID NO: 31967 - DNA, 25 bp, Homo sapien
ctttcctcaaaactgtctcctagtt

SEQ ID NO: 31968 - DNA, 25 bp, Homo sapien
aaactgtctcctagttatccacatt

SEQ ID NO: 31969 - DNA, 25 bp, Homo sapien
gtctcctagttatccacattaacat

SEQ ID NO: 31970 - DNA, 25 bp, Homo sapien
catggaggtgattcttgttaaaggt

SEQ ID NO: 31971 - DNA, 25 bp, Homo sapien
gaaaagttctaaaactcgccattat

SEQ ID NO: 31972 - DNA, 25 bp, Homo sapien
ctcgccattataagacacacacaac

SEQ ID NO: 31973 - DNA, 25 bp, Homo sapien
aacttctctgctacgaaaagtcttg

SEQ ID NO: 31974 - DNA, 25 bp, Homo sapien
gtcttgattgattctggcctcagga

SEQ ID NO: 31975 - DNA, 25 bp, Homo sapien
gaggggcagggtttgaaagatatga

SEQ ID NO: 31976 - DNA, 25 bp, Homo sapien
aggagatgagacctaccttccagtt

SEQ ID NO: 31977 - DNA, 25 bp, Homo sapien
ctaccttccagttgtcagcaagcag

SEQ ID NO: 31978 - DNA, 25 bp, Homo sapien
ttgggacctcagttgcaaccacaag

SEQ ID NO: 31979 - DNA, 25 bp, Homo sapien
agaagagtactccaagcttcagatg

SEQ ID NO: 31980 - DNA, 25 bp, Homo sapien
gcttcagatgataaccacagcctgg

SEQ ID NO: 31981 - DNA, 25 bp, Homo sapien
gcatgatcctcagtatgagaatcta

SEQ ID NO: 31982 - DNA, 25 bp, Homo sapien
tgagaatctatctgttctgtgctgg

SEQ ID NO: 31983 - DNA, 25 bp, Homo sapien
tgttctgtgctggacttctaatata

SEQ ID NO: 31984 - DNA, 25 bp, Homo sapien
tgagataatgggtcacattggctgg

SEQ ID NO: 31985 - DNA, 25 bp, Homo sapien
aattagacgagcgtggtggtggaca

SEQ ID NO: 31986 - DNA, 25 bp, Homo sapien
ggcaggagactagctggaaccaggg

SEQ ID NO: 31987 - DNA, 25 bp, Homo sapien
agcaagagaattcccactctctctc

SEQ ID NO: 31988 - DNA, 25 bp, Homo sapien
aatctatcattatacagcacagagt

SEQ ID NO: 31989 - DNA, 25 bp, Homo sapien
agcacagagtggagccaagttttta

SEQ ID NO: 31990 - DNA, 25 bp, Homo sapien
gagtggagccaagtttttaattttg

SEQ ID NO: 31991 - DNA, 25 bp, Homo sapien
aggatcaaatatgaaaaccctttct

SEQ ID NO: 31992 - DNA, 25 bp, Homo sapien
ttcttttattgggccacattgtaga

SEQ ID NO: 31993 - DNA, 25 bp, Homo sapien
gggccacattgtagatgctgatttg

SEQ ID NO: 31994 - DNA, 25 bp, Homo sapien
tgataattgtttcctatgcagatag

SEQ ID NO: 31995 - DNA, 25 bp, Homo sapien
gtttgcatttatgaatcttgctgcc

SEQ ID NO: 31996 - DNA, 25 bp, Homo sapien
tcttgctgccttttagcaccaggat

SEQ ID NO: 31997 - DNA, 25 bp, Homo sapien
gctgccttttagcaccaggatgttt

SEQ ID NO: 31998 - DNA, 25 bp, Homo sapien
ctactaggtaccaggccctattacg

SEQ ID NO: 31999 - DNA, 25 bp, Homo sapien
ggccctattacggctgccaatgggg

SEQ ID NO: 32000 - DNA, 25 bp, Homo sapien
gctgccaatggggggcatggggcgg

SEQ ID NO: 32001 - DNA, 25 bp, Homo sapien
cagtgagcaaaactcttgccccacg

SEQ ID NO: 32002 - DNA, 25 bp, Homo sapien
gagccagcgctgcagtgaaagagac

SEQ ID NO: 32003 - DNA, 25 bp, Homo sapien
gaaatacagagcatgagccaagaca

SEQ ID NO: 32004 - DNA, 25 bp, Homo sapien
gagccaagacattagaatctggaac

SEQ ID NO: 32005 - DNA, 25 bp, Homo sapien
tgtaggtagtgatatgtgtgttagg

SEQ ID NO: 32006 - DNA, 25 bp, Homo sapien
aataaggccgagagaggggagtgat

SEQ ID NO: 32007 - DNA, 25 bp, Homo sapien
gagagacctctctaagaaggtgagc

SEQ ID NO: 32008 - DNA, 25 bp, Homo sapien
gaaggtgagcacttaggccgggtgc

SEQ ID NO: 32009 - DNA, 25 bp, Homo sapien
cttcttctgagaattgtctactcat

SEQ ID NO: 32010 - DNA, 25 bp, Homo sapien
gagaattgtctactcatgtcctcag

SEQ ID NO: 32011 - DNA, 25 bp, Homo sapien
tgtcctcagcccagtttttgatggg

SEQ ID NO: 32012 - DNA, 25 bp, Homo sapien
ctcagcccagtttttgatgggattg

SEQ ID NO: 32013 - DNA, 25 bp, Homo sapien
gtagattatagatattagtcctttg

SEQ ID NO: 32014 - DNA, 25 bp, Homo sapien
tagtcctttgtcagatgtatagatt

SEQ ID NO: 32015 - DNA, 25 bp, Homo sapien
gctgtgcagaagtttttatgaagca

SEQ ID NO: 32016 - DNA, 25 bp, Homo sapien
ttatgaagcaagtctttggggagga

SEQ ID NO: 32017 - DNA, 25 bp, Homo sapien
agtctttggggaggatattttgtct

SEQ ID NO: 32018 - DNA, 25 bp, Homo sapien
ggggaggatattttgtctcataaaa

SEQ ID NO: 32019 - DNA, 25 bp, Homo sapien
aagaaagtggattccagccgggcgc

SEQ ID NO: 32020 - DNA, 25 bp, Homo sapien
ttgctggaaatgattccaagtcctt

SEQ ID NO: 32021 - DNA, 25 bp, Homo sapien
agtcctttagtaattctttgagata

SEQ ID NO: 32022 - DNA, 25 bp, Homo sapien
gatattggggaattgcctcttccag

SEQ ID NO: 32023 - DNA, 25 bp, Homo sapien
cttcactgcctcatatccatgaaac

SEQ ID NO: 32024 - DNA, 25 bp, Homo sapien
gaaagatttgcagatgtccttaaca

SEQ ID NO: 32025 - DNA, 25 bp, Homo sapien
atgtccttaacatctatctgtagca

SEQ ID NO: 32026 - DNA, 25 bp, Homo sapien
atctatctgtagcatatttccaata

SEQ ID NO: 32027 - DNA, 25 bp, Homo sapien
gcaccaggaccacaaaaggttccat

SEQ ID NO: 32028 - DNA, 25 bp, Homo sapien
gaagccttctcttcttattaagaca

SEQ ID NO: 32029 - DNA, 25 bp, Homo sapien
agctgtgagcttgcactccaaagtt

SEQ ID NO: 32030 - DNA, 25 bp, Homo sapien
tccaaagtttttataacactccctg

SEQ ID NO: 32031 - DNA, 25 bp, Homo sapien
gcaccgggtacacttaacgtgtctc

SEQ ID NO: 32032 - DNA, 25 bp, Homo sapien
acgtgtctctataagccaagttgct

SEQ ID NO: 32033 - DNA, 25 bp, Homo sapien
aagccaagttgcttcaggaccttca

SEQ ID NO: 32034 - DNA, 25 bp, Homo sapien
tcaccactggcctctagaatggtcc

SEQ ID NO: 32035 - DNA, 25 bp, Homo sapien
ctgggggacatgtgtgcccatctgg

SEQ ID NO: 32036 - DNA, 25 bp, Homo sapien
gtgagtggacctgacaagtgccaga

SEQ ID NO: 32037 - DNA, 25 bp, Homo sapien
agtgccagagtaaccgtgtagacag

SEQ ID NO: 32038 - DNA, 25 bp, Homo sapien
gagcagtgtagacagcgctcagccc

SEQ ID NO: 32039 - DNA, 25 bp, Homo sapien
ccccaggtgtggacctcatgctggt

SEQ ID NO: 32040 - DNA, 25 bp, Homo sapien
ccagcacagccagtgccatcaggga

SEQ ID NO: 32041 - DNA, 25 bp, Homo sapien
agagctggtcccagcatggggtgca

SEQ ID NO: 32042 - DNA, 25 bp, Homo sapien
gcagcccctcggaggcagaggaagg

SEQ ID NO: 32043 - DNA, 25 bp, Homo sapien
ggaaggaaaatggggatggctgggg

SEQ ID NO: 32044 - DNA, 25 bp, Homo sapien
cccctttgccatagcctgattttgg

SEQ ID NO: 32045 - DNA, 25 bp, Homo sapien
ggaggaaggggcgatttgagggaga

SEQ ID NO: 32046 - DNA, 25 bp, Homo sapien
gagaaagcttatggctgggtctggt

SEQ ID NO: 32047 - DNA, 25 bp, Homo sapien
tcccagagggtcttactgttccagg

SEQ ID NO: 32048 - DNA, 25 bp, Homo sapien
ccagagggtcttactgttccagggt

SEQ ID NO: 32049 - DNA, 25 bp, Homo sapien
gcagactggatttttgctctgcccc

SEQ ID NO: 32050 - DNA, 25 bp, Homo sapien
gggaggggagctatgctaggactcc

SEQ ID NO: 32051 - DNA, 25 bp, Homo sapien
gggagctatgctaggactccaacct

SEQ ID NO: 32052 - DNA, 25 bp, Homo sapien
ctgcgctagcttcttttgatactga

SEQ ID NO: 32053 - DNA, 25 bp, Homo sapien
gatgggttttgttgtgtcttgtgaa

SEQ ID NO: 32054 - DNA, 25 bp, Homo sapien
gaaggtgttcccactgatacaaaaa

SEQ ID NO: 32055 - DNA, 25 bp, Homo sapien
acaaggatggagttctggtggatga

SEQ ID NO: 32056 - DNA, 25 bp, Homo sapien
atttggattgccacagatccctgct

SEQ ID NO: 32057 - DNA, 25 bp, Homo sapien
gatccctgcttcatagatttgcatc

SEQ ID NO: 32058 - DNA, 25 bp, Homo sapien
tttatctttccaaatttgccataac

SEQ ID NO: 32059 - DNA, 25 bp, Homo sapien
gccataacagatttaggtttctttc

SEQ ID NO: 32060 - DNA, 25 bp, Homo sapien
ttttttccattaagagactcattgc

SEQ ID NO: 32061 - DNA, 25 bp, Homo sapien
gagactcattgcttgggaaatgctt

SEQ ID NO: 32062 - DNA, 25 bp, Homo sapien
aatgctttcttcgtactaaaatttg

SEQ ID NO: 32063 - DNA, 25 bp, Homo sapien
gtatttttagctcgtatgacttgtt

SEQ ID NO: 32064 - DNA, 25 bp, Homo sapien
tctttgttcctaatgacgtggactt

SEQ ID NO: 32065 - DNA, 25 bp, Homo sapien
gtggactttagcatgcagagcagca

SEQ ID NO: 32066 - DNA, 25 bp, Homo sapien
gcagcaaagagagagcaaccaccaa

SEQ ID NO: 32067 - DNA, 25 bp, Homo sapien
gactggtctgagtgctctagcacct

SEQ ID NO: 32068 - DNA, 25 bp, Homo sapien
gccggctggcagaggcgaactgtag

SEQ ID NO: 32069 - DNA, 25 bp, Homo sapien
gaactgtagagtgcagggacccctc

SEQ ID NO: 32070 - DNA, 25 bp, Homo sapien
aggtatggggcggcaaaacctatca

SEQ ID NO: 32071 - DNA, 25 bp, Homo sapien
ggcggcaaaacctatcatcaactgt

SEQ ID NO: 32072 - DNA, 25 bp, Homo sapien
aatggaacttgctcgggttcaatta

SEQ ID NO: 32073 - DNA, 25 bp, Homo sapien
acttgctcgggttcaattaaaggca

SEQ ID NO: 32074 - DNA, 25 bp, Homo sapien
attcattatgatcaacagacctcac

SEQ ID NO: 32075 - DNA, 25 bp, Homo sapien
ttttcaccccgtctacaatattttg

SEQ ID NO: 32076 - DNA, 25 bp, Homo sapien
tagtgtttcactccagagacttcaa

SEQ ID NO: 32077 - DNA, 25 bp, Homo sapien
cggaggattctctattatgtgctat

SEQ ID NO: 32078 - DNA, 25 bp, Homo sapien
ggattctctattatgtgctatctga

SEQ ID NO: 32079 - DNA, 25 bp, Homo sapien
atttgagcatagtttctccactgtc

SEQ ID NO: 32080 - DNA, 25 bp, Homo sapien
gtttctccactgtcagagacgactg

SEQ ID NO: 32081 - DNA, 25 bp, Homo sapien
gagacgactgttattttattttcaa

SEQ ID NO: 32082 - DNA, 25 bp, Homo sapien
aagtagcagcacaatacgtacatat

SEQ ID NO: 32083 - DNA, 25 bp, Homo sapien
tacgtacatataaaccctatgagta

SEQ ID NO: 32084 - DNA, 25 bp, Homo sapien
aattatgtctgttctgtttgatcac

SEQ ID NO: 32085 - DNA, 25 bp, Homo sapien
gagactcgtggtgtggaattacaag

SEQ ID NO: 32086 - DNA, 25 bp, Homo sapien
gccaaggctcgaagagagaagaaaa

SEQ ID NO: 32087 - DNA, 25 bp, Homo sapien
aagttaaaagtatcacaaagtcgtg

SEQ ID NO: 32088 - DNA, 25 bp, Homo sapien
gtcgtgaagaaaggaaaggccaaga

SEQ ID NO: 32089 - DNA, 25 bp, Homo sapien
gccaagaaagccctaaaagagtttg

SEQ ID NO: 32090 - DNA, 25 bp, Homo sapien
gccctaaaagagtttgagcagctgc

SEQ ID NO: 32091 - DNA, 25 bp, Homo sapien
gagtttgagcagctgcggaaggtta

SEQ ID NO: 32092 - DNA, 25 bp, Homo sapien
gagcagctgcggaaggttaatccag

SEQ ID NO: 32093 - DNA, 25 bp, Homo sapien
cggaaggttaatccagctgccgcac

SEQ ID NO: 32094 - DNA, 25 bp, Homo sapien
ttaatccagctgccgcactagaaga

SEQ ID NO: 32095 - DNA, 25 bp, Homo sapien
cagctgccgcactagaagaacgaag

SEQ ID NO: 32096 - DNA, 25 bp, Homo sapien
gctgccgcactagaagaacgaagaa

SEQ ID NO: 32097 - DNA, 25 bp, Homo sapien
agagtggctaggagtcttggcccag

SEQ ID NO: 32098 - DNA, 25 bp, Homo sapien
cccagagtccttcagaggcaagtct

SEQ ID NO: 32099 - DNA, 25 bp, Homo sapien
agaggcaagtctggtaggtcacaca

SEQ ID NO: 32100 - DNA, 25 bp, Homo sapien
aagcccagcagtactatgtgtgtag

SEQ ID NO: 32101 - DNA, 25 bp, Homo sapien
ctatgtgtgtagtgctgcagcaggg

SEQ ID NO: 32102 - DNA, 25 bp, Homo sapien
agacccccagagcattgtagtcagc

SEQ ID NO: 32103 - DNA, 25 bp, Homo sapien
gtagtcagcagtaacaccatcaaaa

SEQ ID NO: 32104 - DNA, 25 bp, Homo sapien
aaacaggtatctagccttcctgggc

SEQ ID NO: 32105 - DNA, 25 bp, Homo sapien
cctgggcctctgtagtgaatgtaca

SEQ ID NO: 32106 - DNA, 25 bp, Homo sapien
gtctagcccgcaagtacaaaaccat

SEQ ID NO: 32107 - DNA, 25 bp, Homo sapien
tggtgatgcgcacccataatccagc

SEQ ID NO: 32108 - DNA, 25 bp, Homo sapien
tggaagccaacctggctgtcctgaa

SEQ ID NO: 32109 - DNA, 25 bp, Homo sapien
gaagctgtaccagttcaacccagcc

SEQ ID NO: 32110 - DNA, 25 bp, Homo sapien
gtgcatgatcgaccaggcacatcaa

SEQ ID NO: 32111 - DNA, 25 bp, Homo sapien
cagattttgtacctcggggacctgc

SEQ ID NO: 32112 - DNA, 25 bp, Homo sapien
tgctggagacctgccatttccaggc

SEQ ID NO: 32113 - DNA, 25 bp, Homo sapien
aggccttctggaaagccctggatga

SEQ ID NO: 32114 - DNA, 25 bp, Homo sapien
aactggctttgaagactctgtccga

SEQ ID NO: 32115 - DNA, 25 bp, Homo sapien
ctctgtccgaaagtttatctgccat

SEQ ID NO: 32116 - DNA, 25 bp, Homo sapien
atcacttaccagcacattgaccgct

SEQ ID NO: 32117 - DNA, 25 bp, Homo sapien
gccgacgagtcggggcagatcttca

SEQ ID NO: 32118 - DNA, 25 bp, Homo sapien
tgacagtgtgtccagcatcatggcc

SEQ ID NO: 32119 - DNA, 25 bp, Homo sapien
cttgtgcccggtgtgtggcaaggcc

SEQ ID NO: 32120 - DNA, 25 bp, Homo sapien
cgccacctcaaatctcacttggagg

SEQ ID NO: 32121 - DNA, 25 bp, Homo sapien
tcacttggaggacaagccctaccgc

SEQ ID NO: 32122 - DNA, 25 bp, Homo sapien
tgagccacaactgctggacacacac

SEQ ID NO: 32123 - DNA, 25 bp, Homo sapien
acagagaggaggaagtctcccccgc

SEQ ID NO: 32124 - DNA, 25 bp, Homo sapien
tctcccccgccagggatgttgttga

SEQ ID NO: 32125 - DNA, 25 bp, Homo sapien
ggagaagtgctttgtggtgccagag

SEQ ID NO: 32126 - DNA, 25 bp, Homo sapien
cccagcctggtgctaatccataagg

SEQ ID NO: 32127 - DNA, 25 bp, Homo sapien
tccataaggacatgggcctcggcgc

SEQ ID NO: 32128 - DNA, 25 bp, Homo sapien
gcgcctgggcagaggtggtggaggt

SEQ ID NO: 32129 - DNA, 25 bp, Homo sapien
agatgggcacctgacagctttgcct

SEQ ID NO: 32130 - DNA, 25 bp, Homo sapien
gaatactcataattcttatctctat

SEQ ID NO: 32131 - DNA, 25 bp, Homo sapien
tcataattcttatctctataatcaa

SEQ ID NO: 32132 - DNA, 25 bp, Homo sapien
gagatgcttgttctgaaagtaagat

SEQ ID NO: 32133 - DNA, 25 bp, Homo sapien
gatcagtgaactgcttttcagtctc

SEQ ID NO: 32134 - DNA, 25 bp, Homo sapien
actgcttttcagtctcaatctttga

SEQ ID NO: 32135 - DNA, 25 bp, Homo sapien
gcaaatatgttaatcttctcatttt

SEQ ID NO: 32136 - DNA, 25 bp, Homo sapien
cttctcatttttttactgtcatata

SEQ ID NO: 32137 - DNA, 25 bp, Homo sapien
tttactgtcatataatcttagtgat

SEQ ID NO: 32138 - DNA, 25 bp, Homo sapien
aaattggctcatctggctttttgaa

SEQ ID NO: 32139 - DNA, 25 bp, Homo sapien
gatgttgattaggtatatctacaaa

SEQ ID NO: 32140 - DNA, 25 bp, Homo sapien
taagtatttttcttgtgtatgtata

SEQ ID NO: 32141 - DNA, 25 bp, Homo sapien
gcctttgggaacagggtcagcatcc

SEQ ID NO: 32142 - DNA, 25 bp, Homo sapien
gtcagcatccacggcaatggtgcca

SEQ ID NO: 32143 - DNA, 25 bp, Homo sapien
cactgcatgtgtcagcctcatgact

SEQ ID NO: 32144 - DNA, 25 bp, Homo sapien
gcctcatgactacaaaccagaccag

SEQ ID NO: 32145 - DNA, 25 bp, Homo sapien
aaccagaccagatgggcttggctat

SEQ ID NO: 32146 - DNA, 25 bp, Homo sapien
gggcttggctattgtcatgcccaag

SEQ ID NO: 32147 - DNA, 25 bp, Homo sapien
ggtttggtgacctggccatgaggac

SEQ ID NO: 32148 - DNA, 25 bp, Homo sapien
ggtagtagagctgggcttcagaccc

SEQ ID NO: 32149 - DNA, 25 bp, Homo sapien
ctttccatgagctgagtctctgcct

SEQ ID NO: 32150 - DNA, 25 bp, Homo sapien
tccaagctctgcccatgtgtgtggc

SEQ ID NO: 32151 - DNA, 25 bp, Homo sapien
aaggccagacagggcggggtgtggt

SEQ ID NO: 32152 - DNA, 25 bp, Homo sapien
taccaggtattgcgcttaagggaca

SEQ ID NO: 32153 - DNA, 25 bp, Homo sapien
tttcttcgcccggacaacttgaatg

SEQ ID NO: 32154 - DNA, 25 bp, Homo sapien
ctgttgattccacttctgtcgagga

SEQ ID NO: 32155 - DNA, 25 bp, Homo sapien
ctgtcgaggagcttcggggctcaga

SEQ ID NO: 32156 - DNA, 25 bp, Homo sapien
cagagaggtgatgacgtgcccaagg

SEQ ID NO: 32157 - DNA, 25 bp, Homo sapien
atgacgtgcccaaggtgacgcaact

SEQ ID NO: 32158 - DNA, 25 bp, Homo sapien
tgacgcaactcgtgaacagccgtgc

SEQ ID NO: 32159 - DNA, 25 bp, Homo sapien
ggctcttcaacacggcatttagcgc

SEQ ID NO: 32160 - DNA, 25 bp, Homo sapien
agcgcagaaagtcgtggttcaggca

SEQ ID NO: 32161 - DNA, 25 bp, Homo sapien
tcaggcagtatgggccgctgtgaca

SEQ ID NO: 32162 - DNA, 25 bp, Homo sapien
aagaacagacattcaggccaggcac

SEQ ID NO: 32163 - DNA, 25 bp, Homo sapien
aggacatcgaggctgcggtgaacca

SEQ ID NO: 32164 - DNA, 25 bp, Homo sapien
ggctgcggtgaaccatgattgtacc

SEQ ID NO: 32165 - DNA, 25 bp, Homo sapien
tattccagcctggacgactgagtga

SEQ ID NO: 32166 - DNA, 25 bp, Homo sapien
gatttctgattgcctcactcaagat

SEQ ID NO: 32167 - DNA, 25 bp, Homo sapien
gattgcctcactcaagataaggtca

SEQ ID NO: 32168 - DNA, 25 bp, Homo sapien
ggtcaacattgaaggtggaggtgga

SEQ ID NO: 32169 - DNA, 25 bp, Homo sapien
gatgcagtttatgtaggggtctgaa

SEQ ID NO: 32170 - DNA, 25 bp, Homo sapien
gggtctgaagattttaccattctgg

SEQ ID NO: 32171 - DNA, 25 bp, Homo sapien
gaaaagtgaacgtctgaccgggcgc

SEQ ID NO: 32172 - DNA, 25 bp, Homo sapien
ccagcacttaaggagtacgagacgg

SEQ ID NO: 32173 - DNA, 25 bp, Homo sapien
tcaagagatcgacagcatgctggcc

SEQ ID NO: 32174 - DNA, 25 bp, Homo sapien
aacataaagtgtctgagccctcgag

SEQ ID NO: 32175 - DNA, 25 bp, Homo sapien
agatcctcatccctaagtctgagta

SEQ ID NO: 32176 - DNA, 25 bp, Homo sapien
aagaacttggactgaccttgaagag

SEQ ID NO: 32177 - DNA, 25 bp, Homo sapien
gtaaccatgatgttgttcttgggaa

SEQ ID NO: 32178 - DNA, 25 bp, Homo sapien
atgaatccacttatgggacgccgca

SEQ ID NO: 32179 - DNA, 25 bp, Homo sapien
ttatgggacgccgcagacatgctac

SEQ ID NO: 32180 - DNA, 25 bp, Homo sapien
ccgcagacatgctaccctaataatg

SEQ ID NO: 32181 - DNA, 25 bp, Homo sapien
ggaagattgcaccagtcaagagggg

SEQ ID NO: 32182 - DNA, 25 bp, Homo sapien
gaagtcctcctacatcggagctgat

SEQ ID NO: 32183 - DNA, 25 bp, Homo sapien
agtcagattcacacttgggaaatga

SEQ ID NO: 32184 - DNA, 25 bp, Homo sapien
acataagtcaagaccaaccacctgg

SEQ ID NO: 32185 - DNA, 25 bp, Homo sapien
tgatcatgtacaaggccatctggta

SEQ ID NO: 32186 - DNA, 25 bp, Homo sapien
gtacaaggccatctggtacgaccag

SEQ ID NO: 32187 - DNA, 25 bp, Homo sapien
atctggtacgaccagttcacctgcc

SEQ ID NO: 32188 - DNA, 25 bp, Homo sapien
ttcctgctgcggcacaagatctgca

SEQ ID NO: 32189 - DNA, 25 bp, Homo sapien
tgctgcggcacaagatctgcacgcc

SEQ ID NO: 32190 - DNA, 25 bp, Homo sapien
gcggcacaagatctgcacgccgctg

SEQ ID NO: 32191 - DNA, 25 bp, Homo sapien
gaccctggagatgtactacacggag

SEQ ID NO: 32192 - DNA, 25 bp, Homo sapien
actacacggagatggaccccgagcg

SEQ ID NO: 32193 - DNA, 25 bp, Homo sapien
ctgagccgcaagcacggcacggaga

SEQ ID NO: 32194 - DNA, 25 bp, Homo sapien
agccgcaagcacggcacggagacgc

SEQ ID NO: 32195 - DNA, 25 bp, Homo sapien
aagccgtcggccaaggcggagaagg

SEQ ID NO: 32196 - DNA, 25 bp, Homo sapien
tggaggaacccactaggccgtggat

SEQ ID NO: 32197 - DNA, 25 bp, Homo sapien
gaacccactaggccgtggatagagc

SEQ ID NO: 32198 - DNA, 25 bp, Homo sapien
gatagagcagagccatgttgacaca

SEQ ID NO: 32199 - DNA, 25 bp, Homo sapien
gcggccgatcactggaaccagggaa

SEQ ID NO: 32200 - DNA, 25 bp, Homo sapien
gaaccagggaagtgacctcatagca

SEQ ID NO: 32201 - DNA, 25 bp, Homo sapien
gaagtgacctcatagcaagggcccg

SEQ ID NO: 32202 - DNA, 25 bp, Homo sapien
ctcatagcaagggcccgcagagcag

SEQ ID NO: 32203 - DNA, 25 bp, Homo sapien
ttggtttctggacccagctctggaa

SEQ ID NO: 32204 - DNA, 25 bp, Homo sapien
ggctgacagctcactggaacttttc

SEQ ID NO: 32205 - DNA, 25 bp, Homo sapien
cactggaacttttcatctgcttggc

SEQ ID NO: 32206 - DNA, 25 bp, Homo sapien
gaagcaggccgagggtggtggctca

SEQ ID NO: 32207 - DNA, 25 bp, Homo sapien
gggaagtaggtgatgccagccctca

SEQ ID NO: 32208 - DNA, 25 bp, Homo sapien
ctgtcttcagccagggacttgagaa

SEQ ID NO: 32209 - DNA, 25 bp, Homo sapien
cagtggctccaatctgtggaccagt

SEQ ID NO: 32210 - DNA, 25 bp, Homo sapien
gaaggactatatttgtactgtaccc

SEQ ID NO: 32211 - DNA, 25 bp, Homo sapien
gattttagggtgcagctacgctcac

SEQ ID NO: 32212 - DNA, 25 bp, Homo sapien
taaacttttggtggcctggggcatg

SEQ ID NO: 32213 - DNA, 25 bp, Homo sapien
ggggcatgtcttgaggcccagactg

SEQ ID NO: 32214 - DNA, 25 bp, Homo sapien
tgctgtcttgagactccatccagcc

SEQ ID NO: 32215 - DNA, 25 bp, Homo sapien
ccactatctccctgtgacgggtgaa

SEQ ID NO: 32216 - DNA, 25 bp, Homo sapien
ggtgaacttcgtgtactgtgtctcg

SEQ ID NO: 32217 - DNA, 25 bp, Homo sapien
gtactgtgtctcgggtccatatatg

SEQ ID NO: 32218 - DNA, 25 bp, Homo sapien
tagacggaagctcctcagtcttaga

SEQ ID NO: 32219 - DNA, 25 bp, Homo sapien
gaaggtggatttctcagccacgttc

SEQ ID NO: 32220 - DNA, 25 bp, Homo sapien
ttctcagccacgttcaacctgatga

SEQ ID NO: 32221 - DNA, 25 bp, Homo sapien
aacctgatgagttcactgcttcttc

SEQ ID NO: 32222 - DNA, 25 bp, Homo sapien
actgcttcttccccaaacattgcag

SEQ ID NO: 32223 - DNA, 25 bp, Homo sapien
tgggctgtgaacttacgtgtgatgt

SEQ ID NO: 32224 - DNA, 25 bp, Homo sapien
tgcaaatgctcagacgacacacacg

SEQ ID NO: 32225 - DNA, 25 bp, Homo sapien
acacgacctaccctgatggtttgga

SEQ ID NO: 32226 - DNA, 25 bp, Homo sapien
cagacagatcagaccctctagttgc

SEQ ID NO: 32227 - DNA, 25 bp, Homo sapien
aaagctcagggcggtcgagtgcagt

SEQ ID NO: 32228 - DNA, 25 bp, Homo sapien
ctccagcccgggttacagtgtgagg

SEQ ID NO: 32229 - DNA, 25 bp, Homo sapien
agtgctgggttcaaagggctgtgtg

SEQ ID NO: 32230 - DNA, 25 bp, Homo sapien
gtgtgtgggtgcacacatctgtccc

SEQ ID NO: 32231 - DNA, 25 bp, Homo sapien
tatgcagtgagacctgtctacctcc

SEQ ID NO: 32232 - DNA, 25 bp, Homo sapien
gtctacctcccacaaggagcaaggg

SEQ ID NO: 32233 - DNA, 25 bp, Homo sapien
ctgctcattcctacccaggtagtgg

SEQ ID NO: 32234 - DNA, 25 bp, Homo sapien
ttccagaggggtctcactgacagcc

SEQ ID NO: 32235 - DNA, 25 bp, Homo sapien
gctgtggatcaaggaaggctgcccc

SEQ ID NO: 32236 - DNA, 25 bp, Homo sapien
gatgcagaggtggaaggccctgggc

SEQ ID NO: 32237 - DNA, 25 bp, Homo sapien
cacaggcgagagtgggcgtgtcacc

SEQ ID NO: 32238 - DNA, 25 bp, Homo sapien
gttcccagcaagtctgcagctgtgc

SEQ ID NO: 32239 - DNA, 25 bp, Homo sapien
ccttgcaaggaacgtctcttccggc

SEQ ID NO: 32240 - DNA, 25 bp, Homo sapien
gctgcaggccaagggctttagctcc

SEQ ID NO: 32241 - DNA, 25 bp, Homo sapien
aggagggggcacgtgtgtacagcca

SEQ ID NO: 32242 - DNA, 25 bp, Homo sapien
agcgctcgctgctggaggacaaaga

SEQ ID NO: 32243 - DNA, 25 bp, Homo sapien
caggcgcccttcgcaaagagtgacg

SEQ ID NO: 32244 - DNA, 25 bp, Homo sapien
gtgggagaacggactcctcagactc

SEQ ID NO: 32245 - DNA, 25 bp, Homo sapien
tcagactctccccaatagcggaagt

SEQ ID NO: 32246 - DNA, 25 bp, Homo sapien
ctgaaggatggccaatctgctccgg

SEQ ID NO: 32247 - DNA, 25 bp, Homo sapien
cagacttaacgatccttgctgcagt

SEQ ID NO: 32248 - DNA, 25 bp, Homo sapien
gcagtccctccggagaggatctgga

SEQ ID NO: 32249 - DNA, 25 bp, Homo sapien
tggggagggcgtggagacagtctac

SEQ ID NO: 32250 - DNA, 25 bp, Homo sapien
ctagcagacccccgagagggtgcaa

SEQ ID NO: 32251 - DNA, 25 bp, Homo sapien
ggtctatcaccctggttgatcaact

SEQ ID NO: 32252 - DNA, 25 bp, Homo sapien
caaaggcccctacttgatggttttg

SEQ ID NO: 32253 - DNA, 25 bp, Homo sapien
ggcaacattgactcatttgcccctt

SEQ ID NO: 32254 - DNA, 25 bp, Homo sapien
cttggcgacgcagggggcctagaga

SEQ ID NO: 32255 - DNA, 25 bp, Homo sapien
gcctagagagccccgtgatggacgg

SEQ ID NO: 32256 - DNA, 25 bp, Homo sapien
cttggagacaggtcggtgctcctcc

SEQ ID NO: 32257 - DNA, 25 bp, Homo sapien
tcctcccccatgagggcttggggcg

SEQ ID NO: 32258 - DNA, 25 bp, Homo sapien
caagagctacttgcccgaaggtacg

SEQ ID NO: 32259 - DNA, 25 bp, Homo sapien
gacagggagagcctgagacgccctt

SEQ ID NO: 32260 - DNA, 25 bp, Homo sapien
ggtgccctgatgagcggtgagaagc

SEQ ID NO: 32261 - DNA, 25 bp, Homo sapien
tttcccccattaattgtgacaagcc

SEQ ID NO: 32262 - DNA, 25 bp, Homo sapien
gtcgctgtcaatggtcaccgagact

SEQ ID NO: 32263 - DNA, 25 bp, Homo sapien
ggagccagaatctgagcctcagctg

SEQ ID NO: 32264 - DNA, 25 bp, Homo sapien
ctgtcggtcaagcagcgggacgtac

SEQ ID NO: 32265 - DNA, 25 bp, Homo sapien
caggcgcccttcgcaaagagtgacg

SEQ ID NO: 32266 - DNA, 25 bp, Homo sapien
gtgggagaacggactcctcagactc

SEQ ID NO: 32267 - DNA, 25 bp, Homo sapien
tcagactctccccaatagcggaagt

SEQ ID NO: 32268 - DNA, 25 bp, Homo sapien
ctgaaggatggccaatctgctccgg

SEQ ID NO: 32269 - DNA, 25 bp, Homo sapien
cagacttaacgatccttgctgcagt

SEQ ID NO: 32270 - DNA, 25 bp, Homo sapien
ctgcagtccctccggagaggatctg

SEQ ID NO: 32271 - DNA, 25 bp, Homo sapien
gagaggatctggactggctgggagt

SEQ ID NO: 32272 - DNA, 25 bp, Homo sapien
tctacggaaagcgctagcagacccc

SEQ ID NO: 32273 - DNA, 25 bp, Homo sapien
ccctggggtaggggcatcatttcag

SEQ ID NO: 32274 - DNA, 25 bp, Homo sapien
tggggtaggggcatcatttcagtga

SEQ ID NO: 32275 - DNA, 25 bp, Homo sapien
gggtaggggcatcatttcagtgaga

SEQ ID NO: 32276 - DNA, 25 bp, Homo sapien
ttcagtgagaatcagatgttttctg

SEQ ID NO: 32277 - DNA, 25 bp, Homo sapien
ccctgggtggtggacctgtggagaa

SEQ ID NO: 32278 - DNA, 25 bp, Homo sapien
tcccttggtttcccaagctctggga

SEQ ID NO: 32279 - DNA, 25 bp, Homo sapien
cctctgacaactctttcattcatga

SEQ ID NO: 32280 - DNA, 25 bp, Homo sapien
ctgacaactctttcattcatgatgt

SEQ ID NO: 32281 - DNA, 25 bp, Homo sapien
gaatatggggaatgacctgagagcc

SEQ ID NO: 32282 - DNA, 25 bp, Homo sapien
ggggaatgacctgagagccacactc

SEQ ID NO: 32283 - DNA, 25 bp, Homo sapien
tgacctgagagccacactcagctcc

SEQ ID NO: 32284 - DNA, 25 bp, Homo sapien
gcccggtctgaagctcaagtgagga

SEQ ID NO: 32285 - DNA, 25 bp, Homo sapien
ttaatgaatttggtgtgatttgttg

SEQ ID NO: 32286 - DNA, 25 bp, Homo sapien
ctcgccccactggtaaaacatgggt

SEQ ID NO: 32287 - DNA, 25 bp, Homo sapien
gtaaaacatgggtcttggtcccagc

SEQ ID NO: 32288 - DNA, 25 bp, Homo sapien
ccctcccagtttttagcttgaatga

SEQ ID NO: 32289 - DNA, 25 bp, Homo sapien
ccagaagcatcttgtgttgtatatg

SEQ ID NO: 32290 - DNA, 25 bp, Homo sapien
aagcatcttgtgttgtatatgtgtg

SEQ ID NO: 32291 - DNA, 25 bp, Homo sapien
gacagaagccacggtcctaagagcc

SEQ ID NO: 32292 - DNA, 25 bp, Homo sapien
gaagccacggtcctaagagccggtt

SEQ ID NO: 32293 - DNA, 25 bp, Homo sapien
gtcctaagagccggttttatcctcg

SEQ ID NO: 32294 - DNA, 25 bp, Homo sapien
taagagccggttttatcctcgtcat

SEQ ID NO: 32295 - DNA, 25 bp, Homo sapien
cccgaggacgacgacgaggacgagg

SEQ ID NO: 32296 - DNA, 25 bp, Homo sapien
cgaggaggacacggtgactcggctg

SEQ ID NO: 32297 - DNA, 25 bp, Homo sapien
tcttcacgtcggcggaggagctgga

SEQ ID NO: 32298 - DNA, 25 bp, Homo sapien
cgcagcggctggaggagcgcgaacg

SEQ ID NO: 32299 - DNA, 25 bp, Homo sapien
ctggaggagcgcgaacggatcctgc

SEQ ID NO: 32300 - DNA, 25 bp, Homo sapien
cggatcctgcgggagatctggcgca

SEQ ID NO: 32301 - DNA, 25 bp, Homo sapien
gcatgcactattactgatgggcccc

SEQ ID NO: 32302 - DNA, 25 bp, Homo sapien
cggacctgcacatgagctcagagct

SEQ ID NO: 32303 - DNA, 25 bp, Homo sapien
cacatgagctcagagctaccccaca

SEQ ID NO: 32304 - DNA, 25 bp, Homo sapien
acagctcccaggtgctactgggcgt

SEQ ID NO: 32305 - DNA, 25 bp, Homo sapien
ctccctctctggggtcgatgaagag

SEQ ID NO: 32306 - DNA, 25 bp, Homo sapien
acaatggcgaggtgcgcaccgccag

SEQ ID NO: 32307 - DNA, 25 bp, Homo sapien
ccaggctgctgagcgagcgagacgc

SEQ ID NO: 32308 - DNA, 25 bp, Homo sapien
agcgagacgcagccaagcacaggct

SEQ ID NO: 32309 - DNA, 25 bp, Homo sapien
tcaaggacaatggcgagcctccgcg

SEQ ID NO: 32310 - DNA, 25 bp, Homo sapien
caccgtctacctggtggtggcgttg

SEQ ID NO: 32311 - DNA, 25 bp, Homo sapien
gcggctgtgcaggaggagcagggcg

SEQ ID NO: 32312 - DNA, 25 bp, Homo sapien
tccctttccagggcatctggtggat

SEQ ID NO: 32313 - DNA, 25 bp, Homo sapien
ctatcccagagctaccagtacaagg

SEQ ID NO: 32314 - DNA, 25 bp, Homo sapien
agttcctgaagccgattatgcccaa

SEQ ID NO: 32315 - DNA, 25 bp, Homo sapien
cttccctcctcagggcactgagaga

SEQ ID NO: 32316 - DNA, 25 bp, Homo sapien
tctcggaatagcttcccgttcagtt

SEQ ID NO: 32317 - DNA, 25 bp, Homo sapien
gaaactgcatcttgcagcttttcgg

SEQ ID NO: 32318 - DNA, 25 bp, Homo sapien
aggttgacgatggctctgaactctc

SEQ ID NO: 32319 - DNA, 25 bp, Homo sapien
aaaacggaggtctcatctgtgtcct

SEQ ID NO: 32320 - DNA, 25 bp, Homo sapien
ccaagctggccatcgtgggcattgc

SEQ ID NO: 32321 - DNA, 25 bp, Homo sapien
ttggttggagcaggtactggcccca

SEQ ID NO: 32322 - DNA, 25 bp, Homo sapien
cacggcctgaagacttcatgcggcc

SEQ ID NO: 32323 - DNA, 25 bp, Homo sapien
ggggtgcagtcttacatgattgtcc

SEQ ID NO: 32324 - DNA, 25 bp, Homo sapien
ctggccatccgagcggtggcaaagc

SEQ ID NO: 32325 - DNA, 25 bp, Homo sapien
agaaggaagtgacgcgcatggtggt

SEQ ID NO: 32326 - DNA, 25 bp, Homo sapien
atctacaaccccgttatctatgtct

SEQ ID NO: 32327 - DNA, 25 bp, Homo sapien
atctatgtctttatgaaccggcagt

SEQ ID NO: 32328 - DNA, 25 bp, Homo sapien
tagccgaccatggtggtgcatgcct

SEQ ID NO: 32329 - DNA, 25 bp, Homo sapien
ggtaagaggatcacctaagcctgtg

SEQ ID NO: 32330 - DNA, 25 bp, Homo sapien
aagcctgtgaggtcatggttgcaat

SEQ ID NO: 32331 - DNA, 25 bp, Homo sapien
caatgagtcatgatcacgccactgc

SEQ ID NO: 32332 - DNA, 25 bp, Homo sapien
gcgacacagtaagaccctgtctcaa

SEQ ID NO: 32333 - DNA, 25 bp, Homo sapien
aagaagtgtgtttctggccaggcac

SEQ ID NO: 32334 - DNA, 25 bp, Homo sapien
ggaggcctaggtgggcagatcatga

SEQ ID NO: 32335 - DNA, 25 bp, Homo sapien
gccaacatggcgaaacacctgtctc

SEQ ID NO: 32336 - DNA, 25 bp, Homo sapien
actttgggaggccgacccagatggg

SEQ ID NO: 32337 - DNA, 25 bp, Homo sapien
aggccgacccagatgggtggatcac

SEQ ID NO: 32338 - DNA, 25 bp, Homo sapien
cagtaagccaagatcgtgcctctgc

SEQ ID NO: 32339 - DNA, 25 bp, Homo sapien
gttggggttggagacgtgtgtaata

SEQ ID NO: 32340 - DNA, 25 bp, Homo sapien
ggtttcatttgtttgacctgacacc

SEQ ID NO: 32341 - DNA, 25 bp, Homo sapien
gacctgacacctgccaaggtgttgg

SEQ ID NO: 32342 - DNA, 25 bp, Homo sapien
cttctgggcaccacgagacactaat

SEQ ID NO: 32343 - DNA, 25 bp, Homo sapien
tcggagaggagcagcgtccagtctt

SEQ ID NO: 32344 - DNA, 25 bp, Homo sapien
cctgccaacaccaaggtcatgctga

SEQ ID NO: 32345 - DNA, 25 bp, Homo sapien
caaggtcatgctgatcagcgacatc

SEQ ID NO: 32346 - DNA, 25 bp, Homo sapien
gggctacacagaccgtgtggtgcga

SEQ ID NO: 32347 - DNA, 25 bp, Homo sapien
cgagctttccgctgggaggagctag

SEQ ID NO: 32348 - DNA, 25 bp, Homo sapien
gagctaggtgagggtcctgaacatc

SEQ ID NO: 32349 - DNA, 25 bp, Homo sapien
ctgaacatctgacagggcagctggt

SEQ ID NO: 32350 - DNA, 25 bp, Homo sapien
gagatcgtgtctgtaataggttggc

SEQ ID NO: 32351 - DNA, 25 bp, Homo sapien
tgtaataggttggcacggcgcctgg

SEQ ID NO: 32352 - DNA, 25 bp, Homo sapien
gtaagtgcccaggacatgagctgtt

SEQ ID NO: 32353 - DNA, 25 bp, Homo sapien
catgagctgttctaataactgggta

SEQ ID NO: 32354 - DNA, 25 bp, Homo sapien
atggaatccaggattccgccaccca

SEQ ID NO: 32355 - DNA, 25 bp, Homo sapien
tctgggccactctgaataggacctg

SEQ ID NO: 32356 - DNA, 25 bp, Homo sapien
ccactctgaataggacctggcccac

SEQ ID NO: 32357 - DNA, 25 bp, Homo sapien
ctggcccacaggaagcccattgtaa

SEQ ID NO: 32358 - DNA, 25 bp, Homo sapien
agcccattgtaaattttagctcttc

SEQ ID NO: 32359 - DNA, 25 bp, Homo sapien
attttagctcttcttgatcacagta

SEQ ID NO: 32360 - DNA, 25 bp, Homo sapien
gttggccacgtgtaatggctcatgc

SEQ ID NO: 32361 - DNA, 25 bp, Homo sapien
cggcgcgccctgggagtggaaggcg

SEQ ID NO: 32362 - DNA, 25 bp, Homo sapien
gcgcgccctgggagtggaaggcggc

SEQ ID NO: 32363 - DNA, 25 bp, Homo sapien
gcgccctgggagtggaaggcggcgg

SEQ ID NO: 32364 - DNA, 25 bp, Homo sapien
ccctgggagtggaaggcggcgggcg

SEQ ID NO: 32365 - DNA, 25 bp, Homo sapien
gctcgtcggtcagcgacgtggacca

SEQ ID NO: 32366 - DNA, 25 bp, Homo sapien
gtcggtcagcgacgtggaccaggag

SEQ ID NO: 32367 - DNA, 25 bp, Homo sapien
gtcagcgacgtggaccaggaggagc

SEQ ID NO: 32368 - DNA, 25 bp, Homo sapien
agcgacgtggaccaggaggagccgc

SEQ ID NO: 32369 - DNA, 25 bp, Homo sapien
cgtggccaccgtcaacctggccacg

SEQ ID NO: 32370 - DNA, 25 bp, Homo sapien
gggctacttccgcaagatgcaggcg

SEQ ID NO: 32371 - DNA, 25 bp, Homo sapien
ctacttccgcaagatgcaggcgcgc

SEQ ID NO: 32372 - DNA, 25 bp, Homo sapien
gaaatcattgtgtctgcattggtca

SEQ ID NO: 32373 - DNA, 25 bp, Homo sapien
ctgcattggtcaagatcctggaggc

SEQ ID NO: 32374 - DNA, 25 bp, Homo sapien
ggaggccaacatggacatcgtctac

SEQ ID NO: 32375 - DNA, 25 bp, Homo sapien
gatatggtcaccaagatgcagcagg

SEQ ID NO: 32376 - DNA, 25 bp, Homo sapien
gtaatgtctcagattgcgaatgtga

SEQ ID NO: 32377 - DNA, 25 bp, Homo sapien
ggcattgcatgcccagcaagatcgg

SEQ ID NO: 32378 - DNA, 25 bp, Homo sapien
agatcgaaactgaggttgctggcct

SEQ ID NO: 32379 - DNA, 25 bp, Homo sapien
aaccatgcttgagtcacacaagctt

SEQ ID NO: 32380 - DNA, 25 bp, Homo sapien
tacgtgcctaacagtagctctggga

SEQ ID NO: 32381 - DNA, 25 bp, Homo sapien
gtagctctgggattttatcgcctgt

SEQ ID NO: 32382 - DNA, 25 bp, Homo sapien
ggattttatcgcctgtggatctaat

SEQ ID NO: 32383 - DNA, 25 bp, Homo sapien
accagaacggcgtgcacaactacga

SEQ ID NO: 32384 - DNA, 25 bp, Homo sapien
ctctacacgggagacttcttcctcc

SEQ ID NO: 32385 - DNA, 25 bp, Homo sapien
tctacacgggagacttcttcctcca

SEQ ID NO: 32386 - DNA, 25 bp, Homo sapien
gcagggccagaggtgaccctgcctg

SEQ ID NO: 32387 - DNA, 25 bp, Homo sapien
agcgcagtggcgaggcgagtgtgga

SEQ ID NO: 32388 - DNA, 25 bp, Homo sapien
gcagtggcgaggcgagtgtggaagg

SEQ ID NO: 32389 - DNA, 25 bp, Homo sapien
gagtgtggaaggactcctgaaccag

SEQ ID NO: 32390 - DNA, 25 bp, Homo sapien
tgtggaaggactcctgaaccagctc

SEQ ID NO: 32391 - DNA, 25 bp, Homo sapien
gatgtgctggtggacggacagccat

SEQ ID NO: 32392 - DNA, 25 bp, Homo sapien
gtgctggtggacggacagccatgtg

SEQ ID NO: 32393 - DNA, 25 bp, Homo sapien
tggtggacggacagccatgtgaccg

SEQ ID NO: 32394 - DNA, 25 bp, Homo sapien
ggcaggtggatgacttgagctcagg

SEQ ID NO: 32395 - DNA, 25 bp, Homo sapien
atgatgaaaactccgtctctaccaa

SEQ ID NO: 32396 - DNA, 25 bp, Homo sapien
tagccaggtgtgatgttgtgcgcct

SEQ ID NO: 32397 - DNA, 25 bp, Homo sapien
ttgggccccggaggtagaggttgca

SEQ ID NO: 32398 - DNA, 25 bp, Homo sapien
tgccactgtattccatcctgggcaa

SEQ ID NO: 32399 - DNA, 25 bp, Homo sapien
tcctgggcaacagagccagaccctg

SEQ ID NO: 32400 - DNA, 25 bp, Homo sapien
aaaaaggcctggcacagtggctcac

SEQ ID NO: 32401 - DNA, 25 bp, Homo sapien
tgaggcgggcaaaacacttgaggtc

SEQ ID NO: 32402 - DNA, 25 bp, Homo sapien
cgtggtggcatgtgcctatagcccc

SEQ ID NO: 32403 - DNA, 25 bp, Homo sapien
ggaagctagagcacgagaattatgt

SEQ ID NO: 32404 - DNA, 25 bp, Homo sapien
gagaattatgtgcatcctggaggtg

SEQ ID NO: 32405 - DNA, 25 bp, Homo sapien
ttgcttgttccccggaggttgaagc

SEQ ID NO: 32406 - DNA, 25 bp, Homo sapien
gcttgttccccggaggttgaagcta

SEQ ID NO: 32407 - DNA, 25 bp, Homo sapien
aaaagtacttctacagccatgtcct

SEQ ID NO: 32408 - DNA, 25 bp, Homo sapien
aaagtacttctacagccatgtccta

SEQ ID NO: 32409 - DNA, 25 bp, Homo sapien
atgtcctattccttgatcatccaaa

SEQ ID NO: 32410 - DNA, 25 bp, Homo sapien
tgtcctattccttgatcatccaaag

SEQ ID NO: 32411 - DNA, 25 bp, Homo sapien
tgatcatccaaagcacctgcagagt

SEQ ID NO: 32412 - DNA, 25 bp, Homo sapien
gatcatccaaagcacctgcagagtc

SEQ ID NO: 32413 - DNA, 25 bp, Homo sapien
tcatccaaagcacctgcagagtcca

SEQ ID NO: 32414 - DNA, 25 bp, Homo sapien
gagtccagtgaaatgatatattctg

SEQ ID NO: 32415 - DNA, 25 bp, Homo sapien
gtgaaatgatatattctggctgggc

SEQ ID NO: 32416 - DNA, 25 bp, Homo sapien
ggggctttgaaataacaccaccagt

SEQ ID NO: 32417 - DNA, 25 bp, Homo sapien
caccaccagtggtcttaaggttgaa

SEQ ID NO: 32418 - DNA, 25 bp, Homo sapien
gaagtgtggttcagggccagtgcat

SEQ ID NO: 32419 - DNA, 25 bp, Homo sapien
gggccagtgcatattagtggacagc

SEQ ID NO: 32420 - DNA, 25 bp, Homo sapien
tatatctggaaagcggtctgcccct

SEQ ID NO: 32421 - DNA, 25 bp, Homo sapien
tctgcccctggaggtggtagcaagg

SEQ ID NO: 32422 - DNA, 25 bp, Homo sapien
gagatactccagccaaaaatgcaca

SEQ ID NO: 32423 - DNA, 25 bp, Homo sapien
gactcaaaaccatcatcaacaccaa

SEQ ID NO: 32424 - DNA, 25 bp, Homo sapien
acaccaaaaggacctagttctgtag

SEQ ID NO: 32425 - DNA, 25 bp, Homo sapien
aaagcgcattgaacagtcctgggca

SEQ ID NO: 32426 - DNA, 25 bp, Homo sapien
aacagtcctgggcactacatgtaaa

SEQ ID NO: 32427 - DNA, 25 bp, Homo sapien
tggggaatggtgtcatccacctcgc

SEQ ID NO: 32428 - DNA, 25 bp, Homo sapien
gtcatccacctcgctttaaaaataa

SEQ ID NO: 32429 - DNA, 25 bp, Homo sapien
taagcacatgatggctgggcaccgt

SEQ ID NO: 32430 - DNA, 25 bp, Homo sapien
gggtcctgccagagtctgcagggga

SEQ ID NO: 32431 - DNA, 25 bp, Homo sapien
atgatcttacttccaaatctccttg

SEQ ID NO: 32432 - DNA, 25 bp, Homo sapien
aatctccttggaatttcacgacagc

SEQ ID NO: 32433 - DNA, 25 bp, Homo sapien
atttcacgacagcacagactgactt

SEQ ID NO: 32434 - DNA, 25 bp, Homo sapien
agactgactttataccttcatttca

SEQ ID NO: 32435 - DNA, 25 bp, Homo sapien
aaccgattaacacttctaatgagtc

SEQ ID NO: 32436 - DNA, 25 bp, Homo sapien
ctaatgagtcaagtcctagggtttt

SEQ ID NO: 32437 - DNA, 25 bp, Homo sapien
gttgccaacgaggaacacagctttg

SEQ ID NO: 32438 - DNA, 25 bp, Homo sapien
accaaattcacgcgcaaggagttgc

SEQ ID NO: 32439 - DNA, 25 bp, Homo sapien
caaccatgatggctcggtcagtttt

SEQ ID NO: 32440 - DNA, 25 bp, Homo sapien
ggactttgtggctggtttgtccgtg

SEQ ID NO: 32441 - DNA, 25 bp, Homo sapien
tttgtggctggtttgtccgtgattc

SEQ ID NO: 32442 - DNA, 25 bp, Homo sapien
tggtttgtccgtgattcttcgggga

SEQ ID NO: 32443 - DNA, 25 bp, Homo sapien
cggggaactgtagatgacaggctta

SEQ ID NO: 32444 - DNA, 25 bp, Homo sapien
gacaggcttaattgggccttcaacc

SEQ ID NO: 32445 - DNA, 25 bp, Homo sapien
gcttaattgggccttcaacctgtat

SEQ ID NO: 32446 - DNA, 25 bp, Homo sapien
gccttcaacctgtatgaccttaaca

SEQ ID NO: 32447 - DNA, 25 bp, Homo sapien
gcatcaccaaggaggaaatgcttga

SEQ ID NO: 32448 - DNA, 25 bp, Homo sapien
ggaggccccaagggaacacgtggag

SEQ ID NO: 32449 - DNA, 25 bp, Homo sapien
ctcttctcatctggttcagaactta

SEQ ID NO: 32450 - DNA, 25 bp, Homo sapien
gaacttagaagggcgtggcctctga

SEQ ID NO: 32451 - DNA, 25 bp, Homo sapien
ctgtcccttgagagccaggaatggc

SEQ ID NO: 32452 - DNA, 25 bp, Homo sapien
ggctcttagcagtgggcagtgagcc

SEQ ID NO: 32453 - DNA, 25 bp, Homo sapien
gtgagcccccgagaggataaagcgg

SEQ ID NO: 32454 - DNA, 25 bp, Homo sapien
gagaggataaagcggctgctcgaac

SEQ ID NO: 32455 - DNA, 25 bp, Homo sapien
aagcggctgctcgaacagattgcga

SEQ ID NO: 32456 - DNA, 25 bp, Homo sapien
gattgcgagcacattacttgctgca

SEQ ID NO: 32457 - DNA, 25 bp, Homo sapien
gcacattacttgctgcatgggagga

SEQ ID NO: 32458 - DNA, 25 bp, Homo sapien
caaatcaaagattccttgagggcat

SEQ ID NO: 32459 - DNA, 25 bp, Homo sapien
atgtcaagagcatcactgttgttat

SEQ ID NO: 32460 - DNA, 25 bp, Homo sapien
ataaaagcacactatcatctgaaaa

SEQ ID NO: 32461 - DNA, 25 bp, Homo sapien
tgaaaaagctattaaatacccctct

SEQ ID NO: 32462 - DNA, 25 bp, Homo sapien
ccctctttttccaaatatctacctg

SEQ ID NO: 32463 - DNA, 25 bp, Homo sapien
atctacctgtgtgaagccaggtttt

SEQ ID NO: 32464 - DNA, 25 bp, Homo sapien
gtatggtatttcagctgccttctat

SEQ ID NO: 32465 - DNA, 25 bp, Homo sapien
ttcagctgccttctatcaaggctaa

SEQ ID NO: 32466 - DNA, 25 bp, Homo sapien
gctactctccttaccaaattgtttt

SEQ ID NO: 32467 - DNA, 25 bp, Homo sapien
atgtgtagcaatcaaatcagggtaa

SEQ ID NO: 32468 - DNA, 25 bp, Homo sapien
accttttcttctagctatttatcca

SEQ ID NO: 32469 - DNA, 25 bp, Homo sapien
cttctagctatttatccattgttgg

SEQ ID NO: 32470 - DNA, 25 bp, Homo sapien
atcaattctatatcttagctgttgt

SEQ ID NO: 32471 - DNA, 25 bp, Homo sapien
aattctatgctatattgttgatcaa

SEQ ID NO: 32472 - DNA, 25 bp, Homo sapien
aaatgtgaccttgtacagtttacta

SEQ ID NO: 32473 - DNA, 25 bp, Homo sapien
ttcactacattgagacagttactgt

SEQ ID NO: 32474 - DNA, 25 bp, Homo sapien
gacacaaacaccagctattgcctgc

SEQ ID NO: 32475 - DNA, 25 bp, Homo sapien
caccagctattgcctgcatctggga

SEQ ID NO: 32476 - DNA, 25 bp, Homo sapien
gcatctgggaaattgctgaatcgca

SEQ ID NO: 32477 - DNA, 25 bp, Homo sapien
ctgaatcgcacagcagtcatgtcat

SEQ ID NO: 32478 - DNA, 25 bp, Homo sapien
cgcacagcagtcatgtcataatcag

SEQ ID NO: 32479 - DNA, 25 bp, Homo sapien
tagatactaaatacagacacttcaa

SEQ ID NO: 32480 - DNA, 25 bp, Homo sapien
attttgttgaagctattgactgtac

SEQ ID NO: 32481 - DNA, 25 bp, Homo sapien
agtgttacatatggctttgtacatt

SEQ ID NO: 32482 - DNA, 25 bp, Homo sapien
caccatggccatgactgtggtcacc

SEQ ID NO: 32483 - DNA, 25 bp, Homo sapien
ggccatgactgtggtcaccaaagaa

SEQ ID NO: 32484 - DNA, 25 bp, Homo sapien
agaacaagaaagttcccaccatctt

SEQ ID NO: 32485 - DNA, 25 bp, Homo sapien
tcctgagcaagaaaccccgagaaaa

SEQ ID NO: 32486 - DNA, 25 bp, Homo sapien
ggaggtggattctaagagccaggtc

SEQ ID NO: 32487 - DNA, 25 bp, Homo sapien
ggattctaagagccaggtcattgaa

SEQ ID NO: 32488 - DNA, 25 bp, Homo sapien
ccaggtcattgaaggcatcagccgc

SEQ ID NO: 32489 - DNA, 25 bp, Homo sapien
tcattgaaggcatcagccgcctcat

SEQ ID NO: 32490 - DNA, 25 bp, Homo sapien
tcaggagtggttgaggacacagggc

SEQ ID NO: 32491 - DNA, 25 bp, Homo sapien
gcgtctcctgggccagagagaggag

SEQ ID NO: 32492 - DNA, 25 bp, Homo sapien
gagggactgagttgatgttgggttt

SEQ ID NO: 32493 - DNA, 25 bp, Homo sapien
gctgcactgaggggctgggtgctgg

SEQ ID NO: 32494 - DNA, 25 bp, Homo sapien
tgctggggaggggctggtaggaggg

SEQ ID NO: 32495 - DNA, 25 bp, Homo sapien
tggtaggagggagggtgggcccact

SEQ ID NO: 32496 - DNA, 25 bp, Homo sapien
ggcccactgctttggaggtgatggg

SEQ ID NO: 32497 - DNA, 25 bp, Homo sapien
cgctttgagctgcgcgaggacgggc

SEQ ID NO: 32498 - DNA, 25 bp, Homo sapien
gcaccagcgacttcgtaattcacgg

SEQ ID NO: 32499 - DNA, 25 bp, Homo sapien
cagcgacttcgtaattcacgggatc

SEQ ID NO: 32500 - DNA, 25 bp, Homo sapien
tcacgggatcatccatggggtcacc

SEQ ID NO: 32501 - DNA, 25 bp, Homo sapien
tcacccatgacgtggagctgcagga

SEQ ID NO: 32502 - DNA, 25 bp, Homo sapien
gctgcaggagtctgtcatcactgtg

SEQ ID NO: 32503 - DNA, 25 bp, Homo sapien
tcatgggctggagccgctttgggga

SEQ ID NO: 32504 - DNA, 25 bp, Homo sapien
gcatgagggtgcagccgctgctgca

SEQ ID NO: 32505 - DNA, 25 bp, Homo sapien
ccgctgcagctgcagcagcggccgc

SEQ ID NO: 32506 - DNA, 25 bp, Homo sapien
ccctgcatccatgatgaggccgggg

SEQ ID NO: 32507 - DNA, 25 bp, Homo sapien
catgatgaggccggggcaggtctcc

SEQ ID NO: 32508 - DNA, 25 bp, Homo sapien
tactcctgtggaatcttctgaccca

SEQ ID NO: 32509 - DNA, 25 bp, Homo sapien
acccaaaggctgggcacgacgctgg

SEQ ID NO: 32510 - DNA, 25 bp, Homo sapien
cctaccggcgagagtccagagtggg

SEQ ID NO: 32511 - DNA, 25 bp, Homo sapien
agagtgggtacaggagcaaggggca

SEQ ID NO: 32512 - DNA, 25 bp, Homo sapien
cactgctggggcctgatggctgaag

SEQ ID NO: 32513 - DNA, 25 bp, Homo sapien
atggctgaaggagacgccggcatcc

SEQ ID NO: 32514 - DNA, 25 bp, Homo sapien
gggcctggggaagttgtgtgttgtg

SEQ ID NO: 32515 - DNA, 25 bp, Homo sapien
gatcgtgccattgtgatatgaatat

SEQ ID NO: 32516 - DNA, 25 bp, Homo sapien
gaatatgccttatatgctgatatga

SEQ ID NO: 32517 - DNA, 25 bp, Homo sapien
tgcaaacctgaggctgctcatctga

SEQ ID NO: 32518 - DNA, 25 bp, Homo sapien
caaacctgaggctgctcatctgacc

SEQ ID NO: 32519 - DNA, 25 bp, Homo sapien
acctgaaccaaagagacctccttgt

SEQ ID NO: 32520 - DNA, 25 bp, Homo sapien
accaaagagacctccttgtttcagc

SEQ ID NO: 32521 - DNA, 25 bp, Homo sapien
cccaggtgcagtgggttgtgggaac

SEQ ID NO: 32522 - DNA, 25 bp, Homo sapien
gctttacttagatgattgattgggg

SEQ ID NO: 32523 - DNA, 25 bp, Homo sapien
ttggggcctaggagatgaaatcact

SEQ ID NO: 32524 - DNA, 25 bp, Homo sapien
ggaggttggggtgcaatctttagaa

SEQ ID NO: 32525 - DNA, 25 bp, Homo sapien
ggggtgcaatctttagaatatgcct

SEQ ID NO: 32526 - DNA, 25 bp, Homo sapien
tcagtaatatcttcatccttctcac

SEQ ID NO: 32527 - DNA, 25 bp, Homo sapien
ttatgaccacacacactgaagagta

SEQ ID NO: 32528 - DNA, 25 bp, Homo sapien
agtatgtttgtctcttgtggtgtaa

SEQ ID NO: 32529 - DNA, 25 bp, Homo sapien
attacaccaaattatgttcacacaa

SEQ ID NO: 32530 - DNA, 25 bp, Homo sapien
aatggaggttgcaatcagccgagat

SEQ ID NO: 32531 - DNA, 25 bp, Homo sapien
cagccgagatggtgccatcgcactc

SEQ ID NO: 32532 - DNA, 25 bp, Homo sapien
catcgcactctagcctggggaatag

SEQ ID NO: 32533 - DNA, 25 bp, Homo sapien
aattttagtctctgcagtctcttgt

SEQ ID NO: 32534 - DNA, 25 bp, Homo sapien
tctctgcagtctcttgtcttgaatt

SEQ ID NO: 32535 - DNA, 25 bp, Homo sapien
agttaatcttcctgcttgtatgtga

SEQ ID NO: 32536 - DNA, 25 bp, Homo sapien
cccagctaattaccttgtattacag

SEQ ID NO: 32537 - DNA, 25 bp, Homo sapien
ggaagcggtcaaaccgggtggtgcg

SEQ ID NO: 32538 - DNA, 25 bp, Homo sapien
agcagcagcatcacgaggagctgag

SEQ ID NO: 32539 - DNA, 25 bp, Homo sapien
gggctgcaggagaccatcgcagagt

SEQ ID NO: 32540 - DNA, 25 bp, Homo sapien
gcaggagaccatcgcagagtttttg

SEQ ID NO: 32541 - DNA, 25 bp, Homo sapien
gagaccatcgcagagtttttgtaca

SEQ ID NO: 32542 - DNA, 25 bp, Homo sapien
gcagagtttttgtacattgcccggc

SEQ ID NO: 32543 - DNA, 25 bp, Homo sapien
gcctgtggggtcagaggtcgtggaa

SEQ ID NO: 32544 - DNA, 25 bp, Homo sapien
tcagaggtcgtggaaaccctggctc

SEQ ID NO: 32545 - DNA, 25 bp, Homo sapien
tcttggctggtgttgtggacgtgac

SEQ ID NO: 32546 - DNA, 25 bp, Homo sapien
ctgagcctcctgagtgacagaaagg

SEQ ID NO: 32547 - DNA, 25 bp, Homo sapien
gtgacagaaagggcctgacccggag

SEQ ID NO: 32548 - DNA, 25 bp, Homo sapien
tctactcaactatccgaatatgtcc

SEQ ID NO: 32549 - DNA, 25 bp, Homo sapien
atccgaatatgtccatttcgcagag

SEQ ID NO: 32550 - DNA, 25 bp, Homo sapien
ggagtgcagatagctacagagagga

SEQ ID NO: 32551 - DNA, 25 bp, Homo sapien
gagaggagggtcaaagcacgattta

SEQ ID NO: 32552 - DNA, 25 bp, Homo sapien
aagcacgatttaatcaaggcctgat

SEQ ID NO: 32553 - DNA, 25 bp, Homo sapien
aatcaaggcctgattcccaagtctg

SEQ ID NO: 32554 - DNA, 25 bp, Homo sapien
tcctctcaatttcacctgcattgac

SEQ ID NO: 32555 - DNA, 25 bp, Homo sapien
aatttcacctgcattgacaagtatt

SEQ ID NO: 32556 - DNA, 25 bp, Homo sapien
gacaagtattaattgaaccccaact

SEQ ID NO: 32557 - DNA, 25 bp, Homo sapien
tgaaccccaactgtatatgttgcac

SEQ ID NO: 32558 - DNA, 25 bp, Homo sapien
aatttctttgtgtagctgatgtatg

SEQ ID NO: 32559 - DNA, 25 bp, Homo sapien
tattcccttgcatgggcagtggctt

SEQ ID NO: 32560 - DNA, 25 bp, Homo sapien
gagcattagtcctcattcgctgaac

SEQ ID NO: 32561 - DNA, 25 bp, Homo sapien
ttcgctgaaccctgttgtttaggtc

SEQ ID NO: 32562 - DNA, 25 bp, Homo sapien
agcccattggctgcaagaccaggga

SEQ ID NO: 32563 - DNA, 25 bp, Homo sapien
tggaggggcattgctctagccctca

SEQ ID NO: 32564 - DNA, 25 bp, Homo sapien
gtgggaggttcattcagcacccacc

SEQ ID NO: 32565 - DNA, 25 bp, Homo sapien
agcacccaccagtcaggtatgttct

SEQ ID NO: 32566 - DNA, 25 bp, Homo sapien
gaacccacagcagtcgcagaatgag

SEQ ID NO: 32567 - DNA, 25 bp, Homo sapien
gtcgcagaatgagcacctggcaggg

SEQ ID NO: 32568 - DNA, 25 bp, Homo sapien
gtaatcagactcaggttccacacac

SEQ ID NO: 32569 - DNA, 25 bp, Homo sapien
cacaagcaacaactcgtgggcctct

SEQ ID NO: 32570 - DNA, 25 bp, Homo sapien
gatctggggacgggtatggtggctc

SEQ ID NO: 32571 - DNA, 25 bp, Homo sapien
ggctcacgcctattatcttagcact

SEQ ID NO: 32572 - DNA, 25 bp, Homo sapien
actgagtgagcctgggagttcgagg

SEQ ID NO: 32573 - DNA, 25 bp, Homo sapien
ccttagcttctacgccactaaggcc

SEQ ID NO: 32574 - DNA, 25 bp, Homo sapien
ggaagagactatgctgttcactctg

SEQ ID NO: 32575 - DNA, 25 bp, Homo sapien
gtcccctctatatgctgttaattca

SEQ ID NO: 32576 - DNA, 25 bp, Homo sapien
tatgctgttaattcaaaggcactca

SEQ ID NO: 32577 - DNA, 25 bp, Homo sapien
ttcaaaggcactcaggttagtcctg

SEQ ID NO: 32578 - DNA, 25 bp, Homo sapien
ggttagtcctgagtcaggcctggat

SEQ ID NO: 32579 - DNA, 25 bp, Homo sapien
aggcctggatggggatacagggggg

SEQ ID NO: 32580 - DNA, 25 bp, Homo sapien
agaaggatctggggacgggtatggt

SEQ ID NO: 32581 - DNA, 25 bp, Homo sapien
agctgtgcgagaacctgttcttcct

SEQ ID NO: 32582 - DNA, 25 bp, Homo sapien
tgcacagcttggagatgggctggtg

SEQ ID NO: 32583 - DNA, 25 bp, Homo sapien
aagaaaggcggcctcagaactcagc

SEQ ID NO: 32584 - DNA, 25 bp, Homo sapien
agaactcagctgtgactcttgcaga

SEQ ID NO: 32585 - DNA, 25 bp, Homo sapien
gagactgaagtgggcttttgtgtta

SEQ ID NO: 32586 - DNA, 25 bp, Homo sapien
ctttctccaaccctgtagaataaga

SEQ ID NO: 32587 - DNA, 25 bp, Homo sapien
atggccttgttgcctgtgtagagca

SEQ ID NO: 32588 - DNA, 25 bp, Homo sapien
gagcaagttacggtggtactgccac

SEQ ID NO: 32589 - DNA, 25 bp, Homo sapien
ggtactgccactctgcaggtggagc

SEQ ID NO: 32590 - DNA, 25 bp, Homo sapien
tctgcaggtggagcgggtgactctg

SEQ ID NO: 32591 - DNA, 25 bp, Homo sapien
tgggggaccattaagacctccagac

SEQ ID NO: 32592 - DNA, 25 bp, Homo sapien
ggcttcactgctaatcacatcgtgc

SEQ ID NO: 32593 - DNA, 25 bp, Homo sapien
gaggctctggctcaaacagcaatag

SEQ ID NO: 32594 - DNA, 25 bp, Homo sapien
cagcaatagggtcttcctcactgac

SEQ ID NO: 32595 - DNA, 25 bp, Homo sapien
actgaccttggaggatgcctgtggc

SEQ ID NO: 32596 - DNA, 25 bp, Homo sapien
tgaggtctgtgatttccgagcacgc

SEQ ID NO: 32597 - DNA, 25 bp, Homo sapien
gcactcaacttggccttttgattgc

SEQ ID NO: 32598 - DNA, 25 bp, Homo sapien
gcaacagtcccaacaagcaggcttc

SEQ ID NO: 32599 - DNA, 25 bp, Homo sapien
cactggccgccacggaaaagcagtc

SEQ ID NO: 32600 - DNA, 25 bp, Homo sapien
agtggacagactttgccacggtgct

SEQ ID NO: 32601 - DNA, 25 bp, Homo sapien
cctcctgggcacgtccaggtgaggg

SEQ ID NO: 32602 - DNA, 25 bp, Homo sapien
gcacagtgcctaaccctagaaaagc

SEQ ID NO: 32603 - DNA, 25 bp, Homo sapien
ctcatgctagcctcacgaaactgga

SEQ ID NO: 32604 - DNA, 25 bp, Homo sapien
gaacttgttgctgattttgaccttg

SEQ ID NO: 32605 - DNA, 25 bp, Homo sapien
tgaagttaactgttccccttggtat

SEQ ID NO: 32606 - DNA, 25 bp, Homo sapien
gtgttctgggatttctctagaggct

SEQ ID NO: 32607 - DNA, 25 bp, Homo sapien
gaaccagttgttttgtcttgcgggt

SEQ ID NO: 32608 - DNA, 25 bp, Homo sapien
agtttcctttcttagctgatgtctt

SEQ ID NO: 32609 - DNA, 25 bp, Homo sapien
ctgatgtctttggccagaacaccgt

SEQ ID NO: 32610 - DNA, 25 bp, Homo sapien
agaacaccgtgggctgttacttgct

SEQ ID NO: 32611 - DNA, 25 bp, Homo sapien
gaagcggtttgcatttacgcctgta

SEQ ID NO: 32612 - DNA, 25 bp, Homo sapien
ttttgtacgcaattctcgattcttt

SEQ ID NO: 32613 - DNA, 25 bp, Homo sapien
tgagaacattaggccccagcaacac

SEQ ID NO: 32614 - DNA, 25 bp, Homo sapien
ggattataatttctgcttgagtatg

SEQ ID NO: 32615 - DNA, 25 bp, Homo sapien
atttctgcttgagtatggtgttaac

SEQ ID NO: 32616 - DNA, 25 bp, Homo sapien
gttttcttttaaggtgacccatctg

SEQ ID NO: 32617 - DNA, 25 bp, Homo sapien
tcttttaaggtgacccatctgtgat

SEQ ID NO: 32618 - DNA, 25 bp, Homo sapien
agcttagtgctaaaatcagtgtaac

SEQ ID NO: 32619 - DNA, 25 bp, Homo sapien
atcagtgtaacttatacatggccta

SEQ ID NO: 32620 - DNA, 25 bp, Homo sapien
tacatggcctaaaatgtttctacaa

SEQ ID NO: 32621 - DNA, 25 bp, Homo sapien
aattagagtttgtcacttattccat

SEQ ID NO: 32622 - DNA, 25 bp, Homo sapien
tgtcacttattccatttgtacctaa

SEQ ID NO: 32623 - DNA, 25 bp, Homo sapien
ttattccatttgtacctaagagaaa

SEQ ID NO: 32624 - DNA, 25 bp, Homo sapien
tcagttagaaaaggactccctggcc

SEQ ID NO: 32625 - DNA, 25 bp, Homo sapien
gcccggcctcagacaaagggtccgg

SEQ ID NO: 32626 - DNA, 25 bp, Homo sapien
gagtccccgcagaggaagcacaagt

SEQ ID NO: 32627 - DNA, 25 bp, Homo sapien
ggaagcacaagtgccactacgcggg

SEQ ID NO: 32628 - DNA, 25 bp, Homo sapien
gccactacgcgggctgcgagaaagt

SEQ ID NO: 32629 - DNA, 25 bp, Homo sapien
gcgggctgcgagaaagtttacggga

SEQ ID NO: 32630 - DNA, 25 bp, Homo sapien
tttacgggaaatcttcgcacctcaa

SEQ ID NO: 32631 - DNA, 25 bp, Homo sapien
acctcaaggcgcacctgagaactca

SEQ ID NO: 32632 - DNA, 25 bp, Homo sapien
actgcaacaagaagttcgcgcgctc

SEQ ID NO: 32633 - DNA, 25 bp, Homo sapien
ggcgagaagaagttcagctgcccca

SEQ ID NO: 32634 - DNA, 25 bp, Homo sapien
cccatctgcgagaagcgcttcatgc

SEQ ID NO: 32635 - DNA, 25 bp, Homo sapien
gcgagaagcgcttcatgcgcagcga

SEQ ID NO: 32636 - DNA, 25 bp, Homo sapien
aagagaaagagctgtgatactgaga

SEQ ID NO: 32637 - DNA, 25 bp, Homo sapien
gatactgagagctacctattggcat

SEQ ID NO: 32638 - DNA, 25 bp, Homo sapien
gagagctacctattggcataaaaga

SEQ ID NO: 32639 - DNA, 25 bp, Homo sapien
gtagactggatcaatgtgggtcagc

SEQ ID NO: 32640 - DNA, 25 bp, Homo sapien
tgtgggtcagctacataagccccca

SEQ ID NO: 32641 - DNA, 25 bp, Homo sapien
tagccaaggagggaacatgtatgta

SEQ ID NO: 32642 - DNA, 25 bp, Homo sapien
tcaggcttatgagaatcacaactgt

SEQ ID NO: 32643 - DNA, 25 bp, Homo sapien
gagaatcacaactgtatgtctatag

SEQ ID NO: 32644 - DNA, 25 bp, Homo sapien
actgtatgtctataggacatcctaa

SEQ ID NO: 32645 - DNA, 25 bp, Homo sapien
aactgaattttatctacatgtatag

SEQ ID NO: 32646 - DNA, 25 bp, Homo sapien
gaaaacatattttgggccgggcatg

SEQ ID NO: 32647 - DNA, 25 bp, Homo sapien
gctgaggagtgcgggtgcacagcgc

SEQ ID NO: 32648 - DNA, 25 bp, Homo sapien
tgccccagtgctggatccactgggt

SEQ ID NO: 32649 - DNA, 25 bp, Homo sapien
tccactgggtgaagccagctgggct

SEQ ID NO: 32650 - DNA, 25 bp, Homo sapien
tacaccgatgggcactctgtatcta

SEQ ID NO: 32651 - DNA, 25 bp, Homo sapien
accaatccacactctgtatctggct

SEQ ID NO: 32652 - DNA, 25 bp, Homo sapien
tttgtgtccacactctgtatctagc

SEQ ID NO: 32653 - DNA, 25 bp, Homo sapien
gtggagaacctttgtgtctagctca

SEQ ID NO: 32654 - DNA, 25 bp, Homo sapien
ctagctcagggatcgtaaacgcacc

SEQ ID NO: 32655 - DNA, 25 bp, Homo sapien
agcaccctgtcaaaacagaccactt

SEQ ID NO: 32656 - DNA, 25 bp, Homo sapien
agaccacttgactctctgtaaaatg

SEQ ID NO: 32657 - DNA, 25 bp, Homo sapien
ccctcccacgccgtggaagctttgt

SEQ ID NO: 32658 - DNA, 25 bp, Homo sapien
gaatacgactgtcatcttcccattt

SEQ ID NO: 32659 - DNA, 25 bp, Homo sapien
agatgttcagcgtgcagggcttgct

SEQ ID NO: 32660 - DNA, 25 bp, Homo sapien
ttcacaaacagtgcttccagtcctc

SEQ ID NO: 32661 - DNA, 25 bp, Homo sapien
cccggtgtgcgaggatcacagcgag

SEQ ID NO: 32662 - DNA, 25 bp, Homo sapien
aacttctggaaagtgtggcctctgc

SEQ ID NO: 32663 - DNA, 25 bp, Homo sapien
gtggcctctgcagcaacatgatgcc

SEQ ID NO: 32664 - DNA, 25 bp, Homo sapien
acatgatgcccctgagtactgtgaa

SEQ ID NO: 32665 - DNA, 25 bp, Homo sapien
agactgttcaacatgccttatgata

SEQ ID NO: 32666 - DNA, 25 bp, Homo sapien
tcactgatgctgagccagtttgtat

SEQ ID NO: 32667 - DNA, 25 bp, Homo sapien
tcagtttctctttctctaaagcttg

SEQ ID NO: 32668 - DNA, 25 bp, Homo sapien
gaaactggttggtcctttcagtgaa

SEQ ID NO: 32669 - DNA, 25 bp, Homo sapien
actgttagggtctttcccaggacat

SEQ ID NO: 32670 - DNA, 25 bp, Homo sapien
tctccccatcattgaagcgcaagtt

SEQ ID NO: 32671 - DNA, 25 bp, Homo sapien
gaagcgcaagttttcttgaattcaa

SEQ ID NO: 32672 - DNA, 25 bp, Homo sapien
attcaaatactcccaatgagcttgt

SEQ ID NO: 32673 - DNA, 25 bp, Homo sapien
atgagcttgtatacttccaaacagc

SEQ ID NO: 32674 - DNA, 25 bp, Homo sapien
ccaaacagctaaacttgatttccag

SEQ ID NO: 32675 - DNA, 25 bp, Homo sapien
tgatttccagttgtggatttcacac

SEQ ID NO: 32676 - DNA, 25 bp, Homo sapien
cacacatataattgccgccttcttc

SEQ ID NO: 32677 - DNA, 25 bp, Homo sapien
cccccctagttgaatcagcttgtct

SEQ ID NO: 32678 - DNA, 25 bp, Homo sapien
gtctaacaagcccattttcatgccc

SEQ ID NO: 32679 - DNA, 25 bp, Homo sapien
ctgtgggttttccaagcctcatatt

SEQ ID NO: 32680 - DNA, 25 bp, Homo sapien
aggatagtagagcagggccctgact

SEQ ID NO: 32681 - DNA, 25 bp, Homo sapien
ggccctgacttgtaacgttcatggg

SEQ ID NO: 32682 - DNA, 25 bp, Homo sapien
gtaacgttcatgggtagccagggtg

SEQ ID NO: 32683 - DNA, 25 bp, Homo sapien
tagccagggtgtatgtggccagagc

SEQ ID NO: 32684 - DNA, 25 bp, Homo sapien
ggccagagcagagtaagcatgggcg

SEQ ID NO: 32685 - DNA, 25 bp, Homo sapien
gggcgaaagtagagagctgggggtt

SEQ ID NO: 32686 - DNA, 25 bp, Homo sapien
gttggaggggcatttccaggtcatg

SEQ ID NO: 32687 - DNA, 25 bp, Homo sapien
tcatgtggggcctcgggaggacctt

SEQ ID NO: 32688 - DNA, 25 bp, Homo sapien
aggagccaccggagggctctgagca

SEQ ID NO: 32689 - DNA, 25 bp, Homo sapien
ggtagggctctgatcagatggatat

SEQ ID NO: 32690 - DNA, 25 bp, Homo sapien
gagaattgcttcaacgcaggaggcg

SEQ ID NO: 32691 - DNA, 25 bp, Homo sapien
cctgaagagcctgcagcggctccac

SEQ ID NO: 32692 - DNA, 25 bp, Homo sapien
acctgctaagccctctggaggagaa

SEQ ID NO: 32693 - DNA, 25 bp, Homo sapien
cccctggcctggaagtcaactatgg

SEQ ID NO: 32694 - DNA, 25 bp, Homo sapien
cagaccatctggtttgagctgccac

SEQ ID NO: 32695 - DNA, 25 bp, Homo sapien
ccaggagctgctatacaccactgtc

SEQ ID NO: 32696 - DNA, 25 bp, Homo sapien
tgatagacagcagtgcctcttgcac

SEQ ID NO: 32697 - DNA, 25 bp, Homo sapien
tgagtggcccagcatcaactgagag

SEQ ID NO: 32698 - DNA, 25 bp, Homo sapien
catggtctgccttggatgctatcag

SEQ ID NO: 32699 - DNA, 25 bp, Homo sapien
gatgctatcagatcactgttctaga

SEQ ID NO: 32700 - DNA, 25 bp, Homo sapien
gggccaaagcgggctgcaggaactc

SEQ ID NO: 32701 - DNA, 25 bp, Homo sapien
cctgaggttgcccagtctgagggag

SEQ ID NO: 32702 - DNA, 25 bp, Homo sapien
gtgtacattcaaacctagctaccca

SEQ ID NO: 32703 - DNA, 25 bp, Homo sapien
tagctacccatcaggtcatccatac

SEQ ID NO: 32704 - DNA, 25 bp, Homo sapien
acgaatgtggcaaggtcttcactca

SEQ ID NO: 32705 - DNA, 25 bp, Homo sapien
tcttcactcaaaactcacatcttgc

SEQ ID NO: 32706 - DNA, 25 bp, Homo sapien
gagtgtgggaaagccttcagtgttc

SEQ ID NO: 32707 - DNA, 25 bp, Homo sapien
tcagtgttcgttcaaccctaactac

SEQ ID NO: 32708 - DNA, 25 bp, Homo sapien
caaccctaactacccatatggcaat

SEQ ID NO: 32709 - DNA, 25 bp, Homo sapien
ccaatgtggcaaggtctttactcaa

SEQ ID NO: 32710 - DNA, 25 bp, Homo sapien
gcagggggatcacctgaggtctcga

SEQ ID NO: 32711 - DNA, 25 bp, Homo sapien
ttcgagaccaggctggccaacacgg

SEQ ID NO: 32712 - DNA, 25 bp, Homo sapien
gccaacacggtgaaacgctgtctct

SEQ ID NO: 32713 - DNA, 25 bp, Homo sapien
gtgaggccttgaaggtgccttcatc

SEQ ID NO: 32714 - DNA, 25 bp, Homo sapien
ggtgccttcatcaactgtggagtac

SEQ ID NO: 32715 - DNA, 25 bp, Homo sapien
ccttcatcaactgtggagtacctca

SEQ ID NO: 32716 - DNA, 25 bp, Homo sapien
acatggcattgatgtgcgggtcctc

SEQ ID NO: 32717 - DNA, 25 bp, Homo sapien
gtcctccagacagagcaggcagtga

SEQ ID NO: 32718 - DNA, 25 bp, Homo sapien
aggagtataatgccttggttgccca

SEQ ID NO: 32719 - DNA, 25 bp, Homo sapien
ttggttgcccaaggggtcagggtgg

SEQ ID NO: 32720 - DNA, 25 bp, Homo sapien
tcagggtgggaggtgtcttccattc

SEQ ID NO: 32721 - DNA, 25 bp, Homo sapien
ccacctgctgatggagccttaagag

SEQ ID NO: 32722 - DNA, 25 bp, Homo sapien
agaggagaataaatcactaagtgcc

SEQ ID NO: 32723 - DNA, 25 bp, Homo sapien
gagacagtgcggtggacttcagtga

SEQ ID NO: 32724 - DNA, 25 bp, Homo sapien
acctccgggagcagcgcaggagagc

SEQ ID NO: 32725 - DNA, 25 bp, Homo sapien
gcaggagagctggagctgctggcag

SEQ ID NO: 32726 - DNA, 25 bp, Homo sapien
gctgctggcaggagaggtgccggcc

SEQ ID NO: 32727 - DNA, 25 bp, Homo sapien
cccgaagccctggggcgtttgacat

SEQ ID NO: 32728 - DNA, 25 bp, Homo sapien
ctggggcgtttgacatgagtggggt

SEQ ID NO: 32729 - DNA, 25 bp, Homo sapien
tgagtggggtcaggggatctctggc

SEQ ID NO: 32730 - DNA, 25 bp, Homo sapien
tcaggggatctctggctgaggctgt

SEQ ID NO: 32731 - DNA, 25 bp, Homo sapien
tctggctgaggctgtgggcagcccc

SEQ ID NO: 32732 - DNA, 25 bp, Homo sapien
ccggaagacgccggagtcattcctg

SEQ ID NO: 32733 - DNA, 25 bp, Homo sapien
ccttcctcctataatccagggcgga

SEQ ID NO: 32734 - DNA, 25 bp, Homo sapien
tccagggcggaagggggcctggctc

SEQ ID NO: 32735 - DNA, 25 bp, Homo sapien
tcccttggtgtaggaacaacggagg

SEQ ID NO: 32736 - DNA, 25 bp, Homo sapien
acaacggaggagtttctcctctgct

SEQ ID NO: 32737 - DNA, 25 bp, Homo sapien
tttctcctctgctaactattcatat

SEQ ID NO: 32738 - DNA, 25 bp, Homo sapien
tgtactatgttatgcacacattaca

SEQ ID NO: 32739 - DNA, 25 bp, Homo sapien
gagaacaggtgtgagttttccaaaa

SEQ ID NO: 32740 - DNA, 25 bp, Homo sapien
tagtgtcaaaaattcaggggcagtt

SEQ ID NO: 32741 - DNA, 25 bp, Homo sapien
ggggcagttaaggagtcatggatgg

SEQ ID NO: 32742 - DNA, 25 bp, Homo sapien
tgttctcaattatttgcgggatcta

SEQ ID NO: 32743 - DNA, 25 bp, Homo sapien
aggatggttactagtggctgggaaa

SEQ ID NO: 32744 - DNA, 25 bp, Homo sapien
gtgtgcgaggggaactggggatgct

SEQ ID NO: 32745 - DNA, 25 bp, Homo sapien
gatagcacaaccgggtgagtatagt

SEQ ID NO: 32746 - DNA, 25 bp, Homo sapien
tcagacacgcactgcattcggcaga

SEQ ID NO: 32747 - DNA, 25 bp, Homo sapien
gacacgcactgcattcggcagagct

SEQ ID NO: 32748 - DNA, 25 bp, Homo sapien
gcactgcattcggcagagctccagt

SEQ ID NO: 32749 - DNA, 25 bp, Homo sapien
gcagagctccagtgagcaaggcacg

SEQ ID NO: 32750 - DNA, 25 bp, Homo sapien
gagctccagtgagcaaggcacgacc

SEQ ID NO: 32751 - DNA, 25 bp, Homo sapien
gaccctcagatctcagtctagtgaa

SEQ ID NO: 32752 - DNA, 25 bp, Homo sapien
ccctcagatctcagtctagtgaagg

SEQ ID NO: 32753 - DNA, 25 bp, Homo sapien
ggagagaaaactgtaataacactac

SEQ ID NO: 32754 - DNA, 25 bp, Homo sapien
atctcaaagcgattggacctagcag

SEQ ID NO: 32755 - DNA, 25 bp, Homo sapien
aaagcgattggacctagcagctcat

SEQ ID NO: 32756 - DNA, 25 bp, Homo sapien
agcgattggacctagcagctcatgc

SEQ ID NO: 32757 - DNA, 25 bp, Homo sapien
aggaaacaactcgtactgaacccat

SEQ ID NO: 32758 - DNA, 25 bp, Homo sapien
aacccatcaacactacttattctta

SEQ ID NO: 32759 - DNA, 25 bp, Homo sapien
acttattcttacactgacttccaaa

SEQ ID NO: 32760 - DNA, 25 bp, Homo sapien
caaactcctaactgcatcactgtaa

SEQ ID NO: 32761 - DNA, 25 bp, Homo sapien
tctaccatttgctctgatatctctg

SEQ ID NO: 32762 - DNA, 25 bp, Homo sapien
gtcattacacagcccactaatgcct

SEQ ID NO: 32763 - DNA, 25 bp, Homo sapien
ccactaatgccttctcagtcaaact

SEQ ID NO: 32764 - DNA, 25 bp, Homo sapien
tcagtcaaactctcttatgccctgg

SEQ ID NO: 32765 - DNA, 25 bp, Homo sapien
ctctcttatgccctggcaagccaat

SEQ ID NO: 32766 - DNA, 25 bp, Homo sapien
ggcaagccaatgaggataccctttg

SEQ ID NO: 32767 - DNA, 25 bp, Homo sapien
gataccctttgacaaaccctgtgga

SEQ ID NO: 32768 - DNA, 25 bp, Homo sapien
ggcaaagagagacacaccctgagcc

SEQ ID NO: 32769 - DNA, 25 bp, Homo sapien
aggatgactactcggtcctgtttga

SEQ ID NO: 32770 - DNA, 25 bp, Homo sapien
gtggctcagagatacgtggtggctt

SEQ ID NO: 32771 - DNA, 25 bp, Homo sapien
aaaagtgatgccgcctggcagactc

SEQ ID NO: 32772 - DNA, 25 bp, Homo sapien
cccccaacgacacagggcaggacag

SEQ ID NO: 32773 - DNA, 25 bp, Homo sapien
ggatcgggaagcctggtgacaagcc

SEQ ID NO: 32774 - DNA, 25 bp, Homo sapien
ctcaggagactacgtggccagacct

SEQ ID NO: 32775 - DNA, 25 bp, Homo sapien
gacctggagacaaggtggctgcccg

SEQ ID NO: 32776 - DNA, 25 bp, Homo sapien
ctgcccgggtgaaggccgtggatgg

SEQ ID NO: 32777 - DNA, 25 bp, Homo sapien
ggccgtggatggggacgagcagtgg

SEQ ID NO: 32778 - DNA, 25 bp, Homo sapien
ggtggtcagttacagccatgccacc

SEQ ID NO: 32779 - DNA, 25 bp, Homo sapien
tccaggcaggtcatgaacacccact

SEQ ID NO: 32780 - DNA, 25 bp, Homo sapien
cacatcgtcaacacttacggggcct

SEQ ID NO: 32781 - DNA, 25 bp, Homo sapien
gcccccgatgccatgtgggaggact

SEQ ID NO: 32782 - DNA, 25 bp, Homo sapien
gggaggactacgagttcaagtgcaa

SEQ ID NO: 32783 - DNA, 25 bp, Homo sapien
agttcaagtgcaagccaggtgaccc

SEQ ID NO: 32784 - DNA, 25 bp, Homo sapien
cttccagacctacgagcacaacgac

SEQ ID NO: 32785 - DNA, 25 bp, Homo sapien
tacgagcacaacgactggatcatcc

SEQ ID NO: 32786 - DNA, 25 bp, Homo sapien
ggtccgaggagagcactacaggtac

SEQ ID NO: 32787 - DNA, 25 bp, Homo sapien
caggtacaagttcagccgtcctggg

SEQ ID NO: 32788 - DNA, 25 bp, Homo sapien
gccgccgagggcaagtggtgggtgc

SEQ ID NO: 32789 - DNA, 25 bp, Homo sapien
gaagaggatcggagcctacttccct

SEQ ID NO: 32790 - DNA, 25 bp, Homo sapien
agcaaatctagctttcagtattcct

SEQ ID NO: 32791 - DNA, 25 bp, Homo sapien
attcctaatttttacctaagctcat

SEQ ID NO: 32792 - DNA, 25 bp, Homo sapien
tttttacctaagctcattgctccag

SEQ ID NO: 32793 - DNA, 25 bp, Homo sapien
gaaccaacttcaagaatgcagcact

SEQ ID NO: 32794 - DNA, 25 bp, Homo sapien
aatgcagcacttcttaatctttagc

SEQ ID NO: 32795 - DNA, 25 bp, Homo sapien
cttaatctttagctctttcttggga

SEQ ID NO: 32796 - DNA, 25 bp, Homo sapien
gctctttcttgggagaagctagact

SEQ ID NO: 32797 - DNA, 25 bp, Homo sapien
gaagctagactttattcattatatt

SEQ ID NO: 32798 - DNA, 25 bp, Homo sapien
cattatattgctatgacaacttcac

SEQ ID NO: 32799 - DNA, 25 bp, Homo sapien
aaattgtttacatgattggaccctc

SEQ ID NO: 32800 - DNA, 25 bp, Homo sapien
atgattggaccctcagattctgtta

SEQ ID NO: 32801 - DNA, 25 bp, Homo sapien
gaagtccaagaccagttggctcgca

SEQ ID NO: 32802 - DNA, 25 bp, Homo sapien
ttggctcgcatctgacttcagtgaa

SEQ ID NO: 32803 - DNA, 25 bp, Homo sapien
gcagctgccatcaggtgttcatgtc

SEQ ID NO: 32804 - DNA, 25 bp, Homo sapien
tcagggctggggtacaattccacct

SEQ ID NO: 32805 - DNA, 25 bp, Homo sapien
gcaaaacaggagctggactgacatc

SEQ ID NO: 32806 - DNA, 25 bp, Homo sapien
ggactgacatcaaacatgctgtaac

SEQ ID NO: 32807 - DNA, 25 bp, Homo sapien
atgctgtaacttgcaatgaagtcac

SEQ ID NO: 32808 - DNA, 25 bp, Homo sapien
gtcacctaagtacttttttggatca

SEQ ID NO: 32809 - DNA, 25 bp, Homo sapien
tttggatcaaatctatgatgccatc

SEQ ID NO: 32810 - DNA, 25 bp, Homo sapien
gatgccatcattcttaagatcaccc

SEQ ID NO: 32811 - DNA, 25 bp, Homo sapien
agatcaccctttattttaatgaaat

SEQ ID NO: 32812 - DNA, 25 bp, Homo sapien
ttccagctccttcaggtgtttgatt

SEQ ID NO: 32813 - DNA, 25 bp, Homo sapien
gctccttcaggtgtttgattccagc

SEQ ID NO: 32814 - DNA, 25 bp, Homo sapien
tcaggtgtttgattccagcatgtag

SEQ ID NO: 32815 - DNA, 25 bp, Homo sapien
gtttgattccagcatgtagtataca

SEQ ID NO: 32816 - DNA, 25 bp, Homo sapien
ggataatctgacttaagaaactttt

SEQ ID NO: 32817 - DNA, 25 bp, Homo sapien
ttgtgttgtcacagaaatacctgaa

SEQ ID NO: 32818 - DNA, 25 bp, Homo sapien
tacctgaaattcagtagtacttcat

SEQ ID NO: 32819 - DNA, 25 bp, Homo sapien
tcagtagtacttcattcaattaatt

SEQ ID NO: 32820 - DNA, 25 bp, Homo sapien
gagttatactgttttcaaagtcatt

SEQ ID NO: 32821 - DNA, 25 bp, Homo sapien
tatggaaattaggctgggcgctgtg

SEQ ID NO: 32822 - DNA, 25 bp, Homo sapien
agccgggccagcatggtggaaaccc

SEQ ID NO: 32823 - DNA, 25 bp, Homo sapien
acaatggcgaggtgcgcaccgccag

SEQ ID NO: 32824 - DNA, 25 bp, Homo sapien
gcggccaagcacaggctggtggtgc

SEQ ID NO: 32825 - DNA, 25 bp, Homo sapien
gctggtggtgctggtcaaggacaat

SEQ ID NO: 32826 - DNA, 25 bp, Homo sapien
tcaaggacaatggcgagcctccgcg

SEQ ID NO: 32827 - DNA, 25 bp, Homo sapien
caccgtctacctggtggtggcgttg

SEQ ID NO: 32828 - DNA, 25 bp, Homo sapien
ggcggtgcggctgtgtaggaggagc

SEQ ID NO: 32829 - DNA, 25 bp, Homo sapien
cccttccagggcatcttgtggacat

SEQ ID NO: 32830 - DNA, 25 bp, Homo sapien
ttgtggacatgagcggcaccaggac

SEQ ID NO: 32831 - DNA, 25 bp, Homo sapien
cctatcccagagctaccagtatgag

SEQ ID NO: 32832 - DNA, 25 bp, Homo sapien
gtgtctggcaggaggctcagggacc

SEQ ID NO: 32833 - DNA, 25 bp, Homo sapien
tcaagttcctgaagccgattatccc

SEQ ID NO: 32834 - DNA, 25 bp, Homo sapien
tgatgttgatgatgattctggtaat

SEQ ID NO: 32835 - DNA, 25 bp, Homo sapien
gattctggtaatcatggcagtaaga

SEQ ID NO: 32836 - DNA, 25 bp, Homo sapien
aagttaattataattgttcttccat

SEQ ID NO: 32837 - DNA, 25 bp, Homo sapien
gagtgggtactattatctccatttt

SEQ ID NO: 32838 - DNA, 25 bp, Homo sapien
aatttgaaggcactcaaccttgagt

SEQ ID NO: 32839 - DNA, 25 bp, Homo sapien
gtgtcttgctgagggttactgtatc

SEQ ID NO: 32840 - DNA, 25 bp, Homo sapien
gagggttactgtatctagcaggtga

SEQ ID NO: 32841 - DNA, 25 bp, Homo sapien
agcaggtgatggagcttggatttga

SEQ ID NO: 32842 - DNA, 25 bp, Homo sapien
ttagattcatctttttgtacaccaa

SEQ ID NO: 32843 - DNA, 25 bp, Homo sapien
ttttgtacaccaatgtgcttttgtt

SEQ ID NO: 32844 - DNA, 25 bp, Homo sapien
aaagtcggtggtggctaggcgtggt

SEQ ID NO: 32845 - DNA, 25 bp, Homo sapien
agtacattctcattgttgtccagcc

SEQ ID NO: 32846 - DNA, 25 bp, Homo sapien
tacattctcattgttgtccagccat

SEQ ID NO: 32847 - DNA, 25 bp, Homo sapien
atcatccatctccagaagttttcca

SEQ ID NO: 32848 - DNA, 25 bp, Homo sapien
tctccagaagttttccatcttccca

SEQ ID NO: 32849 - DNA, 25 bp, Homo sapien
gaagttttccatcttcccaaattct

SEQ ID NO: 32850 - DNA, 25 bp, Homo sapien
aattctgtgcccattgaacaataac

SEQ ID NO: 32851 - DNA, 25 bp, Homo sapien
ctctatcatcaacttcactactcat

SEQ ID NO: 32852 - DNA, 25 bp, Homo sapien
aaagtctttaagatgcatccatgtt

SEQ ID NO: 32853 - DNA, 25 bp, Homo sapien
aagatgcatccatgtttccagtgtt

SEQ ID NO: 32854 - DNA, 25 bp, Homo sapien
aactcatacgtgattgcagccgggc

SEQ ID NO: 32855 - DNA, 25 bp, Homo sapien
atacgtgattgcagccgggcatggt

SEQ ID NO: 32856 - DNA, 25 bp, Homo sapien
taatagttacaaatgcggtgagcac

SEQ ID NO: 32857 - DNA, 25 bp, Homo sapien
cggtgagcacagcaaaccatcaagg

SEQ ID NO: 32858 - DNA, 25 bp, Homo sapien
agaggattgggccaggcgtgtggct

SEQ ID NO: 32859 - DNA, 25 bp, Homo sapien
ccagcactttaggagcccaaggtgg

SEQ ID NO: 32860 - DNA, 25 bp, Homo sapien
tcatgagtttgagatcagcctggcc

SEQ ID NO: 32861 - DNA, 25 bp, Homo sapien
agcctggccaacagacgtgagtcac

SEQ ID NO: 32862 - DNA, 25 bp, Homo sapien
acagacgtgagtcacttttcccagc

SEQ ID NO: 32863 - DNA, 25 bp, Homo sapien
cagcctgctttttgtttctttaaca

SEQ ID NO: 32864 - DNA, 25 bp, Homo sapien
gaatctgaatcacattggcttatat

SEQ ID NO: 32865 - DNA, 25 bp, Homo sapien
tttccaaaccatcaatgtgggttgt

SEQ ID NO: 32866 - DNA, 25 bp, Homo sapien
gtgaaattctcagtttttttatgtt

SEQ ID NO: 32867 - DNA, 25 bp, Homo sapien
gtgttgagtggttctccgtaaaagt

SEQ ID NO: 32868 - DNA, 25 bp, Homo sapien
ggttctccgtaaaagtataagtgct

SEQ ID NO: 32869 - DNA, 25 bp, Homo sapien
gctaacactacgaagaaatgcacac

SEQ ID NO: 32870 - DNA, 25 bp, Homo sapien
atcattcttgctcacttctataaca

SEQ ID NO: 32871 - DNA, 25 bp, Homo sapien
tgctcacttctataacaaacttaca

SEQ ID NO: 32872 - DNA, 25 bp, Homo sapien
acagcctaaaacttctggagttcac

SEQ ID NO: 32873 - DNA, 25 bp, Homo sapien
taaaacttctggagttcactacctt

SEQ ID NO: 32874 - DNA, 25 bp, Homo sapien
gtatcatacacgtacttttgagcta

SEQ ID NO: 32875 - DNA, 25 bp, Homo sapien
tacttttgagctactattatttgaa

SEQ ID NO: 32876 - DNA, 25 bp, Homo sapien
aaatctgccaaatagcatctttagg

SEQ ID NO: 32877 - DNA, 25 bp, Homo sapien
ggctcaatgtattgggaggcttctt

SEQ ID NO: 32878 - DNA, 25 bp, Homo sapien
cactctggggttctcaagtccatga

SEQ ID NO: 32879 - DNA, 25 bp, Homo sapien
atctggcaaactgaaccctttttat

SEQ ID NO: 32880 - DNA, 25 bp, Homo sapien
gaaccctttttatacatcgacactg

SEQ ID NO: 32881 - DNA, 25 bp, Homo sapien
gacactgtgtgtgatcgctcagacc

SEQ ID NO: 32882 - DNA, 25 bp, Homo sapien
tcttccctaccactgggtacagatg

SEQ ID NO: 32883 - DNA, 25 bp, Homo sapien
gggtacagatggatgcggcgaagtc

SEQ ID NO: 32884 - DNA, 25 bp, Homo sapien
gaagttgttcacagcaatccgtgcc

SEQ ID NO: 32885 - DNA, 25 bp, Homo sapien
gtcttgaaggtcattgtgtccttgg

SEQ ID NO: 32886 - DNA, 25 bp, Homo sapien
tgtgtccttggtttccttgggagta

SEQ ID NO: 32887 - DNA, 25 bp, Homo sapien
ggtcttcgaaacttgtgtggccaga

SEQ ID NO: 32888 - DNA, 25 bp, Homo sapien
gggggagaattcagtgcccccttcg

SEQ ID NO: 32889 - DNA, 25 bp, Homo sapien
ttcgacaccttcttcaacatcgaga

SEQ ID NO: 32890 - DNA, 25 bp, Homo sapien
agaagtacctcgaccacgagcagaa

SEQ ID NO: 32891 - DNA, 25 bp, Homo sapien
ctcggactgggagaagtacgcggcc

SEQ ID NO: 32892 - DNA, 25 bp, Homo sapien
gtacgcggccgaggagtacgacatc

SEQ ID NO: 32893 - DNA, 25 bp, Homo sapien
ccgaggagtacgacatcctggtggc

SEQ ID NO: 32894 - DNA, 25 bp, Homo sapien
ctgggaggacgggttcgaggccgag

SEQ ID NO: 32895 - DNA, 25 bp, Homo sapien
accgcggctcgtgtaaaaactgttg

SEQ ID NO: 32896 - DNA, 25 bp, Homo sapien
gagcagtgccgaaggctggacagca

SEQ ID NO: 32897 - DNA, 25 bp, Homo sapien
gaaggctggacagcatggccatcga

SEQ ID NO: 32898 - DNA, 25 bp, Homo sapien
ctctgccagatgctggacctggtca

SEQ ID NO: 32899 - DNA, 25 bp, Homo sapien
tggacctggtcaagccgaggactga

SEQ ID NO: 32900 - DNA, 25 bp, Homo sapien
gataaaacgtgtcaattccttagca

SEQ ID NO: 32901 - DNA, 25 bp, Homo sapien
aattccttagcattggccgaagagt

SEQ ID NO: 32902 - DNA, 25 bp, Homo sapien
gatctaatgcggaatcacctgaatg

SEQ ID NO: 32903 - DNA, 25 bp, Homo sapien
atgagaagagggcactccgcttgga

SEQ ID NO: 32904 - DNA, 25 bp, Homo sapien
actccgcttggagtggatgattgtc

SEQ ID NO: 32905 - DNA, 25 bp, Homo sapien
tgattgtcatcctcattaccataga

SEQ ID NO: 32906 - DNA, 25 bp, Homo sapien
gaggtaatgtttgagctgggacgag

SEQ ID NO: 32907 - DNA, 25 bp, Homo sapien
gctgggacgagtatttttctgatca

SEQ ID NO: 32908 - DNA, 25 bp, Homo sapien
gtgataaccaaagtgtcactgcaag

SEQ ID NO: 32909 - DNA, 25 bp, Homo sapien
gtcactgcaagagatattcaagttc

SEQ ID NO: 32910 - DNA, 25 bp, Homo sapien
gaagggtggcttgagatgagatcag

SEQ ID NO: 32911 - DNA, 25 bp, Homo sapien
caatgtccaccacttcctgtggaaa

SEQ ID NO: 32912 - DNA, 25 bp, Homo sapien
gagagtcagctggtgactctccctt

SEQ ID NO: 32913 - DNA, 25 bp, Homo sapien
ctactggtccagtaacagtcttcga

SEQ ID NO: 32914 - DNA, 25 bp, Homo sapien
agtcttcgagtgggcctttcaacac

SEQ ID NO: 32915 - DNA, 25 bp, Homo sapien
ccatcatcaaggcattcccagattc

SEQ ID NO: 32916 - DNA, 25 bp, Homo sapien
ttcccagattcctgagtagggtggc

SEQ ID NO: 32917 - DNA, 25 bp, Homo sapien
tcctgagtagggtggcttttggttt

SEQ ID NO: 32918 - DNA, 25 bp, Homo sapien
aaacagaattttgagggcatggccc

SEQ ID NO: 32919 - DNA, 25 bp, Homo sapien
gagggcatggcccaaataactcatg

SEQ ID NO: 32920 - DNA, 25 bp, Homo sapien
ataactcatgagttccaagttgaaa

SEQ ID NO: 32921 - DNA, 25 bp, Homo sapien
atggttgtgcaagttggacattaca

SEQ ID NO: 32922 - DNA, 25 bp, Homo sapien
gtatccctatgttacaaacctgcac

SEQ ID NO: 32923 - DNA, 25 bp, Homo sapien
ggcattcacggagttccaacgagtc

SEQ ID NO: 32924 - DNA, 25 bp, Homo sapien
caacgagtctgttactggctgggga

SEQ ID NO: 32925 - DNA, 25 bp, Homo sapien
tggaccactgccacgatatcgtcca

SEQ ID NO: 32926 - DNA, 25 bp, Homo sapien
ctgccacgatatcgtccacagcagc

SEQ ID NO: 32927 - DNA, 25 bp, Homo sapien
cagagcctccaatttgaacggggta

SEQ ID NO: 32928 - DNA, 25 bp, Homo sapien
tttgaacggggtacactgtccgctc

SEQ ID NO: 32929 - DNA, 25 bp, Homo sapien
ccgctccacgtctgtggtcatggat

SEQ ID NO: 32930 - DNA, 25 bp, Homo sapien
gaaaccatcatactaagcaaactat

SEQ ID NO: 32931 - DNA, 25 bp, Homo sapien
aaatgacgagttgataggggcagca

SEQ ID NO: 32932 - DNA, 25 bp, Homo sapien
aggggcagcaaacaaacatggaaca

SEQ ID NO: 32933 - DNA, 25 bp, Homo sapien
ctgagaacaggaaagggcccggaag

SEQ ID NO: 32934 - DNA, 25 bp, Homo sapien
gaaagggcccggaagggctgactca

SEQ ID NO: 32935 - DNA, 25 bp, Homo sapien
ggccgacgctcacacgaaaatggga

SEQ ID NO: 32936 - DNA, 25 bp, Homo sapien
gacgctcacacgaaaatgggatgca

SEQ ID NO: 32937 - DNA, 25 bp, Homo sapien
gctcacacgaaaatgggatgcactt

SEQ ID NO: 32938 - DNA, 25 bp, Homo sapien
gaaaatgggatgcactttatttgct

SEQ ID NO: 32939 - DNA, 25 bp, Homo sapien
ctggtgcaaaggcaggtgagggtgc

SEQ ID NO: 32940 - DNA, 25 bp, Homo sapien
caaaggcaggtgagggtgcctcctg

SEQ ID NO: 32941 - DNA, 25 bp, Homo sapien
tttgaaagaggttccagctatcact

SEQ ID NO: 32942 - DNA, 25 bp, Homo sapien
ttccagctatcacttgtaaccatat

SEQ ID NO: 32943 - DNA, 25 bp, Homo sapien
gctatcacttgtaaccatatatata

SEQ ID NO: 32944 - DNA, 25 bp, Homo sapien
atgttactacaaacttgattaaact

SEQ ID NO: 32945 - DNA, 25 bp, Homo sapien
ttaaacttctggtggaaattccatc

SEQ ID NO: 32946 - DNA, 25 bp, Homo sapien
aattccatcacattttatgcaattt

SEQ ID NO: 32947 - DNA, 25 bp, Homo sapien
taatgccacatggacattatattcc

SEQ ID NO: 32948 - DNA, 25 bp, Homo sapien
gacattatattccttaaccattctt

SEQ ID NO: 32949 - DNA, 25 bp, Homo sapien
atattccttaaccattcttttgcat

SEQ ID NO: 32950 - DNA, 25 bp, Homo sapien
attcttttgcatgtgattaacattt

SEQ ID NO: 32951 - DNA, 25 bp, Homo sapien
taacatttgtgaaattaaccactta

SEQ ID NO: 32952 - DNA, 25 bp, Homo sapien
aaccacttaagcaagtgtttttgct

SEQ ID NO: 32953 - DNA, 25 bp, Homo sapien
gaatttgttggcagggcgtggtggc

SEQ ID NO: 32954 - DNA, 25 bp, Homo sapien
ggaggcagaagttgcggttagccga

SEQ ID NO: 32955 - DNA, 25 bp, Homo sapien
tttacctcaaaatgtgtttaaccat

SEQ ID NO: 32956 - DNA, 25 bp, Homo sapien
gaaatgaccctacaaagctgttttg

SEQ ID NO: 32957 - DNA, 25 bp, Homo sapien
agaccctcccaatcctgaggagatt

SEQ ID NO: 32958 - DNA, 25 bp, Homo sapien
aggagattaaaactctagcaccttt

SEQ ID NO: 32959 - DNA, 25 bp, Homo sapien
aaactctagcaccttttgaaagatc

SEQ ID NO: 32960 - DNA, 25 bp, Homo sapien
ctctagcaccttttgaaagatctga

SEQ ID NO: 32961 - DNA, 25 bp, Homo sapien
gtctctaagggcagcgactattaga

SEQ ID NO: 32962 - DNA, 25 bp, Homo sapien
gggcagcgactattagacttcaaag

SEQ ID NO: 32963 - DNA, 25 bp, Homo sapien
tagacttcaaagaactttggtctcc

SEQ ID NO: 32964 - DNA, 25 bp, Homo sapien
aattcacttgtagcctggaagcttc

SEQ ID NO: 32965 - DNA, 25 bp, Homo sapien
tcacttgtagcctggaagcttccct

SEQ ID NO: 32966 - DNA, 25 bp, Homo sapien
tgaagttcactcttgattgcaccca

SEQ ID NO: 32967 - DNA, 25 bp, Homo sapien
attgcacccaccctgtagaagatgg

SEQ ID NO: 32968 - DNA, 25 bp, Homo sapien
aattctgatgtcgtacctaaggctt

SEQ ID NO: 32969 - DNA, 25 bp, Homo sapien
ggagcaagagcaagatcaccgtgac

SEQ ID NO: 32970 - DNA, 25 bp, Homo sapien
atcaccgtgacatccgaggtgcctt

SEQ ID NO: 32971 - DNA, 25 bp, Homo sapien
acctaaggcttgtccatctttgttg

SEQ ID NO: 32972 - DNA, 25 bp, Homo sapien
gaataatctacgtgactggttgcgc

SEQ ID NO: 32973 - DNA, 25 bp, Homo sapien
ctggttgcgcgtagttgctaacagc

SEQ ID NO: 32974 - DNA, 25 bp, Homo sapien
tacgaattacgttacttccagatta

SEQ ID NO: 32975 - DNA, 25 bp, Homo sapien
ttgttggaggtgccatggctcctgt

SEQ ID NO: 32976 - DNA, 25 bp, Homo sapien
tttatccttgtatctctgcagtgtg

SEQ ID NO: 32977 - DNA, 25 bp, Homo sapien
gtctcgaggcagggctgacacatgg

SEQ ID NO: 32978 - DNA, 25 bp, Homo sapien
tgacacatggtgccatagccagcgg

SEQ ID NO: 32979 - DNA, 25 bp, Homo sapien
agcggagggcgctcagtgagtgccc

SEQ ID NO: 32980 - DNA, 25 bp, Homo sapien
cccgggccttctagacaacaggcag

SEQ ID NO: 32981 - DNA, 25 bp, Homo sapien
aggaaggatgaacctcagggcaccc

SEQ ID NO: 32982 - DNA, 25 bp, Homo sapien
ttgggacagaggtgcccacgagggc

SEQ ID NO: 32983 - DNA, 25 bp, Homo sapien
cacgagggcagaggccggtgctaag

SEQ ID NO: 32984 - DNA, 25 bp, Homo sapien
tcctctccagagatgccaggggggc

SEQ ID NO: 32985 - DNA, 25 bp, Homo sapien
caggggggcgtgtatgctctgcccc

SEQ ID NO: 32986 - DNA, 25 bp, Homo sapien
tgggtggggaggctctttaggctca

SEQ ID NO: 32987 - DNA, 25 bp, Homo sapien
tgccgcccgcattataaacacagga

SEQ ID NO: 32988 - DNA, 25 bp, Homo sapien
gtggccgtggacatgcacggtggca

SEQ ID NO: 32989 - DNA, 25 bp, Homo sapien
tggacatgcacggtggcactgtggc

SEQ ID NO: 32990 - DNA, 25 bp, Homo sapien
tcactcttccaagggccttcttggt

SEQ ID NO: 32991 - DNA, 25 bp, Homo sapien
caagggccttcttggtgtgactgtc

SEQ ID NO: 32992 - DNA, 25 bp, Homo sapien
aacaggagggcattggagcccatcc

SEQ ID NO: 32993 - DNA, 25 bp, Homo sapien
caggagggcattggagcccatccaa

SEQ ID NO: 32994 - DNA, 25 bp, Homo sapien
ccatccaagcagtccagggggaccc

SEQ ID NO: 32995 - DNA, 25 bp, Homo sapien
atccaagcagtccagggggaccctc

SEQ ID NO: 32996 - DNA, 25 bp, Homo sapien
caggcacctgcttgaggagtgccca

SEQ ID NO: 32997 - DNA, 25 bp, Homo sapien
cacctgcttgaggagtgcccagagc

SEQ ID NO: 32998 - DNA, 25 bp, Homo sapien
acctgcttgaggagtgcccagagca

SEQ ID NO: 32999 - DNA, 25 bp, Homo sapien
agctgggaaccttggtggaggggtg

SEQ ID NO: 33000 - DNA, 25 bp, Homo sapien
gggtggtgaccatcgaaaggagcaa

SEQ ID NO: 33001 - DNA, 25 bp, Homo sapien
ggagcaagagcaagatcaccgtgac

SEQ ID NO: 33002 - DNA, 25 bp, Homo sapien
gggccatggctcctgtgaaaaagct

SEQ ID NO: 33003 - DNA, 25 bp, Homo sapien
gatcaccgtgacatccgaggtgcct

SEQ ID NO: 33004 - DNA, 25 bp, Homo sapien
tccgaggtgcctttctccaaaaggt

SEQ ID NO: 33005 - DNA, 25 bp, Homo sapien
gaataatctacgtgactggttgcgc

SEQ ID NO: 33006 - DNA, 25 bp, Homo sapien
ctggttgcgcgtagttgctaacagc

SEQ ID NO: 33007 - DNA, 25 bp, Homo sapien
tacgaattacgttacttccagatta

SEQ ID NO: 33008 - DNA, 25 bp, Homo sapien
tgaagttcactcttgattgcaccca

SEQ ID NO: 33009 - DNA, 25 bp, Homo sapien
attgcacccaccctgtagaagatgg

SEQ ID NO: 33010 - DNA, 25 bp, Homo sapien
attaccttttgatcctcaatactga

SEQ ID NO: 33011 - DNA, 25 bp, Homo sapien
gacaatgtcttttcttttgtttcta

SEQ ID NO: 33012 - DNA, 25 bp, Homo sapien
aactttatattattcctcagaagca

SEQ ID NO: 33013 - DNA, 25 bp, Homo sapien
aaagtctactaacctgcattttcct

SEQ ID NO: 33014 - DNA, 25 bp, Homo sapien
gcattttcctgtagtttagcttcgt

SEQ ID NO: 33015 - DNA, 25 bp, Homo sapien
gacactggaaatgttcaactgtagt

SEQ ID NO: 33016 - DNA, 25 bp, Homo sapien
ggaagccaggcatgcaacagatttt

SEQ ID NO: 33017 - DNA, 25 bp, Homo sapien
gagacttcctttcagtgtaagagct

SEQ ID NO: 33018 - DNA, 25 bp, Homo sapien
gtttgtgttaaatttgcagcagagc

SEQ ID NO: 33019 - DNA, 25 bp, Homo sapien
gtacattgttctggaatttcatcat

SEQ ID NO: 33020 - DNA, 25 bp, Homo sapien
gaaattttttgcacatctgaatatc

SEQ ID NO: 33021 - DNA, 25 bp, Homo sapien
tcagaggccaccctgagatggaccg

SEQ ID NO: 33022 - DNA, 25 bp, Homo sapien
gatggaccgagatcttcagttgggg

SEQ ID NO: 33023 - DNA, 25 bp, Homo sapien
gagatcttcagttggggaggcgcct

SEQ ID NO: 33024 - DNA, 25 bp, Homo sapien
ggcgggccaatggctgtgacggata

SEQ ID NO: 33025 - DNA, 25 bp, Homo sapien
cagccgagtggcgggctagcatacc

SEQ ID NO: 33026 - DNA, 25 bp, Homo sapien
gagtggcgggctagcataccgcctg

SEQ ID NO: 33027 - DNA, 25 bp, Homo sapien
gtgacggataaggggtgtggggtgc

SEQ ID NO: 33028 - DNA, 25 bp, Homo sapien
tgtggggtgcggggacaatgggcca

SEQ ID NO: 33029 - DNA, 25 bp, Homo sapien
caatgggccagagcttctcatgcag

SEQ ID NO: 33030 - DNA, 25 bp, Homo sapien
ccagcgccgggtcggagagtcagag

SEQ ID NO: 33031 - DNA, 25 bp, Homo sapien
gggtcggagagtcagaggccaccct

SEQ ID NO: 33032 - DNA, 25 bp, Homo sapien
ctgtttgcagacgacatgattgttt

SEQ ID NO: 33033 - DNA, 25 bp, Homo sapien
gtttgcagacgacatgattgtttat

SEQ ID NO: 33034 - DNA, 25 bp, Homo sapien
gcagacgacatgattgtttatctag

SEQ ID NO: 33035 - DNA, 25 bp, Homo sapien
gacgacatgattgtttatctagaaa

SEQ ID NO: 33036 - DNA, 25 bp, Homo sapien
aagcattcctatacaccaacaacag

SEQ ID NO: 33037 - DNA, 25 bp, Homo sapien
agcattcctatacaccaacaacaga

SEQ ID NO: 33038 - DNA, 25 bp, Homo sapien
gcattcctatacaccaacaacagac

SEQ ID NO: 33039 - DNA, 25 bp, Homo sapien
attcctatacaccaacaacagacaa

SEQ ID NO: 33040 - DNA, 25 bp, Homo sapien
tcctatacaccaacaacagacaaac

SEQ ID NO: 33041 - DNA, 25 bp, Homo sapien
ctggttcaatatatgcaaatcaata

SEQ ID NO: 33042 - DNA, 25 bp, Homo sapien
cagagccaaagacaaaagccacatg

SEQ ID NO: 33043 - DNA, 25 bp, Homo sapien
gacggggctcctgaggggtacaggt

SEQ ID NO: 33044 - DNA, 25 bp, Homo sapien
tcccttctttggatgtccttgtgag

SEQ ID NO: 33045 - DNA, 25 bp, Homo sapien
tggatgtccttgtgagtcactctgg

SEQ ID NO: 33046 - DNA, 25 bp, Homo sapien
gttcctgggacaagggtcaagccag

SEQ ID NO: 33047 - DNA, 25 bp, Homo sapien
tgctttgcggggggcagggcagaaa

SEQ ID NO: 33048 - DNA, 25 bp, Homo sapien
ggggggcagggcagaaatggactcc

SEQ ID NO: 33049 - DNA, 25 bp, Homo sapien
ggcagaaatggactccttttgggtc

SEQ ID NO: 33050 - DNA, 25 bp, Homo sapien
ggccttgacccacaggacgtgtggt

SEQ ID NO: 33051 - DNA, 25 bp, Homo sapien
cccacaggacgtgtggtggcgcctg

SEQ ID NO: 33052 - DNA, 25 bp, Homo sapien
tgcgcctctagtgccttttgagggg

SEQ ID NO: 33053 - DNA, 25 bp, Homo sapien
ctagtgccttttgaggggttcccat

SEQ ID NO: 33054 - DNA, 25 bp, Homo sapien
gaatcgcttaaacccgtgaggtgga

SEQ ID NO: 33055 - DNA, 25 bp, Homo sapien
gcagagatcacgcaactgcactcca

SEQ ID NO: 33056 - DNA, 25 bp, Homo sapien
gaaatggacaggcaattcctcatag

SEQ ID NO: 33057 - DNA, 25 bp, Homo sapien
atcaatgaaaaactcgcagaagctg

SEQ ID NO: 33058 - DNA, 25 bp, Homo sapien
gtgaagctgccatgaaagagattga

SEQ ID NO: 33059 - DNA, 25 bp, Homo sapien
gagattgaatccattgtcaaagcta

SEQ ID NO: 33060 - DNA, 25 bp, Homo sapien
gtgagcagtgcttttgaacaagatg

SEQ ID NO: 33061 - DNA, 25 bp, Homo sapien
gaagattcccctttaattgtggata

SEQ ID NO: 33062 - DNA, 25 bp, Homo sapien
aaaataaagttcttgctgggcacag

SEQ ID NO: 33063 - DNA, 25 bp, Homo sapien
tgaggtgggtggatgacaaggtcag

SEQ ID NO: 33064 - DNA, 25 bp, Homo sapien
atcccagctacttggtaggccgagg

SEQ ID NO: 33065 - DNA, 25 bp, Homo sapien
tggtggagaccctggagctgcagaa

SEQ ID NO: 33066 - DNA, 25 bp, Homo sapien
gcagaacctgatgctgtgtgcgctg

SEQ ID NO: 33067 - DNA, 25 bp, Homo sapien
ctccaagcccatccaggggcaacag

SEQ ID NO: 33068 - DNA, 25 bp, Homo sapien
gaggagcactggaggaagcacaccc

SEQ ID NO: 33069 - DNA, 25 bp, Homo sapien
cagccattcactcctactgatgaga

SEQ ID NO: 33070 - DNA, 25 bp, Homo sapien
agctcatgcatgtgtcaatgtcata

SEQ ID NO: 33071 - DNA, 25 bp, Homo sapien
taactgtctttatacgcttctgcac

SEQ ID NO: 33072 - DNA, 25 bp, Homo sapien
tacgcttctgcactctggggaagaa

SEQ ID NO: 33073 - DNA, 25 bp, Homo sapien
taaagcacctgaagacgttcgaccg

SEQ ID NO: 33074 - DNA, 25 bp, Homo sapien
tgaagggggattggcacccagtggc

SEQ ID NO: 33075 - DNA, 25 bp, Homo sapien
tgtcccttgcttcattcttgtgaca

SEQ ID NO: 33076 - DNA, 25 bp, Homo sapien
atcatctttgattctctgtttcttt

SEQ ID NO: 33077 - DNA, 25 bp, Homo sapien
tcatctttgattctctgtttctttc

SEQ ID NO: 33078 - DNA, 25 bp, Homo sapien
tgcctccaaaatctatccttagtcc

SEQ ID NO: 33079 - DNA, 25 bp, Homo sapien
aaatctatccttagtccatcacttt

SEQ ID NO: 33080 - DNA, 25 bp, Homo sapien
tccaccaggcagacaactgagcctt

SEQ ID NO: 33081 - DNA, 25 bp, Homo sapien
gcagacaactgagccttttaaacct

SEQ ID NO: 33082 - DNA, 25 bp, Homo sapien
aactgagccttttaaacctccatca

SEQ ID NO: 33083 - DNA, 25 bp, Homo sapien
gagccttttaaacctccatcagatt

SEQ ID NO: 33084 - DNA, 25 bp, Homo sapien
taaacctccatcagatttgtcctct

SEQ ID NO: 33085 - DNA, 25 bp, Homo sapien
cccctgcaatgacttcttacctggg

SEQ ID NO: 33086 - DNA, 25 bp, Homo sapien
tgcaatgacttcttacctgggtcca

SEQ ID NO: 33087 - DNA, 25 bp, Homo sapien
ctggaagggctgatggagctccccg

SEQ ID NO: 33088 - DNA, 25 bp, Homo sapien
ttagaagtgcggtttactcctcatg

SEQ ID NO: 33089 - DNA, 25 bp, Homo sapien
ctcctcatgccgagatggaccttgg

SEQ ID NO: 33090 - DNA, 25 bp, Homo sapien
gggcagctcagttcacaagatgttg

SEQ ID NO: 33091 - DNA, 25 bp, Homo sapien
agcgtgccattgaggctgtgctgtc

SEQ ID NO: 33092 - DNA, 25 bp, Homo sapien
atagcgcatgtcacttgctggtttg

SEQ ID NO: 33093 - DNA, 25 bp, Homo sapien
aggtgctgaggatcaagccggcttc

SEQ ID NO: 33094 - DNA, 25 bp, Homo sapien
tgagcctgttcatatgactggccct

SEQ ID NO: 33095 - DNA, 25 bp, Homo sapien
gtccttggtgtctctagggtcttaa

SEQ ID NO: 33096 - DNA, 25 bp, Homo sapien
ctagggtcttaaggagcctccctca

SEQ ID NO: 33097 - DNA, 25 bp, Homo sapien
gcctccctcatgtctttaaggtagc

SEQ ID NO: 33098 - DNA, 25 bp, Homo sapien
ccatcctggcctcagaacatgctga

SEQ ID NO: 33099 - DNA, 25 bp, Homo sapien
gtagggtggcacctttttatccaag

SEQ ID NO: 33100 - DNA, 25 bp, Homo sapien
atccaagttactagctacacatcag

SEQ ID NO: 33101 - DNA, 25 bp, Homo sapien
gcatgactgcagagcggtagaggtg

SEQ ID NO: 33102 - DNA, 25 bp, Homo sapien
gtgctgctttttggagatggactgg

SEQ ID NO: 33103 - DNA, 25 bp, Homo sapien
tggactggaacgtctggtttctgtc

SEQ ID NO: 33104 - DNA, 25 bp, Homo sapien
ccggcagctacgtctattttctgta

SEQ ID NO: 33105 - DNA, 25 bp, Homo sapien
gtgccacagtgagacctggagccac

SEQ ID NO: 33106 - DNA, 25 bp, Homo sapien
ccctggcgccgtttagagctgggag

SEQ ID NO: 33107 - DNA, 25 bp, Homo sapien
tttagagctgggagcccgtggactc

SEQ ID NO: 33108 - DNA, 25 bp, Homo sapien
tctattcaaccactctgacgtgggg

SEQ ID NO: 33109 - DNA, 25 bp, Homo sapien
gaacttcggggtgaacacccgctga

SEQ ID NO: 33110 - DNA, 25 bp, Homo sapien
acacccgctgatcctttaacaagga

SEQ ID NO: 33111 - DNA, 25 bp, Homo sapien
gtttcctctcatacattccaagtaa

SEQ ID NO: 33112 - DNA, 25 bp, Homo sapien
ggagtgatagctctttctgttctgc

SEQ ID NO: 33113 - DNA, 25 bp, Homo sapien
tgccattcccaacattcctggggga

SEQ ID NO: 33114 - DNA, 25 bp, Homo sapien
atactatttcactgagcccaagatg

SEQ ID NO: 33115 - DNA, 25 bp, Homo sapien
gtctgtaacacctgtcaatacttgt

SEQ ID NO: 33116 - DNA, 25 bp, Homo sapien
gatattcttgcagctgactacgtgt

SEQ ID NO: 33117 - DNA, 25 bp, Homo sapien
gggcagatcagctttgcagtagatt

SEQ ID NO: 33118 - DNA, 25 bp, Homo sapien
attatgctgcatcctcgtggcaaaa

SEQ ID NO: 33119 - DNA, 25 bp, Homo sapien
aacccctttattgctgtctgagaaa

SEQ ID NO: 33120 - DNA, 25 bp, Homo sapien
aaaccttcaggtacataatgcatga

SEQ ID NO: 33121 - DNA, 25 bp, Homo sapien
tgcctgcaaaaattaagttctgtta

SEQ ID NO: 33122 - DNA, 25 bp, Homo sapien
gttctgttataataccagccaattc

SEQ ID NO: 33123 - DNA, 25 bp, Homo sapien
ccaattctgaattagccaatgccct

SEQ ID NO: 33124 - DNA, 25 bp, Homo sapien
gccaatgccctaaaagcatctaaca

SEQ ID NO: 33125 - DNA, 25 bp, Homo sapien
ggttatcttatgagtcctatgaaaa

SEQ ID NO: 33126 - DNA, 25 bp, Homo sapien
ttttagctaccaacgccatgtttac

SEQ ID NO: 33127 - DNA, 25 bp, Homo sapien
accaacgccatgtttacgtgacaag

SEQ ID NO: 33128 - DNA, 25 bp, Homo sapien
gacaagaaattgttttggccctgtg

SEQ ID NO: 33129 - DNA, 25 bp, Homo sapien
ttggccctgtggtttatgacgtgct

SEQ ID NO: 33130 - DNA, 25 bp, Homo sapien
tgtggtttatgacgtgctgctggat

SEQ ID NO: 33131 - DNA, 25 bp, Homo sapien
ccagcaacgagaacgccacatggtc

SEQ ID NO: 33132 - DNA, 25 bp, Homo sapien
ctcaccctctaaacgttcagcggtg

SEQ ID NO: 33133 - DNA, 25 bp, Homo sapien
aacggacgtttgagctcacgtggcg

SEQ ID NO: 33134 - DNA, 25 bp, Homo sapien
ggcggccatgcatggtttgtggcgg

SEQ ID NO: 33135 - DNA, 25 bp, Homo sapien
tttgtggcggaagacggggcccagc

SEQ ID NO: 33136 - DNA, 25 bp, Homo sapien
tcccccagcgctgaagcacggggtt

SEQ ID NO: 33137 - DNA, 25 bp, Homo sapien
ggggctcgggaccatgaggatgacc

SEQ ID NO: 33138 - DNA, 25 bp, Homo sapien
acaaaactgctccaacagacttttt

SEQ ID NO: 33139 - DNA, 25 bp, Homo sapien
ggctggagcagcacgacagctgccc

SEQ ID NO: 33140 - DNA, 25 bp, Homo sapien
cccgtctgccgaaaaagcctcacgg

SEQ ID NO: 33141 - DNA, 25 bp, Homo sapien
aagcctcacgggacagaacacggcc

SEQ ID NO: 33142 - DNA, 25 bp, Homo sapien
gactggtcccagaactaccatattt

SEQ ID NO: 33143 - DNA, 25 bp, Homo sapien
gtcccagaactaccatatttgtaaa

SEQ ID NO: 33144 - DNA, 25 bp, Homo sapien
tgtaaaatccctggaagacccttat

SEQ ID NO: 33145 - DNA, 25 bp, Homo sapien
atccctggaagacccttattcccag

SEQ ID NO: 33146 - DNA, 25 bp, Homo sapien
acccttattcccagcaaattcgctt

SEQ ID NO: 33147 - DNA, 25 bp, Homo sapien
agcaaattcgcttacaacagcagca

SEQ ID NO: 33148 - DNA, 25 bp, Homo sapien
acgcaatgcctacacacggttttaa

SEQ ID NO: 33149 - DNA, 25 bp, Homo sapien
gcctacacacggttttaaccatgga

SEQ ID NO: 33150 - DNA, 25 bp, Homo sapien
gaatgcactgcagactctcaagaga

SEQ ID NO: 33151 - DNA, 25 bp, Homo sapien
gactctcaagagatcaatcaaattg

SEQ ID NO: 33152 - DNA, 25 bp, Homo sapien
aacagtttggtttttcatatggaat

SEQ ID NO: 33153 - DNA, 25 bp, Homo sapien
aatgagatgagggcaggccgcccct

SEQ ID NO: 33154 - DNA, 25 bp, Homo sapien
cccagctagcgcaggaagttcctgg

SEQ ID NO: 33155 - DNA, 25 bp, Homo sapien
agagctggaagagctttcccttctg

SEQ ID NO: 33156 - DNA, 25 bp, Homo sapien
cgtcttctcgcagccgtatagtagt

SEQ ID NO: 33157 - DNA, 25 bp, Homo sapien
cgtccttgaagtccttttcgatggc

SEQ ID NO: 33158 - DNA, 25 bp, Homo sapien
tctcctcgctctcaggggcgaggta

SEQ ID NO: 33159 - DNA, 25 bp, Homo sapien
gcgaggtagctcacgtagggcttga

SEQ ID NO: 33160 - DNA, 25 bp, Homo sapien
ttgagcttgaagccggtcagatccg

SEQ ID NO: 33161 - DNA, 25 bp, Homo sapien
gtcagatccgggacgacgaactccg

SEQ ID NO: 33162 - DNA, 25 bp, Homo sapien
cgaacctccagcccgaggtgaggaa

SEQ ID NO: 33163 - DNA, 25 bp, Homo sapien
cgaggtgaggaagccgatgcccttg

SEQ ID NO: 33164 - DNA, 25 bp, Homo sapien
ggaggtgctcaagtacagcgagttc

SEQ ID NO: 33165 - DNA, 25 bp, Homo sapien
ggtgctcaagtacagcgagttcttc

SEQ ID NO: 33166 - DNA, 25 bp, Homo sapien
gctcaagtacagcgagttcttcacg

SEQ ID NO: 33167 - DNA, 25 bp, Homo sapien
caagtacagcgagttcttcacgggc

SEQ ID NO: 33168 - DNA, 25 bp, Homo sapien
gcgcagcgtgcacgaggagttttga

SEQ ID NO: 33169 - DNA, 25 bp, Homo sapien
tcactctgccgaaggcgctgacggc

SEQ ID NO: 33170 - DNA, 25 bp, Homo sapien
actctgccgaaggcgctgacggcat

SEQ ID NO: 33171 - DNA, 25 bp, Homo sapien
tctgccgaaggcgctgacggcatcg

SEQ ID NO: 33172 - DNA, 25 bp, Homo sapien
tgccgaaggcgctgacggcatcgcg

SEQ ID NO: 33173 - DNA, 25 bp, Homo sapien
aaacttcgctggaaatgagtagcca

SEQ ID NO: 33174 - DNA, 25 bp, Homo sapien
tgagtagccaggaagttcaggggag

SEQ ID NO: 33175 - DNA, 25 bp, Homo sapien
tttcccttcctctctatttataagg

SEQ ID NO: 33176 - DNA, 25 bp, Homo sapien
tctatttataaggtccctgctccac

SEQ ID NO: 33177 - DNA, 25 bp, Homo sapien
agccccaaccaaagacactagtgca

SEQ ID NO: 33178 - DNA, 25 bp, Homo sapien
caaccaaagacactagtgcaccccc

SEQ ID NO: 33179 - DNA, 25 bp, Homo sapien
ttcacagacactgacctcagaggcc

SEQ ID NO: 33180 - DNA, 25 bp, Homo sapien
cctctgtaccccgtgaggggtggca

SEQ ID NO: 33181 - DNA, 25 bp, Homo sapien
ccccccccaacagctgctatggggg

SEQ ID NO: 33182 - DNA, 25 bp, Homo sapien
ccaacagctgctatgggggggctaa

SEQ ID NO: 33183 - DNA, 25 bp, Homo sapien
atgggggggctaaattatctctatt

SEQ ID NO: 33184 - DNA, 25 bp, Homo sapien
ggggctaaattatctctattttgta

SEQ ID NO: 33185 - DNA, 25 bp, Homo sapien
ggatctatatttgtaggggttcggg

SEQ ID NO: 33186 - DNA, 25 bp, Homo sapien
ctgcgccggagcttaggactcggaa

SEQ ID NO: 33187 - DNA, 25 bp, Homo sapien
gcgccggagcttaggactcggaagc

SEQ ID NO: 33188 - DNA, 25 bp, Homo sapien
ggagcttaggactcggaagcggccg

SEQ ID NO: 33189 - DNA, 25 bp, Homo sapien
ctccctgaggcgagggtagcgggtg

SEQ ID NO: 33190 - DNA, 25 bp, Homo sapien
tgaggcgagggtagcgggtgcatgg

SEQ ID NO: 33191 - DNA, 25 bp, Homo sapien
ggtagcgggtgcatggcgcagtaac

SEQ ID NO: 33192 - DNA, 25 bp, Homo sapien
tagcgggtgcatggcgcagtaacgg

SEQ ID NO: 33193 - DNA, 25 bp, Homo sapien
ccttctactgctgcaaggagcacca

SEQ ID NO: 33194 - DNA, 25 bp, Homo sapien
actgctgcaaggagcaccagcgtca

SEQ ID NO: 33195 - DNA, 25 bp, Homo sapien
gagcaccagcgtcaggactggaaga

SEQ ID NO: 33196 - DNA, 25 bp, Homo sapien
gcaccagcgtcaggactggaagaag

SEQ ID NO: 33197 - DNA, 25 bp, Homo sapien
agacggccttgagtctcagtacgag

SEQ ID NO: 33198 - DNA, 25 bp, Homo sapien
acggccttgagtctcagtacgagtg

SEQ ID NO: 33199 - DNA, 25 bp, Homo sapien
gccttgagtctcagtacgagtgtgc

SEQ ID NO: 33200 - DNA, 25 bp, Homo sapien
tgagtctcagtacgagtgtgcgtga

SEQ ID NO: 33201 - DNA, 25 bp, Homo sapien
gtctcagtacgagtgtgcgtgagtg

SEQ ID NO: 33202 - DNA, 25 bp, Homo sapien
gtacgagtgtgcgtgagtgtgagcc

SEQ ID NO: 33203 - DNA, 25 bp, Homo sapien
gagtgtgcgtgagtgtgagccacct

SEQ ID NO: 33204 - DNA, 25 bp, Homo sapien
agtgtgcgtgagtgtgagccacctt

SEQ ID NO: 33205 - DNA, 25 bp, Homo sapien
cgtgagtgtgagccaccttggcaag

SEQ ID NO: 33206 - DNA, 25 bp, Homo sapien
gagtgtgagccaccttggcaagtgc

SEQ ID NO: 33207 - DNA, 25 bp, Homo sapien
tgtgagccaccttggcaagtgcctg

SEQ ID NO: 33208 - DNA, 25 bp, Homo sapien
ttccctggacacgaagccaggagat

SEQ ID NO: 33209 - DNA, 25 bp, Homo sapien
gccaggagatctgtgttctaagccc

SEQ ID NO: 33210 - DNA, 25 bp, Homo sapien
ggagatctgtgttctaagcccagac

SEQ ID NO: 33211 - DNA, 25 bp, Homo sapien
tctgtgttctaagcccagactcact

SEQ ID NO: 33212 - DNA, 25 bp, Homo sapien
gactcactgtcaccttaggctagtg

SEQ ID NO: 33213 - DNA, 25 bp, Homo sapien
actgtcaccttaggctagtgcctcc

SEQ ID NO: 33214 - DNA, 25 bp, Homo sapien
cacagcttccttgggcggattttgg

SEQ ID NO: 33215 - DNA, 25 bp, Homo sapien
tgggcggattttgggaactggcacg

SEQ ID NO: 33216 - DNA, 25 bp, Homo sapien
gattttgggaactggcacgttttat

SEQ ID NO: 33217 - DNA, 25 bp, Homo sapien
ggaactggcacgttttatttttgag

SEQ ID NO: 33218 - DNA, 25 bp, Homo sapien
actggcacgttttatttttgagaga

SEQ ID NO: 33219 - DNA, 25 bp, Homo sapien
gaccggatacaggtgtctggggtcc

SEQ ID NO: 33220 - DNA, 25 bp, Homo sapien
tctccgctccaaagataccacagag

SEQ ID NO: 33221 - DNA, 25 bp, Homo sapien
gataccacagagaacgtgtcattcc

SEQ ID NO: 33222 - DNA, 25 bp, Homo sapien
cagagaacgtgtcattcccacattc

SEQ ID NO: 33223 - DNA, 25 bp, Homo sapien
gtgtcattcccacattcagtgagcc

SEQ ID NO: 33224 - DNA, 25 bp, Homo sapien
ttcagtgagccaatcagcagtccct

SEQ ID NO: 33225 - DNA, 25 bp, Homo sapien
acgctccctttgcatagaaactgag

SEQ ID NO: 33226 - DNA, 25 bp, Homo sapien
tgagggtcccttagctgaaggcacc

SEQ ID NO: 33227 - DNA, 25 bp, Homo sapien
gtcccttagctgaaggcaccacaag

SEQ ID NO: 33228 - DNA, 25 bp, Homo sapien
acatgataatgtgtgcagcaactag

SEQ ID NO: 33229 - DNA, 25 bp, Homo sapien
atgtgtgcagcaactagaaactata

SEQ ID NO: 33230 - DNA, 25 bp, Homo sapien
aatgaattcacaatttatgcctata

SEQ ID NO: 33231 - DNA, 25 bp, Homo sapien
ttatgcctataaatttcagatgatt

SEQ ID NO: 33232 - DNA, 25 bp, Homo sapien
aaaacattgaagttcgtcttgaaga

SEQ ID NO: 33233 - DNA, 25 bp, Homo sapien
ggtatgcatggaggtgatttatttt

SEQ ID NO: 33234 - DNA, 25 bp, Homo sapien
cataacacctaacctaacatgggta

SEQ ID NO: 33235 - DNA, 25 bp, Homo sapien
gtatggaactagatatgagctgtat

SEQ ID NO: 33236 - DNA, 25 bp, Homo sapien
gaacaagtagattgattgccttcat

SEQ ID NO: 33237 - DNA, 25 bp, Homo sapien
ttgccttcatatacaagtatgtttt

SEQ ID NO: 33238 - DNA, 25 bp, Homo sapien
atttccttattatcagatgtatttt

SEQ ID NO: 33239 - DNA, 25 bp, Homo sapien
agtttcaatgttgttataattctca

SEQ ID NO: 33240 - DNA, 25 bp, Homo sapien
aaatttagcttgtgcttttgaatta

SEQ ID NO: 33241 - DNA, 25 bp, Homo sapien
gtatgtacatacagtctgataccta

SEQ ID NO: 33242 - DNA, 25 bp, Homo sapien
gattccataaaaccagactcaagtc

SEQ ID NO: 33243 - DNA, 25 bp, Homo sapien
gactcaagtcttgtttagactactg

SEQ ID NO: 33244 - DNA, 25 bp, Homo sapien
ctgaatactgttttagcctgtgccc

SEQ ID NO: 33245 - DNA, 25 bp, Homo sapien
ccctggattctacctctgtatagga

SEQ ID NO: 33246 - DNA, 25 bp, Homo sapien
attggttatgtttcttgcactaagg

SEQ ID NO: 33247 - DNA, 25 bp, Homo sapien
ggatgtttaaaactccgctgtaagt

SEQ ID NO: 33248 - DNA, 25 bp, Homo sapien
ggcaggatgaatcacttgacacata

SEQ ID NO: 33249 - DNA, 25 bp, Homo sapien
ttcattttcttttctttttctacat

SEQ ID NO: 33250 - DNA, 25 bp, Homo sapien
tatgttttcttctctgatttgttca

SEQ ID NO: 33251 - DNA, 25 bp, Homo sapien
aatgctctacaattaaagctggatt

SEQ ID NO: 33252 - DNA, 25 bp, Homo sapien
ctcatgctagcctcacgaaactgga

SEQ ID NO: 33253 - DNA, 25 bp, Homo sapien
gaacttgttgctgattttgaccttg

SEQ ID NO: 33254 - DNA, 25 bp, Homo sapien
tgaagttaactgttccccttggtat

SEQ ID NO: 33255 - DNA, 25 bp, Homo sapien
gtgttctgggatttctctagaggct

SEQ ID NO: 33256 - DNA, 25 bp, Homo sapien
gaaccagttgttttgtcttgcgggt

SEQ ID NO: 33257 - DNA, 25 bp, Homo sapien
gaaagtccaagccgtaggacccagt

SEQ ID NO: 33258 - DNA, 25 bp, Homo sapien
agtttcctttcttagctgatgtctt

SEQ ID NO: 33259 - DNA, 25 bp, Homo sapien
ctgatgtctttggccagaacaccgt

SEQ ID NO: 33260 - DNA, 25 bp, Homo sapien
agaacaccgtgggctgttacttgct

SEQ ID NO: 33261 - DNA, 25 bp, Homo sapien
gaagcggtttgcatttacgcctgta

SEQ ID NO: 33262 - DNA, 25 bp, Homo sapien
ttttgtacgcaattctcgattcttt

SEQ ID NO: 33263 - DNA, 25 bp, Homo sapien
gattttaagccaattctagtaagaa

SEQ ID NO: 33264 - DNA, 25 bp, Homo sapien
gtatttcacttaaggtggaggacct

SEQ ID NO: 33265 - DNA, 25 bp, Homo sapien
gaggaccttaactaaaggaccatat

SEQ ID NO: 33266 - DNA, 25 bp, Homo sapien
aaatactgacagtgtttagcaacat

SEQ ID NO: 33267 - DNA, 25 bp, Homo sapien
gtttagcaacatgcagccctttgag

SEQ ID NO: 33268 - DNA, 25 bp, Homo sapien
gcagccctttgagatttctgtcgta

SEQ ID NO: 33269 - DNA, 25 bp, Homo sapien
gatttctgtcgtaatgctaaacttg

SEQ ID NO: 33270 - DNA, 25 bp, Homo sapien
tgaacatgtggttagtcttttattt

SEQ ID NO: 33271 - DNA, 25 bp, Homo sapien
catgtctataggtctgtcattgtcc

SEQ ID NO: 33272 - DNA, 25 bp, Homo sapien
gtctgtcattgtcctttttcaaagc

SEQ ID NO: 33273 - DNA, 25 bp, Homo sapien
ttgctctgggagaatgcattctaaa

SEQ ID NO: 33274 - DNA, 25 bp, Homo sapien
gtcaaggagagtgcagtcaaccagt

SEQ ID NO: 33275 - DNA, 25 bp, Homo sapien
tattctcagaccacttctaccaaaa

SEQ ID NO: 33276 - DNA, 25 bp, Homo sapien
aagtcagtccttttatctactcaat

SEQ ID NO: 33277 - DNA, 25 bp, Homo sapien
aaagagaccaccttcacttgttgag

SEQ ID NO: 33278 - DNA, 25 bp, Homo sapien
gatttcacgttatcagtgcagttcc

SEQ ID NO: 33279 - DNA, 25 bp, Homo sapien
tgcagttccgttctcgggggaaagc

SEQ ID NO: 33280 - DNA, 25 bp, Homo sapien
cccatccgtactaccaggagactgg

SEQ ID NO: 33281 - DNA, 25 bp, Homo sapien
gagactggatccgcaaagtagacac

SEQ ID NO: 33282 - DNA, 25 bp, Homo sapien
gacacttggtctcatgaagccactg

SEQ ID NO: 33283 - DNA, 25 bp, Homo sapien
gccactgctgggctccagagagaag

SEQ ID NO: 33284 - DNA, 25 bp, Homo sapien
gttgtggcagacaatatgctgaaca

SEQ ID NO: 33285 - DNA, 25 bp, Homo sapien
ggagtgcaatggcgtgataccggct

SEQ ID NO: 33286 - DNA, 25 bp, Homo sapien
tgggattgcaggcatgtgcaccacg

SEQ ID NO: 33287 - DNA, 25 bp, Homo sapien
gtacccaagcaagcaattttaagtg

SEQ ID NO: 33288 - DNA, 25 bp, Homo sapien
gtagtcaggaaaggccccattgcag

SEQ ID NO: 33289 - DNA, 25 bp, Homo sapien
gaaaggccccattgcagaaaaaaat

SEQ ID NO: 33290 - DNA, 25 bp, Homo sapien
tgagggagggaacaggtggataact

SEQ ID NO: 33291 - DNA, 25 bp, Homo sapien
ggtggataactgggggataagcagg

SEQ ID NO: 33292 - DNA, 25 bp, Homo sapien
gtgcaaaggctcttgggtcagaaca

SEQ ID NO: 33293 - DNA, 25 bp, Homo sapien
aatttaagctgttcattcaaccaaa

SEQ ID NO: 33294 - DNA, 25 bp, Homo sapien
gtgggtagctgggtgtggtgttgca

SEQ ID NO: 33295 - DNA, 25 bp, Homo sapien
tggtcctagccacttgggaggttga

SEQ ID NO: 33296 - DNA, 25 bp, Homo sapien
cgcctgaggctgcggggaaaccgcg

SEQ ID NO: 33297 - DNA, 25 bp, Homo sapien
tgaggctgcggggaaaccgcgggga

SEQ ID NO: 33298 - DNA, 25 bp, Homo sapien
gtcttggctggtcagcgctacaggc

SEQ ID NO: 33299 - DNA, 25 bp, Homo sapien
cgcctgttccagggcaggatcctgg

SEQ ID NO: 33300 - DNA, 25 bp, Homo sapien
gttccagggcaggatcctggaccgg

SEQ ID NO: 33301 - DNA, 25 bp, Homo sapien
ctcaccctctaaacgttcagcggtg

SEQ ID NO: 33302 - DNA, 25 bp, Homo sapien
taaacgttcagcggtggaaagattt

SEQ ID NO: 33303 - DNA, 25 bp, Homo sapien
ctccagctcgcccagtaaagagaac

SEQ ID NO: 33304 - DNA, 25 bp, Homo sapien
gctcgcccagtaaagagaacgccac

SEQ ID NO: 33305 - DNA, 25 bp, Homo sapien
cgcccagtaaagagaacgccacaag

SEQ ID NO: 33306 - DNA, 25 bp, Homo sapien
aagagaacgccacaagtaactcctg

SEQ ID NO: 33307 - DNA, 25 bp, Homo sapien
atatatctgaaccaagttgtgtgca

SEQ ID NO: 33308 - DNA, 25 bp, Homo sapien
gagtgacttcagggacagagcagag

SEQ ID NO: 33309 - DNA, 25 bp, Homo sapien
agttagaatcagcatagcctccctg

SEQ ID NO: 33310 - DNA, 25 bp, Homo sapien
attttgattaataccccagcctaag

SEQ ID NO: 33311 - DNA, 25 bp, Homo sapien
ttaataccccagcctaagagttata

SEQ ID NO: 33312 - DNA, 25 bp, Homo sapien
gtttcgggtctttacctcatagtat

SEQ ID NO: 33313 - DNA, 25 bp, Homo sapien
gacactgcatagattttgccctgaa

SEQ ID NO: 33314 - DNA, 25 bp, Homo sapien
ttttgccctgaatactggtgtgccc

SEQ ID NO: 33315 - DNA, 25 bp, Homo sapien
tactggtgtgcccaggtatgccgtg

SEQ ID NO: 33316 - DNA, 25 bp, Homo sapien
tctctctctgtttccagtggtggta

SEQ ID NO: 33317 - DNA, 25 bp, Homo sapien
taaagaaagctggggttaatcctga

SEQ ID NO: 33318 - DNA, 25 bp, Homo sapien
ggactacttccacagtgttcttctt

SEQ ID NO: 33319 - DNA, 25 bp, Homo sapien
gatggccattttgatgctccagatg

SEQ ID NO: 33320 - DNA, 25 bp, Homo sapien
ttagccaacactgatgttcccatcc

SEQ ID NO: 33321 - DNA, 25 bp, Homo sapien
cccatcccaacacactactttgtgg

SEQ ID NO: 33322 - DNA, 25 bp, Homo sapien
aaactgccctgggtggctggatgtc

SEQ ID NO: 33323 - DNA, 25 bp, Homo sapien
ctggatgtcctaccctttatcatcc

SEQ ID NO: 33324 - DNA, 25 bp, Homo sapien
tcaccgacctaccaacgtggagagc

SEQ ID NO: 33325 - DNA, 25 bp, Homo sapien
aagatttacagctcacattgcccgg

SEQ ID NO: 33326 - DNA, 25 bp, Homo sapien
cccgggtccgtgatgtagaacttct

SEQ ID NO: 33327 - DNA, 25 bp, Homo sapien
tagaacttctcactgggcttgactt

SEQ ID NO: 33328 - DNA, 25 bp, Homo sapien
gtgcagcctgtctctgaaattttgc

SEQ ID NO: 33329 - DNA, 25 bp, Homo sapien
gatggaggccgtttttctggagaac

SEQ ID NO: 33330 - DNA, 25 bp, Homo sapien
ctggagaacctgaggcatgcagctg

SEQ ID NO: 33331 - DNA, 25 bp, Homo sapien
catgcagctggggttttggctcagg

SEQ ID NO: 33332 - DNA, 25 bp, Homo sapien
ggctcaggaggacctcgtgggactg

SEQ ID NO: 33333 - DNA, 25 bp, Homo sapien
gcggcagccatcttacagaaggtag

SEQ ID NO: 33334 - DNA, 25 bp, Homo sapien
ggacatattccactggcagatcatg

SEQ ID NO: 33335 - DNA, 25 bp, Homo sapien
ggagttcctgcccattgttgggcat

SEQ ID NO: 33336 - DNA, 25 bp, Homo sapien
gcagccccggagagctgaatttccc

SEQ ID NO: 33337 - DNA, 25 bp, Homo sapien
tgaatttcccctatctgtttcaact

SEQ ID NO: 33338 - DNA, 25 bp, Homo sapien
gggcttgagttggctacgttcatac

SEQ ID NO: 33339 - DNA, 25 bp, Homo sapien
catactgggataggcggggccaccc

SEQ ID NO: 33340 - DNA, 25 bp, Homo sapien
tcaagattaccagccattgaccacc

SEQ ID NO: 33341 - DNA, 25 bp, Homo sapien
ggaagggccttagcctgggaagcac

SEQ ID NO: 33342 - DNA, 25 bp, Homo sapien
agcctgggaagcacagcttctccgt

SEQ ID NO: 33343 - DNA, 25 bp, Homo sapien
ctcgcaatacaccaggaagctccgc

SEQ ID NO: 33344 - DNA, 25 bp, Homo sapien
ccgtcggagactcaatcttcgcatc

SEQ ID NO: 33345 - DNA, 25 bp, Homo sapien
gcaggggtgcaaatgggtggccgtg

SEQ ID NO: 33346 - DNA, 25 bp, Homo sapien
ggccgaagggctgaaccactgggcc

SEQ ID NO: 33347 - DNA, 25 bp, Homo sapien
cccggatggggctcacagagcggaa

SEQ ID NO: 33348 - DNA, 25 bp, Homo sapien
agagcggaacgctccacgagaatcg

SEQ ID NO: 33349 - DNA, 25 bp, Homo sapien
cacgagaatcgtgggggcgagggaa

SEQ ID NO: 33350 - DNA, 25 bp, Homo sapien
tgggggcgagggaaagggtcaagat

SEQ ID NO: 33351 - DNA, 25 bp, Homo sapien
aaaccacagactttggcctcagaga

SEQ ID NO: 33352 - DNA, 25 bp, Homo sapien
gattgtgtgaaactgcccagctcag

SEQ ID NO: 33353 - DNA, 25 bp, Homo sapien
gcccagctcagggataaccagggac

SEQ ID NO: 33354 - DNA, 25 bp, Homo sapien
aaccagggacattcacctgtgttca

SEQ ID NO: 33355 - DNA, 25 bp, Homo sapien
ggatgtattgtttccactcgtgtcc

SEQ ID NO: 33356 - DNA, 25 bp, Homo sapien
gtccctaaggagtgagaaacccatt

SEQ ID NO: 33357 - DNA, 25 bp, Homo sapien
gaaacccatttatactctactctca

SEQ ID NO: 33358 - DNA, 25 bp, Homo sapien
ttaatattctgtttaggcccactaa

SEQ ID NO: 33359 - DNA, 25 bp, Homo sapien
ggcccactaaggcaaaatagcccca

SEQ ID NO: 33360 - DNA, 25 bp, Homo sapien
atagccccaaaacaagactgacaaa

SEQ ID NO: 33361 - DNA, 25 bp, Homo sapien
gaggcttaaaattgactgccaggct

SEQ ID NO: 33362 - DNA, 25 bp, Homo sapien
aattgaattctcttttcacattagt

SEQ ID NO: 33363 - DNA, 25 bp, Homo sapien
atttgtggatttgatatcctggata

SEQ ID NO: 33364 - DNA, 25 bp, Homo sapien
gtaatgctgcatttctatttgaatg

SEQ ID NO: 33365 - DNA, 25 bp, Homo sapien
gaatgttaagtggtctttcttgttt

SEQ ID NO: 33366 - DNA, 25 bp, Homo sapien
tattcatgcatgtatattcatcata

SEQ ID NO: 33367 - DNA, 25 bp, Homo sapien
catcatattttacaaggttcctggt

SEQ ID NO: 33368 - DNA, 25 bp, Homo sapien
aattacagggctctatttaaggatg

SEQ ID NO: 33369 - DNA, 25 bp, Homo sapien
gataaagaaatgtttccctgcccca

SEQ ID NO: 33370 - DNA, 25 bp, Homo sapien
cacagtcttcattctatttctcttt

SEQ ID NO: 33371 - DNA, 25 bp, Homo sapien
atttctctttaattttattcactga

SEQ ID NO: 33372 - DNA, 25 bp, Homo sapien
agcaaacccatggaaaatgtctcag

SEQ ID NO: 33373 - DNA, 25 bp, Homo sapien
cctgcctctctaggtttttcaatac

SEQ ID NO: 33374 - DNA, 25 bp, Homo sapien
gctacccaaaagctgaccgtccagc

SEQ ID NO: 33375 - DNA, 25 bp, Homo sapien
cctgaccacacttgttcctagtgca

SEQ ID NO: 33376 - DNA, 25 bp, Homo sapien
tagtgcagggagctcagacagggcc

SEQ ID NO: 33377 - DNA, 25 bp, Homo sapien
agacagggccttccatctagagccc

SEQ ID NO: 33378 - DNA, 25 bp, Homo sapien
catctagagcccagcacctagagcc

SEQ ID NO: 33379 - DNA, 25 bp, Homo sapien
tagagccaggctgcccagattcaaa

SEQ ID NO: 33380 - DNA, 25 bp, Homo sapien
cacttttcccactgtatgatcttgg

SEQ ID NO: 33381 - DNA, 25 bp, Homo sapien
tgtgccttggtttcctcatttataa

SEQ ID NO: 33382 - DNA, 25 bp, Homo sapien
aaatgtggataacaggccgggcgca

SEQ ID NO: 33383 - DNA, 25 bp, Homo sapien
ggctgaggcgggagagtggcgtgaa

SEQ ID NO: 33384 - DNA, 25 bp, Homo sapien
agcaggaatggatgtcccactgtcc

SEQ ID NO: 33385 - DNA, 25 bp, Homo sapien
tgtgacttgctcccaagttcagggc

SEQ ID NO: 33386 - DNA, 25 bp, Homo sapien
ccaagttcagggcaggtccatctga

SEQ ID NO: 33387 - DNA, 25 bp, Homo sapien
tcagggcaggtccatctgattggct

SEQ ID NO: 33388 - DNA, 25 bp, Homo sapien
atctgattggctgagtctggaatgt

SEQ ID NO: 33389 - DNA, 25 bp, Homo sapien
gagggaggcagggaaagtaagcctt

SEQ ID NO: 33390 - DNA, 25 bp, Homo sapien
ccttttcagcttctgtcgtgggagg

SEQ ID NO: 33391 - DNA, 25 bp, Homo sapien
agcttctgtcgtgggaggtgggctc

SEQ ID NO: 33392 - DNA, 25 bp, Homo sapien
agggtggaggatcttcaaacacagg

SEQ ID NO: 33393 - DNA, 25 bp, Homo sapien
caggaaaagaacccggatcctggca

SEQ ID NO: 33394 - DNA, 25 bp, Homo sapien
gcaatagtaaaggatcttttctttg

SEQ ID NO: 33395 - DNA, 25 bp, Homo sapien
tatagaaaacaatccttacttcttt

SEQ ID NO: 33396 - DNA, 25 bp, Homo sapien
aaacaaaatcatgggaattattctt

SEQ ID NO: 33397 - DNA, 25 bp, Homo sapien
agttataaatctttctctgggccgg

SEQ ID NO: 33398 - DNA, 25 bp, Homo sapien
aaagtcgacgcggccgcgaatttag

SEQ ID NO: 33399 - DNA, 25 bp, Homo sapien
gacgcggccgcgaatttagtagtag

SEQ ID NO: 33400 - DNA, 25 bp, Homo sapien
tttagtagtagtaggcggccgctct

SEQ ID NO: 33401 - DNA, 25 bp, Homo sapien
tagtaggcggccgctctagaggatc

SEQ ID NO: 33402 - DNA, 25 bp, Homo sapien
gccgctctagaggatccaagcttac

SEQ ID NO: 33403 - DNA, 25 bp, Homo sapien
agaggatccaagcttacgtacgcgt

SEQ ID NO: 33404 - DNA, 25 bp, Homo sapien
ccaagcttacgtacgcgtgcatgcg

SEQ ID NO: 33405 - DNA, 25 bp, Homo sapien
ttacgtacgcgtgcatgcgacgtca

SEQ ID NO: 33406 - DNA, 25 bp, Homo sapien
tttgtccctgtttctatcaactgta

SEQ ID NO: 33407 - DNA, 25 bp, Homo sapien
gtccctgtttctatcaactgtaaaa

SEQ ID NO: 33408 - DNA, 25 bp, Homo sapien
agagatgaggtttcgccatgttggc

SEQ ID NO: 33409 - DNA, 25 bp, Homo sapien
atgaggtttcgccatgttggccagg

SEQ ID NO: 33410 - DNA, 25 bp, Homo sapien
ccgcaccaggctgcaagatgtttaa

SEQ ID NO: 33411 - DNA, 25 bp, Homo sapien
ggctgcaagatgtttaagaatgggc

SEQ ID NO: 33412 - DNA, 25 bp, Homo sapien
gaatgggctttgacaagttgatttt

SEQ ID NO: 33413 - DNA, 25 bp, Homo sapien
aaatgggggttctagagttgttgtg

SEQ ID NO: 33414 - DNA, 25 bp, Homo sapien
gtggtgtgagatgtattgtaacaga

SEQ ID NO: 33415 - DNA, 25 bp, Homo sapien
taatacacacaaagcaccaagaaca

SEQ ID NO: 33416 - DNA, 25 bp, Homo sapien
caccaagaacaatgctggagtgcag

SEQ ID NO: 33417 - DNA, 25 bp, Homo sapien
gaggaccggaggttgggttcctgat

SEQ ID NO: 33418 - DNA, 25 bp, Homo sapien
gggttcctgattaaacttcactgtg

SEQ ID NO: 33419 - DNA, 25 bp, Homo sapien
ttcactgtgtgttttctatctcgga

SEQ ID NO: 33420 - DNA, 25 bp, Homo sapien
ttctcactctacagggtcctggtga

SEQ ID NO: 33421 - DNA, 25 bp, Homo sapien
tgaagagccagtgaggcccctggta

SEQ ID NO: 33422 - DNA, 25 bp, Homo sapien
tgcaggggcagcacagctggggtgc

SEQ ID NO: 33423 - DNA, 25 bp, Homo sapien
gggactttttgtttctgaaggcagt

SEQ ID NO: 33424 - DNA, 25 bp, Homo sapien
gaaggcagtcgatctgcagcggggc

SEQ ID NO: 33425 - DNA, 25 bp, Homo sapien
tctgcagcggggccttatgctgcca

SEQ ID NO: 33426 - DNA, 25 bp, Homo sapien
ggcaggtggctgagcaggagctccc

SEQ ID NO: 33427 - DNA, 25 bp, Homo sapien
cacccctgggcatcatgtgtgtggg

SEQ ID NO: 33428 - DNA, 25 bp, Homo sapien
gtgaagggaggtgctgaatgccagg

SEQ ID NO: 33429 - DNA, 25 bp, Homo sapien
cactggcatgctgggtcatggggac

SEQ ID NO: 33430 - DNA, 25 bp, Homo sapien
ggtcatggggacagcacgtgcaaag

SEQ ID NO: 33431 - DNA, 25 bp, Homo sapien
gcacgtgcaaaggacctgtggcagg

SEQ ID NO: 33432 - DNA, 25 bp, Homo sapien
gcaaaggacctgtggcaggagccca

SEQ ID NO: 33433 - DNA, 25 bp, Homo sapien
ggaacagggacttggtgagagacac

SEQ ID NO: 33434 - DNA, 25 bp, Homo sapien
gtccagggtgaatccaggaccctcg

SEQ ID NO: 33435 - DNA, 25 bp, Homo sapien
gaaggacaggggatggccttcgggc

SEQ ID NO: 33436 - DNA, 25 bp, Homo sapien
atggccttcgggcttattaagatcc

SEQ ID NO: 33437 - DNA, 25 bp, Homo sapien
attaagatcctaatggggccgggca

SEQ ID NO: 33438 - DNA, 25 bp, Homo sapien
aggcgggtgggtcacatgaggttgg

SEQ ID NO: 33439 - DNA, 25 bp, Homo sapien
ttgctcctttttatggacctttaat

SEQ ID NO: 33440 - DNA, 25 bp, Homo sapien
gagagtaaccctccacagaatgtct

SEQ ID NO: 33441 - DNA, 25 bp, Homo sapien
tgaattcttgcattctttacccttc

SEQ ID NO: 33442 - DNA, 25 bp, Homo sapien
tttacccttccatcactatattgat

SEQ ID NO: 33443 - DNA, 25 bp, Homo sapien
cctcacttcgtctctacagaatgtt

SEQ ID NO: 33444 - DNA, 25 bp, Homo sapien
aagtgccttccaatgacaacagctc

SEQ ID NO: 33445 - DNA, 25 bp, Homo sapien
gctcagatttgctttacgacgactt

SEQ ID NO: 33446 - DNA, 25 bp, Homo sapien
ggaggaagatgccgactgttatgat

SEQ ID NO: 33447 - DNA, 25 bp, Homo sapien
tgaggagtcgtgacgtgctccttca

SEQ ID NO: 33448 - DNA, 25 bp, Homo sapien
ccctgccatctcaggccaaagggag

SEQ ID NO: 33449 - DNA, 25 bp, Homo sapien
ggcccctcagcaaaaacctattcac

SEQ ID NO: 33450 - DNA, 25 bp, Homo sapien
acaccaaaaccccatctgtatgtca

SEQ ID NO: 33451 - DNA, 25 bp, Homo sapien
atctgtatgtcaccatcatcgagga

SEQ ID NO: 33452 - DNA, 25 bp, Homo sapien
tcaccatcatcgaggaccaaaggta

SEQ ID NO: 33453 - DNA, 25 bp, Homo sapien
ataaaaatcagagcgcttctccccc

SEQ ID NO: 33454 - DNA, 25 bp, Homo sapien
ctggacacagaatgactttgatgag

SEQ ID NO: 33455 - DNA, 25 bp, Homo sapien
gaatcagacttctccgagctaaagg

SEQ ID NO: 33456 - DNA, 25 bp, Homo sapien
agttcgaacccatcgcaaagaagct

SEQ ID NO: 33457 - DNA, 25 bp, Homo sapien
gagtaaccagtgtagagaagtcctt

SEQ ID NO: 33458 - DNA, 25 bp, Homo sapien
accatggcatgagaactacgtgacg

SEQ ID NO: 33459 - DNA, 25 bp, Homo sapien
acgtgacgaatgcacaagctttagt

SEQ ID NO: 33460 - DNA, 25 bp, Homo sapien
agctttagtagctgattcaatcaac

SEQ ID NO: 33461 - DNA, 25 bp, Homo sapien
gtggacaccatgaggcttccacttc

SEQ ID NO: 33462 - DNA, 25 bp, Homo sapien
cttccacttcatcagaccatcagtg

SEQ ID NO: 33463 - DNA, 25 bp, Homo sapien
ccatcagtgaaccaggccctggcat

SEQ ID NO: 33464 - DNA, 25 bp, Homo sapien
ggccctggcatttaggagaacctct

SEQ ID NO: 33465 - DNA, 25 bp, Homo sapien
acctctgtgaacttaggttcctgtt

SEQ ID NO: 33466 - DNA, 25 bp, Homo sapien
ttaggttcctgttgacccagtgact

SEQ ID NO: 33467 - DNA, 25 bp, Homo sapien
gacccagtgactttgctttggtgga

SEQ ID NO: 33468 - DNA, 25 bp, Homo sapien
tcccccaaagggttagctgccagtt

SEQ ID NO: 33469 - DNA, 25 bp, Homo sapien
gagatgtcagcagggctagactagc

SEQ ID NO: 33470 - DNA, 25 bp, Homo sapien
gggctagactagctgtgttcttaaa

SEQ ID NO: 33471 - DNA, 25 bp, Homo sapien
tagctgtgttcttaaatataccatt

SEQ ID NO: 33472 - DNA, 25 bp, Homo sapien
cagctcccgattcctggaagtatga

SEQ ID NO: 33473 - DNA, 25 bp, Homo sapien
gtgaccagatggccgtcatagtcct

SEQ ID NO: 33474 - DNA, 25 bp, Homo sapien
gtttgtttcctcttagagctggcct

SEQ ID NO: 33475 - DNA, 25 bp, Homo sapien
ggaactgccgtgtgactggatttgg

SEQ ID NO: 33476 - DNA, 25 bp, Homo sapien
tccttctcttcctgcggatgtagag

SEQ ID NO: 33477 - DNA, 25 bp, Homo sapien
gccccttccaagagggacaggcctc

SEQ ID NO: 33478 - DNA, 25 bp, Homo sapien
tcctcccacgtttttatggatctgc

SEQ ID NO: 33479 - DNA, 25 bp, Homo sapien
tggatctgcaccagactgttacctt

SEQ ID NO: 33480 - DNA, 25 bp, Homo sapien
ccgaagtttcttcaatgacccctcg

SEQ ID NO: 33481 - DNA, 25 bp, Homo sapien
gacccctcgagaactttgggaccag

SEQ ID NO: 33482 - DNA, 25 bp, Homo sapien
ttctgtcgttatattcttctttcct

SEQ ID NO: 33483 - DNA, 25 bp, Homo sapien
aggctgaggggaagctaggctctgg

SEQ ID NO: 33484 - DNA, 25 bp, Homo sapien
tgccctgtcctggggtgatggacaa

SEQ ID NO: 33485 - DNA, 25 bp, Homo sapien
ttggaagcctctaggctgagccctc

SEQ ID NO: 33486 - DNA, 25 bp, Homo sapien
gagagcaccaacctgaggagtggac

SEQ ID NO: 33487 - DNA, 25 bp, Homo sapien
gaggtggatacaggagacacttctc

SEQ ID NO: 33488 - DNA, 25 bp, Homo sapien
tcatctcatctcagaccctagaggg

SEQ ID NO: 33489 - DNA, 25 bp, Homo sapien
accctagaggggtccacagatgggg

SEQ ID NO: 33490 - DNA, 25 bp, Homo sapien
gatggggacacaagacccagccagc

SEQ ID NO: 33491 - DNA, 25 bp, Homo sapien
ggatggcccgggcaagtaacaacct

SEQ ID NO: 33492 - DNA, 25 bp, Homo sapien
ctctgtgcttcatctgagggcacgg

SEQ ID NO: 33493 - DNA, 25 bp, Homo sapien
cccagggcctaacacgagtttcatg

SEQ ID NO: 33494 - DNA, 25 bp, Homo sapien
gcagtctttggtacctgtgttcgtc

SEQ ID NO: 33495 - DNA, 25 bp, Homo sapien
acctgtgttcgtcagggatgctctg

SEQ ID NO: 33496 - DNA, 25 bp, Homo sapien
gcatgggcatggtgacagtggtcct

SEQ ID NO: 33497 - DNA, 25 bp, Homo sapien
ttcagcgcgtggtgcatgtgcagca

SEQ ID NO: 33498 - DNA, 25 bp, Homo sapien
atgtgcagcatctcgtcgtgctgct

SEQ ID NO: 33499 - DNA, 25 bp, Homo sapien
gcagcatctcgtcgtgctgctgtgc

SEQ ID NO: 33500 - DNA, 25 bp, Homo sapien
gtgttctggttcccacatgagtaca

SEQ ID NO: 33501 - DNA, 25 bp, Homo sapien
cccacatgagtacatattggccagc

SEQ ID NO: 33502 - DNA, 25 bp, Homo sapien
ccgagatgatgaactccggggtctg

SEQ ID NO: 33503 - DNA, 25 bp, Homo sapien
tccggggtctgagagtgggcaaaca

SEQ ID NO: 33504 - DNA, 25 bp, Homo sapien
gaagaaggttgggacctggtgcctg

SEQ ID NO: 33505 - DNA, 25 bp, Homo sapien
gtaaccagtggagctctgttgactt

SEQ ID NO: 33506 - DNA, 25 bp, Homo sapien
gtggagctctgttgacttaacgcca

SEQ ID NO: 33507 - DNA, 25 bp, Homo sapien
gacttaacgccaacaacgacttcag

SEQ ID NO: 33508 - DNA, 25 bp, Homo sapien
cgccaacaacgacttcagctttact

SEQ ID NO: 33509 - DNA, 25 bp, Homo sapien
tcagctttactctaagaatgggacc

SEQ ID NO: 33510 - DNA, 25 bp, Homo sapien
atgaattctctgtagtttcatcagc

SEQ ID NO: 33511 - DNA, 25 bp, Homo sapien
gtagtttcatcagcttgaacgatat

SEQ ID NO: 33512 - DNA, 25 bp, Homo sapien
gtttcatttattgtcacgaatgcaa

SEQ ID NO: 33513 - DNA, 25 bp, Homo sapien
gagaattttcgagaaagcctgtttt

SEQ ID NO: 33514 - DNA, 25 bp, Homo sapien
tgttttttcttgtgccttaaatctt

SEQ ID NO: 33515 - DNA, 25 bp, Homo sapien
gattaaattgaaggccagcacggtg

SEQ ID NO: 33516 - DNA, 25 bp, Homo sapien
gatagccattgatgtatgcatctct

SEQ ID NO: 33517 - DNA, 25 bp, Homo sapien
tatgcatctcttggctgtactataa

SEQ ID NO: 33518 - DNA, 25 bp, Homo sapien
gatctgctaatgaattctcttaaaa

SEQ ID NO: 33519 - DNA, 25 bp, Homo sapien
gaattctcttaaaaacatactgtat

SEQ ID NO: 33520 - DNA, 25 bp, Homo sapien
catactgtattctgttgctgtgtgt

SEQ ID NO: 33521 - DNA, 25 bp, Homo sapien
gtcttatatgaaatttctgtcccaa

SEQ ID NO: 33522 - DNA, 25 bp, Homo sapien
tgtagtgtattcttggttatcagaa

SEQ ID NO: 33523 - DNA, 25 bp, Homo sapien
atactcatatagctttgggattttg

SEQ ID NO: 33524 - DNA, 25 bp, Homo sapien
ctgtacagtctcagtcccataaaat

SEQ ID NO: 33525 - DNA, 25 bp, Homo sapien
gcctacacacaggatctagaagaat

SEQ ID NO: 33526 - DNA, 25 bp, Homo sapien
gaatgactttgttctttgcttgtgt

SEQ ID NO: 33527 - DNA, 25 bp, Homo sapien
gcctatggaacctgacattgcagtg

SEQ ID NO: 33528 - DNA, 25 bp, Homo sapien
gctgcctctccatctatggaactat

SEQ ID NO: 33529 - DNA, 25 bp, Homo sapien
gaaatttcacacatattccctaggc

SEQ ID NO: 33530 - DNA, 25 bp, Homo sapien
tcacacatattccctaggcagcatt

SEQ ID NO: 33531 - DNA, 25 bp, Homo sapien
ttccctaggcagcattaaggcccag

SEQ ID NO: 33532 - DNA, 25 bp, Homo sapien
aggcccaggtatattgagtagtcca

SEQ ID NO: 33533 - DNA, 25 bp, Homo sapien
actatattcgagtatcagtttaaat

SEQ ID NO: 33534 - DNA, 25 bp, Homo sapien
aactaatggcttgtgccaagaactg

SEQ ID NO: 33535 - DNA, 25 bp, Homo sapien
gtgccaagaactgaaactaagctat

SEQ ID NO: 33536 - DNA, 25 bp, Homo sapien
taagaaattacatacctggccaggt

SEQ ID NO: 33537 - DNA, 25 bp, Homo sapien
tacttaggaggttgcgatgggagaa

SEQ ID NO: 33538 - DNA, 25 bp, Homo sapien
tttgtagggactgagcctgcaccga

SEQ ID NO: 33539 - DNA, 25 bp, Homo sapien
cctgcaccgacgacttcaattgcag

SEQ ID NO: 33540 - DNA, 25 bp, Homo sapien
catctcttctgcagcaagataacat

SEQ ID NO: 33541 - DNA, 25 bp, Homo sapien
gataacatgctactaggcctcaatt

SEQ ID NO: 33542 - DNA, 25 bp, Homo sapien
gctactaggcctcaattcattgcta

SEQ ID NO: 33543 - DNA, 25 bp, Homo sapien
aggcctcaattcattgctaaacatt

SEQ ID NO: 33544 - DNA, 25 bp, Homo sapien
aacattttttaacaagtatctcaca

SEQ ID NO: 33545 - DNA, 25 bp, Homo sapien
aaatgaatctggaggtaatcccagc

SEQ ID NO: 33546 - DNA, 25 bp, Homo sapien
ctggctctggttgagacccagaaga

SEQ ID NO: 33547 - DNA, 25 bp, Homo sapien
gagacccagaagagtcatgcatcag

SEQ ID NO: 33548 - DNA, 25 bp, Homo sapien
caggaaataccctggcctttgtagg

SEQ ID NO: 33549 - DNA, 25 bp, Homo sapien
ttcctggctcccaaggccatgaaga

SEQ ID NO: 33550 - DNA, 25 bp, Homo sapien
agaagatgtacaaggcgtgcctcaa

SEQ ID NO: 33551 - DNA, 25 bp, Homo sapien
ctgacgtgggctattactcctggag

SEQ ID NO: 33552 - DNA, 25 bp, Homo sapien
tattactcctggaggtgtcccaagc

SEQ ID NO: 33553 - DNA, 25 bp, Homo sapien
gaagaaccgtgatgtcatcaccctc

SEQ ID NO: 33554 - DNA, 25 bp, Homo sapien
cccatgggcgctgattacatcatta

SEQ ID NO: 33555 - DNA, 25 bp, Homo sapien
tacatcattatgaactactcagtca

SEQ ID NO: 33556 - DNA, 25 bp, Homo sapien
gaactactcagtcaaacatcccaaa

SEQ ID NO: 33557 - DNA, 25 bp, Homo sapien
tcagtcaaacatcccaaatacccac

SEQ ID NO: 33558 - DNA, 25 bp, Homo sapien
caaatacccacctcggaaagacttg

SEQ ID NO: 33559 - DNA, 25 bp, Homo sapien
gaaagacttggtccgagctgtgtcc

SEQ ID NO: 33560 - DNA, 25 bp, Homo sapien
tcctgagttgggtcctacaggcgca

SEQ ID NO: 33561 - DNA, 25 bp, Homo sapien
ctcagcctcccaaaatcctggggtt

SEQ ID NO: 33562 - DNA, 25 bp, Homo sapien
aatcctggggttacagatgtgagct

SEQ ID NO: 33563 - DNA, 25 bp, Homo sapien
cagatgtgagctaccactcacggcc

SEQ ID NO: 33564 - DNA, 25 bp, Homo sapien
acggcccaaatcttcttgatcatat

SEQ ID NO: 33565 - DNA, 25 bp, Homo sapien
gagcatgagttgtcacttcttgttt

SEQ ID NO: 33566 - DNA, 25 bp, Homo sapien
tcacttcttgtttgccttttttata

SEQ ID NO: 33567 - DNA, 25 bp, Homo sapien
gttggagagttacatcattgctaat

SEQ ID NO: 33568 - DNA, 25 bp, Homo sapien
gattctacatttatttgtgggtttt

SEQ ID NO: 33569 - DNA, 25 bp, Homo sapien
ctttctttccacagcacttttgata

SEQ ID NO: 33570 - DNA, 25 bp, Homo sapien
aagcaagtggcttcctttttgagat

SEQ ID NO: 33571 - DNA, 25 bp, Homo sapien
agctgtccacatttgtatgttgtgc

SEQ ID NO: 33572 - DNA, 25 bp, Homo sapien
gtccacatttgtatgttgtgccctg

SEQ ID NO: 33573 - DNA, 25 bp, Homo sapien
acatttgtatgttgtgccctggaat

SEQ ID NO: 33574 - DNA, 25 bp, Homo sapien
ttgtatgttgtgccctggaatcagc

SEQ ID NO: 33575 - DNA, 25 bp, Homo sapien
ctggaatcagcctggtttagctcaa

SEQ ID NO: 33576 - DNA, 25 bp, Homo sapien
gaatcagcctggtttagctcaaatc

SEQ ID NO: 33577 - DNA, 25 bp, Homo sapien
tcagcctggtttagctcaaatcccc

SEQ ID NO: 33578 - DNA, 25 bp, Homo sapien
caacttcaaaaggatttcaggctga

SEQ ID NO: 33579 - DNA, 25 bp, Homo sapien
aacacagtgaggccttatctcaaca

SEQ ID NO: 33580 - DNA, 25 bp, Homo sapien
gaggccttatctcaacaacaaccac

SEQ ID NO: 33581 - DNA, 25 bp, Homo sapien
tatctcaacaacaaccacaaaatct

SEQ ID NO: 33582 - DNA, 25 bp, Homo sapien
cttttattagaatgccatgcctgct

SEQ ID NO: 33583 - DNA, 25 bp, Homo sapien
tagaatgccatgcctgcttatgtta

SEQ ID NO: 33584 - DNA, 25 bp, Homo sapien
atgccatgcctgcttatgttatgca

SEQ ID NO: 33585 - DNA, 25 bp, Homo sapien
gcctgcttatgttatgcatgtattt

SEQ ID NO: 33586 - DNA, 25 bp, Homo sapien
caaacagtagtggtgagcaaacgtg

SEQ ID NO: 33587 - DNA, 25 bp, Homo sapien
tggtgagcaaacgtgtgtttccccc

SEQ ID NO: 33588 - DNA, 25 bp, Homo sapien
tttcccccacatgtgcagaatatga

SEQ ID NO: 33589 - DNA, 25 bp, Homo sapien
cccccacatgtgcagaatatgatgg

SEQ ID NO: 33590 - DNA, 25 bp, Homo sapien
ttaactccaggaaatatgatctata

SEQ ID NO: 33591 - DNA, 25 bp, Homo sapien
atatgatctatatggttccttaaaa

SEQ ID NO: 33592 - DNA, 25 bp, Homo sapien
ttagttccttatgttcattgtataa

SEQ ID NO: 33593 - DNA, 25 bp, Homo sapien
ctcccatgttctatcttacgtattc

SEQ ID NO: 33594 - DNA, 25 bp, Homo sapien
cccatgttctatcttacgtattcag

SEQ ID NO: 33595 - DNA, 25 bp, Homo sapien
cttacgtattcagaacttgttcatc

SEQ ID NO: 33596 - DNA, 25 bp, Homo sapien
atcttgtaactgaaagcgtgtaccc

SEQ ID NO: 33597 - DNA, 25 bp, Homo sapien
tgaaagcgtgtaccctttgaccaac

SEQ ID NO: 33598 - DNA, 25 bp, Homo sapien
cctgtcttaacaggatctacagatc

SEQ ID NO: 33599 - DNA, 25 bp, Homo sapien
gatctacagatcaaggacaggggag

SEQ ID NO: 33600 - DNA, 25 bp, Homo sapien
gaggggatagtggaggaaaacggag

SEQ ID NO: 33601 - DNA, 25 bp, Homo sapien
tggaggaaaacggagttagtctgtt

SEQ ID NO: 33602 - DNA, 25 bp, Homo sapien
gaggggacagtatgtttcttggggc

SEQ ID NO: 33603 - DNA, 25 bp, Homo sapien
acagtatgtttcttggggcctgagg

SEQ ID NO: 33604 - DNA, 25 bp, Homo sapien
aagcaagccagatttactgcacaat

SEQ ID NO: 33605 - DNA, 25 bp, Homo sapien
actgcacaatatgcagtacccagta

SEQ ID NO: 33606 - DNA, 25 bp, Homo sapien
ccagtactactttaaatcccaagag

SEQ ID NO: 33607 - DNA, 25 bp, Homo sapien
atcccaagagaacagtgtgatgtct

SEQ ID NO: 33608 - DNA, 25 bp, Homo sapien
gtgatgtctaatatatacaggtcta

SEQ ID NO: 33609 - DNA, 25 bp, Homo sapien
aatactgtggaataagcccaggaag

SEQ ID NO: 33610 - DNA, 25 bp, Homo sapien
cccaggaaggttagatgtgtttgca

SEQ ID NO: 33611 - DNA, 25 bp, Homo sapien
atgtgtttgcaaataagttgcccaa

SEQ ID NO: 33612 - DNA, 25 bp, Homo sapien
tattcagaccacaggctttaatgta

SEQ ID NO: 33613 - DNA, 25 bp, Homo sapien
gaggatttttgttaagtgtcaatcg

SEQ ID NO: 33614 - DNA, 25 bp, Homo sapien
gaggccggcaaatcacctaaggtca

SEQ ID NO: 33615 - DNA, 25 bp, Homo sapien
agtaatagtgaccctttcacgtcct

SEQ ID NO: 33616 - DNA, 25 bp, Homo sapien
gtcctggagcccgagtggaccaatc

SEQ ID NO: 33617 - DNA, 25 bp, Homo sapien
ggaagcctaagtgacgatgaccctc

SEQ ID NO: 33618 - DNA, 25 bp, Homo sapien
ctaggtccctgggtggacccatcag

SEQ ID NO: 33619 - DNA, 25 bp, Homo sapien
caggaccccaagtgatagtgaccca

SEQ ID NO: 33620 - DNA, 25 bp, Homo sapien
gaacagtccagaagcctgagagaca

SEQ ID NO: 33621 - DNA, 25 bp, Homo sapien
gagagacagtggccccttgataatc

SEQ ID NO: 33622 - DNA, 25 bp, Homo sapien
taatctgggtctcacgggaccagct

SEQ ID NO: 33623 - DNA, 25 bp, Homo sapien
agtggtccacgtcctaaagacacct

SEQ ID NO: 33624 - DNA, 25 bp, Homo sapien
tggggcttctgtggccaagccccac

SEQ ID NO: 33625 - DNA, 25 bp, Homo sapien
gtgtgccagtgatggtgggtggggg

SEQ ID NO: 33626 - DNA, 25 bp, Homo sapien
gtttttatgttgtgaatgtgctaat

SEQ ID NO: 33627 - DNA, 25 bp, Homo sapien
gaatgtgctaatatgtgcatcaact

SEQ ID NO: 33628 - DNA, 25 bp, Homo sapien
gtgcatcaactgtaaagatgtatca

SEQ ID NO: 33629 - DNA, 25 bp, Homo sapien
aggcaaattaagatataggaccaaa

SEQ ID NO: 33630 - DNA, 25 bp, Homo sapien
gtagatggcagttatgaatgtatat

SEQ ID NO: 33631 - DNA, 25 bp, Homo sapien
gatttctattaactttttggctggg

SEQ ID NO: 33632 - DNA, 25 bp, Homo sapien
ttttggctgggcagagtggcttaca

SEQ ID NO: 33633 - DNA, 25 bp, Homo sapien
aaattatatgaacttttgctattaa

SEQ ID NO: 33634 - DNA, 25 bp, Homo sapien
gaacttttgctattaatgtttattt

SEQ ID NO: 33635 - DNA, 25 bp, Homo sapien
atttgtaggctatttatatcacttc

SEQ ID NO: 33636 - DNA, 25 bp, Homo sapien
gtaggctatttatatcacttcataa

SEQ ID NO: 33637 - DNA, 25 bp, Homo sapien
gcttaacgccgctgaaggtatccgg

SEQ ID NO: 33638 - DNA, 25 bp, Homo sapien
taacgccgctgaaggtatccgggtg

SEQ ID NO: 33639 - DNA, 25 bp, Homo sapien
acgccgctgaaggtatccgggtgcg

SEQ ID NO: 33640 - DNA, 25 bp, Homo sapien
ggcgcctgaaggttaccgagtgcat

SEQ ID NO: 33641 - DNA, 25 bp, Homo sapien
gcgcctgaaggttaccgagtgcatg

SEQ ID NO: 33642 - DNA, 25 bp, Homo sapien
gaaggttaccgagtgcatgagcgcc

SEQ ID NO: 33643 - DNA, 25 bp, Homo sapien
aggttaccgagtgcatgagcgccta

SEQ ID NO: 33644 - DNA, 25 bp, Homo sapien
cgagtgcatgagcgcctagcgcttc

SEQ ID NO: 33645 - DNA, 25 bp, Homo sapien
tggcggcgacggtcgcaggaggtgc

SEQ ID NO: 33646 - DNA, 25 bp, Homo sapien
ggcgacggtcgcaggaggtgccgtc

SEQ ID NO: 33647 - DNA, 25 bp, Homo sapien
gacggtcgcaggaggtgccgtctgc

SEQ ID NO: 33648 - DNA, 25 bp, Homo sapien
ggatctgtagcttttccagctgaga

SEQ ID NO: 33649 - DNA, 25 bp, Homo sapien
ggggttcaggataccgaatcaacac

SEQ ID NO: 33650 - DNA, 25 bp, Homo sapien
atattctcagaccacttctaccaaa

SEQ ID NO: 33651 - DNA, 25 bp, Homo sapien
aagtcagtccttttatctactcaag

SEQ ID NO: 33652 - DNA, 25 bp, Homo sapien
aaagagaccaccttcacttgttgag

SEQ ID NO: 33653 - DNA, 25 bp, Homo sapien
gatttcacgttatcagtgcagttcc

SEQ ID NO: 33654 - DNA, 25 bp, Homo sapien
tgcagttccgttctcgggggaaagc

SEQ ID NO: 33655 - DNA, 25 bp, Homo sapien
cccatccgtactaccaggagactgg

SEQ ID NO: 33656 - DNA, 25 bp, Homo sapien
gacacttggtctcatgaagccactg

SEQ ID NO: 33657 - DNA, 25 bp, Homo sapien
gccactgctgggctccagagagaag

SEQ ID NO: 33658 - DNA, 25 bp, Homo sapien
aatcatggtctgtcactgaatctgg

SEQ ID NO: 33659 - DNA, 25 bp, Homo sapien
acagctgagccaagaactaatggaa

SEQ ID NO: 33660 - DNA, 25 bp, Homo sapien
agaactgaagaggatggaagcacat

SEQ ID NO: 33661 - DNA, 25 bp, Homo sapien
tcccatctaactcaggagttacatc

SEQ ID NO: 33662 - DNA, 25 bp, Homo sapien
ggagttacatcagcgagatatcact

SEQ ID NO: 33663 - DNA, 25 bp, Homo sapien
agatatcactattgcttccaccaaa

SEQ ID NO: 33664 - DNA, 25 bp, Homo sapien
tattgcttccaccaaaggttcttcc

SEQ ID NO: 33665 - DNA, 25 bp, Homo sapien
tccaccaaaggttcttcctcagaca

SEQ ID NO: 33666 - DNA, 25 bp, Homo sapien
aaagcgactcagagcagagatgcaa

SEQ ID NO: 33667 - DNA, 25 bp, Homo sapien
attttggatcagctggagtcactca

SEQ ID NO: 33668 - DNA, 25 bp, Homo sapien
aaaatcgtcatctttctgaaatggt

SEQ ID NO: 33669 - DNA, 25 bp, Homo sapien
gaaattggaattgggtttacatgag

SEQ ID NO: 33670 - DNA, 25 bp, Homo sapien
gcaaagggacagttaaagcttcata

SEQ ID NO: 33671 - DNA, 25 bp, Homo sapien
gacagttaaagcttcatatgcatta

SEQ ID NO: 33672 - DNA, 25 bp, Homo sapien
gagtgacaaattgagcgttcaactc

SEQ ID NO: 33673 - DNA, 25 bp, Homo sapien
agaaatccagagcttgtgcaaggaa

SEQ ID NO: 33674 - DNA, 25 bp, Homo sapien
taatgaccgaaatagactctcaaaa

SEQ ID NO: 33675 - DNA, 25 bp, Homo sapien
aaagtcgacgcggccgcgaatttag

SEQ ID NO: 33676 - DNA, 25 bp, Homo sapien
gcggccgcgaatttagtagtagtag

SEQ ID NO: 33677 - DNA, 25 bp, Homo sapien
gtagtagtaggcggccgctctagag

SEQ ID NO: 33678 - DNA, 25 bp, Homo sapien
gccgctctagaggatccaagcttac

SEQ ID NO: 33679 - DNA, 25 bp, Homo sapien
gatccaagcttacgtacgcgtgcat

SEQ ID NO: 33680 - DNA, 25 bp, Homo sapien
tacgtacgcgtgcatgcgacgtcat

SEQ ID NO: 33681 - DNA, 25 bp, Homo sapien
ccggccacagtgcagtatttctaac

SEQ ID NO: 33682 - DNA, 25 bp, Homo sapien
gtgcagtatttctaaccagtgatca

SEQ ID NO: 33683 - DNA, 25 bp, Homo sapien
aaagaggatgcgtgtccaccatccc

SEQ ID NO: 33684 - DNA, 25 bp, Homo sapien
ccatcccagccagggcttggagcag

SEQ ID NO: 33685 - DNA, 25 bp, Homo sapien
ctgtgtcccctgcattgtaacacat

SEQ ID NO: 33686 - DNA, 25 bp, Homo sapien
ctgcattgtaacacatccaggcaca

SEQ ID NO: 33687 - DNA, 25 bp, Homo sapien
gcacaagaatagccgcccagtgact

SEQ ID NO: 33688 - DNA, 25 bp, Homo sapien
tgccaagtgagtgaaccagcctgct

SEQ ID NO: 33689 - DNA, 25 bp, Homo sapien
ttcccaaactgctcattatcctgtt

SEQ ID NO: 33690 - DNA, 25 bp, Homo sapien
caaactgctcattatcctgttaccc

SEQ ID NO: 33691 - DNA, 25 bp, Homo sapien
tgtccaaatacactccagatgcaaa

SEQ ID NO: 33692 - DNA, 25 bp, Homo sapien
gggtttcacagtgcaatctctgccc

SEQ ID NO: 33693 - DNA, 25 bp, Homo sapien
caatctctgccccacgagaatagaa

SEQ ID NO: 33694 - DNA, 25 bp, Homo sapien
cacagatgcagcagttctctcagtc

SEQ ID NO: 33695 - DNA, 25 bp, Homo sapien
ttttcactcagttttggttccctgc

SEQ ID NO: 33696 - DNA, 25 bp, Homo sapien
ctgacccaattcgctgccaaaagag

SEQ ID NO: 33697 - DNA, 25 bp, Homo sapien
aaatcccgtatggttgtgtcatcct

SEQ ID NO: 33698 - DNA, 25 bp, Homo sapien
tgtcatcctctcttaatcattttta

SEQ ID NO: 33699 - DNA, 25 bp, Homo sapien
taataatcagctctagcttgcttca

SEQ ID NO: 33700 - DNA, 25 bp, Homo sapien
gcttgatctgttgatgctttctctc

SEQ ID NO: 33701 - DNA, 25 bp, Homo sapien
gaggctcagttagcaacctgtgttg

SEQ ID NO: 33702 - DNA, 25 bp, Homo sapien
aggacacatgcgcttttgtagaatt

SEQ ID NO: 33703 - DNA, 25 bp, Homo sapien
gtggaatgttcactgacgtcttttc

SEQ ID NO: 33704 - DNA, 25 bp, Homo sapien
tgacgtcttttcttggtagccatca

SEQ ID NO: 33705 - DNA, 25 bp, Homo sapien
tcttggtagccatcatcgaaactaa

SEQ ID NO: 33706 - DNA, 25 bp, Homo sapien
agacttgatagccaaggtcccttct

SEQ ID NO: 33707 - DNA, 25 bp, Homo sapien
tcccttctggtccagttttctgatt

SEQ ID NO: 33708 - DNA, 25 bp, Homo sapien
ttttctgatttagggttctctcaag

SEQ ID NO: 33709 - DNA, 25 bp, Homo sapien
gactcattaatgagctcgctaacct

SEQ ID NO: 33710 - DNA, 25 bp, Homo sapien
gctcgctaacctacgatctggtgat

SEQ ID NO: 33711 - DNA, 25 bp, Homo sapien
gataattttgtgtgcacagcccaag

SEQ ID NO: 33712 - DNA, 25 bp, Homo sapien
acagcccaaggaccacgaggctttc

SEQ ID NO: 33713 - DNA, 25 bp, Homo sapien
aaccagtatggctaactatatcaca

SEQ ID NO: 33714 - DNA, 25 bp, Homo sapien
ccgtgcctcaccagaattgtgtact

SEQ ID NO: 33715 - DNA, 25 bp, Homo sapien
ttcttcttcttcggcatggagtttc

SEQ ID NO: 33716 - DNA, 25 bp, Homo sapien
tggtgcaaacttggctcaccgcaac

SEQ ID NO: 33717 - DNA, 25 bp, Homo sapien
cgggttcaatagattctccagcctc

SEQ ID NO: 33718 - DNA, 25 bp, Homo sapien
ctccagcctcagcctgctgagtagc

SEQ ID NO: 33719 - DNA, 25 bp, Homo sapien
ccacacccagctaatctttgtactt

SEQ ID NO: 33720 - DNA, 25 bp, Homo sapien
atatgagaccacaaaactgccttcc

SEQ ID NO: 33721 - DNA, 25 bp, Homo sapien
gccttccctgctcagttttaatttt

SEQ ID NO: 33722 - DNA, 25 bp, Homo sapien
tagccttctctggttaccaaaataa

SEQ ID NO: 33723 - DNA, 25 bp, Homo sapien
taccaaaataaccacgctcacggcc

SEQ ID NO: 33724 - DNA, 25 bp, Homo sapien
cgctcacggccgttcatttgaagat

SEQ ID NO: 33725 - DNA, 25 bp, Homo sapien
gattttaaagcttcatgttatgcaa

SEQ ID NO: 33726 - DNA, 25 bp, Homo sapien
gaatcctgctgttatacatgtgaca

SEQ ID NO: 33727 - DNA, 25 bp, Homo sapien
gacagtgactttgtgctgaaatttc

SEQ ID NO: 33728 - DNA, 25 bp, Homo sapien
tcagctattccagataaacattgta

SEQ ID NO: 33729 - DNA, 25 bp, Homo sapien
ccaggttgcttatagcactttaagt

SEQ ID NO: 33730 - DNA, 25 bp, Homo sapien
gtagatttagttgtatagcacttac

SEQ ID NO: 33731 - DNA, 25 bp, Homo sapien
tagcacttacatatttagttctttt

SEQ ID NO: 33732 - DNA, 25 bp, Homo sapien
tacagggcatcatttccttgtctca

SEQ ID NO: 33733 - DNA, 25 bp, Homo sapien
gcatcatttccttgtctcattataa

SEQ ID NO: 33734 - DNA, 25 bp, Homo sapien
ttcggtcttccacagcagtattatt

SEQ ID NO: 33735 - DNA, 25 bp, Homo sapien
gcagtattattgtctttgtggagtt

SEQ ID NO: 33736 - DNA, 25 bp, Homo sapien
ggccgtgtgggatccagcgagaggc

SEQ ID NO: 33737 - DNA, 25 bp, Homo sapien
gcgagaggccagggcttggagtggg

SEQ ID NO: 33738 - DNA, 25 bp, Homo sapien
cttggagtgggcctgggaccaggaa

SEQ ID NO: 33739 - DNA, 25 bp, Homo sapien
ggaccaggaaggacctctaggctgt

SEQ ID NO: 33740 - DNA, 25 bp, Homo sapien
cttgtgcagaccctggactgcatcc

SEQ ID NO: 33741 - DNA, 25 bp, Homo sapien
gggcaggtggcacctggtgacacct

SEQ ID NO: 33742 - DNA, 25 bp, Homo sapien
ggcaggcttagggcacagttagggg

SEQ ID NO: 33743 - DNA, 25 bp, Homo sapien
aggagagggaaggccagggcccctg

SEQ ID NO: 33744 - DNA, 25 bp, Homo sapien
agacaagcgtggccaggcacagtgg

SEQ ID NO: 33745 - DNA, 25 bp, Homo sapien
gcagaggttgtggtgagctaagatc

SEQ ID NO: 33746 - DNA, 25 bp, Homo sapien
gagctaagatcacgccattgcactc

SEQ ID NO: 33747 - DNA, 25 bp, Homo sapien
ggcgggcagaggaggggagatgggc

SEQ ID NO: 33748 - DNA, 25 bp, Homo sapien
tcattcgtctaggggcacccgaatc

SEQ ID NO: 33749 - DNA, 25 bp, Homo sapien
cctatcactcaggcactggcagggt

SEQ ID NO: 33750 - DNA, 25 bp, Homo sapien
ctgcggctccaaagcgagctgggca

SEQ ID NO: 33751 - DNA, 25 bp, Homo sapien
ggtgaacctgctatttcggatgaca

SEQ ID NO: 33752 - DNA, 25 bp, Homo sapien
tgaaaggaacacacgtccctgactg

SEQ ID NO: 33753 - DNA, 25 bp, Homo sapien
acacgtccctgactgactaggagga

SEQ ID NO: 33754 - DNA, 25 bp, Homo sapien
ggaggaacagagctgcctgctatct

SEQ ID NO: 33755 - DNA, 25 bp, Homo sapien
tgctatctggaacaacttcctccca

SEQ ID NO: 33756 - DNA, 25 bp, Homo sapien
caacttcctcccagactaagtgaga

SEQ ID NO: 33757 - DNA, 25 bp, Homo sapien
gacattgggcattttagttctatat

SEQ ID NO: 33758 - DNA, 25 bp, Homo sapien
tcttcccagcctcctggtggataat

SEQ ID NO: 33759 - DNA, 25 bp, Homo sapien
taacaactgagccagacctgcacac

SEQ ID NO: 33760 - DNA, 25 bp, Homo sapien
cttgggcctggtggaagggctctca

SEQ ID NO: 33761 - DNA, 25 bp, Homo sapien
gctctcagcccagggatcagggact

SEQ ID NO: 33762 - DNA, 25 bp, Homo sapien
tgggctgcttgctttctatttatta

SEQ ID NO: 33763 - DNA, 25 bp, Homo sapien
aacccctgcgtgaagaggacctggc

SEQ ID NO: 33764 - DNA, 25 bp, Homo sapien
acctggccaaggggcctgacttgca

SEQ ID NO: 33765 - DNA, 25 bp, Homo sapien
cacatcctcatggcccagaggcagg

SEQ ID NO: 33766 - DNA, 25 bp, Homo sapien
gaggaaggcctgcaggacttccacc

SEQ ID NO: 33767 - DNA, 25 bp, Homo sapien
gcccagagccattgtctgcatgtgt

SEQ ID NO: 33768 - DNA, 25 bp, Homo sapien
ctccttcaccctgtatgagttctgg

SEQ ID NO: 33769 - DNA, 25 bp, Homo sapien
tccagagtcacccaaagcatcctgg

SEQ ID NO: 33770 - DNA, 25 bp, Homo sapien
ggtcctggtgagcaccttgtgttac

SEQ ID NO: 33771 - DNA, 25 bp, Homo sapien
agcaccttgtgttactttactcgct

SEQ ID NO: 33772 - DNA, 25 bp, Homo sapien
tacatatgtctctttttcctaatcc

SEQ ID NO: 33773 - DNA, 25 bp, Homo sapien
tttcctaatcccagttggtggctgt

SEQ ID NO: 33774 - DNA, 25 bp, Homo sapien
tggtggctgttgaacacctctgcac

SEQ ID NO: 33775 - DNA, 25 bp, Homo sapien
cacagtttcctaagctggtcagata

SEQ ID NO: 33776 - DNA, 25 bp, Homo sapien
aagctggtcagatagttctccgatt

SEQ ID NO: 33777 - DNA, 25 bp, Homo sapien
agttctccgatttatgtggattgtc

SEQ ID NO: 33778 - DNA, 25 bp, Homo sapien
tgtggattgtcttctttttgtataa

SEQ ID NO: 33779 - DNA, 25 bp, Homo sapien
gtataatgaatggccgtttgttgat

SEQ ID NO: 33780 - DNA, 25 bp, Homo sapien
tcacagttcactgcagcctgggtga

SEQ ID NO: 33781 - DNA, 25 bp, Homo sapien
tgggtgacaaaggagaccccgtcaa

SEQ ID NO: 33782 - DNA, 25 bp, Homo sapien
tttgtttcctagcttagaatttata

SEQ ID NO: 33783 - DNA, 25 bp, Homo sapien
tgcagtggcgcaatttcggctcact

SEQ ID NO: 33784 - DNA, 25 bp, Homo sapien
cacgacgcccagctgatttttgtgt

SEQ ID NO: 33785 - DNA, 25 bp, Homo sapien
gttggccaagatggtctcaatctct

SEQ ID NO: 33786 - DNA, 25 bp, Homo sapien
gtctcaatctcttgaccttgtgatc

SEQ ID NO: 33787 - DNA, 25 bp, Homo sapien
caccgcgcctggtctatatgtgatt

SEQ ID NO: 33788 - DNA, 25 bp, Homo sapien
gtgatttcaaattaggtggccttat

SEQ ID NO: 33789 - DNA, 25 bp, Homo sapien
gatggtttctgggcaaaatcaaatg

SEQ ID NO: 33790 - DNA, 25 bp, Homo sapien
atgatttctgtctctattttcttga

SEQ ID NO: 33791 - DNA, 25 bp, Homo sapien
ttattataatcccgtgaaaccatca

SEQ ID NO: 33792 - DNA, 25 bp, Homo sapien
gaaaccatcatcagagtcaccataa

SEQ ID NO: 33793 - DNA, 25 bp, Homo sapien
atttatctaatctatcacctttgta

SEQ ID NO: 33794 - DNA, 25 bp, Homo sapien
ttgtatttacttggagcctttataa

SEQ ID NO: 33795 - DNA, 25 bp, Homo sapien
tataaagtttttctctctgctcttc

SEQ ID NO: 33796 - DNA, 25 bp, Homo sapien
ctctctgctcttcaaacaaccattg

SEQ ID NO: 33797 - DNA, 25 bp, Homo sapien
tttgctgtatgatggagtactttcc

SEQ ID NO: 33798 - DNA, 25 bp, Homo sapien
taaaattgccaaacctgtcaccaaa

SEQ ID NO: 33799 - DNA, 25 bp, Homo sapien
aaggtataggctgagcatcatggct

SEQ ID NO: 33800 - DNA, 25 bp, Homo sapien
catcatggctcatgcctgtattccc

SEQ ID NO: 33801 - DNA, 25 bp, Homo sapien
gggaacatggcaaaaccttgtctct

SEQ ID NO: 33802 - DNA, 25 bp, Homo sapien
gaatttgaactgtccactgtgtgtc

SEQ ID NO: 33803 - DNA, 25 bp, Homo sapien
gcccgagggtctggaacaactgcag

SEQ ID NO: 33804 - DNA, 25 bp, Homo sapien
ggagcaaaccaagttcacacgcaag

SEQ ID NO: 33805 - DNA, 25 bp, Homo sapien
accaagttcacacgcaaggagttgc

SEQ ID NO: 33806 - DNA, 25 bp, Homo sapien
ttcggggaacggtagatgacagact

SEQ ID NO: 33807 - DNA, 25 bp, Homo sapien
tagatgacagactgaattgggcctt

SEQ ID NO: 33808 - DNA, 25 bp, Homo sapien
ggccttcaacttgtatgacctcaac

SEQ ID NO: 33809 - DNA, 25 bp, Homo sapien
ttcaacttgtatgacctcaacaagg

SEQ ID NO: 33810 - DNA, 25 bp, Homo sapien
actaaggaggaaatgctcgacatca

SEQ ID NO: 33811 - DNA, 25 bp, Homo sapien
gaggagcccccaagggaacatgtgg

SEQ ID NO: 33812 - DNA, 25 bp, Homo sapien
gagcccccaagggaacatgtggaga

SEQ ID NO: 33813 - DNA, 25 bp, Homo sapien
cttagagctctgtcaactctccatg

SEQ ID NO: 33814 - DNA, 25 bp, Homo sapien
gggggctttataacagaggcagaac

SEQ ID NO: 33815 - DNA, 25 bp, Homo sapien
aatacacgcatgtttcccatgttga

SEQ ID NO: 33816 - DNA, 25 bp, Homo sapien
tagtgtcccgcagaaagtcatgtcc

SEQ ID NO: 33817 - DNA, 25 bp, Homo sapien
agtcatgtccagctggaacccagga

SEQ ID NO: 33818 - DNA, 25 bp, Homo sapien
ggtctctgcagataacacttagtta

SEQ ID NO: 33819 - DNA, 25 bp, Homo sapien
ccaatggctgtgtcctttcaggaag

SEQ ID NO: 33820 - DNA, 25 bp, Homo sapien
gagacctacagggaagacggccatg

SEQ ID NO: 33821 - DNA, 25 bp, Homo sapien
gtcacggaatgccaaggacagctgg

SEQ ID NO: 33822 - DNA, 25 bp, Homo sapien
agaaatcaatcatactcacacctcc

SEQ ID NO: 33823 - DNA, 25 bp, Homo sapien
gaatttctggcctcgtgaatggtga

SEQ ID NO: 33824 - DNA, 25 bp, Homo sapien
acaggctcaggatctatgagcgaga

SEQ ID NO: 33825 - DNA, 25 bp, Homo sapien
atgagcgagaggactacaggggcca

SEQ ID NO: 33826 - DNA, 25 bp, Homo sapien
gcgagaggactacaggggccagatg

SEQ ID NO: 33827 - DNA, 25 bp, Homo sapien
tcagtgagatccactccttcaacgt

SEQ ID NO: 33828 - DNA, 25 bp, Homo sapien
gggggccacggatgcgagagtgggc

SEQ ID NO: 33829 - DNA, 25 bp, Homo sapien
ccacggatgcgagagtgggctccct

SEQ ID NO: 33830 - DNA, 25 bp, Homo sapien
agtgggctccctaaggagagctgtg

SEQ ID NO: 33831 - DNA, 25 bp, Homo sapien
gggctccctaaggagagctgtggag

SEQ ID NO: 33832 - DNA, 25 bp, Homo sapien
aaggagagctgtggagctctactga

SEQ ID NO: 33833 - DNA, 25 bp, Homo sapien
gaaatgtttgtactctatcccttgc

SEQ ID NO: 33834 - DNA, 25 bp, Homo sapien
tctatcccttgcttcatctggaaac

SEQ ID NO: 33835 - DNA, 25 bp, Homo sapien
ttgatgggaacgtacctccaggcag

SEQ ID NO: 33836 - DNA, 25 bp, Homo sapien
atttagtttgtcacagtcttgggga

SEQ ID NO: 33837 - DNA, 25 bp, Homo sapien
gtcacagtcttggggacatgggatc

SEQ ID NO: 33838 - DNA, 25 bp, Homo sapien
tggggacatgggatcatttgagctt

SEQ ID NO: 33839 - DNA, 25 bp, Homo sapien
cctctccttccagggaagacccgtg

SEQ ID NO: 33840 - DNA, 25 bp, Homo sapien
tccagggaagacccgtgtgaaccgc

SEQ ID NO: 33841 - DNA, 25 bp, Homo sapien
tccagacttgactgatcccgggatt

SEQ ID NO: 33842 - DNA, 25 bp, Homo sapien
gatcccgggattgaaatgaggagca

SEQ ID NO: 33843 - DNA, 25 bp, Homo sapien
ctcctgcaactcacggggtttcaag

SEQ ID NO: 33844 - DNA, 25 bp, Homo sapien
gcaactcacggggtttcaagagaag

SEQ ID NO: 33845 - DNA, 25 bp, Homo sapien
ggttttgatgggaacgtacctccag

SEQ ID NO: 33846 - DNA, 25 bp, Homo sapien
gacagacccatgtatttttggcatg

SEQ ID NO: 33847 - DNA, 25 bp, Homo sapien
ggaactaacagtccattactctatc

SEQ ID NO: 33848 - DNA, 25 bp, Homo sapien
ttactctatcttcagcctatcagga

SEQ ID NO: 33849 - DNA, 25 bp, Homo sapien
cagcctatcaggatcacagttttaa

SEQ ID NO: 33850 - DNA, 25 bp, Homo sapien
tgaagcattcatcagcagcctcaac

SEQ ID NO: 33851 - DNA, 25 bp, Homo sapien
cctcaaccagttttcattgtccatt

SEQ ID NO: 33852 - DNA, 25 bp, Homo sapien
tgtccatttactagattcaatcgtc

SEQ ID NO: 33853 - DNA, 25 bp, Homo sapien
atcgtctctgagtatatagggctga

SEQ ID NO: 33854 - DNA, 25 bp, Homo sapien
gggctgatgttagcaagaccctaaa

SEQ ID NO: 33855 - DNA, 25 bp, Homo sapien
aaaaatgtccattgaaccctgcttc

SEQ ID NO: 33856 - DNA, 25 bp, Homo sapien
gaagcctttgtatgacagacccatg

SEQ ID NO: 33857 - DNA, 25 bp, Homo sapien
cccttccaaagactgtctccgttga

SEQ ID NO: 33858 - DNA, 25 bp, Homo sapien
tccaaagactgtctccgttgacctt

SEQ ID NO: 33859 - DNA, 25 bp, Homo sapien
tgaccttgtctttttggtatgcctt

SEQ ID NO: 33860 - DNA, 25 bp, Homo sapien
ccttgtctttttggtatgccttggg

SEQ ID NO: 33861 - DNA, 25 bp, Homo sapien
ttttggtatgccttggggtttctga

SEQ ID NO: 33862 - DNA, 25 bp, Homo sapien
ggtatgccttggggtttctgataat

SEQ ID NO: 33863 - DNA, 25 bp, Homo sapien
gccttggggtttctgataatgtgtg

SEQ ID NO: 33864 - DNA, 25 bp, Homo sapien
aggtaagtgagcatgtcaaacaaaa

SEQ ID NO: 33865 - DNA, 25 bp, Homo sapien
gtcaaacaaaataggagctcacatg

SEQ ID NO: 33866 - DNA, 25 bp, Homo sapien
aggagctcacatggatatatttatg

SEQ ID NO: 33867 - DNA, 25 bp, Homo sapien
atggatatatttatgtcactgagtt

SEQ ID NO: 33868 - DNA, 25 bp, Homo sapien
cctcactgcaatcatcttcaattgc

SEQ ID NO: 33869 - DNA, 25 bp, Homo sapien
gcaatcatcttcaattgctctgccc

SEQ ID NO: 33870 - DNA, 25 bp, Homo sapien
accaccctgaagacttacctagaca

SEQ ID NO: 33871 - DNA, 25 bp, Homo sapien
caccctgaagacttacctagacacc

SEQ ID NO: 33872 - DNA, 25 bp, Homo sapien
ggctgttctcaggaacaggttccca

SEQ ID NO: 33873 - DNA, 25 bp, Homo sapien
gggtgtttgtggagatctgtctttc

SEQ ID NO: 33874 - DNA, 25 bp, Homo sapien
gtgtttgtggagatctgtctttctc

SEQ ID NO: 33875 - DNA, 25 bp, Homo sapien
gagatctgtctttctccaaagattt

SEQ ID NO: 33876 - DNA, 25 bp, Homo sapien
gatctgtctttctccaaagatttca

SEQ ID NO: 33877 - DNA, 25 bp, Homo sapien
ctttctccaaagatttcatccaact

SEQ ID NO: 33878 - DNA, 25 bp, Homo sapien
tctccaaagatttcatccaactccc

SEQ ID NO: 33879 - DNA, 25 bp, Homo sapien
agcctcattgagtactgcatcgaac

SEQ ID NO: 33880 - DNA, 25 bp, Homo sapien
cccaggacagtgcaactggctcgcc

SEQ ID NO: 33881 - DNA, 25 bp, Homo sapien
aggcagggcagtgtggtgtccagcc

SEQ ID NO: 33882 - DNA, 25 bp, Homo sapien
accatcgcctatgtggaggacggca

SEQ ID NO: 33883 - DNA, 25 bp, Homo sapien
gcccagcgacagcctggagcagggc

SEQ ID NO: 33884 - DNA, 25 bp, Homo sapien
ggagcagggctgaggacgctgcacc

SEQ ID NO: 33885 - DNA, 25 bp, Homo sapien
tgcaccccgcaggaggagggcaact

SEQ ID NO: 33886 - DNA, 25 bp, Homo sapien
ggcattgtcctcctgaggagcaggg

SEQ ID NO: 33887 - DNA, 25 bp, Homo sapien
agcaggggctggctaacagtctcat

SEQ ID NO: 33888 - DNA, 25 bp, Homo sapien
acagtctcatgggtcaccacatggg

SEQ ID NO: 33889 - DNA, 25 bp, Homo sapien
ctgcctcagcagatttctcagacca

SEQ ID NO: 33890 - DNA, 25 bp, Homo sapien
ggccaggtagcgcgcaactgctggc

SEQ ID NO: 33891 - DNA, 25 bp, Homo sapien
gccaggtagcgcgcaactgctggct

SEQ ID NO: 33892 - DNA, 25 bp, Homo sapien
gaggcgcgcttcgagggaatatgcg

SEQ ID NO: 33893 - DNA, 25 bp, Homo sapien
ggcgcgcttcgagggaatatgcgaa

SEQ ID NO: 33894 - DNA, 25 bp, Homo sapien
gggaatatgcgaagctgccgcgtgc

SEQ ID NO: 33895 - DNA, 25 bp, Homo sapien
tccgcagttgcccttgttcggaatc

SEQ ID NO: 33896 - DNA, 25 bp, Homo sapien
caggccccgagagggcgagaccaga

SEQ ID NO: 33897 - DNA, 25 bp, Homo sapien
gccccgagagggcgagaccagaggg

SEQ ID NO: 33898 - DNA, 25 bp, Homo sapien
cgagagggcgagaccagaggggacg

SEQ ID NO: 33899 - DNA, 25 bp, Homo sapien
gggcgagaccagaggggacggaagc

SEQ ID NO: 33900 - DNA, 25 bp, Homo sapien
agaccagaggggacggaagcattgc

SEQ ID NO: 33901 - DNA, 25 bp, Homo sapien
tggaggagagctttgtgcctgttgc

SEQ ID NO: 33902 - DNA, 25 bp, Homo sapien
gagagctgcagaagtactccagtga

SEQ ID NO: 33903 - DNA, 25 bp, Homo sapien
tactccagtgattctgagagcccca

SEQ ID NO: 33904 - DNA, 25 bp, Homo sapien
agtggtgcgttgccaagtggtcaga

SEQ ID NO: 33905 - DNA, 25 bp, Homo sapien
ggcagaggagccagataacttcagc

SEQ ID NO: 33906 - DNA, 25 bp, Homo sapien
acagcaacgggaacttcctgtacag

SEQ ID NO: 33907 - DNA, 25 bp, Homo sapien
gccactctgtatcaggctctttgct

SEQ ID NO: 33908 - DNA, 25 bp, Homo sapien
caggctctttgcttatgccagggca

SEQ ID NO: 33909 - DNA, 25 bp, Homo sapien
tgccagggcatgaagcctcatctaa

SEQ ID NO: 33910 - DNA, 25 bp, Homo sapien
taaagacccaaatcacagcacagct

SEQ ID NO: 33911 - DNA, 25 bp, Homo sapien
gacactcacaggacaaatacaccaa

SEQ ID NO: 33912 - DNA, 25 bp, Homo sapien
cttggagatatttccgtcctccacc

SEQ ID NO: 33913 - DNA, 25 bp, Homo sapien
cacgtgtctgtggctggaactgccc

SEQ ID NO: 33914 - DNA, 25 bp, Homo sapien
ctccccacagctggtaatctggact

SEQ ID NO: 33915 - DNA, 25 bp, Homo sapien
gcctaccaccattccatatttaagt

SEQ ID NO: 33916 - DNA, 25 bp, Homo sapien
tatttaagtggagcccctacgtaga

SEQ ID NO: 33917 - DNA, 25 bp, Homo sapien
ggctttattttagtctccttttcag

SEQ ID NO: 33918 - DNA, 25 bp, Homo sapien
ccttttcagggatgtcgtgggcggg

SEQ ID NO: 33919 - DNA, 25 bp, Homo sapien
gctgccttcaccacatattagtgct

SEQ ID NO: 33920 - DNA, 25 bp, Homo sapien
aatacatggagacgacgcaccctcc

SEQ ID NO: 33921 - DNA, 25 bp, Homo sapien
tccaggatgctcgctgggattccca

SEQ ID NO: 33922 - DNA, 25 bp, Homo sapien
gggcctctgaacggaacagtgtccc

SEQ ID NO: 33923 - DNA, 25 bp, Homo sapien
atattcagataggactgcactacat

SEQ ID NO: 33924 - DNA, 25 bp, Homo sapien
cagataggactgcactacattattt

SEQ ID NO: 33925 - DNA, 25 bp, Homo sapien
atctgttaccatcaggtcaattcct

SEQ ID NO: 33926 - DNA, 25 bp, Homo sapien
gttaccatcaggtcaattcctagta

SEQ ID NO: 33927 - DNA, 25 bp, Homo sapien
aggtcaattcctagtatgcataaat

SEQ ID NO: 33928 - DNA, 25 bp, Homo sapien
gagacctatgttgaaaacccctgaa

SEQ ID NO: 33929 - DNA, 25 bp, Homo sapien
tttttctcagtaaatcatatcatct

SEQ ID NO: 33930 - DNA, 25 bp, Homo sapien
atttctaggtgctatattaattcaa

SEQ ID NO: 33931 - DNA, 25 bp, Homo sapien
tgtgaaatgttctctgcaaaataat

SEQ ID NO: 33932 - DNA, 25 bp, Homo sapien
gcaaaataattcaggccactgtctc

SEQ ID NO: 33933 - DNA, 25 bp, Homo sapien
tttgcaaaggtaagttacagcttgt

SEQ ID NO: 33934 - DNA, 25 bp, Homo sapien
atactgccagcagcgagtgttccgc

SEQ ID NO: 33935 - DNA, 25 bp, Homo sapien
tcactggcctacatgcggccactga

SEQ ID NO: 33936 - DNA, 25 bp, Homo sapien
atatgggccatgcagctagccctgc

SEQ ID NO: 33937 - DNA, 25 bp, Homo sapien
gcagcagcacaaaaaggcctcctgg

SEQ ID NO: 33938 - DNA, 25 bp, Homo sapien
aggacagggcctatgtttggaccaa

SEQ ID NO: 33939 - DNA, 25 bp, Homo sapien
ggaagccatggcaaacctgagccca

SEQ ID NO: 33940 - DNA, 25 bp, Homo sapien
tgagccgtctgaactgtgggaggga

SEQ ID NO: 33941 - DNA, 25 bp, Homo sapien
gagggaagtgctaacagcccagcct

SEQ ID NO: 33942 - DNA, 25 bp, Homo sapien
gccatcaggacaatcataccccttc

SEQ ID NO: 33943 - DNA, 25 bp, Homo sapien
cctgttccctgactgcgtgaaatgt

SEQ ID NO: 33944 - DNA, 25 bp, Homo sapien
tcagttgatttccccaggtacattc

SEQ ID NO: 33945 - DNA, 25 bp, Homo sapien
ttcactggggcaggaatcgccgcgt

SEQ ID NO: 33946 - DNA, 25 bp, Homo sapien
tagcagccaagatgatgtccgcagc

SEQ ID NO: 33947 - DNA, 25 bp, Homo sapien
cagccattgccaacgggggtggtgt

SEQ ID NO: 33948 - DNA, 25 bp, Homo sapien
ttgccaacgggggtggtgtttctgc

SEQ ID NO: 33949 - DNA, 25 bp, Homo sapien
gcagtccgtgggggcagctggactc

SEQ ID NO: 33950 - DNA, 25 bp, Homo sapien
acggcctcaccatgatgaaacgggc

SEQ ID NO: 33951 - DNA, 25 bp, Homo sapien
gcctctgttgggtcagtgttggggg

SEQ ID NO: 33952 - DNA, 25 bp, Homo sapien
tcccagctgaacccgaggctaaaga

SEQ ID NO: 33953 - DNA, 25 bp, Homo sapien
gaaacgggcagctgctgctgcagtg

SEQ ID NO: 33954 - DNA, 25 bp, Homo sapien
tgctgcagtgggaggagccctggca

SEQ ID NO: 33955 - DNA, 25 bp, Homo sapien
tgctcagtgccatgggcttcactgg

SEQ ID NO: 33956 - DNA, 25 bp, Homo sapien
aggccaggaagaacaccatcaccct

SEQ ID NO: 33957 - DNA, 25 bp, Homo sapien
ccaggaagaacaccatcaccctgga

SEQ ID NO: 33958 - DNA, 25 bp, Homo sapien
caccctggagaagcttcatgtgtcc

SEQ ID NO: 33959 - DNA, 25 bp, Homo sapien
tggagaagcttcatgtgtccagcct

SEQ ID NO: 33960 - DNA, 25 bp, Homo sapien
agaagcttcatgtgtccagccttct

SEQ ID NO: 33961 - DNA, 25 bp, Homo sapien
agccttctctctagtgtctttaagt

SEQ ID NO: 33962 - DNA, 25 bp, Homo sapien
gccttctctctagtgtctttaagtt

SEQ ID NO: 33963 - DNA, 25 bp, Homo sapien
ttctctctagtgtctttaagttgct

SEQ ID NO: 33964 - DNA, 25 bp, Homo sapien
ctctagtgtctttaagttgctgatg

SEQ ID NO: 33965 - DNA, 25 bp, Homo sapien
aagttgctgatgactcacaaggtaa

SEQ ID NO: 33966 - DNA, 25 bp, Homo sapien
agttgctgatgactcacaaggtaaa

SEQ ID NO: 33967 - DNA, 25 bp, Homo sapien
gaaagtgttgagataccatggcaga

SEQ ID NO: 33968 - DNA, 25 bp, Homo sapien
cctaagctttgaaccccagtagact

SEQ ID NO: 33969 - DNA, 25 bp, Homo sapien
ctttgaaccccagtagacttcttct

SEQ ID NO: 33970 - DNA, 25 bp, Homo sapien
cttctgccattaagtctctctttat

SEQ ID NO: 33971 - DNA, 25 bp, Homo sapien
taagtctctctttatctgatattct

SEQ ID NO: 33972 - DNA, 25 bp, Homo sapien
ttctaaggatttcttcaaactactt

SEQ ID NO: 33973 - DNA, 25 bp, Homo sapien
aactacttaataatttgtcaccatt

SEQ ID NO: 33974 - DNA, 25 bp, Homo sapien
gtcaccattaactttaatatccagt

SEQ ID NO: 33975 - DNA, 25 bp, Homo sapien
taatctgcactgtaatatcctgctt

SEQ ID NO: 33976 - DNA, 25 bp, Homo sapien
gctcctttggctctcataattgttt

SEQ ID NO: 33977 - DNA, 25 bp, Homo sapien
ggctctcataattgttttatagctg

SEQ ID NO: 33978 - DNA, 25 bp, Homo sapien
gaaagaacaatctcctgctaacagg

SEQ ID NO: 33979 - DNA, 25 bp, Homo sapien
aggtcagtcagatgaattcccttga

SEQ ID NO: 33980 - DNA, 25 bp, Homo sapien
gagcagctcatggagatgcagcacc

SEQ ID NO: 33981 - DNA, 25 bp, Homo sapien
agatgcagcacctgaggtccactgc

SEQ ID NO: 33982 - DNA, 25 bp, Homo sapien
atgcttgggatttgcagctgctcca

SEQ ID NO: 33983 - DNA, 25 bp, Homo sapien
tgtccgatggtgcccagggagcagt

SEQ ID NO: 33984 - DNA, 25 bp, Homo sapien
ggagcagtttctgcagcttcaacgc

SEQ ID NO: 33985 - DNA, 25 bp, Homo sapien
ttcaacgccagctgctgcaggcaga

SEQ ID NO: 33986 - DNA, 25 bp, Homo sapien
aaaccagcacctgcaggaggaactt

SEQ ID NO: 33987 - DNA, 25 bp, Homo sapien
aaccaacacaccacagggaaaccag

SEQ ID NO: 33988 - DNA, 25 bp, Homo sapien
aatgcccaggtttgttgaaagctct

SEQ ID NO: 33989 - DNA, 25 bp, Homo sapien
ggacaagctgggaaccaggaaggag

SEQ ID NO: 33990 - DNA, 25 bp, Homo sapien
ggaaggaggaggtgtcggaaaagtg

SEQ ID NO: 33991 - DNA, 25 bp, Homo sapien
ggtgtcggaaaagtgggaccgccat

SEQ ID NO: 33992 - DNA, 25 bp, Homo sapien
aaagtgggaccgccattgggagtgg

SEQ ID NO: 33993 - DNA, 25 bp, Homo sapien
gaccgccattgggagtggctgcagc

SEQ ID NO: 33994 - DNA, 25 bp, Homo sapien
gtggctgatgcctggctgacagccc

SEQ ID NO: 33995 - DNA, 25 bp, Homo sapien
gctgggcagcagcgtggatgaggtg

SEQ ID NO: 33996 - DNA, 25 bp, Homo sapien
ggcagcagcgtggatgaggtggagc

SEQ ID NO: 33997 - DNA, 25 bp, Homo sapien
tgaggtggagcagcttatccggcga

SEQ ID NO: 33998 - DNA, 25 bp, Homo sapien
gcagcttatccggcgacatgaggcc

SEQ ID NO: 33999 - DNA, 25 bp, Homo sapien
gcttatccggcgacatgaggccttc

SEQ ID NO: 34000 - DNA, 25 bp, Homo sapien
actagattggccatatgtttataat

SEQ ID NO: 34001 - DNA, 25 bp, Homo sapien
agtttcattatacttttctctccac

SEQ ID NO: 34002 - DNA, 25 bp, Homo sapien
tctctccacgttttgtctatgttga

SEQ ID NO: 34003 - DNA, 25 bp, Homo sapien
cacactggggcctgttgagggcagg

SEQ ID NO: 34004 - DNA, 25 bp, Homo sapien
gttgagggcagggagtcggcagaga

SEQ ID NO: 34005 - DNA, 25 bp, Homo sapien
gtcggcagagagagagcatcaggaa

SEQ ID NO: 34006 - DNA, 25 bp, Homo sapien
tgggcttcatacctgggtgatgaga

SEQ ID NO: 34007 - DNA, 25 bp, Homo sapien
tgggtgatgagatgatctgtgcagc

SEQ ID NO: 34008 - DNA, 25 bp, Homo sapien
gcagcaaagcaccatggtacatgtt

SEQ ID NO: 34009 - DNA, 25 bp, Homo sapien
gcaccatggtacatgtttacctatg

SEQ ID NO: 34010 - DNA, 25 bp, Homo sapien
gagactatagtcaacagcaatttaa

SEQ ID NO: 34011 - DNA, 25 bp, Homo sapien
tgaaagctccggagggcgagggtta

SEQ ID NO: 34012 - DNA, 25 bp, Homo sapien
tcccggggccgaggcaggaggacat

SEQ ID NO: 34013 - DNA, 25 bp, Homo sapien
acaaaggagggtctgagttcactga

SEQ ID NO: 34014 - DNA, 25 bp, Homo sapien
tgcacccctctgatgtgctggacat

SEQ ID NO: 34015 - DNA, 25 bp, Homo sapien
tgccaccaggtctcctatggggaga

SEQ ID NO: 34016 - DNA, 25 bp, Homo sapien
ggctgtgacaatccagactgtccaa

SEQ ID NO: 34017 - DNA, 25 bp, Homo sapien
attgagtggtttcactttgcctgcg

SEQ ID NO: 34018 - DNA, 25 bp, Homo sapien
tttgcctgcgtggaccttaccacga

SEQ ID NO: 34019 - DNA, 25 bp, Homo sapien
aaacctgtagtctgggcaacatcgg

SEQ ID NO: 34020 - DNA, 25 bp, Homo sapien
tggtcccaactacctgggaggcgga

SEQ ID NO: 34021 - DNA, 25 bp, Homo sapien
tgagcctggaagtccgaggcttcag

SEQ ID NO: 34022 - DNA, 25 bp, Homo sapien
tcctccctcagactcagaggtccag

SEQ ID NO: 34023 - DNA, 25 bp, Homo sapien
ccctcagactcagaggtccaggccc

SEQ ID NO: 34024 - DNA, 25 bp, Homo sapien
aaccgtccaggccagttaactctgg

SEQ ID NO: 34025 - DNA, 25 bp, Homo sapien
gtccaggccagttaactctggggac

SEQ ID NO: 34026 - DNA, 25 bp, Homo sapien
aactctggggactgggaacccatga

SEQ ID NO: 34027 - DNA, 25 bp, Homo sapien
tgggaacccatgaaattgaccccca

SEQ ID NO: 34028 - DNA, 25 bp, Homo sapien
gaaattgacccccaaatacatcctg

SEQ ID NO: 34029 - DNA, 25 bp, Homo sapien
cccccaaatacatcctgcggaagga

SEQ ID NO: 34030 - DNA, 25 bp, Homo sapien
attcaggaatatctgttcccagccc

SEQ ID NO: 34031 - DNA, 25 bp, Homo sapien
ctcctccctcaaaccaagggtacag

SEQ ID NO: 34032 - DNA, 25 bp, Homo sapien
caaaccaagggtacagatccccagc

SEQ ID NO: 34033 - DNA, 25 bp, Homo sapien
gtagccccatcacagaagatgcgac

SEQ ID NO: 34034 - DNA, 25 bp, Homo sapien
tgtgtccaccctagttcttaaattt

SEQ ID NO: 34035 - DNA, 25 bp, Homo sapien
gggatttggggtgtatgttaagagt

SEQ ID NO: 34036 - DNA, 25 bp, Homo sapien
agagtttttcaaatttgccagattg

SEQ ID NO: 34037 - DNA, 25 bp, Homo sapien
aacttttgtcagatgcctactttgc

SEQ ID NO: 34038 - DNA, 25 bp, Homo sapien
ctactttgctttcatttcatctcta

SEQ ID NO: 34039 - DNA, 25 bp, Homo sapien
gtgccagtgtgcagctgggtttctt

SEQ ID NO: 34040 - DNA, 25 bp, Homo sapien
cctggcactaggctacagcacttag

SEQ ID NO: 34041 - DNA, 25 bp, Homo sapien
acttagcacctctgatcttgttttt

SEQ ID NO: 34042 - DNA, 25 bp, Homo sapien
gaggttaacaaagcttttctgccca

SEQ ID NO: 34043 - DNA, 25 bp, Homo sapien
ttttctgcccacttcttggggagaa

SEQ ID NO: 34044 - DNA, 25 bp, Homo sapien
gcctctccacgcacagtgttaagga

SEQ ID NO: 34045 - DNA, 25 bp, Homo sapien
tgcggcatgggtgtgtccagtgcca

SEQ ID NO: 34046 - DNA, 25 bp, Homo sapien
gccacctggtccttcatgaagagca

SEQ ID NO: 34047 - DNA, 25 bp, Homo sapien
gaggctggtcgggaatggggaggtc

SEQ ID NO: 34048 - DNA, 25 bp, Homo sapien
ccagtcggcacctggtggctggaag

SEQ ID NO: 34049 - DNA, 25 bp, Homo sapien
ccccgccttagatcaatcacgtgga

SEQ ID NO: 34050 - DNA, 25 bp, Homo sapien
aaggcacgttttagagtctcttgtc

SEQ ID NO: 34051 - DNA, 25 bp, Homo sapien
ttaatgattatgtccatccgtctgt

SEQ ID NO: 34052 - DNA, 25 bp, Homo sapien
cactagcctctgacaaccatgaagc

SEQ ID NO: 34053 - DNA, 25 bp, Homo sapien
aaaatccgttacatgtgggtctgaa

SEQ ID NO: 34054 - DNA, 25 bp, Homo sapien
gaacttgtagactcggtcacagtat

SEQ ID NO: 34055 - DNA, 25 bp, Homo sapien
ccctctgcacgggagcgcaggagga

SEQ ID NO: 34056 - DNA, 25 bp, Homo sapien
actagacattgatagcagtcgtcct

SEQ ID NO: 34057 - DNA, 25 bp, Homo sapien
tagcagtcgtcctaatgtagcacca

SEQ ID NO: 34058 - DNA, 25 bp, Homo sapien
tgtagcaccagatggtctctctcta

SEQ ID NO: 34059 - DNA, 25 bp, Homo sapien
caccagatggtctctctctaaaatc

SEQ ID NO: 34060 - DNA, 25 bp, Homo sapien
ctctctaaaatctatatccagtgta

SEQ ID NO: 34061 - DNA, 25 bp, Homo sapien
gaaacacataggggatgacggatca

SEQ ID NO: 34062 - DNA, 25 bp, Homo sapien
gacggatcaaactctgtagcaactg

SEQ ID NO: 34063 - DNA, 25 bp, Homo sapien
cctggcacttcagaaacgctgaaac

SEQ ID NO: 34064 - DNA, 25 bp, Homo sapien
gaaacgtttcatggcagagcagctg

SEQ ID NO: 34065 - DNA, 25 bp, Homo sapien
gagcagcagcagattcctggaaaac

SEQ ID NO: 34066 - DNA, 25 bp, Homo sapien
ttttttccctatctgtatctatagc

SEQ ID NO: 34067 - DNA, 25 bp, Homo sapien
atctgtatctatagcaacaacccag

SEQ ID NO: 34068 - DNA, 25 bp, Homo sapien
gcaacaacccagaacttacaaactt

SEQ ID NO: 34069 - DNA, 25 bp, Homo sapien
gaatgctgtttgtggtacttaagaa

SEQ ID NO: 34070 - DNA, 25 bp, Homo sapien
aattcagttggattatcattatgtg

SEQ ID NO: 34071 - DNA, 25 bp, Homo sapien
gatactggcagattgcagtgcaacc

SEQ ID NO: 34072 - DNA, 25 bp, Homo sapien
gattgcagtgcaaccttatgccaat

SEQ ID NO: 34073 - DNA, 25 bp, Homo sapien
atgtaatttaacagccccagatatt

SEQ ID NO: 34074 - DNA, 25 bp, Homo sapien
aacagccccagatattgttgaatat

SEQ ID NO: 34075 - DNA, 25 bp, Homo sapien
gggagcagtataaagcttatttgta

SEQ ID NO: 34076 - DNA, 25 bp, Homo sapien
tatttagtagtgtatctcatagata

SEQ ID NO: 34077 - DNA, 25 bp, Homo sapien
gaaatgcttttcagtttgacagccc

SEQ ID NO: 34078 - DNA, 25 bp, Homo sapien
tgcttttcagtttgacagcccgttt

SEQ ID NO: 34079 - DNA, 25 bp, Homo sapien
gacaagtgcacctggggtttcagga

SEQ ID NO: 34080 - DNA, 25 bp, Homo sapien
ggctgtctctggaaaaagcctccat

SEQ ID NO: 34081 - DNA, 25 bp, Homo sapien
tgcccacccgccaggcggaaagtca

SEQ ID NO: 34082 - DNA, 25 bp, Homo sapien
cgccaggcggaaagtcaccctgttc

SEQ ID NO: 34083 - DNA, 25 bp, Homo sapien
tcccagcgcggtttcagcatttaat

SEQ ID NO: 34084 - DNA, 25 bp, Homo sapien
gaggagggggctgtgagtcctcaga

SEQ ID NO: 34085 - DNA, 25 bp, Homo sapien
ctgctaggccatccctggatagcaa

SEQ ID NO: 34086 - DNA, 25 bp, Homo sapien
gccatccctggatagcaagtgaatt

SEQ ID NO: 34087 - DNA, 25 bp, Homo sapien
attaacttaagggcactgtgatggg

SEQ ID NO: 34088 - DNA, 25 bp, Homo sapien
gtaagaggatgacaacctccactgt

SEQ ID NO: 34089 - DNA, 25 bp, Homo sapien
acctccactgtagtggatgtggctg

SEQ ID NO: 34090 - DNA, 25 bp, Homo sapien
cacactctcccccgagagaaggcag

SEQ ID NO: 34091 - DNA, 25 bp, Homo sapien
ccccgagagaaggcagctcatgctg

SEQ ID NO: 34092 - DNA, 25 bp, Homo sapien
gaggttcttttcaaaggggcatctt

SEQ ID NO: 34093 - DNA, 25 bp, Homo sapien
ttagtaggtgcttatccatgtggac

SEQ ID NO: 34094 - DNA, 25 bp, Homo sapien
ccatgtggactcaaatgcctgcatt

SEQ ID NO: 34095 - DNA, 25 bp, Homo sapien
gagcctggcattgccacttactagc

SEQ ID NO: 34096 - DNA, 25 bp, Homo sapien
taccttcctcattggattgttgaag

SEQ ID NO: 34097 - DNA, 25 bp, Homo sapien
aacacttagaaaggggccaggcatg

SEQ ID NO: 34098 - DNA, 25 bp, Homo sapien
aaacactttgccagactgaagcagg

SEQ ID NO: 34099 - DNA, 25 bp, Homo sapien
tgaaaagtctcccatgtctacttct

SEQ ID NO: 34100 - DNA, 25 bp, Homo sapien
tctacttctttctacacagacgcgg

SEQ ID NO: 34101 - DNA, 25 bp, Homo sapien
tttctacacagacgcggcaaccatc

SEQ ID NO: 34102 - DNA, 25 bp, Homo sapien
gcggcaaccatccgatttctcaatc

SEQ ID NO: 34103 - DNA, 25 bp, Homo sapien
accatccgatttctcaatcttttcc

SEQ ID NO: 34104 - DNA, 25 bp, Homo sapien
tattccacaaagccgccattgtcat

SEQ ID NO: 34105 - DNA, 25 bp, Homo sapien
ctggcccgttctcaatgagctgatg

SEQ ID NO: 34106 - DNA, 25 bp, Homo sapien
tctcaatgagctgatgggcacaccc

SEQ ID NO: 34107 - DNA, 25 bp, Homo sapien
gcacaccccccagacggggtggtgg

SEQ ID NO: 34108 - DNA, 25 bp, Homo sapien
ctcccagtaggggcggctggacaga

SEQ ID NO: 34109 - DNA, 25 bp, Homo sapien
ggggcggctggacagaggcgcccct

SEQ ID NO: 34110 - DNA, 25 bp, Homo sapien
tagttaattctatgttttctcagga

SEQ ID NO: 34111 - DNA, 25 bp, Homo sapien
atgttttctcaggaatcttgactta

SEQ ID NO: 34112 - DNA, 25 bp, Homo sapien
tgattttatctgtgccatactatct

SEQ ID NO: 34113 - DNA, 25 bp, Homo sapien
tgtgccatactatctcatgcaactg

SEQ ID NO: 34114 - DNA, 25 bp, Homo sapien
ctcatgcaactgaactatccaggca

SEQ ID NO: 34115 - DNA, 25 bp, Homo sapien
aactatccaggcatgactaatcttc

SEQ ID NO: 34116 - DNA, 25 bp, Homo sapien
atttcagaatattaggccttcaaca

SEQ ID NO: 34117 - DNA, 25 bp, Homo sapien
ttaggccttcaacagtaagattttt

SEQ ID NO: 34118 - DNA, 25 bp, Homo sapien
gctaccttgggggctgatgagggag

SEQ ID NO: 34119 - DNA, 25 bp, Homo sapien
gaatcacttgatcccggaaaggctg

SEQ ID NO: 34120 - DNA, 25 bp, Homo sapien
cacttgatcccggaaaggctgcagt

SEQ ID NO: 34121 - DNA, 25 bp, Homo sapien
aggcagcgctgcggagaggagcggc

SEQ ID NO: 34122 - DNA, 25 bp, Homo sapien
agaggagcggcagagtgggttgtct

SEQ ID NO: 34123 - DNA, 25 bp, Homo sapien
gcaggcaaccaggcaagtgtgtcgg

SEQ ID NO: 34124 - DNA, 25 bp, Homo sapien
gtgtcggggctggggtgtgaatgcc

SEQ ID NO: 34125 - DNA, 25 bp, Homo sapien
ggtgtgaatgccagcctgtgagtcc

SEQ ID NO: 34126 - DNA, 25 bp, Homo sapien
gcctgtgagtcccggaactatgtgg

SEQ ID NO: 34127 - DNA, 25 bp, Homo sapien
gggacagtgcctatgtgatcacctc

SEQ ID NO: 34128 - DNA, 25 bp, Homo sapien
ggctaagcttaggggcatttcccaa

SEQ ID NO: 34129 - DNA, 25 bp, Homo sapien
ccctggtgtctgacagcctcaagga

SEQ ID NO: 34130 - DNA, 25 bp, Homo sapien
cctggccccaagtgtgagtgatgag

SEQ ID NO: 34131 - DNA, 25 bp, Homo sapien
gatgagcaataaacgtaccgtcccc

SEQ ID NO: 34132 - DNA, 25 bp, Homo sapien
aagatgatcatcaagcttgctataa

SEQ ID NO: 34133 - DNA, 25 bp, Homo sapien
acatttgaacaaagacccacgtact

SEQ ID NO: 34134 - DNA, 25 bp, Homo sapien
agacccacgtacttatcttagaaag

SEQ ID NO: 34135 - DNA, 25 bp, Homo sapien
gattaatggtgctacatcactctac

SEQ ID NO: 34136 - DNA, 25 bp, Homo sapien
ttcctttctagctagctgtttgtgt

SEQ ID NO: 34137 - DNA, 25 bp, Homo sapien
tagctagctgtttgtgtagttcata

SEQ ID NO: 34138 - DNA, 25 bp, Homo sapien
gtagttcatattaatttaccctgcc

SEQ ID NO: 34139 - DNA, 25 bp, Homo sapien
ttaccctgccttttatttggattgt

SEQ ID NO: 34140 - DNA, 25 bp, Homo sapien
gtctgatttcttagttgtacacatg

SEQ ID NO: 34141 - DNA, 25 bp, Homo sapien
cttagttgtacacatgaacctcatt

SEQ ID NO: 34142 - DNA, 25 bp, Homo sapien
atgaacctcattatttgcctggaat

SEQ ID NO: 34143 - DNA, 25 bp, Homo sapien
ttgtctgtaagcttgctctgggact

SEQ ID NO: 34144 - DNA, 25 bp, Homo sapien
ctgtaagcttgctctgggactcagc

SEQ ID NO: 34145 - DNA, 25 bp, Homo sapien
gatggccaagtgaagacccaagtct

SEQ ID NO: 34146 - DNA, 25 bp, Homo sapien
agacccaagtctcagaaaacccaga

SEQ ID NO: 34147 - DNA, 25 bp, Homo sapien
aaacccagacttgggacaactgcct

SEQ ID NO: 34148 - DNA, 25 bp, Homo sapien
gacttgggacaactgcctgggaact

SEQ ID NO: 34149 - DNA, 25 bp, Homo sapien
aactgcctgggaactaggatgctag

SEQ ID NO: 34150 - DNA, 25 bp, Homo sapien
ggatgctagagcagttctgtaatgc

SEQ ID NO: 34151 - DNA, 25 bp, Homo sapien
gctttgagacacagcaattttcaca

SEQ ID NO: 34152 - DNA, 25 bp, Homo sapien
gcaattttcacattggccattcttt

SEQ ID NO: 34153 - DNA, 25 bp, Homo sapien
gctttcttctgaacttaccaccagc

SEQ ID NO: 34154 - DNA, 25 bp, Homo sapien
gtatttagattttttcaccaagtga

SEQ ID NO: 34155 - DNA, 25 bp, Homo sapien
agtggatacttccaagactcttggt

SEQ ID NO: 34156 - DNA, 25 bp, Homo sapien
gaaagcagaaggagcccaggcacag

SEQ ID NO: 34157 - DNA, 25 bp, Homo sapien
caaggcaggtggatcgcttgagctc

SEQ ID NO: 34158 - DNA, 25 bp, Homo sapien
tgaaatcccgtcaccacaaaaaaat

SEQ ID NO: 34159 - DNA, 25 bp, Homo sapien
ttaactgggcgtggtggcatgcacc

SEQ ID NO: 34160 - DNA, 25 bp, Homo sapien
ggtgaggggaatcacctgagccggg

SEQ ID NO: 34161 - DNA, 25 bp, Homo sapien
gggaatcacctgagcccagggaagt

SEQ ID NO: 34162 - DNA, 25 bp, Homo sapien
gttgaggctgctgtgagccatggtc

SEQ ID NO: 34163 - DNA, 25 bp, Homo sapien
gtgagccatggtcatgacactgccc

SEQ ID NO: 34164 - DNA, 25 bp, Homo sapien
tgccctccagcctggacaacagatt

SEQ ID NO: 34165 - DNA, 25 bp, Homo sapien
gtttctaaaacatgacggaggttga

SEQ ID NO: 34166 - DNA, 25 bp, Homo sapien
cggaggttgagatgaagcttcttca

SEQ ID NO: 34167 - DNA, 25 bp, Homo sapien
gaagcttcttcatggagtaaaaaat

SEQ ID NO: 34168 - DNA, 25 bp, Homo sapien
gagaaaggactacagagccccgaat

SEQ ID NO: 34169 - DNA, 25 bp, Homo sapien
tacagagccccgaattaataccaat

SEQ ID NO: 34170 - DNA, 25 bp, Homo sapien
gaagggcaatgcttttagattaaaa

SEQ ID NO: 34171 - DNA, 25 bp, Homo sapien
aatgaaggtgacttaaacagcttaa

SEQ ID NO: 34172 - DNA, 25 bp, Homo sapien
aaagaccttgaaatccatgacgcag

SEQ ID NO: 34173 - DNA, 25 bp, Homo sapien
gggagaattgcgtcatttaaagcct

SEQ ID NO: 34174 - DNA, 25 bp, Homo sapien
ttaaagcctagttaacgcatttact

SEQ ID NO: 34175 - DNA, 25 bp, Homo sapien
aacgcatttactaaacgcagacgaa

SEQ ID NO: 34176 - DNA, 25 bp, Homo sapien
aagcaaattggagactgggcacagt

SEQ ID NO: 34177 - DNA, 25 bp, Homo sapien
aaattggagactgggcacagtggct

SEQ ID NO: 34178 - DNA, 25 bp, Homo sapien
ccagcacctggggaggctgaggtga

SEQ ID NO: 34179 - DNA, 25 bp, Homo sapien
cctggggaggctgaggtgagtggat

SEQ ID NO: 34180 - DNA, 25 bp, Homo sapien
gaccagtctggccgacatggtgaaa

SEQ ID NO: 34181 - DNA, 25 bp, Homo sapien
ggccgacatggtgaaactcagtctc

SEQ ID NO: 34182 - DNA, 25 bp, Homo sapien
ggtgaaactcagtctctattgaaaa

SEQ ID NO: 34183 - DNA, 25 bp, Homo sapien
attagcccagtgtggtggcacacac

SEQ ID NO: 34184 - DNA, 25 bp, Homo sapien
gcccagtgtggtggcacacacttgt

SEQ ID NO: 34185 - DNA, 25 bp, Homo sapien
ccattgcactctagtctgggtgaca

SEQ ID NO: 34186 - DNA, 25 bp, Homo sapien
gcactctagtctgggtgacagagcg

SEQ ID NO: 34187 - DNA, 25 bp, Homo sapien
gcacagagggactttttttgcccag

SEQ ID NO: 34188 - DNA, 25 bp, Homo sapien
ttttgcccagtgtgtgcctgagtta

SEQ ID NO: 34189 - DNA, 25 bp, Homo sapien
cttgtgttcccagcagacatctgac

SEQ ID NO: 34190 - DNA, 25 bp, Homo sapien
gacatctgacgtagagacctgcgaa

SEQ ID NO: 34191 - DNA, 25 bp, Homo sapien
gacctgcgaatggatctgagatgag

SEQ ID NO: 34192 - DNA, 25 bp, Homo sapien
gagtagtaacgcaggttgtccgggg

SEQ ID NO: 34193 - DNA, 25 bp, Homo sapien
gtaacgcaggttgtccggggagaga

SEQ ID NO: 34194 - DNA, 25 bp, Homo sapien
ggcttgattcctgcctacagattgg

SEQ ID NO: 34195 - DNA, 25 bp, Homo sapien
ctgcctacagattggggttccggga

SEQ ID NO: 34196 - DNA, 25 bp, Homo sapien
ggttccgggatatttgttgagcgtt

SEQ ID NO: 34197 - DNA, 25 bp, Homo sapien
agaatccagatgagacacttgtcgc

SEQ ID NO: 34198 - DNA, 25 bp, Homo sapien
ctggtagatgtccatgcccatgtgc

SEQ ID NO: 34199 - DNA, 25 bp, Homo sapien
gctcctgctgggactcaattcaggc

SEQ ID NO: 34200 - DNA, 25 bp, Homo sapien
gactcaattcaggctatgtatgact

SEQ ID NO: 34201 - DNA, 25 bp, Homo sapien
gactatgaagtcaggctcatctgct

SEQ ID NO: 34202 - DNA, 25 bp, Homo sapien
tgaagtcaggctcatctgcttactg

SEQ ID NO: 34203 - DNA, 25 bp, Homo sapien
actggctgtgtgaactttttgtatc

SEQ ID NO: 34204 - DNA, 25 bp, Homo sapien
tcatccatgaaatccaagtaatact

SEQ ID NO: 34205 - DNA, 25 bp, Homo sapien
aatactacctaattgttactgtgga

SEQ ID NO: 34206 - DNA, 25 bp, Homo sapien
gcaatttctagttattattctagcc

SEQ ID NO: 34207 - DNA, 25 bp, Homo sapien
tattctagccagtaatggacttcag

SEQ ID NO: 34208 - DNA, 25 bp, Homo sapien
tgagaaggaagtctgggctgggcat

SEQ ID NO: 34209 - DNA, 25 bp, Homo sapien
ggaggcgctctataggcggaatctg

SEQ ID NO: 34210 - DNA, 25 bp, Homo sapien
ccgcaggtgaggagcccatggggcg

SEQ ID NO: 34211 - DNA, 25 bp, Homo sapien
cccatggggcgggcagccccagaaa

SEQ ID NO: 34212 - DNA, 25 bp, Homo sapien
gccccagaaagcgggcagcaggccc

SEQ ID NO: 34213 - DNA, 25 bp, Homo sapien
agcaggccccgataccgggaagagc

SEQ ID NO: 34214 - DNA, 25 bp, Homo sapien
taccgggaagagccgacacagccac

SEQ ID NO: 34215 - DNA, 25 bp, Homo sapien
acacagccacgaaccagacaagcag

SEQ ID NO: 34216 - DNA, 25 bp, Homo sapien
cagcggacaatcggttctggactca

SEQ ID NO: 34217 - DNA, 25 bp, Homo sapien
ggctgcgggtgttgggaaccatgcc

SEQ ID NO: 34218 - DNA, 25 bp, Homo sapien
ccctggagagtcctgtttgcacagc

SEQ ID NO: 34219 - DNA, 25 bp, Homo sapien
ggaataaaatagccagggccacact

SEQ ID NO: 34220 - DNA, 25 bp, Homo sapien
gcaagacactgcaagataccctctc

SEQ ID NO: 34221 - DNA, 25 bp, Homo sapien
gagaggcttttgcagagtcactcag

SEQ ID NO: 34222 - DNA, 25 bp, Homo sapien
gagtcactcaggacaagcttgaagg

SEQ ID NO: 34223 - DNA, 25 bp, Homo sapien
gaatgtgcacatttacctgattggg

SEQ ID NO: 34224 - DNA, 25 bp, Homo sapien
gggaaagagtcatctcgtacccact

SEQ ID NO: 34225 - DNA, 25 bp, Homo sapien
tgactccatcagtgtaagtggccaa

SEQ ID NO: 34226 - DNA, 25 bp, Homo sapien
cagtttgtgccaccagatcactgcg

SEQ ID NO: 34227 - DNA, 25 bp, Homo sapien
ctgcggcctgcaagcatggtggaga

SEQ ID NO: 34228 - DNA, 25 bp, Homo sapien
ggtggagacttgtatgtggtgggag

SEQ ID NO: 34229 - DNA, 25 bp, Homo sapien
tccatcccacggcgcatgtggaagt

SEQ ID NO: 34230 - DNA, 25 bp, Homo sapien
acaatgccaccgttgactgggagtg

SEQ ID NO: 34231 - DNA, 25 bp, Homo sapien
atgtatcctggtaccaacaactccc

SEQ ID NO: 34232 - DNA, 25 bp, Homo sapien
tggtaccaacaactcccaggaacag

SEQ ID NO: 34233 - DNA, 25 bp, Homo sapien
cccccaaactcctcatttatgacaa

SEQ ID NO: 34234 - DNA, 25 bp, Homo sapien
taagcgaccctcagggattcctggc

SEQ ID NO: 34235 - DNA, 25 bp, Homo sapien
tcaccggactccagactggggacga

SEQ ID NO: 34236 - DNA, 25 bp, Homo sapien
ggggacgaggccgattattactgcg

SEQ ID NO: 34237 - DNA, 25 bp, Homo sapien
gcggaacatgggatagcagcctgag

SEQ ID NO: 34238 - DNA, 25 bp, Homo sapien
tatctgcggccccaggacagaaggt

SEQ ID NO: 34239 - DNA, 25 bp, Homo sapien
ccaggacagaaggtcgccatctcct

SEQ ID NO: 34240 - DNA, 25 bp, Homo sapien
catctcctgctctggaagcagctcc

SEQ ID NO: 34241 - DNA, 25 bp, Homo sapien
ggaagcagctccaacattgggaata

SEQ ID NO: 34242 - DNA, 25 bp, Homo sapien
gcaggacatgggcaaacatgctgat

SEQ ID NO: 34243 - DNA, 25 bp, Homo sapien
gattggtgcaaatgtggtgccgagc

SEQ ID NO: 34244 - DNA, 25 bp, Homo sapien
caaatgtggtgccgagctgtccata

SEQ ID NO: 34245 - DNA, 25 bp, Homo sapien
ccgagctgtccatagctgcagtgaa

SEQ ID NO: 34246 - DNA, 25 bp, Homo sapien
agcaagaccttctctaggttttcta

SEQ ID NO: 34247 - DNA, 25 bp, Homo sapien
aggttttctagctttcattaaatgt

SEQ ID NO: 34248 - DNA, 25 bp, Homo sapien
atgtatttttttccccagagctaat

SEQ ID NO: 34249 - DNA, 25 bp, Homo sapien
tccccagagctaatttgaaagttga

SEQ ID NO: 34250 - DNA, 25 bp, Homo sapien
gaaagttgattggaccactgtggat

SEQ ID NO: 34251 - DNA, 25 bp, Homo sapien
gtgggaaataggggccgagtgcggt

SEQ ID NO: 34252 - DNA, 25 bp, Homo sapien
gaacgtgggaaatatgaacctttga

SEQ ID NO: 34253 - DNA, 25 bp, Homo sapien
gaaaacggtggaaacttctctgtgg

SEQ ID NO: 34254 - DNA, 25 bp, Homo sapien
cgcaactccaagatcatccttatcg

SEQ ID NO: 34255 - DNA, 25 bp, Homo sapien
atccttatcgatgaagccacagcct

SEQ ID NO: 34256 - DNA, 25 bp, Homo sapien
catggagacagacaccctgatccag

SEQ ID NO: 34257 - DNA, 25 bp, Homo sapien
ctgatccagcgcacaatccgtgaag

SEQ ID NO: 34258 - DNA, 25 bp, Homo sapien
caatccgtgaagccttccagggctg

SEQ ID NO: 34259 - DNA, 25 bp, Homo sapien
gaatttgatcggccggaggtactgc

SEQ ID NO: 34260 - DNA, 25 bp, Homo sapien
agaagcctgggtcattgttcgcagc

SEQ ID NO: 34261 - DNA, 25 bp, Homo sapien
gattgctggatggaaaccctggaat

SEQ ID NO: 34262 - DNA, 25 bp, Homo sapien
ggaataggctacttgatggctctca

SEQ ID NO: 34263 - DNA, 25 bp, Homo sapien
gatggctctcaagaccttagaaccc

SEQ ID NO: 34264 - DNA, 25 bp, Homo sapien
gaaatgttctgattacatcactgat

SEQ ID NO: 34265 - DNA, 25 bp, Homo sapien
tacatcactgattggtaatggttag

SEQ ID NO: 34266 - DNA, 25 bp, Homo sapien
gtgtttttgttgatgaggtttacat

SEQ ID NO: 34267 - DNA, 25 bp, Homo sapien
cacatttgtttcttatacaggtggt

SEQ ID NO: 34268 - DNA, 25 bp, Homo sapien
tacaggtggtgtgaactctagggcc

SEQ ID NO: 34269 - DNA, 25 bp, Homo sapien
gtggtgtgaactctagggcctatac

SEQ ID NO: 34270 - DNA, 25 bp, Homo sapien
actagaatcaatttgttccttgtta

SEQ ID NO: 34271 - DNA, 25 bp, Homo sapien
aaaggccttttgaattatactgcag

SEQ ID NO: 34272 - DNA, 25 bp, Homo sapien
tactgcagggcatcttgtgaatatg

SEQ ID NO: 34273 - DNA, 25 bp, Homo sapien
acagttgtgtgtgcatataaaatac

SEQ ID NO: 34274 - DNA, 25 bp, Homo sapien
aaaatacatatttacgccaggcgtg

SEQ ID NO: 34275 - DNA, 25 bp, Homo sapien
gcaaccttgaagagccgctgcattg

SEQ ID NO: 34276 - DNA, 25 bp, Homo sapien
gaagagccgctgcattgagaggcca

SEQ ID NO: 34277 - DNA, 25 bp, Homo sapien
gccgctgcattgagaggccagggac

SEQ ID NO: 34278 - DNA, 25 bp, Homo sapien
cagggacagggagaccggtgcgatg

SEQ ID NO: 34279 - DNA, 25 bp, Homo sapien
ggagaccggtgcgatggcagagcgc

SEQ ID NO: 34280 - DNA, 25 bp, Homo sapien
gcagcgggaagggcgaaactccgga

SEQ ID NO: 34281 - DNA, 25 bp, Homo sapien
ctgcggcggactgctgaaggggccg

SEQ ID NO: 34282 - DNA, 25 bp, Homo sapien
cggcggactgctgaaggggccgagc

SEQ ID NO: 34283 - DNA, 25 bp, Homo sapien
ggagacagcgagccagagtctgggt

SEQ ID NO: 34284 - DNA, 25 bp, Homo sapien
gagtctgggtgtttgtgcgagagcc

SEQ ID NO: 34285 - DNA, 25 bp, Homo sapien
ctgggtgtttgtgcgagagccacgg

SEQ ID NO: 34286 - DNA, 25 bp, Homo sapien
ctctcctggacaatgtggaccccaa

SEQ ID NO: 34287 - DNA, 25 bp, Homo sapien
ggatcatccagactaaagccctgca

SEQ ID NO: 34288 - DNA, 25 bp, Homo sapien
aagccctgcaggtgggctgtctgct

SEQ ID NO: 34289 - DNA, 25 bp, Homo sapien
tgctggcacagcagttctgagccct

SEQ ID NO: 34290 - DNA, 25 bp, Homo sapien
agccccttggactgaggcagttttg

SEQ ID NO: 34291 - DNA, 25 bp, Homo sapien
gcagttttggtggatgggggacctc

SEQ ID NO: 34292 - DNA, 25 bp, Homo sapien
gggacctccactggtgacagagaag

SEQ ID NO: 34293 - DNA, 25 bp, Homo sapien
gttcatctgctgctgtttacattct

SEQ ID NO: 34294 - DNA, 25 bp, Homo sapien
gctgtttacattctggggggttagg

SEQ ID NO: 34295 - DNA, 25 bp, Homo sapien
ggccagggaagtggatgtctcctcc

SEQ ID NO: 34296 - DNA, 25 bp, Homo sapien
cctccccatccaggggctgtgtatt

SEQ ID NO: 34297 - DNA, 25 bp, Homo sapien
ctgccttttctcactcagatgggga

SEQ ID NO: 34298 - DNA, 25 bp, Homo sapien
tgccaagaggacacctgtctactca

SEQ ID NO: 34299 - DNA, 25 bp, Homo sapien
aacgtcagcctctcgaggagctagg

SEQ ID NO: 34300 - DNA, 25 bp, Homo sapien
gagctaggactacaggcacatgcca

SEQ ID NO: 34301 - DNA, 25 bp, Homo sapien
caccaccaagcccagctatttttaa

SEQ ID NO: 34302 - DNA, 25 bp, Homo sapien
agacaaggtctcactatgtggccca

SEQ ID NO: 34303 - DNA, 25 bp, Homo sapien
ggaggtggagttgatgcctggatac

SEQ ID NO: 34304 - DNA, 25 bp, Homo sapien
acacagggtcctgagctctggggac

SEQ ID NO: 34305 - DNA, 25 bp, Homo sapien
gggaccaagcaatgtcctctggtga

SEQ ID NO: 34306 - DNA, 25 bp, Homo sapien
gcagaagatttgcctcttactcgcc

SEQ ID NO: 34307 - DNA, 25 bp, Homo sapien
cttactcgccatgtgctctgaatac

SEQ ID NO: 34308 - DNA, 25 bp, Homo sapien
cggagaatactggcttggactggaa

SEQ ID NO: 34309 - DNA, 25 bp, Homo sapien
tacagcagctttcgtctggaacctg

SEQ ID NO: 34310 - DNA, 25 bp, Homo sapien
tatagactgcgcctgggaacttacc

SEQ ID NO: 34311 - DNA, 25 bp, Homo sapien
tgtatgcaggaaactgcgcccactt

SEQ ID NO: 34312 - DNA, 25 bp, Homo sapien
gcgcccactttcataaaggaggctg

SEQ ID NO: 34313 - DNA, 25 bp, Homo sapien
gctggtggtacaatgcctgtgcaca

SEQ ID NO: 34314 - DNA, 25 bp, Homo sapien
gcctgtgcacattctaacctaaatg

SEQ ID NO: 34315 - DNA, 25 bp, Homo sapien
ggaggccattacagaagcaagcacc

SEQ ID NO: 34316 - DNA, 25 bp, Homo sapien
ctgggccgaatacagaggcgggtca

SEQ ID NO: 34317 - DNA, 25 bp, Homo sapien
aggcgggtcatactccttaagagca

SEQ ID NO: 34318 - DNA, 25 bp, Homo sapien
ttggcacaatttatttctacacata

SEQ ID NO: 34319 - DNA, 25 bp, Homo sapien
aattatctgctgtaagagagagttt

SEQ ID NO: 34320 - DNA, 25 bp, Homo sapien
gagagagtttggactaccttcttga

SEQ ID NO: 34321 - DNA, 25 bp, Homo sapien
agagtttggactaccttcttgactt

SEQ ID NO: 34322 - DNA, 25 bp, Homo sapien
tggactaccttcttgactttgttga

SEQ ID NO: 34323 - DNA, 25 bp, Homo sapien
gactaccttcttgactttgttgatg

SEQ ID NO: 34324 - DNA, 25 bp, Homo sapien
accttcttgactttgttgatgccac

SEQ ID NO: 34325 - DNA, 25 bp, Homo sapien
ttgactttgttgatgccacacctga

SEQ ID NO: 34326 - DNA, 25 bp, Homo sapien
actttgttgatgccacacctgagtt

SEQ ID NO: 34327 - DNA, 25 bp, Homo sapien
ttgttgatgccacacctgagtttca

SEQ ID NO: 34328 - DNA, 25 bp, Homo sapien
gagtttcagagattccacttcacac

SEQ ID NO: 34329 - DNA, 25 bp, Homo sapien
gtttcagagattccacttcacactg

SEQ ID NO: 34330 - DNA, 25 bp, Homo sapien
cttgcacctcccggatggtgctgac

SEQ ID NO: 34331 - DNA, 25 bp, Homo sapien
ttgcacctcccggatggtgctgact

SEQ ID NO: 34332 - DNA, 25 bp, Homo sapien
tgcacctcccggatggtgctgactg

SEQ ID NO: 34333 - DNA, 25 bp, Homo sapien
cggcggcgagtcgtgaggacgcgcc

SEQ ID NO: 34334 - DNA, 25 bp, Homo sapien
ggcggcgagtcgtgaggacgcgccg

SEQ ID NO: 34335 - DNA, 25 bp, Homo sapien
gcggcgagtcgtgaggacgcgccgc

SEQ ID NO: 34336 - DNA, 25 bp, Homo sapien
cggcgagtcgtgaggacgcgccgcg

SEQ ID NO: 34337 - DNA, 25 bp, Homo sapien
gcgccgcagccggggctgcggactt

SEQ ID NO: 34338 - DNA, 25 bp, Homo sapien
cgccgcagccggggctgcggacttc

SEQ ID NO: 34339 - DNA, 25 bp, Homo sapien
gccgcagccggggctgcggacttcg

SEQ ID NO: 34340 - DNA, 25 bp, Homo sapien
ccgcagccggggctgcggacttcgg

SEQ ID NO: 34341 - DNA, 25 bp, Homo sapien
gactgaatcgttatgcatgtgtcaa

SEQ ID NO: 34342 - DNA, 25 bp, Homo sapien
tgcatgtgtcaatcaatgggaggtg

SEQ ID NO: 34343 - DNA, 25 bp, Homo sapien
atgggaggtgtgcattctctagaag

SEQ ID NO: 34344 - DNA, 25 bp, Homo sapien
gcattctctagaagtagttttaggc

SEQ ID NO: 34345 - DNA, 25 bp, Homo sapien
gcctgttgaggcactgtcatgtggt

SEQ ID NO: 34346 - DNA, 25 bp, Homo sapien
gaggcactgtcatgtggtgtgaaag

SEQ ID NO: 34347 - DNA, 25 bp, Homo sapien
gaaagatttaaatgtagcaacgcta

SEQ ID NO: 34348 - DNA, 25 bp, Homo sapien
aagaagtggggacattggccgggcg

SEQ ID NO: 34349 - DNA, 25 bp, Homo sapien
gtcgagagttcgaggccagtctgac

SEQ ID NO: 34350 - DNA, 25 bp, Homo sapien
ggggggcacattccagagagtggtg

SEQ ID NO: 34351 - DNA, 25 bp, Homo sapien
attatgttcgggcggggtcttagct

SEQ ID NO: 34352 - DNA, 25 bp, Homo sapien
tgccatgctgatgccatatattcca

SEQ ID NO: 34353 - DNA, 25 bp, Homo sapien
gctgatgccatatattccaacgtga

SEQ ID NO: 34354 - DNA, 25 bp, Homo sapien
attccaacgtgatcaacctggctcc

SEQ ID NO: 34355 - DNA, 25 bp, Homo sapien
aggaggacgactttgctgtctacac

SEQ ID NO: 34356 - DNA, 25 bp, Homo sapien
cttttcatcaccccaggaggacatt

SEQ ID NO: 34357 - DNA, 25 bp, Homo sapien
ggaggacattgccagaccaagtgga

SEQ ID NO: 34358 - DNA, 25 bp, Homo sapien
gaccaagtggaatatgtctccattg

SEQ ID NO: 34359 - DNA, 25 bp, Homo sapien
gtctccattgtattccactgatggg

SEQ ID NO: 34360 - DNA, 25 bp, Homo sapien
cagagtgggggtcagacctggcccc

SEQ ID NO: 34361 - DNA, 25 bp, Homo sapien
cagctgaatcttggcataccctttg

SEQ ID NO: 34362 - DNA, 25 bp, Homo sapien
ggcataccctttgctttagatttat

SEQ ID NO: 34363 - DNA, 25 bp, Homo sapien
gagaactttgggatggtccgcgatc

SEQ ID NO: 34364 - DNA, 25 bp, Homo sapien
gtccgcgatctggcactgatggagc

SEQ ID NO: 34365 - DNA, 25 bp, Homo sapien
ggagtagacgaagcctatacgctag

SEQ ID NO: 34366 - DNA, 25 bp, Homo sapien
ggtttggtatgactggatgaggccc

SEQ ID NO: 34367 - DNA, 25 bp, Homo sapien
cacagcttcactctgactatatgca

SEQ ID NO: 34368 - DNA, 25 bp, Homo sapien
actatatgcagcccctgactgaggc

SEQ ID NO: 34369 - DNA, 25 bp, Homo sapien
cccctgactgaggccaaagccaaga

SEQ ID NO: 34370 - DNA, 25 bp, Homo sapien
acaaggttcggggtgttcagcagct

SEQ ID NO: 34371 - DNA, 25 bp, Homo sapien
tgttcagcagctgatacagcgcctc

SEQ ID NO: 34372 - DNA, 25 bp, Homo sapien
ggctgatcaagtctcctgcagaaat

SEQ ID NO: 34373 - DNA, 25 bp, Homo sapien
gattgctgggaagctgacatcacag

SEQ ID NO: 34374 - DNA, 25 bp, Homo sapien
tggggacccacagccaagaggagtc

SEQ ID NO: 34375 - DNA, 25 bp, Homo sapien
tcggtgaggggcccgaggtggcaga

SEQ ID NO: 34376 - DNA, 25 bp, Homo sapien
gggggtcctcaagactgtgggagac

SEQ ID NO: 34377 - DNA, 25 bp, Homo sapien
gcagggggagctgagtggcaggaca

SEQ ID NO: 34378 - DNA, 25 bp, Homo sapien
aggacttggacctcggaggggtctg

SEQ ID NO: 34379 - DNA, 25 bp, Homo sapien
cagcaagacactccggctggagctc

SEQ ID NO: 34380 - DNA, 25 bp, Homo sapien
gggagaggacacagggtggcctcaa

SEQ ID NO: 34381 - DNA, 25 bp, Homo sapien
aaagaggggatgggcagcctcctca

SEQ ID NO: 34382 - DNA, 25 bp, Homo sapien
cccatcactcttgatcctcaaagga

SEQ ID NO: 34383 - DNA, 25 bp, Homo sapien
tgagacagcgaaggctctgcctgcc

SEQ ID NO: 34384 - DNA, 25 bp, Homo sapien
ggagaattcggtggcctcagatgga

SEQ ID NO: 34385 - DNA, 25 bp, Homo sapien
ggctgtgctgtgtgccaatgtttcg

SEQ ID NO: 34386 - DNA, 25 bp, Homo sapien
caatgtttcgtttgcctcagacagg

SEQ ID NO: 34387 - DNA, 25 bp, Homo sapien
cagacaggtatctcttcgttatcag

SEQ ID NO: 34388 - DNA, 25 bp, Homo sapien
tgcttcatttcatctgggagcagaa

SEQ ID NO: 34389 - DNA, 25 bp, Homo sapien
gagctgtggagttcttaaatatcaa

SEQ ID NO: 34390 - DNA, 25 bp, Homo sapien
aaatatcaaccatggcactttctcc

SEQ ID NO: 34391 - DNA, 25 bp, Homo sapien
acttgttcctgtgggcttcagtgat

SEQ ID NO: 34392 - DNA, 25 bp, Homo sapien
cacttcactcagaggcatttgcatc

SEQ ID NO: 34393 - DNA, 25 bp, Homo sapien
aaagcctctaaagtgatcagtgcct

SEQ ID NO: 34394 - DNA, 25 bp, Homo sapien
tcagtgccttgatgccaactaagga

SEQ ID NO: 34395 - DNA, 25 bp, Homo sapien
gcattgaatctctgaaggctctatg

SEQ ID NO: 34396 - DNA, 25 bp, Homo sapien
ggaactggtgctgtactgggtacac

SEQ ID NO: 34397 - DNA, 25 bp, Homo sapien
tgggtacacagtaggcgcccaggac

SEQ ID NO: 34398 - DNA, 25 bp, Homo sapien
ggaagggcagagtgctggtttctcc

SEQ ID NO: 34399 - DNA, 25 bp, Homo sapien
gctggtttctccaggttgggttggg

SEQ ID NO: 34400 - DNA, 25 bp, Homo sapien
atgcctgagcctttgtccaaagtga

SEQ ID NO: 34401 - DNA, 25 bp, Homo sapien
gtgaggtcactcgagaattcatgga

SEQ ID NO: 34402 - DNA, 25 bp, Homo sapien
agtcagggggcatcttgcaagacct

SEQ ID NO: 34403 - DNA, 25 bp, Homo sapien
atcttgcaagacctttagtgccaca

SEQ ID NO: 34404 - DNA, 25 bp, Homo sapien
cacaaataagcatcgagcacctccc

SEQ ID NO: 34405 - DNA, 25 bp, Homo sapien
tccttatcccccatggtgtttatta

SEQ ID NO: 34406 - DNA, 25 bp, Homo sapien
gcaggtgaccagcagtgtcattgta

SEQ ID NO: 34407 - DNA, 25 bp, Homo sapien
tgcctaagcctgtctgtgcttcaga

SEQ ID NO: 34408 - DNA, 25 bp, Homo sapien
ctggctgtggggtaactgggggtat

SEQ ID NO: 34409 - DNA, 25 bp, Homo sapien
ctgggggtatgagctgtggccacag

SEQ ID NO: 34410 - DNA, 25 bp, Homo sapien
gtggccacaggtgagcaaggcaggg

SEQ ID NO: 34411 - DNA, 25 bp, Homo sapien
aggcagggaactgcaatccagccct

SEQ ID NO: 34412 - DNA, 25 bp, Homo sapien
cgtaggggcagaggtcgccagctag

SEQ ID NO: 34413 - DNA, 25 bp, Homo sapien
tgtccacttgtcaccttaggttttc

SEQ ID NO: 34414 - DNA, 25 bp, Homo sapien
tctgtgtgtttcatatccaacggca

SEQ ID NO: 34415 - DNA, 25 bp, Homo sapien
gggacagagtcctctaaatactcca

SEQ ID NO: 34416 - DNA, 25 bp, Homo sapien
atagcacacccagagccagggatcc

SEQ ID NO: 34417 - DNA, 25 bp, Homo sapien
gagccagggatccctttgtagtttt

SEQ ID NO: 34418 - DNA, 25 bp, Homo sapien
gattacgggcaagtttttattagag

SEQ ID NO: 34419 - DNA, 25 bp, Homo sapien
actctcagttctaacgcagggattc

SEQ ID NO: 34420 - DNA, 25 bp, Homo sapien
gattcaggaattgggctttcagact

SEQ ID NO: 34421 - DNA, 25 bp, Homo sapien
tccttctgcagtgtcacagtccaga

SEQ ID NO: 34422 - DNA, 25 bp, Homo sapien
gcagtgtcacagtccagactttttt

SEQ ID NO: 34423 - DNA, 25 bp, Homo sapien
cacagtgggtcccagggctagcagg

SEQ ID NO: 34424 - DNA, 25 bp, Homo sapien
tcccagggctagcaggagcgtgctg

SEQ ID NO: 34425 - DNA, 25 bp, Homo sapien
ggtgctggcaggagtgtgctggtga

SEQ ID NO: 34426 - DNA, 25 bp, Homo sapien
ggcaggagtgtgctggtgagccggc

SEQ ID NO: 34427 - DNA, 25 bp, Homo sapien
gctctgtctttgtaaatccttcagg

SEQ ID NO: 34428 - DNA, 25 bp, Homo sapien
tgtctttgtaaatccttcaggggtc

SEQ ID NO: 34429 - DNA, 25 bp, Homo sapien
gaaatcaccataattgatgatgctg

SEQ ID NO: 34430 - DNA, 25 bp, Homo sapien
gacagagacgttcaatatttccttg

SEQ ID NO: 34431 - DNA, 25 bp, Homo sapien
gacgttcaatatttccttgatcagt

SEQ ID NO: 34432 - DNA, 25 bp, Homo sapien
tgatcagtgttgctggaggtggcag

SEQ ID NO: 34433 - DNA, 25 bp, Homo sapien
ggtggcagacttggtgatgatgttg

SEQ ID NO: 34434 - DNA, 25 bp, Homo sapien
tgttgtggtaactgttgttattcca

SEQ ID NO: 34435 - DNA, 25 bp, Homo sapien
gttattccacaaaatgattctccat

SEQ ID NO: 34436 - DNA, 25 bp, Homo sapien
gggaaagccttgtttcaggctagcg

SEQ ID NO: 34437 - DNA, 25 bp, Homo sapien
tcaggctagcgtttcatgtaatttt

SEQ ID NO: 34438 - DNA, 25 bp, Homo sapien
agaaagtgtctcacatttttgtttt

SEQ ID NO: 34439 - DNA, 25 bp, Homo sapien
caatatggttgaattcccgtctcta

SEQ ID NO: 34440 - DNA, 25 bp, Homo sapien
cccactccgtacaatccaagtgcat

SEQ ID NO: 34441 - DNA, 25 bp, Homo sapien
caatccaagtgcattcaacaagtga

SEQ ID NO: 34442 - DNA, 25 bp, Homo sapien
tcccatgattcccacatgtctgtgg

SEQ ID NO: 34443 - DNA, 25 bp, Homo sapien
tgttctcctaatagtgaatgagtct

SEQ ID NO: 34444 - DNA, 25 bp, Homo sapien
ctcctgccatccacatacgatgtga

SEQ ID NO: 34445 - DNA, 25 bp, Homo sapien
attgtaagttcaataaacctctttg

SEQ ID NO: 34446 - DNA, 25 bp, Homo sapien
aaatcactgaacatttaatcccagc

SEQ ID NO: 34447 - DNA, 25 bp, Homo sapien
ggttctaacgtgaagccaaatgagg

SEQ ID NO: 34448 - DNA, 25 bp, Homo sapien
gaggacaggcgcatgattcagttta

SEQ ID NO: 34449 - DNA, 25 bp, Homo sapien
agaaaattgccccaaagtggatgaa

SEQ ID NO: 34450 - DNA, 25 bp, Homo sapien
tgaagcacacacatcagcagctcag

SEQ ID NO: 34451 - DNA, 25 bp, Homo sapien
ccccctaggagatccacacaatcag

SEQ ID NO: 34452 - DNA, 25 bp, Homo sapien
gatcatagtggtggtatatcggtat

SEQ ID NO: 34453 - DNA, 25 bp, Homo sapien
gattttaggacaccacttgcaggtc

SEQ ID NO: 34454 - DNA, 25 bp, Homo sapien
gacaccacttgcaggtcatgagaac

SEQ ID NO: 34455 - DNA, 25 bp, Homo sapien
gactgacttctctatctttcatgat

SEQ ID NO: 34456 - DNA, 25 bp, Homo sapien
tttatacattatccagaacttgctg

SEQ ID NO: 34457 - DNA, 25 bp, Homo sapien
gaacttgctgggtttgagtgttgca

SEQ ID NO: 34458 - DNA, 25 bp, Homo sapien
acattagcttgttcaacatttttta

SEQ ID NO: 34459 - DNA, 25 bp, Homo sapien
acattttttaatcctccatgttgag

SEQ ID NO: 34460 - DNA, 25 bp, Homo sapien
taaacacattaaaggctgggcgcgg

SEQ ID NO: 34461 - DNA, 25 bp, Homo sapien
ggccgagacgggtgtataacgaggt

SEQ ID NO: 34462 - DNA, 25 bp, Homo sapien
ggcaggagagcccttcagaagtatg

SEQ ID NO: 34463 - DNA, 25 bp, Homo sapien
gcaggagagcccttcagaagtatgt

SEQ ID NO: 34464 - DNA, 25 bp, Homo sapien
aggagagcccttcagaagtatgtgg

SEQ ID NO: 34465 - DNA, 25 bp, Homo sapien
agcccttcagaagtatgtggaggag

SEQ ID NO: 34466 - DNA, 25 bp, Homo sapien
gtggaggagaaggtgaagcaggaga

SEQ ID NO: 34467 - DNA, 25 bp, Homo sapien
tgaattctgccaatatctttttctt

SEQ ID NO: 34468 - DNA, 25 bp, Homo sapien
attctgccaatatctttttcttttc

SEQ ID NO: 34469 - DNA, 25 bp, Homo sapien
tctgccaatatctttttcttttctt

SEQ ID NO: 34470 - DNA, 25 bp, Homo sapien
cccggcctgatccatgaaaattgag

SEQ ID NO: 34471 - DNA, 25 bp, Homo sapien
cggcctgatccatgaaaattgagag

SEQ ID NO: 34472 - DNA, 25 bp, Homo sapien
gcctgatccatgaaaattgagagag

SEQ ID NO: 34473 - DNA, 25 bp, Homo sapien
ccataggccatacatgttactgtaa

SEQ ID NO: 34474 - DNA, 25 bp, Homo sapien
gagctactagtttctctattgtccc

SEQ ID NO: 34475 - DNA, 25 bp, Homo sapien
gtttctctattgtcccagggagata

SEQ ID NO: 34476 - DNA, 25 bp, Homo sapien
ggagatattagacctctctttttct

SEQ ID NO: 34477 - DNA, 25 bp, Homo sapien
ttatatcctaatttcctttcttact

SEQ ID NO: 34478 - DNA, 25 bp, Homo sapien
tcctaatttcctttcttacttcaat

SEQ ID NO: 34479 - DNA, 25 bp, Homo sapien
cttacttcaatctagaattctccag

SEQ ID NO: 34480 - DNA, 25 bp, Homo sapien
gaattctccagtaggtaccatctct

SEQ ID NO: 34481 - DNA, 25 bp, Homo sapien
aaagctgggtctcatgtttgagaca

SEQ ID NO: 34482 - DNA, 25 bp, Homo sapien
gtttgagacaagttcccaggtacta

SEQ ID NO: 34483 - DNA, 25 bp, Homo sapien
caagttcccaggtactattgaagta

SEQ ID NO: 34484 - DNA, 25 bp, Homo sapien
ttgagacccaaattgagcatgttgc

SEQ ID NO: 34485 - DNA, 25 bp, Homo sapien
cctttgcgctttgattccagatagt

SEQ ID NO: 34486 - DNA, 25 bp, Homo sapien
gtggaagtgtttatcgagcatgcaa

SEQ ID NO: 34487 - DNA, 25 bp, Homo sapien
gcatgcaaaagaaaccctcacggct

SEQ ID NO: 34488 - DNA, 25 bp, Homo sapien
gctctgggagttgtgtctgtgtgac

SEQ ID NO: 34489 - DNA, 25 bp, Homo sapien
gacctgagagtgatccatctcctgc

SEQ ID NO: 34490 - DNA, 25 bp, Homo sapien
gcagtgggcacttttcattgagaca

SEQ ID NO: 34491 - DNA, 25 bp, Homo sapien
caaactccagggtgtccagaggggg

SEQ ID NO: 34492 - DNA, 25 bp, Homo sapien
ggcccattcctggcacttagagaca

SEQ ID NO: 34493 - DNA, 25 bp, Homo sapien
aactcagcaatctttcgttctagtt

SEQ ID NO: 34494 - DNA, 25 bp, Homo sapien
cgttctagttatattcggtctttga

SEQ ID NO: 34495 - DNA, 25 bp, Homo sapien
tccggaacccgaagctggagaaagc

SEQ ID NO: 34496 - DNA, 25 bp, Homo sapien
gctggagaaagcggagatattggag

SEQ ID NO: 34497 - DNA, 25 bp, Homo sapien
gagatattggagttcgccgtgggct

SEQ ID NO: 34498 - DNA, 25 bp, Homo sapien
tattggagttcgccgtgggctactt

SEQ ID NO: 34499 - DNA, 25 bp, Homo sapien
ttcgccgtgggctacttgagggagc

SEQ ID NO: 34500 - DNA, 25 bp, Homo sapien
cgtgggctacttgagggagcgaagc

SEQ ID NO: 34501 - DNA, 25 bp, Homo sapien
cccggcccaagccggtagatccgag

SEQ ID NO: 34502 - DNA, 25 bp, Homo sapien
ggcccaagccggtagatccgaggcc

SEQ ID NO: 34503 - DNA, 25 bp, Homo sapien
gcgcgccggggattctggcgcgccg

SEQ ID NO: 34504 - DNA, 25 bp, Homo sapien
cgccgcctcacagacaagacggggc

SEQ ID NO: 34505 - DNA, 25 bp, Homo sapien
gcctcacagacaagacggggcgccc

SEQ ID NO: 34506 - DNA, 25 bp, Homo sapien
aaagattgggttttgaagatcgata

SEQ ID NO: 34507 - DNA, 25 bp, Homo sapien
agattgggttttgaagatcgatatt

SEQ ID NO: 34508 - DNA, 25 bp, Homo sapien
attgggttttgaagatcgatatttt

SEQ ID NO: 34509 - DNA, 25 bp, Homo sapien
ttgggttttgaagatcgatattttt

SEQ ID NO: 34510 - DNA, 25 bp, Homo sapien
tgggttttgaagatcgatattttta

SEQ ID NO: 34511 - DNA, 25 bp, Homo sapien
ggttttgaagatcgatatttttaat

SEQ ID NO: 34512 - DNA, 25 bp, Homo sapien
gttttgaagatcgatatttttaatg

SEQ ID NO: 34513 - DNA, 25 bp, Homo sapien
gaagatcgatatttttaatggattt

SEQ ID NO: 34514 - DNA, 25 bp, Homo sapien
aagatcgatatttttaatggattta

SEQ ID NO: 34515 - DNA, 25 bp, Homo sapien
agatcgatatttttaatggatttaa

SEQ ID NO: 34516 - DNA, 25 bp, Homo sapien
taaaaaataaaggctgggcaccttg

SEQ ID NO: 34517 - DNA, 25 bp, Homo sapien
tccatctacctgtcattgatctatc

SEQ ID NO: 34518 - DNA, 25 bp, Homo sapien
tctatctatcatctaccaatctaca

SEQ ID NO: 34519 - DNA, 25 bp, Homo sapien
atcatctaccaatctacatttttgt

SEQ ID NO: 34520 - DNA, 25 bp, Homo sapien
attactatattctatctatccattt

SEQ ID NO: 34521 - DNA, 25 bp, Homo sapien
cagaaaaacgttgacctcttggcga

SEQ ID NO: 34522 - DNA, 25 bp, Homo sapien
gttgacctcttggcgagaatgcaaa

SEQ ID NO: 34523 - DNA, 25 bp, Homo sapien
ttctatctatccatttattccatct

SEQ ID NO: 34524 - DNA, 25 bp, Homo sapien
ctggaaaagcttacctggaatcacg

SEQ ID NO: 34525 - DNA, 25 bp, Homo sapien
ttccatctatctattccatttatca

SEQ ID NO: 34526 - DNA, 25 bp, Homo sapien
tacctacctattattatctatcatc

SEQ ID NO: 34527 - DNA, 25 bp, Homo sapien
atcatctatgtattccatctacctg

SEQ ID NO: 34528 - DNA, 25 bp, Homo sapien
gtagctggggctatgtcagccaggc

SEQ ID NO: 34529 - DNA, 25 bp, Homo sapien
cttgcttttccaccaggtgcgtaag

SEQ ID NO: 34530 - DNA, 25 bp, Homo sapien
aggtgcgtaagtatctgcttcggct

SEQ ID NO: 34531 - DNA, 25 bp, Homo sapien
cttcggctggacgtccggaaggatc

SEQ ID NO: 34532 - DNA, 25 bp, Homo sapien
ggctggacgtccggaaggatcacgt

SEQ ID NO: 34533 - DNA, 25 bp, Homo sapien
aggatcacgtgaagttctggcggcc

SEQ ID NO: 34534 - DNA, 25 bp, Homo sapien
accctgtacagccgcagtatggggc

SEQ ID NO: 34535 - DNA, 25 bp, Homo sapien
gtacagccgcagtatggggcatggc

SEQ ID NO: 34536 - DNA, 25 bp, Homo sapien
ccgcagtatggggcatggctcagcc

SEQ ID NO: 34537 - DNA, 25 bp, Homo sapien
tggaccgtgcccaggtgaaggcttt

SEQ ID NO: 34538 - DNA, 25 bp, Homo sapien
ctcagcatctgctgcgaatctccgg

SEQ ID NO: 34539 - DNA, 25 bp, Homo sapien
tgcttacagaatggatcatgtcccc

SEQ ID NO: 34540 - DNA, 25 bp, Homo sapien
atgtcccccttatgttgaggtgacc

SEQ ID NO: 34541 - DNA, 25 bp, Homo sapien
tgaggtgaccacttaattgctttcc

SEQ ID NO: 34542 - DNA, 25 bp, Homo sapien
gtttttgccactgatttagccatgt

SEQ ID NO: 34543 - DNA, 25 bp, Homo sapien
acccttttctgggtttgaagctgct

SEQ ID NO: 34544 - DNA, 25 bp, Homo sapien
tgctgtctctagaagtgccatctca

SEQ ID NO: 34545 - DNA, 25 bp, Homo sapien
gccatctcaattgtgctttgtatca

SEQ ID NO: 34546 - DNA, 25 bp, Homo sapien
ttgtgctttgtatcagtcagtgctg

SEQ ID NO: 34547 - DNA, 25 bp, Homo sapien
tggtaaggtttctaggaggtctgtt

SEQ ID NO: 34548 - DNA, 25 bp, Homo sapien
ggtctgttaggtgtacatcctgcag

SEQ ID NO: 34549 - DNA, 25 bp, Homo sapien
actctccttttatgtggtctctttg

SEQ ID NO: 34550 - DNA, 25 bp, Homo sapien
cggcccctgcacatttaggatatgc

SEQ ID NO: 34551 - DNA, 25 bp, Homo sapien
tatgctcctggatggggactgggct

SEQ ID NO: 34552 - DNA, 25 bp, Homo sapien
gtcccccaggatgtcttgtggtggc

SEQ ID NO: 34553 - DNA, 25 bp, Homo sapien
ggcactggctagggaggggcaggcc

SEQ ID NO: 34554 - DNA, 25 bp, Homo sapien
cttgggagatgcattttccgtctgg

SEQ ID NO: 34555 - DNA, 25 bp, Homo sapien
ctgcccaggccactgtgagggtggg

SEQ ID NO: 34556 - DNA, 25 bp, Homo sapien
tgctggctgagcccctggggcagaa

SEQ ID NO: 34557 - DNA, 25 bp, Homo sapien
gacagaagtggggcggcctgaaccc

SEQ ID NO: 34558 - DNA, 25 bp, Homo sapien
ggaacccggcaggggtgtctgaggc

SEQ ID NO: 34559 - DNA, 25 bp, Homo sapien
caagcctgtggctggagctggtgtg

SEQ ID NO: 34560 - DNA, 25 bp, Homo sapien
aataaagtcccacaggtgcctcaaa

SEQ ID NO: 34561 - DNA, 25 bp, Homo sapien
ctcactgacataactggaagataat

SEQ ID NO: 34562 - DNA, 25 bp, Homo sapien
atttgttatggcagcaattaagagt

SEQ ID NO: 34563 - DNA, 25 bp, Homo sapien
gagtaatacggattttagtacttgg

SEQ ID NO: 34564 - DNA, 25 bp, Homo sapien
agtacttggcagtggggtgtggcta

SEQ ID NO: 34565 - DNA, 25 bp, Homo sapien
ggggtgtggctatcacatattcctg

SEQ ID NO: 34566 - DNA, 25 bp, Homo sapien
tattcctgaaagtgttggggtgtct

SEQ ID NO: 34567 - DNA, 25 bp, Homo sapien
tggggtgtctttgagattgcgcagt

SEQ ID NO: 34568 - DNA, 25 bp, Homo sapien
gattgcgcagtggaaagaggttgga

SEQ ID NO: 34569 - DNA, 25 bp, Homo sapien
accctacaatggcctgtaagtgctc

SEQ ID NO: 34570 - DNA, 25 bp, Homo sapien
aatggcctgtaagtgctcaagttaa

SEQ ID NO: 34571 - DNA, 25 bp, Homo sapien
tcaagttaaagaaagagtcggccgg

SEQ ID NO: 34572 - DNA, 25 bp, Homo sapien
gtagcattacaaagcctgtgggaat

SEQ ID NO: 34573 - DNA, 25 bp, Homo sapien
aatatgacctatacagcactggcta

SEQ ID NO: 34574 - DNA, 25 bp, Homo sapien
acagcactggctatctattagattc

SEQ ID NO: 34575 - DNA, 25 bp, Homo sapien
atctattagattcacctggggagct

SEQ ID NO: 34576 - DNA, 25 bp, Homo sapien
aaagcacacatgctcgggttctacc

SEQ ID NO: 34577 - DNA, 25 bp, Homo sapien
gggatgaccatctatatttttaata

SEQ ID NO: 34578 - DNA, 25 bp, Homo sapien
gctccacaagttaattctgatgcac

SEQ ID NO: 34579 - DNA, 25 bp, Homo sapien
gatagacgaaccattactttaacat

SEQ ID NO: 34580 - DNA, 25 bp, Homo sapien
cattactttaacatgactcaccttg

SEQ ID NO: 34581 - DNA, 25 bp, Homo sapien
gcttattctcaaagctactttccca

SEQ ID NO: 34582 - DNA, 25 bp, Homo sapien
tactttcccattcttgaaattggat

SEQ ID NO: 34583 - DNA, 25 bp, Homo sapien
cgagccctcctactgggagatgatc

SEQ ID NO: 34584 - DNA, 25 bp, Homo sapien
gatgatccgctgcgacaacgaatgc

SEQ ID NO: 34585 - DNA, 25 bp, Homo sapien
gtgtgagtctcaaccataaaccaaa

SEQ ID NO: 34586 - DNA, 25 bp, Homo sapien
accaaagcgcaagtggtactgttcc

SEQ ID NO: 34587 - DNA, 25 bp, Homo sapien
ggtactgttccagatgccggggaaa

SEQ ID NO: 34588 - DNA, 25 bp, Homo sapien
ggaaagaacgatgggcaaagccctt

SEQ ID NO: 34589 - DNA, 25 bp, Homo sapien
acaggtagtttggggacatgcgtct

SEQ ID NO: 34590 - DNA, 25 bp, Homo sapien
gggacatgcgtctaatagtgaggag

SEQ ID NO: 34591 - DNA, 25 bp, Homo sapien
tgttgattacattgccacctttgct

SEQ ID NO: 34592 - DNA, 25 bp, Homo sapien
attgccacctttgctgaggtgcagg

SEQ ID NO: 34593 - DNA, 25 bp, Homo sapien
aagaatgttgttagaggccgggcgc

SEQ ID NO: 34594 - DNA, 25 bp, Homo sapien
gtctcttagaaggacactggtcatt

SEQ ID NO: 34595 - DNA, 25 bp, Homo sapien
ggtcattggatttaaaggccacctg

SEQ ID NO: 34596 - DNA, 25 bp, Homo sapien
aggccacctgggtaatttatagtga

SEQ ID NO: 34597 - DNA, 25 bp, Homo sapien
gtgatctaatctcaagaatctttcc

SEQ ID NO: 34598 - DNA, 25 bp, Homo sapien
gaatctttccttaattacatgcaaa

SEQ ID NO: 34599 - DNA, 25 bp, Homo sapien
tacatgcaaatactctttatccaaa

SEQ ID NO: 34600 - DNA, 25 bp, Homo sapien
gcattcacaaattctggagcttagt

SEQ ID NO: 34601 - DNA, 25 bp, Homo sapien
ggagcttagtacttggacatatatt

SEQ ID NO: 34602 - DNA, 25 bp, Homo sapien
tggggggttgatggttggaggggct

SEQ ID NO: 34603 - DNA, 25 bp, Homo sapien
gaggggcttttattcaactcagtac

SEQ ID NO: 34604 - DNA, 25 bp, Homo sapien
tcctagctattcagggaactgaggt

SEQ ID NO: 34605 - DNA, 25 bp, Homo sapien
gaaagttggaatattgccttctcag

SEQ ID NO: 34606 - DNA, 25 bp, Homo sapien
ttggaatattgccttctcagtgttt

SEQ ID NO: 34607 - DNA, 25 bp, Homo sapien
aaagcagaccccaaatcacagtgat

SEQ ID NO: 34608 - DNA, 25 bp, Homo sapien
agcagaccccaaatcacagtgatcc

SEQ ID NO: 34609 - DNA, 25 bp, Homo sapien
gaccccaaatcacagtgatcccaga

SEQ ID NO: 34610 - DNA, 25 bp, Homo sapien
atcccagaatagactacatacttac

SEQ ID NO: 34611 - DNA, 25 bp, Homo sapien
catacttacatttgaacaggctacg

SEQ ID NO: 34612 - DNA, 25 bp, Homo sapien
acttacatttgaacaggctacgaaa

SEQ ID NO: 34613 - DNA, 25 bp, Homo sapien
ggctacgaaaatgttaatcaccggg

SEQ ID NO: 34614 - DNA, 25 bp, Homo sapien
taatcaccgggatttcaatttcttt

SEQ ID NO: 34615 - DNA, 25 bp, Homo sapien
ttgcttcctcgggttgctttaaatg

SEQ ID NO: 34616 - DNA, 25 bp, Homo sapien
ctctggacggctccgtggacgagag

SEQ ID NO: 34617 - DNA, 25 bp, Homo sapien
tggacggctccgtggacgagaggaa

SEQ ID NO: 34618 - DNA, 25 bp, Homo sapien
gacggctccgtggacgagaggaagc

SEQ ID NO: 34619 - DNA, 25 bp, Homo sapien
ggctccgtggacgagaggaagctgc

SEQ ID NO: 34620 - DNA, 25 bp, Homo sapien
gtggacgagaggaagctgcgcgagc

SEQ ID NO: 34621 - DNA, 25 bp, Homo sapien
gacgagaggaagctgcgcgagctga

SEQ ID NO: 34622 - DNA, 25 bp, Homo sapien
tcctcatcaacacctacggaatcct

SEQ ID NO: 34623 - DNA, 25 bp, Homo sapien
tcatcaacacctacggaatcctgaa

SEQ ID NO: 34624 - DNA, 25 bp, Homo sapien
aacacctacggaatcctgaagcagc

SEQ ID NO: 34625 - DNA, 25 bp, Homo sapien
cacctacggaatcctgaagcagcgg

SEQ ID NO: 34626 - DNA, 25 bp, Homo sapien
cgcaagctggtcatcgacgtggtgc

SEQ ID NO: 34627 - DNA, 25 bp, Homo sapien
tgaccaagcaccacgtgccattcat

SEQ ID NO: 34628 - DNA, 25 bp, Homo sapien
gaagtatttcttagacccatgtctc

SEQ ID NO: 34629 - DNA, 25 bp, Homo sapien
cccatgtctctgtccaaataggcct

SEQ ID NO: 34630 - DNA, 25 bp, Homo sapien
ggcatttcccgctcatttatatgac

SEQ ID NO: 34631 - DNA, 25 bp, Homo sapien
gacttgctgagttcctatggtcatt

SEQ ID NO: 34632 - DNA, 25 bp, Homo sapien
gtggtctgtagcactcaggttttct

SEQ ID NO: 34633 - DNA, 25 bp, Homo sapien
agtactgtctcatccattgaatcat

SEQ ID NO: 34634 - DNA, 25 bp, Homo sapien
gaatcatttcaccttcataagtgct

SEQ ID NO: 34635 - DNA, 25 bp, Homo sapien
taagtgctgagagaaaccccttggt

SEQ ID NO: 34636 - DNA, 25 bp, Homo sapien
gccatcagccaacaggcagttcctg

SEQ ID NO: 34637 - DNA, 25 bp, Homo sapien
gggaaggttttgagagctccctcca

SEQ ID NO: 34638 - DNA, 25 bp, Homo sapien
cctgctagccaaaaggcttccctct

SEQ ID NO: 34639 - DNA, 25 bp, Homo sapien
tgtgtgttgcagtcctgtggcatta

SEQ ID NO: 34640 - DNA, 25 bp, Homo sapien
gtcctgtggcattatgcatgccccc

SEQ ID NO: 34641 - DNA, 25 bp, Homo sapien
gaccccaggctttttatggctgtga

SEQ ID NO: 34642 - DNA, 25 bp, Homo sapien
gggtaagacgtgaccttttgaggtg

SEQ ID NO: 34643 - DNA, 25 bp, Homo sapien
gatgcaagaatctgggactgagaca

SEQ ID NO: 34644 - DNA, 25 bp, Homo sapien
aagtaacggttcagccatccagaat

SEQ ID NO: 34645 - DNA, 25 bp, Homo sapien
ccatccagaatgggtcgggcggcag

SEQ ID NO: 34646 - DNA, 25 bp, Homo sapien
gcggcagcaaccacttactagagtg

SEQ ID NO: 34647 - DNA, 25 bp, Homo sapien
ccacttactagagtgcggcggtctt

SEQ ID NO: 34648 - DNA, 25 bp, Homo sapien
ggcggtccaacggagagacgccggc

SEQ ID NO: 34649 - DNA, 25 bp, Homo sapien
gaagcgtaaggctgaggccgcggtg

SEQ ID NO: 34650 - DNA, 25 bp, Homo sapien
tggtcgccgtagccgagaagcgaga

SEQ ID NO: 34651 - DNA, 25 bp, Homo sapien
agctggcgaacggcggggagggaat

SEQ ID NO: 34652 - DNA, 25 bp, Homo sapien
gaccgttgttatcgagcattgcact

SEQ ID NO: 34653 - DNA, 25 bp, Homo sapien
tgcactagctgacgcgtctatgggc

SEQ ID NO: 34654 - DNA, 25 bp, Homo sapien
gaagccccggaggggcagcttcgag

SEQ ID NO: 34655 - DNA, 25 bp, Homo sapien
tgcggagctctggactgggattaag

SEQ ID NO: 34656 - DNA, 25 bp, Homo sapien
gcaaactcaaattccctgagcctca

SEQ ID NO: 34657 - DNA, 25 bp, Homo sapien
agaagccctcatgctgagctttgtg

SEQ ID NO: 34658 - DNA, 25 bp, Homo sapien
gatcctgaagccatggtttcttccc

SEQ ID NO: 34659 - DNA, 25 bp, Homo sapien
gaggcaaccctctagtaaggcattg

SEQ ID NO: 34660 - DNA, 25 bp, Homo sapien
cacatcgcatgcactcagagcacag

SEQ ID NO: 34661 - DNA, 25 bp, Homo sapien
cgcatgcactcagagcacagagccg

SEQ ID NO: 34662 - DNA, 25 bp, Homo sapien
gctctcgttttgtcaggcagctatg

SEQ ID NO: 34663 - DNA, 25 bp, Homo sapien
tctcgttttgtcaggcagctatgca

SEQ ID NO: 34664 - DNA, 25 bp, Homo sapien
ttgtcaggcagctatgcagttgctc

SEQ ID NO: 34665 - DNA, 25 bp, Homo sapien
tcaggcagctatgcagttgctcttc

SEQ ID NO: 34666 - DNA, 25 bp, Homo sapien
atcctccccttgagagtcatcagaa

SEQ ID NO: 34667 - DNA, 25 bp, Homo sapien
cctccccttgagagtcatcagaaaa

SEQ ID NO: 34668 - DNA, 25 bp, Homo sapien
gagagtcatcagaaaaatacattag

SEQ ID NO: 34669 - DNA, 25 bp, Homo sapien
cacaaggcagggcagtgctcacgcc

SEQ ID NO: 34670 - DNA, 25 bp, Homo sapien
acaaggcagggcagtgctcacgcct

SEQ ID NO: 34671 - DNA, 25 bp, Homo sapien
accccaagaggttcaatgtagctgt

SEQ ID NO: 34672 - DNA, 25 bp, Homo sapien
gaggttcaatgtagctgtgacccgg

SEQ ID NO: 34673 - DNA, 25 bp, Homo sapien
ggttcaatgtagctgtgacccgggc

SEQ ID NO: 34674 - DNA, 25 bp, Homo sapien
ggccatgaccctgactggaaagtat

SEQ ID NO: 34675 - DNA, 25 bp, Homo sapien
agtattcctggagttctgtaaagaa

SEQ ID NO: 34676 - DNA, 25 bp, Homo sapien
ctgccaaactggacctgcaacaggg

SEQ ID NO: 34677 - DNA, 25 bp, Homo sapien
aactggacctgcaacagggacagaa

SEQ ID NO: 34678 - DNA, 25 bp, Homo sapien
agggacagaatttactgcaaggtct

SEQ ID NO: 34679 - DNA, 25 bp, Homo sapien
caaggtctgagcaagctcagcccct

SEQ ID NO: 34680 - DNA, 25 bp, Homo sapien
gagccagagtggaggaatgagctct

SEQ ID NO: 34681 - DNA, 25 bp, Homo sapien
gtggaggaatgagctctgaagacac

SEQ ID NO: 34682 - DNA, 25 bp, Homo sapien
atatggtatatattcaccatggaat

SEQ ID NO: 34683 - DNA, 25 bp, Homo sapien
gtgggagttaagctatgggtatgca

SEQ ID NO: 34684 - DNA, 25 bp, Homo sapien
gcagactccaaatggggagggtgga

SEQ ID NO: 34685 - DNA, 25 bp, Homo sapien
aaaagctacaagttgggtacaatgt

SEQ ID NO: 34686 - DNA, 25 bp, Homo sapien
acactactcaggtgatgggtacact

SEQ ID NO: 34687 - DNA, 25 bp, Homo sapien
gatacaaacattatacctgctactc

SEQ ID NO: 34688 - DNA, 25 bp, Homo sapien
acaaacattatacctgctactcttc

SEQ ID NO: 34689 - DNA, 25 bp, Homo sapien
cctgctactcttcctagtgaatttc

SEQ ID NO: 34690 - DNA, 25 bp, Homo sapien
actcttcctagtgaatttcctaatc

SEQ ID NO: 34691 - DNA, 25 bp, Homo sapien
tagtgaatttcctaatcagtctaaa

SEQ ID NO: 34692 - DNA, 25 bp, Homo sapien
atcagtctaaaatcttgcatggtaa

SEQ ID NO: 34693 - DNA, 25 bp, Homo sapien
gctgtactttattgactacctcttc

SEQ ID NO: 34694 - DNA, 25 bp, Homo sapien
tgactacctcttccacaggagaacc

SEQ ID NO: 34695 - DNA, 25 bp, Homo sapien
tccacaggagaacccagcacaggtc

SEQ ID NO: 34696 - DNA, 25 bp, Homo sapien
aacccagcacaggtcacagtggctt

SEQ ID NO: 34697 - DNA, 25 bp, Homo sapien
gtcacagtggcttatcctgtaatcc

SEQ ID NO: 34698 - DNA, 25 bp, Homo sapien
gggaggccaaagcagacggatcacc

SEQ ID NO: 34699 - DNA, 25 bp, Homo sapien
gccaacatggcgaaaccttgtctct

SEQ ID NO: 34700 - DNA, 25 bp, Homo sapien
agctgggggaagccgaggtgggtgg

SEQ ID NO: 34701 - DNA, 25 bp, Homo sapien
ttagccaggcgtggtagtaggtgcc

SEQ ID NO: 34702 - DNA, 25 bp, Homo sapien
tggtagtaggtgcctatagtcccag

SEQ ID NO: 34703 - DNA, 25 bp, Homo sapien
gaacctggaaggcggagtttgcagt

SEQ ID NO: 34704 - DNA, 25 bp, Homo sapien
ttccaggcgtgacccatcatgcctg

SEQ ID NO: 34705 - DNA, 25 bp, Homo sapien
ccaggcgtgacccatcatgcctggc

SEQ ID NO: 34706 - DNA, 25 bp, Homo sapien
ctggccccaggtagtctttagaaat

SEQ ID NO: 34707 - DNA, 25 bp, Homo sapien
aatgttaagctatttggctttattt

SEQ ID NO: 34708 - DNA, 25 bp, Homo sapien
ggctttattttcacactgacagctg

SEQ ID NO: 34709 - DNA, 25 bp, Homo sapien
cactgacagctggtttgtggtgggt

SEQ ID NO: 34710 - DNA, 25 bp, Homo sapien
tgtggtgggtgtgttatggtttatt

SEQ ID NO: 34711 - DNA, 25 bp, Homo sapien
gtgggtgtgttatggtttattatta

SEQ ID NO: 34712 - DNA, 25 bp, Homo sapien
ggcacatgccacggattaacatcgc

SEQ ID NO: 34713 - DNA, 25 bp, Homo sapien
atgccacggattaacatcgctaatt

SEQ ID NO: 34714 - DNA, 25 bp, Homo sapien
ggattaacatcgctaattttgtatt

SEQ ID NO: 34715 - DNA, 25 bp, Homo sapien
tgatcactgggacctggttccagcc

SEQ ID NO: 34716 - DNA, 25 bp, Homo sapien
gttccagccgtttgcaggggaggcg

SEQ ID NO: 34717 - DNA, 25 bp, Homo sapien
gacgcacacgggcgagaagcgcttc

SEQ ID NO: 34718 - DNA, 25 bp, Homo sapien
cttctgccatccaggggtgtagtga

SEQ ID NO: 34719 - DNA, 25 bp, Homo sapien
gtgtagtgaggacccacggggagcc

SEQ ID NO: 34720 - DNA, 25 bp, Homo sapien
ttccagccgtgggcaaaccctgaag

SEQ ID NO: 34721 - DNA, 25 bp, Homo sapien
tgcccccctccagagagtgaggagg

SEQ ID NO: 34722 - DNA, 25 bp, Homo sapien
tgaggagggggcctgagactggacc

SEQ ID NO: 34723 - DNA, 25 bp, Homo sapien
gcctgacctcagagtgtccaggggc

SEQ ID NO: 34724 - DNA, 25 bp, Homo sapien
caggggcttggagagacctgcgccc

SEQ ID NO: 34725 - DNA, 25 bp, Homo sapien
tctcccaggagtcgctgatcactgg

SEQ ID NO: 34726 - DNA, 25 bp, Homo sapien
gtggagagcaagctccacgaccacg

SEQ ID NO: 34727 - DNA, 25 bp, Homo sapien
gcagggactcagctgaaggactggg

SEQ ID NO: 34728 - DNA, 25 bp, Homo sapien
ggagaaggaccagagcacgtgccac

SEQ ID NO: 34729 - DNA, 25 bp, Homo sapien
cttccacctcctagggtgaaaccag

SEQ ID NO: 34730 - DNA, 25 bp, Homo sapien
tccacctcctagggtgaaaccagga

SEQ ID NO: 34731 - DNA, 25 bp, Homo sapien
agggtgaaaccaggagagattgctt

SEQ ID NO: 34732 - DNA, 25 bp, Homo sapien
aggagagattgcttgcttcacttgt

SEQ ID NO: 34733 - DNA, 25 bp, Homo sapien
gagagattgcttgcttcacttgtac

SEQ ID NO: 34734 - DNA, 25 bp, Homo sapien
agagattgcttgcttcacttgtaca

SEQ ID NO: 34735 - DNA, 25 bp, Homo sapien
gagattgcttgcttcacttgtacaa

SEQ ID NO: 34736 - DNA, 25 bp, Homo sapien
agattgcttgcttcacttgtacaag

SEQ ID NO: 34737 - DNA, 25 bp, Homo sapien
agctccaggaacgagaccgactgtt

SEQ ID NO: 34738 - DNA, 25 bp, Homo sapien
accgactgttccactcattagagaa

SEQ ID NO: 34739 - DNA, 25 bp, Homo sapien
gttagtgcctggtacaatatgggaa

SEQ ID NO: 34740 - DNA, 25 bp, Homo sapien
ggcagctgaagatagactggcaagc

SEQ ID NO: 34741 - DNA, 25 bp, Homo sapien
ggcagtcatttctggcgaggcagag

SEQ ID NO: 34742 - DNA, 25 bp, Homo sapien
tggcgaggcagaggcaagcgaccag

SEQ ID NO: 34743 - DNA, 25 bp, Homo sapien
gcagcagaagatcatacccaggcca

SEQ ID NO: 34744 - DNA, 25 bp, Homo sapien
cagccggccacagcaaggtagagaa

SEQ ID NO: 34745 - DNA, 25 bp, Homo sapien
agttgtgccgctcaatcacagacac

SEQ ID NO: 34746 - DNA, 25 bp, Homo sapien
atacttagtgtttctcattttgagg

SEQ ID NO: 34747 - DNA, 25 bp, Homo sapien
gtatgaaaatgtcctcttcttcaaa

SEQ ID NO: 34748 - DNA, 25 bp, Homo sapien
gaagcagtagggacttgcacaaagc

SEQ ID NO: 34749 - DNA, 25 bp, Homo sapien
tggagggagggtgtccattagcccc

SEQ ID NO: 34750 - DNA, 25 bp, Homo sapien
gtccattagccccaaggagacacag

SEQ ID NO: 34751 - DNA, 25 bp, Homo sapien
ggagacacaggatctgggctctgtc

SEQ ID NO: 34752 - DNA, 25 bp, Homo sapien
catgctggaccagatcaactcctgt

SEQ ID NO: 34753 - DNA, 25 bp, Homo sapien
cctgtctggaccacctggaggagaa

SEQ ID NO: 34754 - DNA, 25 bp, Homo sapien
ctgctggagtccaaccggcagacac

SEQ ID NO: 34755 - DNA, 25 bp, Homo sapien
cacgcctggagttccagcagcagct

SEQ ID NO: 34756 - DNA, 25 bp, Homo sapien
ctggcttagacaccttctcaagggc

SEQ ID NO: 34757 - DNA, 25 bp, Homo sapien
ttctcaagggctggccttcagggac

SEQ ID NO: 34758 - DNA, 25 bp, Homo sapien
gccctcctggggccaagagtgggcc

SEQ ID NO: 34759 - DNA, 25 bp, Homo sapien
gtggaaatagcggctgcttcttttc

SEQ ID NO: 34760 - DNA, 25 bp, Homo sapien
acgtcgtgatccagaagtccagagc

SEQ ID NO: 34761 - DNA, 25 bp, Homo sapien
tgaggactgcctgtttgcagggccc

SEQ ID NO: 34762 - DNA, 25 bp, Homo sapien
cgcctggcaggacgactgagcaagt

SEQ ID NO: 34763 - DNA, 25 bp, Homo sapien
ggacacctgcgcgttaggagattct

SEQ ID NO: 34764 - DNA, 25 bp, Homo sapien
acgcctggggtcccaagggaagctg

SEQ ID NO: 34765 - DNA, 25 bp, Homo sapien
ccaaactcgaggacctattgctccc

SEQ ID NO: 34766 - DNA, 25 bp, Homo sapien
ggcgtctgggaaccctgaaatcctt

SEQ ID NO: 34767 - DNA, 25 bp, Homo sapien
gtagatcatcatgaccctctgtgtt

SEQ ID NO: 34768 - DNA, 25 bp, Homo sapien
ccctctgtgttccttttggcaaatg

SEQ ID NO: 34769 - DNA, 25 bp, Homo sapien
gacttgcttccattgtttgtttgtt

SEQ ID NO: 34770 - DNA, 25 bp, Homo sapien
ctgtctacctctttctacacagaca

SEQ ID NO: 34771 - DNA, 25 bp, Homo sapien
tttctacacagacatggcaaccatc

SEQ ID NO: 34772 - DNA, 25 bp, Homo sapien
atggcaaccatccgatttctcaatc

SEQ ID NO: 34773 - DNA, 25 bp, Homo sapien
accatccgatttctcaatcttttcc

SEQ ID NO: 34774 - DNA, 25 bp, Homo sapien
tttctattccacaaaaccgccattg

SEQ ID NO: 34775 - DNA, 25 bp, Homo sapien
aaccgccattgtcatcatggcccgt

SEQ ID NO: 34776 - DNA, 25 bp, Homo sapien
atggcccgttctcaatgagctgttg

SEQ ID NO: 34777 - DNA, 25 bp, Homo sapien
aatgagctgttggctatacctccca

SEQ ID NO: 34778 - DNA, 25 bp, Homo sapien
gctatacctcccaaacggggtggtg

SEQ ID NO: 34779 - DNA, 25 bp, Homo sapien
ttaggcgcggccgggcagaagcgcc

SEQ ID NO: 34780 - DNA, 25 bp, Homo sapien
cagtaggggcggccgggcaaaagcg

SEQ ID NO: 34781 - DNA, 25 bp, Homo sapien
aattcacttattttcatgggttctg

SEQ ID NO: 34782 - DNA, 25 bp, Homo sapien
gacctaaaaatctcaatggcaccta

SEQ ID NO: 34783 - DNA, 25 bp, Homo sapien
ctaaaaatctcaatggcacctacca

SEQ ID NO: 34784 - DNA, 25 bp, Homo sapien
ctaacacatagtaggggctctacat

SEQ ID NO: 34785 - DNA, 25 bp, Homo sapien
gtaggggctctacatgattatctgt

SEQ ID NO: 34786 - DNA, 25 bp, Homo sapien
ggctctacatgattatctgtaattg

SEQ ID NO: 34787 - DNA, 25 bp, Homo sapien
ggaggtgatggttttcctatttgat

SEQ ID NO: 34788 - DNA, 25 bp, Homo sapien
gcaacatagttctaagccagtggtt

SEQ ID NO: 34789 - DNA, 25 bp, Homo sapien
tggttctccaacttgagtatgcatc

SEQ ID NO: 34790 - DNA, 25 bp, Homo sapien
tctccaacttgagtatgcatcagaa

SEQ ID NO: 34791 - DNA, 25 bp, Homo sapien
aaaatacagatgtctgccgggcgcg

SEQ ID NO: 34792 - DNA, 25 bp, Homo sapien
acagctctgcctggacttggagaga

SEQ ID NO: 34793 - DNA, 25 bp, Homo sapien
ggagagatgggaggcagacccccac

SEQ ID NO: 34794 - DNA, 25 bp, Homo sapien
ccaccatacatgctgtctgtggccc

SEQ ID NO: 34795 - DNA, 25 bp, Homo sapien
cctcagacattctgtttcatctccc

SEQ ID NO: 34796 - DNA, 25 bp, Homo sapien
accgtccgtgttctcaggagtggtt

SEQ ID NO: 34797 - DNA, 25 bp, Homo sapien
ggagtggttgaggacacagggcccc

SEQ ID NO: 34798 - DNA, 25 bp, Homo sapien
ctcactccttcccagaagtttttgc

SEQ ID NO: 34799 - DNA, 25 bp, Homo sapien
gtttttgcacagaacttcattttga

SEQ ID NO: 34800 - DNA, 25 bp, Homo sapien
gaaagtgtttttctcattctccata

SEQ ID NO: 34801 - DNA, 25 bp, Homo sapien
tgagcgtctcctgggccagagagag

SEQ ID NO: 34802 - DNA, 25 bp, Homo sapien
gggggtgggagggactgagttgatg

SEQ ID NO: 34803 - DNA, 25 bp, Homo sapien
acatctatttcttcattcattcttc

SEQ ID NO: 34804 - DNA, 25 bp, Homo sapien
cccactgagtgcctatttggatact

SEQ ID NO: 34805 - DNA, 25 bp, Homo sapien
caaacccccatggcatgagtttata

SEQ ID NO: 34806 - DNA, 25 bp, Homo sapien
tgcacaagtctaagctacttccttg

SEQ ID NO: 34807 - DNA, 25 bp, Homo sapien
gaaaagactcgagctgagatctcaa

SEQ ID NO: 34808 - DNA, 25 bp, Homo sapien
gaagttgcaggggtaaagaggccaa

SEQ ID NO: 34809 - DNA, 25 bp, Homo sapien
gaggccaaagaagagtgtctcagat

SEQ ID NO: 34810 - DNA, 25 bp, Homo sapien
tgtctcagatgagagcggcacgtgc

SEQ ID NO: 34811 - DNA, 25 bp, Homo sapien
gggaggagcctggtagctctgagaa

SEQ ID NO: 34812 - DNA, 25 bp, Homo sapien
aaaggcacggtggtggctggaatgc

SEQ ID NO: 34813 - DNA, 25 bp, Homo sapien
gtgggggcacattgaaaaccttgtt

SEQ ID NO: 34814 - DNA, 25 bp, Homo sapien
gaattggacttcctggattaccggg

SEQ ID NO: 34815 - DNA, 25 bp, Homo sapien
tggacttcctggattaccgggagcc

SEQ ID NO: 34816 - DNA, 25 bp, Homo sapien
ggattaccgggagccaatggaatga

SEQ ID NO: 34817 - DNA, 25 bp, Homo sapien
tccacagggtccttctatcataggc

SEQ ID NO: 34818 - DNA, 25 bp, Homo sapien
cacagggtccttctatcataggccc

SEQ ID NO: 34819 - DNA, 25 bp, Homo sapien
aagggtacagatggtcctatgggac

SEQ ID NO: 34820 - DNA, 25 bp, Homo sapien
acagatggtcctatgggaccccatg

SEQ ID NO: 34821 - DNA, 25 bp, Homo sapien
ggagctatgggagagcctggaccaa

SEQ ID NO: 34822 - DNA, 25 bp, Homo sapien
ccaagagggccctatgggctgcctg

SEQ ID NO: 34823 - DNA, 25 bp, Homo sapien
tatgggctgcctgggaaagatggag

SEQ ID NO: 34824 - DNA, 25 bp, Homo sapien
gagagcctggtcttgatggcttccc

SEQ ID NO: 34825 - DNA, 25 bp, Homo sapien
agcatggacgacctgatacgccact

SEQ ID NO: 34826 - DNA, 25 bp, Homo sapien
acctgatacgccactgtaacgggaa

SEQ ID NO: 34827 - DNA, 25 bp, Homo sapien
acgccactgtaacgggaagctgggc

SEQ ID NO: 34828 - DNA, 25 bp, Homo sapien
gattcggtcggtaaagacgtcttct

SEQ ID NO: 34829 - DNA, 25 bp, Homo sapien
gtcggtaaagacgtcttctagagcc

SEQ ID NO: 34830 - DNA, 25 bp, Homo sapien
acttcacctacaatattgttaacta

SEQ ID NO: 34831 - DNA, 25 bp, Homo sapien
agctgggcagctacaaaatcaatgg

SEQ ID NO: 34832 - DNA, 25 bp, Homo sapien
gctacaaaatcaatggccggacgaa

SEQ ID NO: 34833 - DNA, 25 bp, Homo sapien
ggccggacgaaagccatggttgctt

SEQ ID NO: 34834 - DNA, 25 bp, Homo sapien
gccatggttgcttgttatccgggca

SEQ ID NO: 34835 - DNA, 25 bp, Homo sapien
ggttgcttgttatccgggcaatgga

SEQ ID NO: 34836 - DNA, 25 bp, Homo sapien
catggaacatgcttaatctaaacaa

SEQ ID NO: 34837 - DNA, 25 bp, Homo sapien
cagacccaggtgtaaggtacatgga

SEQ ID NO: 34838 - DNA, 25 bp, Homo sapien
ggccaaggcagagatccatgcctgc

SEQ ID NO: 34839 - DNA, 25 bp, Homo sapien
agagatccatgcctgcatgactcag

SEQ ID NO: 34840 - DNA, 25 bp, Homo sapien
actcagtgggtttggtgcacaggca

SEQ ID NO: 34841 - DNA, 25 bp, Homo sapien
ggtttggtgcacaggcacacacctc

SEQ ID NO: 34842 - DNA, 25 bp, Homo sapien
ttcatacttggtctgagccactgtt

SEQ ID NO: 34843 - DNA, 25 bp, Homo sapien
ttggtctgagccactgttgtctgta

SEQ ID NO: 34844 - DNA, 25 bp, Homo sapien
aaggtaattgtcctgctaatgctgt

SEQ ID NO: 34845 - DNA, 25 bp, Homo sapien
gctaatgctgtacaggggctcttgg

SEQ ID NO: 34846 - DNA, 25 bp, Homo sapien
tgggcacactggcgcccagtaagag

SEQ ID NO: 34847 - DNA, 25 bp, Homo sapien
gagaagctgaattggtgttcactaa

SEQ ID NO: 34848 - DNA, 25 bp, Homo sapien
acaagcacaggagctttgttatatt

SEQ ID NO: 34849 - DNA, 25 bp, Homo sapien
ggcaaaacctgaagggtgtgttcgt

SEQ ID NO: 34850 - DNA, 25 bp, Homo sapien
aagggtgtgttcgtggggtgatgag

SEQ ID NO: 34851 - DNA, 25 bp, Homo sapien
gttcagtcacctgtgatctgtgcat

SEQ ID NO: 34852 - DNA, 25 bp, Homo sapien
gtcacctgtgatctgtgcatctggc

SEQ ID NO: 34853 - DNA, 25 bp, Homo sapien
tgatctgtgcatctggccagcactg

SEQ ID NO: 34854 - DNA, 25 bp, Homo sapien
gcattcaggagttagtgggtcacgt

SEQ ID NO: 34855 - DNA, 25 bp, Homo sapien
gtgggtcacgtttgacaagggccaa

SEQ ID NO: 34856 - DNA, 25 bp, Homo sapien
aagaacattgtcatattttctacct

SEQ ID NO: 34857 - DNA, 25 bp, Homo sapien
atatcaatgattttagcttatgtta

SEQ ID NO: 34858 - DNA, 25 bp, Homo sapien
gcactacagccaccgtgacggtgcc

SEQ ID NO: 34859 - DNA, 25 bp, Homo sapien
cactacagccaccgtgacggtgccc

SEQ ID NO: 34860 - DNA, 25 bp, Homo sapien
gcccttccagcactgagaagcacag

SEQ ID NO: 34861 - DNA, 25 bp, Homo sapien
cccttccagcactgagaagcacagc

SEQ ID NO: 34862 - DNA, 25 bp, Homo sapien
ccttccagcactgagaagcacagcc

SEQ ID NO: 34863 - DNA, 25 bp, Homo sapien
ttccagcactgagaagcacagccac

SEQ ID NO: 34864 - DNA, 25 bp, Homo sapien
tccagcactgagaagcacagccacc

SEQ ID NO: 34865 - DNA, 25 bp, Homo sapien
aggaacagctcacactaccaaagtg

SEQ ID NO: 34866 - DNA, 25 bp, Homo sapien
ggaacagctcacactaccaaagtgc

SEQ ID NO: 34867 - DNA, 25 bp, Homo sapien
tccagtgtggatcagcacaaccacc

SEQ ID NO: 34868 - DNA, 25 bp, Homo sapien
cagtgtggatcagcacaaccaccac

SEQ ID NO: 34869 - DNA, 25 bp, Homo sapien
tattgaaactgcacctgtaatccca

SEQ ID NO: 34870 - DNA, 25 bp, Homo sapien
ggaggctgaggacagaggattgctt

SEQ ID NO: 34871 - DNA, 25 bp, Homo sapien
tgggcagcaaagtgagaccccatct

SEQ ID NO: 34872 - DNA, 25 bp, Homo sapien
taaaactgttctctagaagctttgg

SEQ ID NO: 34873 - DNA, 25 bp, Homo sapien
aaaagtccttttagcttctagcaca

SEQ ID NO: 34874 - DNA, 25 bp, Homo sapien
gcttctagcacatatttgtacaaag

SEQ ID NO: 34875 - DNA, 25 bp, Homo sapien
aaatgtttactgacgaggccgggcg

SEQ ID NO: 34876 - DNA, 25 bp, Homo sapien
ttggagggccgaggcaggcagatca

SEQ ID NO: 34877 - DNA, 25 bp, Homo sapien
aagatcagcctggccagtatggtga

SEQ ID NO: 34878 - DNA, 25 bp, Homo sapien
agccatgcgaagtagcaggtgcctg

SEQ ID NO: 34879 - DNA, 25 bp, Homo sapien
gaagtagcaggtgcctgtagttcca

SEQ ID NO: 34880 - DNA, 25 bp, Homo sapien
gatcctgaaaggttgtcccaaactg

SEQ ID NO: 34881 - DNA, 25 bp, Homo sapien
gagcaatcagatacctactgaggtc

SEQ ID NO: 34882 - DNA, 25 bp, Homo sapien
ttctgcttggcatggcatcctaagg

SEQ ID NO: 34883 - DNA, 25 bp, Homo sapien
gatgacctcatgttcattgttcctg

SEQ ID NO: 34884 - DNA, 25 bp, Homo sapien
tgttcattgttcctggttttttcca

SEQ ID NO: 34885 - DNA, 25 bp, Homo sapien
gcctctacactccatcataggacat

SEQ ID NO: 34886 - DNA, 25 bp, Homo sapien
atcataggacatcgagtccctcctc

SEQ ID NO: 34887 - DNA, 25 bp, Homo sapien
ggcaaatctgagtggcttctctaag

SEQ ID NO: 34888 - DNA, 25 bp, Homo sapien
cttctctaagcatctgctggtacaa

SEQ ID NO: 34889 - DNA, 25 bp, Homo sapien
ggtacaagtcaatgtggcaccatga

SEQ ID NO: 34890 - DNA, 25 bp, Homo sapien
acccccatgcaagacacttatgaga

SEQ ID NO: 34891 - DNA, 25 bp, Homo sapien
aaagcagtggctccactagtgcgtt

SEQ ID NO: 34892 - DNA, 25 bp, Homo sapien
gctccactagtgcgttatctgaaat

SEQ ID NO: 34893 - DNA, 25 bp, Homo sapien
aaatcaaatgacaccaacgtgcatc

SEQ ID NO: 34894 - DNA, 25 bp, Homo sapien
ccaactctcagaagacgccgataac

SEQ ID NO: 34895 - DNA, 25 bp, Homo sapien
ataactgcatcaccatgcatgagaa

SEQ ID NO: 34896 - DNA, 25 bp, Homo sapien
ctggatatggttgggtcccctgacc

SEQ ID NO: 34897 - DNA, 25 bp, Homo sapien
ggaagctgcagctggttgtatatcc

SEQ ID NO: 34898 - DNA, 25 bp, Homo sapien
gtatatccaatatccgcaggctggc

SEQ ID NO: 34899 - DNA, 25 bp, Homo sapien
aggctggctcttgctacagagaagg

SEQ ID NO: 34900 - DNA, 25 bp, Homo sapien
tgacacaggacatgtcactcccatg

SEQ ID NO: 34901 - DNA, 25 bp, Homo sapien
aaattgcatggagacttttgtttct

SEQ ID NO: 34902 - DNA, 25 bp, Homo sapien
gagagaccaaggaaggaagcgagtg

SEQ ID NO: 34903 - DNA, 25 bp, Homo sapien
ggaagcgagtgtgaaaggctgtcca

SEQ ID NO: 34904 - DNA, 25 bp, Homo sapien
aaggctgtccaaggctttaggccag

SEQ ID NO: 34905 - DNA, 25 bp, Homo sapien
ctgtccaaggctttaggccagaagc

SEQ ID NO: 34906 - DNA, 25 bp, Homo sapien
gaagcctaaagctggtactccaacc

SEQ ID NO: 34907 - DNA, 25 bp, Homo sapien
gcctaaagctggtactccaacctgc

SEQ ID NO: 34908 - DNA, 25 bp, Homo sapien
aaagctggtactccaacctgcttta

SEQ ID NO: 34909 - DNA, 25 bp, Homo sapien
ttattcattctagaaaatcttccaa

SEQ ID NO: 34910 - DNA, 25 bp, Homo sapien
aatcttccaagacatcttaaactga

SEQ ID NO: 34911 - DNA, 25 bp, Homo sapien
ccaagacatcttaaactgacattta

SEQ ID NO: 34912 - DNA, 25 bp, Homo sapien
ctgacatttaagaattggaggtttt

SEQ ID NO: 34913 - DNA, 25 bp, Homo sapien
gacctggcactgggaggcagggctc

SEQ ID NO: 34914 - DNA, 25 bp, Homo sapien
gcaattcagacccctctgagagacg

SEQ ID NO: 34915 - DNA, 25 bp, Homo sapien
ccactccctgggacacagacccagg

SEQ ID NO: 34916 - DNA, 25 bp, Homo sapien
ggacccccgaggggagggcaggatg

SEQ ID NO: 34917 - DNA, 25 bp, Homo sapien
tcctctggctttcccaggagatggg

SEQ ID NO: 34918 - DNA, 25 bp, Homo sapien
aggagatgggtccagggtctgtctg

SEQ ID NO: 34919 - DNA, 25 bp, Homo sapien
tctgctttggttaagggctccctaa

SEQ ID NO: 34920 - DNA, 25 bp, Homo sapien
ccaagggttgagagccagtggcggg

SEQ ID NO: 34921 - DNA, 25 bp, Homo sapien
gaccactcttctttaagccatagac

SEQ ID NO: 34922 - DNA, 25 bp, Homo sapien
gaagcggagggttgacaccaccgtg

SEQ ID NO: 34923 - DNA, 25 bp, Homo sapien
ttgacaccaccgtgaaccagagggt

SEQ ID NO: 34924 - DNA, 25 bp, Homo sapien
aaaatcacagtttatccctgcacct

SEQ ID NO: 34925 - DNA, 25 bp, Homo sapien
ccctgcaccttcatagattatgttg

SEQ ID NO: 34926 - DNA, 25 bp, Homo sapien
gattatgttgctcgtcttagagacc

SEQ ID NO: 34927 - DNA, 25 bp, Homo sapien
gttgctcgtcttagagaccaccagg

SEQ ID NO: 34928 - DNA, 25 bp, Homo sapien
gtcttagagaccaccaggcagcgaa

SEQ ID NO: 34929 - DNA, 25 bp, Homo sapien
gagaccaccaggcagcgaatggagt

SEQ ID NO: 34930 - DNA, 25 bp, Homo sapien
cagcgaatggagtcaagcccttgcg

SEQ ID NO: 34931 - DNA, 25 bp, Homo sapien
gagtcctgccctgactacaggacta

SEQ ID NO: 34932 - DNA, 25 bp, Homo sapien
tacaggactagtttctcccattctt

SEQ ID NO: 34933 - DNA, 25 bp, Homo sapien
tctttccttctccaggataaagttc

SEQ ID NO: 34934 - DNA, 25 bp, Homo sapien
tccttctccaggataaagttcctca

SEQ ID NO: 34935 - DNA, 25 bp, Homo sapien
tatgcagctcatgctgtgaaatcca

SEQ ID NO: 34936 - DNA, 25 bp, Homo sapien
aagagctccaagctaatgcctgcac

SEQ ID NO: 34937 - DNA, 25 bp, Homo sapien
atggcttggatatctgatgttttca

SEQ ID NO: 34938 - DNA, 25 bp, Homo sapien
gctgctgtcaagtgttaaaacccgg

SEQ ID NO: 34939 - DNA, 25 bp, Homo sapien
ggtggttctttattcattactacaa

SEQ ID NO: 34940 - DNA, 25 bp, Homo sapien
aaaacacaactttcctatgccttgg

SEQ ID NO: 34941 - DNA, 25 bp, Homo sapien
ttcacctgaaacactagagagcatt

SEQ ID NO: 34942 - DNA, 25 bp, Homo sapien
ggaatcaaatggtctgtcagttcaa

SEQ ID NO: 34943 - DNA, 25 bp, Homo sapien
gtggtaggaatgctctataacccct

SEQ ID NO: 34944 - DNA, 25 bp, Homo sapien
ccccttctcaggttactggcattgg

SEQ ID NO: 34945 - DNA, 25 bp, Homo sapien
ataccagccttaactatgcagctca

SEQ ID NO: 34946 - DNA, 25 bp, Homo sapien
ttctcttaccgccatggagttcgac

SEQ ID NO: 34947 - DNA, 25 bp, Homo sapien
ccatggagttcgacctgggagcagc

SEQ ID NO: 34948 - DNA, 25 bp, Homo sapien
ctcccagaagcccggtgtgggggcg

SEQ ID NO: 34949 - DNA, 25 bp, Homo sapien
tcccagaagcccggtgtgggggcgg

SEQ ID NO: 34950 - DNA, 25 bp, Homo sapien
tccagcgattcggacacggatgtga

SEQ ID NO: 34951 - DNA, 25 bp, Homo sapien
ccagcgattcggacacggatgtgaa

SEQ ID NO: 34952 - DNA, 25 bp, Homo sapien
gcgattcggacacggatgtgaagtc

SEQ ID NO: 34953 - DNA, 25 bp, Homo sapien
cggacacggatgtgaagtcccacgc

SEQ ID NO: 34954 - DNA, 25 bp, Homo sapien
ggacacggatgtgaagtcccacgct

SEQ ID NO: 34955 - DNA, 25 bp, Homo sapien
tggctccaagcagcacgagagcatc

SEQ ID NO: 34956 - DNA, 25 bp, Homo sapien
gctccaagcagcacgagagcatccc

SEQ ID NO: 34957 - DNA, 25 bp, Homo sapien
gagtacactgcagccgagaacaaga

SEQ ID NO: 34958 - DNA, 25 bp, Homo sapien
cactgcagccgagaacaagagcccc

SEQ ID NO: 34959 - DNA, 25 bp, Homo sapien
ggaactctttgtcccacaggagagc

SEQ ID NO: 34960 - DNA, 25 bp, Homo sapien
aactctttgtcccacaggagagcag

SEQ ID NO: 34961 - DNA, 25 bp, Homo sapien
tctttgtcccacaggagagcagcgg

SEQ ID NO: 34962 - DNA, 25 bp, Homo sapien
ttgtcccacaggagagcagcggatc

SEQ ID NO: 34963 - DNA, 25 bp, Homo sapien
agcggatccacgccagagaagatgc

SEQ ID NO: 34964 - DNA, 25 bp, Homo sapien
gcggatccacgccagagaagatgct

SEQ ID NO: 34965 - DNA, 25 bp, Homo sapien
ggatccacgccagagaagatgcttg

SEQ ID NO: 34966 - DNA, 25 bp, Homo sapien
tcgctctggccaaatgccttcaaaa

SEQ ID NO: 34967 - DNA, 25 bp, Homo sapien
cgctctggccaaatgccttcaaaaa

SEQ ID NO: 34968 - DNA, 25 bp, Homo sapien
tttagtggtgacggggtttgctctg

SEQ ID NO: 34969 - DNA, 25 bp, Homo sapien
gttagccattttatacgtgtttact

SEQ ID NO: 34970 - DNA, 25 bp, Homo sapien
acgtgtttactgaacacctgtcctg

SEQ ID NO: 34971 - DNA, 25 bp, Homo sapien
tgtcctgtgcccatattctaagtgc

SEQ ID NO: 34972 - DNA, 25 bp, Homo sapien
tgtgcccatattctaagtgccttac

SEQ ID NO: 34973 - DNA, 25 bp, Homo sapien
atattctaagtgccttacctgcatt

SEQ ID NO: 34974 - DNA, 25 bp, Homo sapien
gtgccttacctgcattaaactcatg

SEQ ID NO: 34975 - DNA, 25 bp, Homo sapien
ctgcattaaactcatgtaaccttca

SEQ ID NO: 34976 - DNA, 25 bp, Homo sapien
gcacccaataccccttatagtgagt

SEQ ID NO: 34977 - DNA, 25 bp, Homo sapien
tagtgagtttattacgggccctact

SEQ ID NO: 34978 - DNA, 25 bp, Homo sapien
ttattacgggccctactggccgttg

SEQ ID NO: 34979 - DNA, 25 bp, Homo sapien
tgtagatgctttgctgacttgttca

SEQ ID NO: 34980 - DNA, 25 bp, Homo sapien
gacttgttcagctctgtaaaaacac

SEQ ID NO: 34981 - DNA, 25 bp, Homo sapien
tggaacatgtcctgtatatatcaca

SEQ ID NO: 34982 - DNA, 25 bp, Homo sapien
gatgggattagtctgatcgcttaat

SEQ ID NO: 34983 - DNA, 25 bp, Homo sapien
atcgcttaatatgcacaatcctgga

SEQ ID NO: 34984 - DNA, 25 bp, Homo sapien
atgcttacattacatgcacgcggat

SEQ ID NO: 34985 - DNA, 25 bp, Homo sapien
catgcacgcggatttcatgctccat

SEQ ID NO: 34986 - DNA, 25 bp, Homo sapien
ttcatgctccataatcttttctatt

SEQ ID NO: 34987 - DNA, 25 bp, Homo sapien
tacctttctgtaaatgatgtgcatg

SEQ ID NO: 34988 - DNA, 25 bp, Homo sapien
aatgctgttcataatttgactacgt

SEQ ID NO: 34989 - DNA, 25 bp, Homo sapien
aagtgcctatatggtggtaatgcta

SEQ ID NO: 34990 - DNA, 25 bp, Homo sapien
gcttagagggcaacattggaaggtt

SEQ ID NO: 34991 - DNA, 25 bp, Homo sapien
atcaccgatttaaagattgcaatat

SEQ ID NO: 34992 - DNA, 25 bp, Homo sapien
ggattaaatctgataggttttccag

SEQ ID NO: 34993 - DNA, 25 bp, Homo sapien
gaacaaaaatcagctctaaaaccaa

SEQ ID NO: 34994 - DNA, 25 bp, Homo sapien
aatgtaaatcagccctatccatact

SEQ ID NO: 34995 - DNA, 25 bp, Homo sapien
gccctatccatactatagtttctct

SEQ ID NO: 34996 - DNA, 25 bp, Homo sapien
gtaactgctatcttaatgttctgaa

SEQ ID NO: 34997 - DNA, 25 bp, Homo sapien
aaatgccaattccagtccaaagctt

SEQ ID NO: 34998 - DNA, 25 bp, Homo sapien
tccagtccaaagctttatttgccaa

SEQ ID NO: 34999 - DNA, 25 bp, Homo sapien
gctttatttgccaagttttcttaga

SEQ ID NO: 35000 - DNA, 25 bp, Homo sapien
aagacttttgcctaaagtggcatta

SEQ ID NO: 35001 - DNA, 25 bp, Homo sapien
tttttaaactggaagaggatgcaca

SEQ ID NO: 35002 - DNA, 25 bp, Homo sapien
tggaagaggatgcacaggggaagaa

SEQ ID NO: 35003 - DNA, 25 bp, Homo sapien
ggaagaggatgcacaggggaagaaa

SEQ ID NO: 35004 - DNA, 25 bp, Homo sapien
gaggatgcacaggggaagaaattga

SEQ ID NO: 35005 - DNA, 25 bp, Homo sapien
tttgttggcttttgtttacctggcg

SEQ ID NO: 35006 - DNA, 25 bp, Homo sapien
ttgttggcttttgtttacctggcgt

SEQ ID NO: 35007 - DNA, 25 bp, Homo sapien
cttttgtttacctggcgtgtgtggc

SEQ ID NO: 35008 - DNA, 25 bp, Homo sapien
ttttgtttacctggcgtgtgtggca

SEQ ID NO: 35009 - DNA, 25 bp, Homo sapien
tttgtttacctggcgtgtgtggcag

SEQ ID NO: 35010 - DNA, 25 bp, Homo sapien
ttgtttacctggcgtgtgtggcagc

SEQ ID NO: 35011 - DNA, 25 bp, Homo sapien
tgtttacctggcgtgtgtggcagcc

SEQ ID NO: 35012 - DNA, 25 bp, Homo sapien
tccggacggtgtaccagctcaacgg

SEQ ID NO: 35013 - DNA, 25 bp, Homo sapien
atttcttggtctgtctatgagttct

SEQ ID NO: 35014 - DNA, 25 bp, Homo sapien
ggtctgtctatgagttcttcaagta

SEQ ID NO: 35015 - DNA, 25 bp, Homo sapien
agttcttcaagtactttctcaccaa

SEQ ID NO: 35016 - DNA, 25 bp, Homo sapien
ttctcaccaagcgccagctggaaaa

SEQ ID NO: 35017 - DNA, 25 bp, Homo sapien
gcgccagctggaaaatcgagctcca

SEQ ID NO: 35018 - DNA, 25 bp, Homo sapien
aatcgagctccatactaaaggaagg

SEQ ID NO: 35019 - DNA, 25 bp, Homo sapien
aggaagggatcatagaatcttttct

SEQ ID NO: 35020 - DNA, 25 bp, Homo sapien
gaatcttttcttaaagtcattctct

SEQ ID NO: 35021 - DNA, 25 bp, Homo sapien
cgtctgtaagacccttctgaacact

SEQ ID NO: 35022 - DNA, 25 bp, Homo sapien
tctgaacactcaggagaacgtggcc

SEQ ID NO: 35023 - DNA, 25 bp, Homo sapien
tattgcatactacacagaagcttca

SEQ ID NO: 35024 - DNA, 25 bp, Homo sapien
gagcactagagggaggtttatcacc

SEQ ID NO: 35025 - DNA, 25 bp, Homo sapien
ttgttattactcagtgactctctaa

SEQ ID NO: 35026 - DNA, 25 bp, Homo sapien
agtgactctctaatttcacatcagc

SEQ ID NO: 35027 - DNA, 25 bp, Homo sapien
atttcacatcagcatgttcagcttg

SEQ ID NO: 35028 - DNA, 25 bp, Homo sapien
gcatgttcagcttgtgctagtcatc

SEQ ID NO: 35029 - DNA, 25 bp, Homo sapien
gtgctagtcatcattctgatttgct

SEQ ID NO: 35030 - DNA, 25 bp, Homo sapien
gatttgcttatctgtttttggtcaa

SEQ ID NO: 35031 - DNA, 25 bp, Homo sapien
gactatttagttcaattgttcatcc

SEQ ID NO: 35032 - DNA, 25 bp, Homo sapien
atttgcttttataattgcctccttg

SEQ ID NO: 35033 - DNA, 25 bp, Homo sapien
aaacggctttgcctagccaaggatt

SEQ ID NO: 35034 - DNA, 25 bp, Homo sapien
agcggcagaacatcgtctggaggaa

SEQ ID NO: 35035 - DNA, 25 bp, Homo sapien
aacatcgtctggaggaatgtcgtcc

SEQ ID NO: 35036 - DNA, 25 bp, Homo sapien
gctctgggtgtgacagctggtgccc

SEQ ID NO: 35037 - DNA, 25 bp, Homo sapien
tctgggtgtgacagctggtgcccat

SEQ ID NO: 35038 - DNA, 25 bp, Homo sapien
gcccatcgcttgtggagccacaggt

SEQ ID NO: 35039 - DNA, 25 bp, Homo sapien
catcgcttgtggagccacaggtcct

SEQ ID NO: 35040 - DNA, 25 bp, Homo sapien
cgcttgtggagccacaggtcctacc

SEQ ID NO: 35041 - DNA, 25 bp, Homo sapien
caagctgcctctgaggatatttctg

SEQ ID NO: 35042 - DNA, 25 bp, Homo sapien
gctgcctctgaggatatttctggct

SEQ ID NO: 35043 - DNA, 25 bp, Homo sapien
cctctgaggatatttctggctgtcg

SEQ ID NO: 35044 - DNA, 25 bp, Homo sapien
tctgaggatatttctggctgtcgcc

SEQ ID NO: 35045 - DNA, 25 bp, Homo sapien
ataacttaatctcttcatgttcagt

SEQ ID NO: 35046 - DNA, 25 bp, Homo sapien
cttttctttgattatggtatgctta

SEQ ID NO: 35047 - DNA, 25 bp, Homo sapien
gagaactacaatcaccgaatctact

SEQ ID NO: 35048 - DNA, 25 bp, Homo sapien
aatcaccgaatctactgtattcaat

SEQ ID NO: 35049 - DNA, 25 bp, Homo sapien
ctgagcaggtgtttgtttacccata

SEQ ID NO: 35050 - DNA, 25 bp, Homo sapien
gtttgtttacccatagtgttctgtg

SEQ ID NO: 35051 - DNA, 25 bp, Homo sapien
acccatagtgttctgtgtagttatt

SEQ ID NO: 35052 - DNA, 25 bp, Homo sapien
gtgtagttattgcttagtctgcaga

SEQ ID NO: 35053 - DNA, 25 bp, Homo sapien
tagatgagatgtctgacttgctttc

SEQ ID NO: 35054 - DNA, 25 bp, Homo sapien
ttcacttattaaacatgttcaccat

SEQ ID NO: 35055 - DNA, 25 bp, Homo sapien
cagatattgttcaactagactagga

SEQ ID NO: 35056 - DNA, 25 bp, Homo sapien
tgctgggacagggacctatggcacc

SEQ ID NO: 35057 - DNA, 25 bp, Homo sapien
ggcagcttaggtttgggttaagttg

SEQ ID NO: 35058 - DNA, 25 bp, Homo sapien
taagttgtggtgaggggccttgccc

SEQ ID NO: 35059 - DNA, 25 bp, Homo sapien
gggtccaacctgacccagtgatctt

SEQ ID NO: 35060 - DNA, 25 bp, Homo sapien
ttctttattgtcctgatttgtcctc

SEQ ID NO: 35061 - DNA, 25 bp, Homo sapien
tgatttgtcctctttgttggttttt

SEQ ID NO: 35062 - DNA, 25 bp, Homo sapien
gaagggcagctgagccaaaggggtc

SEQ ID NO: 35063 - DNA, 25 bp, Homo sapien
gggtcagaaattctgccctttgcct

SEQ ID NO: 35064 - DNA, 25 bp, Homo sapien
cctccaccacatggcattctggttt

SEQ ID NO: 35065 - DNA, 25 bp, Homo sapien
catggcattctggttttggtttctg

SEQ ID NO: 35066 - DNA, 25 bp, Homo sapien
ggtctttctatgctggttgtattta

SEQ ID NO: 35067 - DNA, 25 bp, Homo sapien
tctagagaaaaaacctcccacacct

SEQ ID NO: 35068 - DNA, 25 bp, Homo sapien
atgaatgcaattgttgttgttaact

SEQ ID NO: 35069 - DNA, 25 bp, Homo sapien
gttgttaacttgtttattgcagctt

SEQ ID NO: 35070 - DNA, 25 bp, Homo sapien
tattgcagcttataatggttacaaa

SEQ ID NO: 35071 - DNA, 25 bp, Homo sapien
gcaatagcatcacaaatttcacaaa

SEQ ID NO: 35072 - DNA, 25 bp, Homo sapien
aaagcatttttttcactgcattcta

SEQ ID NO: 35073 - DNA, 25 bp, Homo sapien
ctgcattctagttgtggtttgtcca

SEQ ID NO: 35074 - DNA, 25 bp, Homo sapien
ttctagttgtggtttgtccaaactc

SEQ ID NO: 35075 - DNA, 25 bp, Homo sapien
gtccaaactcatcaatgtatcttat

SEQ ID NO: 35076 - DNA, 25 bp, Homo sapien
gtatcttatcatgtctggatccccg

SEQ ID NO: 35077 - DNA, 25 bp, Homo sapien
cgagctcgaattaattcctcttccg

SEQ ID NO: 35078 - DNA, 25 bp, Homo sapien
gaggctgtctgatttaatctttgca

SEQ ID NO: 35079 - DNA, 25 bp, Homo sapien
ggttcccttcacaaacaggtgaggc

SEQ ID NO: 35080 - DNA, 25 bp, Homo sapien
gcagctttttcaagggcattccaag

SEQ ID NO: 35081 - DNA, 25 bp, Homo sapien
agaccttgttgtacctaaatactat

SEQ ID NO: 35082 - DNA, 25 bp, Homo sapien
agggacctgtcattgaggacgaacc

SEQ ID NO: 35083 - DNA, 25 bp, Homo sapien
gaggacgaaccatcacagcaagagg

SEQ ID NO: 35084 - DNA, 25 bp, Homo sapien
aagaggaattatctcgtgccgcatc

SEQ ID NO: 35085 - DNA, 25 bp, Homo sapien
ccgcatcttcgcataactgacagga

SEQ ID NO: 35086 - DNA, 25 bp, Homo sapien
ggatccctggcaaggatgtctcaat

SEQ ID NO: 35087 - DNA, 25 bp, Homo sapien
gtgaactgcagtatctaccctggac

SEQ ID NO: 35088 - DNA, 25 bp, Homo sapien
taccctggacctaaaagaacttgct

SEQ ID NO: 35089 - DNA, 25 bp, Homo sapien
cacaggcaggctggttcagctgggc

SEQ ID NO: 35090 - DNA, 25 bp, Homo sapien
cttcggtccatctaggttttcagtg

SEQ ID NO: 35091 - DNA, 25 bp, Homo sapien
tcacactgagccaactactgtcact

SEQ ID NO: 35092 - DNA, 25 bp, Homo sapien
gccaactactgtcactgttttaacc

SEQ ID NO: 35093 - DNA, 25 bp, Homo sapien
aaagctagcctggaactgctatggt

SEQ ID NO: 35094 - DNA, 25 bp, Homo sapien
tacagaactctatttgcaagctcct

SEQ ID NO: 35095 - DNA, 25 bp, Homo sapien
gcaagctcctgctttaacctgagcg

SEQ ID NO: 35096 - DNA, 25 bp, Homo sapien
acctgagcgtcctctgctcaggatc

SEQ ID NO: 35097 - DNA, 25 bp, Homo sapien
ccccagcctgcactgagtcaagaag

SEQ ID NO: 35098 - DNA, 25 bp, Homo sapien
tggggttgggactcccctgagaaag

SEQ ID NO: 35099 - DNA, 25 bp, Homo sapien
gggtcggggccacactgagtgtggg

SEQ ID NO: 35100 - DNA, 25 bp, Homo sapien
atattccagactctgagctgtttcc

SEQ ID NO: 35101 - DNA, 25 bp, Homo sapien
tttcatgtatttgagctcctctagt

SEQ ID NO: 35102 - DNA, 25 bp, Homo sapien
tatttgagctcctctagttgctgtc

SEQ ID NO: 35103 - DNA, 25 bp, Homo sapien
tgctgccaacctgtgactcacaaat

SEQ ID NO: 35104 - DNA, 25 bp, Homo sapien
gactaggatctcttgttctttaatt

SEQ ID NO: 35105 - DNA, 25 bp, Homo sapien
tttagggtcttgttccaggactcaa

SEQ ID NO: 35106 - DNA, 25 bp, Homo sapien
gttccaggactcaaatcagtaactt

SEQ ID NO: 35107 - DNA, 25 bp, Homo sapien
ggtgctgaatgtgttggtaaccata

SEQ ID NO: 35108 - DNA, 25 bp, Homo sapien
aaccatatcgcaatacacctcaagg

SEQ ID NO: 35109 - DNA, 25 bp, Homo sapien
tttcttgaattttatatccgtttgt

SEQ ID NO: 35110 - DNA, 25 bp, Homo sapien
atatccgtttgttcactcgtacatg

SEQ ID NO: 35111 - DNA, 25 bp, Homo sapien
ggccctggcattcttgataaacaca

SEQ ID NO: 35112 - DNA, 25 bp, Homo sapien
taaacacattatacattctccctag

SEQ ID NO: 35113 - DNA, 25 bp, Homo sapien
cattatacattctccctagtaaggt

SEQ ID NO: 35114 - DNA, 25 bp, Homo sapien
ttctccctagtaaggtgacatttca

SEQ ID NO: 35115 - DNA, 25 bp, Homo sapien
aacatgcatcatgatcttacccata

SEQ ID NO: 35116 - DNA, 25 bp, Homo sapien
atcatgatcttacccataaacagtc

SEQ ID NO: 35117 - DNA, 25 bp, Homo sapien
cataaacagtcaggtcacaccccga

SEQ ID NO: 35118 - DNA, 25 bp, Homo sapien
ggtcacaccccgaacatgttaataa

SEQ ID NO: 35119 - DNA, 25 bp, Homo sapien
agttagatcaaccaattttcaatat

SEQ ID NO: 35120 - DNA, 25 bp, Homo sapien
caaaatcatctgtggaattctcaaa

SEQ ID NO: 35121 - DNA, 25 bp, Homo sapien
gcagtatgatttaaacgtcgacgcg

SEQ ID NO: 35122 - DNA, 25 bp, Homo sapien
gaagggtcagaggtcaggaaggaga

SEQ ID NO: 35123 - DNA, 25 bp, Homo sapien
gggagggtgtgtgggaagaatggag

SEQ ID NO: 35124 - DNA, 25 bp, Homo sapien
aattcaggctgggtgcagtggctca

SEQ ID NO: 35125 - DNA, 25 bp, Homo sapien
gggaagccaaggcaggcggatcact

SEQ ID NO: 35126 - DNA, 25 bp, Homo sapien
ggagctgggcattatggcaggcacc

SEQ ID NO: 35127 - DNA, 25 bp, Homo sapien
gcaggagaataactggaatccggga

SEQ ID NO: 35128 - DNA, 25 bp, Homo sapien
ggaatccgggagatgcatgttgcag

SEQ ID NO: 35129 - DNA, 25 bp, Homo sapien
tgagctgagattgcaccactacact

SEQ ID NO: 35130 - DNA, 25 bp, Homo sapien
ttagccaggcggtagtggtgtgtgc

SEQ ID NO: 35131 - DNA, 25 bp, Homo sapien
ggtagtggtgtgtgcctataatccc

SEQ ID NO: 35132 - DNA, 25 bp, Homo sapien
gctacttgggaggctaagacaggag

SEQ ID NO: 35133 - DNA, 25 bp, Homo sapien
ccagtagctttcttggcctacagag

SEQ ID NO: 35134 - DNA, 25 bp, Homo sapien
tgcatccagcttcctatttacaatg

SEQ ID NO: 35135 - DNA, 25 bp, Homo sapien
taatcctggaccgatcgaatgcacc

SEQ ID NO: 35136 - DNA, 25 bp, Homo sapien
gaatgcaccaaatatcccaaaactc

SEQ ID NO: 35137 - DNA, 25 bp, Homo sapien
aactcaatagattccttcttctgtt

SEQ ID NO: 35138 - DNA, 25 bp, Homo sapien
ttcttctgttcattggattcgtctg

SEQ ID NO: 35139 - DNA, 25 bp, Homo sapien
gattcgtctgtgtcctattgagttt

SEQ ID NO: 35140 - DNA, 25 bp, Homo sapien
atgagaatgaaactgccgggctatc

SEQ ID NO: 35141 - DNA, 25 bp, Homo sapien
atacctggatttgctcctgtcaatg

SEQ ID NO: 35142 - DNA, 25 bp, Homo sapien
ggctgtaccaatcctctaatatgaa

SEQ ID NO: 35143 - DNA, 25 bp, Homo sapien
ctggccctattgctataccaatgat

SEQ ID NO: 35144 - DNA, 25 bp, Homo sapien
ccgagtaccccagggagctgatcga

SEQ ID NO: 35145 - DNA, 25 bp, Homo sapien
gatggaggccgtttttctggagaac

SEQ ID NO: 35146 - DNA, 25 bp, Homo sapien
tgaggcatgcagctggggttttggc

SEQ ID NO: 35147 - DNA, 25 bp, Homo sapien
tcgtgggactgctggagcccatcaa

SEQ ID NO: 35148 - DNA, 25 bp, Homo sapien
aagacccaacctccaattacaaatg

SEQ ID NO: 35149 - DNA, 25 bp, Homo sapien
gcagccccggagagctgaatttccc

SEQ ID NO: 35150 - DNA, 25 bp, Homo sapien
tcccctatctgtttcaactgctgga

SEQ ID NO: 35151 - DNA, 25 bp, Homo sapien
aaaggcttcgtgggctgtgagtatc

SEQ ID NO: 35152 - DNA, 25 bp, Homo sapien
gggcttgagttggctacgttcatac

SEQ ID NO: 35153 - DNA, 25 bp, Homo sapien
catactgggataggcggggccaccc

SEQ ID NO: 35154 - DNA, 25 bp, Homo sapien
cagacagcgagtgacatcccatctc

SEQ ID NO: 35155 - DNA, 25 bp, Homo sapien
gcatgtacgggaaataacagcactt

SEQ ID NO: 35156 - DNA, 25 bp, Homo sapien
aacagcactttaggtgtagttcagg

SEQ ID NO: 35157 - DNA, 25 bp, Homo sapien
gtagttcaggtgagcaagatgccag

SEQ ID NO: 35158 - DNA, 25 bp, Homo sapien
gcaagatgccagatagtttctacta

SEQ ID NO: 35159 - DNA, 25 bp, Homo sapien
gtttctactaaccatatactctttc

SEQ ID NO: 35160 - DNA, 25 bp, Homo sapien
taaccatatactctttctgcttctt

SEQ ID NO: 35161 - DNA, 25 bp, Homo sapien
gtagattatatatattcctaaagct

SEQ ID NO: 35162 - DNA, 25 bp, Homo sapien
tattcctaaagcttggtggaggtag

SEQ ID NO: 35163 - DNA, 25 bp, Homo sapien
gtggaggtagtggagctatcacaca

SEQ ID NO: 35164 - DNA, 25 bp, Homo sapien
gtagtggagctatcacacactcaaa

SEQ ID NO: 35165 - DNA, 25 bp, Homo sapien
atcacacactcaaatgagcttgtat

SEQ ID NO: 35166 - DNA, 25 bp, Homo sapien
cattttttggtgtccgtttgtattg

SEQ ID NO: 35167 - DNA, 25 bp, Homo sapien
ttggtgtccgtttgtattgaataat

SEQ ID NO: 35168 - DNA, 25 bp, Homo sapien
caaaaggtggattatcttctgaaga

SEQ ID NO: 35169 - DNA, 25 bp, Homo sapien
ggaaactgttagtccagaatgatgt

SEQ ID NO: 35170 - DNA, 25 bp, Homo sapien
gttatagattctctagttttctccc

SEQ ID NO: 35171 - DNA, 25 bp, Homo sapien
tctctagttttctccctagggatgg

SEQ ID NO: 35172 - DNA, 25 bp, Homo sapien
gagcccggggagcagggtcatgaac

SEQ ID NO: 35173 - DNA, 25 bp, Homo sapien
ggagcagggtcatgaacttttttct

SEQ ID NO: 35174 - DNA, 25 bp, Homo sapien
caatcaagggttttgtattcagaat

SEQ ID NO: 35175 - DNA, 25 bp, Homo sapien
ggaatgggacattggtgtgtttaga

SEQ ID NO: 35176 - DNA, 25 bp, Homo sapien
caaatctgtacagtttctattgttc

SEQ ID NO: 35177 - DNA, 25 bp, Homo sapien
gccccagttgatgagcggcgtgtcc

SEQ ID NO: 35178 - DNA, 25 bp, Homo sapien
tccctcgaaatcgttgcatctcact

SEQ ID NO: 35179 - DNA, 25 bp, Homo sapien
gttgcatctcacttctgagaacgaa

SEQ ID NO: 35180 - DNA, 25 bp, Homo sapien
agaacgaaatctcgcttcagtcact

SEQ ID NO: 35181 - DNA, 25 bp, Homo sapien
tcactctgccgaaggcgctgacggc

SEQ ID NO: 35182 - DNA, 25 bp, Homo sapien
tgccgaaggcgctgacggcatcgcg

SEQ ID NO: 35183 - DNA, 25 bp, Homo sapien
cgccgctccgtgggaaaaaacagct

SEQ ID NO: 35184 - DNA, 25 bp, Homo sapien
ggaaaaaacagctcctccatttcct

SEQ ID NO: 35185 - DNA, 25 bp, Homo sapien
gctcctccatttccttgaaaactga

SEQ ID NO: 35186 - DNA, 25 bp, Homo sapien
caggaagttcaggggagggtgccgg

SEQ ID NO: 35187 - DNA, 25 bp, Homo sapien
tcccgcagctgccgctgagaaaatg

SEQ ID NO: 35188 - DNA, 25 bp, Homo sapien
aagagtgaggttgtgcttaaggcag

SEQ ID NO: 35189 - DNA, 25 bp, Homo sapien
gcagtctgattctgttcttacttcc

SEQ ID NO: 35190 - DNA, 25 bp, Homo sapien
ttcttacttcctctcagcataaggg

SEQ ID NO: 35191 - DNA, 25 bp, Homo sapien
gaaaactcagacttgtatccgactt

SEQ ID NO: 35192 - DNA, 25 bp, Homo sapien
agacttgtatccgacttgaccagaa

SEQ ID NO: 35193 - DNA, 25 bp, Homo sapien
ttgaagccactatttctgtgtattt

SEQ ID NO: 35194 - DNA, 25 bp, Homo sapien
tgcagccatattcatatttcggtct

SEQ ID NO: 35195 - DNA, 25 bp, Homo sapien
gtctctcttaatggaccttgctgga

SEQ ID NO: 35196 - DNA, 25 bp, Homo sapien
ctttaagaatgagccttcacacctc

SEQ ID NO: 35197 - DNA, 25 bp, Homo sapien
ctcctgcagcaggtgatagctctgt

SEQ ID NO: 35198 - DNA, 25 bp, Homo sapien
gcaggtgatagctctgtacttcaga

SEQ ID NO: 35199 - DNA, 25 bp, Homo sapien
gaggagcagagagactgttcccttg

SEQ ID NO: 35200 - DNA, 25 bp, Homo sapien
cagagagactgttcccttgggtgga

SEQ ID NO: 35201 - DNA, 25 bp, Homo sapien
gagactgttcccttgggtggagagg

SEQ ID NO: 35202 - DNA, 25 bp, Homo sapien
gttcccttgggtggagaggtgtggg

SEQ ID NO: 35203 - DNA, 25 bp, Homo sapien
cacccattgccaagcagcaagaatg

SEQ ID NO: 35204 - DNA, 25 bp, Homo sapien
gcaagaatgttcgtgcttttttcca

SEQ ID NO: 35205 - DNA, 25 bp, Homo sapien
tggaaacttacagatgcctgcctgg

SEQ ID NO: 35206 - DNA, 25 bp, Homo sapien
tacagatgcctgcctgggatgatga

SEQ ID NO: 35207 - DNA, 25 bp, Homo sapien
gatgcctgcctgggatgatgaggca

SEQ ID NO: 35208 - DNA, 25 bp, Homo sapien
gggatgatgaggcacattcagaaca

SEQ ID NO: 35209 - DNA, 25 bp, Homo sapien
gaggcacattcagaacaaatgcttt

SEQ ID NO: 35210 - DNA, 25 bp, Homo sapien
gcagggcgggaggcatgcaagccag

SEQ ID NO: 35211 - DNA, 25 bp, Homo sapien
ggaaaacccctctgaagctgggcag

SEQ ID NO: 35212 - DNA, 25 bp, Homo sapien
gccgtgctccttggaacgcaaaggg

SEQ ID NO: 35213 - DNA, 25 bp, Homo sapien
aaagggccgaggagcatctggtttt

SEQ ID NO: 35214 - DNA, 25 bp, Homo sapien
ggttttcatggcaaagctctactcc

SEQ ID NO: 35215 - DNA, 25 bp, Homo sapien
actccagagctcctttaacatctgc

SEQ ID NO: 35216 - DNA, 25 bp, Homo sapien
atggcaaagatgacttccaggtgga

SEQ ID NO: 35217 - DNA, 25 bp, Homo sapien
tccaggtggatattgctctcttacg

SEQ ID NO: 35218 - DNA, 25 bp, Homo sapien
tgctctcttacggtgttggggatgc

SEQ ID NO: 35219 - DNA, 25 bp, Homo sapien
gttggggatgccagaacaccacttg

SEQ ID NO: 35220 - DNA, 25 bp, Homo sapien
ccattggccttatgtgcgtgtgtgc

SEQ ID NO: 35221 - DNA, 25 bp, Homo sapien
atatctaccaacattgagacttgac

SEQ ID NO: 35222 - DNA, 25 bp, Homo sapien
atatttaagatcccacagaagcgta

SEQ ID NO: 35223 - DNA, 25 bp, Homo sapien
aatgtctgtcattaaaggataggtt

SEQ ID NO: 35224 - DNA, 25 bp, Homo sapien
gataggttaaggtgtggttcagcca

SEQ ID NO: 35225 - DNA, 25 bp, Homo sapien
ggttcagccatataggaatatctcg

SEQ ID NO: 35226 - DNA, 25 bp, Homo sapien
ggaatatctcgtatctgttaaaatg

SEQ ID NO: 35227 - DNA, 25 bp, Homo sapien
atggccatgatacattaggtgaaac

SEQ ID NO: 35228 - DNA, 25 bp, Homo sapien
aagtgtacagtgtgaactcatttta

SEQ ID NO: 35229 - DNA, 25 bp, Homo sapien
aaggtctattcacagctttctttga

SEQ ID NO: 35230 - DNA, 25 bp, Homo sapien
catgaaactttcaactttatacatt

SEQ ID NO: 35231 - DNA, 25 bp, Homo sapien
attaatattttacactacccacatt

SEQ ID NO: 35232 - DNA, 25 bp, Homo sapien
gcagcgcaactctcatgcagattta

SEQ ID NO: 35233 - DNA, 25 bp, Homo sapien
gatttacatttgactgttggagcaa

SEQ ID NO: 35234 - DNA, 25 bp, Homo sapien
gtaaacgtgtatctcttgttcattt

SEQ ID NO: 35235 - DNA, 25 bp, Homo sapien
ttacctgcggtgtgactagctttaa

SEQ ID NO: 35236 - DNA, 25 bp, Homo sapien
gaaatgctatttctttctggttcct

SEQ ID NO: 35237 - DNA, 25 bp, Homo sapien
ctggttcctgcagccattgaaaaac

SEQ ID NO: 35238 - DNA, 25 bp, Homo sapien
cctgcagccattgaaaaaccttttt

SEQ ID NO: 35239 - DNA, 25 bp, Homo sapien
acctttttccttgcaaattataatg

SEQ ID NO: 35240 - DNA, 25 bp, Homo sapien
gatttttatcaactgtgggaaacca

SEQ ID NO: 35241 - DNA, 25 bp, Homo sapien
aacacaaagctgataacctttctta

SEQ ID NO: 35242 - DNA, 25 bp, Homo sapien
aacgacccagtcacagtaaagaaga

SEQ ID NO: 35243 - DNA, 25 bp, Homo sapien
gaattggtcacaagtatgttgttgc

SEQ ID NO: 35244 - DNA, 25 bp, Homo sapien
atgttgttgcataggctgtacagtt

SEQ ID NO: 35245 - DNA, 25 bp, Homo sapien
taggctgtacagttgggaagtagaa

SEQ ID NO: 35246 - DNA, 25 bp, Homo sapien
aaaccaaatgctacccagagaccta

SEQ ID NO: 35247 - DNA, 25 bp, Homo sapien
tacccagagacctaacccaattaag

SEQ ID NO: 35248 - DNA, 25 bp, Homo sapien
gacctaacccaattaagctctttgt

SEQ ID NO: 35249 - DNA, 25 bp, Homo sapien
taagctctttgtatttctccttcaa

SEQ ID NO: 35250 - DNA, 25 bp, Homo sapien
caagaaataaatcttccttccttct

SEQ ID NO: 35251 - DNA, 25 bp, Homo sapien
ttcatcctgatttttttattttcta

SEQ ID NO: 35252 - DNA, 25 bp, Homo sapien
aataaaaataggccaggcgcggtgg

SEQ ID NO: 35253 - DNA, 25 bp, Homo sapien
agtcaagatcgtgtcactgcactcc

SEQ ID NO: 35254 - DNA, 25 bp, Homo sapien
ctcccgaaggcctgcacaggcccag

SEQ ID NO: 35255 - DNA, 25 bp, Homo sapien
gcctcttggcttctaatttgtttat

SEQ ID NO: 35256 - DNA, 25 bp, Homo sapien
gcttctaatttgtttatcttttgtg

SEQ ID NO: 35257 - DNA, 25 bp, Homo sapien
ggaattttggaatatttccaccatt

SEQ ID NO: 35258 - DNA, 25 bp, Homo sapien
tcccaacatctgcctcacagcagat

SEQ ID NO: 35259 - DNA, 25 bp, Homo sapien
ctgcctcacagcagattcttcacgc

SEQ ID NO: 35260 - DNA, 25 bp, Homo sapien
cctccagacccagatggtgtctcac

SEQ ID NO: 35261 - DNA, 25 bp, Homo sapien
gacccagatggtgtctcactgtggc

SEQ ID NO: 35262 - DNA, 25 bp, Homo sapien
agatggtgtctcactgtggcatcct

SEQ ID NO: 35263 - DNA, 25 bp, Homo sapien
tgacttttggtggcctctgcaggcc

SEQ ID NO: 35264 - DNA, 25 bp, Homo sapien
ctctgcaggcctcgacaaggcccag

SEQ ID NO: 35265 - DNA, 25 bp, Homo sapien
aaattcagcctaaacgttttgccag

SEQ ID NO: 35266 - DNA, 25 bp, Homo sapien
atgctgtgagtttccaacctcagcc

SEQ ID NO: 35267 - DNA, 25 bp, Homo sapien
gaaggtctagtttgtccatcaccat

SEQ ID NO: 35268 - DNA, 25 bp, Homo sapien
ggtctaggagatctgtcccttttag

SEQ ID NO: 35269 - DNA, 25 bp, Homo sapien
tttatcatttattaatcctccctgc

SEQ ID NO: 35270 - DNA, 25 bp, Homo sapien
atttcctcatcttttgttgttgtca

SEQ ID NO: 35271 - DNA, 25 bp, Homo sapien
tccctgcctgtgtctattattatat

SEQ ID NO: 35272 - DNA, 25 bp, Homo sapien
tctacactgcaaatttggggtctca

SEQ ID NO: 35273 - DNA, 25 bp, Homo sapien
tttactgtgcctttgtttttactag

SEQ ID NO: 35274 - DNA, 25 bp, Homo sapien
gtttttactagtgtctgctgttgca

SEQ ID NO: 35275 - DNA, 25 bp, Homo sapien
gaagacattctctgcctgagtttta

SEQ ID NO: 35276 - DNA, 25 bp, Homo sapien
aaggagccctcttgatgatttctgt

SEQ ID NO: 35277 - DNA, 25 bp, Homo sapien
gaaatcgaggccccttgattgtttc

SEQ ID NO: 35278 - DNA, 25 bp, Homo sapien
ttgtttctgtgaaacaccctgcacc

SEQ ID NO: 35279 - DNA, 25 bp, Homo sapien
ctttccccactgagatctttcgggt

SEQ ID NO: 35280 - DNA, 25 bp, Homo sapien
cactgagatctttcgggttctctcc

SEQ ID NO: 35281 - DNA, 25 bp, Homo sapien
taatccccctacgtggtgcttgggg

SEQ ID NO: 35282 - DNA, 25 bp, Homo sapien
catcccgataccatctcagtaaatc

SEQ ID NO: 35283 - DNA, 25 bp, Homo sapien
tctcagtaaatctcctacaatggcc

SEQ ID NO: 35284 - DNA, 25 bp, Homo sapien
ttcaggtcctcaccctgagacagga

SEQ ID NO: 35285 - DNA, 25 bp, Homo sapien
atcagggacccttaggtctcactgc

SEQ ID NO: 35286 - DNA, 25 bp, Homo sapien
gtctcactgctctctgattcagagc

SEQ ID NO: 35287 - DNA, 25 bp, Homo sapien
ggtctgaatttgtgttggcatccat

SEQ ID NO: 35288 - DNA, 25 bp, Homo sapien
ggcatccatggtacttactgttcag

SEQ ID NO: 35289 - DNA, 25 bp, Homo sapien
ggagcagagtgccctctgctggagt

SEQ ID NO: 35290 - DNA, 25 bp, Homo sapien
tgccctctgctggagtaatcgcaat

SEQ ID NO: 35291 - DNA, 25 bp, Homo sapien
gtaatcgcaattattcttgcagcag

SEQ ID NO: 35292 - DNA, 25 bp, Homo sapien
gcagcagattaatttgacttgggtc

SEQ ID NO: 35293 - DNA, 25 bp, Homo sapien
gacttgggtcatgaattcaacaacc

SEQ ID NO: 35294 - DNA, 25 bp, Homo sapien
aacaaccagttacttgcctttcatc

SEQ ID NO: 35295 - DNA, 25 bp, Homo sapien
acttgcctttcatcatacaatttct

SEQ ID NO: 35296 - DNA, 25 bp, Homo sapien
tcagcagcccttacttctgcaaaat

SEQ ID NO: 35297 - DNA, 25 bp, Homo sapien
gatgcctctggctagaatgtttgtg

SEQ ID NO: 35298 - DNA, 25 bp, Homo sapien
gctccccagacacttaaccgaaggg

SEQ ID NO: 35299 - DNA, 25 bp, Homo sapien
ggctccagaaggcggtgtgggggat

SEQ ID NO: 35300 - DNA, 25 bp, Homo sapien
agaaggcggtgtgggggatggcggt

SEQ ID NO: 35301 - DNA, 25 bp, Homo sapien
accccaccaccaggggtcagcagag

SEQ ID NO: 35302 - DNA, 25 bp, Homo sapien
ggtcagcagagcccaggaggcgaca

SEQ ID NO: 35303 - DNA, 25 bp, Homo sapien
tcagcagagcccaggaggcgacacc

SEQ ID NO: 35304 - DNA, 25 bp, Homo sapien
cccgagtcggctctgttgtttgaat

SEQ ID NO: 35305 - DNA, 25 bp, Homo sapien
cgagtcggctctgttgtttgaataa

SEQ ID NO: 35306 - DNA, 25 bp, Homo sapien
gagtcggctctgttgtttgaataaa

SEQ ID NO: 35307 - DNA, 25 bp, Homo sapien
gtcggctctgttgtttgaataaacg

SEQ ID NO: 35308 - DNA, 25 bp, Homo sapien
ttgaataaacgtgaacgtgaaccca

SEQ ID NO: 35309 - DNA, 25 bp, Homo sapien
agctgtttgggcaggaatcgggtgt

SEQ ID NO: 35310 - DNA, 25 bp, Homo sapien
cattccacagggcaggacaactgag

SEQ ID NO: 35311 - DNA, 25 bp, Homo sapien
cgcgcaggtgcacagtggaaggacc

SEQ ID NO: 35312 - DNA, 25 bp, Homo sapien
gaaggaccaggactgctcatatgca

SEQ ID NO: 35313 - DNA, 25 bp, Homo sapien
tgcagtggcagtctttggctaacaa

SEQ ID NO: 35314 - DNA, 25 bp, Homo sapien
taacaagtcatcataggtctggagc

SEQ ID NO: 35315 - DNA, 25 bp, Homo sapien
gcaccatgggattgtagctggcggg

SEQ ID NO: 35316 - DNA, 25 bp, Homo sapien
tcttgatctgcgcgtgcatgtttgc

SEQ ID NO: 35317 - DNA, 25 bp, Homo sapien
cgccgatgcacatggtcacttgcac

SEQ ID NO: 35318 - DNA, 25 bp, Homo sapien
gaccgtgtgcagacggcagcaacgc

SEQ ID NO: 35319 - DNA, 25 bp, Homo sapien
taaatacacagttccatcagaccag

SEQ ID NO: 35320 - DNA, 25 bp, Homo sapien
cagagctctaagcctcagtggctcc

SEQ ID NO: 35321 - DNA, 25 bp, Homo sapien
gtgatggtgcacatggcaaacccca

SEQ ID NO: 35322 - DNA, 25 bp, Homo sapien
gggctggccacaggaatgccacaac

SEQ ID NO: 35323 - DNA, 25 bp, Homo sapien
cccgcagcatatgccctagggtgac

SEQ ID NO: 35324 - DNA, 25 bp, Homo sapien
gtgaccacgcagtgaggctggtgcc

SEQ ID NO: 35325 - DNA, 25 bp, Homo sapien
ccatgctccacactgggaggccagg

SEQ ID NO: 35326 - DNA, 25 bp, Homo sapien
tagggaccccttgaggggccgagct

SEQ ID NO: 35327 - DNA, 25 bp, Homo sapien
gccgagctgacatccaaggctgagg

SEQ ID NO: 35328 - DNA, 25 bp, Homo sapien
tgttccggcatatcctggccgtaac

SEQ ID NO: 35329 - DNA, 25 bp, Homo sapien
gggtaatttactagctgtggcctcc

SEQ ID NO: 35330 - DNA, 25 bp, Homo sapien
ctcccactaactagcattcctttaa

SEQ ID NO: 35331 - DNA, 25 bp, Homo sapien
ctcaacgagactcagttttccgcct

SEQ ID NO: 35332 - DNA, 25 bp, Homo sapien
tcttttccaaagtgagcggtggccc

SEQ ID NO: 35333 - DNA, 25 bp, Homo sapien
gcaccaaggcgagatccgccaggac

SEQ ID NO: 35334 - DNA, 25 bp, Homo sapien
ggacagcctgtatgaggcgggcgcg

SEQ ID NO: 35335 - DNA, 25 bp, Homo sapien
gggccgggtggtgaatagctggtac

SEQ ID NO: 35336 - DNA, 25 bp, Homo sapien
ggtgaatagctggtaccgctaccgc

SEQ ID NO: 35337 - DNA, 25 bp, Homo sapien
gagcgaggagatctgctggacgaac

SEQ ID NO: 35338 - DNA, 25 bp, Homo sapien
tggacgaactcggagagcttcgccg

SEQ ID NO: 35339 - DNA, 25 bp, Homo sapien
ctggtgccgctttggcaagcgggag

SEQ ID NO: 35340 - DNA, 25 bp, Homo sapien
ccgcagcagcagtactatctcaagg

SEQ ID NO: 35341 - DNA, 25 bp, Homo sapien
agtactatctcaaggtgcacctggg

SEQ ID NO: 35342 - DNA, 25 bp, Homo sapien
cacgttcacagcagctctttcaagc

SEQ ID NO: 35343 - DNA, 25 bp, Homo sapien
ttcacagcagctctttcaagcagcc

SEQ ID NO: 35344 - DNA, 25 bp, Homo sapien
aatcagcagagcctcgtgaatgtat

SEQ ID NO: 35345 - DNA, 25 bp, Homo sapien
cagcagagcctcgtgaatgtatttc

SEQ ID NO: 35346 - DNA, 25 bp, Homo sapien
gagcctcgtgaatgtatttctcgtg

SEQ ID NO: 35347 - DNA, 25 bp, Homo sapien
cctcgtgaatgtatttctcgtggca

SEQ ID NO: 35348 - DNA, 25 bp, Homo sapien
cgtgaatgtatttctcgtggcaaga

SEQ ID NO: 35349 - DNA, 25 bp, Homo sapien
atttctcgtggcaagaagggagctc

SEQ ID NO: 35350 - DNA, 25 bp, Homo sapien
tcatcttctgggtcctgccagaggg

SEQ ID NO: 35351 - DNA, 25 bp, Homo sapien
tcttctgggtcctgccagagggcag

SEQ ID NO: 35352 - DNA, 25 bp, Homo sapien
ctgggtcctgccagagggcagtgag

SEQ ID NO: 35353 - DNA, 25 bp, Homo sapien
tttgcagtctgttttctaggcggtg

SEQ ID NO: 35354 - DNA, 25 bp, Homo sapien
tgcagtctgttttctaggcggtgga

SEQ ID NO: 35355 - DNA, 25 bp, Homo sapien
tttctgtgtgtgattcactgtgtac

SEQ ID NO: 35356 - DNA, 25 bp, Homo sapien
gtgtgtgattcactgtgtactggtc

SEQ ID NO: 35357 - DNA, 25 bp, Homo sapien
tgattcactgtgtactggtcagcac

SEQ ID NO: 35358 - DNA, 25 bp, Homo sapien
gtgtactggtcagcacaggctggcc

SEQ ID NO: 35359 - DNA, 25 bp, Homo sapien
gtactggtcagcacaggctggccag

SEQ ID NO: 35360 - DNA, 25 bp, Homo sapien
ctggtcagcacaggctggccagaga

SEQ ID NO: 35361 - DNA, 25 bp, Homo sapien
tgttcttgtttctggtgttgtcacg

SEQ ID NO: 35362 - DNA, 25 bp, Homo sapien
ttgtttctggtgttgtcacgtcttc

SEQ ID NO: 35363 - DNA, 25 bp, Homo sapien
tttctggtgttgtcacgtcttcttg

SEQ ID NO: 35364 - DNA, 25 bp, Homo sapien
gccctgctgcatcgagacacaatgc

SEQ ID NO: 35365 - DNA, 25 bp, Homo sapien
agacacaatgctggcagctgcggca

SEQ ID NO: 35366 - DNA, 25 bp, Homo sapien
cagtacctgctacataccagatcta

SEQ ID NO: 35367 - DNA, 25 bp, Homo sapien
gagtcacaggcaagaccagctgaaa

SEQ ID NO: 35368 - DNA, 25 bp, Homo sapien
aagaggttccgcaactgtgtcattt

SEQ ID NO: 35369 - DNA, 25 bp, Homo sapien
ggtgcaatgtttggaggcgacacac

SEQ ID NO: 35370 - DNA, 25 bp, Homo sapien
ggcgacacactctatgaacttcggt

SEQ ID NO: 35371 - DNA, 25 bp, Homo sapien
acttcggtgttccttacagttagcg

SEQ ID NO: 35372 - DNA, 25 bp, Homo sapien
tcctttcactgctgtcaatgacctg

SEQ ID NO: 35373 - DNA, 25 bp, Homo sapien
gggacatctgcttgggagagctggc

SEQ ID NO: 35374 - DNA, 25 bp, Homo sapien
agctggctttaatactctgactgtg

SEQ ID NO: 35375 - DNA, 25 bp, Homo sapien
aaatagccaaaagccaatacataat

SEQ ID NO: 35376 - DNA, 25 bp, Homo sapien
tattagttggttctcatgcatacat

SEQ ID NO: 35377 - DNA, 25 bp, Homo sapien
tgatcctcacaactgtttaagtttt

SEQ ID NO: 35378 - DNA, 25 bp, Homo sapien
agaatcatacaatacctgcctgctt

SEQ ID NO: 35379 - DNA, 25 bp, Homo sapien
tcatacaatacctgcctgctttcat

SEQ ID NO: 35380 - DNA, 25 bp, Homo sapien
gttgtgtacatcaatagttcatcta

SEQ ID NO: 35381 - DNA, 25 bp, Homo sapien
gtttacacattcaccactgatatat

SEQ ID NO: 35382 - DNA, 25 bp, Homo sapien
accactgatatataagttgcttcca

SEQ ID NO: 35383 - DNA, 25 bp, Homo sapien
gttgcttccagtgtgaggctgtttt

SEQ ID NO: 35384 - DNA, 25 bp, Homo sapien
gtgaggctgttttaaataaagctgc

SEQ ID NO: 35385 - DNA, 25 bp, Homo sapien
gagctctatttctgttaacccaaat

SEQ ID NO: 35386 - DNA, 25 bp, Homo sapien
tgcacacgcaggagcgggcggtgga

SEQ ID NO: 35387 - DNA, 25 bp, Homo sapien
ggaggaggtgaagctggccatcaag

SEQ ID NO: 35388 - DNA, 25 bp, Homo sapien
ggccatcaagccatactatcagaag

SEQ ID NO: 35389 - DNA, 25 bp, Homo sapien
atcctgaggaaggccgtccacaaga

SEQ ID NO: 35390 - DNA, 25 bp, Homo sapien
gtccacaagatctgccacagcaaaa

SEQ ID NO: 35391 - DNA, 25 bp, Homo sapien
tgaaggtgagcaacctggtgcgggc

SEQ ID NO: 35392 - DNA, 25 bp, Homo sapien
tacttccgcaagcacggtcgcaagc

SEQ ID NO: 35393 - DNA, 25 bp, Homo sapien
cctcccccgtcagtgggatgactgg

SEQ ID NO: 35394 - DNA, 25 bp, Homo sapien
ggatgactgggggagggttgctgca

SEQ ID NO: 35395 - DNA, 25 bp, Homo sapien
cagggaagaggagagccccctgccc

SEQ ID NO: 35396 - DNA, 25 bp, Homo sapien
ccctctccccaatttcattaaagat

SEQ ID NO: 35397 - DNA, 25 bp, Homo sapien
agacttaaaagtaatcgtcctagct

SEQ ID NO: 35398 - DNA, 25 bp, Homo sapien
tcgtcctagctattacatgtttcca

SEQ ID NO: 35399 - DNA, 25 bp, Homo sapien
ataattgagctaaacttggtgcctg

SEQ ID NO: 35400 - DNA, 25 bp, Homo sapien
attattgcagcttagttcttcatat

SEQ ID NO: 35401 - DNA, 25 bp, Homo sapien
ggaagactttccattgttaagtaga

SEQ ID NO: 35402 - DNA, 25 bp, Homo sapien
cctgctattgctaccattcacaaca

SEQ ID NO: 35403 - DNA, 25 bp, Homo sapien
gctaccattcacaacaactagtttg

SEQ ID NO: 35404 - DNA, 25 bp, Homo sapien
gtttgtgtgaactagggttttccat

SEQ ID NO: 35405 - DNA, 25 bp, Homo sapien
gaaatgggctgaattgtgcagcagt

SEQ ID NO: 35406 - DNA, 25 bp, Homo sapien
tgtgcagcagttatgcgggtagcat

SEQ ID NO: 35407 - DNA, 25 bp, Homo sapien
aatgaacttatgaacaggcaagcac

SEQ ID NO: 35408 - DNA, 25 bp, Homo sapien
ctctggcctctggggacataaacgg

SEQ ID NO: 35409 - DNA, 25 bp, Homo sapien
ctggggacataaacggggcggctgg

SEQ ID NO: 35410 - DNA, 25 bp, Homo sapien
gcccaagttctggggcaggtaggag

SEQ ID NO: 35411 - DNA, 25 bp, Homo sapien
caggtaggagagggccgtcacacac

SEQ ID NO: 35412 - DNA, 25 bp, Homo sapien
gcccttcctcaaggggtcacttatt

SEQ ID NO: 35413 - DNA, 25 bp, Homo sapien
ttaaaaagtccacggcctgaggcca

SEQ ID NO: 35414 - DNA, 25 bp, Homo sapien
taaccttcgtaaagacctgtctcct

SEQ ID NO: 35415 - DNA, 25 bp, Homo sapien
gtggttctagcaggttctatgccat

SEQ ID NO: 35416 - DNA, 25 bp, Homo sapien
caggttctatgccatctgcattggg

SEQ ID NO: 35417 - DNA, 25 bp, Homo sapien
ggatgtctggttgtttttatttctg

SEQ ID NO: 35418 - DNA, 25 bp, Homo sapien
agttgtcgataccacgtgaattcat

SEQ ID NO: 35419 - DNA, 25 bp, Homo sapien
tgctggtctaatttggaccccctgc

SEQ ID NO: 35420 - DNA, 25 bp, Homo sapien
gaggggagggacaaatcccctactg

SEQ ID NO: 35421 - DNA, 25 bp, Homo sapien
catttcaatggggtagtttttggat

SEQ ID NO: 35422 - DNA, 25 bp, Homo sapien
taatggagatgtctggacccttcct

SEQ ID NO: 35423 - DNA, 25 bp, Homo sapien
cgttgttctcgtaggtgaaccccag

SEQ ID NO: 35424 - DNA, 25 bp, Homo sapien
tgttctcgtaggtgaaccccaggtc

SEQ ID NO: 35425 - DNA, 25 bp, Homo sapien
atgtgaacatcacgtgttataactg

SEQ ID NO: 35426 - DNA, 25 bp, Homo sapien
tcacgtgttataactgtagcgctgt

SEQ ID NO: 35427 - DNA, 25 bp, Homo sapien
aactgtagcgctgtaaatttttttg

SEQ ID NO: 35428 - DNA, 25 bp, Homo sapien
ggggtcccagagggtagagctcaag

SEQ ID NO: 35429 - DNA, 25 bp, Homo sapien
agagctcaaggattttgggttttgt

SEQ ID NO: 35430 - DNA, 25 bp, Homo sapien
gtgttctgatatctgaggccagtaa

SEQ ID NO: 35431 - DNA, 25 bp, Homo sapien
aatatctagttctcagagcatttgg

SEQ ID NO: 35432 - DNA, 25 bp, Homo sapien
atggctacctaaattgaaatccttt

SEQ ID NO: 35433 - DNA, 25 bp, Homo sapien
aggactggcctaaattgtctaatgt

SEQ ID NO: 35434 - DNA, 25 bp, Homo sapien
ataaaatctgtccattcccattaaa

SEQ ID NO: 35435 - DNA, 25 bp, Homo sapien
agcaggtagctcaatctactaatgt

SEQ ID NO: 35436 - DNA, 25 bp, Homo sapien
ctactaatgttgtttgatctgtgtt

SEQ ID NO: 35437 - DNA, 25 bp, Homo sapien
gatctgtgtttgttatactggttgt

SEQ ID NO: 35438 - DNA, 25 bp, Homo sapien
ttaactattaactacattcaccttg

SEQ ID NO: 35439 - DNA, 25 bp, Homo sapien
acttgttgacaatgcactgacttta

SEQ ID NO: 35440 - DNA, 25 bp, Homo sapien
ggggtgtacctgtttatctgtaact

SEQ ID NO: 35441 - DNA, 25 bp, Homo sapien
gggcgccagcccaagaatggggacc

SEQ ID NO: 35442 - DNA, 25 bp, Homo sapien
agaatggggaccatgggactcctcc

SEQ ID NO: 35443 - DNA, 25 bp, Homo sapien
cttgtatcccatttgcccagggaac

SEQ ID NO: 35444 - DNA, 25 bp, Homo sapien
cccagggaactgccactcctggttg

SEQ ID NO: 35445 - DNA, 25 bp, Homo sapien
ggaaatagcagccaacggacacctc

SEQ ID NO: 35446 - DNA, 25 bp, Homo sapien
ctcccgatgccagtgctaaggctgg

SEQ ID NO: 35447 - DNA, 25 bp, Homo sapien
tgggaacctagtaacagactctgct

SEQ ID NO: 35448 - DNA, 25 bp, Homo sapien
ggaggggagatctatccacatacct

SEQ ID NO: 35449 - DNA, 25 bp, Homo sapien
gggcctggggatagcgagaggcttg

SEQ ID NO: 35450 - DNA, 25 bp, Homo sapien
gaggcttgagaatggggccgcttgg

SEQ ID NO: 35451 - DNA, 25 bp, Homo sapien
gggtctgtacaatacggtttgctat

SEQ ID NO: 35452 - DNA, 25 bp, Homo sapien
tgaagatgatatgaggccggggcgg

SEQ ID NO: 35453 - DNA, 25 bp, Homo sapien
agatgatatgaggccggggcggggg

SEQ ID NO: 35454 - DNA, 25 bp, Homo sapien
accccacctacacaggggcattgac

SEQ ID NO: 35455 - DNA, 25 bp, Homo sapien
acctacacaggggcattgacagact

SEQ ID NO: 35456 - DNA, 25 bp, Homo sapien
acaggggcattgacagactggagtt

SEQ ID NO: 35457 - DNA, 25 bp, Homo sapien
gactggagttgaaagccgacgaacc

SEQ ID NO: 35458 - DNA, 25 bp, Homo sapien
agttgaaagccgacgaaccgacacg

SEQ ID NO: 35459 - DNA, 25 bp, Homo sapien
gaaccgacacgcggcagagtcaata

SEQ ID NO: 35460 - DNA, 25 bp, Homo sapien
cacgcggcagagtcaataattcaat

SEQ ID NO: 35461 - DNA, 25 bp, Homo sapien
gttacgaactttctctgtaacttgg

SEQ ID NO: 35462 - DNA, 25 bp, Homo sapien
cttgggtttcaataattatggattt

SEQ ID NO: 35463 - DNA, 25 bp, Homo sapien
gcgccggcgttggcattagtatcat

SEQ ID NO: 35464 - DNA, 25 bp, Homo sapien
agacgtggttgtgaccttcactgga

SEQ ID NO: 35465 - DNA, 25 bp, Homo sapien
gcacctgcgcaggttggtgactgag

SEQ ID NO: 35466 - DNA, 25 bp, Homo sapien
gtctggcagcgggtatcagggcagc

SEQ ID NO: 35467 - DNA, 25 bp, Homo sapien
cacccaggcatcactgtgtctgaaa

SEQ ID NO: 35468 - DNA, 25 bp, Homo sapien
tgtggtcttgagcagtcatggagcc

SEQ ID NO: 35469 - DNA, 25 bp, Homo sapien
cactctttgcctttattcaggttgg

SEQ ID NO: 35470 - DNA, 25 bp, Homo sapien
gctttaatgatttgccactcactag

SEQ ID NO: 35471 - DNA, 25 bp, Homo sapien
actcactagcctcatgactctggag

SEQ ID NO: 35472 - DNA, 25 bp, Homo sapien
gacgtcactgtgcctttggtatata

SEQ ID NO: 35473 - DNA, 25 bp, Homo sapien
ggctgagttaatgaccttctctgaa

SEQ ID NO: 35474 - DNA, 25 bp, Homo sapien
gcgcaccccttaggaagtggctgtc

SEQ ID NO: 35475 - DNA, 25 bp, Homo sapien
tgaggttctcagccgatgtgttaga

SEQ ID NO: 35476 - DNA, 25 bp, Homo sapien
gttagaggttgagcatcgcctgtgc

SEQ ID NO: 35477 - DNA, 25 bp, Homo sapien
ccagcttgctggctgtcagtgcttg

SEQ ID NO: 35478 - DNA, 25 bp, Homo sapien
cctccctggctggagggtcggggag

SEQ ID NO: 35479 - DNA, 25 bp, Homo sapien
gagatggttggtccacagggctagc

SEQ ID NO: 35480 - DNA, 25 bp, Homo sapien
acagggctagccctgggtggtggga

SEQ ID NO: 35481 - DNA, 25 bp, Homo sapien
aggggcccagggtcagggtgagaga

SEQ ID NO: 35482 - DNA, 25 bp, Homo sapien
aggcgacggatgtggatcctgacct

SEQ ID NO: 35483 - DNA, 25 bp, Homo sapien
ggatcctgacctcctgagaggtgtg

SEQ ID NO: 35484 - DNA, 25 bp, Homo sapien
aggtgtgaggtgcagggatacccac

SEQ ID NO: 35485 - DNA, 25 bp, Homo sapien
ttcccataatccctacgtgttgtgg

SEQ ID NO: 35486 - DNA, 25 bp, Homo sapien
cataatccctacgtgttgtgggagg

SEQ ID NO: 35487 - DNA, 25 bp, Homo sapien
cagtgggcagtaatttaatcatggt

SEQ ID NO: 35488 - DNA, 25 bp, Homo sapien
gggcagtaatttaatcatggtggtg

SEQ ID NO: 35489 - DNA, 25 bp, Homo sapien
taccctcatgctgttcttgtgatgg

SEQ ID NO: 35490 - DNA, 25 bp, Homo sapien
ccctcatgctgttcttgtgatggtg

SEQ ID NO: 35491 - DNA, 25 bp, Homo sapien
gctgttcttgtgatggtgagttctc

SEQ ID NO: 35492 - DNA, 25 bp, Homo sapien
gttcttgtgatggtgagttctcatg

SEQ ID NO: 35493 - DNA, 25 bp, Homo sapien
gatggtgagttctcatgagatctga

SEQ ID NO: 35494 - DNA, 25 bp, Homo sapien
gttctcatgagatctgatgggtgtt

SEQ ID NO: 35495 - DNA, 25 bp, Homo sapien
gatctgatgggtgtttttttttgtt

SEQ ID NO: 35496 - DNA, 25 bp, Homo sapien
ggcttgtggggagggacaccaacag

SEQ ID NO: 35497 - DNA, 25 bp, Homo sapien
ggagggacaccaacagggtttcaag

SEQ ID NO: 35498 - DNA, 25 bp, Homo sapien
gggtttcaaggggaccaggagtcag

SEQ ID NO: 35499 - DNA, 25 bp, Homo sapien
cagaatgtggggagacgcctctgcc

SEQ ID NO: 35500 - DNA, 25 bp, Homo sapien
catcacccgagaggagaggacgccc

SEQ ID NO: 35501 - DNA, 25 bp, Homo sapien
ctctccagggtaggccagcttgagg

SEQ ID NO: 35502 - DNA, 25 bp, Homo sapien
ggccagcttgaggaatcttatttat

SEQ ID NO: 35503 - DNA, 25 bp, Homo sapien
tgaactagtctgttgggttggggga

SEQ ID NO: 35504 - DNA, 25 bp, Homo sapien
gttgggggaaggaggtggctgctac

SEQ ID NO: 35505 - DNA, 25 bp, Homo sapien
tccaatctggggtcgggggaccctg

SEQ ID NO: 35506 - DNA, 25 bp, Homo sapien
ggaccctgggaggtgctttacagac

SEQ ID NO: 35507 - DNA, 25 bp, Homo sapien
cagtgacaggggctgccccgagctg

SEQ ID NO: 35508 - DNA, 25 bp, Homo sapien
gctgccccgagctggagggggatcc

SEQ ID NO: 35509 - DNA, 25 bp, Homo sapien
ctggagggggatccagcgaccaaac

SEQ ID NO: 35510 - DNA, 25 bp, Homo sapien
ccagcgaccaaaccagaggatgcac

SEQ ID NO: 35511 - DNA, 25 bp, Homo sapien
caaaccagaggatgcactgaccgcc

SEQ ID NO: 35512 - DNA, 25 bp, Homo sapien
gttggcccctggaggccgaggggca

SEQ ID NO: 35513 - DNA, 25 bp, Homo sapien
cccctggaggccgaggggcatggcg

SEQ ID NO: 35514 - DNA, 25 bp, Homo sapien
gtctgtaggctcgggcgacatggac

SEQ ID NO: 35515 - DNA, 25 bp, Homo sapien
tcgggcgacatggacgggttgccga

SEQ ID NO: 35516 - DNA, 25 bp, Homo sapien
catggacgggttgccgaagagttcc

SEQ ID NO: 35517 - DNA, 25 bp, Homo sapien
ctgccgggtggaggcgtctagtggc

SEQ ID NO: 35518 - DNA, 25 bp, Homo sapien
cctgcccatcgctggttttggggta

SEQ ID NO: 35519 - DNA, 25 bp, Homo sapien
ccgcactcgcagggcaagaagctta

SEQ ID NO: 35520 - DNA, 25 bp, Homo sapien
attgaccagaacctctttcaacagg

SEQ ID NO: 35521 - DNA, 25 bp, Homo sapien
gccaggaaccgtggagggccaactc

SEQ ID NO: 35522 - DNA, 25 bp, Homo sapien
gcaaagtcccacgcggcgaagagtt

SEQ ID NO: 35523 - DNA, 25 bp, Homo sapien
gagttttggagcagcgcttacctag

SEQ ID NO: 35524 - DNA, 25 bp, Homo sapien
gaaccaggaattgtctccaactcca

SEQ ID NO: 35525 - DNA, 25 bp, Homo sapien
caactccaggcgctcagggaatcgc

SEQ ID NO: 35526 - DNA, 25 bp, Homo sapien
gtccaggcgctctgcagacaaataa

SEQ ID NO: 35527 - DNA, 25 bp, Homo sapien
gaaggtgaatggcggctgcgaggga

SEQ ID NO: 35528 - DNA, 25 bp, Homo sapien
gagtgggaagcgaggctcatgcggg

SEQ ID NO: 35529 - DNA, 25 bp, Homo sapien
ctctccaggtgcaaaacttcctcga

SEQ ID NO: 35530 - DNA, 25 bp, Homo sapien
aggtgcaaaacttcctcgagtcagc

SEQ ID NO: 35531 - DNA, 25 bp, Homo sapien
cttttgacttttggcagcctcttca

SEQ ID NO: 35532 - DNA, 25 bp, Homo sapien
tttgacttttggcagcctcttcagg

SEQ ID NO: 35533 - DNA, 25 bp, Homo sapien
cagcctcttcaggcgcagaacttga

SEQ ID NO: 35534 - DNA, 25 bp, Homo sapien
ttcaggcgcagaacttgatctccag

SEQ ID NO: 35535 - DNA, 25 bp, Homo sapien
cctcttggcctctaatttgtttatc

SEQ ID NO: 35536 - DNA, 25 bp, Homo sapien
cttggcctctaatttgtttatcttt

SEQ ID NO: 35537 - DNA, 25 bp, Homo sapien
gcctctaatttgtttatcttttgtg

SEQ ID NO: 35538 - DNA, 25 bp, Homo sapien
ttatcttttgtgtataaatcccaaa

SEQ ID NO: 35539 - DNA, 25 bp, Homo sapien
ttgaattttggaatatttccaccat

SEQ ID NO: 35540 - DNA, 25 bp, Homo sapien
ccagacctctttaagtcacactctt

SEQ ID NO: 35541 - DNA, 25 bp, Homo sapien
gtcacactcttaacttagctttctc

SEQ ID NO: 35542 - DNA, 25 bp, Homo sapien
ttagctttctctgatgtctgttgcc

SEQ ID NO: 35543 - DNA, 25 bp, Homo sapien
gtctgttgccgccattagttttttt

SEQ ID NO: 35544 - DNA, 25 bp, Homo sapien
tgttgccgccattagtttttttcta

SEQ ID NO: 35545 - DNA, 25 bp, Homo sapien
acatagctccatcccatacgggtag

SEQ ID NO: 35546 - DNA, 25 bp, Homo sapien
ctccatcccatacgggtagctggct

SEQ ID NO: 35547 - DNA, 25 bp, Homo sapien
tagcctgagaccttcctaggggctg

SEQ ID NO: 35548 - DNA, 25 bp, Homo sapien
gagccctgtggaggacgttgggagt

SEQ ID NO: 35549 - DNA, 25 bp, Homo sapien
gttgggagtaacgctgctttgcttt

SEQ ID NO: 35550 - DNA, 25 bp, Homo sapien
gctttgctttggcaggttgaagggg

SEQ ID NO: 35551 - DNA, 25 bp, Homo sapien
ggccaagcttctggggtttggctct

SEQ ID NO: 35552 - DNA, 25 bp, Homo sapien
ggcggggttcatccagactaaagcc

SEQ ID NO: 35553 - DNA, 25 bp, Homo sapien
atccagactaaagccctgcaggtgg

SEQ ID NO: 35554 - DNA, 25 bp, Homo sapien
gcaggtgggctttaaaatatcggct

SEQ ID NO: 35555 - DNA, 25 bp, Homo sapien
aaatatcggctggagcccaatgccc

SEQ ID NO: 35556 - DNA, 25 bp, Homo sapien
ggttacagtgtagactccagggttt

SEQ ID NO: 35557 - DNA, 25 bp, Homo sapien
agactccagggtttgggggatgcct

SEQ ID NO: 35558 - DNA, 25 bp, Homo sapien
tttcccccccaagcacagaggggag

SEQ ID NO: 35559 - DNA, 25 bp, Homo sapien
gcacagaggggagaggggccaggga

SEQ ID NO: 35560 - DNA, 25 bp, Homo sapien
ggccagggaagtggatgtctcctcc

SEQ ID NO: 35561 - DNA, 25 bp, Homo sapien
cctccccatccaggggctgtgtatt

SEQ ID NO: 35562 - DNA, 25 bp, Homo sapien
gacacacgaagggccgatcgggggc

SEQ ID NO: 35563 - DNA, 25 bp, Homo sapien
gcttcttctggtgggccaggagtct

SEQ ID NO: 35564 - DNA, 25 bp, Homo sapien
tcgtcgaaggtctggccacagatgg

SEQ ID NO: 35565 - DNA, 25 bp, Homo sapien
aaggtctggccacagatggcacagc

SEQ ID NO: 35566 - DNA, 25 bp, Homo sapien
tggctcttgcggtgggtgatgaggt

SEQ ID NO: 35567 - DNA, 25 bp, Homo sapien
gggtgatgaggttggacttctggct

SEQ ID NO: 35568 - DNA, 25 bp, Homo sapien
gaggttggacttctggctgaagctg

SEQ ID NO: 35569 - DNA, 25 bp, Homo sapien
ggctgaagctgcggtcgcagtcggg

SEQ ID NO: 35570 - DNA, 25 bp, Homo sapien
aagctgcggtcgcagtcgggacagg

SEQ ID NO: 35571 - DNA, 25 bp, Homo sapien
gcgacaccaggttggacttctggct

SEQ ID NO: 35572 - DNA, 25 bp, Homo sapien
gtagggtttgtggcggaaggccttg

SEQ ID NO: 35573 - DNA, 25 bp, Homo sapien
tgctttttaccctccagagctaaga

SEQ ID NO: 35574 - DNA, 25 bp, Homo sapien
taccctccagagctaagaggtagca

SEQ ID NO: 35575 - DNA, 25 bp, Homo sapien
gaggtagcagagtctcttgggatga

SEQ ID NO: 35576 - DNA, 25 bp, Homo sapien
gagtctcttgggatgagtgattcac

SEQ ID NO: 35577 - DNA, 25 bp, Homo sapien
gatgagtgattcaccctcttacttg

SEQ ID NO: 35578 - DNA, 25 bp, Homo sapien
cctcttacttggcgaccactgatga

SEQ ID NO: 35579 - DNA, 25 bp, Homo sapien
ggcgaccactgatgagatcaacaac

SEQ ID NO: 35580 - DNA, 25 bp, Homo sapien
ttggagcctaaattccctcatctat

SEQ ID NO: 35581 - DNA, 25 bp, Homo sapien
agcctaaattccctcatctataaaa

SEQ ID NO: 35582 - DNA, 25 bp, Homo sapien
gataatattatctacctcacaagct

SEQ ID NO: 35583 - DNA, 25 bp, Homo sapien
ttatctacctcacaagcttatgaaa

SEQ ID NO: 35584 - DNA, 25 bp, Homo sapien
aaatgaaatcacactaccagcaata

SEQ ID NO: 35585 - DNA, 25 bp, Homo sapien
atcacactaccagcaatagacagtt

SEQ ID NO: 35586 - DNA, 25 bp, Homo sapien
acaatagccagttccgtaaataact

SEQ ID NO: 35587 - DNA, 25 bp, Homo sapien
gtgttggtacactagcaatcacaaa

SEQ ID NO: 35588 - DNA, 25 bp, Homo sapien
tagcaatcacaaatatggtttcttt

SEQ ID NO: 35589 - DNA, 25 bp, Homo sapien
atcagtcataacatggcgaagtgtg

SEQ ID NO: 35590 - DNA, 25 bp, Homo sapien
aagtgtgtagttgctgtttctgaaa

SEQ ID NO: 35591 - DNA, 25 bp, Homo sapien
gtgatccaaactctacatccagaga

SEQ ID NO: 35592 - DNA, 25 bp, Homo sapien
tatgtttcaaatcaggtgtgtacca

SEQ ID NO: 35593 - DNA, 25 bp, Homo sapien
tgattttaatacgtgttttggtttg

SEQ ID NO: 35594 - DNA, 25 bp, Homo sapien
atctgcttctagatacagtgtgtaa

SEQ ID NO: 35595 - DNA, 25 bp, Homo sapien
aagtgatagacgtgacaaagcctga

SEQ ID NO: 35596 - DNA, 25 bp, Homo sapien
gatagacgtgacaaagcctgaagaa

SEQ ID NO: 35597 - DNA, 25 bp, Homo sapien
gacgtgacaaagcctgaagaatgaa

SEQ ID NO: 35598 - DNA, 25 bp, Homo sapien
gaaagtcagccaaagacgtggagaa

SEQ ID NO: 35599 - DNA, 25 bp, Homo sapien
cggccgcctactactactatacggc

SEQ ID NO: 35600 - DNA, 25 bp, Homo sapien
gggaaagtaaagggcttcaagcaat

SEQ ID NO: 35601 - DNA, 25 bp, Homo sapien
cctactactactatacggctgcgag

SEQ ID NO: 35602 - DNA, 25 bp, Homo sapien
atacggctgcgagaagacgacagaa

SEQ ID NO: 35603 - DNA, 25 bp, Homo sapien
gacagaaggggcaactaatccagga

SEQ ID NO: 35604 - DNA, 25 bp, Homo sapien
gaaggggcaactaatccaggattgg

SEQ ID NO: 35605 - DNA, 25 bp, Homo sapien
gattggggtcagggaagtagtcaga

SEQ ID NO: 35606 - DNA, 25 bp, Homo sapien
aaaataggcattgcatacacatatg

SEQ ID NO: 35607 - DNA, 25 bp, Homo sapien
gcacacgtatgtgcacgtgccacac

SEQ ID NO: 35608 - DNA, 25 bp, Homo sapien
tgtgcacgtgccacacattttttgt

SEQ ID NO: 35609 - DNA, 25 bp, Homo sapien
gcagtggttggcttttttgaattga

SEQ ID NO: 35610 - DNA, 25 bp, Homo sapien
gaattgaaatttttgcgcattgatg

SEQ ID NO: 35611 - DNA, 25 bp, Homo sapien
tgcgcattgatgcattgaaataagg

SEQ ID NO: 35612 - DNA, 25 bp, Homo sapien
tatttatctctgagcactaaactta

SEQ ID NO: 35613 - DNA, 25 bp, Homo sapien
ttatctctgagcactaaacttattt

SEQ ID NO: 35614 - DNA, 25 bp, Homo sapien
gaattactgtcagaattacatacac

SEQ ID NO: 35615 - DNA, 25 bp, Homo sapien
catacacaattacaacaaacttttt

SEQ ID NO: 35616 - DNA, 25 bp, Homo sapien
gcattttaatatgttgagccactgg

SEQ ID NO: 35617 - DNA, 25 bp, Homo sapien
gtccaatgcgggggcactgcagaac

SEQ ID NO: 35618 - DNA, 25 bp, Homo sapien
tcagagctaaaatgccttcaccctt

SEQ ID NO: 35619 - DNA, 25 bp, Homo sapien
cgttttcctcccagctgaggtgaag

SEQ ID NO: 35620 - DNA, 25 bp, Homo sapien
ggacggagcatgatcacgtcctccc

SEQ ID NO: 35621 - DNA, 25 bp, Homo sapien
gagagggctgtatcatacctaccac

SEQ ID NO: 35622 - DNA, 25 bp, Homo sapien
tctgtctccaatctcattacccaga

SEQ ID NO: 35623 - DNA, 25 bp, Homo sapien
cccagaagtctcctagagctgctgc

SEQ ID NO: 35624 - DNA, 25 bp, Homo sapien
tctggggcactgtcatcggtgtagt

SEQ ID NO: 35625 - DNA, 25 bp, Homo sapien
tgagcctatgtttaccatcgtctac

SEQ ID NO: 35626 - DNA, 25 bp, Homo sapien
tggcagggctgcaccagtggaagac

SEQ ID NO: 35627 - DNA, 25 bp, Homo sapien
tccacccagtgtctgcagacttttg

SEQ ID NO: 35628 - DNA, 25 bp, Homo sapien
gataccagccagtaaggagcttctc

SEQ ID NO: 35629 - DNA, 25 bp, Homo sapien
ggagcttctcaattcctttgatttg

SEQ ID NO: 35630 - DNA, 25 bp, Homo sapien
aattcctttgatttgtcaattcctg

SEQ ID NO: 35631 - DNA, 25 bp, Homo sapien
tccaacctgtgaaagaaacgtgaat

SEQ ID NO: 35632 - DNA, 25 bp, Homo sapien
gaaacgtgaatgtaaaagagaccta

SEQ ID NO: 35633 - DNA, 25 bp, Homo sapien
tttattctctagttgatcagctata

SEQ ID NO: 35634 - DNA, 25 bp, Homo sapien
acataggcatgtttgtactaatgaa

SEQ ID NO: 35635 - DNA, 25 bp, Homo sapien
tgaaacgtactgtcaacctctatca

SEQ ID NO: 35636 - DNA, 25 bp, Homo sapien
gtactgtcaacctctatcacattgt

SEQ ID NO: 35637 - DNA, 25 bp, Homo sapien
tgtcaacctctatcacattgttaaa

SEQ ID NO: 35638 - DNA, 25 bp, Homo sapien
ttaacacttttggtggtaactcaat

SEQ ID NO: 35639 - DNA, 25 bp, Homo sapien
acatctgcattggacaactccaccc

SEQ ID NO: 35640 - DNA, 25 bp, Homo sapien
ggcttgggccgtgacttaggcagag

SEQ ID NO: 35641 - DNA, 25 bp, Homo sapien
cagaggagggtctggcaggggctgc

SEQ ID NO: 35642 - DNA, 25 bp, Homo sapien
ccctctctgctcttttattgcaggc

SEQ ID NO: 35643 - DNA, 25 bp, Homo sapien
ggggccagaccacatgggagtgggc

SEQ ID NO: 35644 - DNA, 25 bp, Homo sapien
gcctggggatgggatcaccttccag

SEQ ID NO: 35645 - DNA, 25 bp, Homo sapien
caccttccagaccacagcagatgtg

SEQ ID NO: 35646 - DNA, 25 bp, Homo sapien
agcagatgtgggacacacagcctcc

SEQ ID NO: 35647 - DNA, 25 bp, Homo sapien
cacagcctcctgactccaggaagag

SEQ ID NO: 35648 - DNA, 25 bp, Homo sapien
cccccacacctagactcagtaagga

SEQ ID NO: 35649 - DNA, 25 bp, Homo sapien
gtcgggttggaccttaacatctgca

SEQ ID NO: 35650 - DNA, 25 bp, Homo sapien
aggagggagacgcaggtggacttgg

SEQ ID NO: 35651 - DNA, 25 bp, Homo sapien
gctggcacctgcggcaggtaccagc

SEQ ID NO: 35652 - DNA, 25 bp, Homo sapien
ggcagtgcttgaatgccacaggctg

SEQ ID NO: 35653 - DNA, 25 bp, Homo sapien
gccaccaggtacgacgaccaggtac

SEQ ID NO: 35654 - DNA, 25 bp, Homo sapien
gaccaggtaccagaaaccaccaggc

SEQ ID NO: 35655 - DNA, 25 bp, Homo sapien
gggcagaaagccagcgtccatgccc

SEQ ID NO: 35656 - DNA, 25 bp, Homo sapien
cagcatggggggttggttctttggg

SEQ ID NO: 35657 - DNA, 25 bp, Homo sapien
gatttgtaaagtgatgttcctcttc

SEQ ID NO: 35658 - DNA, 25 bp, Homo sapien
tcttccttttttacacttttcagct

SEQ ID NO: 35659 - DNA, 25 bp, Homo sapien
gctcatatttaacctctgtttggaa

SEQ ID NO: 35660 - DNA, 25 bp, Homo sapien
actgtacatttttttgcttcctaat

SEQ ID NO: 35661 - DNA, 25 bp, Homo sapien
tccagcacaaggggtctccagtgtg

SEQ ID NO: 35662 - DNA, 25 bp, Homo sapien
cacaaggggtctccagtgtggacgt

SEQ ID NO: 35663 - DNA, 25 bp, Homo sapien
gtggacgtggcctgaccagggccac

SEQ ID NO: 35664 - DNA, 25 bp, Homo sapien
gcctgaccagggccactggaaactg

SEQ ID NO: 35665 - DNA, 25 bp, Homo sapien
tggaaactgtcccaggaacgatgga

SEQ ID NO: 35666 - DNA, 25 bp, Homo sapien
ggaacgatggactcacgcttttgtc

SEQ ID NO: 35667 - DNA, 25 bp, Homo sapien
actcacgcttttgtccttaaactga

SEQ ID NO: 35668 - DNA, 25 bp, Homo sapien
actgacttaccatccgaggagttcc

SEQ ID NO: 35669 - DNA, 25 bp, Homo sapien
cttaccatccgaggagttcccatga

SEQ ID NO: 35670 - DNA, 25 bp, Homo sapien
gccaaaacagcgaatgtccatcaac

SEQ ID NO: 35671 - DNA, 25 bp, Homo sapien
gggaacagaattccatggtctcaat

SEQ ID NO: 35672 - DNA, 25 bp, Homo sapien
ggggaaggaggacacaacctcaaga

SEQ ID NO: 35673 - DNA, 25 bp, Homo sapien
gacacaacctcaagaaaggaagcgt

SEQ ID NO: 35674 - DNA, 25 bp, Homo sapien
gcgtgaaccccagggaacagcgggt

SEQ ID NO: 35675 - DNA, 25 bp, Homo sapien
acagacaatgacagctgatatttat

SEQ ID NO: 35676 - DNA, 25 bp, Homo sapien
atttgcaccatgccaagcattcggc

SEQ ID NO: 35677 - DNA, 25 bp, Homo sapien
agcattcggcttggattatcccatt

SEQ ID NO: 35678 - DNA, 25 bp, Homo sapien
tggattatcccatttgtttctcaca

SEQ ID NO: 35679 - DNA, 25 bp, Homo sapien
ccccattgccaacagggccagggca

SEQ ID NO: 35680 - DNA, 25 bp, Homo sapien
gggccagggcaagagtacacacagg

SEQ ID NO: 35681 - DNA, 25 bp, Homo sapien
agggcaagagtacacacaggggcct

SEQ ID NO: 35682 - DNA, 25 bp, Homo sapien
tatcaatcaagctaacaactgttaa

SEQ ID NO: 35683 - DNA, 25 bp, Homo sapien
attcgagaggcacaggtttagtgat

SEQ ID NO: 35684 - DNA, 25 bp, Homo sapien
ttccttctctatgggtccaatcaca

SEQ ID NO: 35685 - DNA, 25 bp, Homo sapien
caatcacactacttggttctgcagt

SEQ ID NO: 35686 - DNA, 25 bp, Homo sapien
aatattttcataatcctaacattgt

SEQ ID NO: 35687 - DNA, 25 bp, Homo sapien
taaatgctgtttattggttttcaat

SEQ ID NO: 35688 - DNA, 25 bp, Homo sapien
ttgaagcagaggttactattttatt

SEQ ID NO: 35689 - DNA, 25 bp, Homo sapien
cttatatcagtattgcagcattcac

SEQ ID NO: 35690 - DNA, 25 bp, Homo sapien
gtattgcagcattcactgtagtgat

SEQ ID NO: 35691 - DNA, 25 bp, Homo sapien
agttaggaacatagccaattaggac

SEQ ID NO: 35692 - DNA, 25 bp, Homo sapien
gaaatttgggtcttttacaagctga

SEQ ID NO: 35693 - DNA, 25 bp, Homo sapien
caagctgatgattgttgcattttgg

SEQ ID NO: 35694 - DNA, 25 bp, Homo sapien
actcaggtggattcataatttgttc

SEQ ID NO: 35695 - DNA, 25 bp, Homo sapien
ggttgtatttcttaggatatttgca

SEQ ID NO: 35696 - DNA, 25 bp, Homo sapien
attgtctataattctactactcata

SEQ ID NO: 35697 - DNA, 25 bp, Homo sapien
aaaaccactattcacatatgtgtac

SEQ ID NO: 35698 - DNA, 25 bp, Homo sapien
tatgtgtactttcctctattaacct

SEQ ID NO: 35699 - DNA, 25 bp, Homo sapien
aacctttcaaagcatgcctcaattt

SEQ ID NO: 35700 - DNA, 25 bp, Homo sapien
atgctattagcatcaccaatgtcaa

SEQ ID NO: 35701 - DNA, 25 bp, Homo sapien
accaatgtcaatataaactccttgt

SEQ ID NO: 35702 - DNA, 25 bp, Homo sapien
acatcaactggatatgccatggctt

SEQ ID NO: 35703 - DNA, 25 bp, Homo sapien
gccatggcttatttaatcactgtat

SEQ ID NO: 35704 - DNA, 25 bp, Homo sapien
aaaccacgctgcaataaatatcttt

SEQ ID NO: 35705 - DNA, 25 bp, Homo sapien
atgctgtgagtttccaacctcagcc

SEQ ID NO: 35706 - DNA, 25 bp, Homo sapien
ctcagcccatctgcgggcagagaag

SEQ ID NO: 35707 - DNA, 25 bp, Homo sapien
gctgtctggctcagtgatctacatt

SEQ ID NO: 35708 - DNA, 25 bp, Homo sapien
ggtctaggagatctgtcccttttag

SEQ ID NO: 35709 - DNA, 25 bp, Homo sapien
tcccttttagagacaccttacttat

SEQ ID NO: 35710 - DNA, 25 bp, Homo sapien
tttatcatttattaatcctccctgc

SEQ ID NO: 35711 - DNA, 25 bp, Homo sapien
tccctgcctgtgtctattattatat

SEQ ID NO: 35712 - DNA, 25 bp, Homo sapien
tatattcatatctctacgctgcaaa

SEQ ID NO: 35713 - DNA, 25 bp, Homo sapien
tttactgtgcctttgtttttactag

SEQ ID NO: 35714 - DNA, 25 bp, Homo sapien
gtttttactagtgtctgctgttgca

SEQ ID NO: 35715 - DNA, 25 bp, Homo sapien
aacattctttgcctgagttttaatt

SEQ ID NO: 35716 - DNA, 25 bp, Homo sapien
tcactcccttgatacagcccaagat

SEQ ID NO: 35717 - DNA, 25 bp, Homo sapien
gaaatactgccatcgagggctcaga

SEQ ID NO: 35718 - DNA, 25 bp, Homo sapien
gaatgttattccctgaagcgcagcg

SEQ ID NO: 35719 - DNA, 25 bp, Homo sapien
agcgcagcgcttggaaagcacgggc

SEQ ID NO: 35720 - DNA, 25 bp, Homo sapien
agttggcagacatagaccctactct

SEQ ID NO: 35721 - DNA, 25 bp, Homo sapien
agctctccatctcacactttaagag

SEQ ID NO: 35722 - DNA, 25 bp, Homo sapien
gaagacccacaactctttgcatata

SEQ ID NO: 35723 - DNA, 25 bp, Homo sapien
aattacagactctagctgctgcctg

SEQ ID NO: 35724 - DNA, 25 bp, Homo sapien
cagcctaccagatgtcgatttgcac

SEQ ID NO: 35725 - DNA, 25 bp, Homo sapien
ttgcactacgtggagcttcttatat

SEQ ID NO: 35726 - DNA, 25 bp, Homo sapien
gatgtgacttattttccttttacta

SEQ ID NO: 35727 - DNA, 25 bp, Homo sapien
gttcaaccatgttttcagaggccgc

SEQ ID NO: 35728 - DNA, 25 bp, Homo sapien
tgttttcagaggccgcactgcatga

SEQ ID NO: 35729 - DNA, 25 bp, Homo sapien
gaggccgcactgcatgaatgcggga

SEQ ID NO: 35730 - DNA, 25 bp, Homo sapien
gatgatcactaatcaataatctgat

SEQ ID NO: 35731 - DNA, 25 bp, Homo sapien
tatggacaggccacttatgctcagt

SEQ ID NO: 35732 - DNA, 25 bp, Homo sapien
gccacttatgctcagttttacctta

SEQ ID NO: 35733 - DNA, 25 bp, Homo sapien
ccttagttattccttggtatccaca

SEQ ID NO: 35734 - DNA, 25 bp, Homo sapien
tagttattccttggtatccacaggc

SEQ ID NO: 35735 - DNA, 25 bp, Homo sapien
aataccctcatatttccatataatc

SEQ ID NO: 35736 - DNA, 25 bp, Homo sapien
atataatctacatacattctcccat

SEQ ID NO: 35737 - DNA, 25 bp, Homo sapien
tacatacattctcccatatacttta

SEQ ID NO: 35738 - DNA, 25 bp, Homo sapien
gtcccccaggatgtcttgtggtggc

SEQ ID NO: 35739 - DNA, 25 bp, Homo sapien
ggcactggctagggaggggcaggcc

SEQ ID NO: 35740 - DNA, 25 bp, Homo sapien
cttgggagatgcattttccgtctgg

SEQ ID NO: 35741 - DNA, 25 bp, Homo sapien
ctgcccaggccactgtgagggtggg

SEQ ID NO: 35742 - DNA, 25 bp, Homo sapien
tgctggctgagcccctggggcagaa

SEQ ID NO: 35743 - DNA, 25 bp, Homo sapien
ctcccacagcagagccaggtgaggg

SEQ ID NO: 35744 - DNA, 25 bp, Homo sapien
gacagaagtggggcggcctgaaccc

SEQ ID NO: 35745 - DNA, 25 bp, Homo sapien
ggaacccggcaggggtgtctgaggc

SEQ ID NO: 35746 - DNA, 25 bp, Homo sapien
cggtccaagcctgtggctggagctg

SEQ ID NO: 35747 - DNA, 25 bp, Homo sapien
ggctggagctggtgtgtgtttatct

SEQ ID NO: 35748 - DNA, 25 bp, Homo sapien
cggcccctgcacatttaggatatgc

SEQ ID NO: 35749 - DNA, 25 bp, Homo sapien
cacattggctgttacggcttcaatg

SEQ ID NO: 35750 - DNA, 25 bp, Homo sapien
acggcttcaatgtaggggatggggc

SEQ ID NO: 35751 - DNA, 25 bp, Homo sapien
gtccataacgaatactgattcctca

SEQ ID NO: 35752 - DNA, 25 bp, Homo sapien
aacatagttaactgagcccccaaag

SEQ ID NO: 35753 - DNA, 25 bp, Homo sapien
tatttgaatagatgcagtgaccaca

SEQ ID NO: 35754 - DNA, 25 bp, Homo sapien
ccctcaaatcaacacattacagtta

SEQ ID NO: 35755 - DNA, 25 bp, Homo sapien
acattacagttagatgtctcccatc

SEQ ID NO: 35756 - DNA, 25 bp, Homo sapien
gatgtctcccatctgaaattggata

SEQ ID NO: 35757 - DNA, 25 bp, Homo sapien
ttggatagcccactgaaattgaaca

SEQ ID NO: 35758 - DNA, 25 bp, Homo sapien
gaaattgaacatgccttctcttata

SEQ ID NO: 35759 - DNA, 25 bp, Homo sapien
ggaggatcctttgtgctcaagagtt

SEQ ID NO: 35760 - DNA, 25 bp, Homo sapien
acacattgggtatcttgtgcccaag

SEQ ID NO: 35761 - DNA, 25 bp, Homo sapien
ttgggtatcttgtgcccaaggcctg

SEQ ID NO: 35762 - DNA, 25 bp, Homo sapien
ccaaggcctgtatttgtggagctga

SEQ ID NO: 35763 - DNA, 25 bp, Homo sapien
ggcctgtatttgtggagctgatgtt

SEQ ID NO: 35764 - DNA, 25 bp, Homo sapien
ctgtatttgtggagctgatgttcta

SEQ ID NO: 35765 - DNA, 25 bp, Homo sapien
gctgatgttctagtgagagacagta

SEQ ID NO: 35766 - DNA, 25 bp, Homo sapien
agcaacatagcaaaagcccttatct

SEQ ID NO: 35767 - DNA, 25 bp, Homo sapien
tagcaaaagcccttatctgcaaaaa

SEQ ID NO: 35768 - DNA, 25 bp, Homo sapien
gcttggttcatggagaccctgtttt

SEQ ID NO: 35769 - DNA, 25 bp, Homo sapien
gtgtttacaccagcaaaatactcat

SEQ ID NO: 35770 - DNA, 25 bp, Homo sapien
atcatacttagcaaatctaacacat

SEQ ID NO: 35771 - DNA, 25 bp, Homo sapien
gcagaagcctgcagtggctgctgct

SEQ ID NO: 35772 - DNA, 25 bp, Homo sapien
ctccctcacgtggggaaagcacagc

SEQ ID NO: 35773 - DNA, 25 bp, Homo sapien
gcacagcagggatgcgcggcaagaa

SEQ ID NO: 35774 - DNA, 25 bp, Homo sapien
tgcgcggcaagaatgtacctgtaga

SEQ ID NO: 35775 - DNA, 25 bp, Homo sapien
gtacctgtagatgtgtacataccac

SEQ ID NO: 35776 - DNA, 25 bp, Homo sapien
agacgatttgagaaccgagaagggg

SEQ ID NO: 35777 - DNA, 25 bp, Homo sapien
tgtgtacataccacagtgctgtaat

SEQ ID NO: 35778 - DNA, 25 bp, Homo sapien
aaaacagcacaccactgcttctttt

SEQ ID NO: 35779 - DNA, 25 bp, Homo sapien
gcacaccactgcttcttttgaaaat

SEQ ID NO: 35780 - DNA, 25 bp, Homo sapien
aggggagtgggaaggccgagtgtca

SEQ ID NO: 35781 - DNA, 25 bp, Homo sapien
ggaaggccgagtgtcagagctggag

SEQ ID NO: 35782 - DNA, 25 bp, Homo sapien
agcattcgttttttacctgtttgtg

SEQ ID NO: 35783 - DNA, 25 bp, Homo sapien
aaacttctaggtaatttgccacgct

SEQ ID NO: 35784 - DNA, 25 bp, Homo sapien
taatttgccacgctttttgactgct

SEQ ID NO: 35785 - DNA, 25 bp, Homo sapien
ctgctcaccaataccctgtaaaaat

SEQ ID NO: 35786 - DNA, 25 bp, Homo sapien
aatacgtaattcttcctgtttgtgt

SEQ ID NO: 35787 - DNA, 25 bp, Homo sapien
tagtccatcagatgttcccgtgtgc

SEQ ID NO: 35788 - DNA, 25 bp, Homo sapien
gcctcttttatgccaaattgattgt

SEQ ID NO: 35789 - DNA, 25 bp, Homo sapien
gggaccaagtagtttgcccatggca

SEQ ID NO: 35790 - DNA, 25 bp, Homo sapien
aatttatgacctgctgaggcctctc

SEQ ID NO: 35791 - DNA, 25 bp, Homo sapien
gacctgctgaggcctctcagaaaac

SEQ ID NO: 35792 - DNA, 25 bp, Homo sapien
aactgagcatactagcaagacagct

SEQ ID NO: 35793 - DNA, 25 bp, Homo sapien
ctcaatcccatgaattattaaattt

SEQ ID NO: 35794 - DNA, 25 bp, Homo sapien
tgtactttatgggaagttgcctatt

SEQ ID NO: 35795 - DNA, 25 bp, Homo sapien
gatgtggttaagtgagtcctctggt

SEQ ID NO: 35796 - DNA, 25 bp, Homo sapien
gtggttaagtgagtcctctggtgca

SEQ ID NO: 35797 - DNA, 25 bp, Homo sapien
ggtgcagtgacatccttttaagcca

SEQ ID NO: 35798 - DNA, 25 bp, Homo sapien
cataaacctattacaaactacccag

SEQ ID NO: 35799 - DNA, 25 bp, Homo sapien
aaactacccaggcagaggcatttac

SEQ ID NO: 35800 - DNA, 25 bp, Homo sapien
cccaggcagaggcatttacttaatt

SEQ ID NO: 35801 - DNA, 25 bp, Homo sapien
tagtgcaattaaaaccctgaaaaca

SEQ ID NO: 35802 - DNA, 25 bp, Homo sapien
acatgatccttgttgactctgcttg

SEQ ID NO: 35803 - DNA, 25 bp, Homo sapien
tccttgttgactctgcttggttgaa

SEQ ID NO: 35804 - DNA, 25 bp, Homo sapien
ctccgtttcctgcttaagtgcattc

SEQ ID NO: 35805 - DNA, 25 bp, Homo sapien
tcaggatctcggggactggcctgga

SEQ ID NO: 35806 - DNA, 25 bp, Homo sapien
atctctccagctatctagggttttg

SEQ ID NO: 35807 - DNA, 25 bp, Homo sapien
accagaacgcagcagtctgcacctc

SEQ ID NO: 35808 - DNA, 25 bp, Homo sapien
tctgcacctctgtagaaggccacac

SEQ ID NO: 35809 - DNA, 25 bp, Homo sapien
agagactggaaccgttcctgtcctg

SEQ ID NO: 35810 - DNA, 25 bp, Homo sapien
ctgtgtcccatatctgcattgtgac

SEQ ID NO: 35811 - DNA, 25 bp, Homo sapien
gcattgtgactagcctgtcatccac

SEQ ID NO: 35812 - DNA, 25 bp, Homo sapien
gtcagctcctattgtggctttgtac

SEQ ID NO: 35813 - DNA, 25 bp, Homo sapien
ggttcatgagtgatgtcttcccgac

SEQ ID NO: 35814 - DNA, 25 bp, Homo sapien
cgactccagaatctcccaggatgat

SEQ ID NO: 35815 - DNA, 25 bp, Homo sapien
attctttgttaacatgagagtccca

SEQ ID NO: 35816 - DNA, 25 bp, Homo sapien
tgagagtcccatgtctgaaaaccaa

SEQ ID NO: 35817 - DNA, 25 bp, Homo sapien
aaaaccaaagtccaatttctgtctg

SEQ ID NO: 35818 - DNA, 25 bp, Homo sapien
aaagtccaatttctgtctggccttt

SEQ ID NO: 35819 - DNA, 25 bp, Homo sapien
ttttgtctcatccttcttggcaaaa

SEQ ID NO: 35820 - DNA, 25 bp, Homo sapien
gtctcatccttcttggcaaaagtag

SEQ ID NO: 35821 - DNA, 25 bp, Homo sapien
atccttcttggcaaaagtagctttt

SEQ ID NO: 35822 - DNA, 25 bp, Homo sapien
gtattaatgtgcttgacaccatgac

SEQ ID NO: 35823 - DNA, 25 bp, Homo sapien
tgtgcttgacaccatgactgaaata

SEQ ID NO: 35824 - DNA, 25 bp, Homo sapien
gcttgacaccatgactgaaatacta

SEQ ID NO: 35825 - DNA, 25 bp, Homo sapien
gaaatactatgatcttgtttgtcaa

SEQ ID NO: 35826 - DNA, 25 bp, Homo sapien
taaaagtagctcacatttaatttct

SEQ ID NO: 35827 - DNA, 25 bp, Homo sapien
ttatgtgaatttgcattccagtata

SEQ ID NO: 35828 - DNA, 25 bp, Homo sapien
gcattccagtataaatagtattcac

SEQ ID NO: 35829 - DNA, 25 bp, Homo sapien
gaataggtgtcaatatggcatgcat

SEQ ID NO: 35830 - DNA, 25 bp, Homo sapien
atggcatgcatattgtaactttcat

SEQ ID NO: 35831 - DNA, 25 bp, Homo sapien
aattttggaatacagcctatctcat

SEQ ID NO: 35832 - DNA, 25 bp, Homo sapien
tacagcctatctcatgaccatattg

SEQ ID NO: 35833 - DNA, 25 bp, Homo sapien
gaaatgtacggaatttgatccatgc

SEQ ID NO: 35834 - DNA, 25 bp, Homo sapien
tgatccatgcgatactatgtgtgca

SEQ ID NO: 35835 - DNA, 25 bp, Homo sapien
gcgatactatgtgtgcattatttga

SEQ ID NO: 35836 - DNA, 25 bp, Homo sapien
ttttattcaaaccgtggaacaaatg

SEQ ID NO: 35837 - DNA, 25 bp, Homo sapien
ctagacccccacgtttggagattca

SEQ ID NO: 35838 - DNA, 25 bp, Homo sapien
gattcaaaacttctgtcttcgtcct

SEQ ID NO: 35839 - DNA, 25 bp, Homo sapien
tatacttttcctcagaggagcaggc

SEQ ID NO: 35840 - DNA, 25 bp, Homo sapien
tcctcagaggagcaggcaacagtgt

SEQ ID NO: 35841 - DNA, 25 bp, Homo sapien
gtgtgggataaacagagtcacgatc

SEQ ID NO: 35842 - DNA, 25 bp, Homo sapien
agagtcacgatcagaggaaccccag

SEQ ID NO: 35843 - DNA, 25 bp, Homo sapien
ggaaccccagggtctggtgatggca

SEQ ID NO: 35844 - DNA, 25 bp, Homo sapien
ccccagggtctggtgatggcaggga

SEQ ID NO: 35845 - DNA, 25 bp, Homo sapien
cagggtctggtgatggcagggatgg

SEQ ID NO: 35846 - DNA, 25 bp, Homo sapien
gaaaatccacaaattccaatgtcac

SEQ ID NO: 35847 - DNA, 25 bp, Homo sapien
aatccacaaattccaatgtcacaaa

SEQ ID NO: 35848 - DNA, 25 bp, Homo sapien
taggtctagctgtgttttgcatcaa

SEQ ID NO: 35849 - DNA, 25 bp, Homo sapien
gtctgggatggcagctcattatcaa

SEQ ID NO: 35850 - DNA, 25 bp, Homo sapien
agctcattatcaaatatactcctat

SEQ ID NO: 35851 - DNA, 25 bp, Homo sapien
atactcctatttttgtggtgattta

SEQ ID NO: 35852 - DNA, 25 bp, Homo sapien
ggtgatttatgaacatccccactaa

SEQ ID NO: 35853 - DNA, 25 bp, Homo sapien
gaacatccccactaagtataactaa

SEQ ID NO: 35854 - DNA, 25 bp, Homo sapien
aagagcctcagatcaagtttggtca

SEQ ID NO: 35855 - DNA, 25 bp, Homo sapien
agtttggtcaggttttgtcaccaag

SEQ ID NO: 35856 - DNA, 25 bp, Homo sapien
agaaattgtgtctctgtcctttttt

SEQ ID NO: 35857 - DNA, 25 bp, Homo sapien
tatttttcctctttgcagaatgggc

SEQ ID NO: 35858 - DNA, 25 bp, Homo sapien
cagtttggggtagtactgctttgca

SEQ ID NO: 35859 - DNA, 25 bp, Homo sapien
tgttttccgcctagcgacaagggat

SEQ ID NO: 35860 - DNA, 25 bp, Homo sapien
ctagcgacaagggatttgctcgcac

SEQ ID NO: 35861 - DNA, 25 bp, Homo sapien
ccctagtcgctggacagctcttttt

SEQ ID NO: 35862 - DNA, 25 bp, Homo sapien
tcgctggacagctctttttttgatt

SEQ ID NO: 35863 - DNA, 25 bp, Homo sapien
gattggctcaaatcctgtaaagggc

SEQ ID NO: 35864 - DNA, 25 bp, Homo sapien
gtaaagggcttgaccagtctctaca

SEQ ID NO: 35865 - DNA, 25 bp, Homo sapien
gaccagtctctacatagtcaccgtc

SEQ ID NO: 35866 - DNA, 25 bp, Homo sapien
gccttcaatttacgttctttacact

SEQ ID NO: 35867 - DNA, 25 bp, Homo sapien
tacactacggggactggggtcgtct

SEQ ID NO: 35868 - DNA, 25 bp, Homo sapien
cccacctccacaggtgccttaaagg

SEQ ID NO: 35869 - DNA, 25 bp, Homo sapien
ttgggaggggcgctctgagattaaa

SEQ ID NO: 35870 - DNA, 25 bp, Homo sapien
gactttcaccatcctgatattaaaa

SEQ ID NO: 35871 - DNA, 25 bp, Homo sapien
atattaaaactgtgcaggtgtccac

SEQ ID NO: 35872 - DNA, 25 bp, Homo sapien
ggtgtccacagtagatgcttttcag

SEQ ID NO: 35873 - DNA, 25 bp, Homo sapien
gaaaaggagatcattattctgtcct

SEQ ID NO: 35874 - DNA, 25 bp, Homo sapien
gaatgttgcattgactagaggaaag

SEQ ID NO: 35875 - DNA, 25 bp, Homo sapien
aagaggcatttgttgattgtgggaa

SEQ ID NO: 35876 - DNA, 25 bp, Homo sapien
gtgggaaatttagcctgtttgagga

SEQ ID NO: 35877 - DNA, 25 bp, Homo sapien
ggggacgagtgatccaacactgcga

SEQ ID NO: 35878 - DNA, 25 bp, Homo sapien
agggaagatggattgcaacatgcaa

SEQ ID NO: 35879 - DNA, 25 bp, Homo sapien
catgcaaaccagtatgaaccacagc

SEQ ID NO: 35880 - DNA, 25 bp, Homo sapien
gaaccatctccttaaagattatttt

SEQ ID NO: 35881 - DNA, 25 bp, Homo sapien
agatatgtatatcatctgccgccta

SEQ ID NO: 35882 - DNA, 25 bp, Homo sapien
atctgccgcctaaagccatattcat

SEQ ID NO: 35883 - DNA, 25 bp, Homo sapien
aagccatattcattcaccataaatt

SEQ ID NO: 35884 - DNA, 25 bp, Homo sapien
ggatggatctcaatgacctggcgaa

SEQ ID NO: 35885 - DNA, 25 bp, Homo sapien
ggcgaagactgaaaatacaactccc

SEQ ID NO: 35886 - DNA, 25 bp, Homo sapien
tacaactcccatcaccagcagagtt

SEQ ID NO: 35887 - DNA, 25 bp, Homo sapien
cagcagagttgctaggctgctgctg

SEQ ID NO: 35888 - DNA, 25 bp, Homo sapien
ttgacctgactgtggaagaacttcc

SEQ ID NO: 35889 - DNA, 25 bp, Homo sapien
gaacttccagcagtttacacaggac

SEQ ID NO: 35890 - DNA, 25 bp, Homo sapien
aaactctatcataaggaactgccag

SEQ ID NO: 35891 - DNA, 25 bp, Homo sapien
aacatctgactgtgattttctaatg

SEQ ID NO: 35892 - DNA, 25 bp, Homo sapien
cctccagtctgttctcacataacag

SEQ ID NO: 35893 - DNA, 25 bp, Homo sapien
cacataacagagtagttttggtttt

SEQ ID NO: 35894 - DNA, 25 bp, Homo sapien
ttgttttttaaggtgagttctcact

SEQ ID NO: 35895 - DNA, 25 bp, Homo sapien
gagttctcactatgtttctcagact

SEQ ID NO: 35896 - DNA, 25 bp, Homo sapien
gtttctcagactggtctcgaactcc

SEQ ID NO: 35897 - DNA, 25 bp, Homo sapien
ggtttcaccatgttagccgggatgg

SEQ ID NO: 35898 - DNA, 25 bp, Homo sapien
ccgcctcagcctctcaaatagctgg

SEQ ID NO: 35899 - DNA, 25 bp, Homo sapien
aatagctgggcttacaggcatgagc

SEQ ID NO: 35900 - DNA, 25 bp, Homo sapien
ccaccacacctggccaggatttggt

SEQ ID NO: 35901 - DNA, 25 bp, Homo sapien
cacctggccaggatttggttgttta

SEQ ID NO: 35902 - DNA, 25 bp, Homo sapien
ttagccgggatggtcttgatctcct

SEQ ID NO: 35903 - DNA, 25 bp, Homo sapien
actccaacctgggcaagaagagcaa

SEQ ID NO: 35904 - DNA, 25 bp, Homo sapien
aagaaataacaggccaggtgtggtg

SEQ ID NO: 35905 - DNA, 25 bp, Homo sapien
aaggcaagcagatcatttatggtca

SEQ ID NO: 35906 - DNA, 25 bp, Homo sapien
taatcccagctactgaggagggtga

SEQ ID NO: 35907 - DNA, 25 bp, Homo sapien
gagggtgaggtaggagaattgcttg

SEQ ID NO: 35908 - DNA, 25 bp, Homo sapien
tgggaggcggacgttgcagtaagct

SEQ ID NO: 35909 - DNA, 25 bp, Homo sapien
gcggacgttgcagtaagctgagatc

SEQ ID NO: 35910 - DNA, 25 bp, Homo sapien
cagcctgggacagaccaagactccg

SEQ ID NO: 35911 - DNA, 25 bp, Homo sapien
gaaataacacaggtacaagtcatca

SEQ ID NO: 35912 - DNA, 25 bp, Homo sapien
aacacaggtacaagtcatcaaaatc

SEQ ID NO: 35913 - DNA, 25 bp, Homo sapien
gtcatcaaaatcctgaattataatt

SEQ ID NO: 35914 - DNA, 25 bp, Homo sapien
cgcgctgcgggctggaaggagtcgc

SEQ ID NO: 35915 - DNA, 25 bp, Homo sapien
gcgctgcgggctggaaggagtcgcc

SEQ ID NO: 35916 - DNA, 25 bp, Homo sapien
cgctgcgggctggaaggagtcgccg

SEQ ID NO: 35917 - DNA, 25 bp, Homo sapien
ctgcgggctggaaggagtcgccgcc

SEQ ID NO: 35918 - DNA, 25 bp, Homo sapien
tccgtctccagcgggaacgaggacg

SEQ ID NO: 35919 - DNA, 25 bp, Homo sapien
ccgtctccagcgggaacgaggacga

SEQ ID NO: 35920 - DNA, 25 bp, Homo sapien
gtctccagcgggaacgaggacgagg

SEQ ID NO: 35921 - DNA, 25 bp, Homo sapien
tccagcgggaacgaggacgaggagc

SEQ ID NO: 35922 - DNA, 25 bp, Homo sapien
cgggaacgaggacgaggagcgccgc

SEQ ID NO: 35923 - DNA, 25 bp, Homo sapien
ttcctgagcgcctggaggccaaggg

SEQ ID NO: 35924 - DNA, 25 bp, Homo sapien
tgagtactgtccgggaacccggcgt

SEQ ID NO: 35925 - DNA, 25 bp, Homo sapien
actctgtcgccgagttttggagtgt

SEQ ID NO: 35926 - DNA, 25 bp, Homo sapien
gttttggagtgtattggcgcgatct

SEQ ID NO: 35927 - DNA, 25 bp, Homo sapien
gaactctaaacctgcgtgtgtggct

SEQ ID NO: 35928 - DNA, 25 bp, Homo sapien
agcgtcacctcaggtctggggaagt

SEQ ID NO: 35929 - DNA, 25 bp, Homo sapien
gtcacctcaggtctggggaagtctg

SEQ ID NO: 35930 - DNA, 25 bp, Homo sapien
tcaggtctggggaagtctgtgctgg

SEQ ID NO: 35931 - DNA, 25 bp, Homo sapien
ttcgggccagaaagactctcgttct

SEQ ID NO: 35932 - DNA, 25 bp, Homo sapien
ggccagaaagactctcgttctttct

SEQ ID NO: 35933 - DNA, 25 bp, Homo sapien
cgttctttctagatggtgggatcag

SEQ ID NO: 35934 - DNA, 25 bp, Homo sapien
ttctagatggtgggatcaggggcct

SEQ ID NO: 35935 - DNA, 25 bp, Homo sapien
gttgtctattttgataatgtattat

SEQ ID NO: 35936 - DNA, 25 bp, Homo sapien
ggtgaggcaactgagactcaaaggt

SEQ ID NO: 35937 - DNA, 25 bp, Homo sapien
attagtagcagagccctgactggga

SEQ ID NO: 35938 - DNA, 25 bp, Homo sapien
gccctgactgggacatagtttgaag

SEQ ID NO: 35939 - DNA, 25 bp, Homo sapien
aaacttcaccaagctacctttcttg

SEQ ID NO: 35940 - DNA, 25 bp, Homo sapien
tcaccaagctacctttcttgaaagg

SEQ ID NO: 35941 - DNA, 25 bp, Homo sapien
cttgaaaggtccaaatgtttatgtt

SEQ ID NO: 35942 - DNA, 25 bp, Homo sapien
tatgttttcaactactctttccact

SEQ ID NO: 35943 - DNA, 25 bp, Homo sapien
ccataactttcactacatattaaat

SEQ ID NO: 35944 - DNA, 25 bp, Homo sapien
aataggacaatcatcaatgcatata

SEQ ID NO: 35945 - DNA, 25 bp, Homo sapien
caatgcatatatagccagcccttca

SEQ ID NO: 35946 - DNA, 25 bp, Homo sapien
catatatagccagcccttcatatct

SEQ ID NO: 35947 - DNA, 25 bp, Homo sapien
cctcttggcagcgcaacgaactgac

SEQ ID NO: 35948 - DNA, 25 bp, Homo sapien
ttggcagcgcaacgaactgaccgac

SEQ ID NO: 35949 - DNA, 25 bp, Homo sapien
cgcttcctgcagctcaataagtgcc

SEQ ID NO: 35950 - DNA, 25 bp, Homo sapien
tcctgcagctcaataagtgcccggc

SEQ ID NO: 35951 - DNA, 25 bp, Homo sapien
cgtgcttcggcacgagctggtgccg

SEQ ID NO: 35952 - DNA, 25 bp, Homo sapien
gcttcctcaacgggcaggtggtatt

SEQ ID NO: 35953 - DNA, 25 bp, Homo sapien
tcctcaacgggcaggtggtattcga

SEQ ID NO: 35954 - DNA, 25 bp, Homo sapien
tcaacgggcaggtggtattcgaggc

SEQ ID NO: 35955 - DNA, 25 bp, Homo sapien
acgggcaggtggtattcgaggcgtg

SEQ ID NO: 35956 - DNA, 25 bp, Homo sapien
ggcaggtggtattcgaggcgtgggg

SEQ ID NO: 35957 - DNA, 25 bp, Homo sapien
caggtggtattcgaggcgtggggcc

SEQ ID NO: 35958 - DNA, 25 bp, Homo sapien
cgagttatggagcgctccgaccaga

SEQ ID NO: 35959 - DNA, 25 bp, Homo sapien
cgcctcttactggccaggagtggac

SEQ ID NO: 35960 - DNA, 25 bp, Homo sapien
cttactggccaggagtggacttggt

SEQ ID NO: 35961 - DNA, 25 bp, Homo sapien
tggacttggttagggctaccttctc

SEQ ID NO: 35962 - DNA, 25 bp, Homo sapien
ggctaccttctcattggttgcagcc

SEQ ID NO: 35963 - DNA, 25 bp, Homo sapien
ccttctcattggttgcagccagagg

SEQ ID NO: 35964 - DNA, 25 bp, Homo sapien
gtcccaatagagcccggggctactt

SEQ ID NO: 35965 - DNA, 25 bp, Homo sapien
aatagagcccggggctacttccact

SEQ ID NO: 35966 - DNA, 25 bp, Homo sapien
tccaggggcgactctagtggcctga

SEQ ID NO: 35967 - DNA, 25 bp, Homo sapien
aggagatgtatttataggcccccag

SEQ ID NO: 35968 - DNA, 25 bp, Homo sapien
attggccgagttatggagcgctccg

SEQ ID NO: 35969 - DNA, 25 bp, Homo sapien
tgaagtgtgttggctccgtagccct

SEQ ID NO: 35970 - DNA, 25 bp, Homo sapien
ccttggtgactgtatcctcagaaga

SEQ ID NO: 35971 - DNA, 25 bp, Homo sapien
acaaatcttggcttagtgggttata

SEQ ID NO: 35972 - DNA, 25 bp, Homo sapien
gtattaattgtccttgtttacttca

SEQ ID NO: 35973 - DNA, 25 bp, Homo sapien
cagacaggatccattgctaatcatg

SEQ ID NO: 35974 - DNA, 25 bp, Homo sapien
gagagctctttattttctgtggaag

SEQ ID NO: 35975 - DNA, 25 bp, Homo sapien
gagaaagctctgacaaatatccaaa

SEQ ID NO: 35976 - DNA, 25 bp, Homo sapien
gactcagctgaaagcatgtgcctct

SEQ ID NO: 35977 - DNA, 25 bp, Homo sapien
caaacatcgtttgctttggagagga

SEQ ID NO: 35978 - DNA, 25 bp, Homo sapien
ggaacttaaggactcagcaggaaat

SEQ ID NO: 35979 - DNA, 25 bp, Homo sapien
gacactttgctgttgatagctgagg

SEQ ID NO: 35980 - DNA, 25 bp, Homo sapien
atcttcccgccatctgatgagcagt

SEQ ID NO: 35981 - DNA, 25 bp, Homo sapien
aaatctggaactgcctctgttgtgt

SEQ ID NO: 35982 - DNA, 25 bp, Homo sapien
cctctgttgtgtgcctgctgaataa

SEQ ID NO: 35983 - DNA, 25 bp, Homo sapien
gtgcctgctgaataacttctatccc

SEQ ID NO: 35984 - DNA, 25 bp, Homo sapien
aacttctatcccagagaggccaaag

SEQ ID NO: 35985 - DNA, 25 bp, Homo sapien
gcaccctgacgctgagcaaagcaga

SEQ ID NO: 35986 - DNA, 25 bp, Homo sapien
aacacaaagtctacgcctgcgaagt

SEQ ID NO: 35987 - DNA, 25 bp, Homo sapien
ctcgcccgtcacaaagagcttcaac

SEQ ID NO: 35988 - DNA, 25 bp, Homo sapien
gttagagggagaagtgcccccacct

SEQ ID NO: 35989 - DNA, 25 bp, Homo sapien
tccacaggggacctacccctattgc

SEQ ID NO: 35990 - DNA, 25 bp, Homo sapien
tcctcctccttggctttaattatgc

SEQ ID NO: 35991 - DNA, 25 bp, Homo sapien
gagttcaagttcaacccgtgtgtga

SEQ ID NO: 35992 - DNA, 25 bp, Homo sapien
aagttcaacccgtgtgtgaaagcaa

SEQ ID NO: 35993 - DNA, 25 bp, Homo sapien
ggattggcttcttcaaaggctcctc

SEQ ID NO: 35994 - DNA, 25 bp, Homo sapien
aaggctcctcttgtagaactgcctc

SEQ ID NO: 35995 - DNA, 25 bp, Homo sapien
tagaactgcctctttgaaatttcga

SEQ ID NO: 35996 - DNA, 25 bp, Homo sapien
gaaatttcgaggtaatctactttgg

SEQ ID NO: 35997 - DNA, 25 bp, Homo sapien
tactttggagactctgcctggagag

SEQ ID NO: 35998 - DNA, 25 bp, Homo sapien
ggtcagttcctaagttaaaagcatc

SEQ ID NO: 35999 - DNA, 25 bp, Homo sapien
aaaagcatcgcttaaccttggctcc

SEQ ID NO: 36000 - DNA, 25 bp, Homo sapien
tcctgtggcattttacaaaggttta

SEQ ID NO: 36001 - DNA, 25 bp, Homo sapien
attgattcctctgaaagggcctgaa

SEQ ID NO: 36002 - DNA, 25 bp, Homo sapien
atgaaatatgccagatctatagtat

SEQ ID NO: 36003 - DNA, 25 bp, Homo sapien
gtattttaatgtgcatctactttaa

SEQ ID NO: 36004 - DNA, 25 bp, Homo sapien
gtgcatctactttaaatgagtcatc

SEQ ID NO: 36005 - DNA, 25 bp, Homo sapien
aatgagtcatcttggggtttttata

SEQ ID NO: 36006 - DNA, 25 bp, Homo sapien
ttataattcccttatgttcttgccc

SEQ ID NO: 36007 - DNA, 25 bp, Homo sapien
ttgcccctctacacttgaaataaca

SEQ ID NO: 36008 - DNA, 25 bp, Homo sapien
ggattagttctcttatagtagacag

SEQ ID NO: 36009 - DNA, 25 bp, Homo sapien
gtagacaggcagctatatgcagcaa

SEQ ID NO: 36010 - DNA, 25 bp, Homo sapien
aacagctaagaaaacatgccacatt

SEQ ID NO: 36011 - DNA, 25 bp, Homo sapien
atttgtttttggtgtaagcacagga

SEQ ID NO: 36012 - DNA, 25 bp, Homo sapien
cataacacctaacattcataaaaat

SEQ ID NO: 36013 - DNA, 25 bp, Homo sapien
acaaaatcaacaacctacaaatctc

SEQ ID NO: 36014 - DNA, 25 bp, Homo sapien
aacaacctacaaatctctttcagtc

SEQ ID NO: 36015 - DNA, 25 bp, Homo sapien
caacctacaaatctctttcagtcct

SEQ ID NO: 36016 - DNA, 25 bp, Homo sapien
acaaatctctttcagtcctttgcat

SEQ ID NO: 36017 - DNA, 25 bp, Homo sapien
tctttcagtcctttgcatttcaagc

SEQ ID NO: 36018 - DNA, 25 bp, Homo sapien
gcatttcaagcaaaatattctcttc

SEQ ID NO: 36019 - DNA, 25 bp, Homo sapien
ttcaagcaaaatattctcttcagaa

SEQ ID NO: 36020 - DNA, 25 bp, Homo sapien
attctcttcagaaaaatgaccattt

SEQ ID NO: 36021 - DNA, 25 bp, Homo sapien
atcatcatgatcgctcgacatcgat

SEQ ID NO: 36022 - DNA, 25 bp, Homo sapien
gaccatttcataatatatatcccct

SEQ ID NO: 36023 - DNA, 25 bp, Homo sapien
tcataatatatatccccttctgtcg

SEQ ID NO: 36024 - DNA, 25 bp, Homo sapien
ccagggacctgtggtaagctaatga

SEQ ID NO: 36025 - DNA, 25 bp, Homo sapien
ggacctgtggtaagctaatgagatc

SEQ ID NO: 36026 - DNA, 25 bp, Homo sapien
gagatcaagaactggctccataagg

SEQ ID NO: 36027 - DNA, 25 bp, Homo sapien
aagaactggctccataaggtgggta

SEQ ID NO: 36028 - DNA, 25 bp, Homo sapien
atggaggagtgattgcaaagctctg

SEQ ID NO: 36029 - DNA, 25 bp, Homo sapien
gtgcccaattccaagagggaaaaga

SEQ ID NO: 36030 - DNA, 25 bp, Homo sapien
aagagatgtaaaccatcgacgtttg

SEQ ID NO: 36031 - DNA, 25 bp, Homo sapien
tcgacgtttgagaggcgtgatcgcc

SEQ ID NO: 36032 - DNA, 25 bp, Homo sapien
gagaggcgtgatcgcctgattcctg

SEQ ID NO: 36033 - DNA, 25 bp, Homo sapien
gaggcgtgatcgcctgattcctgtg

SEQ ID NO: 36034 - DNA, 25 bp, Homo sapien
taaggggatatgaccaggcctccct

SEQ ID NO: 36035 - DNA, 25 bp, Homo sapien
gaagccattctaaaaaggactccct

SEQ ID NO: 36036 - DNA, 25 bp, Homo sapien
aaaaaggactccctacatgacctgc

SEQ ID NO: 36037 - DNA, 25 bp, Homo sapien
aatacaggagcttaccttgaacctt

SEQ ID NO: 36038 - DNA, 25 bp, Homo sapien
taccttgaacctttgaattgggcca

SEQ ID NO: 36039 - DNA, 25 bp, Homo sapien
aattgggccaaattgcgatgaccac

SEQ ID NO: 36040 - DNA, 25 bp, Homo sapien
ttgcgatgaccactgcatcctggaa

SEQ ID NO: 36041 - DNA, 25 bp, Homo sapien
tttgtactaagccagttgcctcttt

SEQ ID NO: 36042 - DNA, 25 bp, Homo sapien
ttgcctctttcaaaacaacttgtca

SEQ ID NO: 36043 - DNA, 25 bp, Homo sapien
acttgtcaacttgtctaatcaccct

SEQ ID NO: 36044 - DNA, 25 bp, Homo sapien
tctctcttcagaacacaagtggctt

SEQ ID NO: 36045 - DNA, 25 bp, Homo sapien
acacaagtggcttctagctgaatct

SEQ ID NO: 36046 - DNA, 25 bp, Homo sapien
cggttcagggcagcctgtgagcagc

SEQ ID NO: 36047 - DNA, 25 bp, Homo sapien
gactctgcaggaggacagagcatcc

SEQ ID NO: 36048 - DNA, 25 bp, Homo sapien
cagagcatccctgacgctttcaggg

SEQ ID NO: 36049 - DNA, 25 bp, Homo sapien
catccctgacgctttcaggggggcc

SEQ ID NO: 36050 - DNA, 25 bp, Homo sapien
ctttgacctctccaaggtaccaggc

SEQ ID NO: 36051 - DNA, 25 bp, Homo sapien
acactgggcctggcaaaacgcgtgt

SEQ ID NO: 36052 - DNA, 25 bp, Homo sapien
gcaaaacgcgtgtggagcctggagc

SEQ ID NO: 36053 - DNA, 25 bp, Homo sapien
agaagagacagctgtcagcccgagg

SEQ ID NO: 36054 - DNA, 25 bp, Homo sapien
gggagtccgcctatgaggggagagg

SEQ ID NO: 36055 - DNA, 25 bp, Homo sapien
ctatgaggggagaggcagtctttga

SEQ ID NO: 36056 - DNA, 25 bp, Homo sapien
tcctgggccaggactaacacggctc

SEQ ID NO: 36057 - DNA, 25 bp, Homo sapien
cagtggacatttcttggcctgtttt

SEQ ID NO: 36058 - DNA, 25 bp, Homo sapien
tttcctgtgggttttcttcagcatg

SEQ ID NO: 36059 - DNA, 25 bp, Homo sapien
gtgggttttcttcagcatgatatga

SEQ ID NO: 36060 - DNA, 25 bp, Homo sapien
ctgcctcgtcacttgtgctaatggt

SEQ ID NO: 36061 - DNA, 25 bp, Homo sapien
gtgctaatggtcagttgtacacaca

SEQ ID NO: 36062 - DNA, 25 bp, Homo sapien
atgtggaagtgacctgtagcagcgg

SEQ ID NO: 36063 - DNA, 25 bp, Homo sapien
gtagcagcggtcactcattttaaca

SEQ ID NO: 36064 - DNA, 25 bp, Homo sapien
aacaattgaactctgctgggttggg

SEQ ID NO: 36065 - DNA, 25 bp, Homo sapien
tctgctgggttgggtatttaccttt

SEQ ID NO: 36066 - DNA, 25 bp, Homo sapien
aacaaaaagacctcatgctcatgca

SEQ ID NO: 36067 - DNA, 25 bp, Homo sapien
gacctcatgctcatgcagtggacat

SEQ ID NO: 36068 - DNA, 25 bp, Homo sapien
gtctattctgatttctcaaatttta

SEQ ID NO: 36069 - DNA, 25 bp, Homo sapien
tttaggtctttcatagcttttttat

SEQ ID NO: 36070 - DNA, 25 bp, Homo sapien
ttgctctgttttctgacagtgctca

SEQ ID NO: 36071 - DNA, 25 bp, Homo sapien
gttttctgacagtgctcaaagtggg

SEQ ID NO: 36072 - DNA, 25 bp, Homo sapien
aaacacatttcctatgggacacaca

SEQ ID NO: 36073 - DNA, 25 bp, Homo sapien
tttcctatgggacacacatttcaaa

SEQ ID NO: 36074 - DNA, 25 bp, Homo sapien
aagggtagcacttttaagtcatttg

SEQ ID NO: 36075 - DNA, 25 bp, Homo sapien
atatttagtctagtgttagtcctta

SEQ ID NO: 36076 - DNA, 25 bp, Homo sapien
ttagtccttaaatctgccaacaaaa

SEQ ID NO: 36077 - DNA, 25 bp, Homo sapien
aaagtaggcacatttattccattgt

SEQ ID NO: 36078 - DNA, 25 bp, Homo sapien
ggcacatttattccattgtgactgt

SEQ ID NO: 36079 - DNA, 25 bp, Homo sapien
tttgaagaggctagaaccccgcact

SEQ ID NO: 36080 - DNA, 25 bp, Homo sapien
gtgccttgagcttactgacctcaac

SEQ ID NO: 36081 - DNA, 25 bp, Homo sapien
tcaacaccctggttccactaaaact

SEQ ID NO: 36082 - DNA, 25 bp, Homo sapien
ttacaaaattatgctgccggtctgc

SEQ ID NO: 36083 - DNA, 25 bp, Homo sapien
atgctgccggtctgcaggatgtagt

SEQ ID NO: 36084 - DNA, 25 bp, Homo sapien
ttctgtaccagaggtgagtgccaca

SEQ ID NO: 36085 - DNA, 25 bp, Homo sapien
ccagaggtgagtgccacaccctaac

SEQ ID NO: 36086 - DNA, 25 bp, Homo sapien
cacaccctaacctagtctgagtttt

SEQ ID NO: 36087 - DNA, 25 bp, Homo sapien
ccctaacctagtctgagtttttatg

SEQ ID NO: 36088 - DNA, 25 bp, Homo sapien
acacataagctctcaataaacgtta

SEQ ID NO: 36089 - DNA, 25 bp, Homo sapien
tcaataaacgttagcttatcattgt

SEQ ID NO: 36090 - DNA, 25 bp, Homo sapien
agccacacaggaaatgacaacgacg

SEQ ID NO: 36091 - DNA, 25 bp, Homo sapien
tgacaacgacgctgaatcccagcct

SEQ ID NO: 36092 - DNA, 25 bp, Homo sapien
gagcagaagtcccgcaggacagaca

SEQ ID NO: 36093 - DNA, 25 bp, Homo sapien
gacacagacagcgctagtgaccagc

SEQ ID NO: 36094 - DNA, 25 bp, Homo sapien
tagtgaccagcacggttctcatgta

SEQ ID NO: 36095 - DNA, 25 bp, Homo sapien
ggttctcatgtaaattacaagcccc

SEQ ID NO: 36096 - DNA, 25 bp, Homo sapien
ctccctcctgagctgagaaacggaa

SEQ ID NO: 36097 - DNA, 25 bp, Homo sapien
tgagaaacggaacctcgcgaaccac

SEQ ID NO: 36098 - DNA, 25 bp, Homo sapien
ccgcccccggatcagaaatatatct

SEQ ID NO: 36099 - DNA, 25 bp, Homo sapien
tatctatattctcgactaaagtctc

SEQ ID NO: 36100 - DNA, 25 bp, Homo sapien
gtctgtctaatgtggtgggtctttt

SEQ ID NO: 36101 - DNA, 25 bp, Homo sapien
tccttaagctctggaacgagccccc

SEQ ID NO: 36102 - DNA, 25 bp, Homo sapien
tcgttccgctctctgtatgtaagct

SEQ ID NO: 36103 - DNA, 25 bp, Homo sapien
ttccgctctctgtatgtaagctgcg

SEQ ID NO: 36104 - DNA, 25 bp, Homo sapien
gctctctgtatgtaagctgcgtgca

SEQ ID NO: 36105 - DNA, 25 bp, Homo sapien
tatgtaagctgcgtgcaggcaccgg

SEQ ID NO: 36106 - DNA, 25 bp, Homo sapien
cttttacgcggacacctgtgtacac

SEQ ID NO: 36107 - DNA, 25 bp, Homo sapien
ttacgcggacacctgtgtacactca

SEQ ID NO: 36108 - DNA, 25 bp, Homo sapien
cgcggacacctgtgtacactcacag

SEQ ID NO: 36109 - DNA, 25 bp, Homo sapien
gtgtacactcacaggtggagtgggc

SEQ ID NO: 36110 - DNA, 25 bp, Homo sapien
gtctgcccatgcaggggaacacggt

SEQ ID NO: 36111 - DNA, 25 bp, Homo sapien
catgcaggggaacacggtgctcggg

SEQ ID NO: 36112 - DNA, 25 bp, Homo sapien
tccggggtgagctggtcgaaggtct

SEQ ID NO: 36113 - DNA, 25 bp, Homo sapien
ctggtcgaaggtcttggagtcctcc

SEQ ID NO: 36114 - DNA, 25 bp, Homo sapien
gtttcctaggtagtaaccataggtg

SEQ ID NO: 36115 - DNA, 25 bp, Homo sapien
gtaaccataggtggcttgtttgtat

SEQ ID NO: 36116 - DNA, 25 bp, Homo sapien
gcttgtttgtattcttcccaggaaa

SEQ ID NO: 36117 - DNA, 25 bp, Homo sapien
tgtccctatcataatccttccagac

SEQ ID NO: 36118 - DNA, 25 bp, Homo sapien
atccttccagactttggcgacatta

SEQ ID NO: 36119 - DNA, 25 bp, Homo sapien
ttccagactttggcgacattatcaa

SEQ ID NO: 36120 - DNA, 25 bp, Homo sapien
caaagatgtatcttttctgcacccg

SEQ ID NO: 36121 - DNA, 25 bp, Homo sapien
tgcacccgtttgatccaggttttca

SEQ ID NO: 36122 - DNA, 25 bp, Homo sapien
cgtttgatccaggttttcagctcct

SEQ ID NO: 36123 - DNA, 25 bp, Homo sapien
gctatttaaagtctgagtgcgttgg

SEQ ID NO: 36124 - DNA, 25 bp, Homo sapien
agtgcgttggtaactgattcagtca

SEQ ID NO: 36125 - DNA, 25 bp, Homo sapien
aactgattcagtcatctgtaggttg

SEQ ID NO: 36126 - DNA, 25 bp, Homo sapien
aagtgattacttttatctgccttca

SEQ ID NO: 36127 - DNA, 25 bp, Homo sapien
ttatctgccttcatagtgagaatta

SEQ ID NO: 36128 - DNA, 25 bp, Homo sapien
ttagatttctattctttgtaaagca

SEQ ID NO: 36129 - DNA, 25 bp, Homo sapien
gggaatatagattgtgcatggagta

SEQ ID NO: 36130 - DNA, 25 bp, Homo sapien
taatgatggtagctgcgctgcagaa

SEQ ID NO: 36131 - DNA, 25 bp, Homo sapien
agcctgtcagagtaacttattcagt

SEQ ID NO: 36132 - DNA, 25 bp, Homo sapien
gaatctcattagtttattctgtaaa

SEQ ID NO: 36133 - DNA, 25 bp, Homo sapien
gtttattctgtaaatagttcctagt

SEQ ID NO: 36134 - DNA, 25 bp, Homo sapien
aaacaaataatcctgccttttacag

SEQ ID NO: 36135 - DNA, 25 bp, Homo sapien
ctgccttttacaggtgaaactcggg

SEQ ID NO: 36136 - DNA, 25 bp, Homo sapien
caggtgaaactcggggctgtccata

SEQ ID NO: 36137 - DNA, 25 bp, Homo sapien
tagaacacacgatgggctttcctta

SEQ ID NO: 36138 - DNA, 25 bp, Homo sapien
tgtttcccagatctcttgaactctg

SEQ ID NO: 36139 - DNA, 25 bp, Homo sapien
tctcttgaactctgggttctcccag

SEQ ID NO: 36140 - DNA, 25 bp, Homo sapien
tccccaagtcagggggctctctgag

SEQ ID NO: 36141 - DNA, 25 bp, Homo sapien
ggctctctgagtgcagggtctgatg

SEQ ID NO: 36142 - DNA, 25 bp, Homo sapien
tctgagtgcagggtctgatgctgag

SEQ ID NO: 36143 - DNA, 25 bp, Homo sapien
atgctgagtcccacttagcttgggg

SEQ ID NO: 36144 - DNA, 25 bp, Homo sapien
tgagtcccacttagcttggggtcag

SEQ ID NO: 36145 - DNA, 25 bp, Homo sapien
ctcagaaaagagagctcccgccact

SEQ ID NO: 36146 - DNA, 25 bp, Homo sapien
tcccgccactcgaagctggagaagg

SEQ ID NO: 36147 - DNA, 25 bp, Homo sapien
ggagaaggcggacatcctggagatg

SEQ ID NO: 36148 - DNA, 25 bp, Homo sapien
ggcggacatcctggagatgaccgtg

SEQ ID NO: 36149 - DNA, 25 bp, Homo sapien
tcctggagatgaccgtgagacacct

SEQ ID NO: 36150 - DNA, 25 bp, Homo sapien
ggagatgaccgtgagacacctgcgg

SEQ ID NO: 36151 - DNA, 25 bp, Homo sapien
agatgaccgtgagacacctgcggag

SEQ ID NO: 36152 - DNA, 25 bp, Homo sapien
cttccacgagtgtctggcggaggtg

SEQ ID NO: 36153 - DNA, 25 bp, Homo sapien
cacgagtgtctggcggaggtgaacc

SEQ ID NO: 36154 - DNA, 25 bp, Homo sapien
tctggcggaggtgaaccgcttcctg

SEQ ID NO: 36155 - DNA, 25 bp, Homo sapien
cgcagggcccgggtgggccctggag

SEQ ID NO: 36156 - DNA, 25 bp, Homo sapien
cttggtgggcagttctgccttccaa

SEQ ID NO: 36157 - DNA, 25 bp, Homo sapien
ctgctgccagtgcacacttttacaa

SEQ ID NO: 36158 - DNA, 25 bp, Homo sapien
ggcccacttcttctgtggatggccc

SEQ ID NO: 36159 - DNA, 25 bp, Homo sapien
tcagggtcctgggagaccctctggg

SEQ ID NO: 36160 - DNA, 25 bp, Homo sapien
gagaccctctgggctgaggaggagg

SEQ ID NO: 36161 - DNA, 25 bp, Homo sapien
gcagcagcccagctgtttagggttg

SEQ ID NO: 36162 - DNA, 25 bp, Homo sapien
tgtttagggttgctggaggccgggc

SEQ ID NO: 36163 - DNA, 25 bp, Homo sapien
ggctaccgtcttgtgcctgaaaacc

SEQ ID NO: 36164 - DNA, 25 bp, Homo sapien
ttgtgcctgaaaaccacggggcctg

SEQ ID NO: 36165 - DNA, 25 bp, Homo sapien
agaccccagaacggagcttcaagtc

SEQ ID NO: 36166 - DNA, 25 bp, Homo sapien
ttcaagtcagacagatccctgcctt

SEQ ID NO: 36167 - DNA, 25 bp, Homo sapien
agaggaactaacccaacttatatga

SEQ ID NO: 36168 - DNA, 25 bp, Homo sapien
gtcgtgtagttatggcactgtctta

SEQ ID NO: 36169 - DNA, 25 bp, Homo sapien
ggcactgtcttatttggaacatttg

SEQ ID NO: 36170 - DNA, 25 bp, Homo sapien
atttgacaacctactactaatcaca

SEQ ID NO: 36171 - DNA, 25 bp, Homo sapien
ggtttttgcactccatagttgtctt

SEQ ID NO: 36172 - DNA, 25 bp, Homo sapien
tagttgtcttagcccaatctttcta

SEQ ID NO: 36173 - DNA, 25 bp, Homo sapien
tagcccaatctttctatactcttac

SEQ ID NO: 36174 - DNA, 25 bp, Homo sapien
ctttctatactcttacgattacttg

SEQ ID NO: 36175 - DNA, 25 bp, Homo sapien
acgattacttgggttaacgcttctg

SEQ ID NO: 36176 - DNA, 25 bp, Homo sapien
ccttctggctcttgagataccctaa

SEQ ID NO: 36177 - DNA, 25 bp, Homo sapien
gtttactgacctagcagatgtgtgg

SEQ ID NO: 36178 - DNA, 25 bp, Homo sapien
gcaacgcgattcgcgcgggggtgaa

SEQ ID NO: 36179 - DNA, 25 bp, Homo sapien
gaacggtcaatttgagccgcgtcga

SEQ ID NO: 36180 - DNA, 25 bp, Homo sapien
gggcgcgagctgtgttggaagcaaa

SEQ ID NO: 36181 - DNA, 25 bp, Homo sapien
tggaagcaaagtcctccttgtgggt

SEQ ID NO: 36182 - DNA, 25 bp, Homo sapien
tccttgtgggttggggtggcggagg

SEQ ID NO: 36183 - DNA, 25 bp, Homo sapien
gagaagggaagcgagggtcgcggcg

SEQ ID NO: 36184 - DNA, 25 bp, Homo sapien
cgcccgcgactactgaaggcgctgc

SEQ ID NO: 36185 - DNA, 25 bp, Homo sapien
gcctgacctgaacgggcacttgtgt

SEQ ID NO: 36186 - DNA, 25 bp, Homo sapien
tcgaggtcgggcttgggaagggtca

SEQ ID NO: 36187 - DNA, 25 bp, Homo sapien
tgaacgggcacttgtgttccagctc

SEQ ID NO: 36188 - DNA, 25 bp, Homo sapien
tgggaagggtcagcgggaggcctga

SEQ ID NO: 36189 - DNA, 25 bp, Homo sapien
tgttctatctaatacatgggacaga

SEQ ID NO: 36190 - DNA, 25 bp, Homo sapien
gaatcctcagacgttctggtttgat

SEQ ID NO: 36191 - DNA, 25 bp, Homo sapien
ttctggtttgattgttgtgggtgta

SEQ ID NO: 36192 - DNA, 25 bp, Homo sapien
gttgtgggtgtagcccaggcatggg

SEQ ID NO: 36193 - DNA, 25 bp, Homo sapien
gtagcccaggcatgggattttttaa

SEQ ID NO: 36194 - DNA, 25 bp, Homo sapien
agagctgctcaggtaattccaattt

SEQ ID NO: 36195 - DNA, 25 bp, Homo sapien
gctgctcaggtaattccaatttaat

SEQ ID NO: 36196 - DNA, 25 bp, Homo sapien
ccaatttaattgcgtgtcctacctt

SEQ ID NO: 36197 - DNA, 25 bp, Homo sapien
tttaattgcgtgtcctaccttgggt

SEQ ID NO: 36198 - DNA, 25 bp, Homo sapien
ccgtcgtctcatgtgtttgctaaac

SEQ ID NO: 36199 - DNA, 25 bp, Homo sapien
cgtctcatgtgtttgctaaactgga

SEQ ID NO: 36200 - DNA, 25 bp, Homo sapien
tagacatactaataggtgcacagtg

SEQ ID NO: 36201 - DNA, 25 bp, Homo sapien
ggtgcacagtgaaatacttattgtt

SEQ ID NO: 36202 - DNA, 25 bp, Homo sapien
aagtcagagtttaggccaggggcac

SEQ ID NO: 36203 - DNA, 25 bp, Homo sapien
gtttaggccaggggcacaggctgac

SEQ ID NO: 36204 - DNA, 25 bp, Homo sapien
attttggtcttatatcttcttatgt

SEQ ID NO: 36205 - DNA, 25 bp, Homo sapien
gtttgtgttatttcatgtgtgccag

SEQ ID NO: 36206 - DNA, 25 bp, Homo sapien
atttcatgtgtgccagtttctcttt

SEQ ID NO: 36207 - DNA, 25 bp, Homo sapien
gatcacgtgataagcttataatctt

SEQ ID NO: 36208 - DNA, 25 bp, Homo sapien
tataatcttctcataattcccctta

SEQ ID NO: 36209 - DNA, 25 bp, Homo sapien
taattccccttacttagcattgtgt

SEQ ID NO: 36210 - DNA, 25 bp, Homo sapien
acttagcattgtgttagacatacta

SEQ ID NO: 36211 - DNA, 25 bp, Homo sapien
gttgggccctgaggcttgaagcttg

SEQ ID NO: 36212 - DNA, 25 bp, Homo sapien
ggatgtccctgcactgatacagaag

SEQ ID NO: 36213 - DNA, 25 bp, Homo sapien
tggcaaagcctgccgtgtcttacat

SEQ ID NO: 36214 - DNA, 25 bp, Homo sapien
atttgtctctctatccggattagat

SEQ ID NO: 36215 - DNA, 25 bp, Homo sapien
tgtgtctgcaggaaggagctcccca

SEQ ID NO: 36216 - DNA, 25 bp, Homo sapien
tcacctctttccacttaaacgtgtc

SEQ ID NO: 36217 - DNA, 25 bp, Homo sapien
taaacgtgtcccatgaatcttgtca

SEQ ID NO: 36218 - DNA, 25 bp, Homo sapien
gtgttccttaactattttgtctgcc

SEQ ID NO: 36219 - DNA, 25 bp, Homo sapien
ctattttgtctgccatgtcatttat

SEQ ID NO: 36220 - DNA, 25 bp, Homo sapien
gtatataacctctttaatgcctgaa

SEQ ID NO: 36221 - DNA, 25 bp, Homo sapien
ggagacacatctggaatttgctgca

SEQ ID NO: 36222 - DNA, 25 bp, Homo sapien
ccacaggacggatcttacagaggca

SEQ ID NO: 36223 - DNA, 25 bp, Homo sapien
cagaggcaagtggtccctggacctc

SEQ ID NO: 36224 - DNA, 25 bp, Homo sapien
tctagacggccgtgtcagaggctcc

SEQ ID NO: 36225 - DNA, 25 bp, Homo sapien
gctccaccctgttgtgaacttggta

SEQ ID NO: 36226 - DNA, 25 bp, Homo sapien
ggcaaaggcttagaggctggaccag

SEQ ID NO: 36227 - DNA, 25 bp, Homo sapien
cttggctttggacacctgagaaccc

SEQ ID NO: 36228 - DNA, 25 bp, Homo sapien
aaggtttttgacatgagtgtactcc

SEQ ID NO: 36229 - DNA, 25 bp, Homo sapien
catgagtgtactcctgcttagttcc

SEQ ID NO: 36230 - DNA, 25 bp, Homo sapien
gggctgcatttgcggtgctttgccc

SEQ ID NO: 36231 - DNA, 25 bp, Homo sapien
gagtgaggggccaagggatctcctc

SEQ ID NO: 36232 - DNA, 25 bp, Homo sapien
gcctaggtgggcagactataggagg

SEQ ID NO: 36233 - DNA, 25 bp, Homo sapien
agaattctaattttatcaagctgaa

SEQ ID NO: 36234 - DNA, 25 bp, Homo sapien
tactgtgtcaaaagaggcattatgt

SEQ ID NO: 36235 - DNA, 25 bp, Homo sapien
gcattatgttgcttgtgtgatatag

SEQ ID NO: 36236 - DNA, 25 bp, Homo sapien
gatatagtgaatagtgtccctccaa

SEQ ID NO: 36237 - DNA, 25 bp, Homo sapien
tagtgtccctccaaatttcatgtac

SEQ ID NO: 36238 - DNA, 25 bp, Homo sapien
atgtacacctggaatgtcacaatgt

SEQ ID NO: 36239 - DNA, 25 bp, Homo sapien
atgtgacttaacagtagccacccct

SEQ ID NO: 36240 - DNA, 25 bp, Homo sapien
tttgcaagatccccagtggatgcct

SEQ ID NO: 36241 - DNA, 25 bp, Homo sapien
tcctatgcatacatatccctatgat

SEQ ID NO: 36242 - DNA, 25 bp, Homo sapien
gtttatgaatttggcacttaacagc

SEQ ID NO: 36243 - DNA, 25 bp, Homo sapien
atttggcacttaacagcagaactaa

SEQ ID NO: 36244 - DNA, 25 bp, Homo sapien
cgccggcggtgcgtgtgggaaggcg

SEQ ID NO: 36245 - DNA, 25 bp, Homo sapien
gtgcgtgtgggaaggcgtggggtgc

SEQ ID NO: 36246 - DNA, 25 bp, Homo sapien
gtgtgggaaggcgtggggtgcggac

SEQ ID NO: 36247 - DNA, 25 bp, Homo sapien
gcccgaggccgaacggtggtgtgtc

SEQ ID NO: 36248 - DNA, 25 bp, Homo sapien
gaggccgaacggtggtgtgtcgttc

SEQ ID NO: 36249 - DNA, 25 bp, Homo sapien
agctcgtcggtgtggggttcgaggc

SEQ ID NO: 36250 - DNA, 25 bp, Homo sapien
ctcgtcggtgtggggttcgaggcgg

SEQ ID NO: 36251 - DNA, 25 bp, Homo sapien
gtggggttcgaggcggtttgagtga

SEQ ID NO: 36252 - DNA, 25 bp, Homo sapien
ggttcgaggcggtttgagtgagacg

SEQ ID NO: 36253 - DNA, 25 bp, Homo sapien
gaggcggtttgagtgagacgagacg

SEQ ID NO: 36254 - DNA, 25 bp, Homo sapien
cggtttgagtgagacgagacgagac

SEQ ID NO: 36255 - DNA, 25 bp, Homo sapien
gagtacatccaattgttgacatagt

SEQ ID NO: 36256 - DNA, 25 bp, Homo sapien
aattttgctattatatcgacttctt

SEQ ID NO: 36257 - DNA, 25 bp, Homo sapien
acttggtttcaattcacagagatct

SEQ ID NO: 36258 - DNA, 25 bp, Homo sapien
agcatacacctcagccttaaatgac

SEQ ID NO: 36259 - DNA, 25 bp, Homo sapien
gcagcaggtgggaaagtggctttgg

SEQ ID NO: 36260 - DNA, 25 bp, Homo sapien
gtttgtgagctctgaatccacacag

SEQ ID NO: 36261 - DNA, 25 bp, Homo sapien
aggactgcattctgacaacctgaat

SEQ ID NO: 36262 - DNA, 25 bp, Homo sapien
ttgtccttaccacaatgaggcagaa

SEQ ID NO: 36263 - DNA, 25 bp, Homo sapien
gtatttcagtcacaattaatgccaa

SEQ ID NO: 36264 - DNA, 25 bp, Homo sapien
atatcctggaacttattttgtgagc

SEQ ID NO: 36265 - DNA, 25 bp, Homo sapien
taagggtgacttgatgagtacatcc

SEQ ID NO: 36266 - DNA, 25 bp, Homo sapien
gcccaaacaaattcgaatatcttct

SEQ ID NO: 36267 - DNA, 25 bp, Homo sapien
ggaatacctctcaatgtcttaccaa

SEQ ID NO: 36268 - DNA, 25 bp, Homo sapien
ggcagtgatcttcctaaagtatcaa

SEQ ID NO: 36269 - DNA, 25 bp, Homo sapien
aaagtatcaactcagccacgttcta

SEQ ID NO: 36270 - DNA, 25 bp, Homo sapien
gaatgttgagggtctaaagctatag

SEQ ID NO: 36271 - DNA, 25 bp, Homo sapien
gagcatacagggcaaggcactttat

SEQ ID NO: 36272 - DNA, 25 bp, Homo sapien
gcactttattaggggctcctcatct

SEQ ID NO: 36273 - DNA, 25 bp, Homo sapien
ctgtttgccatttttactggcagat

SEQ ID NO: 36274 - DNA, 25 bp, Homo sapien
ttatactagtaagtgtcccctgcca

SEQ ID NO: 36275 - DNA, 25 bp, Homo sapien
cccctgccaaccatcttgtaaatat

SEQ ID NO: 36276 - DNA, 25 bp, Homo sapien
taagcttacatttgctctgaagtaa

SEQ ID NO: 36277 - DNA, 25 bp, Homo sapien
tgctgggtcttgagccacagctgca

SEQ ID NO: 36278 - DNA, 25 bp, Homo sapien
ctgcagccaatgcagcagctcgcgc

SEQ ID NO: 36279 - DNA, 25 bp, Homo sapien
tttctgtttttcctccttgaggcgc

SEQ ID NO: 36280 - DNA, 25 bp, Homo sapien
cttcttctctaggtcctggagcagc

SEQ ID NO: 36281 - DNA, 25 bp, Homo sapien
cctggagcagctcctggaagcgggc

SEQ ID NO: 36282 - DNA, 25 bp, Homo sapien
tccacctggtagcccaggagctcct

SEQ ID NO: 36283 - DNA, 25 bp, Homo sapien
ctgctgccagttcacaatcatctgt

SEQ ID NO: 36284 - DNA, 25 bp, Homo sapien
atctgtggcatcttggccatgcact

SEQ ID NO: 36285 - DNA, 25 bp, Homo sapien
gccatgcactctgcgatgtgctgct

SEQ ID NO: 36286 - DNA, 25 bp, Homo sapien
tccggcgacggccataacgaaccgg

SEQ ID NO: 36287 - DNA, 25 bp, Homo sapien
gacaaagcctcaggagctgggtgcc

SEQ ID NO: 36288 - DNA, 25 bp, Homo sapien
cgccctgcaggacctgcggaagaca

SEQ ID NO: 36289 - DNA, 25 bp, Homo sapien
tgcaggacctgcggaagacagcctg

SEQ ID NO: 36290 - DNA, 25 bp, Homo sapien
caggacctgcggaagacagcctgca

SEQ ID NO: 36291 - DNA, 25 bp, Homo sapien
ggacctgcggaagacagcctgcagc

SEQ ID NO: 36292 - DNA, 25 bp, Homo sapien
gacctgcggaagacagcctgcagcc

SEQ ID NO: 36293 - DNA, 25 bp, Homo sapien
cagcggggcactgaggaccacgctg

SEQ ID NO: 36294 - DNA, 25 bp, Homo sapien
gaccacgctgctccgtgtgaataaa

SEQ ID NO: 36295 - DNA, 25 bp, Homo sapien
acgctgctccgtgtgaataaatgcc

SEQ ID NO: 36296 - DNA, 25 bp, Homo sapien
gctgctccgtgtgaataaatgccca

SEQ ID NO: 36297 - DNA, 25 bp, Homo sapien
gctccgtgtgaataaatgcccagtg

SEQ ID NO: 36298 - DNA, 25 bp, Homo sapien
tccgtgtgaataaatgcccagtggc

SEQ ID NO: 36299 - DNA, 25 bp, Homo sapien
aaccactatttaaatgatgctgctt

SEQ ID NO: 36300 - DNA, 25 bp, Homo sapien
gctttaagtgtttggggcaggataa

SEQ ID NO: 36301 - DNA, 25 bp, Homo sapien
ccttactgtctataattaacttcag

SEQ ID NO: 36302 - DNA, 25 bp, Homo sapien
acacactattttggagggaggatac

SEQ ID NO: 36303 - DNA, 25 bp, Homo sapien
cccagctttcagagcactgaattat

SEQ ID NO: 36304 - DNA, 25 bp, Homo sapien
tattgtgagctggtgactctgcagg

SEQ ID NO: 36305 - DNA, 25 bp, Homo sapien
gactctgcaggcctgagtggtatta

SEQ ID NO: 36306 - DNA, 25 bp, Homo sapien
gcaggcctgagtggtattagggttg

SEQ ID NO: 36307 - DNA, 25 bp, Homo sapien
ttagggttgtggaatgttgttgcat

SEQ ID NO: 36308 - DNA, 25 bp, Homo sapien
ggaatgttgttgcatacacgtttat

SEQ ID NO: 36309 - DNA, 25 bp, Homo sapien
acacgtttatgagttaaccactatt

SEQ ID NO: 36310 - DNA, 25 bp, Homo sapien
ggcagaggcagcaggccatatggct

SEQ ID NO: 36311 - DNA, 25 bp, Homo sapien
cgctaccacagggctgggcagaaag

SEQ ID NO: 36312 - DNA, 25 bp, Homo sapien
ggacaaaggtgcccaactgaagggt

SEQ ID NO: 36313 - DNA, 25 bp, Homo sapien
gaagggtaagcatggcagtgagtat

SEQ ID NO: 36314 - DNA, 25 bp, Homo sapien
gtatctcttcccaactcaaaagtct

SEQ ID NO: 36315 - DNA, 25 bp, Homo sapien
ctcaaaagtctcactttgggctgaa

SEQ ID NO: 36316 - DNA, 25 bp, Homo sapien
agaagagtctgaataagcccccaac

SEQ ID NO: 36317 - DNA, 25 bp, Homo sapien
ccctttctcaatttctgttggcagt

SEQ ID NO: 36318 - DNA, 25 bp, Homo sapien
atagctcagtttaacctggattgtg

SEQ ID NO: 36319 - DNA, 25 bp, Homo sapien
attgcattggccaaatctcgacaat

SEQ ID NO: 36320 - DNA, 25 bp, Homo sapien
aaatctcgacaatttgagcattcaa

SEQ ID NO: 36321 - DNA, 25 bp, Homo sapien
tacgctgcaggccttgaagctgccg

SEQ ID NO: 36322 - DNA, 25 bp, Homo sapien
tgccggcgggaggcgagacgacggc

SEQ ID NO: 36323 - DNA, 25 bp, Homo sapien
gccgcaggtacaggcaggcgggcag

SEQ ID NO: 36324 - DNA, 25 bp, Homo sapien
gcgctcacgaaccggtagtcgtagg

SEQ ID NO: 36325 - DNA, 25 bp, Homo sapien
tagtcgtaggcgagcggctcagggg

SEQ ID NO: 36326 - DNA, 25 bp, Homo sapien
tgcgggtcccgatggggggacctgg

SEQ ID NO: 36327 - DNA, 25 bp, Homo sapien
tcgcgcacgtactgcgcgggcaggt

SEQ ID NO: 36328 - DNA, 25 bp, Homo sapien
cgtactgcgcgggcaggtagaaggg

SEQ ID NO: 36329 - DNA, 25 bp, Homo sapien
gcctcttagacgttctctgagtcgc

SEQ ID NO: 36330 - DNA, 25 bp, Homo sapien
ctgagtcgctgcgcgacaggggcag

SEQ ID NO: 36331 - DNA, 25 bp, Homo sapien
gctgcgcgacaggggcagcaggcac

SEQ ID NO: 36332 - DNA, 25 bp, Homo sapien
cagtgagtcgaggttgcgctactgc

SEQ ID NO: 36333 - DNA, 25 bp, Homo sapien
aaacctacagctgttcaaggaccag

SEQ ID NO: 36334 - DNA, 25 bp, Homo sapien
caaggaccagctgacaggtcaagtg

SEQ ID NO: 36335 - DNA, 25 bp, Homo sapien
caggtcaagtgtggccttttctggt

SEQ ID NO: 36336 - DNA, 25 bp, Homo sapien
ggccttttctggtctttgaacacat

SEQ ID NO: 36337 - DNA, 25 bp, Homo sapien
agaaagtgacaaatgctgcaaagcc

SEQ ID NO: 36338 - DNA, 25 bp, Homo sapien
aacgggtagactaactgcccagctt

SEQ ID NO: 36339 - DNA, 25 bp, Homo sapien
actgcccagcttagacacttatcta

SEQ ID NO: 36340 - DNA, 25 bp, Homo sapien
agacacttatctatgccacaaaaca

SEQ ID NO: 36341 - DNA, 25 bp, Homo sapien
aaacagctgaatttgtcacatttat

SEQ ID NO: 36342 - DNA, 25 bp, Homo sapien
aacaggattccattgacctaattat

SEQ ID NO: 36343 - DNA, 25 bp, Homo sapien
ttttatgttattccttggcaaggtg

SEQ ID NO: 36344 - DNA, 25 bp, Homo sapien
ttggcaaggtgctgatagtctgcag

SEQ ID NO: 36345 - DNA, 25 bp, Homo sapien
gatagtctgcagcacaggtttagct

SEQ ID NO: 36346 - DNA, 25 bp, Homo sapien
gctgggattatgctgctcaactacc

SEQ ID NO: 36347 - DNA, 25 bp, Homo sapien
gctgctcaactaccagcaggactac

SEQ ID NO: 36348 - DNA, 25 bp, Homo sapien
ctcattgcttcctgtctatttatga

SEQ ID NO: 36349 - DNA, 25 bp, Homo sapien
ggtagtggatgtattattcttgtgt

SEQ ID NO: 36350 - DNA, 25 bp, Homo sapien
caaaatacaatgatgggagccctgg

SEQ ID NO: 36351 - DNA, 25 bp, Homo sapien
gggagccctggcagagaattctata

SEQ ID NO: 36352 - DNA, 25 bp, Homo sapien
gaagctggtaagggaggcgtcgctg

SEQ ID NO: 36353 - DNA, 25 bp, Homo sapien
aggcgtcgctgattccagagagcta

SEQ ID NO: 36354 - DNA, 25 bp, Homo sapien
gcagcttttgtcagatgcttacttt

SEQ ID NO: 36355 - DNA, 25 bp, Homo sapien
gcttctggccgcatgaaggtcaagt

SEQ ID NO: 36356 - DNA, 25 bp, Homo sapien
tctggccgcatgaaggtcaagtgtg

SEQ ID NO: 36357 - DNA, 25 bp, Homo sapien
taaaagtattttgggtggtgctgag

SEQ ID NO: 36358 - DNA, 25 bp, Homo sapien
gaaaggagaaacatgggcttgggga

SEQ ID NO: 36359 - DNA, 25 bp, Homo sapien
gaagacctggcactaagctatagca

SEQ ID NO: 36360 - DNA, 25 bp, Homo sapien
gacctggcactaagctatagcactt

SEQ ID NO: 36361 - DNA, 25 bp, Homo sapien
actaagctatagcacttagcacctc

SEQ ID NO: 36362 - DNA, 25 bp, Homo sapien
atataagtagccaagcattattaat

SEQ ID NO: 36363 - DNA, 25 bp, Homo sapien
ctgtattcaagctatgtggacataa

SEQ ID NO: 36364 - DNA, 25 bp, Homo sapien
gttggtgctaataaacctaatctac

SEQ ID NO: 36365 - DNA, 25 bp, Homo sapien
tcgtggtcagtaaattccgggaaat

SEQ ID NO: 36366 - DNA, 25 bp, Homo sapien
aattcaacaggagctttccagtgga

SEQ ID NO: 36367 - DNA, 25 bp, Homo sapien
gaaggccagctgaatggtgaaacaa

SEQ ID NO: 36368 - DNA, 25 bp, Homo sapien
gtgaaacaaatacacccattgaagg

SEQ ID NO: 36369 - DNA, 25 bp, Homo sapien
gaggaagtactttctggggtcttag

SEQ ID NO: 36370 - DNA, 25 bp, Homo sapien
acagaactacgatataagccagact

SEQ ID NO: 36371 - DNA, 25 bp, Homo sapien
gccagacttgaaagagggctccaga

SEQ ID NO: 36372 - DNA, 25 bp, Homo sapien
gagggctccagaaaaagtagatgcg

SEQ ID NO: 36373 - DNA, 25 bp, Homo sapien
cagatcctactgatgaaattcccac

SEQ ID NO: 36374 - DNA, 25 bp, Homo sapien
gaccaacatcgagcagatttttagg

SEQ ID NO: 36375 - DNA, 25 bp, Homo sapien
gatttttaggtctttcgtggtcagt

SEQ ID NO: 36376 - DNA, 25 bp, Homo sapien
caggctgagagctcacctgttcagc

SEQ ID NO: 36377 - DNA, 25 bp, Homo sapien
gagctcacctgttcagcagagaagt

SEQ ID NO: 36378 - DNA, 25 bp, Homo sapien
ctgtctaccacagtgttatcagctt

SEQ ID NO: 36379 - DNA, 25 bp, Homo sapien
gtgttatcagcttcattgtcatcct

SEQ ID NO: 36380 - DNA, 25 bp, Homo sapien
tcatcctggtggttgtggtgatcat

SEQ ID NO: 36381 - DNA, 25 bp, Homo sapien
ggtggttgtggtgatcatcctagtt

SEQ ID NO: 36382 - DNA, 25 bp, Homo sapien
gatcatcctagttggtgtggtcagc

SEQ ID NO: 36383 - DNA, 25 bp, Homo sapien
ctagttggtgtggtcagcctgaggt

SEQ ID NO: 36384 - DNA, 25 bp, Homo sapien
gtcagcctgaggttcaagtgtcgga

SEQ ID NO: 36385 - DNA, 25 bp, Homo sapien
tcaagtgtcggaagagcaaggagtc

SEQ ID NO: 36386 - DNA, 25 bp, Homo sapien
gagcaaggagtctgaagatccccag

SEQ ID NO: 36387 - DNA, 25 bp, Homo sapien
ctccaccttccaatgcaacagttag

SEQ ID NO: 36388 - DNA, 25 bp, Homo sapien
cataagttttcaacacatgcttttt

SEQ ID NO: 36389 - DNA, 25 bp, Homo sapien
actcttaatttctgttgtactgcct

SEQ ID NO: 36390 - DNA, 25 bp, Homo sapien
gttgtactgccttctaatcttggcc

SEQ ID NO: 36391 - DNA, 25 bp, Homo sapien
ctaatcttggcctccatcatttcag

SEQ ID NO: 36392 - DNA, 25 bp, Homo sapien
ggcctccatcatttcagattaccaa

SEQ ID NO: 36393 - DNA, 25 bp, Homo sapien
ttcagattaccaaagctgtctctta

SEQ ID NO: 36394 - DNA, 25 bp, Homo sapien
aagctgtctcttaactggtttcttt

SEQ ID NO: 36395 - DNA, 25 bp, Homo sapien
ctcttaactggtttctttgtctcca

SEQ ID NO: 36396 - DNA, 25 bp, Homo sapien
ccttgtgcacttgctatctattctg

SEQ ID NO: 36397 - DNA, 25 bp, Homo sapien
tgctatctattctgtgtgctgcagc

SEQ ID NO: 36398 - DNA, 25 bp, Homo sapien
tgtctgttccttgggagcagggctc

SEQ ID NO: 36399 - DNA, 25 bp, Homo sapien
gttccttgggagcagggctccttgg

SEQ ID NO: 36400 - DNA, 25 bp, Homo sapien
tgggagcagggctccttggaaggca

SEQ ID NO: 36401 - DNA, 25 bp, Homo sapien
tcgctcggccggcctagagagagaa

SEQ ID NO: 36402 - DNA, 25 bp, Homo sapien
gctcggccggcctagagagagaaaa

SEQ ID NO: 36403 - DNA, 25 bp, Homo sapien
aaaggacgatttcaagtggagcctg

SEQ ID NO: 36404 - DNA, 25 bp, Homo sapien
aggaggcggcaaatagctcagtccg

SEQ ID NO: 36405 - DNA, 25 bp, Homo sapien
aggcggcaaatagctcagtccgcac

SEQ ID NO: 36406 - DNA, 25 bp, Homo sapien
cgtgctgagcagagacagcagcccc

SEQ ID NO: 36407 - DNA, 25 bp, Homo sapien
gacatggtccccactggggcaaggc

SEQ ID NO: 36408 - DNA, 25 bp, Homo sapien
tggtccccactggggcaaggctgca

SEQ ID NO: 36409 - DNA, 25 bp, Homo sapien
tgggttcaggtgatcctcatacctc

SEQ ID NO: 36410 - DNA, 25 bp, Homo sapien
gctggaactacaagtgtgtgccacc

SEQ ID NO: 36411 - DNA, 25 bp, Homo sapien
gtgtgccaccatgtctggctaattt

SEQ ID NO: 36412 - DNA, 25 bp, Homo sapien
gacagggttttactatgttgaccag

SEQ ID NO: 36413 - DNA, 25 bp, Homo sapien
tgttgaccagattggtcttaaactc

SEQ ID NO: 36414 - DNA, 25 bp, Homo sapien
ctagggttacaggtgttagccactg

SEQ ID NO: 36415 - DNA, 25 bp, Homo sapien
acctggcctctaaggtgattctgat

SEQ ID NO: 36416 - DNA, 25 bp, Homo sapien
gtgtgtattttggaaccactgtctc

SEQ ID NO: 36417 - DNA, 25 bp, Homo sapien
ggaaccactgtctcctagacagaaa

SEQ ID NO: 36418 - DNA, 25 bp, Homo sapien
gaaagcttctgtctcaaagatgatc

SEQ ID NO: 36419 - DNA, 25 bp, Homo sapien
gtctcaaagatgatcacattggtgt

SEQ ID NO: 36420 - DNA, 25 bp, Homo sapien
gaattctcttatctcgactatgtag

SEQ ID NO: 36421 - DNA, 25 bp, Homo sapien
atctcgactatgtagaataccacct

SEQ ID NO: 36422 - DNA, 25 bp, Homo sapien
gaataccacctactggacagaacaa

SEQ ID NO: 36423 - DNA, 25 bp, Homo sapien
gagatggcttgagaggagtaacact

SEQ ID NO: 36424 - DNA, 25 bp, Homo sapien
aacactgtagtaccttggaacccag

SEQ ID NO: 36425 - DNA, 25 bp, Homo sapien
aattcgccgattacaaagacaccat

SEQ ID NO: 36426 - DNA, 25 bp, Homo sapien
aatactttctgatcaaacaggttca

SEQ ID NO: 36427 - DNA, 25 bp, Homo sapien
gtgtaacagttacgccatacttcat

SEQ ID NO: 36428 - DNA, 25 bp, Homo sapien
gttacgccatacttcataagtggta

SEQ ID NO: 36429 - DNA, 25 bp, Homo sapien
gttgggcatagtagtgattgggtga

SEQ ID NO: 36430 - DNA, 25 bp, Homo sapien
ggagctaaaggatgtttctttcagt

SEQ ID NO: 36431 - DNA, 25 bp, Homo sapien
tcgggggctataccgagacgcagcc

SEQ ID NO: 36432 - DNA, 25 bp, Homo sapien
ggcctccgggatcagtggggatgag

SEQ ID NO: 36433 - DNA, 25 bp, Homo sapien
tagggccctgctgggacatgggggc

SEQ ID NO: 36434 - DNA, 25 bp, Homo sapien
ctgagtgcccatccaagggctctca

SEQ ID NO: 36435 - DNA, 25 bp, Homo sapien
atccaagggctctcaaggacaccgg

SEQ ID NO: 36436 - DNA, 25 bp, Homo sapien
tcctgggccttggtccccagaagat

SEQ ID NO: 36437 - DNA, 25 bp, Homo sapien
agaagatggcggctagggcctcgcc

SEQ ID NO: 36438 - DNA, 25 bp, Homo sapien
cctcgccgccaggacagagaaggga

SEQ ID NO: 36439 - DNA, 25 bp, Homo sapien
gtcagggaaggagggtcgcccggat

SEQ ID NO: 36440 - DNA, 25 bp, Homo sapien
tcgcccggatccgacattttggaga

SEQ ID NO: 36441 - DNA, 25 bp, Homo sapien
tggagagattccttcactctcctgt

SEQ ID NO: 36442 - DNA, 25 bp, Homo sapien
agacagggtctcactataatgctta

SEQ ID NO: 36443 - DNA, 25 bp, Homo sapien
ccctgtctcccaaagtgctaggatt

SEQ ID NO: 36444 - DNA, 25 bp, Homo sapien
accacacctggcccatagttgtatt

SEQ ID NO: 36445 - DNA, 25 bp, Homo sapien
aacaaatcaatcatggtttcttcta

SEQ ID NO: 36446 - DNA, 25 bp, Homo sapien
gtttcttctagcgttgcgcaaacac

SEQ ID NO: 36447 - DNA, 25 bp, Homo sapien
gcaaacactgacccagcttctgggt

SEQ ID NO: 36448 - DNA, 25 bp, Homo sapien
tatggaaataaccctgtgatgatgt

SEQ ID NO: 36449 - DNA, 25 bp, Homo sapien
ctctaccattcattcttctggtatt

SEQ ID NO: 36450 - DNA, 25 bp, Homo sapien
gaatccactgtttaatcagatccat

SEQ ID NO: 36451 - DNA, 25 bp, Homo sapien
tctttaacagattcaccacaaattt

SEQ ID NO: 36452 - DNA, 25 bp, Homo sapien
acaaattttcatgggcgttgagtgc

SEQ ID NO: 36453 - DNA, 25 bp, Homo sapien
cgcctgcaagggctggatggccaga

SEQ ID NO: 36454 - DNA, 25 bp, Homo sapien
tggagctggagctgcggcaggagcg

SEQ ID NO: 36455 - DNA, 25 bp, Homo sapien
ctggatggccagaacactcgggaca

SEQ ID NO: 36456 - DNA, 25 bp, Homo sapien
cgtctggccaaggagctcgaggagg

SEQ ID NO: 36457 - DNA, 25 bp, Homo sapien
gcgaaggcatcggagcggagcctgc

SEQ ID NO: 36458 - DNA, 25 bp, Homo sapien
ccggctgaagacgctgaccagcgag

SEQ ID NO: 36459 - DNA, 25 bp, Homo sapien
cagcgagctggcattgtacaagagg

SEQ ID NO: 36460 - DNA, 25 bp, Homo sapien
caagagggggaggcggactccgccg

SEQ ID NO: 36461 - DNA, 25 bp, Homo sapien
gggagaatgagatctggcacctgcg

SEQ ID NO: 36462 - DNA, 25 bp, Homo sapien
acctgcgggagcaggtgtcgcgcct

SEQ ID NO: 36463 - DNA, 25 bp, Homo sapien
cctggcgtccgagaagcgggagctg

SEQ ID NO: 36464 - DNA, 25 bp, Homo sapien
cagccttgtaactgtatttaccatg

SEQ ID NO: 36465 - DNA, 25 bp, Homo sapien
ccatgataatatattctgcacggta

SEQ ID NO: 36466 - DNA, 25 bp, Homo sapien
gcacggtaagaattccttttacaga

SEQ ID NO: 36467 - DNA, 25 bp, Homo sapien
acattctttatcaagaggtcggccc

SEQ ID NO: 36468 - DNA, 25 bp, Homo sapien
caaatgcaggcctgtgtgtagctgt

SEQ ID NO: 36469 - DNA, 25 bp, Homo sapien
tgttttttctgtggttgccgcattt

SEQ ID NO: 36470 - DNA, 25 bp, Homo sapien
tgtggttgccgcatttattccacct

SEQ ID NO: 36471 - DNA, 25 bp, Homo sapien
atagagaacagcggtgggggatggg

SEQ ID NO: 36472 - DNA, 25 bp, Homo sapien
gtagagaacctcctttctgttcaac

SEQ ID NO: 36473 - DNA, 25 bp, Homo sapien
gttcaactaatttcacgtgacagtg

SEQ ID NO: 36474 - DNA, 25 bp, Homo sapien
gtgacagtgcatgtatttattcaat

SEQ ID NO: 36475 - DNA, 25 bp, Homo sapien
gtgttagtagtctggctgtgtgccc

SEQ ID NO: 36476 - DNA, 25 bp, Homo sapien
ctgtgtgcccaaaattctgtttcgc

SEQ ID NO: 36477 - DNA, 25 bp, Homo sapien
gtgcccaaaattctgtttcgcagca

SEQ ID NO: 36478 - DNA, 25 bp, Homo sapien
gtttcgcagcaaaagtgaagacctg

SEQ ID NO: 36479 - DNA, 25 bp, Homo sapien
tgggttttttgaggctccaacctga

SEQ ID NO: 36480 - DNA, 25 bp, Homo sapien
ggctccaacctgattagtgcatggt

SEQ ID NO: 36481 - DNA, 25 bp, Homo sapien
caatgaaggctgaggcatctctgac

SEQ ID NO: 36482 - DNA, 25 bp, Homo sapien
ggcatctctgactgaggtgtttttg

SEQ ID NO: 36483 - DNA, 25 bp, Homo sapien
gtacttgtctcaatgggaatggtgt

SEQ ID NO: 36484 - DNA, 25 bp, Homo sapien
aaaaggccttatgtgatctgtatca

SEQ ID NO: 36485 - DNA, 25 bp, Homo sapien
gaaaatttggaatagtgctgctgcc

SEQ ID NO: 36486 - DNA, 25 bp, Homo sapien
gcctatttctaagcactgggtgtaa

SEQ ID NO: 36487 - DNA, 25 bp, Homo sapien
aagacacttgcaaaggaagagctaa

SEQ ID NO: 36488 - DNA, 25 bp, Homo sapien
atttctttggtttttctattgcttg

SEQ ID NO: 36489 - DNA, 25 bp, Homo sapien
ggtttttctattgcttgttattatt

SEQ ID NO: 36490 - DNA, 25 bp, Homo sapien
atcagttaatgtctttagcacacta

SEQ ID NO: 36491 - DNA, 25 bp, Homo sapien
attatgtgtattttcttctctttta

SEQ ID NO: 36492 - DNA, 25 bp, Homo sapien
gtattttcttctcttttacataaat

SEQ ID NO: 36493 - DNA, 25 bp, Homo sapien
agtgtgctcaacttttttacaagag

SEQ ID NO: 36494 - DNA, 25 bp, Homo sapien
gatattaacttggatttatttttca

SEQ ID NO: 36495 - DNA, 25 bp, Homo sapien
tataatttggagaccctttgttatc

SEQ ID NO: 36496 - DNA, 25 bp, Homo sapien
tggagaccctttgttatccaaataa

SEQ ID NO: 36497 - DNA, 25 bp, Homo sapien
tggagcgcttaccagtgaccaagag

SEQ ID NO: 36498 - DNA, 25 bp, Homo sapien
ggcagtgtccaagcaacaagcctcc

SEQ ID NO: 36499 - DNA, 25 bp, Homo sapien
ggctcctgaaactcacatgggtaaa

SEQ ID NO: 36500 - DNA, 25 bp, Homo sapien
gccgagacgggacagtggatccagt

SEQ ID NO: 36501 - DNA, 25 bp, Homo sapien
gatgcatccaaactcattagactac

SEQ ID NO: 36502 - DNA, 25 bp, Homo sapien
caaggatcacggaaactgttggttg

SEQ ID NO: 36503 - DNA, 25 bp, Homo sapien
gttggttgacaatagcatacgggaa

SEQ ID NO: 36504 - DNA, 25 bp, Homo sapien
catacgggaactgcaatacacaaaa

SEQ ID NO: 36505 - DNA, 25 bp, Homo sapien
ggctgaggcctgtgtgacaaatgat

SEQ ID NO: 36506 - DNA, 25 bp, Homo sapien
gtaagggacatctatttgttgggaa

SEQ ID NO: 36507 - DNA, 25 bp, Homo sapien
ctgcttttctggagcgcttaccagt

SEQ ID NO: 36508 - DNA, 25 bp, Homo sapien
tggacgcggtgctgggcgtcatgga

SEQ ID NO: 36509 - DNA, 25 bp, Homo sapien
cggtgctgggcgtcatggacgcggc

SEQ ID NO: 36510 - DNA, 25 bp, Homo sapien
acctcgagctgaacgacgtcatcgg

SEQ ID NO: 36511 - DNA, 25 bp, Homo sapien
cctcgagctgaacgacgtcatcggc

SEQ ID NO: 36512 - DNA, 25 bp, Homo sapien
ctcgagctgaacgacgtcatcggcc

SEQ ID NO: 36513 - DNA, 25 bp, Homo sapien
gcaccccacttctgtatacataaac

SEQ ID NO: 36514 - DNA, 25 bp, Homo sapien
accccacttctgtatacataaacgg

SEQ ID NO: 36515 - DNA, 25 bp, Homo sapien
cccacttctgtatacataaacggcc

SEQ ID NO: 36516 - DNA, 25 bp, Homo sapien
acttctgtatacataaacggccaag

SEQ ID NO: 36517 - DNA, 25 bp, Homo sapien
tctgtatacataaacggccaaggtg

SEQ ID NO: 36518 - DNA, 25 bp, Homo sapien
tgtatacataaacggccaaggtgtg

SEQ ID NO: 36519 - DNA, 25 bp, Homo sapien
ttggggccagactggctgcacagcc

SEQ ID NO: 36520 - DNA, 25 bp, Homo sapien
acagcccaaccaggaggggtctgcc

SEQ ID NO: 36521 - DNA, 25 bp, Homo sapien
tgtctgcatggcagaagcgtctccc

SEQ ID NO: 36522 - DNA, 25 bp, Homo sapien
ttcctgttctcagcatccactaata

SEQ ID NO: 36523 - DNA, 25 bp, Homo sapien
gcatccactaatattcagtcctgta

SEQ ID NO: 36524 - DNA, 25 bp, Homo sapien
attcccacataatacattccatcac

SEQ ID NO: 36525 - DNA, 25 bp, Homo sapien
ccagcccagctccactcagggctgg

SEQ ID NO: 36526 - DNA, 25 bp, Homo sapien
ggctagccccagggtgagcagggcc

SEQ ID NO: 36527 - DNA, 25 bp, Homo sapien
tccaggagggcatcagctttccctg

SEQ ID NO: 36528 - DNA, 25 bp, Homo sapien
ttccctggctcagggatcttctccc

SEQ ID NO: 36529 - DNA, 25 bp, Homo sapien
gccaaggcctcaggagagcatcacc

SEQ ID NO: 36530 - DNA, 25 bp, Homo sapien
tcgttcttactggcgtcaatcttcg

SEQ ID NO: 36531 - DNA, 25 bp, Homo sapien
ttcttactggcgtcaatcttcgccc

SEQ ID NO: 36532 - DNA, 25 bp, Homo sapien
gctcctccgacatagtgctagtgtc

SEQ ID NO: 36533 - DNA, 25 bp, Homo sapien
cctccgacatagtgctagtgtctcc

SEQ ID NO: 36534 - DNA, 25 bp, Homo sapien
cgacatagtgctagtgtctccgccg

SEQ ID NO: 36535 - DNA, 25 bp, Homo sapien
tgccgcgaaccgaaactagcagcaa

SEQ ID NO: 36536 - DNA, 25 bp, Homo sapien
ccgcgaaccgaaactagcagcaaag

SEQ ID NO: 36537 - DNA, 25 bp, Homo sapien
cgaaactagcagcaaagtaatcccc

SEQ ID NO: 36538 - DNA, 25 bp, Homo sapien
ctacctcgcgaagcacacaagacag

SEQ ID NO: 36539 - DNA, 25 bp, Homo sapien
acctcgcgaagcacacaagacaggg

SEQ ID NO: 36540 - DNA, 25 bp, Homo sapien
cgcgaagcacacaagacagggaagg

SEQ ID NO: 36541 - DNA, 25 bp, Homo sapien
aaaaaggtgtctgtgctatttctgt

SEQ ID NO: 36542 - DNA, 25 bp, Homo sapien
gtgtctgtgctatttctgtacagct

SEQ ID NO: 36543 - DNA, 25 bp, Homo sapien
gtgctatttctgtacagctatagag

SEQ ID NO: 36544 - DNA, 25 bp, Homo sapien
gtacagctatagagatgactactac

SEQ ID NO: 36545 - DNA, 25 bp, Homo sapien
gatgactactacagaatcttatttt

SEQ ID NO: 36546 - DNA, 25 bp, Homo sapien
caaacagacagaggcttatactgga

SEQ ID NO: 36547 - DNA, 25 bp, Homo sapien
gacagaggcttatactggaataatg

SEQ ID NO: 36548 - DNA, 25 bp, Homo sapien
ggctgagatggatcatctgagcctc

SEQ ID NO: 36549 - DNA, 25 bp, Homo sapien
gagatggatcatctgagcctcagga

SEQ ID NO: 36550 - DNA, 25 bp, Homo sapien
aagctgtcctacaaagttgagcttt

SEQ ID NO: 36551 - DNA, 25 bp, Homo sapien
gctttgttagtttttcatgtgtaat

SEQ ID NO: 36552 - DNA, 25 bp, Homo sapien
caggtgcggggactcgtggaaggat

SEQ ID NO: 36553 - DNA, 25 bp, Homo sapien
gcgcttgagaaagatcgctccgctc

SEQ ID NO: 36554 - DNA, 25 bp, Homo sapien
atcgctccgctcctgtaaggaagag

SEQ ID NO: 36555 - DNA, 25 bp, Homo sapien
agacacagtcagaagctccgaggct

SEQ ID NO: 36556 - DNA, 25 bp, Homo sapien
gcctaacagaggcccaggttggagc

SEQ ID NO: 36557 - DNA, 25 bp, Homo sapien
gaagggaagctgacgccatgtggga

SEQ ID NO: 36558 - DNA, 25 bp, Homo sapien
gtagaactgtccgcaaattcgtccc

SEQ ID NO: 36559 - DNA, 25 bp, Homo sapien
ggagtcttcagaccagtcaaggccg

SEQ ID NO: 36560 - DNA, 25 bp, Homo sapien
gttatttgtttgcagcacgcggtct

SEQ ID NO: 36561 - DNA, 25 bp, Homo sapien
accctgcaggatttaccagcttttt

SEQ ID NO: 36562 - DNA, 25 bp, Homo sapien
tggcctatgcaatcaatacgtccct

SEQ ID NO: 36563 - DNA, 25 bp, Homo sapien
aggggaacttgggctttgaggcgag

SEQ ID NO: 36564 - DNA, 25 bp, Homo sapien
gaacttgggctttgaggcgagacct

SEQ ID NO: 36565 - DNA, 25 bp, Homo sapien
gggctttgaggcgagacctaattct

SEQ ID NO: 36566 - DNA, 25 bp, Homo sapien
gagacctaattcttagggtgctcta

SEQ ID NO: 36567 - DNA, 25 bp, Homo sapien
gggtgctctatgaggacatgggtgg

SEQ ID NO: 36568 - DNA, 25 bp, Homo sapien
catgggtggtgggcaaagtgacagc

SEQ ID NO: 36569 - DNA, 25 bp, Homo sapien
tggtgggcaaagtgacagccgcctg

SEQ ID NO: 36570 - DNA, 25 bp, Homo sapien
ttgcccccaggatgaatacgacgac

SEQ ID NO: 36571 - DNA, 25 bp, Homo sapien
gaaaatggagttctgagagctagga

SEQ ID NO: 36572 - DNA, 25 bp, Homo sapien
gttctgagagctaggaaactgggag

SEQ ID NO: 36573 - DNA, 25 bp, Homo sapien
ccaggagcaggggaacttgggcttt

SEQ ID NO: 36574 - DNA, 25 bp, Homo sapien
agaacaagaacccatctcaaacaaa

SEQ ID NO: 36575 - DNA, 25 bp, Homo sapien
actcttgtctccttaggatatgtta

SEQ ID NO: 36576 - DNA, 25 bp, Homo sapien
ttaggatatgttacctgctccactg

SEQ ID NO: 36577 - DNA, 25 bp, Homo sapien
tacctgctccactgcagactagaga

SEQ ID NO: 36578 - DNA, 25 bp, Homo sapien
gtattgaaccttttactgcaaactt

SEQ ID NO: 36579 - DNA, 25 bp, Homo sapien
tacatggcgggaaacacacaggcat

SEQ ID NO: 36580 - DNA, 25 bp, Homo sapien
aaagctagctttgttgtatctgaac

SEQ ID NO: 36581 - DNA, 25 bp, Homo sapien
gtatctgaacacatgaatctttttt

SEQ ID NO: 36582 - DNA, 25 bp, Homo sapien
gaatcttttttggtcagtgtaggaa

SEQ ID NO: 36583 - DNA, 25 bp, Homo sapien
gaagcacagccagatcctataggaa

SEQ ID NO: 36584 - DNA, 25 bp, Homo sapien
gagattaaaccactgtgccattttt

SEQ ID NO: 36585 - DNA, 25 bp, Homo sapien
gactacggaggggttgccagggtga

SEQ ID NO: 36586 - DNA, 25 bp, Homo sapien
tgccagggtgatgacaactccgtga

SEQ ID NO: 36587 - DNA, 25 bp, Homo sapien
gatctcttggaagcgaggatccttt

SEQ ID NO: 36588 - DNA, 25 bp, Homo sapien
aaatcctggaatatacactgcagta

SEQ ID NO: 36589 - DNA, 25 bp, Homo sapien
agcatacctcagccttaaacgactg

SEQ ID NO: 36590 - DNA, 25 bp, Homo sapien
ggttttcagtttgtgggttctgaat

SEQ ID NO: 36591 - DNA, 25 bp, Homo sapien
tgggttctgaatccacacaaagaca

SEQ ID NO: 36592 - DNA, 25 bp, Homo sapien
cacaaagacaggattgctttctgaa

SEQ ID NO: 36593 - DNA, 25 bp, Homo sapien
tacagtcacagatatcaccaagatt

SEQ ID NO: 36594 - DNA, 25 bp, Homo sapien
atcaccaagattagtttgttgttat

SEQ ID NO: 36595 - DNA, 25 bp, Homo sapien
gaaggccttgactacggaggggttg

SEQ ID NO: 36596 - DNA, 25 bp, Homo sapien
ccccatgtccttgggaggagggacg

SEQ ID NO: 36597 - DNA, 25 bp, Homo sapien
ggagggacgagaggagagggggagc

SEQ ID NO: 36598 - DNA, 25 bp, Homo sapien
agaggagagggggagctcacggcaa

SEQ ID NO: 36599 - DNA, 25 bp, Homo sapien
gtccgcaggtggtacttgagcgact

SEQ ID NO: 36600 - DNA, 25 bp, Homo sapien
ggtacttgagcgactgcttgtagcg

SEQ ID NO: 36601 - DNA, 25 bp, Homo sapien
gcttgtagcggaagcacttggcgca

SEQ ID NO: 36602 - DNA, 25 bp, Homo sapien
gaagcacttggcgcagtgcgtgcag

SEQ ID NO: 36603 - DNA, 25 bp, Homo sapien
cttggcgcagtgcgtgcaggggtag

SEQ ID NO: 36604 - DNA, 25 bp, Homo sapien
gcgctggtgctccagcaggtgatgc

SEQ ID NO: 36605 - DNA, 25 bp, Homo sapien
tccagcaggtgatgcttctgcgtga

SEQ ID NO: 36606 - DNA, 25 bp, Homo sapien
gcagcaagggacctggtctcactgc

SEQ ID NO: 36607 - DNA, 25 bp, Homo sapien
agagcaagcctaactcaagccattg

SEQ ID NO: 36608 - DNA, 25 bp, Homo sapien
ggaccagcttaatggttctgctcct

SEQ ID NO: 36609 - DNA, 25 bp, Homo sapien
ttctgctcctggtaacgtttttatc

SEQ ID NO: 36610 - DNA, 25 bp, Homo sapien
acagttcctgtcataccttttaaag

SEQ ID NO: 36611 - DNA, 25 bp, Homo sapien
gtcggcttgactacactgtgtggag

SEQ ID NO: 36612 - DNA, 25 bp, Homo sapien
gcaggcagacctgttatcctaaact

SEQ ID NO: 36613 - DNA, 25 bp, Homo sapien
ctgcttgaaagggtcttgcctcacc

SEQ ID NO: 36614 - DNA, 25 bp, Homo sapien
ttgcctcacccaagctagagtgcag

SEQ ID NO: 36615 - DNA, 25 bp, Homo sapien
gagtgcagtggcctttgaagcttac

SEQ ID NO: 36616 - DNA, 25 bp, Homo sapien
agcttactacagcctcaaacttctg

SEQ ID NO: 36617 - DNA, 25 bp, Homo sapien
agcctcccagtggtctttgtagact

SEQ ID NO: 36618 - DNA, 25 bp, Homo sapien
cccgggttagtgtgcctgacaacac

SEQ ID NO: 36619 - DNA, 25 bp, Homo sapien
ccagaattacttcgttttatacatt

SEQ ID NO: 36620 - DNA, 25 bp, Homo sapien
tcacttctcttctgaaatcacagca

SEQ ID NO: 36621 - DNA, 25 bp, Homo sapien
agtttgcgccttttggtctgaggaa

SEQ ID NO: 36622 - DNA, 25 bp, Homo sapien
ttttggtctgaggaacgcaggccct

SEQ ID NO: 36623 - DNA, 25 bp, Homo sapien
ggccctggccactaccaggaaaaag

SEQ ID NO: 36624 - DNA, 25 bp, Homo sapien
gaatgtatatctttaccgtatgcct

SEQ ID NO: 36625 - DNA, 25 bp, Homo sapien
accgtatgcctagtacagtagtgct

SEQ ID NO: 36626 - DNA, 25 bp, Homo sapien
gttgaatggacctcccagaatcacg

SEQ ID NO: 36627 - DNA, 25 bp, Homo sapien
tcacacttcctcggacactaatttg

SEQ ID NO: 36628 - DNA, 25 bp, Homo sapien
tagttcaggcccagagacggcttcc

SEQ ID NO: 36629 - DNA, 25 bp, Homo sapien
tcctcaagtcggcctggaagtgggc

SEQ ID NO: 36630 - DNA, 25 bp, Homo sapien
gtcggcctggaagtgggcctggaag

SEQ ID NO: 36631 - DNA, 25 bp, Homo sapien
agtgggcctggaagagcagcaagtc

SEQ ID NO: 36632 - DNA, 25 bp, Homo sapien
aggtgcaaaacttcctcgagtcagc

SEQ ID NO: 36633 - DNA, 25 bp, Homo sapien
cttttgacttttggcagcctcttca

SEQ ID NO: 36634 - DNA, 25 bp, Homo sapien
cagcctcttcaggcgcagaacttga

SEQ ID NO: 36635 - DNA, 25 bp, Homo sapien
tcaggcgcagaacttgatctccagt

SEQ ID NO: 36636 - DNA, 25 bp, Homo sapien
cctgccagtggcctctttaggccaa

SEQ ID NO: 36637 - DNA, 25 bp, Homo sapien
tttaggccaagctcattcctcacaa

SEQ ID NO: 36638 - DNA, 25 bp, Homo sapien
cctcttggcctctaatttgtttatc

SEQ ID NO: 36639 - DNA, 25 bp, Homo sapien
gcctctaatttgtttatcttttgtg

SEQ ID NO: 36640 - DNA, 25 bp, Homo sapien
acagcatggtgagtgtgtccacgcc

SEQ ID NO: 36641 - DNA, 25 bp, Homo sapien
ccatcgcggacatctacgagcagga

SEQ ID NO: 36642 - DNA, 25 bp, Homo sapien
cggcttcctctatatggtctacgcc

SEQ ID NO: 36643 - DNA, 25 bp, Homo sapien
gagccagcagtaggggggctcggcc

SEQ ID NO: 36644 - DNA, 25 bp, Homo sapien
agagctcctggttcctgaactgagc

SEQ ID NO: 36645 - DNA, 25 bp, Homo sapien
tggtgggctgggcaggcatgtgccc

SEQ ID NO: 36646 - DNA, 25 bp, Homo sapien
gtgcccccctagtcagagggcacca

SEQ ID NO: 36647 - DNA, 25 bp, Homo sapien
agggtggggagcagctcccagcacc

SEQ ID NO: 36648 - DNA, 25 bp, Homo sapien
ctgctgtgtggttcatctttttttt

SEQ ID NO: 36649 - DNA, 25 bp, Homo sapien
ctcggtctccacgtggtgtatggat

SEQ ID NO: 36650 - DNA, 25 bp, Homo sapien
tatggatctgtggtcattgtccctc

SEQ ID NO: 36651 - DNA, 25 bp, Homo sapien
aatagaaattatctcactacttaaa

SEQ ID NO: 36652 - DNA, 25 bp, Homo sapien
ttaaatcccatttttttcacttcat

SEQ ID NO: 36653 - DNA, 25 bp, Homo sapien
aaatcccatttttttcacttcatat

SEQ ID NO: 36654 - DNA, 25 bp, Homo sapien
gtagtatcagcgaaatcagtcatgt

SEQ ID NO: 36655 - DNA, 25 bp, Homo sapien
gcgaaatcagtcatgtttatacctt

SEQ ID NO: 36656 - DNA, 25 bp, Homo sapien
atcagtcatgtttataccttgaata

SEQ ID NO: 36657 - DNA, 25 bp, Homo sapien
tatttagtagtatcttatatttgta

SEQ ID NO: 36658 - DNA, 25 bp, Homo sapien
acattttgcaaattagtatcacaac

SEQ ID NO: 36659 - DNA, 25 bp, Homo sapien
gtatcacaactgctaagtagatgtt

SEQ ID NO: 36660 - DNA, 25 bp, Homo sapien
gctaagtagatgtttctgagtatta

SEQ ID NO: 36661 - DNA, 25 bp, Homo sapien
aaatcagtgttattacctgcaggat

SEQ ID NO: 36662 - DNA, 25 bp, Homo sapien
gactcactggaaagatactctctaa

SEQ ID NO: 36663 - DNA, 25 bp, Homo sapien
gaactcactttggagatagacccta

SEQ ID NO: 36664 - DNA, 25 bp, Homo sapien
tacagttatcccccaatatattgca

SEQ ID NO: 36665 - DNA, 25 bp, Homo sapien
agtcctttgttatatggcatatttg

SEQ ID NO: 36666 - DNA, 25 bp, Homo sapien
gtatactgtgtaaatcatctctaga

SEQ ID NO: 36667 - DNA, 25 bp, Homo sapien
atctctagatgacttttaatacctc

SEQ ID NO: 36668 - DNA, 25 bp, Homo sapien
gatgacttttaatacctcatgcatt

SEQ ID NO: 36669 - DNA, 25 bp, Homo sapien
aatagtctctacatgttcgatgcag

SEQ ID NO: 36670 - DNA, 25 bp, Homo sapien
atgttcgatgcagacacaaccattg

SEQ ID NO: 36671 - DNA, 25 bp, Homo sapien
gcaggcccacctacgtggtatatgt

SEQ ID NO: 36672 - DNA, 25 bp, Homo sapien
acgtggtatatgtcacccagaacat

SEQ ID NO: 36673 - DNA, 25 bp, Homo sapien
gcaaaaccccgtctctatgaaaaat

SEQ ID NO: 36674 - DNA, 25 bp, Homo sapien
gtgagcagagatcgtgccattgcac

SEQ ID NO: 36675 - DNA, 25 bp, Homo sapien
aacccaacatatatgggctgttaga

SEQ ID NO: 36676 - DNA, 25 bp, Homo sapien
tatgggctgttagatagtaattgta

SEQ ID NO: 36677 - DNA, 25 bp, Homo sapien
aatactgcaggatgcttagtgctca

SEQ ID NO: 36678 - DNA, 25 bp, Homo sapien
tgcttagtgctcagtgttatgtatg

SEQ ID NO: 36679 - DNA, 25 bp, Homo sapien
gttatgtatgaacttgtggacttta

SEQ ID NO: 36680 - DNA, 25 bp, Homo sapien
gtggactttacaatgcaggttgaga

SEQ ID NO: 36681 - DNA, 25 bp, Homo sapien
aggttgagaactgctaatgtataga

SEQ ID NO: 36682 - DNA, 25 bp, Homo sapien
gaatgactaaacagctgtctttcag

SEQ ID NO: 36683 - DNA, 25 bp, Homo sapien
gactaaacagctgtctttcagggta

SEQ ID NO: 36684 - DNA, 25 bp, Homo sapien
cacccctgcacgcagtgggtggtgg

SEQ ID NO: 36685 - DNA, 25 bp, Homo sapien
cccctgcacgcagtgggtggtgggg

SEQ ID NO: 36686 - DNA, 25 bp, Homo sapien
aagtgtgtcaacacccagacagggc

SEQ ID NO: 36687 - DNA, 25 bp, Homo sapien
gacagggctgcccgaggaagacagt

SEQ ID NO: 36688 - DNA, 25 bp, Homo sapien
gggctgcccgaggaagacagtgacc

SEQ ID NO: 36689 - DNA, 25 bp, Homo sapien
tgaccagtgtggccacgaggcctgg

SEQ ID NO: 36690 - DNA, 25 bp, Homo sapien
gccgtgtggcaccgaggattgtgag

SEQ ID NO: 36691 - DNA, 25 bp, Homo sapien
gtgtggcaccgaggattgtgagccc

SEQ ID NO: 36692 - DNA, 25 bp, Homo sapien
tggcaccgaggattgtgagcccgtc

SEQ ID NO: 36693 - DNA, 25 bp, Homo sapien
tatttttttattctaacagtttgtg

SEQ ID NO: 36694 - DNA, 25 bp, Homo sapien
cagtttgtgtaacatttattatgat

SEQ ID NO: 36695 - DNA, 25 bp, Homo sapien
aaactctggagtcactgactggttt

SEQ ID NO: 36696 - DNA, 25 bp, Homo sapien
gactggtttgactttcatacggtga

SEQ ID NO: 36697 - DNA, 25 bp, Homo sapien
atatgcatttggtctgtactgatca

SEQ ID NO: 36698 - DNA, 25 bp, Homo sapien
gatcatggaataaacacatctctct

SEQ ID NO: 36699 - DNA, 25 bp, Homo sapien
aaatcctgcctatattttactcagt

SEQ ID NO: 36700 - DNA, 25 bp, Homo sapien
agatctgttgagttggtttttttgg

SEQ ID NO: 36701 - DNA, 25 bp, Homo sapien
tgggggcgccacagactaaggcaga

SEQ ID NO: 36702 - DNA, 25 bp, Homo sapien
cagactaaggcagagactcccctac

SEQ ID NO: 36703 - DNA, 25 bp, Homo sapien
aattggagcccctggtgaggttacg

SEQ ID NO: 36704 - DNA, 25 bp, Homo sapien
gaggttacgcgtgccatgagaaccc

SEQ ID NO: 36705 - DNA, 25 bp, Homo sapien
agtgttggccaaactctggagtcac

SEQ ID NO: 36706 - DNA, 25 bp, Homo sapien
tagaggaactaactcaacttctaat

SEQ ID NO: 36707 - DNA, 25 bp, Homo sapien
tatggcactgtcatgttttaacatt

SEQ ID NO: 36708 - DNA, 25 bp, Homo sapien
ttaactctcatttggcagactacta

SEQ ID NO: 36709 - DNA, 25 bp, Homo sapien
atttggcagactactactaatcaca

SEQ ID NO: 36710 - DNA, 25 bp, Homo sapien
ggttgttacacttccatagttgtct

SEQ ID NO: 36711 - DNA, 25 bp, Homo sapien
atagttgtcttagccgaatccttcc

SEQ ID NO: 36712 - DNA, 25 bp, Homo sapien
agccgaatccttccatattcttatg

SEQ ID NO: 36713 - DNA, 25 bp, Homo sapien
tattcttatgattacttgggttaaa

SEQ ID NO: 36714 - DNA, 25 bp, Homo sapien
gtgaggaccttttggctcttaagat

SEQ ID NO: 36715 - DNA, 25 bp, Homo sapien
gaccttttggctcttaagatatcct

SEQ ID NO: 36716 - DNA, 25 bp, Homo sapien
agtttactgaactagcagacgtgtg

SEQ ID NO: 36717 - DNA, 25 bp, Homo sapien
cagggtgaccaccatgacggggatg

SEQ ID NO: 36718 - DNA, 25 bp, Homo sapien
tgaccaccatgacggggatgctcag

SEQ ID NO: 36719 - DNA, 25 bp, Homo sapien
cgggtggcctgcgacaggcgaagga

SEQ ID NO: 36720 - DNA, 25 bp, Homo sapien
gcgaaggaagccatactctagtgag

SEQ ID NO: 36721 - DNA, 25 bp, Homo sapien
actctagtgagtactccacgatgta

SEQ ID NO: 36722 - DNA, 25 bp, Homo sapien
tctcggggaaggggaactcctggct

SEQ ID NO: 36723 - DNA, 25 bp, Homo sapien
ggaactcctggctgtcattcagggc

SEQ ID NO: 36724 - DNA, 25 bp, Homo sapien
ttgaacaccttgggctcgatgtcca

SEQ ID NO: 36725 - DNA, 25 bp, Homo sapien
ctcaaacttgatggagctgttccca

SEQ ID NO: 36726 - DNA, 25 bp, Homo sapien
gatggagctgttcccaaacatctcc

SEQ ID NO: 36727 - DNA, 25 bp, Homo sapien
ttcccaaacatctccatggtcagct

SEQ ID NO: 36728 - DNA, 25 bp, Homo sapien
gaggcgctgctcaacaagactatgc

SEQ ID NO: 36729 - DNA, 25 bp, Homo sapien
cagatggacggacactggtcggctg

SEQ ID NO: 36730 - DNA, 25 bp, Homo sapien
gtgactgcaatgtcatcctgggctc

SEQ ID NO: 36731 - DNA, 25 bp, Homo sapien
tcggcgcaggagttcctcaagccgt

SEQ ID NO: 36732 - DNA, 25 bp, Homo sapien
gacaccacatcgtttccattgaggt

SEQ ID NO: 36733 - DNA, 25 bp, Homo sapien
gcagagggagagtctgaccgggcct

SEQ ID NO: 36734 - DNA, 25 bp, Homo sapien
aggagaagctcgcgagatctgtgcc

SEQ ID NO: 36735 - DNA, 25 bp, Homo sapien
tgtgccgttgccgaggagactagga

SEQ ID NO: 36736 - DNA, 25 bp, Homo sapien
cgggcaaatggccggagctggaccg

SEQ ID NO: 36737 - DNA, 25 bp, Homo sapien
accgaccatgctgctacgagaagag

SEQ ID NO: 36738 - DNA, 25 bp, Homo sapien
gagaatggctgttgcagtcggcgtc

SEQ ID NO: 36739 - DNA, 25 bp, Homo sapien
ttgacttttcctagcagcgtgatca

SEQ ID NO: 36740 - DNA, 25 bp, Homo sapien
gcagcgtgatcatgggcaagtggct

SEQ ID NO: 36741 - DNA, 25 bp, Homo sapien
ggtaaatggcatgtcacgggtttgg

SEQ ID NO: 36742 - DNA, 25 bp, Homo sapien
ggcatgtcacgggtttggtagctta

SEQ ID NO: 36743 - DNA, 25 bp, Homo sapien
tgtcacgggtttggtagcttattct

SEQ ID NO: 36744 - DNA, 25 bp, Homo sapien
attctttcagaaactcttgcattat

SEQ ID NO: 36745 - DNA, 25 bp, Homo sapien
aactcttgcattatctgtagacgtg

SEQ ID NO: 36746 - DNA, 25 bp, Homo sapien
gacgtggacgtaaatatccacctca

SEQ ID NO: 36747 - DNA, 25 bp, Homo sapien
atatccacctcatagggtttccata

SEQ ID NO: 36748 - DNA, 25 bp, Homo sapien
gagataaggtctgtaaaggtcccac

SEQ ID NO: 36749 - DNA, 25 bp, Homo sapien
gtctgtaaaggtcccacagtgcttg

SEQ ID NO: 36750 - DNA, 25 bp, Homo sapien
gacacctagcaggaagggcttatgc

SEQ ID NO: 36751 - DNA, 25 bp, Homo sapien
caggttgggaggactcactctgtgc

SEQ ID NO: 36752 - DNA, 25 bp, Homo sapien
gctcagagcccttgtgtctgtgaac

SEQ ID NO: 36753 - DNA, 25 bp, Homo sapien
gcccttgtgtctgtgaactttcaat

SEQ ID NO: 36754 - DNA, 25 bp, Homo sapien
tggagccgtggaggatgcaaagacg

SEQ ID NO: 36755 - DNA, 25 bp, Homo sapien
atgcaaagacggcccggctgttcaa

SEQ ID NO: 36756 - DNA, 25 bp, Homo sapien
ggctgctggcggagacaagcactga

SEQ ID NO: 36757 - DNA, 25 bp, Homo sapien
ggagacaagcactgagacatgttta

SEQ ID NO: 36758 - DNA, 25 bp, Homo sapien
gacatgtttattctcatggtccctg

SEQ ID NO: 36759 - DNA, 25 bp, Homo sapien
atggtccctgaaacgcaggatccca

SEQ ID NO: 36760 - DNA, 25 bp, Homo sapien
gaaacgcaggatcccatgaggttgg

SEQ ID NO: 36761 - DNA, 25 bp, Homo sapien
gcagctgcagatttgatggcctact

SEQ ID NO: 36762 - DNA, 25 bp, Homo sapien
ggcctactgtgaagcacatgccaag

SEQ ID NO: 36763 - DNA, 25 bp, Homo sapien
gaagaagtttttctgtgccatcctt

SEQ ID NO: 36764 - DNA, 25 bp, Homo sapien
ttctgtgccatcctttaagtctttg

SEQ ID NO: 36765 - DNA, 25 bp, Homo sapien
tccgggctcctgggacattgatgta

SEQ ID NO: 36766 - DNA, 25 bp, Homo sapien
agtgaagtgggcacctttctagtcc

SEQ ID NO: 36767 - DNA, 25 bp, Homo sapien
cctttctagtccacggcatttgaag

SEQ ID NO: 36768 - DNA, 25 bp, Homo sapien
tgcatgtttaaagatctggtcccct

SEQ ID NO: 36769 - DNA, 25 bp, Homo sapien
gatctggtcccctttatgagaatgc

SEQ ID NO: 36770 - DNA, 25 bp, Homo sapien
ccgatccacatcctgacttaagaga

SEQ ID NO: 36771 - DNA, 25 bp, Homo sapien
gatctgattctgacgaactgcctgg

SEQ ID NO: 36772 - DNA, 25 bp, Homo sapien
aatgaggggatttccaggatgctgg

SEQ ID NO: 36773 - DNA, 25 bp, Homo sapien
ggggatttccaggatgctggacatt

SEQ ID NO: 36774 - DNA, 25 bp, Homo sapien
gctggacatttagtgctgaaatggg

SEQ ID NO: 36775 - DNA, 25 bp, Homo sapien
gaatgtgtctggtaagccaagacag

SEQ ID NO: 36776 - DNA, 25 bp, Homo sapien
taagccaagacaggtcggtcaccct

SEQ ID NO: 36777 - DNA, 25 bp, Homo sapien
ggcacctgaaaatttgcgagattaa

SEQ ID NO: 36778 - DNA, 25 bp, Homo sapien
gaggtttcaggtaatgatgaggcat

SEQ ID NO: 36779 - DNA, 25 bp, Homo sapien
atgaggcatcttatccagagaccac

SEQ ID NO: 36780 - DNA, 25 bp, Homo sapien
gagaccacagcttgaaaactcctgg

SEQ ID NO: 36781 - DNA, 25 bp, Homo sapien
ataaacacttacagatacattttct

SEQ ID NO: 36782 - DNA, 25 bp, Homo sapien
aaaataattctggctgagcacggtg

SEQ ID NO: 36783 - DNA, 25 bp, Homo sapien
gatgtgtgtggatgagctaggaaga

SEQ ID NO: 36784 - DNA, 25 bp, Homo sapien
ggaagacctgaaataggctctctct

SEQ ID NO: 36785 - DNA, 25 bp, Homo sapien
aattaatcctgaagccattctgcaa

SEQ ID NO: 36786 - DNA, 25 bp, Homo sapien
agccattctgcaatactgtctttaa

SEQ ID NO: 36787 - DNA, 25 bp, Homo sapien
ctgtctttaatgtatactcacttgt

SEQ ID NO: 36788 - DNA, 25 bp, Homo sapien
actcacttgttatagaagccagggt

SEQ ID NO: 36789 - DNA, 25 bp, Homo sapien
gttattgtaccaaactacactgttt

SEQ ID NO: 36790 - DNA, 25 bp, Homo sapien
tatgtcttagtatctgggtgtggga

SEQ ID NO: 36791 - DNA, 25 bp, Homo sapien
tggagtttgtgttattcaccactgt

SEQ ID NO: 36792 - DNA, 25 bp, Homo sapien
tcaccactgtattctcaaatatcag

SEQ ID NO: 36793 - DNA, 25 bp, Homo sapien
gaagagtatctggcctactaagtgc

SEQ ID NO: 36794 - DNA, 25 bp, Homo sapien
aatcctgctcaaatttgtacgctcc

SEQ ID NO: 36795 - DNA, 25 bp, Homo sapien
tcctgctcaaatttgtacgctccac

SEQ ID NO: 36796 - DNA, 25 bp, Homo sapien
gctccacctccagtggcacaaaaga

SEQ ID NO: 36797 - DNA, 25 bp, Homo sapien
aagacagtgtggagactcgagaagt

SEQ ID NO: 36798 - DNA, 25 bp, Homo sapien
ggagactcgagaagtttttatctct

SEQ ID NO: 36799 - DNA, 25 bp, Homo sapien
tttttatctctgcccatttgaataa

SEQ ID NO: 36800 - DNA, 25 bp, Homo sapien
tatctctgcccatttgaataaaagc

SEQ ID NO: 36801 - DNA, 25 bp, Homo sapien
gaataaaagcaggcatgtcatgagt

SEQ ID NO: 36802 - DNA, 25 bp, Homo sapien
catgtcatgagtgggaaagcgtata

SEQ ID NO: 36803 - DNA, 25 bp, Homo sapien
aaagcgtataaagtgcagattgcct

SEQ ID NO: 36804 - DNA, 25 bp, Homo sapien
taaagtgcagattgcctttgcgtcc

SEQ ID NO: 36805 - DNA, 25 bp, Homo sapien
aacaggataggcattgtctttcaaa

SEQ ID NO: 36806 - DNA, 25 bp, Homo sapien
tctttcaaatgttcagaccccagtt

SEQ ID NO: 36807 - DNA, 25 bp, Homo sapien
ttcagaccccagtttattaaaggat

SEQ ID NO: 36808 - DNA, 25 bp, Homo sapien
gctaaattttatgatctctcccgtt

SEQ ID NO: 36809 - DNA, 25 bp, Homo sapien
gatctctcccgttgaaaagtaggtg

SEQ ID NO: 36810 - DNA, 25 bp, Homo sapien
aacctcagcctttgggctcaaatga

SEQ ID NO: 36811 - DNA, 25 bp, Homo sapien
gtgatgattttaatgtgacatgcac

SEQ ID NO: 36812 - DNA, 25 bp, Homo sapien
aaaatccttgccagtttacttctgc

SEQ ID NO: 36813 - DNA, 25 bp, Homo sapien
tgcaatttaattttagcctttacta

SEQ ID NO: 36814 - DNA, 25 bp, Homo sapien
tactaattacccacttctgtttaat

SEQ ID NO: 36815 - DNA, 25 bp, Homo sapien
ttccaatttttaacagcaggtacat

SEQ ID NO: 36816 - DNA, 25 bp, Homo sapien
atctcaaggaaatctgattgtccaa

SEQ ID NO: 36817 - DNA, 25 bp, Homo sapien
gattgtccaaatagatctgttaata

SEQ ID NO: 36818 - DNA, 25 bp, Homo sapien
taataggtaacttgctgtgtaaaat

SEQ ID NO: 36819 - DNA, 25 bp, Homo sapien
atacttattgtgctccatttgtgat

SEQ ID NO: 36820 - DNA, 25 bp, Homo sapien
attgtgctccatttgtgatataatt

SEQ ID NO: 36821 - DNA, 25 bp, Homo sapien
atttctgctctgtgatgggggttta

SEQ ID NO: 36822 - DNA, 25 bp, Homo sapien
gctctgtgatgggggtttatttgta

SEQ ID NO: 36823 - DNA, 25 bp, Homo sapien
atgtgtttgaatgagttaacctttt

SEQ ID NO: 36824 - DNA, 25 bp, Homo sapien
aaccttttaatcgcaaccctatgtg

SEQ ID NO: 36825 - DNA, 25 bp, Homo sapien
ttaatcgcaaccctatgtgaataaa

SEQ ID NO: 36826 - DNA, 25 bp, Homo sapien
atgtgaataaaattactccactgtt

SEQ ID NO: 36827 - DNA, 25 bp, Homo sapien
aatgtgcttctgtaattgtgatatt

SEQ ID NO: 36828 - DNA, 25 bp, Homo sapien
attgtgatattttgttttctaagta

SEQ ID NO: 36829 - DNA, 25 bp, Homo sapien
tggactacttacaaagctgttttcc

SEQ ID NO: 36830 - DNA, 25 bp, Homo sapien
agctgttttccctggccataggaaa

SEQ ID NO: 36831 - DNA, 25 bp, Homo sapien
gtagtcaaactgcttattcaggcta

SEQ ID NO: 36832 - DNA, 25 bp, Homo sapien
gaatttgtgcagtgtgttcccttaa

SEQ ID NO: 36833 - DNA, 25 bp, Homo sapien
gtgtgttcccttaattatctactga

SEQ ID NO: 36834 - DNA, 25 bp, Homo sapien
atctactgaatgttgttaccgacta

SEQ ID NO: 36835 - DNA, 25 bp, Homo sapien
acaaggtttctaaaagtctcgcatt

SEQ ID NO: 36836 - DNA, 25 bp, Homo sapien
gtctcgcatttcttttactattcaa

SEQ ID NO: 36837 - DNA, 25 bp, Homo sapien
tggttggaaatgactaatactgctc

SEQ ID NO: 36838 - DNA, 25 bp, Homo sapien
gactgagcaactgttttccgtctaa

SEQ ID NO: 36839 - DNA, 25 bp, Homo sapien
gcaactgttttccgtctaaggagac

SEQ ID NO: 36840 - DNA, 25 bp, Homo sapien
ctggactggatcatacccttgggaa

SEQ ID NO: 36841 - DNA, 25 bp, Homo sapien
catacccttgggaaatgttatacag

SEQ ID NO: 36842 - DNA, 25 bp, Homo sapien
gttatacagaacattattggggcaa

SEQ ID NO: 36843 - DNA, 25 bp, Homo sapien
ggggcaatgacagaatcacagtgtt

SEQ ID NO: 36844 - DNA, 25 bp, Homo sapien
aaatttcctgaatataactgtgctg

SEQ ID NO: 36845 - DNA, 25 bp, Homo sapien
aaatcggtaaacctgtaggccagct

SEQ ID NO: 36846 - DNA, 25 bp, Homo sapien
taaacctgtaggccagctgcagtgg

SEQ ID NO: 36847 - DNA, 25 bp, Homo sapien
ggatgatttgagtctaggaggcgga

SEQ ID NO: 36848 - DNA, 25 bp, Homo sapien
gccaagatcacaccaatgcagttca

SEQ ID NO: 36849 - DNA, 25 bp, Homo sapien
tttaatgaacacgtgtctcacacac

SEQ ID NO: 36850 - DNA, 25 bp, Homo sapien
ctttctgttagcattttctgatgta

SEQ ID NO: 36851 - DNA, 25 bp, Homo sapien
gtaatttccttggtaccagcatctc

SEQ ID NO: 36852 - DNA, 25 bp, Homo sapien
tccttggtaccagcatctcattgga

SEQ ID NO: 36853 - DNA, 25 bp, Homo sapien
accagcatctcattggattttggat

SEQ ID NO: 36854 - DNA, 25 bp, Homo sapien
gattttgacccattttccaggtcta

SEQ ID NO: 36855 - DNA, 25 bp, Homo sapien
attttccaggtctatttttcaattg

SEQ ID NO: 36856 - DNA, 25 bp, Homo sapien
gggaatatgttcattccatgttgta

SEQ ID NO: 36857 - DNA, 25 bp, Homo sapien
ataacaggttatggcaaagcagcat

SEQ ID NO: 36858 - DNA, 25 bp, Homo sapien
taatatcagctcacatatgtaggat

SEQ ID NO: 36859 - DNA, 25 bp, Homo sapien
acatatatcacaaacttaaccaagc

SEQ ID NO: 36860 - DNA, 25 bp, Homo sapien
tttgagagtgtgtggaagtccccct

SEQ ID NO: 36861 - DNA, 25 bp, Homo sapien
agaagccaactatctaatcaatgcc

SEQ ID NO: 36862 - DNA, 25 bp, Homo sapien
atgcaactttttcttaccattcaaa

SEQ ID NO: 36863 - DNA, 25 bp, Homo sapien
caaagtacaggatcacagcataaaa

SEQ ID NO: 36864 - DNA, 25 bp, Homo sapien
gataaaacatcaaactacccagcaa

SEQ ID NO: 36865 - DNA, 25 bp, Homo sapien
actacccagcaacctgagaagcaca

SEQ ID NO: 36866 - DNA, 25 bp, Homo sapien
acagagtgttaaagcctccaccgtg

SEQ ID NO: 36867 - DNA, 25 bp, Homo sapien
ccaccgtgtggagaaactaaattag

SEQ ID NO: 36868 - DNA, 25 bp, Homo sapien
gctattgagtatattgagtaccttc

SEQ ID NO: 36869 - DNA, 25 bp, Homo sapien
accttcaaagcactcaactgacagg

SEQ ID NO: 36870 - DNA, 25 bp, Homo sapien
aactgacaggttttacagactggaa

SEQ ID NO: 36871 - DNA, 25 bp, Homo sapien
gaagttcagctagtttttctccttt

SEQ ID NO: 36872 - DNA, 25 bp, Homo sapien
aagttcagctagtttttctcctttg

SEQ ID NO: 36873 - DNA, 25 bp, Homo sapien
ttcagctagtttttctcctttgttt

SEQ ID NO: 36874 - DNA, 25 bp, Homo sapien
gctagtttttctcctttgtttgact

SEQ ID NO: 36875 - DNA, 25 bp, Homo sapien
ttgtcaatttctatctggtttttaa

SEQ ID NO: 36876 - DNA, 25 bp, Homo sapien
ctatctggtttttaagggtctgagc

SEQ ID NO: 36877 - DNA, 25 bp, Homo sapien
aagggtctgagcttagcttgtgcat

SEQ ID NO: 36878 - DNA, 25 bp, Homo sapien
gggtctgagcttagcttgtgcatgc

SEQ ID NO: 36879 - DNA, 25 bp, Homo sapien
gtctgagcttagcttgtgcatgcaa

SEQ ID NO: 36880 - DNA, 25 bp, Homo sapien
gagcttagcttgtgcatgcaaggtt

SEQ ID NO: 36881 - DNA, 25 bp, Homo sapien
gagtattggaacagtatgtcttcaa

SEQ ID NO: 36882 - DNA, 25 bp, Homo sapien
caagggtaggaggcagggccgctgc

SEQ ID NO: 36883 - DNA, 25 bp, Homo sapien
ctgcctttttcttcctgtatttaag

SEQ ID NO: 36884 - DNA, 25 bp, Homo sapien
gcatctctgggaaaggacctggggc

SEQ ID NO: 36885 - DNA, 25 bp, Homo sapien
gacgactgggaatcctagggggctc

SEQ ID NO: 36886 - DNA, 25 bp, Homo sapien
gttgctctgacatggacacagccag

SEQ ID NO: 36887 - DNA, 25 bp, Homo sapien
gccaggacaagctgctcagacctgc

SEQ ID NO: 36888 - DNA, 25 bp, Homo sapien
ggtgacggaaccagcactgtgtgga

SEQ ID NO: 36889 - DNA, 25 bp, Homo sapien
gtggagaccagcttcaaggagcgga

SEQ ID NO: 36890 - DNA, 25 bp, Homo sapien
aaggctggcttgaggccacacagct

SEQ ID NO: 36891 - DNA, 25 bp, Homo sapien
cctgcgccactgtgttcttaagagg

SEQ ID NO: 36892 - DNA, 25 bp, Homo sapien
gaggcttccagagaaaacggcacac

SEQ ID NO: 36893 - DNA, 25 bp, Homo sapien
gtaagtacagcagcagcattattaa

SEQ ID NO: 36894 - DNA, 25 bp, Homo sapien
gcagtatgagtttcaggtatgtaca

SEQ ID NO: 36895 - DNA, 25 bp, Homo sapien
aatactgtatttctatggtgattga

SEQ ID NO: 36896 - DNA, 25 bp, Homo sapien
aaagtggatatttctattcatatag

SEQ ID NO: 36897 - DNA, 25 bp, Homo sapien
gaaatgtgatttactctcatgtact

SEQ ID NO: 36898 - DNA, 25 bp, Homo sapien
gatttactctcatgtacttatctac

SEQ ID NO: 36899 - DNA, 25 bp, Homo sapien
gtacttatctacatgctaaaaccat

SEQ ID NO: 36900 - DNA, 25 bp, Homo sapien
gtacatgttatgtgtgtgtgtgaga

SEQ ID NO: 36901 - DNA, 25 bp, Homo sapien
gccaaggcacttttactgaataaaa

SEQ ID NO: 36902 - DNA, 25 bp, Homo sapien
gagagacacacacaaacacatttca

SEQ ID NO: 36903 - DNA, 25 bp, Homo sapien
gttttatgtttaagctcaatattca

SEQ ID NO: 36904 - DNA, 25 bp, Homo sapien
atggagaaattctgtccctactgaa

SEQ ID NO: 36905 - DNA, 25 bp, Homo sapien
tgcactccaccttgggcaacaaaag

SEQ ID NO: 36906 - DNA, 25 bp, Homo sapien
aaagtgccagcgtatgaggtaatta

SEQ ID NO: 36907 - DNA, 25 bp, Homo sapien
gaggtaattagattggttctctcca

SEQ ID NO: 36908 - DNA, 25 bp, Homo sapien
ttctctccagaggtaacctgccaag

SEQ ID NO: 36909 - DNA, 25 bp, Homo sapien
gaggtaacctgccaagaagagatgc

SEQ ID NO: 36910 - DNA, 25 bp, Homo sapien
ggaagcccaaggcttatatcccagc

SEQ ID NO: 36911 - DNA, 25 bp, Homo sapien
tatcccagctctgtcttacactaaa

SEQ ID NO: 36912 - DNA, 25 bp, Homo sapien
atgggtacagtgtttccactctgtc

SEQ ID NO: 36913 - DNA, 25 bp, Homo sapien
gctaatattctccaacctgtgtgcc

SEQ ID NO: 36914 - DNA, 25 bp, Homo sapien
ccaacctgtgtgcctgacatgatgg

SEQ ID NO: 36915 - DNA, 25 bp, Homo sapien
ttgttcttctcataatttctggttt

SEQ ID NO: 36916 - DNA, 25 bp, Homo sapien
atggagccttacatcctgatcatgc

SEQ ID NO: 36917 - DNA, 25 bp, Homo sapien
atcctgatcatgctgggccttagaa

SEQ ID NO: 36918 - DNA, 25 bp, Homo sapien
tgggccttagaattctgacacagtg

SEQ ID NO: 36919 - DNA, 25 bp, Homo sapien
acagtgagtcatcacatttcctccc

SEQ ID NO: 36920 - DNA, 25 bp, Homo sapien
tccaccatgactctcacagtacagt

SEQ ID NO: 36921 - DNA, 25 bp, Homo sapien
atcacatgccccaagaaacttctgg

SEQ ID NO: 36922 - DNA, 25 bp, Homo sapien
gataggctgcttattgccatgtgta

SEQ ID NO: 36923 - DNA, 25 bp, Homo sapien
gccatgtgtagtcacttccaagtgc

SEQ ID NO: 36924 - DNA, 25 bp, Homo sapien
tgcctttccatcctgcaattgtggc

SEQ ID NO: 36925 - DNA, 25 bp, Homo sapien
tcctgcaattgtggcctgtgtataa

SEQ ID NO: 36926 - DNA, 25 bp, Homo sapien
cgccatcttggtactttaggttaat

SEQ ID NO: 36927 - DNA, 25 bp, Homo sapien
actttaggttaatccctcaagcatg

SEQ ID NO: 36928 - DNA, 25 bp, Homo sapien
tggcctagggagcactcaggagggt

SEQ ID NO: 36929 - DNA, 25 bp, Homo sapien
actcaggagggttccttggtcctca

SEQ ID NO: 36930 - DNA, 25 bp, Homo sapien
gcttggagacagtctgacccagtgc

SEQ ID NO: 36931 - DNA, 25 bp, Homo sapien
tctccccatctcttcaatggggctg

SEQ ID NO: 36932 - DNA, 25 bp, Homo sapien
cttcaatggggctgataccttcaca

SEQ ID NO: 36933 - DNA, 25 bp, Homo sapien
ccacagcatgggcacttatgaggac

SEQ ID NO: 36934 - DNA, 25 bp, Homo sapien
gtgttggtgatttgtagcccttctg

SEQ ID NO: 36935 - DNA, 25 bp, Homo sapien
ctgcccttaaatgcttccttgggca

SEQ ID NO: 36936 - DNA, 25 bp, Homo sapien
agtatcattcattgtttctctatta

SEQ ID NO: 36937 - DNA, 25 bp, Homo sapien
caccactagagttcctgaaacaggt

SEQ ID NO: 36938 - DNA, 25 bp, Homo sapien
actttggggagccacgcttttgatg

SEQ ID NO: 36939 - DNA, 25 bp, Homo sapien
gccacgcttttgatgtgacagtacc

SEQ ID NO: 36940 - DNA, 25 bp, Homo sapien
tgacagtaccgcagagtgattcccc

SEQ ID NO: 36941 - DNA, 25 bp, Homo sapien
tgattcccccactgaggatgtcatc

SEQ ID NO: 36942 - DNA, 25 bp, Homo sapien
gtcatcatcaaactcttctttggtg

SEQ ID NO: 36943 - DNA, 25 bp, Homo sapien
aaactcttctttggtgtgtgaatta

SEQ ID NO: 36944 - DNA, 25 bp, Homo sapien
cccagctgtaattagacctccactg

SEQ ID NO: 36945 - DNA, 25 bp, Homo sapien
tagacctccactgtgtacttagctg

SEQ ID NO: 36946 - DNA, 25 bp, Homo sapien
aattctgcaatatgtttcttggtta

SEQ ID NO: 36947 - DNA, 25 bp, Homo sapien
aacattgcacagttcttacctcatt

SEQ ID NO: 36948 - DNA, 25 bp, Homo sapien
gcccaaggcttgccgtttgacgagg

SEQ ID NO: 36949 - DNA, 25 bp, Homo sapien
acgaggagcagtcgcggtaggcggt

SEQ ID NO: 36950 - DNA, 25 bp, Homo sapien
ggtaggcggtgggcaaggctgccct

SEQ ID NO: 36951 - DNA, 25 bp, Homo sapien
cccgtgctgtgtagcgggacggcag

SEQ ID NO: 36952 - DNA, 25 bp, Homo sapien
ggacggcaggtcatttattggggag

SEQ ID NO: 36953 - DNA, 25 bp, Homo sapien
tggggaggcagtgttccctaaacac

SEQ ID NO: 36954 - DNA, 25 bp, Homo sapien
ccagcagcttccattttggcatgga

SEQ ID NO: 36955 - DNA, 25 bp, Homo sapien
gagtgttctcggcaatggccatttg

SEQ ID NO: 36956 - DNA, 25 bp, Homo sapien
ggccatttgtcatcactgggaacca

SEQ ID NO: 36957 - DNA, 25 bp, Homo sapien
cttgagccgtgcactgcagacacaa

SEQ ID NO: 36958 - DNA, 25 bp, Homo sapien
cacaatgctgtatttcttctcccag

SEQ ID NO: 36959 - DNA, 25 bp, Homo sapien
gccaacacatcacttttatcttgca

SEQ ID NO: 36960 - DNA, 25 bp, Homo sapien
acacatcacttttatcttgcagctc

SEQ ID NO: 36961 - DNA, 25 bp, Homo sapien
aaattgtgcttacatatgtgtttga

SEQ ID NO: 36962 - DNA, 25 bp, Homo sapien
tgtattctagtttgtttgttcagct

SEQ ID NO: 36963 - DNA, 25 bp, Homo sapien
attctagtttgtttgttcagcttct

SEQ ID NO: 36964 - DNA, 25 bp, Homo sapien
ttctgttcttatttccagttttctg

SEQ ID NO: 36965 - DNA, 25 bp, Homo sapien
gttctctgtgttcatattttactca

SEQ ID NO: 36966 - DNA, 25 bp, Homo sapien
gtgttcatattttactcattgagta

SEQ ID NO: 36967 - DNA, 25 bp, Homo sapien
aattttgttggtactacattgccct

SEQ ID NO: 36968 - DNA, 25 bp, Homo sapien
tttgttggtactacattgccctgtt

SEQ ID NO: 36969 - DNA, 25 bp, Homo sapien
acattgccctgttttgtatatattc

SEQ ID NO: 36970 - DNA, 25 bp, Homo sapien
gcccaacgggtacagcgtgctgggc

SEQ ID NO: 36971 - DNA, 25 bp, Homo sapien
acgggtacagcgtgctgggcatgga

SEQ ID NO: 36972 - DNA, 25 bp, Homo sapien
tgctgggcatggagcgcaacgagcc

SEQ ID NO: 36973 - DNA, 25 bp, Homo sapien
gcagagcctgcttgaagcgggcact

SEQ ID NO: 36974 - DNA, 25 bp, Homo sapien
agagcctgcttgaagcgggcactga

SEQ ID NO: 36975 - DNA, 25 bp, Homo sapien
agcctgcttgaagcgggcactgagg

SEQ ID NO: 36976 - DNA, 25 bp, Homo sapien
tgcttgaagcgggcactgaggcgga

SEQ ID NO: 36977 - DNA, 25 bp, Homo sapien
acggtttatgaggaacagcttcagc

SEQ ID NO: 36978 - DNA, 25 bp, Homo sapien
gaacagcttcagctggagcgggccc

SEQ ID NO: 36979 - DNA, 25 bp, Homo sapien
gccctggagttgtcttcacgggagc

SEQ ID NO: 36980 - DNA, 25 bp, Homo sapien
gttgtcttcacgggagcaggaggag

SEQ ID NO: 36981 - DNA, 25 bp, Homo sapien
tagccatgggagcaataatgtcacc

SEQ ID NO: 36982 - DNA, 25 bp, Homo sapien
gggacaaataacatctgtgtagcag

SEQ ID NO: 36983 - DNA, 25 bp, Homo sapien
ataacatctgtgtagcagtattatg

SEQ ID NO: 36984 - DNA, 25 bp, Homo sapien
cttcctcagagggttggtccctgga

SEQ ID NO: 36985 - DNA, 25 bp, Homo sapien
cagagggttggtccctggatcacac

SEQ ID NO: 36986 - DNA, 25 bp, Homo sapien
cactttgagaaccatacttgtcctg

SEQ ID NO: 36987 - DNA, 25 bp, Homo sapien
tttgagaaccatacttgtcctgaag

SEQ ID NO: 36988 - DNA, 25 bp, Homo sapien
acttgtcctgaagtattggagttca

SEQ ID NO: 36989 - DNA, 25 bp, Homo sapien
ggagttcatgtctaacttcttccca

SEQ ID NO: 36990 - DNA, 25 bp, Homo sapien
cttcccagggcattatgtacagtgc

SEQ ID NO: 36991 - DNA, 25 bp, Homo sapien
gggcattatgtacagtgctttttat

SEQ ID NO: 36992 - DNA, 25 bp, Homo sapien
atggagatcgttaggtctccctcca

SEQ ID NO: 36993 - DNA, 25 bp, Homo sapien
cctccaaaccagcctgcatgatact

SEQ ID NO: 36994 - DNA, 25 bp, Homo sapien
tgcatgatactcattgcactccagc

SEQ ID NO: 36995 - DNA, 25 bp, Homo sapien
aaagcttggggtggctaaggctgac

SEQ ID NO: 36996 - DNA, 25 bp, Homo sapien
aaggctgacattacaaataagttcc

SEQ ID NO: 36997 - DNA, 25 bp, Homo sapien
gaaacaaaccacctctacatattat

SEQ ID NO: 36998 - DNA, 25 bp, Homo sapien
ttttgtcgattcttattcttttata

SEQ ID NO: 36999 - DNA, 25 bp, Homo sapien
cagagagtgaagtccagcctgtgag

SEQ ID NO: 37000 - DNA, 25 bp, Homo sapien
agtagacacattaaacgattccagt

SEQ ID NO: 37001 - DNA, 25 bp, Homo sapien
agcctgtgagaggcccatagcactg

SEQ ID NO: 37002 - DNA, 25 bp, Homo sapien
gcactgccctttagaggatcaacat

SEQ ID NO: 37003 - DNA, 25 bp, Homo sapien
aatgaaggtgacttaaacagcttaa

SEQ ID NO: 37004 - DNA, 25 bp, Homo sapien
gaaggtgacttaaacagcttaaagt

SEQ ID NO: 37005 - DNA, 25 bp, Homo sapien
taaaataatttgaaggcgatctttt

SEQ ID NO: 37006 - DNA, 25 bp, Homo sapien
ttaaagcctagttaacgcatttact

SEQ ID NO: 37007 - DNA, 25 bp, Homo sapien
tagttaacgcatttactaaacgcag

SEQ ID NO: 37008 - DNA, 25 bp, Homo sapien
ggaagacagaagtacgggaaggcga

SEQ ID NO: 37009 - DNA, 25 bp, Homo sapien
gacagaagtacgggaaggcgaagaa

SEQ ID NO: 37010 - DNA, 25 bp, Homo sapien
aagctaagggcaaaatgtacaaact

SEQ ID NO: 37011 - DNA, 25 bp, Homo sapien
gggcaaaatgtacaaacttagaaga

SEQ ID NO: 37012 - DNA, 25 bp, Homo sapien
aatattgtcaagagtttcagataga

SEQ ID NO: 37013 - DNA, 25 bp, Homo sapien
aaacaagctaagacaagtattggag

SEQ ID NO: 37014 - DNA, 25 bp, Homo sapien
gaaacttatggtggcctagactccc

SEQ ID NO: 37015 - DNA, 25 bp, Homo sapien
tatccactcttccttatcttggtaa

SEQ ID NO: 37016 - DNA, 25 bp, Homo sapien
cctgctctgcctacttacaggggca

SEQ ID NO: 37017 - DNA, 25 bp, Homo sapien
aggggcatgtggtcccaatctaagc

SEQ ID NO: 37018 - DNA, 25 bp, Homo sapien
aaatcagcagaatcccattccctgc

SEQ ID NO: 37019 - DNA, 25 bp, Homo sapien
ttccctgccacagttattggctggc

SEQ ID NO: 37020 - DNA, 25 bp, Homo sapien
gagcaatttcctggtctttgttggg

SEQ ID NO: 37021 - DNA, 25 bp, Homo sapien
agagcgcttcagaggtaacccattc

SEQ ID NO: 37022 - DNA, 25 bp, Homo sapien
cattctttctgcatgtcctcaaaaa

SEQ ID NO: 37023 - DNA, 25 bp, Homo sapien
gtgggtagccatcttccaaatacaa

SEQ ID NO: 37024 - DNA, 25 bp, Homo sapien
gaaggagcctttggattccggactg

SEQ ID NO: 37025 - DNA, 25 bp, Homo sapien
gcttctacctacctgtctcaggaag

SEQ ID NO: 37026 - DNA, 25 bp, Homo sapien
caggaagtgcctgagccttgcacct

SEQ ID NO: 37027 - DNA, 25 bp, Homo sapien
agaaagccctggctttgcaaccagc

SEQ ID NO: 37028 - DNA, 25 bp, Homo sapien
cacaggagcaccacggtgcccaaat

SEQ ID NO: 37029 - DNA, 25 bp, Homo sapien
ggtgcccaaatgggtcttggagcat

SEQ ID NO: 37030 - DNA, 25 bp, Homo sapien
ggagcattagaccaggggcttcatg

SEQ ID NO: 37031 - DNA, 25 bp, Homo sapien
gtggcatgggagatagggagacagt

SEQ ID NO: 37032 - DNA, 25 bp, Homo sapien
gggagacagtgtgggtgagcaggtg

SEQ ID NO: 37033 - DNA, 25 bp, Homo sapien
gcaggagctacaggagcctggggcc

SEQ ID NO: 37034 - DNA, 25 bp, Homo sapien
atcacagacaccgccaggcaagtgc

SEQ ID NO: 37035 - DNA, 25 bp, Homo sapien
gccaagcagcagagtgcctggtgtg

SEQ ID NO: 37036 - DNA, 25 bp, Homo sapien
tgaggttgtttactcatttgccctt

SEQ ID NO: 37037 - DNA, 25 bp, Homo sapien
gttccaagatcccattccagttaat

SEQ ID NO: 37038 - DNA, 25 bp, Homo sapien
cccctcatggatccttggttttaat

SEQ ID NO: 37039 - DNA, 25 bp, Homo sapien
tagaattattccgtagcttttgctg

SEQ ID NO: 37040 - DNA, 25 bp, Homo sapien
attccgtagcttttgctgattactc

SEQ ID NO: 37041 - DNA, 25 bp, Homo sapien
aagacagatagctgactggttcata

SEQ ID NO: 37042 - DNA, 25 bp, Homo sapien
aggaactagtgctcaatatacattg

SEQ ID NO: 37043 - DNA, 25 bp, Homo sapien
ggaaatctcttggatgtgaattgtt

SEQ ID NO: 37044 - DNA, 25 bp, Homo sapien
gaattgttacttcaagtggctttta

SEQ ID NO: 37045 - DNA, 25 bp, Homo sapien
gtggcttttattaagattttctcag

SEQ ID NO: 37046 - DNA, 25 bp, Homo sapien
gattttctcagacttacttggaggt

SEQ ID NO: 37047 - DNA, 25 bp, Homo sapien
cctactcaggcccttgaggctatta

SEQ ID NO: 37048 - DNA, 25 bp, Homo sapien
caggcccttgaggctattaggagat

SEQ ID NO: 37049 - DNA, 25 bp, Homo sapien
cttgaggctattaggagatgcttga

SEQ ID NO: 37050 - DNA, 25 bp, Homo sapien
gaagaactcaacaaaatcccaatcc

SEQ ID NO: 37051 - DNA, 25 bp, Homo sapien
tcaacaaaatcccaatccaagtcaa

SEQ ID NO: 37052 - DNA, 25 bp, Homo sapien
ccaatccaagtcaaactttgcacat

SEQ ID NO: 37053 - DNA, 25 bp, Homo sapien
caaactttgcacatatttatattta

SEQ ID NO: 37054 - DNA, 25 bp, Homo sapien
ctgccatagcactgatcagtgacaa

SEQ ID NO: 37055 - DNA, 25 bp, Homo sapien
atcagtgacaatttacaggaatgta

SEQ ID NO: 37056 - DNA, 25 bp, Homo sapien
ggaatgtagcagcgatggaattacc

SEQ ID NO: 37057 - DNA, 25 bp, Homo sapien
gcgatggaattacctggaacagttt

SEQ ID NO: 37058 - DNA, 25 bp, Homo sapien
aaaattatactatttcaacattctc

SEQ ID NO: 37059 - DNA, 25 bp, Homo sapien
atttcaacattctcatttatgtgaa

SEQ ID NO: 37060 - DNA, 25 bp, Homo sapien
aggtgggcattattcatagacttct

SEQ ID NO: 37061 - DNA, 25 bp, Homo sapien
gggcattattcatagacttctacat

SEQ ID NO: 37062 - DNA, 25 bp, Homo sapien
gagaggcttttagtggttgacttac

SEQ ID NO: 37063 - DNA, 25 bp, Homo sapien
ggttgacttactgagtgatgcctga

SEQ ID NO: 37064 - DNA, 25 bp, Homo sapien
gagtgatgcctgaagtaggtgttca

SEQ ID NO: 37065 - DNA, 25 bp, Homo sapien
atactttgcgttatactgagagaga

SEQ ID NO: 37066 - DNA, 25 bp, Homo sapien
aaattgttttgccaactgtatattt

SEQ ID NO: 37067 - DNA, 25 bp, Homo sapien
gttttgccaactgtatatttatgta

SEQ ID NO: 37068 - DNA, 25 bp, Homo sapien
aattctcttaagataatgtgtgaac

SEQ ID NO: 37069 - DNA, 25 bp, Homo sapien
gaaagagctctaagatagttaagta

SEQ ID NO: 37070 - DNA, 25 bp, Homo sapien
aaagcaaggtgtcaaactgtagagt

SEQ ID NO: 37071 - DNA, 25 bp, Homo sapien
aaactgtagagtatgtttccattta

SEQ ID NO: 37072 - DNA, 25 bp, Homo sapien
tgtggtggtgcacacttctaatccc

SEQ ID NO: 37073 - DNA, 25 bp, Homo sapien
cccagctactccgtaggctaaggca

SEQ ID NO: 37074 - DNA, 25 bp, Homo sapien
gtacacacataatctctgaaagggt

SEQ ID NO: 37075 - DNA, 25 bp, Homo sapien
gggtaaaagtggcatactggttggc

SEQ ID NO: 37076 - DNA, 25 bp, Homo sapien
agtggcatactggttggccagaaga

SEQ ID NO: 37077 - DNA, 25 bp, Homo sapien
ggttggccagaagaattgggaggac

SEQ ID NO: 37078 - DNA, 25 bp, Homo sapien
gaataattttcactctttatcattt

SEQ ID NO: 37079 - DNA, 25 bp, Homo sapien
attttcactctttatcattttatat

SEQ ID NO: 37080 - DNA, 25 bp, Homo sapien
aggactgaaagagatttgtaggttg

SEQ ID NO: 37081 - DNA, 25 bp, Homo sapien
agagatttgtaggttgttgattttg

SEQ ID NO: 37082 - DNA, 25 bp, Homo sapien
gccgcctactactactatacggctg

SEQ ID NO: 37083 - DNA, 25 bp, Homo sapien
cctactactactatacggctgcgag

SEQ ID NO: 37084 - DNA, 25 bp, Homo sapien
actactactatacggctgcgagaag

SEQ ID NO: 37085 - DNA, 25 bp, Homo sapien
actactatacggctgcgagaagacg

SEQ ID NO: 37086 - DNA, 25 bp, Homo sapien
actatacggctgcgagaagacgaca

SEQ ID NO: 37087 - DNA, 25 bp, Homo sapien
atacggctgcgagaagacgacagaa

SEQ ID NO: 37088 - DNA, 25 bp, Homo sapien
gacgacagaaggggatatatattat

SEQ ID NO: 37089 - DNA, 25 bp, Homo sapien
aaatggtcatttttctgaagagaat

SEQ ID NO: 37090 - DNA, 25 bp, Homo sapien
gaagagaatattttgcttgaaatgc

SEQ ID NO: 37091 - DNA, 25 bp, Homo sapien
tgaggtcagcagttaaagaccagcc

SEQ ID NO: 37092 - DNA, 25 bp, Homo sapien
aaaagtaaacatgggcactgattgt

SEQ ID NO: 37093 - DNA, 25 bp, Homo sapien
catgggcactgattgttttaataaa

SEQ ID NO: 37094 - DNA, 25 bp, Homo sapien
aacagactaaatggctattcacagg

SEQ ID NO: 37095 - DNA, 25 bp, Homo sapien
aaatggctattcacaggaaactgat

SEQ ID NO: 37096 - DNA, 25 bp, Homo sapien
gctagggcaatatgttttgacagaa

SEQ ID NO: 37097 - DNA, 25 bp, Homo sapien
gacagaaaactctctaagatttagt

SEQ ID NO: 37098 - DNA, 25 bp, Homo sapien
gtaggatgcaagagtttttatagtt

SEQ ID NO: 37099 - DNA, 25 bp, Homo sapien
gtttttatagttgattccatttttg

SEQ ID NO: 37100 - DNA, 25 bp, Homo sapien
aaactagccgggtatggtggtacat

SEQ ID NO: 37101 - DNA, 25 bp, Homo sapien
tatggtggtacatgcctgtaatccc

SEQ ID NO: 37102 - DNA, 25 bp, Homo sapien
ggcccggagtcagtgggtgaggtgt

SEQ ID NO: 37103 - DNA, 25 bp, Homo sapien
ggagtcagtgggtgaggtgttccgc

SEQ ID NO: 37104 - DNA, 25 bp, Homo sapien
ccgctggacactggggtcagagcag

SEQ ID NO: 37105 - DNA, 25 bp, Homo sapien
gggtcagagcagtgcccgaggaagc

SEQ ID NO: 37106 - DNA, 25 bp, Homo sapien
tgcccgaggaagcggggtctggccc

SEQ ID NO: 37107 - DNA, 25 bp, Homo sapien
ggccctggtggggcttgtggaggca

SEQ ID NO: 37108 - DNA, 25 bp, Homo sapien
ggggcttgtggaggcagcaggtgaa

SEQ ID NO: 37109 - DNA, 25 bp, Homo sapien
ggcagcaggtgaagaggcagggccc

SEQ ID NO: 37110 - DNA, 25 bp, Homo sapien
ggtgatggggattgagttgggggca

SEQ ID NO: 37111 - DNA, 25 bp, Homo sapien
ccggactccaagatgacgatctaaa

SEQ ID NO: 37112 - DNA, 25 bp, Homo sapien
gacgatctaaagacccgggagcgag

SEQ ID NO: 37113 - DNA, 25 bp, Homo sapien
gtgcctaaatctagacttggggtcc

SEQ ID NO: 37114 - DNA, 25 bp, Homo sapien
aaatctagacttggggtccacaccg

SEQ ID NO: 37115 - DNA, 25 bp, Homo sapien
cttcccaagcccgagcagagggtca

SEQ ID NO: 37116 - DNA, 25 bp, Homo sapien
cccgagcagagggtcatgcgggccc

SEQ ID NO: 37117 - DNA, 25 bp, Homo sapien
ccccacaggagaagcggccagggcc

SEQ ID NO: 37118 - DNA, 25 bp, Homo sapien
cccaagctttcaggcaggcactgaa

SEQ ID NO: 37119 - DNA, 25 bp, Homo sapien
tcaggcaggcactgaaacgcaccga

SEQ ID NO: 37120 - DNA, 25 bp, Homo sapien
tccggggttgggagctgaaccatcc

SEQ ID NO: 37121 - DNA, 25 bp, Homo sapien
ccatccccacctcagggttatattt

SEQ ID NO: 37122 - DNA, 25 bp, Homo sapien
cacctcagggttatatttccctctc

SEQ ID NO: 37123 - DNA, 25 bp, Homo sapien
ccgccaagagctctgccaggggcgg

SEQ ID NO: 37124 - DNA, 25 bp, Homo sapien
tgcgtgccagtctggtgcacgtggg

SEQ ID NO: 37125 - DNA, 25 bp, Homo sapien
tgccagtctggtgcacgtgggcagt

SEQ ID NO: 37126 - DNA, 25 bp, Homo sapien
ccagcacagctcgggtgaggctgcc

SEQ ID NO: 37127 - DNA, 25 bp, Homo sapien
ttctgcccagcgcatgggtgacacc

SEQ ID NO: 37128 - DNA, 25 bp, Homo sapien
cagcgcatgggtgacacccacactg

SEQ ID NO: 37129 - DNA, 25 bp, Homo sapien
cctggcgctggtctatgccaaggaa

SEQ ID NO: 37130 - DNA, 25 bp, Homo sapien
ggcgctggtctatgccaaggaacag

SEQ ID NO: 37131 - DNA, 25 bp, Homo sapien
gtctatgccaaggaacagctgtttg

SEQ ID NO: 37132 - DNA, 25 bp, Homo sapien
tttgctgaagcatcaggtgcccggc

SEQ ID NO: 37133 - DNA, 25 bp, Homo sapien
gccaggggtgcccaaagtgctggtg

SEQ ID NO: 37134 - DNA, 25 bp, Homo sapien
tggtgtgggtgacagatggcggctc

SEQ ID NO: 37135 - DNA, 25 bp, Homo sapien
gactacaatacaggcatgacatcaa

SEQ ID NO: 37136 - DNA, 25 bp, Homo sapien
tcgatgagactgaatccctacggat

SEQ ID NO: 37137 - DNA, 25 bp, Homo sapien
gaatgtgcaacgtggctgaaatcta

SEQ ID NO: 37138 - DNA, 25 bp, Homo sapien
gcaggtctacggagttgaggtgccc

SEQ ID NO: 37139 - DNA, 25 bp, Homo sapien
ggtcgaggctgagaagccgtggtgg

SEQ ID NO: 37140 - DNA, 25 bp, Homo sapien
cacagagatcccctaaggtcctggc

SEQ ID NO: 37141 - DNA, 25 bp, Homo sapien
gagaagcccaggatggtcggctgcc

SEQ ID NO: 37142 - DNA, 25 bp, Homo sapien
agctgggaggactggttgtgctgct

SEQ ID NO: 37143 - DNA, 25 bp, Homo sapien
gactggttgtgctgctggagaaggg

SEQ ID NO: 37144 - DNA, 25 bp, Homo sapien
gaagtcgcggtgcaggtgatggtgg

SEQ ID NO: 37145 - DNA, 25 bp, Homo sapien
ggcaggccgggagtgtactgtgtgc

SEQ ID NO: 37146 - DNA, 25 bp, Homo sapien
cagaagcttgtcactcctgttaatg

SEQ ID NO: 37147 - DNA, 25 bp, Homo sapien
taatgggaggatcagtcacacatgt

SEQ ID NO: 37148 - DNA, 25 bp, Homo sapien
tagcattgtgtgtgttgcttcccca

SEQ ID NO: 37149 - DNA, 25 bp, Homo sapien
ccctgaggagaggacaccatggctt

SEQ ID NO: 37150 - DNA, 25 bp, Homo sapien
caccatggcttactactcaggacaa

SEQ ID NO: 37151 - DNA, 25 bp, Homo sapien
ctactcaggacaagtatgccccgct

SEQ ID NO: 37152 - DNA, 25 bp, Homo sapien
atgccccgctcagggtgtgatttca

SEQ ID NO: 37153 - DNA, 25 bp, Homo sapien
tctacctagtgaaccccacttaaag

SEQ ID NO: 37154 - DNA, 25 bp, Homo sapien
gagcatttgaatctcttggaaaagg

SEQ ID NO: 37155 - DNA, 25 bp, Homo sapien
gttggtgccaaggacttgcgagggg

SEQ ID NO: 37156 - DNA, 25 bp, Homo sapien
taaaaatgttatccagcctgaccaa

SEQ ID NO: 37157 - DNA, 25 bp, Homo sapien
ccgttcccgagcgaaagcgtaagcg

SEQ ID NO: 37158 - DNA, 25 bp, Homo sapien
aagcgtaagcgactgcgtcgactcc

SEQ ID NO: 37159 - DNA, 25 bp, Homo sapien
ccagtactcgccagggatgaccatg

SEQ ID NO: 37160 - DNA, 25 bp, Homo sapien
gaccatgagcgtgtgatggggcggc

SEQ ID NO: 37161 - DNA, 25 bp, Homo sapien
cgcccctgctcagggcgaggggctg

SEQ ID NO: 37162 - DNA, 25 bp, Homo sapien
cgaggggctgaggtcacacctcggg

SEQ ID NO: 37163 - DNA, 25 bp, Homo sapien
caatcaaggcttgcccagctgggag

SEQ ID NO: 37164 - DNA, 25 bp, Homo sapien
ccccacacgaaagactcttaccatt

SEQ ID NO: 37165 - DNA, 25 bp, Homo sapien
acgcaaggacctcagagacgttctt

SEQ ID NO: 37166 - DNA, 25 bp, Homo sapien
agacgttcttttctgtatggaccct

SEQ ID NO: 37167 - DNA, 25 bp, Homo sapien
ttcctgccatttgtattttgtccca

SEQ ID NO: 37168 - DNA, 25 bp, Homo sapien
gagcatttactaggaagtgacatgg

SEQ ID NO: 37169 - DNA, 25 bp, Homo sapien
gtgacatggcgatgacctctgtaca

SEQ ID NO: 37170 - DNA, 25 bp, Homo sapien
gacctctgtacatgagttaggttca

SEQ ID NO: 37171 - DNA, 25 bp, Homo sapien
gttaggttcactttcatgtggcctc

SEQ ID NO: 37172 - DNA, 25 bp, Homo sapien
gcctcccactacagagatgcgtatg

SEQ ID NO: 37173 - DNA, 25 bp, Homo sapien
gatgcgtatgcccagaagtcagctc

SEQ ID NO: 37174 - DNA, 25 bp, Homo sapien
gcccagaagtcagctctctgaggag

SEQ ID NO: 37175 - DNA, 25 bp, Homo sapien
gctactttggccccagtttgaagca

SEQ ID NO: 37176 - DNA, 25 bp, Homo sapien
gcattctgtccaaatgtcctgagct

SEQ ID NO: 37177 - DNA, 25 bp, Homo sapien
gctctccagcagtcaagtagtgaat

SEQ ID NO: 37178 - DNA, 25 bp, Homo sapien
aaggcagagcttatcctcaattttt

SEQ ID NO: 37179 - DNA, 25 bp, Homo sapien
ggaaatggtgtattcttttcaaaga

SEQ ID NO: 37180 - DNA, 25 bp, Homo sapien
ttttgtaaccatctttacagtttct

SEQ ID NO: 37181 - DNA, 25 bp, Homo sapien
tctttgcttggaaaacttgggttgt

SEQ ID NO: 37182 - DNA, 25 bp, Homo sapien
actaccagttaacaatggcattact

SEQ ID NO: 37183 - DNA, 25 bp, Homo sapien
ttactttccaaaacgttatctaatg

SEQ ID NO: 37184 - DNA, 25 bp, Homo sapien
aaacgttatctaatgggcccaatgt

SEQ ID NO: 37185 - DNA, 25 bp, Homo sapien
taatgggcccaatgtgtacctcaag

SEQ ID NO: 37186 - DNA, 25 bp, Homo sapien
ggcccaatgtgtacctcaagataaa

SEQ ID NO: 37187 - DNA, 25 bp, Homo sapien
atgtctaaaaatttccttgtctgtt

SEQ ID NO: 37188 - DNA, 25 bp, Homo sapien
ttccttgtctgttgatttaaatggt

SEQ ID NO: 37189 - DNA, 25 bp, Homo sapien
ttaaatggttctgaaatgtctgtaa

SEQ ID NO: 37190 - DNA, 25 bp, Homo sapien
ggtgtctccctgactgcagaggagc

SEQ ID NO: 37191 - DNA, 25 bp, Homo sapien
gtgtctccctgactgcagaggagcc

SEQ ID NO: 37192 - DNA, 25 bp, Homo sapien
cagggcaaggacagctcagctgctg

SEQ ID NO: 37193 - DNA, 25 bp, Homo sapien
caaggacagctcagctgctggcagc

SEQ ID NO: 37194 - DNA, 25 bp, Homo sapien
cccatagacatcccccaagtagtct

SEQ ID NO: 37195 - DNA, 25 bp, Homo sapien
tagacatcccccaagtagtctcagg

SEQ ID NO: 37196 - DNA, 25 bp, Homo sapien
ccaagtagtctcaggcctctgacat

SEQ ID NO: 37197 - DNA, 25 bp, Homo sapien
aagtagtctcaggcctctgacatgt

SEQ ID NO: 37198 - DNA, 25 bp, Homo sapien
tgtccctgaggggcccctaagaaag

SEQ ID NO: 37199 - DNA, 25 bp, Homo sapien
tgaggggcccctaagaaagaaagtg

SEQ ID NO: 37200 - DNA, 25 bp, Homo sapien
aggctgtcgtgggaggatcatgtga

SEQ ID NO: 37201 - DNA, 25 bp, Homo sapien
agtaaaggatggtctggcactattt

SEQ ID NO: 37202 - DNA, 25 bp, Homo sapien
aggatggtctggcactattttattt

SEQ ID NO: 37203 - DNA, 25 bp, Homo sapien
tatgctaatccgaggtctggttatt

SEQ ID NO: 37204 - DNA, 25 bp, Homo sapien
aatccgaggtctggttattaggcca

SEQ ID NO: 37205 - DNA, 25 bp, Homo sapien
tattaggccagattcttgttcagtt

SEQ ID NO: 37206 - DNA, 25 bp, Homo sapien
aggccagattcttgttcagttattt

SEQ ID NO: 37207 - DNA, 25 bp, Homo sapien
taatgttgcctcctttttagtaaga

SEQ ID NO: 37208 - DNA, 25 bp, Homo sapien
gcctcctttttagtaagattctacg

SEQ ID NO: 37209 - DNA, 25 bp, Homo sapien
aaggggtagctcttatacttcctct

SEQ ID NO: 37210 - DNA, 25 bp, Homo sapien
gctgttttcttagctattactccaa

SEQ ID NO: 37211 - DNA, 25 bp, Homo sapien
ttttcttagctattactccaaataa

SEQ ID NO: 37212 - DNA, 25 bp, Homo sapien
tcccctcaggctgggacgcagagac

SEQ ID NO: 37213 - DNA, 25 bp, Homo sapien
acgcagagaccggcagcgattcgga

SEQ ID NO: 37214 - DNA, 25 bp, Homo sapien
gaccggcagcgattcggaggacggg

SEQ ID NO: 37215 - DNA, 25 bp, Homo sapien
cagcgattcggaggacgggctgcgg

SEQ ID NO: 37216 - DNA, 25 bp, Homo sapien
ctgcccactgaggtgcagctcatta

SEQ ID NO: 37217 - DNA, 25 bp, Homo sapien
gaggtgcagctcattaacgaagcct

SEQ ID NO: 37218 - DNA, 25 bp, Homo sapien
ggtgcagctcattaacgaagcctat

SEQ ID NO: 37219 - DNA, 25 bp, Homo sapien
agctcattaacgaagcctatgggct

SEQ ID NO: 37220 - DNA, 25 bp, Homo sapien
ttaacgaagcctatgggctggtggt

SEQ ID NO: 37221 - DNA, 25 bp, Homo sapien
tgggctggtggtggatgccgtactg

SEQ ID NO: 37222 - DNA, 25 bp, Homo sapien
cccggcgtggagccgggcgaggtcg

SEQ ID NO: 37223 - DNA, 25 bp, Homo sapien
tggagagttgaatgccagccaccag

SEQ ID NO: 37224 - DNA, 25 bp, Homo sapien
accagccatgggtgccagagtttgt

SEQ ID NO: 37225 - DNA, 25 bp, Homo sapien
ctggatgctagagtgacctgggcgc

SEQ ID NO: 37226 - DNA, 25 bp, Homo sapien
gtgacctgggcgctgaggagggccc

SEQ ID NO: 37227 - DNA, 25 bp, Homo sapien
gatagactcctgcttgcagcattcc

SEQ ID NO: 37228 - DNA, 25 bp, Homo sapien
ttcccagcagaggcatcgcctgtgg

SEQ ID NO: 37229 - DNA, 25 bp, Homo sapien
caccgcgtctgtgtctgtatatggc

SEQ ID NO: 37230 - DNA, 25 bp, Homo sapien
ggcagagctcccagatatatgcaca

SEQ ID NO: 37231 - DNA, 25 bp, Homo sapien
aaaaatgtgtttgcaccccagtctc

SEQ ID NO: 37232 - DNA, 25 bp, Homo sapien
ttcaacagcctggttacttctgggt

SEQ ID NO: 37233 - DNA, 25 bp, Homo sapien
tgctcatctgtatttcttactcttt

SEQ ID NO: 37234 - DNA, 25 bp, Homo sapien
ggtcccgtttcactgcagtgaatgt

SEQ ID NO: 37235 - DNA, 25 bp, Homo sapien
gtcccgtttcactgcagtgaatgtg

SEQ ID NO: 37236 - DNA, 25 bp, Homo sapien
gtgaatgtggcaagagcttccgcta

SEQ ID NO: 37237 - DNA, 25 bp, Homo sapien
gaatgtggcaagagcttccgctacc

SEQ ID NO: 37238 - DNA, 25 bp, Homo sapien
caccaccaggtcgtccacactggtg

SEQ ID NO: 37239 - DNA, 25 bp, Homo sapien
ccaccaggtcgtccacactggtgag

SEQ ID NO: 37240 - DNA, 25 bp, Homo sapien
caggtcgtccacactggtgagaaac

SEQ ID NO: 37241 - DNA, 25 bp, Homo sapien
ggtcgtccacactggtgagaaaccc

SEQ ID NO: 37242 - DNA, 25 bp, Homo sapien
gtccacactggtgagaaaccctact

SEQ ID NO: 37243 - DNA, 25 bp, Homo sapien
cactggtgagaaaccctactgctgc

SEQ ID NO: 37244 - DNA, 25 bp, Homo sapien
tctgggcagctgggggctggcagag

SEQ ID NO: 37245 - DNA, 25 bp, Homo sapien
ccggggacggccggagagcgatcac

SEQ ID NO: 37246 - DNA, 25 bp, Homo sapien
gctgagcggcagtgtaggtagtgaa

SEQ ID NO: 37247 - DNA, 25 bp, Homo sapien
taggtagtgaagactccctggggct

SEQ ID NO: 37248 - DNA, 25 bp, Homo sapien
tccccccatcacttttatgaattcg

SEQ ID NO: 37249 - DNA, 25 bp, Homo sapien
cacttttatgaattcgactccactt

SEQ ID NO: 37250 - DNA, 25 bp, Homo sapien
tgaattcgactccactttctaaagg

SEQ ID NO: 37251 - DNA, 25 bp, Homo sapien
tcgactccactttctaaaggaatta

SEQ ID NO: 37252 - DNA, 25 bp, Homo sapien
ggaattatgagtcttgtggcaaaca

SEQ ID NO: 37253 - DNA, 25 bp, Homo sapien
ggcaaacacaaaccggagtggccgg

SEQ ID NO: 37254 - DNA, 25 bp, Homo sapien
ggatggtgatgacaccgagtctcac

SEQ ID NO: 37255 - DNA, 25 bp, Homo sapien
tgatgacaccgagtctcactttctc

SEQ ID NO: 37256 - DNA, 25 bp, Homo sapien
ggtgctgacagtttaacaagcctta

SEQ ID NO: 37257 - DNA, 25 bp, Homo sapien
gttagctgaacagttcccacggcaa

SEQ ID NO: 37258 - DNA, 25 bp, Homo sapien
gttcccacggcaagtcttggacagt

SEQ ID NO: 37259 - DNA, 25 bp, Homo sapien
gatgatgttccagatcttgtagaaa

SEQ ID NO: 37260 - DNA, 25 bp, Homo sapien
aagtttggtttttggaagctggcat

SEQ ID NO: 37261 - DNA, 25 bp, Homo sapien
gaagctggcatggactagatttaac

SEQ ID NO: 37262 - DNA, 25 bp, Homo sapien
caaatcagctatgtggttccaaagt

SEQ ID NO: 37263 - DNA, 25 bp, Homo sapien
aacatcacctgttactagttcagta

SEQ ID NO: 37264 - DNA, 25 bp, Homo sapien
ttgttcagcatttttcggtcatttg

SEQ ID NO: 37265 - DNA, 25 bp, Homo sapien
tgattttgcattttgcacttcctcc

SEQ ID NO: 37266 - DNA, 25 bp, Homo sapien
gtattggtgcagtttgagggtgttt

SEQ ID NO: 37267 - DNA, 25 bp, Homo sapien
gagacagtcttgctgtattgcccag

SEQ ID NO: 37268 - DNA, 25 bp, Homo sapien
ggcacaatcacagctcattgcatcc

SEQ ID NO: 37269 - DNA, 25 bp, Homo sapien
caatcacccaggcctaagcaatcct

SEQ ID NO: 37270 - DNA, 25 bp, Homo sapien
tcctcccaccttgtagctgggacta

SEQ ID NO: 37271 - DNA, 25 bp, Homo sapien
catgctcagcagatccaagagatat

SEQ ID NO: 37272 - DNA, 25 bp, Homo sapien
gctgggactacagctcacagcacac

SEQ ID NO: 37273 - DNA, 25 bp, Homo sapien
tgagacggattctctatgttgccca

SEQ ID NO: 37274 - DNA, 25 bp, Homo sapien
tcctgcctcagcttccaaaggcaca

SEQ ID NO: 37275 - DNA, 25 bp, Homo sapien
caggccaagttgtagctttgtccct

SEQ ID NO: 37276 - DNA, 25 bp, Homo sapien
gccatcatgcccaacaagaggttct

SEQ ID NO: 37277 - DNA, 25 bp, Homo sapien
gagatatattggcaactttttctag

SEQ ID NO: 37278 - DNA, 25 bp, Homo sapien
aatgtgcctttgcaaagtttgcgaa

SEQ ID NO: 37279 - DNA, 25 bp, Homo sapien
gcgaaatcagattttgtatcccaat

SEQ ID NO: 37280 - DNA, 25 bp, Homo sapien
gctagcattttccaagcatagtaat

SEQ ID NO: 37281 - DNA, 25 bp, Homo sapien
ttttccattttgtctcatgaagtac

SEQ ID NO: 37282 - DNA, 25 bp, Homo sapien
tgtctcatgaagtaccttattgcaa

SEQ ID NO: 37283 - DNA, 25 bp, Homo sapien
cttattgcaaaaatcccactgagta

SEQ ID NO: 37284 - DNA, 25 bp, Homo sapien
ataatctttcaaatagccatgctac

SEQ ID NO: 37285 - DNA, 25 bp, Homo sapien
gccatgctaccagcgtacaacagtg

SEQ ID NO: 37286 - DNA, 25 bp, Homo sapien
acaacagtgatacatgtaaccccaa

SEQ ID NO: 37287 - DNA, 25 bp, Homo sapien
atgtaaccccaaatgtgatgtgaga

SEQ ID NO: 37288 - DNA, 25 bp, Homo sapien
gtgagaggacgattactttgtaaat

SEQ ID NO: 37289 - DNA, 25 bp, Homo sapien
gtagcacttactagcatttctgaag

SEQ ID NO: 37290 - DNA, 25 bp, Homo sapien
acatgaatctaaactgtcttcttct

SEQ ID NO: 37291 - DNA, 25 bp, Homo sapien
tctgttcctcattttgctttactta

SEQ ID NO: 37292 - DNA, 25 bp, Homo sapien
ttaagtgttttgcccatgtgcttgg

SEQ ID NO: 37293 - DNA, 25 bp, Homo sapien
gcttgggtagccttgaagtcaccag

SEQ ID NO: 37294 - DNA, 25 bp, Homo sapien
ggactcaaattcagaccaaaccagg

SEQ ID NO: 37295 - DNA, 25 bp, Homo sapien
accaggactagctttttgtgccatg

SEQ ID NO: 37296 - DNA, 25 bp, Homo sapien
atgagttagccatggtcctggaccc

SEQ ID NO: 37297 - DNA, 25 bp, Homo sapien
gtaaatttattcagctgccctcgtt

SEQ ID NO: 37298 - DNA, 25 bp, Homo sapien
cctcgtttactcacagtttgcttat

SEQ ID NO: 37299 - DNA, 25 bp, Homo sapien
actcacagtttgcttatttgccacc

SEQ ID NO: 37300 - DNA, 25 bp, Homo sapien
gagatgagctctaggtccaggtgat

SEQ ID NO: 37301 - DNA, 25 bp, Homo sapien
ggaggaggttgttggcagggactgc

SEQ ID NO: 37302 - DNA, 25 bp, Homo sapien
ttggcagggactgcagatcctgtca

SEQ ID NO: 37303 - DNA, 25 bp, Homo sapien
ggacctgtctttcatcgggagaaac

SEQ ID NO: 37304 - DNA, 25 bp, Homo sapien
gaaaccactcagagatggatcccat

SEQ ID NO: 37305 - DNA, 25 bp, Homo sapien
tggatcccattccctaaaggtctca

SEQ ID NO: 37306 - DNA, 25 bp, Homo sapien
agcaaaggagcaggactcccaggcc

SEQ ID NO: 37307 - DNA, 25 bp, Homo sapien
ttctgtttcaagctgggcagacccc

SEQ ID NO: 37308 - DNA, 25 bp, Homo sapien
tccctccctaaggactcagctgagg

SEQ ID NO: 37309 - DNA, 25 bp, Homo sapien
cctcccccagcttgatgtttgggtc

SEQ ID NO: 37310 - DNA, 25 bp, Homo sapien
ctccctggccggtgcaaagtacagg

SEQ ID NO: 37311 - DNA, 25 bp, Homo sapien
ggtggccttggagcgaagtgaagcc

SEQ ID NO: 37312 - DNA, 25 bp, Homo sapien
gaagccaacatcaagcacgagcgat

SEQ ID NO: 37313 - DNA, 25 bp, Homo sapien
gaatgagccctgtggggtgacgctt

SEQ ID NO: 37314 - DNA, 25 bp, Homo sapien
tgacgcttcagggcagagctgcctt

SEQ ID NO: 37315 - DNA, 25 bp, Homo sapien
cagagcatcagcacttgaggccttg

SEQ ID NO: 37316 - DNA, 25 bp, Homo sapien
tctctgtggaccattcaggacctcc

SEQ ID NO: 37317 - DNA, 25 bp, Homo sapien
cattcaggacctccagtgggggtgg

SEQ ID NO: 37318 - DNA, 25 bp, Homo sapien
atctctggatgccacagacctgagc

SEQ ID NO: 37319 - DNA, 25 bp, Homo sapien
tgagcagcattgggctggctgtccg

SEQ ID NO: 37320 - DNA, 25 bp, Homo sapien
ctgtccgctgctgactggatggcag

SEQ ID NO: 37321 - DNA, 25 bp, Homo sapien
gcagcgccagaagcactcatttctg

SEQ ID NO: 37322 - DNA, 25 bp, Homo sapien
tctttgtctttacttaattattcca

SEQ ID NO: 37323 - DNA, 25 bp, Homo sapien
gtctttacttaattattccaacatc

SEQ ID NO: 37324 - DNA, 25 bp, Homo sapien
ttaattattccaacatcttatcttc

SEQ ID NO: 37325 - DNA, 25 bp, Homo sapien
aattattccaacatcttatcttctt

SEQ ID NO: 37326 - DNA, 25 bp, Homo sapien
attattccaacatcttatcttcttc

SEQ ID NO: 37327 - DNA, 25 bp, Homo sapien
ttattccaacatcttatcttcttct

SEQ ID NO: 37328 - DNA, 25 bp, Homo sapien
tttttgcaaaacattcacatacatt

SEQ ID NO: 37329 - DNA, 25 bp, Homo sapien
ttcacatacatttaatctctttctc

SEQ ID NO: 37330 - DNA, 25 bp, Homo sapien
tcacatacatttaatctctttctcc

SEQ ID NO: 37331 - DNA, 25 bp, Homo sapien
cacatacatttaatctctttctcct

SEQ ID NO: 37332 - DNA, 25 bp, Homo sapien
acatacatttaatctctttctcctc

SEQ ID NO: 37333 - DNA, 25 bp, Homo sapien
gatcggaatatgtactgtgaagagt

SEQ ID NO: 37334 - DNA, 25 bp, Homo sapien
gtgaagagtaggggtggggaggtgg

SEQ ID NO: 37335 - DNA, 25 bp, Homo sapien
gagtaggggtggggaggtggtctgc

SEQ ID NO: 37336 - DNA, 25 bp, Homo sapien
tccactccgagctgggggggaatct

SEQ ID NO: 37337 - DNA, 25 bp, Homo sapien
ctccgagctgggggggaatctgtgt

SEQ ID NO: 37338 - DNA, 25 bp, Homo sapien
cctcccctgacctgactagggggag

SEQ ID NO: 37339 - DNA, 25 bp, Homo sapien
gacctgactagggggaggatccacc

SEQ ID NO: 37340 - DNA, 25 bp, Homo sapien
tgactagggggaggatccaccccaa

SEQ ID NO: 37341 - DNA, 25 bp, Homo sapien
ctgccaggaagccctacatcaataa

SEQ ID NO: 37342 - DNA, 25 bp, Homo sapien
gccctacatcaataaagttctgtct

SEQ ID NO: 37343 - DNA, 25 bp, Homo sapien
catcaataaagttctgtcttgtgta

SEQ ID NO: 37344 - DNA, 25 bp, Homo sapien
ttactaacttctacattttttattg

SEQ ID NO: 37345 - DNA, 25 bp, Homo sapien
gtcccataaaccagcttcaacaatt

SEQ ID NO: 37346 - DNA, 25 bp, Homo sapien
gtgtccctcagtatctgtggggcat

SEQ ID NO: 37347 - DNA, 25 bp, Homo sapien
ggttctaggaccacttatggatacc

SEQ ID NO: 37348 - DNA, 25 bp, Homo sapien
ggaccacttatggataccaacatct

SEQ ID NO: 37349 - DNA, 25 bp, Homo sapien
ggataccaacatctatggatgctca

SEQ ID NO: 37350 - DNA, 25 bp, Homo sapien
ttaaatcatccctagatcacttata

SEQ ID NO: 37351 - DNA, 25 bp, Homo sapien
gatcacttataatacgtaatacaat

SEQ ID NO: 37352 - DNA, 25 bp, Homo sapien
aatattttcattccaaggtcagttg

SEQ ID NO: 37353 - DNA, 25 bp, Homo sapien
cattccaaggtcagttgaacccatg

SEQ ID NO: 37354 - DNA, 25 bp, Homo sapien
ggtcagttgaacccatggacatagg

SEQ ID NO: 37355 - DNA, 25 bp, Homo sapien
gctaaagggtcgtgagggctctctt

SEQ ID NO: 37356 - DNA, 25 bp, Homo sapien
tcacaagcggttatccagtcgtgcc

SEQ ID NO: 37357 - DNA, 25 bp, Homo sapien
tcttgtttttctctgagtcagtctt

SEQ ID NO: 37358 - DNA, 25 bp, Homo sapien
aaatgaagtgtggcccagtggctcc

SEQ ID NO: 37359 - DNA, 25 bp, Homo sapien
tggctgttaccaggacaaccggagg

SEQ ID NO: 37360 - DNA, 25 bp, Homo sapien
ggaggtttgtctgatattgaagcta

SEQ ID NO: 37361 - DNA, 25 bp, Homo sapien
agagaccaagtcctgatgacattgt

SEQ ID NO: 37362 - DNA, 25 bp, Homo sapien
gaacccagagatccagacatgcctg

SEQ ID NO: 37363 - DNA, 25 bp, Homo sapien
tttaccactggacttatccgttgaa

SEQ ID NO: 37364 - DNA, 25 bp, Homo sapien
ggaggcgattgaccgttatctgcgg

SEQ ID NO: 37365 - DNA, 25 bp, Homo sapien
ggagccgttagcgggagaggcagag

SEQ ID NO: 37366 - DNA, 25 bp, Homo sapien
aattactttatttcattcctattgt

SEQ ID NO: 37367 - DNA, 25 bp, Homo sapien
tcattcctattgtattcacatgtga

SEQ ID NO: 37368 - DNA, 25 bp, Homo sapien
attgttgctgtgtcagatataggag

SEQ ID NO: 37369 - DNA, 25 bp, Homo sapien
gcattatttatggttttttctgtgg

SEQ ID NO: 37370 - DNA, 25 bp, Homo sapien
tctgtggaagagtatgggcattaaa

SEQ ID NO: 37371 - DNA, 25 bp, Homo sapien
tggagaggccctgttagtttacttt

SEQ ID NO: 37372 - DNA, 25 bp, Homo sapien
tagtttacttttcatattgagtgat

SEQ ID NO: 37373 - DNA, 25 bp, Homo sapien
gagtgatgcatgaggtaggtgtttg

SEQ ID NO: 37374 - DNA, 25 bp, Homo sapien
ggtgtttggagtaatattctgcatc

SEQ ID NO: 37375 - DNA, 25 bp, Homo sapien
gaatcattttactaattgtactttt

SEQ ID NO: 37376 - DNA, 25 bp, Homo sapien
aggcactgacactttagacattaca

SEQ ID NO: 37377 - DNA, 25 bp, Homo sapien
atcagtaattttgtgtttggggtgt

SEQ ID NO: 37378 - DNA, 25 bp, Homo sapien
gaaccgaaacaagattagtcctgag

SEQ ID NO: 37379 - DNA, 25 bp, Homo sapien
tagtcctgagttaacaatggctgca

SEQ ID NO: 37380 - DNA, 25 bp, Homo sapien
ctgagttaacaatggctgcaagctg

SEQ ID NO: 37381 - DNA, 25 bp, Homo sapien
tggctgcaagctggatacatggaat

SEQ ID NO: 37382 - DNA, 25 bp, Homo sapien
catggaattcagcacacttttctcc

SEQ ID NO: 37383 - DNA, 25 bp, Homo sapien
ctccctcttactgattatgcttttg

SEQ ID NO: 37384 - DNA, 25 bp, Homo sapien
gcttctgcataaaattttaactcca

SEQ ID NO: 37385 - DNA, 25 bp, Homo sapien
aactccataacttataagctcactc

SEQ ID NO: 37386 - DNA, 25 bp, Homo sapien
gctcactctttattgttactttcta

SEQ ID NO: 37387 - DNA, 25 bp, Homo sapien
tgttactttctaattgacaaataaa

SEQ ID NO: 37388 - DNA, 25 bp, Homo sapien
gcctactactactatacggctgcga

SEQ ID NO: 37389 - DNA, 25 bp, Homo sapien
gattaaatgtatgtgaatgttttgc

SEQ ID NO: 37390 - DNA, 25 bp, Homo sapien
cctactactactatacggctgcgag

SEQ ID NO: 37391 - DNA, 25 bp, Homo sapien
ctactactactatacggctgcgaga

SEQ ID NO: 37392 - DNA, 25 bp, Homo sapien
tactactactatacggctgcgagaa

SEQ ID NO: 37393 - DNA, 25 bp, Homo sapien
actactactatacggctgcgagaag

SEQ ID NO: 37394 - DNA, 25 bp, Homo sapien
ctactactatacggctgcgagaaga

SEQ ID NO: 37395 - DNA, 25 bp, Homo sapien
actactatacggctgcgagaagacg

SEQ ID NO: 37396 - DNA, 25 bp, Homo sapien
tactatacggctgcgagaagacgac

SEQ ID NO: 37397 - DNA, 25 bp, Homo sapien
ctatacggctgcgagaagacgacag

SEQ ID NO: 37398 - DNA, 25 bp, Homo sapien
atacggctgcgagaagacgacagaa

SEQ ID NO: 37399 - DNA, 25 bp, Homo sapien
agaggcttcagtgagccgaggccac

SEQ ID NO: 37400 - DNA, 25 bp, Homo sapien
ctccggccttggtgacagagactct

SEQ ID NO: 37401 - DNA, 25 bp, Homo sapien
gacagagactctgcctcgaaagata

SEQ ID NO: 37402 - DNA, 25 bp, Homo sapien
gggattatactgtacattctttctt

SEQ ID NO: 37403 - DNA, 25 bp, Homo sapien
gacaggcttctgatagattgcaact

SEQ ID NO: 37404 - DNA, 25 bp, Homo sapien
aatcctggtctttcttggtaaacag

SEQ ID NO: 37405 - DNA, 25 bp, Homo sapien
acatgccacaggagaattcagggat

SEQ ID NO: 37406 - DNA, 25 bp, Homo sapien
ggatttgagtttccctgaatagcat

SEQ ID NO: 37407 - DNA, 25 bp, Homo sapien
gatgcatcaaatgggttattactat

SEQ ID NO: 37408 - DNA, 25 bp, Homo sapien
tagccaggtatggttgcacaggcct

SEQ ID NO: 37409 - DNA, 25 bp, Homo sapien
gagaatcacctgaacctgagaggca

SEQ ID NO: 37410 - DNA, 25 bp, Homo sapien
gcagcgggaacagcacgaagagtga

SEQ ID NO: 37411 - DNA, 25 bp, Homo sapien
gaagagtgagctgtcgttggcgtcc

SEQ ID NO: 37412 - DNA, 25 bp, Homo sapien
cagcgacctgagggcgaacagaatc

SEQ ID NO: 37413 - DNA, 25 bp, Homo sapien
gaatcgcggtcttgaatgctgaaaa

SEQ ID NO: 37414 - DNA, 25 bp, Homo sapien
gaaaagagctgcaacggtctcagga

SEQ ID NO: 37415 - DNA, 25 bp, Homo sapien
ggaagaacgacgacaccaaggccaa

SEQ ID NO: 37416 - DNA, 25 bp, Homo sapien
gaattttcgcggatggggcttgtga

SEQ ID NO: 37417 - DNA, 25 bp, Homo sapien
gaatgaagccatggtcagttccgga

SEQ ID NO: 37418 - DNA, 25 bp, Homo sapien
tcagttccggagcgttatcgttgat

SEQ ID NO: 37419 - DNA, 25 bp, Homo sapien
ttatcgttgatatctaccacctgta

SEQ ID NO: 37420 - DNA, 25 bp, Homo sapien
cagaggctttaatatccacctgata

SEQ ID NO: 37421 - DNA, 25 bp, Homo sapien
tcagtcacattgtaggagccagtgt

SEQ ID NO: 37422 - DNA, 25 bp, Homo sapien
gtaggagccagtgtagctatggaat

SEQ ID NO: 37423 - DNA, 25 bp, Homo sapien
gccagtgtagctatggaattatctt

SEQ ID NO: 37424 - DNA, 25 bp, Homo sapien
gaattatcttaggaactcaagcttc

SEQ ID NO: 37425 - DNA, 25 bp, Homo sapien
agcttctaaaactatccatgtagtc

SEQ ID NO: 37426 - DNA, 25 bp, Homo sapien
ctatccatgtagtcaaatctagggg

SEQ ID NO: 37427 - DNA, 25 bp, Homo sapien
gtaaaatttggccgggcacagtggc

SEQ ID NO: 37428 - DNA, 25 bp, Homo sapien
ttagctgggcgtaggtggtgcacac

SEQ ID NO: 37429 - DNA, 25 bp, Homo sapien
gtaggtggtgcacacctgtagtccc

SEQ ID NO: 37430 - DNA, 25 bp, Homo sapien
ataaatgctgttgtgcttggagatg

SEQ ID NO: 37431 - DNA, 25 bp, Homo sapien
atgctgttgtgcttggagatgatca

SEQ ID NO: 37432 - DNA, 25 bp, Homo sapien
aaccaggattaccagttcttcacat

SEQ ID NO: 37433 - DNA, 25 bp, Homo sapien
acgtctgcagctggatttagcttgc

SEQ ID NO: 37434 - DNA, 25 bp, Homo sapien
gcaagctgccaagttgcaacctctt

SEQ ID NO: 37435 - DNA, 25 bp, Homo sapien
ttctgtcattttcatcatagcaagt

SEQ ID NO: 37436 - DNA, 25 bp, Homo sapien
gtctatgcggacaaaagcctccaaa

SEQ ID NO: 37437 - DNA, 25 bp, Homo sapien
ccaaactttccaactgtgtaggcca

SEQ ID NO: 37438 - DNA, 25 bp, Homo sapien
tagaatataatggctatccccctct

SEQ ID NO: 37439 - DNA, 25 bp, Homo sapien
tatccccctctgccaaataagacta

SEQ ID NO: 37440 - DNA, 25 bp, Homo sapien
aaataagactatccacaacccagct

SEQ ID NO: 37441 - DNA, 25 bp, Homo sapien
caacccagctcagacacagtggtta

SEQ ID NO: 37442 - DNA, 25 bp, Homo sapien
tctgagccaacatctatccagcagc

SEQ ID NO: 37443 - DNA, 25 bp, Homo sapien
gagaaatgcacactgtaggacatgg

SEQ ID NO: 37444 - DNA, 25 bp, Homo sapien
gaaatgcacactgtaggacatggaa

SEQ ID NO: 37445 - DNA, 25 bp, Homo sapien
aatgcacactgtaggacatggaata

SEQ ID NO: 37446 - DNA, 25 bp, Homo sapien
cacactgtaggacatggaatatggc

SEQ ID NO: 37447 - DNA, 25 bp, Homo sapien
ggaaaataagtaacagacactgtag

SEQ ID NO: 37448 - DNA, 25 bp, Homo sapien
aagtaacagacactgtaggactgga

SEQ ID NO: 37449 - DNA, 25 bp, Homo sapien
gtaacagacactgtaggactggaaa

SEQ ID NO: 37450 - DNA, 25 bp, Homo sapien
aacagacactgtaggactggaaata

SEQ ID NO: 37451 - DNA, 25 bp, Homo sapien
gacactgtaggactggaaatatggt

SEQ ID NO: 37452 - DNA, 25 bp, Homo sapien
actgtaggactggaaatatggtgag

SEQ ID NO: 37453 - DNA, 25 bp, Homo sapien
ctgtaggactggaaatatggtgaga

SEQ ID NO: 37454 - DNA, 25 bp, Homo sapien
gaattatctagttattgtatatatg

SEQ ID NO: 37455 - DNA, 25 bp, Homo sapien
gtttttaatattatgactctggtcc

SEQ ID NO: 37456 - DNA, 25 bp, Homo sapien
ttatgactctggtcctttggaatga

SEQ ID NO: 37457 - DNA, 25 bp, Homo sapien
cctttggaatgaatgctattattgc

SEQ ID NO: 37458 - DNA, 25 bp, Homo sapien
agcacaacatcaggaagtgtgtttg

SEQ ID NO: 37459 - DNA, 25 bp, Homo sapien
gtcaaatttattttctctaagtagt

SEQ ID NO: 37460 - DNA, 25 bp, Homo sapien
aaatatactaccagttacattttat

SEQ ID NO: 37461 - DNA, 25 bp, Homo sapien
ggttgttagaatatttttctcacac

SEQ ID NO: 37462 - DNA, 25 bp, Homo sapien
tatttttctcacacatagacatgga

SEQ ID NO: 37463 - DNA, 25 bp, Homo sapien
ggaagtcagattcattctttgtgat

SEQ ID NO: 37464 - DNA, 25 bp, Homo sapien
ctttgtgatgtttgtagccaccatt

SEQ ID NO: 37465 - DNA, 25 bp, Homo sapien
taaatctttgttatgatcatgtcat

SEQ ID NO: 37466 - DNA, 25 bp, Homo sapien
gaatggcttgtgcttaaggacaaag

SEQ ID NO: 37467 - DNA, 25 bp, Homo sapien
aagtctagaaaccactatcatagtt

SEQ ID NO: 37468 - DNA, 25 bp, Homo sapien
aatacatgagtatctccctccatgg

SEQ ID NO: 37469 - DNA, 25 bp, Homo sapien
gtatctccctccatggactggagaa

SEQ ID NO: 37470 - DNA, 25 bp, Homo sapien
gtatattgatatttccaggttcatt

SEQ ID NO: 37471 - DNA, 25 bp, Homo sapien
atttccaggttcatttgcatatact

SEQ ID NO: 37472 - DNA, 25 bp, Homo sapien
tttgcatatacttttttccaaataa

SEQ ID NO: 37473 - DNA, 25 bp, Homo sapien
gttaagtgcattgttttcaggaatc

SEQ ID NO: 37474 - DNA, 25 bp, Homo sapien
tccggagttcgaggctggtttggcc

SEQ ID NO: 37475 - DNA, 25 bp, Homo sapien
tcgaggctggtttggccagcatggc

SEQ ID NO: 37476 - DNA, 25 bp, Homo sapien
aaagctagaagccctaattgacctt

SEQ ID NO: 37477 - DNA, 25 bp, Homo sapien
atgggatggtgggattgtcccctct

SEQ ID NO: 37478 - DNA, 25 bp, Homo sapien
cccctctgacagcacatatgaaata

SEQ ID NO: 37479 - DNA, 25 bp, Homo sapien
gaatcttctgacttaaatacaactt

SEQ ID NO: 37480 - DNA, 25 bp, Homo sapien
tcatggagttcttcaccacttatct

SEQ ID NO: 37481 - DNA, 25 bp, Homo sapien
atgtgttctccatatttcttgtata

SEQ ID NO: 37482 - DNA, 25 bp, Homo sapien
atttcttgtataagccagtccccag

SEQ ID NO: 37483 - DNA, 25 bp, Homo sapien
agtccccagcatctgatgttttgag

SEQ ID NO: 37484 - DNA, 25 bp, Homo sapien
gcatggagtttcctaaactttgcac

SEQ ID NO: 37485 - DNA, 25 bp, Homo sapien
gcacagaagaatatcctggggccgg

SEQ ID NO: 37486 - DNA, 25 bp, Homo sapien
aggcaggtggatcataggtcaaaag

SEQ ID NO: 37487 - DNA, 25 bp, Homo sapien
taaaaggcatccgtaggctgcgtgc

SEQ ID NO: 37488 - DNA, 25 bp, Homo sapien
attagtgtttcttagtagaagcaac

SEQ ID NO: 37489 - DNA, 25 bp, Homo sapien
tagtagaagcaacacagtttttttt

SEQ ID NO: 37490 - DNA, 25 bp, Homo sapien
actagatttctcattctgagtctat

SEQ ID NO: 37491 - DNA, 25 bp, Homo sapien
ttctgagtctatacacaattttcta

SEQ ID NO: 37492 - DNA, 25 bp, Homo sapien
gcgtagtactaattcttaagacagt

SEQ ID NO: 37493 - DNA, 25 bp, Homo sapien
gtgtttatctaattgtccagtccca

SEQ ID NO: 37494 - DNA, 25 bp, Homo sapien
aattgtccagtcccaggattcgttg

SEQ ID NO: 37495 - DNA, 25 bp, Homo sapien
gtccagtcccaggattcgttggaat

SEQ ID NO: 37496 - DNA, 25 bp, Homo sapien
attcgttggaatcagagacattttc

SEQ ID NO: 37497 - DNA, 25 bp, Homo sapien
atcagagacattttcttagggggtc

SEQ ID NO: 37498 - DNA, 25 bp, Homo sapien
gatcatttgaggccaggaattcaag

SEQ ID NO: 37499 - DNA, 25 bp, Homo sapien
catgcctatgatcccagctactggg

SEQ ID NO: 37500 - DNA, 25 bp, Homo sapien
gaggcaggagaatcgttttaaccca

SEQ ID NO: 37501 - DNA, 25 bp, Homo sapien
ttaacccagaagacaggctgcagtg

SEQ ID NO: 37502 - DNA, 25 bp, Homo sapien
ggatatttctgatttgggtctttaa

SEQ ID NO: 37503 - DNA, 25 bp, Homo sapien
aagcattttagacttgcattcagaa

SEQ ID NO: 37504 - DNA, 25 bp, Homo sapien
aagacattttcctagcatttcactg

SEQ ID NO: 37505 - DNA, 25 bp, Homo sapien
tagcatttcactgcggagaactggc

SEQ ID NO: 37506 - DNA, 25 bp, Homo sapien
gagaactggcaatcaaaatcccctc

SEQ ID NO: 37507 - DNA, 25 bp, Homo sapien
atatacacatttttttagtcattaa

SEQ ID NO: 37508 - DNA, 25 bp, Homo sapien
tagtcattaatatgcttctgtttta

SEQ ID NO: 37509 - DNA, 25 bp, Homo sapien
atgaaaggggctcgcatgctcattc

SEQ ID NO: 37510 - DNA, 25 bp, Homo sapien
tgctcattcgggtggccaacaacat

SEQ ID NO: 37511 - DNA, 25 bp, Homo sapien
cattcgggtggccaacaacatcagc

SEQ ID NO: 37512 - DNA, 25 bp, Homo sapien
aggtaggcagagatggctatttctg

SEQ ID NO: 37513 - DNA, 25 bp, Homo sapien
atggctatttctgctatctaatcgt

SEQ ID NO: 37514 - DNA, 25 bp, Homo sapien
ttctgctatctaatcgtatttctca

SEQ ID NO: 37515 - DNA, 25 bp, Homo sapien
tgctatctaatcgtatttctcaaag

SEQ ID NO: 37516 - DNA, 25 bp, Homo sapien
atttccaaaaatgtagctgccagtg

SEQ ID NO: 37517 - DNA, 25 bp, Homo sapien
gtagctgccagtgtgcaagctcaat

SEQ ID NO: 37518 - DNA, 25 bp, Homo sapien
gctgccagtgtgcaagctcaataag

SEQ ID NO: 37519 - DNA, 25 bp, Homo sapien
gcaagctcaataagaaaacggtggg

SEQ ID NO: 37520 - DNA, 25 bp, Homo sapien
gaatggcacatgctggggccttacc

SEQ ID NO: 37521 - DNA, 25 bp, Homo sapien
acccctgttggcaggtgggaggcag

SEQ ID NO: 37522 - DNA, 25 bp, Homo sapien
gcagggtgccttggggagttgggaa

SEQ ID NO: 37523 - DNA, 25 bp, Homo sapien
ggccctggatcctagctgagggcag

SEQ ID NO: 37524 - DNA, 25 bp, Homo sapien
tcctagctgagggcagtcaggagcc

SEQ ID NO: 37525 - DNA, 25 bp, Homo sapien
ccagtcagaccttgaaattccagga

SEQ ID NO: 37526 - DNA, 25 bp, Homo sapien
gaccttgaaattccaggatggcaca

SEQ ID NO: 37527 - DNA, 25 bp, Homo sapien
caaagagcttctgaggtcactgtgc

SEQ ID NO: 37528 - DNA, 25 bp, Homo sapien
cagccagcccctaggctagaaacaa

SEQ ID NO: 37529 - DNA, 25 bp, Homo sapien
agatcttagatgttcgaaggcttaa

SEQ ID NO: 37530 - DNA, 25 bp, Homo sapien
gtgaatgcctattagtaatcccagc

SEQ ID NO: 37531 - DNA, 25 bp, Homo sapien
gccgtcaaccgcaagcgcaagaagc

SEQ ID NO: 37532 - DNA, 25 bp, Homo sapien
aaccgcaagcgcaagaagcggcggg

SEQ ID NO: 37533 - DNA, 25 bp, Homo sapien
gcaagcgcaagaagcggcgggaggc

SEQ ID NO: 37534 - DNA, 25 bp, Homo sapien
gcgcaagaagcggcgggaggcgcgg

SEQ ID NO: 37535 - DNA, 25 bp, Homo sapien
caccgacgacgactcggagcaggag

SEQ ID NO: 37536 - DNA, 25 bp, Homo sapien
tcggagcaggaggcgcacaagcctg

SEQ ID NO: 37537 - DNA, 25 bp, Homo sapien
ccacgtggagacggacactgagggc

SEQ ID NO: 37538 - DNA, 25 bp, Homo sapien
acgtggagacggacactgagggcgc

SEQ ID NO: 37539 - DNA, 25 bp, Homo sapien
tcgtccagcagccaggagtcgctgc

SEQ ID NO: 37540 - DNA, 25 bp, Homo sapien
gtccagcagccaggagtcgctgcgg

SEQ ID NO: 37541 - DNA, 25 bp, Homo sapien
ccagcagccaggagtcgctgcggcc

SEQ ID NO: 37542 - DNA, 25 bp, Homo sapien
gactgatctttttgagcaccatctc

SEQ ID NO: 37543 - DNA, 25 bp, Homo sapien
gagcaccatctcatatatcatcttt

SEQ ID NO: 37544 - DNA, 25 bp, Homo sapien
tatatcatctttcttaatcctttaa

SEQ ID NO: 37545 - DNA, 25 bp, Homo sapien
aggaaggtggtgtctatccccattt

SEQ ID NO: 37546 - DNA, 25 bp, Homo sapien
gtgtctatccccatttcgaagatga

SEQ ID NO: 37547 - DNA, 25 bp, Homo sapien
gaaattgagccttggagactctagc

SEQ ID NO: 37548 - DNA, 25 bp, Homo sapien
gagactctagcttatcacatgacaa

SEQ ID NO: 37549 - DNA, 25 bp, Homo sapien
caatcctgcctccaaaacttgaggt

SEQ ID NO: 37550 - DNA, 25 bp, Homo sapien
tgttttttccttacctagtacatct

SEQ ID NO: 37551 - DNA, 25 bp, Homo sapien
tacctagtacatctctgactggtga

SEQ ID NO: 37552 - DNA, 25 bp, Homo sapien
ccgggaggcgtagctagcggtgggc

SEQ ID NO: 37553 - DNA, 25 bp, Homo sapien
acaggaaggtccatgtttcattagt

SEQ ID NO: 37554 - DNA, 25 bp, Homo sapien
tgcagtctcctgaggagtgctgggt

SEQ ID NO: 37555 - DNA, 25 bp, Homo sapien
gagtgctgggtgattctgctttgaa

SEQ ID NO: 37556 - DNA, 25 bp, Homo sapien
tataatcttatgcctgcttgttgga

SEQ ID NO: 37557 - DNA, 25 bp, Homo sapien
gcttgttggattttgttttcttgtt

SEQ ID NO: 37558 - DNA, 25 bp, Homo sapien
agagaggcgagcgagcggatcactt

SEQ ID NO: 37559 - DNA, 25 bp, Homo sapien
tcaggaattcgagaccaacctggcc

SEQ ID NO: 37560 - DNA, 25 bp, Homo sapien
tgaaacaccctctctactaataaca

SEQ ID NO: 37561 - DNA, 25 bp, Homo sapien
tagctgggcttggtagcgcatgcct

SEQ ID NO: 37562 - DNA, 25 bp, Homo sapien
ccaactactagggaggctgaggcag

SEQ ID NO: 37563 - DNA, 25 bp, Homo sapien
tgaacgccggggtcggaggttgcag

SEQ ID NO: 37564 - DNA, 25 bp, Homo sapien
ctggggtggccgaacgtatggagct

SEQ ID NO: 37565 - DNA, 25 bp, Homo sapien
ggccgaacgtatggagctgggctcc

SEQ ID NO: 37566 - DNA, 25 bp, Homo sapien
gagggggtgtgtgagccggaacctc

SEQ ID NO: 37567 - DNA, 25 bp, Homo sapien
cctccagcattcttggggatacgaa

SEQ ID NO: 37568 - DNA, 25 bp, Homo sapien
tggggatacgaacttccaacgctgg

SEQ ID NO: 37569 - DNA, 25 bp, Homo sapien
gctgggcagcctcttaaggcttcta

SEQ ID NO: 37570 - DNA, 25 bp, Homo sapien
taaggcttctaggaattcgcatccc

SEQ ID NO: 37571 - DNA, 25 bp, Homo sapien
cccagccagcagatcggttgcgaga

SEQ ID NO: 37572 - DNA, 25 bp, Homo sapien
gatcggttgcgagagggaccgttcg

SEQ ID NO: 37573 - DNA, 25 bp, Homo sapien
tgcgagagggaccgttcgggtccgc

SEQ ID NO: 37574 - DNA, 25 bp, Homo sapien
ctccgggcttagccggcggaggtgg

SEQ ID NO: 37575 - DNA, 25 bp, Homo sapien
gccactgtgcccggcaaattttttt

SEQ ID NO: 37576 - DNA, 25 bp, Homo sapien
tacctttacagaaggttttgcttat

SEQ ID NO: 37577 - DNA, 25 bp, Homo sapien
gaaggttttgcttatttaattgtga

SEQ ID NO: 37578 - DNA, 25 bp, Homo sapien
atttaattgtgagctcatttttctt

SEQ ID NO: 37579 - DNA, 25 bp, Homo sapien
aattgtgagctcatttttctttgtt

SEQ ID NO: 37580 - DNA, 25 bp, Homo sapien
ttgtgagctcatttttctttgttac

SEQ ID NO: 37581 - DNA, 25 bp, Homo sapien
gtgagctcatttttctttgttactt

SEQ ID NO: 37582 - DNA, 25 bp, Homo sapien
gagctcatttttctttgttactttt

SEQ ID NO: 37583 - DNA, 25 bp, Homo sapien
gctcatttttctttgttacttttgt

SEQ ID NO: 37584 - DNA, 25 bp, Homo sapien
attaatcttttaaaatgtgtcagcc

SEQ ID NO: 37585 - DNA, 25 bp, Homo sapien
ttacaatttttaaatgtgtcaacca

SEQ ID NO: 37586 - DNA, 25 bp, Homo sapien
ttccgcggggtgctggaggagcagt

SEQ ID NO: 37587 - DNA, 25 bp, Homo sapien
ccgcggggtgctggaggagcagtgc

SEQ ID NO: 37588 - DNA, 25 bp, Homo sapien
cgcacaagcctgaccgtggatttca

SEQ ID NO: 37589 - DNA, 25 bp, Homo sapien
aagcctgaccgtggatttcagggac

SEQ ID NO: 37590 - DNA, 25 bp, Homo sapien
gcctgaccgtggatttcagggacac

SEQ ID NO: 37591 - DNA, 25 bp, Homo sapien
ctgaccgtggatttcagggacacat

SEQ ID NO: 37592 - DNA, 25 bp, Homo sapien
gaccgtggatttcagggacacatac

SEQ ID NO: 37593 - DNA, 25 bp, Homo sapien
ccgtggatttcagggacacataccg

SEQ ID NO: 37594 - DNA, 25 bp, Homo sapien
gtggatttcagggacacataccgcc

SEQ ID NO: 37595 - DNA, 25 bp, Homo sapien
tggatttcagggacacataccgcct

SEQ ID NO: 37596 - DNA, 25 bp, Homo sapien
atcgagctttcctggactcggtcat

SEQ ID NO: 37597 - DNA, 25 bp, Homo sapien
ggacattccaggaaggctaacccct

SEQ ID NO: 37598 - DNA, 25 bp, Homo sapien
caggaaggctaacccctggcattta

SEQ ID NO: 37599 - DNA, 25 bp, Homo sapien
aacccctggcatttatggcaggtat

SEQ ID NO: 37600 - DNA, 25 bp, Homo sapien
aggagggcagcacagaaaacatgaa

SEQ ID NO: 37601 - DNA, 25 bp, Homo sapien
acatgaaatcagtcagcatctatgc

SEQ ID NO: 37602 - DNA, 25 bp, Homo sapien
aatcagtcagcatctatgcaatgca

SEQ ID NO: 37603 - DNA, 25 bp, Homo sapien
tatgcaatgcaatacatgcctcatc

SEQ ID NO: 37604 - DNA, 25 bp, Homo sapien
tgcaatacatgcctcatcttactca

SEQ ID NO: 37605 - DNA, 25 bp, Homo sapien
acatgcctcatcttactcagattga

SEQ ID NO: 37606 - DNA, 25 bp, Homo sapien
aagattttaaaactagcattcatgc

SEQ ID NO: 37607 - DNA, 25 bp, Homo sapien
aactagcattcatgctgggcgcagt

SEQ ID NO: 37608 - DNA, 25 bp, Homo sapien
tccagagggagcgagggaagcggct

SEQ ID NO: 37609 - DNA, 25 bp, Homo sapien
ggagcgagggaagcggctagaggat

SEQ ID NO: 37610 - DNA, 25 bp, Homo sapien
gggaagcggctagaggatcggggag

SEQ ID NO: 37611 - DNA, 25 bp, Homo sapien
gcggctagaggatcggggagaagga

SEQ ID NO: 37612 - DNA, 25 bp, Homo sapien
agaggatcggggagaaggagcattc

SEQ ID NO: 37613 - DNA, 25 bp, Homo sapien
cctgctcctatgcggtacttgaagg

SEQ ID NO: 37614 - DNA, 25 bp, Homo sapien
tatgcggtacttgaaggatggcgaa

SEQ ID NO: 37615 - DNA, 25 bp, Homo sapien
ggatggcgaagaggtcgcgcaggtg

SEQ ID NO: 37616 - DNA, 25 bp, Homo sapien
gcgaagaggtcgcgcaggtgggtgg

SEQ ID NO: 37617 - DNA, 25 bp, Homo sapien
cctcctgacatgttgggggtatccc

SEQ ID NO: 37618 - DNA, 25 bp, Homo sapien
tgacatgttgggggtatccctggcc

SEQ ID NO: 37619 - DNA, 25 bp, Homo sapien
ggcgagaagagggaagttggagagg

SEQ ID NO: 37620 - DNA, 25 bp, Homo sapien
aaagttagcccagaaggaaagcatt

SEQ ID NO: 37621 - DNA, 25 bp, Homo sapien
agcctgaatccaccgtggctaggca

SEQ ID NO: 37622 - DNA, 25 bp, Homo sapien
gaatccaccgtggctaggcatattc

SEQ ID NO: 37623 - DNA, 25 bp, Homo sapien
ccaccgtggctaggcatattcttgc

SEQ ID NO: 37624 - DNA, 25 bp, Homo sapien
ggctaggcatattcttgctcttctc

SEQ ID NO: 37625 - DNA, 25 bp, Homo sapien
tcttctcgtgttgctcacaactacc

SEQ ID NO: 37626 - DNA, 25 bp, Homo sapien
tctcgtgttgctcacaactacctgc

SEQ ID NO: 37627 - DNA, 25 bp, Homo sapien
tcacaactacctgcctggatgaatt

SEQ ID NO: 37628 - DNA, 25 bp, Homo sapien
actacctgcctggatgaatttagga

SEQ ID NO: 37629 - DNA, 25 bp, Homo sapien
gttgcaggatacaaggttaaaacac

SEQ ID NO: 37630 - DNA, 25 bp, Homo sapien
ctgcaagtagtatcagcttcaccat

SEQ ID NO: 37631 - DNA, 25 bp, Homo sapien
tcagcttcaccataagcttgggcct

SEQ ID NO: 37632 - DNA, 25 bp, Homo sapien
gttgtcattgtttcagcattcatga

SEQ ID NO: 37633 - DNA, 25 bp, Homo sapien
gcattcatgaactttcttactatca

SEQ ID NO: 37634 - DNA, 25 bp, Homo sapien
tcttactatcacaggttctacttta

SEQ ID NO: 37635 - DNA, 25 bp, Homo sapien
ttctactttaattttccttgccata

SEQ ID NO: 37636 - DNA, 25 bp, Homo sapien
ttttccttgccatatgtgtttccat

SEQ ID NO: 37637 - DNA, 25 bp, Homo sapien
ggacattagccaccacaggaacaca

SEQ ID NO: 37638 - DNA, 25 bp, Homo sapien
gaagactcctgggtgtacagagcaa

SEQ ID NO: 37639 - DNA, 25 bp, Homo sapien
gataccaaacagaatcctttctatt

SEQ ID NO: 37640 - DNA, 25 bp, Homo sapien
aatcagttaagtgttggctgggcgc

SEQ ID NO: 37641 - DNA, 25 bp, Homo sapien
ctactactactactgctcgaattca

SEQ ID NO: 37642 - DNA, 25 bp, Homo sapien
actactactactgctcgaattcaag

SEQ ID NO: 37643 - DNA, 25 bp, Homo sapien
actactactgctcgaattcaagctt

SEQ ID NO: 37644 - DNA, 25 bp, Homo sapien
actactgctcgaattcaagcttcta

SEQ ID NO: 37645 - DNA, 25 bp, Homo sapien
actgctcgaattcaagcttctaacg

SEQ ID NO: 37646 - DNA, 25 bp, Homo sapien
gctcgaattcaagcttctaacgatg

SEQ ID NO: 37647 - DNA, 25 bp, Homo sapien
aattcaagcttctaacgatgtacgg

SEQ ID NO: 37648 - DNA, 25 bp, Homo sapien
caagcttctaacgatgtacggggac

SEQ ID NO: 37649 - DNA, 25 bp, Homo sapien
gcttctaacgatgtacggggacatg

SEQ ID NO: 37650 - DNA, 25 bp, Homo sapien
gtacggggacatggaaataaagcac

SEQ ID NO: 37651 - DNA, 25 bp, Homo sapien
tggaaataaagcacccagcgctgcc

SEQ ID NO: 37652 - DNA, 25 bp, Homo sapien
ttttctctggacacccttatttgga

SEQ ID NO: 37653 - DNA, 25 bp, Homo sapien
gacacccttatttggaggttggcct

SEQ ID NO: 37654 - DNA, 25 bp, Homo sapien
gattttaagctaattgagggtggga

SEQ ID NO: 37655 - DNA, 25 bp, Homo sapien
gggtgggaaatatgaattgtctatc

SEQ ID NO: 37656 - DNA, 25 bp, Homo sapien
aattgtctatctttgaatcctgccc

SEQ ID NO: 37657 - DNA, 25 bp, Homo sapien
tgaatcctgcccagtatacaaccca

SEQ ID NO: 37658 - DNA, 25 bp, Homo sapien
tcctgcccagtatacaacccagtag

SEQ ID NO: 37659 - DNA, 25 bp, Homo sapien
gtatacaacccagtaggtacctaat

SEQ ID NO: 37660 - DNA, 25 bp, Homo sapien
gtacctaatactgttcattgaatgt

SEQ ID NO: 37661 - DNA, 25 bp, Homo sapien
attcatattccttagatttaggaca

SEQ ID NO: 37662 - DNA, 25 bp, Homo sapien
tagatttaggacagtggccttaaaa

SEQ ID NO: 37663 - DNA, 25 bp, Homo sapien
tctgcatttaattaatagctcgagt

SEQ ID NO: 37664 - DNA, 25 bp, Homo sapien
gctcgagtattaaaagcccactccc

SEQ ID NO: 37665 - DNA, 25 bp, Homo sapien
gcccactcccttcaagaaaagcttt

SEQ ID NO: 37666 - DNA, 25 bp, Homo sapien
ccccagtcatgaaagcccttgtttc

SEQ ID NO: 37667 - DNA, 25 bp, Homo sapien
ctttaatctctgaacctagtatcat

SEQ ID NO: 37668 - DNA, 25 bp, Homo sapien
atcataagaatttcctcttttgata

SEQ ID NO: 37669 - DNA, 25 bp, Homo sapien
acatctgtactttcatattctgctc

SEQ ID NO: 37670 - DNA, 25 bp, Homo sapien
gaaggggttttatctgcatttgaca

SEQ ID NO: 37671 - DNA, 25 bp, Homo sapien
gcatttgacattgaaccttgaagta

SEQ ID NO: 37672 - DNA, 25 bp, Homo sapien
agtggaagtttcttcggatcttgtt

SEQ ID NO: 37673 - DNA, 25 bp, Homo sapien
ctaccaaattgtgccttcctaaata

SEQ ID NO: 37674 - DNA, 25 bp, Homo sapien
ctatcccaaagctggtcactgacta

SEQ ID NO: 37675 - DNA, 25 bp, Homo sapien
aaagctggtcactgactataagaat

SEQ ID NO: 37676 - DNA, 25 bp, Homo sapien
aaatcagtgaggcatttgacctaat

SEQ ID NO: 37677 - DNA, 25 bp, Homo sapien
gaggcatttgacctaatgaaccaag

SEQ ID NO: 37678 - DNA, 25 bp, Homo sapien
acctgcctggttaatttattacctg

SEQ ID NO: 37679 - DNA, 25 bp, Homo sapien
ggttaatttattacctgatttgatg

SEQ ID NO: 37680 - DNA, 25 bp, Homo sapien
ctttcattggagtagctgctggtag

SEQ ID NO: 37681 - DNA, 25 bp, Homo sapien
agctgctggtagcaaaggattgact

SEQ ID NO: 37682 - DNA, 25 bp, Homo sapien
gaggagctaataatcggccgtacta

SEQ ID NO: 37683 - DNA, 25 bp, Homo sapien
atcggccgtactataaatggaacat

SEQ ID NO: 37684 - DNA, 25 bp, Homo sapien
gtgtagattctatcccaaagctggt

SEQ ID NO: 37685 - DNA, 25 bp, Homo sapien
atgaatgacagtgagatgcctgcac

SEQ ID NO: 37686 - DNA, 25 bp, Homo sapien
tgcctgcacatctaaccttgtcaga

SEQ ID NO: 37687 - DNA, 25 bp, Homo sapien
gcacatctaaccttgtcagatataa

SEQ ID NO: 37688 - DNA, 25 bp, Homo sapien
gatataatcaaagttctgttcagtg

SEQ ID NO: 37689 - DNA, 25 bp, Homo sapien
gttcagtgacaaattaatgccctgt

SEQ ID NO: 37690 - DNA, 25 bp, Homo sapien
attaatgccctgtaatgtggtaagg

SEQ ID NO: 37691 - DNA, 25 bp, Homo sapien
ttgtggatacagtcttcatcttctt

SEQ ID NO: 37692 - DNA, 25 bp, Homo sapien
caccaggcctgtcacacagatgaat

SEQ ID NO: 37693 - DNA, 25 bp, Homo sapien
gaatgaataagtatttccgtcaaga

SEQ ID NO: 37694 - DNA, 25 bp, Homo sapien
ccaagtaaagaacagccaagtggcc

SEQ ID NO: 37695 - DNA, 25 bp, Homo sapien
ggaggcggagtttgtggtgagttga

SEQ ID NO: 37696 - DNA, 25 bp, Homo sapien
tttggtcccggaccatgtcaacatg

SEQ ID NO: 37697 - DNA, 25 bp, Homo sapien
ccatgtcaacatgagcgagttggtc

SEQ ID NO: 37698 - DNA, 25 bp, Homo sapien
gcgagttggtcaagatcatccggcg

SEQ ID NO: 37699 - DNA, 25 bp, Homo sapien
ttcttcctgctggtgaaccagcaca

SEQ ID NO: 37700 - DNA, 25 bp, Homo sapien
gctggtgaaccagcacagcatggtg

SEQ ID NO: 37701 - DNA, 25 bp, Homo sapien
ccatcgcggacatctacgagcagga

SEQ ID NO: 37702 - DNA, 25 bp, Homo sapien
gaaagacgaggacggcttcctctat

SEQ ID NO: 37703 - DNA, 25 bp, Homo sapien
cggcttcctctatatggtctacgcc

SEQ ID NO: 37704 - DNA, 25 bp, Homo sapien
gagccagcagtaggggggctcggcc

SEQ ID NO: 37705 - DNA, 25 bp, Homo sapien
ccagagagctcctggttcctgaact

SEQ ID NO: 37706 - DNA, 25 bp, Homo sapien
gctcctggttcctgaactgagctgc

SEQ ID NO: 37707 - DNA, 25 bp, Homo sapien
gtgtgcatacacttgtgtgtgcgtt

SEQ ID NO: 37708 - DNA, 25 bp, Homo sapien
gcatacacttgtgtgtgcgttttta

SEQ ID NO: 37709 - DNA, 25 bp, Homo sapien
gtgtgtgcgtttttaagaggctaat

SEQ ID NO: 37710 - DNA, 25 bp, Homo sapien
ggctaatattttggtttgactattt

SEQ ID NO: 37711 - DNA, 25 bp, Homo sapien
gactatttggtcttaactgttttca

SEQ ID NO: 37712 - DNA, 25 bp, Homo sapien
tgttttcagtttacagaggttaatt

SEQ ID NO: 37713 - DNA, 25 bp, Homo sapien
agagatgttccttaaagtcataaag

SEQ ID NO: 37714 - DNA, 25 bp, Homo sapien
gtcataaagatccgtttttattgtt

SEQ ID NO: 37715 - DNA, 25 bp, Homo sapien
ggtggctggtggcatggtagtaccc

SEQ ID NO: 37716 - DNA, 25 bp, Homo sapien
gctggtggcatggtagtacccttgg

SEQ ID NO: 37717 - DNA, 25 bp, Homo sapien
ggcatggtagtacccttgggaggct

SEQ ID NO: 37718 - DNA, 25 bp, Homo sapien
acggcctcgtgctgtgaaggtatat

SEQ ID NO: 37719 - DNA, 25 bp, Homo sapien
atcaatttggaatctcagtacttat

SEQ ID NO: 37720 - DNA, 25 bp, Homo sapien
aggagttcctgctgtgggagtcatg

SEQ ID NO: 37721 - DNA, 25 bp, Homo sapien
gagcgattcgctttatatggtgcaa

SEQ ID NO: 37722 - DNA, 25 bp, Homo sapien
tacaatgctctagatgaatacccag

SEQ ID NO: 37723 - DNA, 25 bp, Homo sapien
gaatacccagcagaagactttactg

SEQ ID NO: 37724 - DNA, 25 bp, Homo sapien
agggagtttatttgatcaccacgtc

SEQ ID NO: 37725 - DNA, 25 bp, Homo sapien
tcaccacgtccagagggcggtatgc

SEQ ID NO: 37726 - DNA, 25 bp, Homo sapien
gtccagagggcggtatgcgacacac

SEQ ID NO: 37727 - DNA, 25 bp, Homo sapien
tgcgacacacgggccaaatatcgag

SEQ ID NO: 37728 - DNA, 25 bp, Homo sapien
tatcgagagggacgacggcctcgtg

SEQ ID NO: 37729 - DNA, 25 bp, Homo sapien
gggttgttaactgtgagcctgagga

SEQ ID NO: 37730 - DNA, 25 bp, Homo sapien
tagtgtacttaaacaacttgtctgt

SEQ ID NO: 37731 - DNA, 25 bp, Homo sapien
tttcccttaggttagataatgctgc

SEQ ID NO: 37732 - DNA, 25 bp, Homo sapien
tagataatgctgctcatgattgtga

SEQ ID NO: 37733 - DNA, 25 bp, Homo sapien
tctgcatctgcctttctttagtgca

SEQ ID NO: 37734 - DNA, 25 bp, Homo sapien
catctgcctttctttagtgcagggt

SEQ ID NO: 37735 - DNA, 25 bp, Homo sapien
tgcagggtagtgtcagtcccactgt

SEQ ID NO: 37736 - DNA, 25 bp, Homo sapien
ccaaagtttgcattctgcgttaacc

SEQ ID NO: 37737 - DNA, 25 bp, Homo sapien
tgcattctgcgttaaccaagtcaca

SEQ ID NO: 37738 - DNA, 25 bp, Homo sapien
ttctgcgttaaccaagtcacaatta

SEQ ID NO: 37739 - DNA, 25 bp, Homo sapien
gaggttttactataggcacaaatgc

SEQ ID NO: 37740 - DNA, 25 bp, Homo sapien
tgtctgccggagaagcagtaatgtt

SEQ ID NO: 37741 - DNA, 25 bp, Homo sapien
gtaatgtttctcagaggctcccaag

SEQ ID NO: 37742 - DNA, 25 bp, Homo sapien
gactttggaagactccaggttctac

SEQ ID NO: 37743 - DNA, 25 bp, Homo sapien
gaatcagctactggagcagcttctc

SEQ ID NO: 37744 - DNA, 25 bp, Homo sapien
tcagctactggagcagcttctcctg

SEQ ID NO: 37745 - DNA, 25 bp, Homo sapien
aaaggccagaaggctgctaagatca

SEQ ID NO: 37746 - DNA, 25 bp, Homo sapien
gctaagatcagcgaggaggctctgc

SEQ ID NO: 37747 - DNA, 25 bp, Homo sapien
gatcagcgaggaggctctgccaaca

SEQ ID NO: 37748 - DNA, 25 bp, Homo sapien
cgaggaggctctgccaacaggaagg

SEQ ID NO: 37749 - DNA, 25 bp, Homo sapien
ggaggctctgccaacaggaaggaaa

SEQ ID NO: 37750 - DNA, 25 bp, Homo sapien
gaaagttctgagcaaaagaggggta

SEQ ID NO: 37751 - DNA, 25 bp, Homo sapien
tttacctgttggaagggcagcaagc

SEQ ID NO: 37752 - DNA, 25 bp, Homo sapien
gcaagcaaaagttttaccagagttt

SEQ ID NO: 37753 - DNA, 25 bp, Homo sapien
ccttgagtaattttgacatgcagag

SEQ ID NO: 37754 - DNA, 25 bp, Homo sapien
tttgacatgcagagttattcacaac

SEQ ID NO: 37755 - DNA, 25 bp, Homo sapien
gcagagttattcacaactttttgca

SEQ ID NO: 37756 - DNA, 25 bp, Homo sapien
tcagagccagtgaagttgccttctc

SEQ ID NO: 37757 - DNA, 25 bp, Homo sapien
tccaacatgaccacattttcctctg

SEQ ID NO: 37758 - DNA, 25 bp, Homo sapien
accacattttcctctgagcagacaa

SEQ ID NO: 37759 - DNA, 25 bp, Homo sapien
gtttgtgggcttgcttggaggttga

SEQ ID NO: 37760 - DNA, 25 bp, Homo sapien
gtgggcttgcttggaggttgaaaga

SEQ ID NO: 37761 - DNA, 25 bp, Homo sapien
aatgagagttgagccaggtgccctg

SEQ ID NO: 37762 - DNA, 25 bp, Homo sapien
agcaagacactttcaacctgatccc

SEQ ID NO: 37763 - DNA, 25 bp, Homo sapien
ctttcaacctgatcccatggcaaag

SEQ ID NO: 37764 - DNA, 25 bp, Homo sapien
catggcaaaggttactggggtagat

SEQ ID NO: 37765 - DNA, 25 bp, Homo sapien
ggggtagatgagtccttggctggaa

SEQ ID NO: 37766 - DNA, 25 bp, Homo sapien
aagtgccctaaggctccatgatggt

SEQ ID NO: 37767 - DNA, 25 bp, Homo sapien
gtggcctggtaggaaaagccctgaa

SEQ ID NO: 37768 - DNA, 25 bp, Homo sapien
gaaaagccctgaacttggagccaaa

SEQ ID NO: 37769 - DNA, 25 bp, Homo sapien
tctcctgcacaggaggcttcagtct

SEQ ID NO: 37770 - DNA, 25 bp, Homo sapien
gtctctgcctctgtaaaatggtgcc

SEQ ID NO: 37771 - DNA, 25 bp, Homo sapien
gccacatgcacagggttgagatggt

SEQ ID NO: 37772 - DNA, 25 bp, Homo sapien
cttgaggctgggtaaggaggctcat

SEQ ID NO: 37773 - DNA, 25 bp, Homo sapien
ttgggtgtgcggacaagcagtgtgg

SEQ ID NO: 37774 - DNA, 25 bp, Homo sapien
tgcggacaagcagtgtggactcccc

SEQ ID NO: 37775 - DNA, 25 bp, Homo sapien
agaggatgtgggtgctggagaggat

SEQ ID NO: 37776 - DNA, 25 bp, Homo sapien
agctgggttgggaagccctctatga

SEQ ID NO: 37777 - DNA, 25 bp, Homo sapien
gggttgggaagccctctatgagcag

SEQ ID NO: 37778 - DNA, 25 bp, Homo sapien
atgagcagagggcggagtcacacag

SEQ ID NO: 37779 - DNA, 25 bp, Homo sapien
gagtcacacagcggcttcaaggagc

SEQ ID NO: 37780 - DNA, 25 bp, Homo sapien
caatgagaacaagagcgcaatgcag

SEQ ID NO: 37781 - DNA, 25 bp, Homo sapien
aagagcgcaatgcagttggaggaac

SEQ ID NO: 37782 - DNA, 25 bp, Homo sapien
gcagcaagaccagtacctgtgtacc

SEQ ID NO: 37783 - DNA, 25 bp, Homo sapien
caagaccagtacctgtgtaccgctc

SEQ ID NO: 37784 - DNA, 25 bp, Homo sapien
ctccagcacgagccttggcaggatt

SEQ ID NO: 37785 - DNA, 25 bp, Homo sapien
acgagccttggcaggattctcttag

SEQ ID NO: 37786 - DNA, 25 bp, Homo sapien
tcctcctaggagatcaaagcccgtt

SEQ ID NO: 37787 - DNA, 25 bp, Homo sapien
taggagatcaaagcccgttcctgca

SEQ ID NO: 37788 - DNA, 25 bp, Homo sapien
gtccttcagggttgacacctgcgtc

SEQ ID NO: 37789 - DNA, 25 bp, Homo sapien
cctttgctgtggttgcaggagggtc

SEQ ID NO: 37790 - DNA, 25 bp, Homo sapien
gcaggagggtcttgtgcatgagcgg

SEQ ID NO: 37791 - DNA, 25 bp, Homo sapien
cttgtgcatgagcgggcgcaggtgc

SEQ ID NO: 37792 - DNA, 25 bp, Homo sapien
tgagcgggcgcaggtgcatgtgctc

SEQ ID NO: 37793 - DNA, 25 bp, Homo sapien
tcagctgtcttgtgtcacccaaagt

SEQ ID NO: 37794 - DNA, 25 bp, Homo sapien
tgtcacccaaagtcagctagaaatg

SEQ ID NO: 37795 - DNA, 25 bp, Homo sapien
gactcaactcagctaattatcagct

SEQ ID NO: 37796 - DNA, 25 bp, Homo sapien
atcagctgatttggcagatcactgt

SEQ ID NO: 37797 - DNA, 25 bp, Homo sapien
ggcagatcactgtaggaatcactaa

SEQ ID NO: 37798 - DNA, 25 bp, Homo sapien
taaaataactccttatgcaacttta

SEQ ID NO: 37799 - DNA, 25 bp, Homo sapien
atagcttcataaatttcctattcca

SEQ ID NO: 37800 - DNA, 25 bp, Homo sapien
tttcctattccatttactttcatca

SEQ ID NO: 37801 - DNA, 25 bp, Homo sapien
attccatttactttcatcatacttg

SEQ ID NO: 37802 - DNA, 25 bp, Homo sapien
tcagatcactgaaaaacctatgcaa

SEQ ID NO: 37803 - DNA, 25 bp, Homo sapien
taagtgctattttttggtgggtaca

SEQ ID NO: 37804 - DNA, 25 bp, Homo sapien
cactttgtttgcatatcatatttta

SEQ ID NO: 37805 - DNA, 25 bp, Homo sapien
gagcaatggctttatctgaaacatg

SEQ ID NO: 37806 - DNA, 25 bp, Homo sapien
tcttcactgtacccttggagcatgt

SEQ ID NO: 37807 - DNA, 25 bp, Homo sapien
tagggaaggccgaacctgttcacct

SEQ ID NO: 37808 - DNA, 25 bp, Homo sapien
gaacctgttcacctgggagatgaca

SEQ ID NO: 37809 - DNA, 25 bp, Homo sapien
gagatgacacacatcacttctactc

SEQ ID NO: 37810 - DNA, 25 bp, Homo sapien
tcacttctactcacaaatccttgga

SEQ ID NO: 37811 - DNA, 25 bp, Homo sapien
gagagaaatgatcccatggctccag

SEQ ID NO: 37812 - DNA, 25 bp, Homo sapien
cccatggctccagtcacttgaaagg

SEQ ID NO: 37813 - DNA, 25 bp, Homo sapien
gcctgtctccgcaacagttacaagc

SEQ ID NO: 37814 - DNA, 25 bp, Homo sapien
cctcttagcctatccatcttaagcc

SEQ ID NO: 37815 - DNA, 25 bp, Homo sapien
tatccatcttaagccccaagctgag

SEQ ID NO: 37816 - DNA, 25 bp, Homo sapien
gccccaagctgagtgtggttctggt

SEQ ID NO: 37817 - DNA, 25 bp, Homo sapien
accagcagtcccggtggaggagaga

SEQ ID NO: 37818 - DNA, 25 bp, Homo sapien
caacaggggaagatggttctgggct

SEQ ID NO: 37819 - DNA, 25 bp, Homo sapien
ggagatctgcagggaaggtatggcc

SEQ ID NO: 37820 - DNA, 25 bp, Homo sapien
ggaaagtgggcaacagagctaagag

SEQ ID NO: 37821 - DNA, 25 bp, Homo sapien
gaaagagagcaattctggggtggat

SEQ ID NO: 37822 - DNA, 25 bp, Homo sapien
aaatggcagatcagtcctgaaggct

SEQ ID NO: 37823 - DNA, 25 bp, Homo sapien
gagtgtggagtggagcagtcattcc

SEQ ID NO: 37824 - DNA, 25 bp, Homo sapien
gaacaaatagcccatcttacacact

SEQ ID NO: 37825 - DNA, 25 bp, Homo sapien
catcttacacactgctgctggtagg

SEQ ID NO: 37826 - DNA, 25 bp, Homo sapien
cacactgctgctggtaggatggaaa

SEQ ID NO: 37827 - DNA, 25 bp, Homo sapien
tgagaggttagctggagactgacca

SEQ ID NO: 37828 - DNA, 25 bp, Homo sapien
cagtccagtctttattagcattggg

SEQ ID NO: 37829 - DNA, 25 bp, Homo sapien
agtccagtctttattagcattgggt

SEQ ID NO: 37830 - DNA, 25 bp, Homo sapien
gtccagtctttattagcattgggtc

SEQ ID NO: 37831 - DNA, 25 bp, Homo sapien
tccagtctttattagcattgggtcc

SEQ ID NO: 37832 - DNA, 25 bp, Homo sapien
cagtctttattagcattgggtccct

SEQ ID NO: 37833 - DNA, 25 bp, Homo sapien
agtctttattagcattgggtccctg

SEQ ID NO: 37834 - DNA, 25 bp, Homo sapien
gtctttattagcattgggtccctgg

SEQ ID NO: 37835 - DNA, 25 bp, Homo sapien
tctttattagcattgggtccctggt

SEQ ID NO: 37836 - DNA, 25 bp, Homo sapien
ctttattagcattgggtccctggtc

SEQ ID NO: 37837 - DNA, 25 bp, Homo sapien
tttattagcattgggtccctggtcc

SEQ ID NO: 37838 - DNA, 25 bp, Homo sapien
ttattagcattgggtccctggtccc

SEQ ID NO: 37839 - DNA, 25 bp, Homo sapien
agccgggataggggactgaccttgt

SEQ ID NO: 37840 - DNA, 25 bp, Homo sapien
tgaccttgtacaggcagcatggaga

SEQ ID NO: 37841 - DNA, 25 bp, Homo sapien
gagtgtcctgcccaagtgatggcac

SEQ ID NO: 37842 - DNA, 25 bp, Homo sapien
ggcactggggagcagtcactcaggt

SEQ ID NO: 37843 - DNA, 25 bp, Homo sapien
cactcaggtttatttccaccagggc

SEQ ID NO: 37844 - DNA, 25 bp, Homo sapien
tgaggcaacctaaaattccatcaag

SEQ ID NO: 37845 - DNA, 25 bp, Homo sapien
caaggtgcttggtcttagcggtgtg

SEQ ID NO: 37846 - DNA, 25 bp, Homo sapien
gtcttagcggtgtgggacccacgtt

SEQ ID NO: 37847 - DNA, 25 bp, Homo sapien
ggacccacgttaaggctcttggtgg

SEQ ID NO: 37848 - DNA, 25 bp, Homo sapien
ggtgggaggtgttttcagcatgaga

SEQ ID NO: 37849 - DNA, 25 bp, Homo sapien
gggttcaggctgtgaatcagagtct

SEQ ID NO: 37850 - DNA, 25 bp, Homo sapien
gggctcgttcaaacaaattatgacc

SEQ ID NO: 37851 - DNA, 25 bp, Homo sapien
ggaggttgcaatcagccgagatggt

SEQ ID NO: 37852 - DNA, 25 bp, Homo sapien
gtactaagcaattttagtctctgca

SEQ ID NO: 37853 - DNA, 25 bp, Homo sapien
acaacttttgttaattctcttatga

SEQ ID NO: 37854 - DNA, 25 bp, Homo sapien
attcatacctctttcctgtttgaaa

SEQ ID NO: 37855 - DNA, 25 bp, Homo sapien
atacctctttcctgtttgaaattat

SEQ ID NO: 37856 - DNA, 25 bp, Homo sapien
attattttactgtgtttcatcaatc

SEQ ID NO: 37857 - DNA, 25 bp, Homo sapien
gtgtttcatcaatctaatgtttatt

SEQ ID NO: 37858 - DNA, 25 bp, Homo sapien
taatgtttatttttattacaccagt

SEQ ID NO: 37859 - DNA, 25 bp, Homo sapien
tttattacaccagtaatttcctcat

SEQ ID NO: 37860 - DNA, 25 bp, Homo sapien
ttataaatctacatgtacctagaaa

SEQ ID NO: 37861 - DNA, 25 bp, Homo sapien
gatctggttcccccaaaatactttg

SEQ ID NO: 37862 - DNA, 25 bp, Homo sapien
gtgtttatgtatactgttagaatgt

SEQ ID NO: 37863 - DNA, 25 bp, Homo sapien
tcgtcatccctaatctgatactgga

SEQ ID NO: 37864 - DNA, 25 bp, Homo sapien
gatactggagtctaaatacatgctc

SEQ ID NO: 37865 - DNA, 25 bp, Homo sapien
tacatgctccataatcatgcaaact

SEQ ID NO: 37866 - DNA, 25 bp, Homo sapien
tgagggtagactgggtgcggtagct

SEQ ID NO: 37867 - DNA, 25 bp, Homo sapien
tgcggtagctcatacctgtaatccc

SEQ ID NO: 37868 - DNA, 25 bp, Homo sapien
attagccgggcgtgggggcatacac

SEQ ID NO: 37869 - DNA, 25 bp, Homo sapien
cgtgggggcatacacctgtaattcc

SEQ ID NO: 37870 - DNA, 25 bp, Homo sapien
aattccagctactcataggatattg

SEQ ID NO: 37871 - DNA, 25 bp, Homo sapien
gttgagatcgtgccattgtgctcca

SEQ ID NO: 37872 - DNA, 25 bp, Homo sapien
cctcatgggtccaagcctattttct

SEQ ID NO: 37873 - DNA, 25 bp, Homo sapien
cagtggctcattacagaccacagta

SEQ ID NO: 37874 - DNA, 25 bp, Homo sapien
tcattacagaccacagtatctcccc

SEQ ID NO: 37875 - DNA, 25 bp, Homo sapien
tagtgtccagaatggtgcccaagtc

SEQ ID NO: 37876 - DNA, 25 bp, Homo sapien
gtgtccagaatggtgcccaagtcac

SEQ ID NO: 37877 - DNA, 25 bp, Homo sapien
gataggtaggaagtggccaaaatga

SEQ ID NO: 37878 - DNA, 25 bp, Homo sapien
gaggtcaaagctaagagtccaaggc

SEQ ID NO: 37879 - DNA, 25 bp, Homo sapien
aagagtccaaggcaaatggccacaa

SEQ ID NO: 37880 - DNA, 25 bp, Homo sapien
gtccaaggcaaatggccacaaggca

SEQ ID NO: 37881 - DNA, 25 bp, Homo sapien
cagaaagagccaaaccagagccccc

SEQ ID NO: 37882 - DNA, 25 bp, Homo sapien
ccctaaaatggggagaccaggatgg

SEQ ID NO: 37883 - DNA, 25 bp, Homo sapien
gaggtttggcggatcagacagcgtg

SEQ ID NO: 37884 - DNA, 25 bp, Homo sapien
ttggcggatcagacagcgtgaggct

SEQ ID NO: 37885 - DNA, 25 bp, Homo sapien
gatcagacagcgtgaggctggggcg

SEQ ID NO: 37886 - DNA, 25 bp, Homo sapien
gggcctcggtcggagggaaaagctg

SEQ ID NO: 37887 - DNA, 25 bp, Homo sapien
cggtcggagggaaaagctggctgcg

SEQ ID NO: 37888 - DNA, 25 bp, Homo sapien
tcggagggaaaagctggctgcgcgc

SEQ ID NO: 37889 - DNA, 25 bp, Homo sapien
gttcaacaggaacggtacgaattct

SEQ ID NO: 37890 - DNA, 25 bp, Homo sapien
gaacggtacgaattctttccgcagg

SEQ ID NO: 37891 - DNA, 25 bp, Homo sapien
gagcctacgggagggaactcctcca

SEQ ID NO: 37892 - DNA, 25 bp, Homo sapien
ggagggaactcctccaggttgctga

SEQ ID NO: 37893 - DNA, 25 bp, Homo sapien
caggttgctgaggtttggcggatca

SEQ ID NO: 37894 - DNA, 25 bp, Homo sapien
gatgtgggcaattctcaatgttacc

SEQ ID NO: 37895 - DNA, 25 bp, Homo sapien
ctcaatgttaccaaatcctagatat

SEQ ID NO: 37896 - DNA, 25 bp, Homo sapien
gagaaatttagtccagccctttcat

SEQ ID NO: 37897 - DNA, 25 bp, Homo sapien
aaggacttgtccaaagttgcatagt

SEQ ID NO: 37898 - DNA, 25 bp, Homo sapien
gggactgagcagtgactaaaagcct

SEQ ID NO: 37899 - DNA, 25 bp, Homo sapien
gactaaaagcctagtccctgtactc

SEQ ID NO: 37900 - DNA, 25 bp, Homo sapien
gtccctgtactccagaagcaggaca

SEQ ID NO: 37901 - DNA, 25 bp, Homo sapien
aagcaggacagtttccacagcagca

SEQ ID NO: 37902 - DNA, 25 bp, Homo sapien
aaggctaaacatctgtggttgggca

SEQ ID NO: 37903 - DNA, 25 bp, Homo sapien
agttggtgagtttatagcctggata

SEQ ID NO: 37904 - DNA, 25 bp, Homo sapien
aagtcaggtctaagccaggtgtgga

SEQ ID NO: 37905 - DNA, 25 bp, Homo sapien
tgccgttttgcccttgggagtagga

SEQ ID NO: 37906 - DNA, 25 bp, Homo sapien
ccgttttgcccttgggagtaggatg

SEQ ID NO: 37907 - DNA, 25 bp, Homo sapien
tttgcccttgggagtaggatgtggt

SEQ ID NO: 37908 - DNA, 25 bp, Homo sapien
gcccttgggagtaggatgtggtgaa

SEQ ID NO: 37909 - DNA, 25 bp, Homo sapien
ggtgaaaggatggggcttctccctt

SEQ ID NO: 37910 - DNA, 25 bp, Homo sapien
tgaaaggatggggcttctcccttac

SEQ ID NO: 37911 - DNA, 25 bp, Homo sapien
tcccttacggggctcacaatggcca

SEQ ID NO: 37912 - DNA, 25 bp, Homo sapien
cttacggggctcacaatggccagag

SEQ ID NO: 37913 - DNA, 25 bp, Homo sapien
cacaatggccagagaagattccgtg

SEQ ID NO: 37914 - DNA, 25 bp, Homo sapien
gaagattccgtgaagtgtctgcgct

SEQ ID NO: 37915 - DNA, 25 bp, Homo sapien
aagattccgtgaagtgtctgcgctg

SEQ ID NO: 37916 - DNA, 25 bp, Homo sapien
gtggccagaagacaggataggagag

SEQ ID NO: 37917 - DNA, 25 bp, Homo sapien
ggataggagagggacaagatttttc

SEQ ID NO: 37918 - DNA, 25 bp, Homo sapien
aatggtggcctgttctgagagggag

SEQ ID NO: 37919 - DNA, 25 bp, Homo sapien
agaagacaggccggggacattcaca

SEQ ID NO: 37920 - DNA, 25 bp, Homo sapien
gcctgtgcttcctagatgcggaggc

SEQ ID NO: 37921 - DNA, 25 bp, Homo sapien
gtgcttcctagatgcggaggcaggc

SEQ ID NO: 37922 - DNA, 25 bp, Homo sapien
tcctagatgcggaggcaggcagggc

SEQ ID NO: 37923 - DNA, 25 bp, Homo sapien
gccctaccctaaggcatgtttccac

SEQ ID NO: 37924 - DNA, 25 bp, Homo sapien
taaggcatgtttccacaatttctct

SEQ ID NO: 37925 - DNA, 25 bp, Homo sapien
aaacttttcttttctgatagtctgt

SEQ ID NO: 37926 - DNA, 25 bp, Homo sapien
atggtcagggttggtggttcacgcc

SEQ ID NO: 37927 - DNA, 25 bp, Homo sapien
gggtttttgcctatttacacacttg

SEQ ID NO: 37928 - DNA, 25 bp, Homo sapien
tacacacttgtgcatgcttacttgt

SEQ ID NO: 37929 - DNA, 25 bp, Homo sapien
ttgtgtaagctgagcctatgacatc

SEQ ID NO: 37930 - DNA, 25 bp, Homo sapien
tcacgctgccagtgggtagctcaag

SEQ ID NO: 37931 - DNA, 25 bp, Homo sapien
tgccagtgggtagctcaaggttgaa

SEQ ID NO: 37932 - DNA, 25 bp, Homo sapien
caaggttgaaaagtctctcccgatt

SEQ ID NO: 37933 - DNA, 25 bp, Homo sapien
tctctcccgattctgaagtcaggct

SEQ ID NO: 37934 - DNA, 25 bp, Homo sapien
atactcaaattgccattttgacttg

SEQ ID NO: 37935 - DNA, 25 bp, Homo sapien
cagtaagataaagtagccgtgccat

SEQ ID NO: 37936 - DNA, 25 bp, Homo sapien
gtagccgtgccatcaaaatagggat

SEQ ID NO: 37937 - DNA, 25 bp, Homo sapien
gaacaaactctgtcctaaggctata

SEQ ID NO: 37938 - DNA, 25 bp, Homo sapien
gtgtgtcaatattctctgcttcaca

SEQ ID NO: 37939 - DNA, 25 bp, Homo sapien
gtcaatattctctgcttcacaaaca

SEQ ID NO: 37940 - DNA, 25 bp, Homo sapien
attctctgcttcacaaacaaattgg

SEQ ID NO: 37941 - DNA, 25 bp, Homo sapien
gaaaccagtggtaaactttagatca

SEQ ID NO: 37942 - DNA, 25 bp, Homo sapien
agaactggccatgagcagtggctca

SEQ ID NO: 37943 - DNA, 25 bp, Homo sapien
gagcagtggctcaggcctgtaatcc

SEQ ID NO: 37944 - DNA, 25 bp, Homo sapien
aattagacaggcatgatggcagatg

SEQ ID NO: 37945 - DNA, 25 bp, Homo sapien
catgatggcagatgcctgtaatccc

SEQ ID NO: 37946 - DNA, 25 bp, Homo sapien
gaacctagaaacttagaggtcaact

SEQ ID NO: 37947 - DNA, 25 bp, Homo sapien
gaggtcaactaaggagacaggcatt

SEQ ID NO: 37948 - DNA, 25 bp, Homo sapien
actaaggagacaggcatttttataa

SEQ ID NO: 37949 - DNA, 25 bp, Homo sapien
cacacacacacacacgaaataataa

SEQ ID NO: 37950 - DNA, 25 bp, Homo sapien
aagagtaggtaatgtcggtgataga

SEQ ID NO: 37951 - DNA, 25 bp, Homo sapien
gaaaggaaaagatctccagatgtgg

SEQ ID NO: 37952 - DNA, 25 bp, Homo sapien
gaaagaagacattaggctgggcgca

SEQ ID NO: 37953 - DNA, 25 bp, Homo sapien
aggcggaggagggcgcattgcttga

SEQ ID NO: 37954 - DNA, 25 bp, Homo sapien
ggaggagggcgcattgcttgagcct

SEQ ID NO: 37955 - DNA, 25 bp, Homo sapien
gagttcgagaccagcttaggcaaca

SEQ ID NO: 37956 - DNA, 25 bp, Homo sapien
ccagcttaggcaacacggtgaaacc

SEQ ID NO: 37957 - DNA, 25 bp, Homo sapien
ttagacaggtgtggcacacgcttgt

SEQ ID NO: 37958 - DNA, 25 bp, Homo sapien
aggctgaagcaggaggattgaggaa

SEQ ID NO: 37959 - DNA, 25 bp, Homo sapien
gttgcaaagttagccgagatcacgc

SEQ ID NO: 37960 - DNA, 25 bp, Homo sapien
cacagcgcatcgctttggaagccgc

SEQ ID NO: 37961 - DNA, 25 bp, Homo sapien
tttcaaagccccattcgtatgcaca

SEQ ID NO: 37962 - DNA, 25 bp, Homo sapien
cccattcgtatgcacagagccttat

SEQ ID NO: 37963 - DNA, 25 bp, Homo sapien
cattcgtatgcacagagccttattc

SEQ ID NO: 37964 - DNA, 25 bp, Homo sapien
ttcgtatgcacagagccttattccc

SEQ ID NO: 37965 - DNA, 25 bp, Homo sapien
tcgtatgcacagagccttattccct

SEQ ID NO: 37966 - DNA, 25 bp, Homo sapien
ttatcttatgatttatttgtgtact

SEQ ID NO: 37967 - DNA, 25 bp, Homo sapien
gatttatttgtgtacttattttcag

SEQ ID NO: 37968 - DNA, 25 bp, Homo sapien
atttgtgtacttattttcagacgga

SEQ ID NO: 37969 - DNA, 25 bp, Homo sapien
gtacttattttcagacggagtctcg

SEQ ID NO: 37970 - DNA, 25 bp, Homo sapien
acttattttcagacggagtctcgct

SEQ ID NO: 37971 - DNA, 25 bp, Homo sapien
tatatgaccttgatcttttaccttt

SEQ ID NO: 37972 - DNA, 25 bp, Homo sapien
atgaccttgatcttttaccttttgt

SEQ ID NO: 37973 - DNA, 25 bp, Homo sapien
aaatggttaaatatcttccagatgt

SEQ ID NO: 37974 - DNA, 25 bp, Homo sapien
atatcttccagatgttgctgcctta

SEQ ID NO: 37975 - DNA, 25 bp, Homo sapien
cttccagatgttgctgccttatcga

SEQ ID NO: 37976 - DNA, 25 bp, Homo sapien
gatgttgctgccttatcgaaatgct

SEQ ID NO: 37977 - DNA, 25 bp, Homo sapien
tatcgaaatgcttctagaactgtct

SEQ ID NO: 37978 - DNA, 25 bp, Homo sapien
aatgcttctagaactgtctgtataa

SEQ ID NO: 37979 - DNA, 25 bp, Homo sapien
atttcagacagtactaaatacttat

SEQ ID NO: 37980 - DNA, 25 bp, Homo sapien
aactgcagtaggttaaaattctatt

SEQ ID NO: 37981 - DNA, 25 bp, Homo sapien
ttgtttataattggcctggtgtggt

SEQ ID NO: 37982 - DNA, 25 bp, Homo sapien
aggaggaagaactaggcaactgcta

SEQ ID NO: 37983 - DNA, 25 bp, Homo sapien
ggaagaactaggcaactgctaggct

SEQ ID NO: 37984 - DNA, 25 bp, Homo sapien
gtaagttgcaggtcctctgcagcgt

SEQ ID NO: 37985 - DNA, 25 bp, Homo sapien
ttgcaggtcctctgcagcgtgcaaa

SEQ ID NO: 37986 - DNA, 25 bp, Homo sapien
gtcctctgcagcgtgcaaaactgga

SEQ ID NO: 37987 - DNA, 25 bp, Homo sapien
gcagcgtgcaaaactggaaccccag

SEQ ID NO: 37988 - DNA, 25 bp, Homo sapien
tgcaaaactggaaccccaggtaaca

SEQ ID NO: 37989 - DNA, 25 bp, Homo sapien
ggtaacaaccaagaaaacctccatg

SEQ ID NO: 37990 - DNA, 25 bp, Homo sapien
aaccaagaaaacctccatgaagctg

SEQ ID NO: 37991 - DNA, 25 bp, Homo sapien
aaacctccatgaagctggaatacta

SEQ ID NO: 37992 - DNA, 25 bp, Homo sapien
acagaaaaccagacatggcatgttc

SEQ ID NO: 37993 - DNA, 25 bp, Homo sapien
aagggacaggaattcctcacttggg

SEQ ID NO: 37994 - DNA, 25 bp, Homo sapien
tcctcacttggggagcttggtagtt

SEQ ID NO: 37995 - DNA, 25 bp, Homo sapien
ggggagcttggtagttggagatgtg

SEQ ID NO: 37996 - DNA, 25 bp, Homo sapien
gctccaggctgaatacagccctgcg

SEQ ID NO: 37997 - DNA, 25 bp, Homo sapien
ttggttccctgactgggaagccagg

SEQ ID NO: 37998 - DNA, 25 bp, Homo sapien
attaacagatagtcgaggcagcccc

SEQ ID NO: 37999 - DNA, 25 bp, Homo sapien
gccccttaggcagcataggcctgcc

SEQ ID NO: 38000 - DNA, 25 bp, Homo sapien
tggccagcttgagggacgcagaacc

SEQ ID NO: 38001 - DNA, 25 bp, Homo sapien
ttgagggacgcagaacctgagagca

SEQ ID NO: 38002 - DNA, 25 bp, Homo sapien
acacctcgccagagtggcgtgtggc

SEQ ID NO: 38003 - DNA, 25 bp, Homo sapien
cacagaggatcaatgcagcggctga

SEQ ID NO: 38004 - DNA, 25 bp, Homo sapien
gaccacgcggaccaaagggtttctg

SEQ ID NO: 38005 - DNA, 25 bp, Homo sapien
gcggaccaaagggtttctgggactg

SEQ ID NO: 38006 - DNA, 25 bp, Homo sapien
gggtttctgggactgaacaaaatca

SEQ ID NO: 38007 - DNA, 25 bp, Homo sapien
gaacaaaatcaaggggctggctcgc

SEQ ID NO: 38008 - DNA, 25 bp, Homo sapien
aaaatcaaggggctggctcgccagg

SEQ ID NO: 38009 - DNA, 25 bp, Homo sapien
tcaaggggctggctcgccaggtgtg

SEQ ID NO: 38010 - DNA, 25 bp, Homo sapien
cagaggctgctccagttacagcacc

SEQ ID NO: 38011 - DNA, 25 bp, Homo sapien
ggccccaggttgtgagcccctgggg

SEQ ID NO: 38012 - DNA, 25 bp, Homo sapien
cccaggttgtgagcccctggggctg

SEQ ID NO: 38013 - DNA, 25 bp, Homo sapien
tgctgcagggggactgtgagatgga

SEQ ID NO: 38014 - DNA, 25 bp, Homo sapien
cagggggactgtgagatggaggacc

SEQ ID NO: 38015 - DNA, 25 bp, Homo sapien
tacagttctccaggtgtggaatgat

SEQ ID NO: 38016 - DNA, 25 bp, Homo sapien
gtcaatacgattgcttggccttttc

SEQ ID NO: 38017 - DNA, 25 bp, Homo sapien
cagcaacactccttgtaaggggcag

SEQ ID NO: 38018 - DNA, 25 bp, Homo sapien
taaggggcagagacagggtccacca

SEQ ID NO: 38019 - DNA, 25 bp, Homo sapien
tccaccaactccccaagatgaagaa

SEQ ID NO: 38020 - DNA, 25 bp, Homo sapien
agatgaagaagccccttcaggccag

SEQ ID NO: 38021 - DNA, 25 bp, Homo sapien
tcaggccagtcgtggtggctcatgc

SEQ ID NO: 38022 - DNA, 25 bp, Homo sapien
cagcactttgcaaggccgaggaggg

SEQ ID NO: 38023 - DNA, 25 bp, Homo sapien
ggaggctgcagcgagccaagatcgt

SEQ ID NO: 38024 - DNA, 25 bp, Homo sapien
aggagaccataggatttggacccca

SEQ ID NO: 38025 - DNA, 25 bp, Homo sapien
gaccccaaagggatgtgaactgatc

SEQ ID NO: 38026 - DNA, 25 bp, Homo sapien
tccttttccttcttgtaactgagaa

SEQ ID NO: 38027 - DNA, 25 bp, Homo sapien
gtaactgagaagaacttgccttgag

SEQ ID NO: 38028 - DNA, 25 bp, Homo sapien
tgagaagaacttgccttgagccacg

SEQ ID NO: 38029 - DNA, 25 bp, Homo sapien
aacttgccttgagccacgtcaagtc

SEQ ID NO: 38030 - DNA, 25 bp, Homo sapien
cctcggtgtggacttttctcttagg

SEQ ID NO: 38031 - DNA, 25 bp, Homo sapien
tcggtgtggacttttctcttaggaa

SEQ ID NO: 38032 - DNA, 25 bp, Homo sapien
ggtgtggacttttctcttaggaaag

SEQ ID NO: 38033 - DNA, 25 bp, Homo sapien
tcttaggaaagagccccaggtcggc

SEQ ID NO: 38034 - DNA, 25 bp, Homo sapien
gaggccaagagatcaagacaatcct

SEQ ID NO: 38035 - DNA, 25 bp, Homo sapien
aattagcgggcttggtggcagatgc

SEQ ID NO: 38036 - DNA, 25 bp, Homo sapien
ttagcgggcttggtggcagatgcct

SEQ ID NO: 38037 - DNA, 25 bp, Homo sapien
gtcttgaagtcttgggttggacatt

SEQ ID NO: 38038 - DNA, 25 bp, Homo sapien
cttgggttggacatttcaccatggc

SEQ ID NO: 38039 - DNA, 25 bp, Homo sapien
cagagctcggctggaaacagatgag

SEQ ID NO: 38040 - DNA, 25 bp, Homo sapien
gagacaacatgtgaggaggcagaca

SEQ ID NO: 38041 - DNA, 25 bp, Homo sapien
acaggagctggggatccaggctctg

SEQ ID NO: 38042 - DNA, 25 bp, Homo sapien
ccaggctctgagcacctgagaggtt

SEQ ID NO: 38043 - DNA, 25 bp, Homo sapien
tgagaggtttgggggaaggtattgg

SEQ ID NO: 38044 - DNA, 25 bp, Homo sapien
tggattggattgtgtcccccaacaa

SEQ ID NO: 38045 - DNA, 25 bp, Homo sapien
gtcctaacccctgtacaggtgaatg

SEQ ID NO: 38046 - DNA, 25 bp, Homo sapien
tttggaaatagcgtctttacagagg

SEQ ID NO: 38047 - DNA, 25 bp, Homo sapien
atgaggtcatttgggcaggtgcagt

SEQ ID NO: 38048 - DNA, 25 bp, Homo sapien
tctgtttctctttaaagttgaagaa

SEQ ID NO: 38049 - DNA, 25 bp, Homo sapien
ccagttttccagtagcatatatgta

SEQ ID NO: 38050 - DNA, 25 bp, Homo sapien
gatgcattgaggtcatactgtgaga

SEQ ID NO: 38051 - DNA, 25 bp, Homo sapien
gagaaaatgtctttagggtatccct

SEQ ID NO: 38052 - DNA, 25 bp, Homo sapien
tgtctttagggtatccctccaaaat

SEQ ID NO: 38053 - DNA, 25 bp, Homo sapien
gtatccctccaaaataggagcctta

SEQ ID NO: 38054 - DNA, 25 bp, Homo sapien
aaggaaggcatatctaaaaaccata

SEQ ID NO: 38055 - DNA, 25 bp, Homo sapien
aaccatagtggttgcttttaggtat

SEQ ID NO: 38056 - DNA, 25 bp, Homo sapien
tagtttcctatataacctatagtca

SEQ ID NO: 38057 - DNA, 25 bp, Homo sapien
ataacctatagtcagacttatctat

SEQ ID NO: 38058 - DNA, 25 bp, Homo sapien
aatgcatacatcggccgggtgcagt

SEQ ID NO: 38059 - DNA, 25 bp, Homo sapien
tctacagcggcattgtcactttcat

SEQ ID NO: 38060 - DNA, 25 bp, Homo sapien
gcggcattgtcactttcatcaaggt

SEQ ID NO: 38061 - DNA, 25 bp, Homo sapien
tcatcaaggtgaagtagccccagaa

SEQ ID NO: 38062 - DNA, 25 bp, Homo sapien
agtagccccagaagagcaggacgcc

SEQ ID NO: 38063 - DNA, 25 bp, Homo sapien
cagaagagcaggacgccctgtacct

SEQ ID NO: 38064 - DNA, 25 bp, Homo sapien
gacgccctgtacctgcagagaaggg

SEQ ID NO: 38065 - DNA, 25 bp, Homo sapien
ctgtacctcatctgtggctaccaga

SEQ ID NO: 38066 - DNA, 25 bp, Homo sapien
acctcatctgtggctaccagagagc

SEQ ID NO: 38067 - DNA, 25 bp, Homo sapien
catctgtggctaccagagagcagaa

SEQ ID NO: 38068 - DNA, 25 bp, Homo sapien
ccatcactccgcaggcgaatcagag

SEQ ID NO: 38069 - DNA, 25 bp, Homo sapien
tcactccgcaggcgaatcagagccc

SEQ ID NO: 38070 - DNA, 25 bp, Homo sapien
tgagtcttactgaggttggcacccc

SEQ ID NO: 38071 - DNA, 25 bp, Homo sapien
cttctgtgacacatcctgtcctaaa

SEQ ID NO: 38072 - DNA, 25 bp, Homo sapien
gacacatcctgtcctaaaggatttg

SEQ ID NO: 38073 - DNA, 25 bp, Homo sapien
ctcaggtgccttcttcaaggacctt

SEQ ID NO: 38074 - DNA, 25 bp, Homo sapien
gccttcttcaaggacctttgaaact

SEQ ID NO: 38075 - DNA, 25 bp, Homo sapien
gaaactgtgtatttgtaagacccca

SEQ ID NO: 38076 - DNA, 25 bp, Homo sapien
gaggacaggtacttaaacctcagtt

SEQ ID NO: 38077 - DNA, 25 bp, Homo sapien
gtacttaaacctcagttctctcttg

SEQ ID NO: 38078 - DNA, 25 bp, Homo sapien
acctcagttctctcttgaaacggct

SEQ ID NO: 38079 - DNA, 25 bp, Homo sapien
gttctctcttgaaacggctttcttc

SEQ ID NO: 38080 - DNA, 25 bp, Homo sapien
gaaacggctttcttcttatacaagg

SEQ ID NO: 38081 - DNA, 25 bp, Homo sapien
ggcagaaatcagtttgtgatgggct

SEQ ID NO: 38082 - DNA, 25 bp, Homo sapien
gtgatgggctattgatggtaaacta

SEQ ID NO: 38083 - DNA, 25 bp, Homo sapien
aatggaaagctctggcaaacccttg

SEQ ID NO: 38084 - DNA, 25 bp, Homo sapien
agctctggcaaacccttgaatgaga

SEQ ID NO: 38085 - DNA, 25 bp, Homo sapien
aaatgatctaacagagaatcctcta

SEQ ID NO: 38086 - DNA, 25 bp, Homo sapien
ggagaccaggtgggaatctttcgca

SEQ ID NO: 38087 - DNA, 25 bp, Homo sapien
tgggaatctttcgcaccaagtcagg

SEQ ID NO: 38088 - DNA, 25 bp, Homo sapien
gagttgtcacaaaagctgagggaag

SEQ ID NO: 38089 - DNA, 25 bp, Homo sapien
ggaggagaggcaaattcaagggact

SEQ ID NO: 38090 - DNA, 25 bp, Homo sapien
gaggttgactctttagaacttggcg

SEQ ID NO: 38091 - DNA, 25 bp, Homo sapien
gaacttggcgatgatgtgaaaatgt

SEQ ID NO: 38092 - DNA, 25 bp, Homo sapien
caatcactgaatccacgtttctgct

SEQ ID NO: 38093 - DNA, 25 bp, Homo sapien
ctgaatccacgtttctgctgtttaa

SEQ ID NO: 38094 - DNA, 25 bp, Homo sapien
tgaggaggagggccttcaaaagtta

SEQ ID NO: 38095 - DNA, 25 bp, Homo sapien
ggagagagtatgcccagagtttgga

SEQ ID NO: 38096 - DNA, 25 bp, Homo sapien
tgtcgggtgctgggatgagggcttc

SEQ ID NO: 38097 - DNA, 25 bp, Homo sapien
gagggcttcatgtttggaagacgca

SEQ ID NO: 38098 - DNA, 25 bp, Homo sapien
atgggtgtagtgagggtagtgtggc

SEQ ID NO: 38099 - DNA, 25 bp, Homo sapien
ggaaatggatccagatgggcttgat

SEQ ID NO: 38100 - DNA, 25 bp, Homo sapien
gggcttgatggggagcagatgggca

SEQ ID NO: 38101 - DNA, 25 bp, Homo sapien
cgatggcaggggtgcatcggctcac

SEQ ID NO: 38102 - DNA, 25 bp, Homo sapien
tcactggggctgcatctgaggtaaa

SEQ ID NO: 38103 - DNA, 25 bp, Homo sapien
atacatgtggttatcttttgccctg

SEQ ID NO: 38104 - DNA, 25 bp, Homo sapien
atcttttgccctgttgtgatggata

SEQ ID NO: 38105 - DNA, 25 bp, Homo sapien
aagtgggtttatgtcaccttctcac

SEQ ID NO: 38106 - DNA, 25 bp, Homo sapien
tcaccttctcaccttcttataagaa

SEQ ID NO: 38107 - DNA, 25 bp, Homo sapien
agaaagctctgagaatgggcatttt

SEQ ID NO: 38108 - DNA, 25 bp, Homo sapien
tgttgagatggagtctgccacccag

SEQ ID NO: 38109 - DNA, 25 bp, Homo sapien
gccacccaggctggagtccagtggc

SEQ ID NO: 38110 - DNA, 25 bp, Homo sapien
ggagtccagtggcgtgatcatacct

SEQ ID NO: 38111 - DNA, 25 bp, Homo sapien
tccagtggcgtgatcatacctcact

SEQ ID NO: 38112 - DNA, 25 bp, Homo sapien
caccacgcccagcaaatttttaaat

SEQ ID NO: 38113 - DNA, 25 bp, Homo sapien
agagtgggaggcagggtgcggtggc

SEQ ID NO: 38114 - DNA, 25 bp, Homo sapien
ccaagaatatacccagggactatag

SEQ ID NO: 38115 - DNA, 25 bp, Homo sapien
gaaactctgatgtagaagaaggacc

SEQ ID NO: 38116 - DNA, 25 bp, Homo sapien
ggattctggagtcaaaacttcttag

SEQ ID NO: 38117 - DNA, 25 bp, Homo sapien
aaacttcttagtttcacatcccagc

SEQ ID NO: 38118 - DNA, 25 bp, Homo sapien
ccttaatagatacaggaccttgagc

SEQ ID NO: 38119 - DNA, 25 bp, Homo sapien
gaatattttgaagcaagctgagtgc

SEQ ID NO: 38120 - DNA, 25 bp, Homo sapien
aaatttacgatatactccctttcat

SEQ ID NO: 38121 - DNA, 25 bp, Homo sapien
tttacgatatactccctttcatgta

SEQ ID NO: 38122 - DNA, 25 bp, Homo sapien
cgatatactccctttcatgtaaaaa

SEQ ID NO: 38123 - DNA, 25 bp, Homo sapien
acatgtgtatctgttcatttttgca

SEQ ID NO: 38124 - DNA, 25 bp, Homo sapien
gaaatataggaagtggccaggtgcg

SEQ ID NO: 38125 - DNA, 25 bp, Homo sapien
cccaagtacatggctgaagctgtcc

SEQ ID NO: 38126 - DNA, 25 bp, Homo sapien
tgggtccctacaaagcagggaaggg

SEQ ID NO: 38127 - DNA, 25 bp, Homo sapien
caagtacatggctgaagctgtccag

SEQ ID NO: 38128 - DNA, 25 bp, Homo sapien
atggctgaagctgtccagctgcaga

SEQ ID NO: 38129 - DNA, 25 bp, Homo sapien
aagctgtccagctgcagagagtggt

SEQ ID NO: 38130 - DNA, 25 bp, Homo sapien
gtccagctgcagagagtggtggggc

SEQ ID NO: 38131 - DNA, 25 bp, Homo sapien
cccacttcctgagccctgagtggaa

SEQ ID NO: 38132 - DNA, 25 bp, Homo sapien
tcctgagccctgagtggaagccttt

SEQ ID NO: 38133 - DNA, 25 bp, Homo sapien
tgcagagagtggtggggcctgactg

SEQ ID NO: 38134 - DNA, 25 bp, Homo sapien
agaccctcaatgcccattaaatact

SEQ ID NO: 38135 - DNA, 25 bp, Homo sapien
aatgcccattaaatactcttgcctg

SEQ ID NO: 38136 - DNA, 25 bp, Homo sapien
actccagcgtgggcaccaagagtga

SEQ ID NO: 38137 - DNA, 25 bp, Homo sapien
gcgtgggcaccaagagtgaaactcc

SEQ ID NO: 38138 - DNA, 25 bp, Homo sapien
agtgctgtattctgttatttttgct

SEQ ID NO: 38139 - DNA, 25 bp, Homo sapien
tattctgttatttttgcttcctacc

SEQ ID NO: 38140 - DNA, 25 bp, Homo sapien
tgcttcctaccctgagaagaacata

SEQ ID NO: 38141 - DNA, 25 bp, Homo sapien
taatacagctgttgtctttctgcct

SEQ ID NO: 38142 - DNA, 25 bp, Homo sapien
gtctttcgcccagactggagcacag

SEQ ID NO: 38143 - DNA, 25 bp, Homo sapien
atccactggggtcgccagttcgaga

SEQ ID NO: 38144 - DNA, 25 bp, Homo sapien
ccactggggtcgccagttcgagacc

SEQ ID NO: 38145 - DNA, 25 bp, Homo sapien
ccagcctgacccacatggagaaatg

SEQ ID NO: 38146 - DNA, 25 bp, Homo sapien
gaaatgccgtctctactaacaatac

SEQ ID NO: 38147 - DNA, 25 bp, Homo sapien
ggaaattattctgctgccaaaagta

SEQ ID NO: 38148 - DNA, 25 bp, Homo sapien
gattggcattttttttagactgtga

SEQ ID NO: 38149 - DNA, 25 bp, Homo sapien
gatctcttctctgtacttttaatga

SEQ ID NO: 38150 - DNA, 25 bp, Homo sapien
gaactttggccttatttttatactg

SEQ ID NO: 38151 - DNA, 25 bp, Homo sapien
actggaactgactcaaaacctctta

SEQ ID NO: 38152 - DNA, 25 bp, Homo sapien
gattctgtattttctttcacctagt

SEQ ID NO: 38153 - DNA, 25 bp, Homo sapien
gttaatctagttttggccattctgt

SEQ ID NO: 38154 - DNA, 25 bp, Homo sapien
gttttggccattctgtattttgtcc

SEQ ID NO: 38155 - DNA, 25 bp, Homo sapien
gtattttgtccagtttttctcataa

SEQ ID NO: 38156 - DNA, 25 bp, Homo sapien
ttatctcaatttcagcaacttccaa

SEQ ID NO: 38157 - DNA, 25 bp, Homo sapien
atgtgattatgggacctactttata

SEQ ID NO: 38158 - DNA, 25 bp, Homo sapien
actgaggtgaggccatcgcttgaac

SEQ ID NO: 38159 - DNA, 25 bp, Homo sapien
aggccatcgcttgaacctaggaggt

SEQ ID NO: 38160 - DNA, 25 bp, Homo sapien
ctaggaggttgaggttgcagtgagc

SEQ ID NO: 38161 - DNA, 25 bp, Homo sapien
gctgcactacagcctgggcaagagg

SEQ ID NO: 38162 - DNA, 25 bp, Homo sapien
ttatgatggctgagtctgtgtcaaa

SEQ ID NO: 38163 - DNA, 25 bp, Homo sapien
atggcagtagttttcctattactac

SEQ ID NO: 38164 - DNA, 25 bp, Homo sapien
gtgtttttgtaataccagtggagcc

SEQ ID NO: 38165 - DNA, 25 bp, Homo sapien
accagtggagccttttcttaaaatg

SEQ ID NO: 38166 - DNA, 25 bp, Homo sapien
gaaacggatcaaatggaatggctca

SEQ ID NO: 38167 - DNA, 25 bp, Homo sapien
gaggatcgtttgagcacaggagttc

SEQ ID NO: 38168 - DNA, 25 bp, Homo sapien
gttcaagatgaagcctgagcaacat

SEQ ID NO: 38169 - DNA, 25 bp, Homo sapien
ctgatgcaggaaacctatcgccagt

SEQ ID NO: 38170 - DNA, 25 bp, Homo sapien
tcgataagtccccaaggctgcatgt

SEQ ID NO: 38171 - DNA, 25 bp, Homo sapien
taagtccccaaggctgcatgtatta

SEQ ID NO: 38172 - DNA, 25 bp, Homo sapien
gtccccaaggctgcatgtattagca

SEQ ID NO: 38173 - DNA, 25 bp, Homo sapien
aagcacagcaggactctgagagaag

SEQ ID NO: 38174 - DNA, 25 bp, Homo sapien
tctctttgttgctgagaaggtagag

SEQ ID NO: 38175 - DNA, 25 bp, Homo sapien
cagtcctgtgcatccaggctgttag

SEQ ID NO: 38176 - DNA, 25 bp, Homo sapien
tgtgcatccaggctgttaggtgact

SEQ ID NO: 38177 - DNA, 25 bp, Homo sapien
tgactctgctgtgacttagtcccac

SEQ ID NO: 38178 - DNA, 25 bp, Homo sapien
tcccacccagcaccataaagaaagg

SEQ ID NO: 38179 - DNA, 25 bp, Homo sapien
aggcaaattgacggccgggtgcagt

SEQ ID NO: 38180 - DNA, 25 bp, Homo sapien
ttccgtttctatttgtgaagggagg

SEQ ID NO: 38181 - DNA, 25 bp, Homo sapien
gtttctatttgtgaagggaggagga

SEQ ID NO: 38182 - DNA, 25 bp, Homo sapien
gggaggaggaaggcagaggcgggct

SEQ ID NO: 38183 - DNA, 25 bp, Homo sapien
aggaaggcagaggcgggctggtgtc

SEQ ID NO: 38184 - DNA, 25 bp, Homo sapien
tgtctctggccggggactggaattt

SEQ ID NO: 38185 - DNA, 25 bp, Homo sapien
tggccggggactggaatttcatctg

SEQ ID NO: 38186 - DNA, 25 bp, Homo sapien
ggccggggactggaatttcatctga

SEQ ID NO: 38187 - DNA, 25 bp, Homo sapien
ccggggactggaatttcatctgaat

SEQ ID NO: 38188 - DNA, 25 bp, Homo sapien
aatttcatctgaatgactgcccctg

SEQ ID NO: 38189 - DNA, 25 bp, Homo sapien
gcctcgggggagcgcagaagtagcc

SEQ ID NO: 38190 - DNA, 25 bp, Homo sapien
tcgggggagcgcagaagtagccgcc

SEQ ID NO: 38191 - DNA, 25 bp, Homo sapien
gagaatgtcagccccttgaagctgc

SEQ ID NO: 38192 - DNA, 25 bp, Homo sapien
ttgaagctgcggtctgtctatgctg

SEQ ID NO: 38193 - DNA, 25 bp, Homo sapien
gtcgtaccctcagagcctaagatga

SEQ ID NO: 38194 - DNA, 25 bp, Homo sapien
gagctcaggaaatgaacaccctcgg

SEQ ID NO: 38195 - DNA, 25 bp, Homo sapien
gctccccaaaacccagggagaggtg

SEQ ID NO: 38196 - DNA, 25 bp, Homo sapien
cttccaggcccttcagagagtgagc

SEQ ID NO: 38197 - DNA, 25 bp, Homo sapien
cctgcggtccacttgggagcaagag

SEQ ID NO: 38198 - DNA, 25 bp, Homo sapien
gggagcaagagcggtgatcgaggca

SEQ ID NO: 38199 - DNA, 25 bp, Homo sapien
agcgccagtcgggagtgggctgggg

SEQ ID NO: 38200 - DNA, 25 bp, Homo sapien
ggcctgaccccaagaggggcggatg

SEQ ID NO: 38201 - DNA, 25 bp, Homo sapien
gagctgctggtgattaggagccgcc

SEQ ID NO: 38202 - DNA, 25 bp, Homo sapien
ggaaaccactggtcttgtcagtcat

SEQ ID NO: 38203 - DNA, 25 bp, Homo sapien
tggtcttgtcagtcatgtacacaca

SEQ ID NO: 38204 - DNA, 25 bp, Homo sapien
gtcagtcatgtacacacagaaaaaa

SEQ ID NO: 38205 - DNA, 25 bp, Homo sapien
agacagagtttcgctcttgttgccc

SEQ ID NO: 38206 - DNA, 25 bp, Homo sapien
caatggtgcaatttcagctcactgc

SEQ ID NO: 38207 - DNA, 25 bp, Homo sapien
tctgccacccggattcaagcaattc

SEQ ID NO: 38208 - DNA, 25 bp, Homo sapien
gccacccggattcaagcaattctcc

SEQ ID NO: 38209 - DNA, 25 bp, Homo sapien
ctcccgagtagctggaattgcagac

SEQ ID NO: 38210 - DNA, 25 bp, Homo sapien
gtagctggaattgcagacacccatc

SEQ ID NO: 38211 - DNA, 25 bp, Homo sapien
tacaggcatgaaccactgtgcccag

SEQ ID NO: 38212 - DNA, 25 bp, Homo sapien
ataaaatgaccagcaagtaaacttg

SEQ ID NO: 38213 - DNA, 25 bp, Homo sapien
cctattgaggcagctcatacctgta

SEQ ID NO: 38214 - DNA, 25 bp, Homo sapien
ggatcactttaggctgagagtttca

SEQ ID NO: 38215 - DNA, 25 bp, Homo sapien
ctttaggctgagagtttcagatcag

SEQ ID NO: 38216 - DNA, 25 bp, Homo sapien
aaattagttgtttgtggtagtgtgt

SEQ ID NO: 38217 - DNA, 25 bp, Homo sapien
tagttacagctacccagaagactca

SEQ ID NO: 38218 - DNA, 25 bp, Homo sapien
gttacagctacccagaagactcagg

SEQ ID NO: 38219 - DNA, 25 bp, Homo sapien
acagctacccagaagactcaggcag

SEQ ID NO: 38220 - DNA, 25 bp, Homo sapien
gctacccagaagactcaggcaggag

SEQ ID NO: 38221 - DNA, 25 bp, Homo sapien
tgggcaatcaagcaagatcttgtct

SEQ ID NO: 38222 - DNA, 25 bp, Homo sapien
ctttgggtggctgagtggttggatc

SEQ ID NO: 38223 - DNA, 25 bp, Homo sapien
gggtggctgagtggttggatcactt

SEQ ID NO: 38224 - DNA, 25 bp, Homo sapien
gctcttctcagacaggaatcctgtg

SEQ ID NO: 38225 - DNA, 25 bp, Homo sapien
tcccacattatttttggcaccccac

SEQ ID NO: 38226 - DNA, 25 bp, Homo sapien
ttcttccccgtgaaagcaaattgtt

SEQ ID NO: 38227 - DNA, 25 bp, Homo sapien
ccactacagtataggcccggttcag

SEQ ID NO: 38228 - DNA, 25 bp, Homo sapien
agtataggcccggttcagacagagg

SEQ ID NO: 38229 - DNA, 25 bp, Homo sapien
ccggttcagacagaggccttgtcca

SEQ ID NO: 38230 - DNA, 25 bp, Homo sapien
cggagcccagccaaagcaggggcca

SEQ ID NO: 38231 - DNA, 25 bp, Homo sapien
gcaggggccaggcgaatcttttgtt

SEQ ID NO: 38232 - DNA, 25 bp, Homo sapien
ggccaggcgaatcttttgttaaaag

SEQ ID NO: 38233 - DNA, 25 bp, Homo sapien
aagaacaatgcgcgctgggcacagt

SEQ ID NO: 38234 - DNA, 25 bp, Homo sapien
tgggagtccgaagctggaggatcac

SEQ ID NO: 38235 - DNA, 25 bp, Homo sapien
tttataagttaacactcttgccact

SEQ ID NO: 38236 - DNA, 25 bp, Homo sapien
ctcttgccacttactcatcagatta

SEQ ID NO: 38237 - DNA, 25 bp, Homo sapien
ttgccacttactcatcagattatat

SEQ ID NO: 38238 - DNA, 25 bp, Homo sapien
tactcatcagattatattttttcac

SEQ ID NO: 38239 - DNA, 25 bp, Homo sapien
atgtaccttctaacccacaataatg

SEQ ID NO: 38240 - DNA, 25 bp, Homo sapien
acccacaataatgtagcgtaactta

SEQ ID NO: 38241 - DNA, 25 bp, Homo sapien
tgaccacccacaagtaatgaccacc

SEQ ID NO: 38242 - DNA, 25 bp, Homo sapien
aaaattcagacattcagcatgggaa

SEQ ID NO: 38243 - DNA, 25 bp, Homo sapien
tcagcatgggaaggagcactgcata

SEQ ID NO: 38244 - DNA, 25 bp, Homo sapien
ggagcactgcatataggagctaaga

SEQ ID NO: 38245 - DNA, 25 bp, Homo sapien
aaagtacacactttaggctgggcgt

SEQ ID NO: 38246 - DNA, 25 bp, Homo sapien
aaatgtgctgacttacagttatttt

SEQ ID NO: 38247 - DNA, 25 bp, Homo sapien
gacttacagttattttagtgtctat

SEQ ID NO: 38248 - DNA, 25 bp, Homo sapien
gaggaaagttggctgacgttattta

SEQ ID NO: 38249 - DNA, 25 bp, Homo sapien
ttgaatattttatcactgagctttt

SEQ ID NO: 38250 - DNA, 25 bp, Homo sapien
cactgagcttttttctttaacctga

SEQ ID NO: 38251 - DNA, 25 bp, Homo sapien
tttaacctgaattccctgttccatt

SEQ ID NO: 38252 - DNA, 25 bp, Homo sapien
tccctgttccatttttcattcatat

SEQ ID NO: 38253 - DNA, 25 bp, Homo sapien
aaataactccagatttctttcttat

SEQ ID NO: 38254 - DNA, 25 bp, Homo sapien
agatttctttcttatagtcattatt

SEQ ID NO: 38255 - DNA, 25 bp, Homo sapien
tattgatataggcccgggcgctgtg

SEQ ID NO: 38256 - DNA, 25 bp, Homo sapien
ttagccaggtatggtggcgggcgcc

SEQ ID NO: 38257 - DNA, 25 bp, Homo sapien
gggaggtcaacttcagacacctgga

SEQ ID NO: 38258 - DNA, 25 bp, Homo sapien
gacacctggagagttaagagatatg

SEQ ID NO: 38259 - DNA, 25 bp, Homo sapien
gatatgccaactcagtagtgggcta

SEQ ID NO: 38260 - DNA, 25 bp, Homo sapien
gtagtgggctagtactctcttatct

SEQ ID NO: 38261 - DNA, 25 bp, Homo sapien
actctcttatctaggtaccttcctt

SEQ ID NO: 38262 - DNA, 25 bp, Homo sapien
tatctaggtaccttcctttatcctt

SEQ ID NO: 38263 - DNA, 25 bp, Homo sapien
gatttcccacattcctaagatcatc

SEQ ID NO: 38264 - DNA, 25 bp, Homo sapien
ttcccacattcctaagatcatctga

SEQ ID NO: 38265 - DNA, 25 bp, Homo sapien
gatcatctgaaaatctctggccaat

SEQ ID NO: 38266 - DNA, 25 bp, Homo sapien
gccaagcatgatggtgccaacctgt

SEQ ID NO: 38267 - DNA, 25 bp, Homo sapien
gggaggctgaagtatgagcattgct

SEQ ID NO: 38268 - DNA, 25 bp, Homo sapien
gaatacctggtatgtttttgcctac

SEQ ID NO: 38269 - DNA, 25 bp, Homo sapien
atgtttttgcctacaaatcttttat

SEQ ID NO: 38270 - DNA, 25 bp, Homo sapien
ttgtataatgtttgaagaccagtcc

SEQ ID NO: 38271 - DNA, 25 bp, Homo sapien
tgaagaccagtccctgtaagtagga

SEQ ID NO: 38272 - DNA, 25 bp, Homo sapien
gtaggactaatgtgtggtggtggcc

SEQ ID NO: 38273 - DNA, 25 bp, Homo sapien
atgtgtggtggtggcccatagtctt

SEQ ID NO: 38274 - DNA, 25 bp, Homo sapien
ggcccatagtcttctggatattggt

SEQ ID NO: 38275 - DNA, 25 bp, Homo sapien
atttatttctgccctcaactatata

SEQ ID NO: 38276 - DNA, 25 bp, Homo sapien
tgccctcaactatatatacaactga

SEQ ID NO: 38277 - DNA, 25 bp, Homo sapien
tacaactgagtaagccatttaagaa

SEQ ID NO: 38278 - DNA, 25 bp, Homo sapien
ttaagaattctgactccttggctgg

SEQ ID NO: 38279 - DNA, 25 bp, Homo sapien
gaccttgcagtaagcaggggccatg

SEQ ID NO: 38280 - DNA, 25 bp, Homo sapien
gggccatggagagtgccaagcagca

SEQ ID NO: 38281 - DNA, 25 bp, Homo sapien
ttctgtctgggagggctttgagcac

SEQ ID NO: 38282 - DNA, 25 bp, Homo sapien
accatcctcataacctggcttaggc

SEQ ID NO: 38283 - DNA, 25 bp, Homo sapien
taacctggcttaggccacaggcacc

SEQ ID NO: 38284 - DNA, 25 bp, Homo sapien
caccctgctagctttaagccggaca

SEQ ID NO: 38285 - DNA, 25 bp, Homo sapien
ggacagacctgtcacttgctaagtg

SEQ ID NO: 38286 - DNA, 25 bp, Homo sapien
ttgctaagtgtgtggtctctgagcc

SEQ ID NO: 38287 - DNA, 25 bp, Homo sapien
ggtaaggagactcctgacttcaggg

SEQ ID NO: 38288 - DNA, 25 bp, Homo sapien
ttcaggggtcattgtaagtgctaga

SEQ ID NO: 38289 - DNA, 25 bp, Homo sapien
atacataaagtgcaggccgggcgcg

SEQ ID NO: 38290 - DNA, 25 bp, Homo sapien
gttgggggagctcgagagccagacg

SEQ ID NO: 38291 - DNA, 25 bp, Homo sapien
tgggggagctcgagagccagacggc

SEQ ID NO: 38292 - DNA, 25 bp, Homo sapien
tcgagagccagacggccagacaggc

SEQ ID NO: 38293 - DNA, 25 bp, Homo sapien
tcccccattttctttaaggcagcac

SEQ ID NO: 38294 - DNA, 25 bp, Homo sapien
gagtggagagaggccactccctctc

SEQ ID NO: 38295 - DNA, 25 bp, Homo sapien
gatgtggacccggggaggggaggct

SEQ ID NO: 38296 - DNA, 25 bp, Homo sapien
catccccagggcagtttcaggtgcc

SEQ ID NO: 38297 - DNA, 25 bp, Homo sapien
tccccagggcagtttcaggtgccgg

SEQ ID NO: 38298 - DNA, 25 bp, Homo sapien
gctgggccctgaatgtcgaggatag

SEQ ID NO: 38299 - DNA, 25 bp, Homo sapien
tgtcgaggatagtatatagcccgct

SEQ ID NO: 38300 - DNA, 25 bp, Homo sapien
aggatagtatatagcccgctcctgg

SEQ ID NO: 38301 - DNA, 25 bp, Homo sapien
tgaatgtcttaatgcagtatagtta

SEQ ID NO: 38302 - DNA, 25 bp, Homo sapien
gttaaaatggcttcccacagggtag

SEQ ID NO: 38303 - DNA, 25 bp, Homo sapien
ttcccacagggtagataattatcca

SEQ ID NO: 38304 - DNA, 25 bp, Homo sapien
ttttcaggggtcacttcacatttct

SEQ ID NO: 38305 - DNA, 25 bp, Homo sapien
ggggtcacttcacatttctaaagaa

SEQ ID NO: 38306 - DNA, 25 bp, Homo sapien
ctcaagcctctaatctcaacgcttt

SEQ ID NO: 38307 - DNA, 25 bp, Homo sapien
cagctactcgaaaggctaagactgg

SEQ ID NO: 38308 - DNA, 25 bp, Homo sapien
gaagatgacttggaaatcgcaacat

SEQ ID NO: 38309 - DNA, 25 bp, Homo sapien
gacttggaaatcgcaacatcatggt

SEQ ID NO: 38310 - DNA, 25 bp, Homo sapien
acatcatggtacattgctaagtcca

SEQ ID NO: 38311 - DNA, 25 bp, Homo sapien
tacattgctaagtccatgcttgtgt

SEQ ID NO: 38312 - DNA, 25 bp, Homo sapien
ttatcctttgggccaatagaaacaa

SEQ ID NO: 38313 - DNA, 25 bp, Homo sapien
tttaataaaatgctttcccagtggt

SEQ ID NO: 38314 - DNA, 25 bp, Homo sapien
ttcccagtggtcaaattgtcttcct

SEQ ID NO: 38315 - DNA, 25 bp, Homo sapien
attgtcttcctgagtaaagctaaac

SEQ ID NO: 38316 - DNA, 25 bp, Homo sapien
ggtagtgtttatttctagctgcttc

SEQ ID NO: 38317 - DNA, 25 bp, Homo sapien
tttatttctagctgcttctgggtcc

SEQ ID NO: 38318 - DNA, 25 bp, Homo sapien
gcttctgggtcccaggttacctaag

SEQ ID NO: 38319 - DNA, 25 bp, Homo sapien
agggtaatgacaatgggcagctcca

SEQ ID NO: 38320 - DNA, 25 bp, Homo sapien
gacaatgggcagctccactttatta

SEQ ID NO: 38321 - DNA, 25 bp, Homo sapien
ttctccaaaaatcagcaagcatagc

SEQ ID NO: 38322 - DNA, 25 bp, Homo sapien
gcaagcatagctttacattcaagtt

SEQ ID NO: 38323 - DNA, 25 bp, Homo sapien
catggatttgctggtgcagtacaac

SEQ ID NO: 38324 - DNA, 25 bp, Homo sapien
atggatttgctggtgcagtacaact

SEQ ID NO: 38325 - DNA, 25 bp, Homo sapien
ggatttgctggtgcagtacaactag

SEQ ID NO: 38326 - DNA, 25 bp, Homo sapien
gatttgctggtgcagtacaactagg

SEQ ID NO: 38327 - DNA, 25 bp, Homo sapien
atttgctggtgcagtacaactaggc

SEQ ID NO: 38328 - DNA, 25 bp, Homo sapien
ttgctggtgcagtacaactaggctt

SEQ ID NO: 38329 - DNA, 25 bp, Homo sapien
tgctggtgcagtacaactaggctta

SEQ ID NO: 38330 - DNA, 25 bp, Homo sapien
gctggtgcagtacaactaggcttaa

SEQ ID NO: 38331 - DNA, 25 bp, Homo sapien
ctggtgcagtacaactaggcttaat

SEQ ID NO: 38332 - DNA, 25 bp, Homo sapien
ggtgcagtacaactaggcttaatag

SEQ ID NO: 38333 - DNA, 25 bp, Homo sapien
gcagtacaactaggcttaataggga

SEQ ID NO: 38334 - DNA, 25 bp, Homo sapien
ggaacacaccacatttggtccacag

SEQ ID NO: 38335 - DNA, 25 bp, Homo sapien
tttggtccacagaaggactgacttc

SEQ ID NO: 38336 - DNA, 25 bp, Homo sapien
aggactgacttctgattttgtatat

SEQ ID NO: 38337 - DNA, 25 bp, Homo sapien
ttttgtatattacgtggctgttatc

SEQ ID NO: 38338 - DNA, 25 bp, Homo sapien
ttacgtggctgttatcaaggaaagt

SEQ ID NO: 38339 - DNA, 25 bp, Homo sapien
ggaaatggaggcaattcatcagcaa

SEQ ID NO: 38340 - DNA, 25 bp, Homo sapien
cagcaaatttgtacatgtcaggatg

SEQ ID NO: 38341 - DNA, 25 bp, Homo sapien
ggagtggtacatcaaaccgttgtcc

SEQ ID NO: 38342 - DNA, 25 bp, Homo sapien
caaaccgttgtccaaattgccaaga

SEQ ID NO: 38343 - DNA, 25 bp, Homo sapien
attcaggcaaaagacttggagtgtt

SEQ ID NO: 38344 - DNA, 25 bp, Homo sapien
ttggagtgtttctttgattgattta

SEQ ID NO: 38345 - DNA, 25 bp, Homo sapien
tccccgcttggtccgggtgaggaag

SEQ ID NO: 38346 - DNA, 25 bp, Homo sapien
tggtccgggtgaggaagcaggtgag

SEQ ID NO: 38347 - DNA, 25 bp, Homo sapien
agcagcaccagaacgcagtgccgga

SEQ ID NO: 38348 - DNA, 25 bp, Homo sapien
ggcacaggcgatgctgaagaggggg

SEQ ID NO: 38349 - DNA, 25 bp, Homo sapien
agcaccagaacgcagtgccggagcc

SEQ ID NO: 38350 - DNA, 25 bp, Homo sapien
gctgaagagggggctcaagctgtgc

SEQ ID NO: 38351 - DNA, 25 bp, Homo sapien
gctcaagctgtgcgaacacacgctc

SEQ ID NO: 38352 - DNA, 25 bp, Homo sapien
caagctgtgcgaacacacgctcagc

SEQ ID NO: 38353 - DNA, 25 bp, Homo sapien
agggcgaggacaaaggcagccaggg

SEQ ID NO: 38354 - DNA, 25 bp, Homo sapien
gcgcccggcagaagggggagcagcg

SEQ ID NO: 38355 - DNA, 25 bp, Homo sapien
cggcagaagggggagcagcgccgcg

SEQ ID NO: 38356 - DNA, 25 bp, Homo sapien
gcgttttgtatttcagaccattgcc

SEQ ID NO: 38357 - DNA, 25 bp, Homo sapien
ttttgtatttcagaccattgccctc

SEQ ID NO: 38358 - DNA, 25 bp, Homo sapien
ggtctgccgtgctagtgtcaaggac

SEQ ID NO: 38359 - DNA, 25 bp, Homo sapien
ctgccgtgctagtgtcaaggaccgc

SEQ ID NO: 38360 - DNA, 25 bp, Homo sapien
gctagtgtcaaggaccgcgtttcac

SEQ ID NO: 38361 - DNA, 25 bp, Homo sapien
tcaaggaccgcgtttcactagaggt

SEQ ID NO: 38362 - DNA, 25 bp, Homo sapien
ggaccgcgtttcactagaggtggca

SEQ ID NO: 38363 - DNA, 25 bp, Homo sapien
agaggtggcaaggagctttcgtccc

SEQ ID NO: 38364 - DNA, 25 bp, Homo sapien
aggtggcaaggagctttcgtcccac

SEQ ID NO: 38365 - DNA, 25 bp, Homo sapien
gggtgccctttaaaacagtctagag

SEQ ID NO: 38366 - DNA, 25 bp, Homo sapien
gccctttaaaacagtctagagctgg

SEQ ID NO: 38367 - DNA, 25 bp, Homo sapien
cgagtggcgctatgtgctggtgagc

SEQ ID NO: 38368 - DNA, 25 bp, Homo sapien
agtggcgctatgtgctggtgagcac

SEQ ID NO: 38369 - DNA, 25 bp, Homo sapien
ggcccaccaagagctggctcaagaa

SEQ ID NO: 38370 - DNA, 25 bp, Homo sapien
agagctggctcaagaagtttctggg

SEQ ID NO: 38371 - DNA, 25 bp, Homo sapien
ggctcaagaagtttctgggcttcgt

SEQ ID NO: 38372 - DNA, 25 bp, Homo sapien
gaagtttctgggcttcgttgtggac

SEQ ID NO: 38373 - DNA, 25 bp, Homo sapien
ttcgttgtggaccccaaccaagtga

SEQ ID NO: 38374 - DNA, 25 bp, Homo sapien
tcgttgtggaccccaaccaagtgaa

SEQ ID NO: 38375 - DNA, 25 bp, Homo sapien
tagcctcctggacttctgcgaggct

SEQ ID NO: 38376 - DNA, 25 bp, Homo sapien
agcctcctggacttctgcgaggctc

SEQ ID NO: 38377 - DNA, 25 bp, Homo sapien
gacttctgcgaggctcagcagaccc

SEQ ID NO: 38378 - DNA, 25 bp, Homo sapien
gggtgagagtatttccaagaggcct

SEQ ID NO: 38379 - DNA, 25 bp, Homo sapien
gaggccttatttgagtctgggccac

SEQ ID NO: 38380 - DNA, 25 bp, Homo sapien
gggccacatagataaggctcccact

SEQ ID NO: 38381 - DNA, 25 bp, Homo sapien
ccacttccgggcaaggctggtttag

SEQ ID NO: 38382 - DNA, 25 bp, Homo sapien
gcctttctaggagctctgctgatgg

SEQ ID NO: 38383 - DNA, 25 bp, Homo sapien
acaagtgcttcctttcaccaagatt

SEQ ID NO: 38384 - DNA, 25 bp, Homo sapien
caccaagatttcatccagatacctc

SEQ ID NO: 38385 - DNA, 25 bp, Homo sapien
ccagatacctcttaatcacaacctc

SEQ ID NO: 38386 - DNA, 25 bp, Homo sapien
ctctctgttccctagacgatgctag

SEQ ID NO: 38387 - DNA, 25 bp, Homo sapien
gatgctagggtcccagccaagattc

SEQ ID NO: 38388 - DNA, 25 bp, Homo sapien
ggaggttgcagttgaacccggcagg

SEQ ID NO: 38389 - DNA, 25 bp, Homo sapien
gcaaaacctgtaagtgtaagtgtta

SEQ ID NO: 38390 - DNA, 25 bp, Homo sapien
gtaagtgttacagcctagtcaacta

SEQ ID NO: 38391 - DNA, 25 bp, Homo sapien
acagcctagtcaactatcgactgtt

SEQ ID NO: 38392 - DNA, 25 bp, Homo sapien
gtcaactatcgactgttagcctcag

SEQ ID NO: 38393 - DNA, 25 bp, Homo sapien
ttagcctcagtgtgtccagagctgc

SEQ ID NO: 38394 - DNA, 25 bp, Homo sapien
agagctgcctgtaacgtgctcatag

SEQ ID NO: 38395 - DNA, 25 bp, Homo sapien
gcctgtaacgtgctcatagtggaat

SEQ ID NO: 38396 - DNA, 25 bp, Homo sapien
tgagagtcaggtcttcattcctcac

SEQ ID NO: 38397 - DNA, 25 bp, Homo sapien
ggtcttcattcctcacaataagtgt

SEQ ID NO: 38398 - DNA, 25 bp, Homo sapien
tttctcttacattaattctcttcac

SEQ ID NO: 38399 - DNA, 25 bp, Homo sapien
ttaattctcttcactgaaatgagga

SEQ ID NO: 38400 - DNA, 25 bp, Homo sapien
taataattgcacctgacacataaac

SEQ ID NO: 38401 - DNA, 25 bp, Homo sapien
tgacacataaacatagaccacccac

SEQ ID NO: 38402 - DNA, 25 bp, Homo sapien
gaccacccacaaccaaaattaaatg

SEQ ID NO: 38403 - DNA, 25 bp, Homo sapien
gacaaatacacattggatgaccaca

SEQ ID NO: 38404 - DNA, 25 bp, Homo sapien
ggatgaccacagtaacagcaaacag

SEQ ID NO: 38405 - DNA, 25 bp, Homo sapien
atttcacatagacatttagattact

SEQ ID NO: 38406 - DNA, 25 bp, Homo sapien
gagactatgtgtaaacagtcatcat

SEQ ID NO: 38407 - DNA, 25 bp, Homo sapien
aacagtcatcattatagtactcaag

SEQ ID NO: 38408 - DNA, 25 bp, Homo sapien
aagacactaaaacagcttctagcaa

SEQ ID NO: 38409 - DNA, 25 bp, Homo sapien
gagttctagacaggcctgagaaacc

SEQ ID NO: 38410 - DNA, 25 bp, Homo sapien
aacctagtgagacatccttctctta

SEQ ID NO: 38411 - DNA, 25 bp, Homo sapien
atcatctgaggtcagcagtttgaga

SEQ ID NO: 38412 - DNA, 25 bp, Homo sapien
catctgaggtcagcagtttgagacc

SEQ ID NO: 38413 - DNA, 25 bp, Homo sapien
aaaatacaatacaagccgggcacag

SEQ ID NO: 38414 - DNA, 25 bp, Homo sapien
atacaatacaagccgggcacagtgg

SEQ ID NO: 38415 - DNA, 25 bp, Homo sapien
gctgagtgtggtggcacacacctgt

SEQ ID NO: 38416 - DNA, 25 bp, Homo sapien
tgagtgtggtggcacacacctgtaa

SEQ ID NO: 38417 - DNA, 25 bp, Homo sapien
gtaatcccaggtacttgggagtctg

SEQ ID NO: 38418 - DNA, 25 bp, Homo sapien
aatcccaggtacttgggagtctgag

SEQ ID NO: 38419 - DNA, 25 bp, Homo sapien
gaggttgcagtaagcggagattgtg

SEQ ID NO: 38420 - DNA, 25 bp, Homo sapien
tgcagtaagcggagattgtgccact

SEQ ID NO: 38421 - DNA, 25 bp, Homo sapien
gcagtaagcggagattgtgccactg

SEQ ID NO: 38422 - DNA, 25 bp, Homo sapien
gctccccttgccgttggagggcaag

SEQ ID NO: 38423 - DNA, 25 bp, Homo sapien
cccttgccgttggagggcaaggcca

SEQ ID NO: 38424 - DNA, 25 bp, Homo sapien
ctcctcggaaggtctcgaacatctg

SEQ ID NO: 38425 - DNA, 25 bp, Homo sapien
gtctcgaacatctggacgaagcgca

SEQ ID NO: 38426 - DNA, 25 bp, Homo sapien
cgaacatctggacgaagcgcagcct

SEQ ID NO: 38427 - DNA, 25 bp, Homo sapien
tctctgtcaacggcatgctcttgcc

SEQ ID NO: 38428 - DNA, 25 bp, Homo sapien
tcttgccctttgaggagagtgacct

SEQ ID NO: 38429 - DNA, 25 bp, Homo sapien
gccctttgaggagagtgacctggtg

SEQ ID NO: 38430 - DNA, 25 bp, Homo sapien
tgaggagagtgacctggtgggggcc

SEQ ID NO: 38431 - DNA, 25 bp, Homo sapien
gtggagtttccatggtgatgtttac

SEQ ID NO: 38432 - DNA, 25 bp, Homo sapien
ccggggtgtgctcagggaatgtgga

SEQ ID NO: 38433 - DNA, 25 bp, Homo sapien
ggtggtggccgacgggcaagtagag

SEQ ID NO: 38434 - DNA, 25 bp, Homo sapien
caaatcttgcctcaggacttgctgc

SEQ ID NO: 38435 - DNA, 25 bp, Homo sapien
gacttgctgccaggggaacgcagac

SEQ ID NO: 38436 - DNA, 25 bp, Homo sapien
gaacgcagactcagagcgtcctctt

SEQ ID NO: 38437 - DNA, 25 bp, Homo sapien
gtaaggctgcctctggacggaggag

SEQ ID NO: 38438 - DNA, 25 bp, Homo sapien
tgaaagcacaaccagtaccttctca

SEQ ID NO: 38439 - DNA, 25 bp, Homo sapien
gagaccgcgagggtctggaggggcg

SEQ ID NO: 38440 - DNA, 25 bp, Homo sapien
gtaccttctcaggagcgtggggagg

SEQ ID NO: 38441 - DNA, 25 bp, Homo sapien
tgacatgggtgttgccgtgagtggc

SEQ ID NO: 38442 - DNA, 25 bp, Homo sapien
ttcagcattccagtatctcttttca

SEQ ID NO: 38443 - DNA, 25 bp, Homo sapien
accggcctggcacagaggggaagga

SEQ ID NO: 38444 - DNA, 25 bp, Homo sapien
ggactcttctagtaataacgtagct

SEQ ID NO: 38445 - DNA, 25 bp, Homo sapien
tattttccttatatccttattatat

SEQ ID NO: 38446 - DNA, 25 bp, Homo sapien
caagacaaacacactagcctaggcc

SEQ ID NO: 38447 - DNA, 25 bp, Homo sapien
tagcctaggcctatgcagggtcagg

SEQ ID NO: 38448 - DNA, 25 bp, Homo sapien
gggtcaggatcaagacatccctagc

SEQ ID NO: 38449 - DNA, 25 bp, Homo sapien
aagacatccctagcaggtgacagga

SEQ ID NO: 38450 - DNA, 25 bp, Homo sapien
ggtgacaggaatttttcaactccat

SEQ ID NO: 38451 - DNA, 25 bp, Homo sapien
ataatctgtggggccaccatcatat

SEQ ID NO: 38452 - DNA, 25 bp, Homo sapien
gtacattgaccgaaacatggttaca

SEQ ID NO: 38453 - DNA, 25 bp, Homo sapien
aatttgcgtcaatactgctcagtgt

SEQ ID NO: 38454 - DNA, 25 bp, Homo sapien
tactgctcagtgtgccatatttaaa

SEQ ID NO: 38455 - DNA, 25 bp, Homo sapien
ggattaattcactgttgggttaata

SEQ ID NO: 38456 - DNA, 25 bp, Homo sapien
ctgttgggttaatatgcatctcatg

SEQ ID NO: 38457 - DNA, 25 bp, Homo sapien
gcatctcatgaaatgatatcttttc

SEQ ID NO: 38458 - DNA, 25 bp, Homo sapien
tatcttttcattcctttgtatacct

SEQ ID NO: 38459 - DNA, 25 bp, Homo sapien
tcttttcattcctttgtatacctgt

SEQ ID NO: 38460 - DNA, 25 bp, Homo sapien
tcctttgtatacctgtattaggtca

SEQ ID NO: 38461 - DNA, 25 bp, Homo sapien
attaggtcagtatacgctttccatg

SEQ ID NO: 38462 - DNA, 25 bp, Homo sapien
gtcagtatacgctttccatgaaata

SEQ ID NO: 38463 - DNA, 25 bp, Homo sapien
gtatacgctttccatgaaatatatt

SEQ ID NO: 38464 - DNA, 25 bp, Homo sapien
gttataacgtatgacatttttccca

SEQ ID NO: 38465 - DNA, 25 bp, Homo sapien
atgttttaagagttctcttccagag

SEQ ID NO: 38466 - DNA, 25 bp, Homo sapien
tgctccaagtcctgcgatgctaagt

SEQ ID NO: 38467 - DNA, 25 bp, Homo sapien
ctgcgatgctaagtgcttttctcct

SEQ ID NO: 38468 - DNA, 25 bp, Homo sapien
caatacctccacacaggacactaga

SEQ ID NO: 38469 - DNA, 25 bp, Homo sapien
tgtgcggaggccttaacttgagttc

SEQ ID NO: 38470 - DNA, 25 bp, Homo sapien
tctgttttgcacctggatttaccag

SEQ ID NO: 38471 - DNA, 25 bp, Homo sapien
gcacatcaaagctgcttcgcaagcc

SEQ ID NO: 38472 - DNA, 25 bp, Homo sapien
ccctcccagagtgctatgcgagtgg

SEQ ID NO: 38473 - DNA, 25 bp, Homo sapien
ctatgcgagtggctgccgtgcagtt

SEQ ID NO: 38474 - DNA, 25 bp, Homo sapien
gggtggggcgtggtgtttagacaca

SEQ ID NO: 38475 - DNA, 25 bp, Homo sapien
gggtatgactgatggaggccccggc

SEQ ID NO: 38476 - DNA, 25 bp, Homo sapien
ccagccagattccatcctggggaag

SEQ ID NO: 38477 - DNA, 25 bp, Homo sapien
aaaaccaaaactccaagcgcagagc

SEQ ID NO: 38478 - DNA, 25 bp, Homo sapien
accaaaactccaagcgcagagcacc

SEQ ID NO: 38479 - DNA, 25 bp, Homo sapien
tgccatcttcgtccgaatgcagcac

SEQ ID NO: 38480 - DNA, 25 bp, Homo sapien
gcttctcttgtctatgaccaggcag

SEQ ID NO: 38481 - DNA, 25 bp, Homo sapien
tctcttgtctatgaccaggcaggtc

SEQ ID NO: 38482 - DNA, 25 bp, Homo sapien
ggcaggtcacaggcgggagggaccc

SEQ ID NO: 38483 - DNA, 25 bp, Homo sapien
caggtcacaggcgggagggacccag

SEQ ID NO: 38484 - DNA, 25 bp, Homo sapien
ggtttttctattggggcagagagag

SEQ ID NO: 38485 - DNA, 25 bp, Homo sapien
gcaagctggagaattaactccggga

SEQ ID NO: 38486 - DNA, 25 bp, Homo sapien
gaattaactccgggacttgagctcg

SEQ ID NO: 38487 - DNA, 25 bp, Homo sapien
taactccgggacttgagctcggggt

SEQ ID NO: 38488 - DNA, 25 bp, Homo sapien
caaaccaatacatcacatcagcaga

SEQ ID NO: 38489 - DNA, 25 bp, Homo sapien
catcccttcgtggtaaaaactctca

SEQ ID NO: 38490 - DNA, 25 bp, Homo sapien
ataaaggccatatgtgagacccaca

SEQ ID NO: 38491 - DNA, 25 bp, Homo sapien
atgtgagacccacagctgacatcat

SEQ ID NO: 38492 - DNA, 25 bp, Homo sapien
acccacagctgacatcatacctaat

SEQ ID NO: 38493 - DNA, 25 bp, Homo sapien
gctgacatcatacctaatggcgaaa

SEQ ID NO: 38494 - DNA, 25 bp, Homo sapien
gcgaaaagcttaaagcctttcctct

SEQ ID NO: 38495 - DNA, 25 bp, Homo sapien
agacaaggacggccattttcaccac

SEQ ID NO: 38496 - DNA, 25 bp, Homo sapien
gtattggaagtcctagcaagagcaa

SEQ ID NO: 38497 - DNA, 25 bp, Homo sapien
agaggaagtcaaatggtccctcttt

SEQ ID NO: 38498 - DNA, 25 bp, Homo sapien
ctagagatgaggatttcccatgttg

SEQ ID NO: 38499 - DNA, 25 bp, Homo sapien
gctgcactgaggggctgggtgctgg

SEQ ID NO: 38500 - DNA, 25 bp, Homo sapien
tgctggggaggggctggtaggaggg

SEQ ID NO: 38501 - DNA, 25 bp, Homo sapien
actgctttggaggtgatgggactat

SEQ ID NO: 38502 - DNA, 25 bp, Homo sapien
gatgggactatcaataagaactctg

SEQ ID NO: 38503 - DNA, 25 bp, Homo sapien
gcaccagcgacttcggtgagtgtcc

SEQ ID NO: 38504 - DNA, 25 bp, Homo sapien
tgcctccccacagtaattcacggga

SEQ ID NO: 38505 - DNA, 25 bp, Homo sapien
tcacgggatcatccatggggtcacc

SEQ ID NO: 38506 - DNA, 25 bp, Homo sapien
tcacccatgacgtggagctgcagga

SEQ ID NO: 38507 - DNA, 25 bp, Homo sapien
ggagctgcaggagtctgtcatcact

SEQ ID NO: 38508 - DNA, 25 bp, Homo sapien
caggagtctgtcatcactgtggtgg

SEQ ID NO: 38509 - DNA, 25 bp, Homo sapien
tcatgggctggagccgctttgggga

SEQ ID NO: 38510 - DNA, 25 bp, Homo sapien
ggacacccagttactaaagtcagca

SEQ ID NO: 38511 - DNA, 25 bp, Homo sapien
gtgaacacaacactctcactaacac

SEQ ID NO: 38512 - DNA, 25 bp, Homo sapien
ctccttgaccagtcagtcttcagca

SEQ ID NO: 38513 - DNA, 25 bp, Homo sapien
gtgtttaccagaatcgcacaggcta

SEQ ID NO: 38514 - DNA, 25 bp, Homo sapien
accagaatcgcacaggctaagcaca

SEQ ID NO: 38515 - DNA, 25 bp, Homo sapien
ggctaagcacaaacatggaaccaga

SEQ ID NO: 38516 - DNA, 25 bp, Homo sapien
tgaggaaacctcactcgcagaagcc

SEQ ID NO: 38517 - DNA, 25 bp, Homo sapien
gctgtgggtgctaggagccaagtgc

SEQ ID NO: 38518 - DNA, 25 bp, Homo sapien
ctaggagccaagtgctagggactcg

SEQ ID NO: 38519 - DNA, 25 bp, Homo sapien
aacagtcttacgaatgtaattcctt

SEQ ID NO: 38520 - DNA, 25 bp, Homo sapien
tgtgtactactgatcttctattgtg

SEQ ID NO: 38521 - DNA, 25 bp, Homo sapien
cagcggcgggaacagcaggcagctg

SEQ ID NO: 38522 - DNA, 25 bp, Homo sapien
cgggaacagcaggcagctgcagccg

SEQ ID NO: 38523 - DNA, 25 bp, Homo sapien
ttctcggagcagtttctctttctcc

SEQ ID NO: 38524 - DNA, 25 bp, Homo sapien
ctcggagcagtttctctttctccgc

SEQ ID NO: 38525 - DNA, 25 bp, Homo sapien
cgccaagtcgcgcagacctaaggag

SEQ ID NO: 38526 - DNA, 25 bp, Homo sapien
aagtcgcgcagacctaaggagaagc

SEQ ID NO: 38527 - DNA, 25 bp, Homo sapien
cgcgcagacctaaggagaagcggga

SEQ ID NO: 38528 - DNA, 25 bp, Homo sapien
ggagaagcgggagaaggagaggagg

SEQ ID NO: 38529 - DNA, 25 bp, Homo sapien
ggagaggaggaggcacggtctcggt

SEQ ID NO: 38530 - DNA, 25 bp, Homo sapien
agaacggggaggtgaagccgctgcc

SEQ ID NO: 38531 - DNA, 25 bp, Homo sapien
ccgctgccccgagataaaatcaaag

SEQ ID NO: 38532 - DNA, 25 bp, Homo sapien
gagtttatttccatgtttgttattt

SEQ ID NO: 38533 - DNA, 25 bp, Homo sapien
atgagggatatttcaaccagtcaat

SEQ ID NO: 38534 - DNA, 25 bp, Homo sapien
tcaaccagtcaatgaatagacacag

SEQ ID NO: 38535 - DNA, 25 bp, Homo sapien
tagacacagagcgaaattcagtgca

SEQ ID NO: 38536 - DNA, 25 bp, Homo sapien
gagcgaaattcagtgcaaagatagt

SEQ ID NO: 38537 - DNA, 25 bp, Homo sapien
aagatagtgaagatggcctggcgcc

SEQ ID NO: 38538 - DNA, 25 bp, Homo sapien
atagtgaagatggcctggcgccgtg

SEQ ID NO: 38539 - DNA, 25 bp, Homo sapien
tcaggaggttgagaccatcctggct

SEQ ID NO: 38540 - DNA, 25 bp, Homo sapien
gagattgagaccatcctgactaaca

SEQ ID NO: 38541 - DNA, 25 bp, Homo sapien
ctaacacagtgaaacctcgtctcta

SEQ ID NO: 38542 - DNA, 25 bp, Homo sapien
cagtgaaacctcgtctctagtagaa

SEQ ID NO: 38543 - DNA, 25 bp, Homo sapien
aggttgactcctaggtagtgtgcct

SEQ ID NO: 38544 - DNA, 25 bp, Homo sapien
agtgtgcctagtgaccaagagggct

SEQ ID NO: 38545 - DNA, 25 bp, Homo sapien
agagggctgctaagaaagctttctg

SEQ ID NO: 38546 - DNA, 25 bp, Homo sapien
gaaagctttctgaccacttgtggct

SEQ ID NO: 38547 - DNA, 25 bp, Homo sapien
cacttgtggctgtcattggactgat

SEQ ID NO: 38548 - DNA, 25 bp, Homo sapien
tggactgatttgcccagatgacatc

SEQ ID NO: 38549 - DNA, 25 bp, Homo sapien
gatttgcccagatgacatcaattgg

SEQ ID NO: 38550 - DNA, 25 bp, Homo sapien
gggaatttgaggcatgacctataaa

SEQ ID NO: 38551 - DNA, 25 bp, Homo sapien
gacctataaagatcagttgcttgca

SEQ ID NO: 38552 - DNA, 25 bp, Homo sapien
tcagttgcttgcaagagtctcagga

SEQ ID NO: 38553 - DNA, 25 bp, Homo sapien
ggccagatatggcagctcatgcctg

SEQ ID NO: 38554 - DNA, 25 bp, Homo sapien
aaaagggcatgatctcttctataag

SEQ ID NO: 38555 - DNA, 25 bp, Homo sapien
taaaaccatgctgtacactgaagac

SEQ ID NO: 38556 - DNA, 25 bp, Homo sapien
catttacttaccaaaacgccaccat

SEQ ID NO: 38557 - DNA, 25 bp, Homo sapien
gcaacataggcataacatttcacaa

SEQ ID NO: 38558 - DNA, 25 bp, Homo sapien
ttgtggcctaagagtcacctgactt

SEQ ID NO: 38559 - DNA, 25 bp, Homo sapien
ctggacgaaacattgggaacctcac

SEQ ID NO: 38560 - DNA, 25 bp, Homo sapien
aacgccaccatataactgtattctc

SEQ ID NO: 38561 - DNA, 25 bp, Homo sapien
ggcagcagcaactaacatgacacag

SEQ ID NO: 38562 - DNA, 25 bp, Homo sapien
ataactgtattctcaggtggcaaaa

SEQ ID NO: 38563 - DNA, 25 bp, Homo sapien
ggtggcaaaacccagagtcaaacaa

SEQ ID NO: 38564 - DNA, 25 bp, Homo sapien
gatgtggtcatctactcatagtgaa

SEQ ID NO: 38565 - DNA, 25 bp, Homo sapien
tatacttacatttctatcatcaaac

SEQ ID NO: 38566 - DNA, 25 bp, Homo sapien
tcatcaaacaaacaatctacacttt

SEQ ID NO: 38567 - DNA, 25 bp, Homo sapien
ggacaaaacgggtcaaactgcttat

SEQ ID NO: 38568 - DNA, 25 bp, Homo sapien
aacgggtcaaactgcttataacatt

SEQ ID NO: 38569 - DNA, 25 bp, Homo sapien
ggtcaaactgcttataacattggcc

SEQ ID NO: 38570 - DNA, 25 bp, Homo sapien
ggaaattatactgtgatgattctaa

SEQ ID NO: 38571 - DNA, 25 bp, Homo sapien
agtggagtgtagtggcttgtacctg

SEQ ID NO: 38572 - DNA, 25 bp, Homo sapien
tagggaaaccctgtatctatcacaa

SEQ ID NO: 38573 - DNA, 25 bp, Homo sapien
gggaaaccctgtatctatcacaaaa

SEQ ID NO: 38574 - DNA, 25 bp, Homo sapien
gcaatgagctgtgataatgccgctg

SEQ ID NO: 38575 - DNA, 25 bp, Homo sapien
ccctgtggcttgggtgacagggtga

SEQ ID NO: 38576 - DNA, 25 bp, Homo sapien
aggggactgggtatggcaggcagct

SEQ ID NO: 38577 - DNA, 25 bp, Homo sapien
ggcaggcagctaaggaatttgagtt

SEQ ID NO: 38578 - DNA, 25 bp, Homo sapien
tttattttggtgaacgaggagagca

SEQ ID NO: 38579 - DNA, 25 bp, Homo sapien
gatttcatagagaaacctactacct

SEQ ID NO: 38580 - DNA, 25 bp, Homo sapien
cctactacctaggagtgaaattgct

SEQ ID NO: 38581 - DNA, 25 bp, Homo sapien
gaaattgctgggtcctatggtaact

SEQ ID NO: 38582 - DNA, 25 bp, Homo sapien
catttacctttttgaggaactgcca

SEQ ID NO: 38583 - DNA, 25 bp, Homo sapien
ggaactgccaaactgtttttcatag

SEQ ID NO: 38584 - DNA, 25 bp, Homo sapien
ggctgcaccattttagaaatatcta

SEQ ID NO: 38585 - DNA, 25 bp, Homo sapien
gaaatatctaaaggcggctgggtgc

SEQ ID NO: 38586 - DNA, 25 bp, Homo sapien
taaaggcggctgggtgcagtggctc

SEQ ID NO: 38587 - DNA, 25 bp, Homo sapien
tggtgtttcttcacagtatctctgt

SEQ ID NO: 38588 - DNA, 25 bp, Homo sapien
gagggtgtattattcctttttatag

SEQ ID NO: 38589 - DNA, 25 bp, Homo sapien
gggaattttgtcatatttgttgcac

SEQ ID NO: 38590 - DNA, 25 bp, Homo sapien
gttgcacagcaaggaaggactttca

SEQ ID NO: 38591 - DNA, 25 bp, Homo sapien
gggatgtggtgaggaagagcaggca

SEQ ID NO: 38592 - DNA, 25 bp, Homo sapien
agagcaggcaatagagagcagggag

SEQ ID NO: 38593 - DNA, 25 bp, Homo sapien
gaggaaaggctaagtagcatctgga

SEQ ID NO: 38594 - DNA, 25 bp, Homo sapien
attaaaaatgtctatcctcagccgg

SEQ ID NO: 38595 - DNA, 25 bp, Homo sapien
agcactttggggggtcgagatgggc

SEQ ID NO: 38596 - DNA, 25 bp, Homo sapien
ggggtcgagatgggcagatcacctg

SEQ ID NO: 38597 - DNA, 25 bp, Homo sapien
aaattagttgcgcgtggtggtgggc

SEQ ID NO: 38598 - DNA, 25 bp, Homo sapien
tgatcaggtcctctagactctggaa

SEQ ID NO: 38599 - DNA, 25 bp, Homo sapien
caggtcctctagactctggaactcg

SEQ ID NO: 38600 - DNA, 25 bp, Homo sapien
actctggaactcgagcgtgtggctg

SEQ ID NO: 38601 - DNA, 25 bp, Homo sapien
ctgcgccgacagctgaatctgcagc

SEQ ID NO: 38602 - DNA, 25 bp, Homo sapien
gccgacagctgaatctgcagccggt

SEQ ID NO: 38603 - DNA, 25 bp, Homo sapien
agctgaatctgcagccggtagggct

SEQ ID NO: 38604 - DNA, 25 bp, Homo sapien
gcagccggtagggctgcttgccgat

SEQ ID NO: 38605 - DNA, 25 bp, Homo sapien
gcgctggagcttagcggcttgtagc

SEQ ID NO: 38606 - DNA, 25 bp, Homo sapien
ggagcttagcggcttgtagcggtac

SEQ ID NO: 38607 - DNA, 25 bp, Homo sapien
agcggcttgtagcggtacagatcgt

SEQ ID NO: 38608 - DNA, 25 bp, Homo sapien
ttgtagcggtacagatcgttgacca

SEQ ID NO: 38609 - DNA, 25 bp, Homo sapien
gaagtggtttctatgctatttgata

SEQ ID NO: 38610 - DNA, 25 bp, Homo sapien
gtttctatgctatttgataatcagt

SEQ ID NO: 38611 - DNA, 25 bp, Homo sapien
taatcagtaatgttcagctgtcatg

SEQ ID NO: 38612 - DNA, 25 bp, Homo sapien
agctgtcatgatagtactttactgg

SEQ ID NO: 38613 - DNA, 25 bp, Homo sapien
actttactggttgcagacccatctc

SEQ ID NO: 38614 - DNA, 25 bp, Homo sapien
actagtgcagtttataattgtgcct

SEQ ID NO: 38615 - DNA, 25 bp, Homo sapien
ttgtgcctacttttaaaatctttca

SEQ ID NO: 38616 - DNA, 25 bp, Homo sapien
gaaatcataactgacagggatacag

SEQ ID NO: 38617 - DNA, 25 bp, Homo sapien
gaaatgctactatcacttattttaa

SEQ ID NO: 38618 - DNA, 25 bp, Homo sapien
gcaggcaaataccattgctttttga

SEQ ID NO: 38619 - DNA, 25 bp, Homo sapien
aaataccattgctttttgagtgcct

SEQ ID NO: 38620 - DNA, 25 bp, Homo sapien
ggtatctgccgctgattatttcagt

SEQ ID NO: 38621 - DNA, 25 bp, Homo sapien
gccgctgattatttcagtcgctcca

SEQ ID NO: 38622 - DNA, 25 bp, Homo sapien
gattatttcagtcgctccaatcgta

SEQ ID NO: 38623 - DNA, 25 bp, Homo sapien
tttcagtcgctccaatcgtagggga

SEQ ID NO: 38624 - DNA, 25 bp, Homo sapien
cagtcgctccaatcgtaggggaagt

SEQ ID NO: 38625 - DNA, 25 bp, Homo sapien
atcgtaggggaagtgttgtctctga

SEQ ID NO: 38626 - DNA, 25 bp, Homo sapien
aggggaagtgttgtctctgaggtgg

SEQ ID NO: 38627 - DNA, 25 bp, Homo sapien
ggaagtgttgtctctgaggtggatg

SEQ ID NO: 38628 - DNA, 25 bp, Homo sapien
gttgtctctgaggtggatgatatca

SEQ ID NO: 38629 - DNA, 25 bp, Homo sapien
gaggtggatgatatcagtatcccag

SEQ ID NO: 38630 - DNA, 25 bp, Homo sapien
tatcagtatcccagatttgtccagc

SEQ ID NO: 38631 - DNA, 25 bp, Homo sapien
agggacccaatgctaataaagactg

SEQ ID NO: 38632 - DNA, 25 bp, Homo sapien
ctactactactatacggctgcgaga

SEQ ID NO: 38633 - DNA, 25 bp, Homo sapien
actactatacggctgcgagaagacg

SEQ ID NO: 38634 - DNA, 25 bp, Homo sapien
atacggctgcgagaagacgacagaa

SEQ ID NO: 38635 - DNA, 25 bp, Homo sapien
gacgacagaaggggtgggaagggat

SEQ ID NO: 38636 - DNA, 25 bp, Homo sapien
tgggaagggatggtacgtggagggg

SEQ ID NO: 38637 - DNA, 25 bp, Homo sapien
gggatggtacgtggaggggaatggg

SEQ ID NO: 38638 - DNA, 25 bp, Homo sapien
gaggggaatgggtggtgggaccagg

SEQ ID NO: 38639 - DNA, 25 bp, Homo sapien
ggtggtgggaccagggacccaatgc

SEQ ID NO: 38640 - DNA, 25 bp, Homo sapien
ggtgggaccagggacccaatgctaa

SEQ ID NO: 38641 - DNA, 25 bp, Homo sapien
gggaccagggacccaatgctaataa

SEQ ID NO: 38642 - DNA, 25 bp, Homo sapien
ttatcttttgtgtataaatcccaaa

SEQ ID NO: 38643 - DNA, 25 bp, Homo sapien
tggagtgagtttctgcaccaagccc

SEQ ID NO: 38644 - DNA, 25 bp, Homo sapien
tgcaccaagcccgaattttttattt

SEQ ID NO: 38645 - DNA, 25 bp, Homo sapien
ttccttattatttggtgttaaacag

SEQ ID NO: 38646 - DNA, 25 bp, Homo sapien
aaacaggtttaatgacagtgatggc

SEQ ID NO: 38647 - DNA, 25 bp, Homo sapien
gacagtgatggcaactttttggcac

SEQ ID NO: 38648 - DNA, 25 bp, Homo sapien
gatggcaactttttggcacaataaa

SEQ ID NO: 38649 - DNA, 25 bp, Homo sapien
tacccaattcgccctatagtgagtc

SEQ ID NO: 38650 - DNA, 25 bp, Homo sapien
ttcgccctatagtgagtcgtattac

SEQ ID NO: 38651 - DNA, 25 bp, Homo sapien
gtcgtattacaattcacttgcccgc

SEQ ID NO: 38652 - DNA, 25 bp, Homo sapien
ccgcgtgtttcaaacgtcggacttg

SEQ ID NO: 38653 - DNA, 25 bp, Homo sapien
gttgttttctagtgtggtctgtagc

SEQ ID NO: 38654 - DNA, 25 bp, Homo sapien
gtgtggtctgtagcccaataactgg

SEQ ID NO: 38655 - DNA, 25 bp, Homo sapien
cgagttacagacaaacatcaccgta

SEQ ID NO: 38656 - DNA, 25 bp, Homo sapien
catcaccgtaaatgactcacaacat

SEQ ID NO: 38657 - DNA, 25 bp, Homo sapien
gtggttgcaaactcttaatttatac

SEQ ID NO: 38658 - DNA, 25 bp, Homo sapien
actgttacagttccttgttttgtct

SEQ ID NO: 38659 - DNA, 25 bp, Homo sapien
cagtaaagtagggcctgccgtttct

SEQ ID NO: 38660 - DNA, 25 bp, Homo sapien
gaaaccttggtgaattcatcctagg

SEQ ID NO: 38661 - DNA, 25 bp, Homo sapien
gggactatgacgtcagtacaagcca

SEQ ID NO: 38662 - DNA, 25 bp, Homo sapien
gggataaccttcttgcaggtctgat

SEQ ID NO: 38663 - DNA, 25 bp, Homo sapien
ggtctgatttttcatgtaaggcggg

SEQ ID NO: 38664 - DNA, 25 bp, Homo sapien
gagaagcactacacctgactggctt

SEQ ID NO: 38665 - DNA, 25 bp, Homo sapien
ggttgaggatgaatcttcggtgtaa

SEQ ID NO: 38666 - DNA, 25 bp, Homo sapien
aaatatttcatatcccatcaagttg

SEQ ID NO: 38667 - DNA, 25 bp, Homo sapien
aatgagtcatgatttgttgcaccca

SEQ ID NO: 38668 - DNA, 25 bp, Homo sapien
tatgggaggtggcaccatggtgctt

SEQ ID NO: 38669 - DNA, 25 bp, Homo sapien
catggtgctttggaggcgttggtaa

SEQ ID NO: 38670 - DNA, 25 bp, Homo sapien
tggtaagatgtgaccctctgttgcc

SEQ ID NO: 38671 - DNA, 25 bp, Homo sapien
cctatgcccataaaccagtggtggg

SEQ ID NO: 38672 - DNA, 25 bp, Homo sapien
ggagtagatggcaggggcttgttga

SEQ ID NO: 38673 - DNA, 25 bp, Homo sapien
ggcaggggcttgttgaagggattga

SEQ ID NO: 38674 - DNA, 25 bp, Homo sapien
gaacccaagaggccaaggtttcaat

SEQ ID NO: 38675 - DNA, 25 bp, Homo sapien
tggacgttcggaacggaaaggcctg

SEQ ID NO: 38676 - DNA, 25 bp, Homo sapien
ggaacggaaaggcctggaaaagcag

SEQ ID NO: 38677 - DNA, 25 bp, Homo sapien
gaaaagcaggaggtgagatgagcgg

SEQ ID NO: 38678 - DNA, 25 bp, Homo sapien
ccgactccaccgcagagtgggagag

SEQ ID NO: 38679 - DNA, 25 bp, Homo sapien
cagcaatacagaatttcctgccccc

SEQ ID NO: 38680 - DNA, 25 bp, Homo sapien
caccgcagagtgggagaggccgacg

SEQ ID NO: 38681 - DNA, 25 bp, Homo sapien
cagagtgggagaggccgacgctccc

SEQ ID NO: 38682 - DNA, 25 bp, Homo sapien
tcctcatgcaccgaggagccgagcc

SEQ ID NO: 38683 - DNA, 25 bp, Homo sapien
cccacagcacagaaaagctccggct

SEQ ID NO: 38684 - DNA, 25 bp, Homo sapien
cacagcacagaaaagctccggctcc

SEQ ID NO: 38685 - DNA, 25 bp, Homo sapien
cgaggggatggccaggggggccagg

SEQ ID NO: 38686 - DNA, 25 bp, Homo sapien
ctgatgacttaaatccagcgtggag

SEQ ID NO: 38687 - DNA, 25 bp, Homo sapien
atccagcgtggagttgaaaattgcc

SEQ ID NO: 38688 - DNA, 25 bp, Homo sapien
tttcagcattctttttgttcagttt

SEQ ID NO: 38689 - DNA, 25 bp, Homo sapien
gttcagttttagaatcaggattatg

SEQ ID NO: 38690 - DNA, 25 bp, Homo sapien
gattatgtttactccttatttttat

SEQ ID NO: 38691 - DNA, 25 bp, Homo sapien
tatgtttactccttatttttattgg

SEQ ID NO: 38692 - DNA, 25 bp, Homo sapien
acatacagaaaggtgcattcatcat

SEQ ID NO: 38693 - DNA, 25 bp, Homo sapien
ggtgcattcatcataaatgtacagc

SEQ ID NO: 38694 - DNA, 25 bp, Homo sapien
aatgtacagcttggtaaattttcaa

SEQ ID NO: 38695 - DNA, 25 bp, Homo sapien
aaagcaagcatatccagggctgggc

SEQ ID NO: 38696 - DNA, 25 bp, Homo sapien
caagcatatccagggctgggcgcgg

SEQ ID NO: 38697 - DNA, 25 bp, Homo sapien
gttgattcatgttctgagtccatat

SEQ ID NO: 38698 - DNA, 25 bp, Homo sapien
gttctgagtccatatgatgagacac

SEQ ID NO: 38699 - DNA, 25 bp, Homo sapien
gatgagacacattacgatggaattg

SEQ ID NO: 38700 - DNA, 25 bp, Homo sapien
ttacgatggaattgtcacttttgtt

SEQ ID NO: 38701 - DNA, 25 bp, Homo sapien
tcagccctcatttaagctatcagtt

SEQ ID NO: 38702 - DNA, 25 bp, Homo sapien
ttaagctatcagttggtaaccactt

SEQ ID NO: 38703 - DNA, 25 bp, Homo sapien
cagttggtaaccacttgggtaatct

SEQ ID NO: 38704 - DNA, 25 bp, Homo sapien
catttatttggtcacattggtaacc

SEQ ID NO: 38705 - DNA, 25 bp, Homo sapien
ttggtcacattggtaaccaacattg

SEQ ID NO: 38706 - DNA, 25 bp, Homo sapien
aaagttccttgcaacagaatgacta

SEQ ID NO: 38707 - DNA, 25 bp, Homo sapien
gtaatatggattagtggccgggcgc

SEQ ID NO: 38708 - DNA, 25 bp, Homo sapien
ggatgtttctcattttccatgattt

SEQ ID NO: 38709 - DNA, 25 bp, Homo sapien
tttcagttttcttgccatattccac

SEQ ID NO: 38710 - DNA, 25 bp, Homo sapien
tattccacgtcctacagtggacatt

SEQ ID NO: 38711 - DNA, 25 bp, Homo sapien
tcgccatatttcacgtcctaaagtg

SEQ ID NO: 38712 - DNA, 25 bp, Homo sapien
aagtgtgtatttctcattttccgtg

SEQ ID NO: 38713 - DNA, 25 bp, Homo sapien
ttccgtgattttcagttttctcgcc

SEQ ID NO: 38714 - DNA, 25 bp, Homo sapien
gatttcgtcatttttcaagtcgtca

SEQ ID NO: 38715 - DNA, 25 bp, Homo sapien
agtcgtcaagtggatgtttctcatt

SEQ ID NO: 38716 - DNA, 25 bp, Homo sapien
tgccatattccacgtcctacagtgg

SEQ ID NO: 38717 - DNA, 25 bp, Homo sapien
tggacatttctaaattttccacctt

SEQ ID NO: 38718 - DNA, 25 bp, Homo sapien
cgccatatttcacgtcctaaagtgt

SEQ ID NO: 38719 - DNA, 25 bp, Homo sapien
aaattctgagagctctggctgtggt

SEQ ID NO: 38720 - DNA, 25 bp, Homo sapien
ctggctgtggtacatttcttcagat

SEQ ID NO: 38721 - DNA, 25 bp, Homo sapien
gatatttctcatggcctttgatgga

SEQ ID NO: 38722 - DNA, 25 bp, Homo sapien
aaggtgggaaaactggctgaggact

SEQ ID NO: 38723 - DNA, 25 bp, Homo sapien
ctcaacactcaaatgattgctgctg

SEQ ID NO: 38724 - DNA, 25 bp, Homo sapien
attgctgctggtattctgtaaaaaa

SEQ ID NO: 38725 - DNA, 25 bp, Homo sapien
ggtgcatatttctgtcatgtctgct

SEQ ID NO: 38726 - DNA, 25 bp, Homo sapien
tgtcatgtctgctaggtatgccttt

SEQ ID NO: 38727 - DNA, 25 bp, Homo sapien
ctaggtatgcctttatagcttagct

SEQ ID NO: 38728 - DNA, 25 bp, Homo sapien
aaggtaagattttctcctaccactg

SEQ ID NO: 38729 - DNA, 25 bp, Homo sapien
ctcctaccactgaataccactgtgt

SEQ ID NO: 38730 - DNA, 25 bp, Homo sapien
atgggagtgtcaccctgcaggaagt

SEQ ID NO: 38731 - DNA, 25 bp, Homo sapien
ggcaggatctctgatcagggagctg

SEQ ID NO: 38732 - DNA, 25 bp, Homo sapien
tgctgtccccaagtaaatgctcatc

SEQ ID NO: 38733 - DNA, 25 bp, Homo sapien
gtaaatgctcatccctaggtttaga

SEQ ID NO: 38734 - DNA, 25 bp, Homo sapien
ggtttagagctgacctgggttttgg

SEQ ID NO: 38735 - DNA, 25 bp, Homo sapien
ctcaaccccagaccctgtgtaatag

SEQ ID NO: 38736 - DNA, 25 bp, Homo sapien
cacagatcaatagccacactcttcc

SEQ ID NO: 38737 - DNA, 25 bp, Homo sapien
ttgacaccaagttatcatcccagaa

SEQ ID NO: 38738 - DNA, 25 bp, Homo sapien
aagtccagatgctagacgtggcccc

SEQ ID NO: 38739 - DNA, 25 bp, Homo sapien
gacgtggccccttaatattgagcaa

SEQ ID NO: 38740 - DNA, 25 bp, Homo sapien
tttgattgcaatcctgcttgttttt

SEQ ID NO: 38741 - DNA, 25 bp, Homo sapien
cacctggatttggggttcatctctg

SEQ ID NO: 38742 - DNA, 25 bp, Homo sapien
ttcatctctgtgccctaaggatctg

SEQ ID NO: 38743 - DNA, 25 bp, Homo sapien
ggatctgctatgaccaatcctcttt

SEQ ID NO: 38744 - DNA, 25 bp, Homo sapien
atcctctttttgtaggtgggtctct

SEQ ID NO: 38745 - DNA, 25 bp, Homo sapien
ggtgggtctctggcttaagtattga

SEQ ID NO: 38746 - DNA, 25 bp, Homo sapien
ataggcttcagcggtttgtgtctct

SEQ ID NO: 38747 - DNA, 25 bp, Homo sapien
tcaagccagtagtagctcacttcct

SEQ ID NO: 38748 - DNA, 25 bp, Homo sapien
gtagctcacttcctttgtaaattcc

SEQ ID NO: 38749 - DNA, 25 bp, Homo sapien
cctttgtaaattcctgcttcagtct

SEQ ID NO: 38750 - DNA, 25 bp, Homo sapien
gcttcagtctgggatccgtaggagt

SEQ ID NO: 38751 - DNA, 25 bp, Homo sapien
tgtgagaacttctgaaacgtctcca

SEQ ID NO: 38752 - DNA, 25 bp, Homo sapien
tgctcaccggtcagtgctggtgtga

SEQ ID NO: 38753 - DNA, 25 bp, Homo sapien
gtgctggtgtgacatgatggctgag

SEQ ID NO: 38754 - DNA, 25 bp, Homo sapien
tattcctcaaattgctttgtgctgt

SEQ ID NO: 38755 - DNA, 25 bp, Homo sapien
aacgctacccagaaaggctcatgtt

SEQ ID NO: 38756 - DNA, 25 bp, Homo sapien
ggctcatgttcattactcaagtcac

SEQ ID NO: 38757 - DNA, 25 bp, Homo sapien
attactcaagtcacttcaccagaaa

SEQ ID NO: 38758 - DNA, 25 bp, Homo sapien
gtgacagagccagaattcgaaccca

SEQ ID NO: 38759 - DNA, 25 bp, Homo sapien
aattcgaacccaggtctgccagatt

SEQ ID NO: 38760 - DNA, 25 bp, Homo sapien
gctcattgcaagggagtcttcttca

SEQ ID NO: 38761 - DNA, 25 bp, Homo sapien
cttcttcaaggttattctcaggact

SEQ ID NO: 38762 - DNA, 25 bp, Homo sapien
ggggacgggcatctatgatcccagc

SEQ ID NO: 38763 - DNA, 25 bp, Homo sapien
gaaccacccctagatattgcatatg

SEQ ID NO: 38764 - DNA, 25 bp, Homo sapien
aatgattgcaaataccgccgcagct

SEQ ID NO: 38765 - DNA, 25 bp, Homo sapien
agctacgactcggatttcactgctc

SEQ ID NO: 38766 - DNA, 25 bp, Homo sapien
gaggggctttttggaattcggtgcg

SEQ ID NO: 38767 - DNA, 25 bp, Homo sapien
ggtgcgatctgtaagtcgttgtcga

SEQ ID NO: 38768 - DNA, 25 bp, Homo sapien
gcaggagtttaagtcccatttgccc

SEQ ID NO: 38769 - DNA, 25 bp, Homo sapien
tctcgaagtcggagtccttctccaa

SEQ ID NO: 38770 - DNA, 25 bp, Homo sapien
ctcctttgacccagtgcgtggaaac

SEQ ID NO: 38771 - DNA, 25 bp, Homo sapien
tggaaacagctgctttctccagtgc

SEQ ID NO: 38772 - DNA, 25 bp, Homo sapien
ctgcctcagacctcacttaagataa

SEQ ID NO: 38773 - DNA, 25 bp, Homo sapien
aaaaggcaattctgtgtatcacccc

SEQ ID NO: 38774 - DNA, 25 bp, Homo sapien
gacagtggatttagggatctcagat

SEQ ID NO: 38775 - DNA, 25 bp, Homo sapien
attccagtgccacagatgaacccac

SEQ ID NO: 38776 - DNA, 25 bp, Homo sapien
gccacagatgaacccacaaggacat

SEQ ID NO: 38777 - DNA, 25 bp, Homo sapien
acaaggacatagctgttccctaact

SEQ ID NO: 38778 - DNA, 25 bp, Homo sapien
gttccctaacttggtggatggctcc

SEQ ID NO: 38779 - DNA, 25 bp, Homo sapien
atggctccagtttgcttttaacgaa

SEQ ID NO: 38780 - DNA, 25 bp, Homo sapien
gaatgatgtctctgaaagctgtcct

SEQ ID NO: 38781 - DNA, 25 bp, Homo sapien
aaagctgtcctttcagatgagggag

SEQ ID NO: 38782 - DNA, 25 bp, Homo sapien
aaggatttcacacttcagaatattt

SEQ ID NO: 38783 - DNA, 25 bp, Homo sapien
tccagtcttggagtagtctaacaga

SEQ ID NO: 38784 - DNA, 25 bp, Homo sapien
gtatttatcatgatgggtcacatat

SEQ ID NO: 38785 - DNA, 25 bp, Homo sapien
gagcgaggaagtggcgacagcacgg

SEQ ID NO: 38786 - DNA, 25 bp, Homo sapien
gcgacagcacggtttgaatctggct

SEQ ID NO: 38787 - DNA, 25 bp, Homo sapien
gatgttcgggggaagggctcttatt

SEQ ID NO: 38788 - DNA, 25 bp, Homo sapien
tattttctcccagttataggatcgg

SEQ ID NO: 38789 - DNA, 25 bp, Homo sapien
gaagaaaacctaattccctatctgc

SEQ ID NO: 38790 - DNA, 25 bp, Homo sapien
tccctatctgccaaatgtttctgtt

SEQ ID NO: 38791 - DNA, 25 bp, Homo sapien
gtttctgttggtaatgtcctggcaa

SEQ ID NO: 38792 - DNA, 25 bp, Homo sapien
caacagtgagatgcccccaagaatg

SEQ ID NO: 38793 - DNA, 25 bp, Homo sapien
aaagttctagctatcgactcagccc

SEQ ID NO: 38794 - DNA, 25 bp, Homo sapien
aattctgaattctgtgtgaccttgg

SEQ ID NO: 38795 - DNA, 25 bp, Homo sapien
gatacctacttttggcggggtgcag

SEQ ID NO: 38796 - DNA, 25 bp, Homo sapien
atagcaatagggtctttcctccttt

SEQ ID NO: 38797 - DNA, 25 bp, Homo sapien
gttgatataattccattttgtgcat

SEQ ID NO: 38798 - DNA, 25 bp, Homo sapien
attccattttgtgcatatgtaccat

SEQ ID NO: 38799 - DNA, 25 bp, Homo sapien
tatgtaccattgtgcatgttgctgt

SEQ ID NO: 38800 - DNA, 25 bp, Homo sapien
atgttgctgtttttgatagtcactc

SEQ ID NO: 38801 - DNA, 25 bp, Homo sapien
gatagtcactcttttaatgaatgta

SEQ ID NO: 38802 - DNA, 25 bp, Homo sapien
gaagcttgggctaatagcacttttc

SEQ ID NO: 38803 - DNA, 25 bp, Homo sapien
gctaatagcacttttcttgttccat

SEQ ID NO: 38804 - DNA, 25 bp, Homo sapien
agcacttttcttgttccattcaaac

SEQ ID NO: 38805 - DNA, 25 bp, Homo sapien
aattacaacactgccattttactgt

SEQ ID NO: 38806 - DNA, 25 bp, Homo sapien
actgccattttactgttgtgtttaa

SEQ ID NO: 38807 - DNA, 25 bp, Homo sapien
cctggtggccggaggccgtaactgt

SEQ ID NO: 38808 - DNA, 25 bp, Homo sapien
gccgtaactgtcgcggctgaggggg

SEQ ID NO: 38809 - DNA, 25 bp, Homo sapien
gatgccagagttcatgggtttctag

SEQ ID NO: 38810 - DNA, 25 bp, Homo sapien
atctgctaggagacacccggacagt

SEQ ID NO: 38811 - DNA, 25 bp, Homo sapien
cagaacctggaggctaaacccccag

SEQ ID NO: 38812 - DNA, 25 bp, Homo sapien
gctttctatgccagctgagagtctg

SEQ ID NO: 38813 - DNA, 25 bp, Homo sapien
attactcagcgtctctgaacctcat

SEQ ID NO: 38814 - DNA, 25 bp, Homo sapien
ctcctcccctgtgacatgtagattg

SEQ ID NO: 38815 - DNA, 25 bp, Homo sapien
gctaaacccatctcacagggctatc

SEQ ID NO: 38816 - DNA, 25 bp, Homo sapien
tggtgccggaggccgtaattgtcgc

SEQ ID NO: 38817 - DNA, 25 bp, Homo sapien
aattgtcgcggctgaaggggcttgt

SEQ ID NO: 38818 - DNA, 25 bp, Homo sapien
gaagacagctcaccatggtacctac

SEQ ID NO: 38819 - DNA, 25 bp, Homo sapien
gctcaccatggtacctacaatgcat

SEQ ID NO: 38820 - DNA, 25 bp, Homo sapien
ggtacctacaatgcatcaaaccaag

SEQ ID NO: 38821 - DNA, 25 bp, Homo sapien
gcatcaaaccaaggttggggcatcc

SEQ ID NO: 38822 - DNA, 25 bp, Homo sapien
aaggttggggcatccaggccattta

SEQ ID NO: 38823 - DNA, 25 bp, Homo sapien
ggcatccaggccatttagtgtacac

SEQ ID NO: 38824 - DNA, 25 bp, Homo sapien
tagtgtacacagtgagatccacctc

SEQ ID NO: 38825 - DNA, 25 bp, Homo sapien
agatccacctcactgagtttctgga

SEQ ID NO: 38826 - DNA, 25 bp, Homo sapien
cacctcactgagtttctggatactc

SEQ ID NO: 38827 - DNA, 25 bp, Homo sapien
gcaggggtatggacagcagaggatg

SEQ ID NO: 38828 - DNA, 25 bp, Homo sapien
ggtatggacagcagaggatggcact

SEQ ID NO: 38829 - DNA, 25 bp, Homo sapien
attcccacttggagcacaaagtgaa

SEQ ID NO: 38830 - DNA, 25 bp, Homo sapien
acaggggagggggactagaatcagt

SEQ ID NO: 38831 - DNA, 25 bp, Homo sapien
ggactagaatcagtcccccatagca

SEQ ID NO: 38832 - DNA, 25 bp, Homo sapien
agtcccccatagcaagcacagaaag

SEQ ID NO: 38833 - DNA, 25 bp, Homo sapien
gctgggagctgttgaaggtttgggg

SEQ ID NO: 38834 - DNA, 25 bp, Homo sapien
ctttgttggttcatccttgttttct

SEQ ID NO: 38835 - DNA, 25 bp, Homo sapien
ttgttttctagctttggatcatttt

SEQ ID NO: 38836 - DNA, 25 bp, Homo sapien
ggatcatttttgtaccaaggcgagc

SEQ ID NO: 38837 - DNA, 25 bp, Homo sapien
ggcgagcaagcctttttgaaaaata

SEQ ID NO: 38838 - DNA, 25 bp, Homo sapien
attgcaggcaactctttacatttaa

SEQ ID NO: 38839 - DNA, 25 bp, Homo sapien
aagtgaagtgtcttaacattttata

SEQ ID NO: 38840 - DNA, 25 bp, Homo sapien
tggggctggagctggacagggccct

SEQ ID NO: 38841 - DNA, 25 bp, Homo sapien
ccctgctcccagctagtgggctggg

SEQ ID NO: 38842 - DNA, 25 bp, Homo sapien
ctagtgggctgggatggctcgtaga

SEQ ID NO: 38843 - DNA, 25 bp, Homo sapien
ggatggctcgtagactatgggaaac

SEQ ID NO: 38844 - DNA, 25 bp, Homo sapien
cccctggcaggtaagggcaggtgga

SEQ ID NO: 38845 - DNA, 25 bp, Homo sapien
ctccaacttctttcttcagcagagc

SEQ ID NO: 38846 - DNA, 25 bp, Homo sapien
gggcaggtggaaggtggagctgggg

SEQ ID NO: 38847 - DNA, 25 bp, Homo sapien
ggagctggggagtggagggcagggg

SEQ ID NO: 38848 - DNA, 25 bp, Homo sapien
gatgggggaggaagaactcatccat

SEQ ID NO: 38849 - DNA, 25 bp, Homo sapien
gcctctcctggtgcagcaatgagtc

SEQ ID NO: 38850 - DNA, 25 bp, Homo sapien
tgcagcaatgagtctccaactttcg

SEQ ID NO: 38851 - DNA, 25 bp, Homo sapien
tcacagcactactcttgatgtacta

SEQ ID NO: 38852 - DNA, 25 bp, Homo sapien
cacagagaattgactccttgcccac

SEQ ID NO: 38853 - DNA, 25 bp, Homo sapien
ttgcccacctatactacctttgtgg

SEQ ID NO: 38854 - DNA, 25 bp, Homo sapien
gggtagagactccagtagtgtgctg

SEQ ID NO: 38855 - DNA, 25 bp, Homo sapien
gtattacctttttatgtccagacaa

SEQ ID NO: 38856 - DNA, 25 bp, Homo sapien
tgaaaaagcccagccttgtagcatt

SEQ ID NO: 38857 - DNA, 25 bp, Homo sapien
tagcatttgccagttattgtgtaaa

SEQ ID NO: 38858 - DNA, 25 bp, Homo sapien
gtgtaaatgtccccactatggtgga

SEQ ID NO: 38859 - DNA, 25 bp, Homo sapien
caggttaccactatgatatcacaga

SEQ ID NO: 38860 - DNA, 25 bp, Homo sapien
agcagcaccccattatactatattt

SEQ ID NO: 38861 - DNA, 25 bp, Homo sapien
attttcaccatacagatgcagtcga

SEQ ID NO: 38862 - DNA, 25 bp, Homo sapien
cagggaggggattatgcccactttt

SEQ ID NO: 38863 - DNA, 25 bp, Homo sapien
gctggaagcaggtgatgcgcaacca

SEQ ID NO: 38864 - DNA, 25 bp, Homo sapien
caggtgatgcgcaaccataggtttc

SEQ ID NO: 38865 - DNA, 25 bp, Homo sapien
gatgcgcaaccataggtttcaagca

SEQ ID NO: 38866 - DNA, 25 bp, Homo sapien
caaccataggtttcaagcaagacaa

SEQ ID NO: 38867 - DNA, 25 bp, Homo sapien
ttctctctgactgaggctcacgtgg

SEQ ID NO: 38868 - DNA, 25 bp, Homo sapien
gactgaaaccaagaacgttattctt

SEQ ID NO: 38869 - DNA, 25 bp, Homo sapien
ctctctgactgaggctcacgtggga

SEQ ID NO: 38870 - DNA, 25 bp, Homo sapien
gaacgttattcttaatctggaaatt

SEQ ID NO: 38871 - DNA, 25 bp, Homo sapien
ggaaatttgactgataatattctct

SEQ ID NO: 38872 - DNA, 25 bp, Homo sapien
gactgaggctcacgtgggaaatatg

SEQ ID NO: 38873 - DNA, 25 bp, Homo sapien
ggatttgaaatagcacaggggaagc

SEQ ID NO: 38874 - DNA, 25 bp, Homo sapien
aggtgtgacaggatggccatgggcc

SEQ ID NO: 38875 - DNA, 25 bp, Homo sapien
gtgtgacaggatggccatgggccag

SEQ ID NO: 38876 - DNA, 25 bp, Homo sapien
ctgtctctacttacaatacagaaaa

SEQ ID NO: 38877 - DNA, 25 bp, Homo sapien
tatctgggcatagcggcaggtgcct

SEQ ID NO: 38878 - DNA, 25 bp, Homo sapien
gacttagacatatcaaccagtcaca

SEQ ID NO: 38879 - DNA, 25 bp, Homo sapien
acatatcaaccagtcacaaccagtt

SEQ ID NO: 38880 - DNA, 25 bp, Homo sapien
caaccagtcacaaccagtttggaac

SEQ ID NO: 38881 - DNA, 25 bp, Homo sapien
atgtgaacactaaccatatgtttga

SEQ ID NO: 38882 - DNA, 25 bp, Homo sapien
gtaatgatattgtactcttatgtat

SEQ ID NO: 38883 - DNA, 25 bp, Homo sapien
taaatcctttagagctgtatactga

SEQ ID NO: 38884 - DNA, 25 bp, Homo sapien
aacaatgtcagtaactctgtcaagt

SEQ ID NO: 38885 - DNA, 25 bp, Homo sapien
gtcagtaactctgtcaagtatatga

SEQ ID NO: 38886 - DNA, 25 bp, Homo sapien
tgcaatatagaagtgcctcccttcc

SEQ ID NO: 38887 - DNA, 25 bp, Homo sapien
ttcccagtggacagctgccttgaaa

SEQ ID NO: 38888 - DNA, 25 bp, Homo sapien
gtggacagctgccttgaaagttaag

SEQ ID NO: 38889 - DNA, 25 bp, Homo sapien
gaattatttcttgcacagtgatccc

SEQ ID NO: 38890 - DNA, 25 bp, Homo sapien
tttcttgcacagtgatcccattctc

SEQ ID NO: 38891 - DNA, 25 bp, Homo sapien
gtatagcatgaaggcattgaggtgt

SEQ ID NO: 38892 - DNA, 25 bp, Homo sapien
gaaggcattgaggtgtgttggtatt

SEQ ID NO: 38893 - DNA, 25 bp, Homo sapien
cattgaggtgtgttggtattatttg

SEQ ID NO: 38894 - DNA, 25 bp, Homo sapien
aaagagtaaatgagccaggcttggt

SEQ ID NO: 38895 - DNA, 25 bp, Homo sapien
tattggccaggctgatctctaactc

SEQ ID NO: 38896 - DNA, 25 bp, Homo sapien
ggcctcaagtgatctatctgcctcc

SEQ ID NO: 38897 - DNA, 25 bp, Homo sapien
ctcagcctcccgaatagctggaatt

SEQ ID NO: 38898 - DNA, 25 bp, Homo sapien
tcccaaagtctgggattgcagacaa

SEQ ID NO: 38899 - DNA, 25 bp, Homo sapien
ttgcagacaagtcatcgtacccggc

SEQ ID NO: 38900 - DNA, 25 bp, Homo sapien
aaaccagcatacatatgcaaaacta

SEQ ID NO: 38901 - DNA, 25 bp, Homo sapien
gagaaaaatacttcccattgatcat

SEQ ID NO: 38902 - DNA, 25 bp, Homo sapien
tggaattacgggcatgcaccaccac

SEQ ID NO: 38903 - DNA, 25 bp, Homo sapien
atacttcccattgatcatttttaaa

SEQ ID NO: 38904 - DNA, 25 bp, Homo sapien
aaggcttctgattggatattgtgtt

SEQ ID NO: 38905 - DNA, 25 bp, Homo sapien
aattgatacaactatgcagatttta

SEQ ID NO: 38906 - DNA, 25 bp, Homo sapien
gaggatgcaagagctactgggaagg

SEQ ID NO: 38907 - DNA, 25 bp, Homo sapien
gagctcagtctgaacctgggggatc

SEQ ID NO: 38908 - DNA, 25 bp, Homo sapien
tctccccttgtccactgatgggggg

SEQ ID NO: 38909 - DNA, 25 bp, Homo sapien
ccactgatggggggtctggctgtta

SEQ ID NO: 38910 - DNA, 25 bp, Homo sapien
ctgtacaagtccctgagtttctcat

SEQ ID NO: 38911 - DNA, 25 bp, Homo sapien
cctgagtttctcatctacagcgggc

SEQ ID NO: 38912 - DNA, 25 bp, Homo sapien
ctacagcgggcaggtatgtcttctc

SEQ ID NO: 38913 - DNA, 25 bp, Homo sapien
tgtcttctcgtacaggttctgggcg

SEQ ID NO: 38914 - DNA, 25 bp, Homo sapien
tctttgctgactcccagtaactgga

SEQ ID NO: 38915 - DNA, 25 bp, Homo sapien
gtgaggaaggtcgggctaggcatct

SEQ ID NO: 38916 - DNA, 25 bp, Homo sapien
gctgggaggagtcgtgtgcccatag

SEQ ID NO: 38917 - DNA, 25 bp, Homo sapien
atgcacacaatttactgttggtgtt

SEQ ID NO: 38918 - DNA, 25 bp, Homo sapien
gaccatttgggctaaaaattatatg

SEQ ID NO: 38919 - DNA, 25 bp, Homo sapien
gcaatggattagtatttcttgattt

SEQ ID NO: 38920 - DNA, 25 bp, Homo sapien
ctatattatcactttcaacctcatg

SEQ ID NO: 38921 - DNA, 25 bp, Homo sapien
atattatcactttcaacctcatgtt

SEQ ID NO: 38922 - DNA, 25 bp, Homo sapien
ttatcactttcaacctcatgtttct

SEQ ID NO: 38923 - DNA, 25 bp, Homo sapien
gaaaaactcctcactgacagtgcac

SEQ ID NO: 38924 - DNA, 25 bp, Homo sapien
aaactcctcactgacagtgcaccca

SEQ ID NO: 38925 - DNA, 25 bp, Homo sapien
gtccctaaaacatgaatctgttctt

SEQ ID NO: 38926 - DNA, 25 bp, Homo sapien
tctgttctttgagatcctggtttcc

SEQ ID NO: 38927 - DNA, 25 bp, Homo sapien
ctgttctttgagatcctggtttcct

SEQ ID NO: 38928 - DNA, 25 bp, Homo sapien
gagagatgctttcgatgggagaggt

SEQ ID NO: 38929 - DNA, 25 bp, Homo sapien
gtaacttgtctgaggtctcttggcc

SEQ ID NO: 38930 - DNA, 25 bp, Homo sapien
ggtctcttggccgtaaagggacaat

SEQ ID NO: 38931 - DNA, 25 bp, Homo sapien
gggacaatattgcaccagcagccac

SEQ ID NO: 38932 - DNA, 25 bp, Homo sapien
agccacatgcctgaccatttatgta

SEQ ID NO: 38933 - DNA, 25 bp, Homo sapien
gcctgaccatttatgtagcttctga

SEQ ID NO: 38934 - DNA, 25 bp, Homo sapien
gtagcttctgactagcactaaattt

SEQ ID NO: 38935 - DNA, 25 bp, Homo sapien
gtctgatttatctctaacatgcttg

SEQ ID NO: 38936 - DNA, 25 bp, Homo sapien
atttttactccataattctggtaca

SEQ ID NO: 38937 - DNA, 25 bp, Homo sapien
ataacagttgatcctaccagcttac

SEQ ID NO: 38938 - DNA, 25 bp, Homo sapien
tccacttttttgcttcttgggctaa

SEQ ID NO: 38939 - DNA, 25 bp, Homo sapien
ctccaccacacactgaatctgtagc

SEQ ID NO: 38940 - DNA, 25 bp, Homo sapien
tctgtagcttccggataccgtagcc

SEQ ID NO: 38941 - DNA, 25 bp, Homo sapien
cccatgggcaccagcttggaggccc

SEQ ID NO: 38942 - DNA, 25 bp, Homo sapien
gctcttccagctggatggagcacac

SEQ ID NO: 38943 - DNA, 25 bp, Homo sapien
ctcatcgtcccaaggcttgaaatcc

SEQ ID NO: 38944 - DNA, 25 bp, Homo sapien
gcaggatggaggacttggccaccag

SEQ ID NO: 38945 - DNA, 25 bp, Homo sapien
ggccaccagttcaggcttcttggcc

SEQ ID NO: 38946 - DNA, 25 bp, Homo sapien
gcaaaagtctttaatcctggcaggg

SEQ ID NO: 38947 - DNA, 25 bp, Homo sapien
cacacacacactcaggattcagatc

SEQ ID NO: 38948 - DNA, 25 bp, Homo sapien
aagctgcgatatcgacactctgcac

SEQ ID NO: 38949 - DNA, 25 bp, Homo sapien
cgtgctcctcaaacttggtgatctc

SEQ ID NO: 38950 - DNA, 25 bp, Homo sapien
cttcagttaaatgctctttggcaga

SEQ ID NO: 38951 - DNA, 25 bp, Homo sapien
aagtatacatttaggcagggtgcag

SEQ ID NO: 38952 - DNA, 25 bp, Homo sapien
gatgggcaggtgggagcacctggga

SEQ ID NO: 38953 - DNA, 25 bp, Homo sapien
ggaggggttggggatgctgtggacc

SEQ ID NO: 38954 - DNA, 25 bp, Homo sapien
tgctgtggacctaggggcagggacc

SEQ ID NO: 38955 - DNA, 25 bp, Homo sapien
ggcagggaccaggacctgccaacga

SEQ ID NO: 38956 - DNA, 25 bp, Homo sapien
ctgccaacgagatgtggcctgtcca

SEQ ID NO: 38957 - DNA, 25 bp, Homo sapien
gaggagggctgggtggtgcagaacc

SEQ ID NO: 38958 - DNA, 25 bp, Homo sapien
ggatgtgaacattgccttgtgccag

SEQ ID NO: 38959 - DNA, 25 bp, Homo sapien
gtgccaggaactgttcccagaacag

SEQ ID NO: 38960 - DNA, 25 bp, Homo sapien
gggtggggatcactagtgtgtctga

SEQ ID NO: 38961 - DNA, 25 bp, Homo sapien
caacatcatctaagggctctcacgg

SEQ ID NO: 38962 - DNA, 25 bp, Homo sapien
atctaagggctctcacggagggcct

SEQ ID NO: 38963 - DNA, 25 bp, Homo sapien
ggcatttgcacatatcctgacaagc

SEQ ID NO: 38964 - DNA, 25 bp, Homo sapien
gcacatatcctgacaagcctgaaag

SEQ ID NO: 38965 - DNA, 25 bp, Homo sapien
aagcctgaaagaagctccgggtgcc

SEQ ID NO: 38966 - DNA, 25 bp, Homo sapien
cattgttcccgggactgaggcccgg

SEQ ID NO: 38967 - DNA, 25 bp, Homo sapien
aaagggaagcgacgtggcagggcca

SEQ ID NO: 38968 - DNA, 25 bp, Homo sapien
gcctttctctagactgagcaccatt

SEQ ID NO: 38969 - DNA, 25 bp, Homo sapien
tgcagagatggatgccaactccctg

SEQ ID NO: 38970 - DNA, 25 bp, Homo sapien
gccaactccctggcaggggcaggac

SEQ ID NO: 38971 - DNA, 25 bp, Homo sapien
gccacaccccaagtctgtaagggcc

SEQ ID NO: 38972 - DNA, 25 bp, Homo sapien
tggacgcccccttgagtagtaagga

SEQ ID NO: 38973 - DNA, 25 bp, Homo sapien
tgttcttttcagctacgtagcccag

SEQ ID NO: 38974 - DNA, 25 bp, Homo sapien
ttcagctacgtagcccagtggttct

SEQ ID NO: 38975 - DNA, 25 bp, Homo sapien
agcccagtggttctccacttaggct

SEQ ID NO: 38976 - DNA, 25 bp, Homo sapien
ctccacttaggcttcacacttgaat

SEQ ID NO: 38977 - DNA, 25 bp, Homo sapien
cacttaggcttcacacttgaatcat

SEQ ID NO: 38978 - DNA, 25 bp, Homo sapien
taaactatagtgatgcctggcggtg

SEQ ID NO: 38979 - DNA, 25 bp, Homo sapien
tagtgatgcctggcggtgtcttact

SEQ ID NO: 38980 - DNA, 25 bp, Homo sapien
tgtcttactcgcagagcttctggtt

SEQ ID NO: 38981 - DNA, 25 bp, Homo sapien
gagcttctggtttgattggtctagg

SEQ ID NO: 38982 - DNA, 25 bp, Homo sapien
tggtttgattggtctaggttgcagc

SEQ ID NO: 38983 - DNA, 25 bp, Homo sapien
gatgactatcattgctggccataga

SEQ ID NO: 38984 - DNA, 25 bp, Homo sapien
gatgttaaaatgttggcttgccatg

SEQ ID NO: 38985 - DNA, 25 bp, Homo sapien
tggcttgccatgaaaactgctattt

SEQ ID NO: 38986 - DNA, 25 bp, Homo sapien
aggatgtccttctctaatttggaaa

SEQ ID NO: 38987 - DNA, 25 bp, Homo sapien
ttacaataaaatacaggccaggcac

SEQ ID NO: 38988 - DNA, 25 bp, Homo sapien
gggaggatcacttaaagccacaaat

SEQ ID NO: 38989 - DNA, 25 bp, Homo sapien
aagccacaaattcaagaccaacctg

SEQ ID NO: 38990 - DNA, 25 bp, Homo sapien
aatacataggctgggcgcggtgact

SEQ ID NO: 38991 - DNA, 25 bp, Homo sapien
gtgatcagatcacttggggtccgtc

SEQ ID NO: 38992 - DNA, 25 bp, Homo sapien
accagcctggcaaacatagtaaaac

SEQ ID NO: 38993 - DNA, 25 bp, Homo sapien
ggtggtacatgtctgtagtcccagc

SEQ ID NO: 38994 - DNA, 25 bp, Homo sapien
cccgagtcggagtctcgctgtgttg

SEQ ID NO: 38995 - DNA, 25 bp, Homo sapien
gagtgcagtgacaggatctcggctc

SEQ ID NO: 38996 - DNA, 25 bp, Homo sapien
cctccacttcctgggttcaaatgat

SEQ ID NO: 38997 - DNA, 25 bp, Homo sapien
gtggctgggactatttttgtatttt

SEQ ID NO: 38998 - DNA, 25 bp, Homo sapien
gcctcgcaacgtgctgggattacag

SEQ ID NO: 38999 - DNA, 25 bp, Homo sapien
gcatgcctggccactaatttttata

SEQ ID NO: 39000 - DNA, 25 bp, Homo sapien
tagagattgggtttcgccacgttac

SEQ ID NO: 39001 - DNA, 25 bp, Homo sapien
tcctactttctttgctccaaggtag

SEQ ID NO: 39002 - DNA, 25 bp, Homo sapien
caggagctatagtgccagctacccg

SEQ ID NO: 39003 - DNA, 25 bp, Homo sapien
gtgggataattacttgaacctgaga

SEQ ID NO: 39004 - DNA, 25 bp, Homo sapien
gctccagcctgagctacagagcaag

SEQ ID NO: 39005 - DNA, 25 bp, Homo sapien
tgaaaattaaacaggtgtccgggtg

SEQ ID NO: 39006 - DNA, 25 bp, Homo sapien
tcatgcctgtaatccgagcacttgt

SEQ ID NO: 39007 - DNA, 25 bp, Homo sapien
aatccgagcacttgtggaggccgag

SEQ ID NO: 39008 - DNA, 25 bp, Homo sapien
ggcaggcggattacttgaggtcagg

SEQ ID NO: 39009 - DNA, 25 bp, Homo sapien
gaggtcaggacttcgaaaccagcct

SEQ ID NO: 39010 - DNA, 25 bp, Homo sapien
tggccaacatggtgagatcccatct

SEQ ID NO: 39011 - DNA, 25 bp, Homo sapien
atggtgagatcccatctctactaaa

SEQ ID NO: 39012 - DNA, 25 bp, Homo sapien
aggtgtggtgtcacgcacctgtagt

SEQ ID NO: 39013 - DNA, 25 bp, Homo sapien
cctgtagtcccagttacttgaacct

SEQ ID NO: 39014 - DNA, 25 bp, Homo sapien
gggaggcagaggttggagcgagccg

SEQ ID NO: 39015 - DNA, 25 bp, Homo sapien
gagcgagccgagattgcaacactgc

SEQ ID NO: 39016 - DNA, 25 bp, Homo sapien
ggaacaggagcaactactaaaagag

SEQ ID NO: 39017 - DNA, 25 bp, Homo sapien
gatacaggatctccagacgaaaatg

SEQ ID NO: 39018 - DNA, 25 bp, Homo sapien
gagacgacgaaaggcatgtaccata

SEQ ID NO: 39019 - DNA, 25 bp, Homo sapien
ggcatgtaccataagctaaagacca

SEQ ID NO: 39020 - DNA, 25 bp, Homo sapien
ctaaagaccagagccttcctgtcac

SEQ ID NO: 39021 - DNA, 25 bp, Homo sapien
tgtcacccctaaccaaggcataatt

SEQ ID NO: 39022 - DNA, 25 bp, Homo sapien
gaatttggaacaagcgtcactacat

SEQ ID NO: 39023 - DNA, 25 bp, Homo sapien
ggaacaagcgtcactacatttgata

SEQ ID NO: 39024 - DNA, 25 bp, Homo sapien
aagcgtcactacatttgataataat

SEQ ID NO: 39025 - DNA, 25 bp, Homo sapien
aaagtttataaaggcatgtggtaca

SEQ ID NO: 39026 - DNA, 25 bp, Homo sapien
ggcatgtggtacaatgatcaaaatc

SEQ ID NO: 39027 - DNA, 25 bp, Homo sapien
ccgcgctccagcaggtgcgcggagc

SEQ ID NO: 39028 - DNA, 25 bp, Homo sapien
acggaggccagggcagttctggacc

SEQ ID NO: 39029 - DNA, 25 bp, Homo sapien
tggaccctcggctcagggagggttc

SEQ ID NO: 39030 - DNA, 25 bp, Homo sapien
tcttgatcctggggctctgattagg

SEQ ID NO: 39031 - DNA, 25 bp, Homo sapien
ggggctctgattaggggactgagac

SEQ ID NO: 39032 - DNA, 25 bp, Homo sapien
ggggactgagacggggagtgattgg

SEQ ID NO: 39033 - DNA, 25 bp, Homo sapien
ggagtgattgggcgagctgagctgc

SEQ ID NO: 39034 - DNA, 25 bp, Homo sapien
tgccgggtggtggtcttgatgtagc

SEQ ID NO: 39035 - DNA, 25 bp, Homo sapien
ggtggtcttgatgtagcagggggtg

SEQ ID NO: 39036 - DNA, 25 bp, Homo sapien
tgatgtagcagggggtgatgagcgg

SEQ ID NO: 39037 - DNA, 25 bp, Homo sapien
tgaacacgttctggaagccatccgc

SEQ ID NO: 39038 - DNA, 25 bp, Homo sapien
ccactagggaggccttcaccaaggt

SEQ ID NO: 39039 - DNA, 25 bp, Homo sapien
tagggaggccttcaccaaggtgaca

SEQ ID NO: 39040 - DNA, 25 bp, Homo sapien
gaggccttcaccaaggtgacagacc

SEQ ID NO: 39041 - DNA, 25 bp, Homo sapien
ggccttcaccaaggtgacagacctg

SEQ ID NO: 39042 - DNA, 25 bp, Homo sapien
tgacagacctggaggctcgggtgca

SEQ ID NO: 39043 - DNA, 25 bp, Homo sapien
cgctgggaggcccggaagcgggcgt

SEQ ID NO: 39044 - DNA, 25 bp, Homo sapien
tgggaggcccggaagcgggcgtgca

SEQ ID NO: 39045 - DNA, 25 bp, Homo sapien
gaggcccggaagcgggcgtgcagtg

SEQ ID NO: 39046 - DNA, 25 bp, Homo sapien
ggcccggaagcgggcgtgcagtgca

SEQ ID NO: 39047 - DNA, 25 bp, Homo sapien
gcaccttggaggatgtctacaaccg

SEQ ID NO: 39048 - DNA, 25 bp, Homo sapien
cttggaggatgtctacaaccgcacc

SEQ ID NO: 39049 - DNA, 25 bp, Homo sapien
agagcaggtatgacgtggcgctgtg

SEQ ID NO: 39050 - DNA, 25 bp, Homo sapien
gacgtggcgctgtgtcatgtgaatt

SEQ ID NO: 39051 - DNA, 25 bp, Homo sapien
tggcgctgtgtcatgtgaatttccc

SEQ ID NO: 39052 - DNA, 25 bp, Homo sapien
atgtgaatttcccaagaagcatttc

SEQ ID NO: 39053 - DNA, 25 bp, Homo sapien
gcatttcatctgtgattccgtatga

SEQ ID NO: 39054 - DNA, 25 bp, Homo sapien
gattccgtatgaaggctttctaagc

SEQ ID NO: 39055 - DNA, 25 bp, Homo sapien
ggctttctaagccctgaaatttgca

SEQ ID NO: 39056 - DNA, 25 bp, Homo sapien
tttgcagggtcatttcctcagtttg

SEQ ID NO: 39057 - DNA, 25 bp, Homo sapien
gggtcatttcctcagtttgtgtatt

SEQ ID NO: 39058 - DNA, 25 bp, Homo sapien
tgtattaaagaaaagctgccccagc

SEQ ID NO: 39059 - DNA, 25 bp, Homo sapien
ggtttccagtgtttaacactgtata

SEQ ID NO: 39060 - DNA, 25 bp, Homo sapien
atgtataatacaccctgaaaatttt

SEQ ID NO: 39061 - DNA, 25 bp, Homo sapien
tcacttctgtttagatctgagacac

SEQ ID NO: 39062 - DNA, 25 bp, Homo sapien
attgtaacctgataatacttcgcat

SEQ ID NO: 39063 - DNA, 25 bp, Homo sapien
aatacttcgcattagtcctcatttc

SEQ ID NO: 39064 - DNA, 25 bp, Homo sapien
cttcgcattagtcctcatttcaaat

SEQ ID NO: 39065 - DNA, 25 bp, Homo sapien
attagtcctcatttcaaatatgtga

SEQ ID NO: 39066 - DNA, 25 bp, Homo sapien
gaatttgagatttgactttgtttgc

SEQ ID NO: 39067 - DNA, 25 bp, Homo sapien
gagatttgactttgtttgctttaat

SEQ ID NO: 39068 - DNA, 25 bp, Homo sapien
ggctgagctgggaagatagcttaaa

SEQ ID NO: 39069 - DNA, 25 bp, Homo sapien
atacctaggattagacacttttaga

SEQ ID NO: 39070 - DNA, 25 bp, Homo sapien
tgctaggcaagcataatttgtatat

SEQ ID NO: 39071 - DNA, 25 bp, Homo sapien
gatcgactccactgagaagagcatg

SEQ ID NO: 39072 - DNA, 25 bp, Homo sapien
tgagaagagcatgggggcctcccga

SEQ ID NO: 39073 - DNA, 25 bp, Homo sapien
tattgcatctaccaacatattcagt

SEQ ID NO: 39074 - DNA, 25 bp, Homo sapien
gcatctaccaacatattcagtggat

SEQ ID NO: 39075 - DNA, 25 bp, Homo sapien
tccagcatttgcggatagctccaaa

SEQ ID NO: 39076 - DNA, 25 bp, Homo sapien
gcggatagctccaaactgggatata

SEQ ID NO: 39077 - DNA, 25 bp, Homo sapien
aactgggatatacgggccaaggttg

SEQ ID NO: 39078 - DNA, 25 bp, Homo sapien
cagtggataagttattatttctgaa

SEQ ID NO: 39079 - DNA, 25 bp, Homo sapien
gactttttgcaacaagtgtgctcgc

SEQ ID NO: 39080 - DNA, 25 bp, Homo sapien
aacaagtgtgctcgcagatcgactc

SEQ ID NO: 39081 - DNA, 25 bp, Homo sapien
ctcgcagatcgactccactgagaag

SEQ ID NO: 39082 - DNA, 25 bp, Homo sapien
aaatcttacttagctgacaactagg

SEQ ID NO: 39083 - DNA, 25 bp, Homo sapien
gacaactaggagtaaaagctctgac

SEQ ID NO: 39084 - DNA, 25 bp, Homo sapien
atactgagatcattctatcttaaca

SEQ ID NO: 39085 - DNA, 25 bp, Homo sapien
gatcattctatcttaacaaacttaa

SEQ ID NO: 39086 - DNA, 25 bp, Homo sapien
gatgcagtttgcaaatatagtcaat

SEQ ID NO: 39087 - DNA, 25 bp, Homo sapien
aatattctcaagtgtacgtagctca

SEQ ID NO: 39088 - DNA, 25 bp, Homo sapien
agtgtacgtagctcaatttcatttg

SEQ ID NO: 39089 - DNA, 25 bp, Homo sapien
gtagctcaatttcatttgcagcaaa

SEQ ID NO: 39090 - DNA, 25 bp, Homo sapien
aacactgttctcaagataggcaagt

SEQ ID NO: 39091 - DNA, 25 bp, Homo sapien
gattaagagcactgactgggccggg

SEQ ID NO: 39092 - DNA, 25 bp, Homo sapien
gagaatggtgtaatcccgggaggtg

SEQ ID NO: 39093 - DNA, 25 bp, Homo sapien
accataacatcctggtgagtctggc

SEQ ID NO: 39094 - DNA, 25 bp, Homo sapien
gccagggagggacaactgtgtctac

SEQ ID NO: 39095 - DNA, 25 bp, Homo sapien
acaactgtgtctactctggaggtgc

SEQ ID NO: 39096 - DNA, 25 bp, Homo sapien
tctactctggaggtgcccatgggga

SEQ ID NO: 39097 - DNA, 25 bp, Homo sapien
gcccatggggaggacaaggcacccc

SEQ ID NO: 39098 - DNA, 25 bp, Homo sapien
cccagcccgagttcgtagggctctg

SEQ ID NO: 39099 - DNA, 25 bp, Homo sapien
cccgagttcgtagggctctgtagag

SEQ ID NO: 39100 - DNA, 25 bp, Homo sapien
agggctctgtagagaggccactggc

SEQ ID NO: 39101 - DNA, 25 bp, Homo sapien
gaggccactggcagagacttttgtg

SEQ ID NO: 39102 - DNA, 25 bp, Homo sapien
ctcactctgccctttcaaaagtcaa

SEQ ID NO: 39103 - DNA, 25 bp, Homo sapien
aaaagtcaaaggcacgccgggcaca

SEQ ID NO: 39104 - DNA, 25 bp, Homo sapien
gccccagttgatgagcggcgtgtcc

SEQ ID NO: 39105 - DNA, 25 bp, Homo sapien
tccctcgaaatcgtggcatctcact

SEQ ID NO: 39106 - DNA, 25 bp, Homo sapien
cgaaatcgtggcatctcacttctga

SEQ ID NO: 39107 - DNA, 25 bp, Homo sapien
gtggcatctcacttctgagaacgaa

SEQ ID NO: 39108 - DNA, 25 bp, Homo sapien
tcactctgccgaaggcgctgacggc

SEQ ID NO: 39109 - DNA, 25 bp, Homo sapien
tgccgaaggcgctgacggcatcgcg

SEQ ID NO: 39110 - DNA, 25 bp, Homo sapien
cgccgctccgtgggaaaaaacagct

SEQ ID NO: 39111 - DNA, 25 bp, Homo sapien
ggaaaaaacagctcctccatttcct

SEQ ID NO: 39112 - DNA, 25 bp, Homo sapien
gctcctccatttccttgaaaactga

SEQ ID NO: 39113 - DNA, 25 bp, Homo sapien
aaacttcgctggaaatgagtagcca

SEQ ID NO: 39114 - DNA, 25 bp, Homo sapien
caggaagttcaggggagggtgccgg

SEQ ID NO: 39115 - DNA, 25 bp, Homo sapien
gacacagatccaaatcatatcagct

SEQ ID NO: 39116 - DNA, 25 bp, Homo sapien
atcatatcagctactttggaagaca

SEQ ID NO: 39117 - DNA, 25 bp, Homo sapien
gaagacagtatagaagtttctctta

SEQ ID NO: 39118 - DNA, 25 bp, Homo sapien
aaaactgaacgtactcttaccatat

SEQ ID NO: 39119 - DNA, 25 bp, Homo sapien
gatccagtaatgatactccttggta

SEQ ID NO: 39120 - DNA, 25 bp, Homo sapien
aaacgaacccacacatggatatttt

SEQ ID NO: 39121 - DNA, 25 bp, Homo sapien
aagagtttcagtcataattgccaaa

SEQ ID NO: 39122 - DNA, 25 bp, Homo sapien
aagaaatgagcaggccaggcacagt

SEQ ID NO: 39123 - DNA, 25 bp, Homo sapien
gggagttcgaggtgggtggattgcc

SEQ ID NO: 39124 - DNA, 25 bp, Homo sapien
ggtgggtggattgcctaaggtcagg

SEQ ID NO: 39125 - DNA, 25 bp, Homo sapien
tgagcagagatcacgccattgcact

SEQ ID NO: 39126 - DNA, 25 bp, Homo sapien
tgggtgaggacaagttccagtggct

SEQ ID NO: 39127 - DNA, 25 bp, Homo sapien
gacctcactggcaaaggctaggccc

SEQ ID NO: 39128 - DNA, 25 bp, Homo sapien
ctcactggcaaaggctaggcccgga

SEQ ID NO: 39129 - DNA, 25 bp, Homo sapien
actggcaaaggctaggcccggagca

SEQ ID NO: 39130 - DNA, 25 bp, Homo sapien
agcaccctaggcgctggattttggg

SEQ ID NO: 39131 - DNA, 25 bp, Homo sapien
accctaggcgctggattttgggaca

SEQ ID NO: 39132 - DNA, 25 bp, Homo sapien
gggacaaaactatttttcagagcgt

SEQ ID NO: 39133 - DNA, 25 bp, Homo sapien
actatttttcagagcgttgtaccgg

SEQ ID NO: 39134 - DNA, 25 bp, Homo sapien
atttttcagagcgttgtaccggcac

SEQ ID NO: 39135 - DNA, 25 bp, Homo sapien
ttttcagagcgttgtaccggcactt

SEQ ID NO: 39136 - DNA, 25 bp, Homo sapien
cgttgtaccggcactttatatatat

SEQ ID NO: 39137 - DNA, 25 bp, Homo sapien
cagttgtatttgttccaaaacttgt

SEQ ID NO: 39138 - DNA, 25 bp, Homo sapien
ggaaagacctgataaaagacgtgtt

SEQ ID NO: 39139 - DNA, 25 bp, Homo sapien
aaatgctgtggaattaggtgtgggt

SEQ ID NO: 39140 - DNA, 25 bp, Homo sapien
aggtgtgggtaaagcaaccgtgaat

SEQ ID NO: 39141 - DNA, 25 bp, Homo sapien
agcaaccgtgaatgtttgggaggga

SEQ ID NO: 39142 - DNA, 25 bp, Homo sapien
caaaatataggactttgccttcatt

SEQ ID NO: 39143 - DNA, 25 bp, Homo sapien
gtttcacaagtgtcttgagtcctca

SEQ ID NO: 39144 - DNA, 25 bp, Homo sapien
gagtcctcattctactaaagctgaa

SEQ ID NO: 39145 - DNA, 25 bp, Homo sapien
gtgcagcctgcatcagcaggcccac

SEQ ID NO: 39146 - DNA, 25 bp, Homo sapien
tcagcaggcccacacgcaaagaaaa

SEQ ID NO: 39147 - DNA, 25 bp, Homo sapien
gaaaaggtcttatcctgacatcaaa

SEQ ID NO: 39148 - DNA, 25 bp, Homo sapien
ggggacagcagaacgacttgacaca

SEQ ID NO: 39149 - DNA, 25 bp, Homo sapien
gacttgacacatgttcatcactggc

SEQ ID NO: 39150 - DNA, 25 bp, Homo sapien
agagctggtcatgagccttttatat

SEQ ID NO: 39151 - DNA, 25 bp, Homo sapien
gagccttttatataagcctttttca

SEQ ID NO: 39152 - DNA, 25 bp, Homo sapien
atataagcctttttcatcgggcctc

SEQ ID NO: 39153 - DNA, 25 bp, Homo sapien
ctttttcatcgggcctcagaggccc

SEQ ID NO: 39154 - DNA, 25 bp, Homo sapien
cctcagaggccctccttaaggaggt

SEQ ID NO: 39155 - DNA, 25 bp, Homo sapien
tccttaaggaggtaccacattggtc

SEQ ID NO: 39156 - DNA, 25 bp, Homo sapien
accacattggtcagctgacttgcaa

SEQ ID NO: 39157 - DNA, 25 bp, Homo sapien
gtttgaggccagctagagtgacata

SEQ ID NO: 39158 - DNA, 25 bp, Homo sapien
gacatagcaagactccgatgctaca

SEQ ID NO: 39159 - DNA, 25 bp, Homo sapien
gttttcttgacttactacattggtg

SEQ ID NO: 39160 - DNA, 25 bp, Homo sapien
attggtgaagtctctagcatgctgc

SEQ ID NO: 39161 - DNA, 25 bp, Homo sapien
ggtgaagtctctagcatgctgctga

SEQ ID NO: 39162 - DNA, 25 bp, Homo sapien
aagtctctagcatgctgctgaatga

SEQ ID NO: 39163 - DNA, 25 bp, Homo sapien
gcatgctgctgaatgaatagaagtg

SEQ ID NO: 39164 - DNA, 25 bp, Homo sapien
tcccataaggggaacatactgcctt

SEQ ID NO: 39165 - DNA, 25 bp, Homo sapien
gggaacatactgccttttactatta

SEQ ID NO: 39166 - DNA, 25 bp, Homo sapien
actgccttttactattaagaatgct

SEQ ID NO: 39167 - DNA, 25 bp, Homo sapien
cgggcagatcattcaatctccttga

SEQ ID NO: 39168 - DNA, 25 bp, Homo sapien
gatcattcaatctccttgagttcag

SEQ ID NO: 39169 - DNA, 25 bp, Homo sapien
aagttgaatgctgggccagcgcagt

SEQ ID NO: 39170 - DNA, 25 bp, Homo sapien
ttgcattttctctatataacatcta

SEQ ID NO: 39171 - DNA, 25 bp, Homo sapien
ctatttttcctgatactgtgccttt

SEQ ID NO: 39172 - DNA, 25 bp, Homo sapien
ttatttcctttgtattcccatagtg

SEQ ID NO: 39173 - DNA, 25 bp, Homo sapien
gtagatgccctttatctgggtactc

SEQ ID NO: 39174 - DNA, 25 bp, Homo sapien
tctgggtactcctggtagattagct

SEQ ID NO: 39175 - DNA, 25 bp, Homo sapien
ggtagattagctgttacacctccct

SEQ ID NO: 39176 - DNA, 25 bp, Homo sapien
acctgtattcagttattgtcactct

SEQ ID NO: 39177 - DNA, 25 bp, Homo sapien
ttattgtcactctgagaactctcca

SEQ ID NO: 39178 - DNA, 25 bp, Homo sapien
taacaacacagctgttacacctccc

SEQ ID NO: 39179 - DNA, 25 bp, Homo sapien
cttcctttttttcacagtgaacctg

SEQ ID NO: 39180 - DNA, 25 bp, Homo sapien
gtattcagctattctcactctgaga

SEQ ID NO: 39181 - DNA, 25 bp, Homo sapien
gaaacagttgttcaggtacaaacat

SEQ ID NO: 39182 - DNA, 25 bp, Homo sapien
aaaacaactctagctatgactctta

SEQ ID NO: 39183 - DNA, 25 bp, Homo sapien
actctagctatgactcttaatgttc

SEQ ID NO: 39184 - DNA, 25 bp, Homo sapien
gactcttaatgttcaattgcaaaat

SEQ ID NO: 39185 - DNA, 25 bp, Homo sapien
tttatgggagtttttcatgggcttt

SEQ ID NO: 39186 - DNA, 25 bp, Homo sapien
tcatgggcttttctaacagtggtta

SEQ ID NO: 39187 - DNA, 25 bp, Homo sapien
gtaactggttatcaggaatggagag

SEQ ID NO: 39188 - DNA, 25 bp, Homo sapien
tatttctggagttattgactcacat

SEQ ID NO: 39189 - DNA, 25 bp, Homo sapien
tgactcacatagtggctgtatttga

SEQ ID NO: 39190 - DNA, 25 bp, Homo sapien
aatagtgtctgaagaggccgggcgc

SEQ ID NO: 39191 - DNA, 25 bp, Homo sapien
attagctgagggtggtggcgcacgc

SEQ ID NO: 39192 - DNA, 25 bp, Homo sapien
gtagaaagaggctcactacagccag

SEQ ID NO: 39193 - DNA, 25 bp, Homo sapien
gtgcagagtcagagtcctgggacca

SEQ ID NO: 39194 - DNA, 25 bp, Homo sapien
cctgggaccatcttgttctgcaagg

SEQ ID NO: 39195 - DNA, 25 bp, Homo sapien
atcttgttctgcaaggtgaccccag

SEQ ID NO: 39196 - DNA, 25 bp, Homo sapien
aggggagagggatcgtcctcattca

SEQ ID NO: 39197 - DNA, 25 bp, Homo sapien
cgtcctcattcagactctagctggg

SEQ ID NO: 39198 - DNA, 25 bp, Homo sapien
cctgttacatagctgtgcctcagag

SEQ ID NO: 39199 - DNA, 25 bp, Homo sapien
gaaagggtcctgcattttctggaat

SEQ ID NO: 39200 - DNA, 25 bp, Homo sapien
ctccattgctcctctacaagcaatt

SEQ ID NO: 39201 - DNA, 25 bp, Homo sapien
aaagagcaacttaggctgggtgcag

SEQ ID NO: 39202 - DNA, 25 bp, Homo sapien
attaaccagacattgtggcatgtgc

SEQ ID NO: 39203 - DNA, 25 bp, Homo sapien
ggctgactctctttgaggagcactg

SEQ ID NO: 39204 - DNA, 25 bp, Homo sapien
ctctttgaggagcactgcagctggt

SEQ ID NO: 39205 - DNA, 25 bp, Homo sapien
gactttaagttacagccagtgctca

SEQ ID NO: 39206 - DNA, 25 bp, Homo sapien
ccagtgctcattgaccactctgaaa

SEQ ID NO: 39207 - DNA, 25 bp, Homo sapien
gctcattgaccactctgaaaatctc

SEQ ID NO: 39208 - DNA, 25 bp, Homo sapien
tctttctgtgctctagaaatggaac

SEQ ID NO: 39209 - DNA, 25 bp, Homo sapien
gaaatggaacatcactgtctgggtg

SEQ ID NO: 39210 - DNA, 25 bp, Homo sapien
tactgaatattttaatcccactatt

SEQ ID NO: 39211 - DNA, 25 bp, Homo sapien
taatcccactattgagaactgctca

SEQ ID NO: 39212 - DNA, 25 bp, Homo sapien
aaagattgttggttggccaggcata

SEQ ID NO: 39213 - DNA, 25 bp, Homo sapien
tggtggtagtacctgtaatttcagc

SEQ ID NO: 39214 - DNA, 25 bp, Homo sapien
gttcagtactttcccacatactaca

SEQ ID NO: 39215 - DNA, 25 bp, Homo sapien
tcccacatactacaggacatttata

SEQ ID NO: 39216 - DNA, 25 bp, Homo sapien
acatttataggtccttcacccacaa

SEQ ID NO: 39217 - DNA, 25 bp, Homo sapien
cacccacaaaatgccatttgagcct

SEQ ID NO: 39218 - DNA, 25 bp, Homo sapien
tgagcctgcaaatcctcgtaacagc

SEQ ID NO: 39219 - DNA, 25 bp, Homo sapien
tgccccttagactgctaatactacc

SEQ ID NO: 39220 - DNA, 25 bp, Homo sapien
ggaaaatatttctaatccctgcctc

SEQ ID NO: 39221 - DNA, 25 bp, Homo sapien
tccctgcctctgtaataccatattc

SEQ ID NO: 39222 - DNA, 25 bp, Homo sapien
catattctgtacttttcttcctatt

SEQ ID NO: 39223 - DNA, 25 bp, Homo sapien
atgttttcattgttatctctttttc

SEQ ID NO: 39224 - DNA, 25 bp, Homo sapien
agggatcacagattgactcttggct

SEQ ID NO: 39225 - DNA, 25 bp, Homo sapien
cagctgtccctgttatgagctcaag

SEQ ID NO: 39226 - DNA, 25 bp, Homo sapien
gagctcaagagcccaaacagacata

SEQ ID NO: 39227 - DNA, 25 bp, Homo sapien
gagcccaaacagacatactgtcagt

SEQ ID NO: 39228 - DNA, 25 bp, Homo sapien
taggactacctatgattctctcgtt

SEQ ID NO: 39229 - DNA, 25 bp, Homo sapien
ttctctcgttgaaccctgtgtagtt

SEQ ID NO: 39230 - DNA, 25 bp, Homo sapien
accctgtgtagttaagcaccaaaca

SEQ ID NO: 39231 - DNA, 25 bp, Homo sapien
gagagaacttagacactaccacacc

SEQ ID NO: 39232 - DNA, 25 bp, Homo sapien
tatataaatcggcggggcacagtgg

SEQ ID NO: 39233 - DNA, 25 bp, Homo sapien
atcgcttgagcttaagagtttcaga

SEQ ID NO: 39234 - DNA, 25 bp, Homo sapien
ttagccaagcttggtggtgtacacc

SEQ ID NO: 39235 - DNA, 25 bp, Homo sapien
agcgatattaacgccattgcactcc

SEQ ID NO: 39236 - DNA, 25 bp, Homo sapien
ccctatggttcgactgagtccacac

SEQ ID NO: 39237 - DNA, 25 bp, Homo sapien
tatggttcgactgagtccacactcc

SEQ ID NO: 39238 - DNA, 25 bp, Homo sapien
tacacctgaggttctggagctcaga

SEQ ID NO: 39239 - DNA, 25 bp, Homo sapien
gaggttctggagctcagaatctgac

SEQ ID NO: 39240 - DNA, 25 bp, Homo sapien
ggttctggagctcagaatctgacag

SEQ ID NO: 39241 - DNA, 25 bp, Homo sapien
tgtcggggggacagagggaaccatt

SEQ ID NO: 39242 - DNA, 25 bp, Homo sapien
gacagagggaaccatttaagaaaag

SEQ ID NO: 39243 - DNA, 25 bp, Homo sapien
agaaagacatgttggctataggcgt

SEQ ID NO: 39244 - DNA, 25 bp, Homo sapien
gacatgttggctataggcgtggtgg

SEQ ID NO: 39245 - DNA, 25 bp, Homo sapien
gaagccggggtaggaggatcaccag

SEQ ID NO: 39246 - DNA, 25 bp, Homo sapien
ggggtaggaggatcaccagaggcca

SEQ ID NO: 39247 - DNA, 25 bp, Homo sapien
atgcctgtagtcccaactactaggg

SEQ ID NO: 39248 - DNA, 25 bp, Homo sapien
ccaactactagggaggctgaggcag

SEQ ID NO: 39249 - DNA, 25 bp, Homo sapien
gaggtgtatactgatgattcttccc

SEQ ID NO: 39250 - DNA, 25 bp, Homo sapien
atactgatgattcttcccactcatt

SEQ ID NO: 39251 - DNA, 25 bp, Homo sapien
tcccactcatttgtttgtccagaag

SEQ ID NO: 39252 - DNA, 25 bp, Homo sapien
tgtcggaagttttccaagtaactat

SEQ ID NO: 39253 - DNA, 25 bp, Homo sapien
gagtacagtggcaggatctcagctt

SEQ ID NO: 39254 - DNA, 25 bp, Homo sapien
catctcccaggttcaagcgatcatg

SEQ ID NO: 39255 - DNA, 25 bp, Homo sapien
ttcaagcgatcatgtgcctaagcct

SEQ ID NO: 39256 - DNA, 25 bp, Homo sapien
taaagactttcgccatgttgtccag

SEQ ID NO: 39257 - DNA, 25 bp, Homo sapien
gaactcctggcctaatgatctgccc

SEQ ID NO: 39258 - DNA, 25 bp, Homo sapien
gatggcgatgctttgaatgttcctg

SEQ ID NO: 39259 - DNA, 25 bp, Homo sapien
ggcgatgctttgaatgttcctggga

SEQ ID NO: 39260 - DNA, 25 bp, Homo sapien
gatgctttgaatgttcctgggagtg

SEQ ID NO: 39261 - DNA, 25 bp, Homo sapien
gctttgaatgttcctgggagtgtct

SEQ ID NO: 39262 - DNA, 25 bp, Homo sapien
cctgggagtgtctgttggtgggtag

SEQ ID NO: 39263 - DNA, 25 bp, Homo sapien
gagtgtctgttggtgggtagagcat

SEQ ID NO: 39264 - DNA, 25 bp, Homo sapien
gttggtgggtagagcatgcatttct

SEQ ID NO: 39265 - DNA, 25 bp, Homo sapien
atttctctttcgtgtgtatatagga

SEQ ID NO: 39266 - DNA, 25 bp, Homo sapien
tctttcgtgtgtatataggagtgga

SEQ ID NO: 39267 - DNA, 25 bp, Homo sapien
ataggagtggaatcaaggccgggca

SEQ ID NO: 39268 - DNA, 25 bp, Homo sapien
ggagtggaatcaaggccgggcactg

SEQ ID NO: 39269 - DNA, 25 bp, Homo sapien
aatagagctttgcaggaaagtgctg

SEQ ID NO: 39270 - DNA, 25 bp, Homo sapien
gagagacatttgacatggactctct

SEQ ID NO: 39271 - DNA, 25 bp, Homo sapien
tagatcaacacttctgggacctcac

SEQ ID NO: 39272 - DNA, 25 bp, Homo sapien
cttctgggacctcacgtggaattgg

SEQ ID NO: 39273 - DNA, 25 bp, Homo sapien
gggacctcacgtggaattggtctct

SEQ ID NO: 39274 - DNA, 25 bp, Homo sapien
attggtctctctgaggtagtggaga

SEQ ID NO: 39275 - DNA, 25 bp, Homo sapien
ctctgaggtagtggagatgctaagt

SEQ ID NO: 39276 - DNA, 25 bp, Homo sapien
gatgctaagtagtgggatttcctca

SEQ ID NO: 39277 - DNA, 25 bp, Homo sapien
gctaagtagtgggatttcctcattc

SEQ ID NO: 39278 - DNA, 25 bp, Homo sapien
acattgtaccccatgaatgaataca

SEQ ID NO: 39279 - DNA, 25 bp, Homo sapien
gtaccccatgaatgaatacaagcat

SEQ ID NO: 39280 - DNA, 25 bp, Homo sapien
ctgcctttccaggactagaaccggg

SEQ ID NO: 39281 - DNA, 25 bp, Homo sapien
ttccaggactagaaccgggaacctg

SEQ ID NO: 39282 - DNA, 25 bp, Homo sapien
cctcctgagctggcatctcagacag

SEQ ID NO: 39283 - DNA, 25 bp, Homo sapien
tcaccaagagagatggccatggggc

SEQ ID NO: 39284 - DNA, 25 bp, Homo sapien
caagagagatggccatggggctcag

SEQ ID NO: 39285 - DNA, 25 bp, Homo sapien
cctctttaccatgtgcagtgaccat

SEQ ID NO: 39286 - DNA, 25 bp, Homo sapien
taccatgtgcagtgaccatttctca

SEQ ID NO: 39287 - DNA, 25 bp, Homo sapien
atgtgcagtgaccatttctcagagc

SEQ ID NO: 39288 - DNA, 25 bp, Homo sapien
agtgaccatttctcagagcaggact

SEQ ID NO: 39289 - DNA, 25 bp, Homo sapien
agagcaggacttgcaaagaggcttt

SEQ ID NO: 39290 - DNA, 25 bp, Homo sapien
ggacttgcaaagaggctttaatttc

SEQ ID NO: 39291 - DNA, 25 bp, Homo sapien
acccattctccatggcctatggaag

SEQ ID NO: 39292 - DNA, 25 bp, Homo sapien
ccatggcctatggaagcctcactgg

SEQ ID NO: 39293 - DNA, 25 bp, Homo sapien
agcctcactggagtttggggcctgc

SEQ ID NO: 39294 - DNA, 25 bp, Homo sapien
ttggggcctgctgcaatggggatga

SEQ ID NO: 39295 - DNA, 25 bp, Homo sapien
gtagaattatacttacgttccttgg

SEQ ID NO: 39296 - DNA, 25 bp, Homo sapien
gttgatgctgttaaggtacccgggg

SEQ ID NO: 39297 - DNA, 25 bp, Homo sapien
ggggtagccattggttcttggatct

SEQ ID NO: 39298 - DNA, 25 bp, Homo sapien
gtgttagaatgagtgctttcccttc

SEQ ID NO: 39299 - DNA, 25 bp, Homo sapien
cccttcctactgatgtgattgtgga

SEQ ID NO: 39300 - DNA, 25 bp, Homo sapien
gtggattaggaattcgtgaccgagt

SEQ ID NO: 39301 - DNA, 25 bp, Homo sapien
gtgaccgagtgatttttggccagtg

SEQ ID NO: 39302 - DNA, 25 bp, Homo sapien
gggcaaagagtaaactaccctgcaa

SEQ ID NO: 39303 - DNA, 25 bp, Homo sapien
aactaccctgcaaatatatgcggat

SEQ ID NO: 39304 - DNA, 25 bp, Homo sapien
atgcggataatttaattggtttcat

SEQ ID NO: 39305 - DNA, 25 bp, Homo sapien
catattacaggaatctagagggcca

SEQ ID NO: 39306 - DNA, 25 bp, Homo sapien
agctcagcagtttgaaaccaacttg

SEQ ID NO: 39307 - DNA, 25 bp, Homo sapien
agcagtttgaaaccaacttgggcaa

SEQ ID NO: 39308 - DNA, 25 bp, Homo sapien
ggcaaaatgagaaaacacccatctc

SEQ ID NO: 39309 - DNA, 25 bp, Homo sapien
aatggtgtcatgtgcatgtagtact

SEQ ID NO: 39310 - DNA, 25 bp, Homo sapien
gcatgtagtacttgtattcccagct

SEQ ID NO: 39311 - DNA, 25 bp, Homo sapien
tggagaggtcaaggctgattgagcc

SEQ ID NO: 39312 - DNA, 25 bp, Homo sapien
gccatgatggtgccagtgtacttca

SEQ ID NO: 39313 - DNA, 25 bp, Homo sapien
ggtcactacgtgattgttagcatat

SEQ ID NO: 39314 - DNA, 25 bp, Homo sapien
tttcatctcagtgtttacatctaca

SEQ ID NO: 39315 - DNA, 25 bp, Homo sapien
gcaataagtaaatttcagccatgta

SEQ ID NO: 39316 - DNA, 25 bp, Homo sapien
tcagccatgtatatacgtgaactaa

SEQ ID NO: 39317 - DNA, 25 bp, Homo sapien
agtgcttctgcaagtcaagagactg

SEQ ID NO: 39318 - DNA, 25 bp, Homo sapien
gtcaagagactgttctcagctttca

SEQ ID NO: 39319 - DNA, 25 bp, Homo sapien
gagactgttctcagctttcaacaat

SEQ ID NO: 39320 - DNA, 25 bp, Homo sapien
gttctcagctttcaacaatactgaa

SEQ ID NO: 39321 - DNA, 25 bp, Homo sapien
ggaatacctaattgagtagtctgct

SEQ ID NO: 39322 - DNA, 25 bp, Homo sapien
aattgagtagtctgctggtcattta

SEQ ID NO: 39323 - DNA, 25 bp, Homo sapien
gtagtctgctggtcatttaaaatta

SEQ ID NO: 39324 - DNA, 25 bp, Homo sapien
cttacctgattcggtgttttcaaat

SEQ ID NO: 39325 - DNA, 25 bp, Homo sapien
gattcggtgttttcaaatttccgag

SEQ ID NO: 39326 - DNA, 25 bp, Homo sapien
ttccgagtttcacccttagggagct

SEQ ID NO: 39327 - DNA, 25 bp, Homo sapien
tcacccttagggagctagtttgcag

SEQ ID NO: 39328 - DNA, 25 bp, Homo sapien
ggagctagtttgcagtttggttctt

SEQ ID NO: 39329 - DNA, 25 bp, Homo sapien
gtttgcagtttggttctttgcagtt

SEQ ID NO: 39330 - DNA, 25 bp, Homo sapien
ctttgcagtttggttctgagagcca

SEQ ID NO: 39331 - DNA, 25 bp, Homo sapien
cagtttggttctgagagccattcct

SEQ ID NO: 39332 - DNA, 25 bp, Homo sapien
tgagagccattcctgaagttcagtt

SEQ ID NO: 39333 - DNA, 25 bp, Homo sapien
cttcacctttccatcaaattttaag

SEQ ID NO: 39334 - DNA, 25 bp, Homo sapien
tctacaaacttattacatccttttt

SEQ ID NO: 39335 - DNA, 25 bp, Homo sapien
ggggtaacatagcctgccaaaggct

SEQ ID NO: 39336 - DNA, 25 bp, Homo sapien
tgagatggagtttcgctcctgttgc

SEQ ID NO: 39337 - DNA, 25 bp, Homo sapien
aacggcacaatctcagttcactgca

SEQ ID NO: 39338 - DNA, 25 bp, Homo sapien
ctgtctcagcctccggagtagctga

SEQ ID NO: 39339 - DNA, 25 bp, Homo sapien
gtagctgagattacaggtgcctgcc

SEQ ID NO: 39340 - DNA, 25 bp, Homo sapien
gacagtgtttcaccaagttggccag

SEQ ID NO: 39341 - DNA, 25 bp, Homo sapien
gcatgagccactgcgtctggcaata

SEQ ID NO: 39342 - DNA, 25 bp, Homo sapien
ctgcgtctggcaataatgtaacttt

SEQ ID NO: 39343 - DNA, 25 bp, Homo sapien
aattaatcccagtttgtagcaataa

SEQ ID NO: 39344 - DNA, 25 bp, Homo sapien
aacagaagactatctacaacggaag

SEQ ID NO: 39345 - DNA, 25 bp, Homo sapien
gaagcaactgccttacagttctgta

SEQ ID NO: 39346 - DNA, 25 bp, Homo sapien
gaaaaagcctccatcttggcaagat

SEQ ID NO: 39347 - DNA, 25 bp, Homo sapien
aagcctccatcttggcaagatatga

SEQ ID NO: 39348 - DNA, 25 bp, Homo sapien
attaagtttatgtacctaggaccat

SEQ ID NO: 39349 - DNA, 25 bp, Homo sapien
acagatgttttgtgccaagtaagta

SEQ ID NO: 39350 - DNA, 25 bp, Homo sapien
gtgccaagtaagtatcatcctcatt

SEQ ID NO: 39351 - DNA, 25 bp, Homo sapien
tcatcctcatttacaagaggggtca

SEQ ID NO: 39352 - DNA, 25 bp, Homo sapien
catttacaagaggggtcacaaactg

SEQ ID NO: 39353 - DNA, 25 bp, Homo sapien
tctacctatcaagttctgttaggcc

SEQ ID NO: 39354 - DNA, 25 bp, Homo sapien
agttctgttaggcctacatcgtgga

SEQ ID NO: 39355 - DNA, 25 bp, Homo sapien
gttaggcctacatcgtggaattttt

SEQ ID NO: 39356 - DNA, 25 bp, Homo sapien
aattgggtgattttggctgggcgca

SEQ ID NO: 39357 - DNA, 25 bp, Homo sapien
ttcctccccttttgggtgcagttga

SEQ ID NO: 39358 - DNA, 25 bp, Homo sapien
gtgcagttgatggatttcccatccc

SEQ ID NO: 39359 - DNA, 25 bp, Homo sapien
ttcccatccccagaacggggaagca

SEQ ID NO: 39360 - DNA, 25 bp, Homo sapien
agcaagatgcactgtggattttcct

SEQ ID NO: 39361 - DNA, 25 bp, Homo sapien
tttattttctagtgctcacctagga

SEQ ID NO: 39362 - DNA, 25 bp, Homo sapien
attggggtcactggttaatgctgat

SEQ ID NO: 39363 - DNA, 25 bp, Homo sapien
gctgatattatttttgatgactcta

SEQ ID NO: 39364 - DNA, 25 bp, Homo sapien
gatgactctaacccttaggtcttac

SEQ ID NO: 39365 - DNA, 25 bp, Homo sapien
cgcccttctatcatttgtacttaag

SEQ ID NO: 39366 - DNA, 25 bp, Homo sapien
tgtacttaagtatttacctggtgaa

SEQ ID NO: 39367 - DNA, 25 bp, Homo sapien
taaagcttatgccgggcacggtgcc

SEQ ID NO: 39368 - DNA, 25 bp, Homo sapien
gtgattgaggaagggtacggtggct

SEQ ID NO: 39369 - DNA, 25 bp, Homo sapien
tgaggtcaggacttcgataccagcc

SEQ ID NO: 39370 - DNA, 25 bp, Homo sapien
ggccaacattacagaaccctttctc

SEQ ID NO: 39371 - DNA, 25 bp, Homo sapien
catggtggtgggcacgtgtaacccc

SEQ ID NO: 39372 - DNA, 25 bp, Homo sapien
aacctgctttgccttctttaagaag

SEQ ID NO: 39373 - DNA, 25 bp, Homo sapien
tgcctgtagtccctggcaatttggg

SEQ ID NO: 39374 - DNA, 25 bp, Homo sapien
ggaggccgaggagggcagatcacct

SEQ ID NO: 39375 - DNA, 25 bp, Homo sapien
tacatgcctgtagtctcagctgctc

SEQ ID NO: 39376 - DNA, 25 bp, Homo sapien
tgctcggggagctgacgcaggagaa

SEQ ID NO: 39377 - DNA, 25 bp, Homo sapien
ttgaatccgggaggcagagctgcag

SEQ ID NO: 39378 - DNA, 25 bp, Homo sapien
gagccaagatagctccattgcactc

SEQ ID NO: 39379 - DNA, 25 bp, Homo sapien
gccatcagaggctggtcggaatccc

SEQ ID NO: 39380 - DNA, 25 bp, Homo sapien
gcagatgagagtggataccgaatgg

SEQ ID NO: 39381 - DNA, 25 bp, Homo sapien
ttaaagctcagctttgatgccccgt

SEQ ID NO: 39382 - DNA, 25 bp, Homo sapien
ctctctctggttctctgatcagaaa

SEQ ID NO: 39383 - DNA, 25 bp, Homo sapien
ctctgatcagaaactgtctctaaac

SEQ ID NO: 39384 - DNA, 25 bp, Homo sapien
atttggcaagacattctgttgtggg

SEQ ID NO: 39385 - DNA, 25 bp, Homo sapien
gttgtgggattttgcctggtggtag

SEQ ID NO: 39386 - DNA, 25 bp, Homo sapien
gaaaagcttgggtattagcctcaga

SEQ ID NO: 39387 - DNA, 25 bp, Homo sapien
gggtattagcctcagaaagattctc

SEQ ID NO: 39388 - DNA, 25 bp, Homo sapien
aatgaggctaatactttggcaaatt

SEQ ID NO: 39389 - DNA, 25 bp, Homo sapien
ggtgcactcctataaaaattgaagc

SEQ ID NO: 39390 - DNA, 25 bp, Homo sapien
tggtctagactgtgctttccactaa

SEQ ID NO: 39391 - DNA, 25 bp, Homo sapien
tctagactgtgctttccactaacca

SEQ ID NO: 39392 - DNA, 25 bp, Homo sapien
cactaaccactagccacagggggct

SEQ ID NO: 39393 - DNA, 25 bp, Homo sapien
catttcaaatgctcagcggccacat

SEQ ID NO: 39394 - DNA, 25 bp, Homo sapien
gtaactagtagcaattgtgtgggac

SEQ ID NO: 39395 - DNA, 25 bp, Homo sapien
agcaattgtgtgggacagcacagat

SEQ ID NO: 39396 - DNA, 25 bp, Homo sapien
agcacagatatagaaaacttccagc

SEQ ID NO: 39397 - DNA, 25 bp, Homo sapien
ggacaaggctgacctagagcaggtc

SEQ ID NO: 39398 - DNA, 25 bp, Homo sapien
acctagagcaggtctgtccgatgga

SEQ ID NO: 39399 - DNA, 25 bp, Homo sapien
agcaggtctgtccgatggaaacaca

SEQ ID NO: 39400 - DNA, 25 bp, Homo sapien
ggaaacacagttagagccacattta

SEQ ID NO: 39401 - DNA, 25 bp, Homo sapien
gctcaaggacgaagacttccccagc

SEQ ID NO: 39402 - DNA, 25 bp, Homo sapien
tacgccatccctgccagaggcagga

SEQ ID NO: 39403 - DNA, 25 bp, Homo sapien
gtgccttccaggaggaggacttccc

SEQ ID NO: 39404 - DNA, 25 bp, Homo sapien
tcctcggtgcccaagcctggcaccg

SEQ ID NO: 39405 - DNA, 25 bp, Homo sapien
ccttgtctctgcctggaacagcagc

SEQ ID NO: 39406 - DNA, 25 bp, Homo sapien
gcagcaagaaggtagcacagcccca

SEQ ID NO: 39407 - DNA, 25 bp, Homo sapien
cggccagcccaccaggaaggctggg

SEQ ID NO: 39408 - DNA, 25 bp, Homo sapien
ggctgggaaggggagcaggggcggc

SEQ ID NO: 39409 - DNA, 25 bp, Homo sapien
cccgccttcacacaggaggaggagg

SEQ ID NO: 39410 - DNA, 25 bp, Homo sapien
ctcccatccaaccctctaaagttgg

SEQ ID NO: 39411 - DNA, 25 bp, Homo sapien
aagccaggcacaattgcaagccccg

SEQ ID NO: 39412 - DNA, 25 bp, Homo sapien
gaggggacaggagaggttggggtca

SEQ ID NO: 39413 - DNA, 25 bp, Homo sapien
ggggacaggagaggttggggtcacg

SEQ ID NO: 39414 - DNA, 25 bp, Homo sapien
gggacaggagaggttggggtcacgg

SEQ ID NO: 39415 - DNA, 25 bp, Homo sapien
ggacaggagaggttggggtcacggt

SEQ ID NO: 39416 - DNA, 25 bp, Homo sapien
gacaggagaggttggggtcacggtg

SEQ ID NO: 39417 - DNA, 25 bp, Homo sapien
acaggagaggttggggtcacggtgg

SEQ ID NO: 39418 - DNA, 25 bp, Homo sapien
caggagaggttggggtcacggtgga

SEQ ID NO: 39419 - DNA, 25 bp, Homo sapien
gaggttggggtcacggtggaaggag

SEQ ID NO: 39420 - DNA, 25 bp, Homo sapien
ttggggtcacggtggaaggaggaag

SEQ ID NO: 39421 - DNA, 25 bp, Homo sapien
aggaggaagagagcccactacagcc

SEQ ID NO: 39422 - DNA, 25 bp, Homo sapien
gaaaaacaaatccaggtcccagtgc

SEQ ID NO: 39423 - DNA, 25 bp, Homo sapien
aggaaggtttaatgagccctgtcca

SEQ ID NO: 39424 - DNA, 25 bp, Homo sapien
ggaaggtttaatgagccctgtccag

SEQ ID NO: 39425 - DNA, 25 bp, Homo sapien
gaaggtttaatgagccctgtccagg

SEQ ID NO: 39426 - DNA, 25 bp, Homo sapien
aaggtttaatgagccctgtccaggg

SEQ ID NO: 39427 - DNA, 25 bp, Homo sapien
aggtttaatgagccctgtccagggc

SEQ ID NO: 39428 - DNA, 25 bp, Homo sapien
ggtttaatgagccctgtccagggcc

SEQ ID NO: 39429 - DNA, 25 bp, Homo sapien
gtttaatgagccctgtccagggccc

SEQ ID NO: 39430 - DNA, 25 bp, Homo sapien
tttaatgagccctgtccagggccct

SEQ ID NO: 39431 - DNA, 25 bp, Homo sapien
tcaagtaccccgagtggaaacagaa

SEQ ID NO: 39432 - DNA, 25 bp, Homo sapien
gtggaaacagaagcacctgcctcac

SEQ ID NO: 39433 - DNA, 25 bp, Homo sapien
ctgtcggagctgtcggtgcagcatg

SEQ ID NO: 39434 - DNA, 25 bp, Homo sapien
agctgtcggtgcagcatgcggactc

SEQ ID NO: 39435 - DNA, 25 bp, Homo sapien
gcagcatgcggactcactggagaac

SEQ ID NO: 39436 - DNA, 25 bp, Homo sapien
gcggactcactggagaacatcgacg

SEQ ID NO: 39437 - DNA, 25 bp, Homo sapien
agaacatcgacgagagcgcggtggc

SEQ ID NO: 39438 - DNA, 25 bp, Homo sapien
agcgcggtggccgagagcagagagg

SEQ ID NO: 39439 - DNA, 25 bp, Homo sapien
agcagagaggagcggatgggcggcg

SEQ ID NO: 39440 - DNA, 25 bp, Homo sapien
cgcaccgcttcagggacggagacag

SEQ ID NO: 39441 - DNA, 25 bp, Homo sapien
cagggacggagacaggaccgggcga

SEQ ID NO: 39442 - DNA, 25 bp, Homo sapien
gagacggtctatttatgttaatgga

SEQ ID NO: 39443 - DNA, 25 bp, Homo sapien
ggttattttgattgtgcattctctg

SEQ ID NO: 39444 - DNA, 25 bp, Homo sapien
gattgtgcattctctgttacacatt

SEQ ID NO: 39445 - DNA, 25 bp, Homo sapien
ctgttacacattttatatcgcttta

SEQ ID NO: 39446 - DNA, 25 bp, Homo sapien
tggtgctgtcacacaattttctctt

SEQ ID NO: 39447 - DNA, 25 bp, Homo sapien
ctgtcacacaattttctcttttcat

SEQ ID NO: 39448 - DNA, 25 bp, Homo sapien
ctgaggttgatgagtagctagggaa

SEQ ID NO: 39449 - DNA, 25 bp, Homo sapien
agggagagattatgtgagcgtgtgt

SEQ ID NO: 39450 - DNA, 25 bp, Homo sapien
gtgagcgtgtgtgtcaggcacagtg

SEQ ID NO: 39451 - DNA, 25 bp, Homo sapien
caggcacagtgtgtccatatgatgg

SEQ ID NO: 39452 - DNA, 25 bp, Homo sapien
atgatacagtgtgcagctgggcgcg

SEQ ID NO: 39453 - DNA, 25 bp, Homo sapien
ggaaagctgctgccaagaaagactg

SEQ ID NO: 39454 - DNA, 25 bp, Homo sapien
gctgccaagaaagactgagcccctc

SEQ ID NO: 39455 - DNA, 25 bp, Homo sapien
tcaagcttctaacgatgtacgggga

SEQ ID NO: 39456 - DNA, 25 bp, Homo sapien
ctgccctctccctgaaataaagaac

SEQ ID NO: 39457 - DNA, 25 bp, Homo sapien
agcttctaacgatgtacggggacat

SEQ ID NO: 39458 - DNA, 25 bp, Homo sapien
ctactactactactgctcgaattca

SEQ ID NO: 39459 - DNA, 25 bp, Homo sapien
actactgctcgaattcaagcttcta

SEQ ID NO: 39460 - DNA, 25 bp, Homo sapien
ctgctcgaattcaagcttctaacga

SEQ ID NO: 39461 - DNA, 25 bp, Homo sapien
aattcaagcttctaacgatgtacgg

SEQ ID NO: 39462 - DNA, 25 bp, Homo sapien
aagcttctaacgatgtacggggaca

SEQ ID NO: 39463 - DNA, 25 bp, Homo sapien
ggggacatgaggaaagctgctgcca

SEQ ID NO: 39464 - DNA, 25 bp, Homo sapien
aactgtggaacaacttcaggccaaa

SEQ ID NO: 39465 - DNA, 25 bp, Homo sapien
caggccaaaaacagagaactactca

SEQ ID NO: 39466 - DNA, 25 bp, Homo sapien
gaactactcaaacaggtcgcagcat

SEQ ID NO: 39467 - DNA, 25 bp, Homo sapien
caggtcgcagcattatcaaagggta

SEQ ID NO: 39468 - DNA, 25 bp, Homo sapien
ggaagcatactaacatctccttgag

SEQ ID NO: 39469 - DNA, 25 bp, Homo sapien
catctccttgagaaagtcatttgtt

SEQ ID NO: 39470 - DNA, 25 bp, Homo sapien
aagtcatttgtttagcatttcttct

SEQ ID NO: 39471 - DNA, 25 bp, Homo sapien
gtgaagcccttaaattctgtgtagt

SEQ ID NO: 39472 - DNA, 25 bp, Homo sapien
aaaaatatttttgcacaccaaatga

SEQ ID NO: 39473 - DNA, 25 bp, Homo sapien
aagtcaggagcagcagggtttatgt

SEQ ID NO: 39474 - DNA, 25 bp, Homo sapien
gagcagcagggtttatgttgtttgt

SEQ ID NO: 39475 - DNA, 25 bp, Homo sapien
gatggatgtccatgaaaacaatatt

SEQ ID NO: 39476 - DNA, 25 bp, Homo sapien
aatttattattagctgtgttaactt

SEQ ID NO: 39477 - DNA, 25 bp, Homo sapien
tgttaacttttattctatgcttcat

SEQ ID NO: 39478 - DNA, 25 bp, Homo sapien
cttttattctatgcttcatatgctc

SEQ ID NO: 39479 - DNA, 25 bp, Homo sapien
gacattgacatagtggatttctgct

SEQ ID NO: 39480 - DNA, 25 bp, Homo sapien
tgacatagtggatttctgctgattt

SEQ ID NO: 39481 - DNA, 25 bp, Homo sapien
tgctgatttttttcaaatccgcaat

SEQ ID NO: 39482 - DNA, 25 bp, Homo sapien
aatccgcaatctttataaccaactg

SEQ ID NO: 39483 - DNA, 25 bp, Homo sapien
ttgtgttctgttggatcaagtattt

SEQ ID NO: 39484 - DNA, 25 bp, Homo sapien
tggatcaagtatttaacatttgctc

SEQ ID NO: 39485 - DNA, 25 bp, Homo sapien
gccttgagatagatccatttatcct

SEQ ID NO: 39486 - DNA, 25 bp, Homo sapien
ggtgtggggtggggaactattattg

SEQ ID NO: 39487 - DNA, 25 bp, Homo sapien
tggggtggggaactattattgtatt

SEQ ID NO: 39488 - DNA, 25 bp, Homo sapien
gttatggcccagaatagcaaggaag

SEQ ID NO: 39489 - DNA, 25 bp, Homo sapien
ctcaatgcctcccctaaggaataag

SEQ ID NO: 39490 - DNA, 25 bp, Homo sapien
tgcctcccctaaggaataagaccac

SEQ ID NO: 39491 - DNA, 25 bp, Homo sapien
ctaccaccttgcctggtttacaaga

SEQ ID NO: 39492 - DNA, 25 bp, Homo sapien
tctgttagctgactcatgcagcccc

SEQ ID NO: 39493 - DNA, 25 bp, Homo sapien
cgttccccgagcttgctcgatttat

SEQ ID NO: 39494 - DNA, 25 bp, Homo sapien
ccgagcttgctcgatttatcacgac

SEQ ID NO: 39495 - DNA, 25 bp, Homo sapien
agcttgctcgatttatcacgaccct

SEQ ID NO: 39496 - DNA, 25 bp, Homo sapien
ggctcttgacgcaagtctgctgatg

SEQ ID NO: 39497 - DNA, 25 bp, Homo sapien
attgcaagctctttgcaagcgccca

SEQ ID NO: 39498 - DNA, 25 bp, Homo sapien
gcaagcgcccagacttaggaactac

SEQ ID NO: 39499 - DNA, 25 bp, Homo sapien
tatctggaggcacctgtgccagcac

SEQ ID NO: 39500 - DNA, 25 bp, Homo sapien
ccagcaccccatgtatacgtaagac

SEQ ID NO: 39501 - DNA, 25 bp, Homo sapien
tacgtaagacttcaccagggagctg

SEQ ID NO: 39502 - DNA, 25 bp, Homo sapien
gagacactgctctgggtatggagct

SEQ ID NO: 39503 - DNA, 25 bp, Homo sapien
gtatggagcttttaccagagctgca

SEQ ID NO: 39504 - DNA, 25 bp, Homo sapien
agagctgcaaacgcagcctgtgccc

SEQ ID NO: 39505 - DNA, 25 bp, Homo sapien
ctgtgcccctgtttcgttggggaat

SEQ ID NO: 39506 - DNA, 25 bp, Homo sapien
gttttcaagggtaccatggagctgg

SEQ ID NO: 39507 - DNA, 25 bp, Homo sapien
aaaacaccacagactttgctgttct

SEQ ID NO: 39508 - DNA, 25 bp, Homo sapien
gaaaacaaacaaacaggctgggcac

SEQ ID NO: 39509 - DNA, 25 bp, Homo sapien
aaacaaacaaacaggctgggcacgg

SEQ ID NO: 39510 - DNA, 25 bp, Homo sapien
aacaaacaaacaggctgggcacggt

SEQ ID NO: 39511 - DNA, 25 bp, Homo sapien
acaaacaaacaggctgggcacggtg

SEQ ID NO: 39512 - DNA, 25 bp, Homo sapien
caaacaaacaggctgggcacggtgg

SEQ ID NO: 39513 - DNA, 25 bp, Homo sapien
agggcattgtggcacatgccaaggt

SEQ ID NO: 39514 - DNA, 25 bp, Homo sapien
gggcattgtggcacatgccaaggtg

SEQ ID NO: 39515 - DNA, 25 bp, Homo sapien
ggcattgtggcacatgccaaggtgg

SEQ ID NO: 39516 - DNA, 25 bp, Homo sapien
gcattgtggcacatgccaaggtggg

SEQ ID NO: 39517 - DNA, 25 bp, Homo sapien
attgtggcacatgccaaggtgggca

SEQ ID NO: 39518 - DNA, 25 bp, Homo sapien
tgtggcacatgccaaggtgggcaga

SEQ ID NO: 39519 - DNA, 25 bp, Homo sapien
ggcttccaaagcgatgcgctgtgcc

SEQ ID NO: 39520 - DNA, 25 bp, Homo sapien
ttccaaagcgatgcgctgtgcctcg

SEQ ID NO: 39521 - DNA, 25 bp, Homo sapien
cctactactactatacggctgcgag

SEQ ID NO: 39522 - DNA, 25 bp, Homo sapien
agcgagactccgtctgaaaataagt

SEQ ID NO: 39523 - DNA, 25 bp, Homo sapien
gactccgtctgaaaataagtacaca

SEQ ID NO: 39524 - DNA, 25 bp, Homo sapien
actatacggctgcgagaagacgaca

SEQ ID NO: 39525 - DNA, 25 bp, Homo sapien
aagggaataaggctctgtgcatacg

SEQ ID NO: 39526 - DNA, 25 bp, Homo sapien
ggaataaggctctgtgcatacgaat

SEQ ID NO: 39527 - DNA, 25 bp, Homo sapien
aaggctctgtgcatacgaatggggc

SEQ ID NO: 39528 - DNA, 25 bp, Homo sapien
tgcatacgaatggggctttgaaagg

SEQ ID NO: 39529 - DNA, 25 bp, Homo sapien
ctttgaaaggcgttgccgcggcttc

SEQ ID NO: 39530 - DNA, 25 bp, Homo sapien
aacctgggactctggtgattctgtg

SEQ ID NO: 39531 - DNA, 25 bp, Homo sapien
gactctggtgattctgtgttctggt

SEQ ID NO: 39532 - DNA, 25 bp, Homo sapien
ctgtgttctggtgaatttaagtttc

SEQ ID NO: 39533 - DNA, 25 bp, Homo sapien
tcattgtgtaccctggacaggaaat

SEQ ID NO: 39534 - DNA, 25 bp, Homo sapien
ggaaattgaactgatgttgacatgt

SEQ ID NO: 39535 - DNA, 25 bp, Homo sapien
gttgacatgtatgcatgcccaggag

SEQ ID NO: 39536 - DNA, 25 bp, Homo sapien
ataaaagttactgatgcacatgcat

SEQ ID NO: 39537 - DNA, 25 bp, Homo sapien
aatgttgttgcaaatctaacactaa

SEQ ID NO: 39538 - DNA, 25 bp, Homo sapien
atttttgactgggtgcagtggctca

SEQ ID NO: 39539 - DNA, 25 bp, Homo sapien
ggcgggtagatcacaaggacaggag

SEQ ID NO: 39540 - DNA, 25 bp, Homo sapien
aaggaggggcaggttgcagtgagcc

SEQ ID NO: 39541 - DNA, 25 bp, Homo sapien
tacggtaatgagcgctggtagccca

SEQ ID NO: 39542 - DNA, 25 bp, Homo sapien
gctggtagcccagacaagtacatga

SEQ ID NO: 39543 - DNA, 25 bp, Homo sapien
gactaggatcagaaacccgagtaga

SEQ ID NO: 39544 - DNA, 25 bp, Homo sapien
gcagaagagcgagttcgcccgtgct

SEQ ID NO: 39545 - DNA, 25 bp, Homo sapien
tcgcccgtgctgtgaaaggtttgtt

SEQ ID NO: 39546 - DNA, 25 bp, Homo sapien
gttgttactgttttgtggagagggg

SEQ ID NO: 39547 - DNA, 25 bp, Homo sapien
tgaggtgggtgtgtgctggtatttc

SEQ ID NO: 39548 - DNA, 25 bp, Homo sapien
tacagagggtggtaacatccttaaa

SEQ ID NO: 39549 - DNA, 25 bp, Homo sapien
atattttctgacaagcatctggcat

SEQ ID NO: 39550 - DNA, 25 bp, Homo sapien
agcatctggcattgtcatttgtgtc

SEQ ID NO: 39551 - DNA, 25 bp, Homo sapien
tatgaaaaccaatcttcggcggggc

SEQ ID NO: 39552 - DNA, 25 bp, Homo sapien
cctctgcctcctggattcaagcagt

SEQ ID NO: 39553 - DNA, 25 bp, Homo sapien
ctcagcctcccgaatagctaggact

SEQ ID NO: 39554 - DNA, 25 bp, Homo sapien
cacgcccagctgattttttgtattt

SEQ ID NO: 39555 - DNA, 25 bp, Homo sapien
cgatcttttgaccttgtgatccgcc

SEQ ID NO: 39556 - DNA, 25 bp, Homo sapien
tgcctcggtctctgagagtgctggg

SEQ ID NO: 39557 - DNA, 25 bp, Homo sapien
gtgttccaaaggccattttgtgtta

SEQ ID NO: 39558 - DNA, 25 bp, Homo sapien
aagtcaaggccgggtgtggtgtctc

SEQ ID NO: 39559 - DNA, 25 bp, Homo sapien
gtggtgtctcatgcctgaaatccca

SEQ ID NO: 39560 - DNA, 25 bp, Homo sapien
aggtgggtgtatcacttgaggccag

SEQ ID NO: 39561 - DNA, 25 bp, Homo sapien
gcatggccaacatggcgataccttg

SEQ ID NO: 39562 - DNA, 25 bp, Homo sapien
gataccttgtctctgctgaaaatac

SEQ ID NO: 39563 - DNA, 25 bp, Homo sapien
aaaacaggacagattagtctctttt

SEQ ID NO: 39564 - DNA, 25 bp, Homo sapien
gattagtctctttttgagcccaaaa

SEQ ID NO: 39565 - DNA, 25 bp, Homo sapien
gagcccaaaagaatctctgtattgt

SEQ ID NO: 39566 - DNA, 25 bp, Homo sapien
gcatgcatttttctgttttacttta

SEQ ID NO: 39567 - DNA, 25 bp, Homo sapien
atgcaatacccatagctgcttttac

SEQ ID NO: 39568 - DNA, 25 bp, Homo sapien
gctgcttttacatttttatatcaca

SEQ ID NO: 39569 - DNA, 25 bp, Homo sapien
ggagaagacctatactgtttgaaaa

SEQ ID NO: 39570 - DNA, 25 bp, Homo sapien
ttgaaaatgcaggccgggcgcggtg

SEQ ID NO: 39571 - DNA, 25 bp, Homo sapien
tgggagggcgaggcaggaggatcac

SEQ ID NO: 39572 - DNA, 25 bp, Homo sapien
tagtctcagctactcgggaggttgg

SEQ ID NO: 39573 - DNA, 25 bp, Homo sapien
tgggaggtggagcttgcggtgagcc

SEQ ID NO: 39574 - DNA, 25 bp, Homo sapien
tcaattccgaatgatgactggacga

SEQ ID NO: 39575 - DNA, 25 bp, Homo sapien
ggacgaatgaggggccaggctttta

SEQ ID NO: 39576 - DNA, 25 bp, Homo sapien
tgaggggccaggcttttatcacctt

SEQ ID NO: 39577 - DNA, 25 bp, Homo sapien
gcttttatcacctttcccaataagg

SEQ ID NO: 39578 - DNA, 25 bp, Homo sapien
cggtcaaatctccaagcgacttctc

SEQ ID NO: 39579 - DNA, 25 bp, Homo sapien
gacttctctcatatcatgtgctaca

SEQ ID NO: 39580 - DNA, 25 bp, Homo sapien
gtcctggatggtctttcttgaattg

SEQ ID NO: 39581 - DNA, 25 bp, Homo sapien
taggatttatgtatagacaccagtt

SEQ ID NO: 39582 - DNA, 25 bp, Homo sapien
gtaatttcagcttttggagagaact

SEQ ID NO: 39583 - DNA, 25 bp, Homo sapien
gatgatatgctgagtatgaagggta

SEQ ID NO: 39584 - DNA, 25 bp, Homo sapien
gtctctagagataacattctttctt

SEQ ID NO: 39585 - DNA, 25 bp, Homo sapien
aaatctatccagtgccgtatgacca

SEQ ID NO: 39586 - DNA, 25 bp, Homo sapien
agtgccgtatgaccaagaagagctg

SEQ ID NO: 39587 - DNA, 25 bp, Homo sapien
gagctgaagaaccgttaccaatcat

SEQ ID NO: 39588 - DNA, 25 bp, Homo sapien
gagcgatcattcctaactgctcctc

SEQ ID NO: 39589 - DNA, 25 bp, Homo sapien
gctcctcagacagagtacaggaata

SEQ ID NO: 39590 - DNA, 25 bp, Homo sapien
catgattgttattggcctgtacttc

SEQ ID NO: 39591 - DNA, 25 bp, Homo sapien
gtacttcatcaactgccagagcctc

SEQ ID NO: 39592 - DNA, 25 bp, Homo sapien
tcctgcaggacagggacaccctgaa

SEQ ID NO: 39593 - DNA, 25 bp, Homo sapien
ggacaccctgaacttctttaaggag

SEQ ID NO: 39594 - DNA, 25 bp, Homo sapien
agtttgatgctcttttcacagaccc

SEQ ID NO: 39595 - DNA, 25 bp, Homo sapien
catctgtgtacctcttcaggggttt

SEQ ID NO: 39596 - DNA, 25 bp, Homo sapien
ctgcctggaacattcttcccatagt

SEQ ID NO: 39597 - DNA, 25 bp, Homo sapien
cctggaacattcttcccatagtgtc

SEQ ID NO: 39598 - DNA, 25 bp, Homo sapien
tcactgctttggattgctgctcaaa

SEQ ID NO: 39599 - DNA, 25 bp, Homo sapien
tttggattgctgctcaaaagtcacc

SEQ ID NO: 39600 - DNA, 25 bp, Homo sapien
caatgagaacatacgggcacagtgg

SEQ ID NO: 39601 - DNA, 25 bp, Homo sapien
gagaacatacgggcacagtgggggg

SEQ ID NO: 39602 - DNA, 25 bp, Homo sapien
gaacatacgggcacagtggggggaa

SEQ ID NO: 39603 - DNA, 25 bp, Homo sapien
gtcggggggtgagaggcaagggaag

SEQ ID NO: 39604 - DNA, 25 bp, Homo sapien
agaggcaagggaagtgatagcatta

SEQ ID NO: 39605 - DNA, 25 bp, Homo sapien
gtagattatgggttgatgggggcag

SEQ ID NO: 39606 - DNA, 25 bp, Homo sapien
gattatgggttgatgggggcagcaa

SEQ ID NO: 39607 - DNA, 25 bp, Homo sapien
ttgacttctctggtgcaagacctca

SEQ ID NO: 39608 - DNA, 25 bp, Homo sapien
tgcaagacctcaggtccgtgggggc

SEQ ID NO: 39609 - DNA, 25 bp, Homo sapien
tcaggtccgtgggggcagaaaaact

SEQ ID NO: 39610 - DNA, 25 bp, Homo sapien
ggcagaaaaacttgattgtggtgac

SEQ ID NO: 39611 - DNA, 25 bp, Homo sapien
ttgtggtgacacctagtgaccagcc

SEQ ID NO: 39612 - DNA, 25 bp, Homo sapien
accagcctgggaaatttcaggaatc

SEQ ID NO: 39613 - DNA, 25 bp, Homo sapien
cggggaagaaacgaggcagggcagg

SEQ ID NO: 39614 - DNA, 25 bp, Homo sapien
accccctgcagcttgagggatctga

SEQ ID NO: 39615 - DNA, 25 bp, Homo sapien
tactgcccttgaacactcttacaaa

SEQ ID NO: 39616 - DNA, 25 bp, Homo sapien
gagctgtgatttgattacacccctg

SEQ ID NO: 39617 - DNA, 25 bp, Homo sapien
tgtgatttgattacacccctgcact

SEQ ID NO: 39618 - DNA, 25 bp, Homo sapien
aatgcttctacactgttggtagaag

SEQ ID NO: 39619 - DNA, 25 bp, Homo sapien
gttggtagaagttgggagtgtcagt

SEQ ID NO: 39620 - DNA, 25 bp, Homo sapien
gggagtgtcagttagtttagccatt

SEQ ID NO: 39621 - DNA, 25 bp, Homo sapien
agtttagccattgtggatgacactg

SEQ ID NO: 39622 - DNA, 25 bp, Homo sapien
ggatgacactgtggtgatttctcaa

SEQ ID NO: 39623 - DNA, 25 bp, Homo sapien
ctagaggcagtaataccatatgacc

SEQ ID NO: 39624 - DNA, 25 bp, Homo sapien
taataccatatgaccaagccatccc

SEQ ID NO: 39625 - DNA, 25 bp, Homo sapien
cacacgtatgtacattgcagcgctt

SEQ ID NO: 39626 - DNA, 25 bp, Homo sapien
gtatgtacattgcagcgcttttcac

SEQ ID NO: 39627 - DNA, 25 bp, Homo sapien
acattgcagcgcttttcacaatagc

SEQ ID NO: 39628 - DNA, 25 bp, Homo sapien
ccatcagtgatgggctggttaaaga

SEQ ID NO: 39629 - DNA, 25 bp, Homo sapien
ggaagctccatgtctggtaccttcc

SEQ ID NO: 39630 - DNA, 25 bp, Homo sapien
cttcctcccttggctgattttaatc

SEQ ID NO: 39631 - DNA, 25 bp, Homo sapien
gagcttttgatgagttctgcgtcct

SEQ ID NO: 39632 - DNA, 25 bp, Homo sapien
ttctgcgtccttccagtgaatgatc

SEQ ID NO: 39633 - DNA, 25 bp, Homo sapien
tgagggtggtctagggtaccccttg

SEQ ID NO: 39634 - DNA, 25 bp, Homo sapien
taccccttgcagttggtgcagcaat

SEQ ID NO: 39635 - DNA, 25 bp, Homo sapien
ggtcttatgtggatggtgctccctt

SEQ ID NO: 39636 - DNA, 25 bp, Homo sapien
gtgctccctttaacttgacaggtgg

SEQ ID NO: 39637 - DNA, 25 bp, Homo sapien
agggacccagtcgaagataattgaa

SEQ ID NO: 39638 - DNA, 25 bp, Homo sapien
catggaggcaagtctttcctgtgtt

SEQ ID NO: 39639 - DNA, 25 bp, Homo sapien
ttcctgtgttgttctcacgatagtg

SEQ ID NO: 39640 - DNA, 25 bp, Homo sapien
gagatgcaagtggaagctccctcag

SEQ ID NO: 39641 - DNA, 25 bp, Homo sapien
tgcaagtggaagctccctcagattc

SEQ ID NO: 39642 - DNA, 25 bp, Homo sapien
aagctccctcagattctagcgttat

SEQ ID NO: 39643 - DNA, 25 bp, Homo sapien
cagattctagcgttatagcacaaca

SEQ ID NO: 39644 - DNA, 25 bp, Homo sapien
ttatagcacaacaaaaggccatgaa

SEQ ID NO: 39645 - DNA, 25 bp, Homo sapien
aaggccatgaaaagtctgttcggag

SEQ ID NO: 39646 - DNA, 25 bp, Homo sapien
gaaaagtctgttcggagatgatgaa

SEQ ID NO: 39647 - DNA, 25 bp, Homo sapien
gtgagatcattcctactttggaacc

SEQ ID NO: 39648 - DNA, 25 bp, Homo sapien
gaggttcctggacatcagtcagttt

SEQ ID NO: 39649 - DNA, 25 bp, Homo sapien
ggacatcagtcagtttttatgaatg

SEQ ID NO: 39650 - DNA, 25 bp, Homo sapien
gtaacatacaaaaagaatctgccag

SEQ ID NO: 39651 - DNA, 25 bp, Homo sapien
aaggttagactacggcactatgaaa

SEQ ID NO: 39652 - DNA, 25 bp, Homo sapien
gatacattcctagaaacatacaacc

SEQ ID NO: 39653 - DNA, 25 bp, Homo sapien
cacaggccaacaaactggataacct

SEQ ID NO: 39654 - DNA, 25 bp, Homo sapien
acaaggttagactacggcactatga

SEQ ID NO: 39655 - DNA, 25 bp, Homo sapien
gactacggcactatgaaaaatcaca

SEQ ID NO: 39656 - DNA, 25 bp, Homo sapien
aaatcacaggccaacaaactggata

SEQ ID NO: 39657 - DNA, 25 bp, Homo sapien
aaagacaaggttagactacggcact

SEQ ID NO: 39658 - DNA, 25 bp, Homo sapien
acaggccaacaaactggataaccta

SEQ ID NO: 39659 - DNA, 25 bp, Homo sapien
gacaaggttagactacggcactatg

SEQ ID NO: 39660 - DNA, 25 bp, Homo sapien
caaggttagactacggcactatgaa

SEQ ID NO: 39661 - DNA, 25 bp, Homo sapien
gacaaggttagactatggcactatg

SEQ ID NO: 39662 - DNA, 25 bp, Homo sapien
ggagttttaaaccttacatgcatca

SEQ ID NO: 39663 - DNA, 25 bp, Homo sapien
tgggccctagtccattaagaaagga

SEQ ID NO: 39664 - DNA, 25 bp, Homo sapien
gggcttagaatgttcatttctccca

SEQ ID NO: 39665 - DNA, 25 bp, Homo sapien
ttcccaggtgatattcaccatgctg

SEQ ID NO: 39666 - DNA, 25 bp, Homo sapien
tgtcctgtctggacactaccttttg

SEQ ID NO: 39667 - DNA, 25 bp, Homo sapien
acccattacaaggtattgcacgtgc

SEQ ID NO: 39668 - DNA, 25 bp, Homo sapien
gcacgtgctggttgaactatggtct

SEQ ID NO: 39669 - DNA, 25 bp, Homo sapien
tatggtctgtcttattttggtgcta

SEQ ID NO: 39670 - DNA, 25 bp, Homo sapien
attttggtgctaaaagcctgtgcca

SEQ ID NO: 39671 - DNA, 25 bp, Homo sapien
tgtgccaaataccaacgctgcagca

SEQ ID NO: 39672 - DNA, 25 bp, Homo sapien
ggaacttgcactgggctgagatcgc

SEQ ID NO: 39673 - DNA, 25 bp, Homo sapien
atgtaagaacctcaaacaactctat

SEQ ID NO: 39674 - DNA, 25 bp, Homo sapien
agacgataacaaatgctggcaagga

SEQ ID NO: 39675 - DNA, 25 bp, Homo sapien
aaaggtaatcctcatacactgttgg

SEQ ID NO: 39676 - DNA, 25 bp, Homo sapien
atgtatattagtaccaccactgtgg

(The sequence listing continues in the following parts.)

We claim:

1. An array comprising a plurality of different sequence oligonucleotide probes wherein each different sequence in the plurality consists of one of the sequences in SEQ ID NO: 1-673,904, wherein the plurality of different sequence oligonucleotide probes consists of each of the sequences listed in SEQ ID NO: 1-673,904 and wherein each different sequence is present in a different feature of the array.

2. The array of claim 1 further comprising a plurality of control probe sets.

3. The array of claim 1 wherein the array comprises a plurality of beads or particles each having a single sequence from SEQ ID NO: 1-673,904 attached and wherein the array includes at least one bead having each of the sequences listed in SEQ ID NO: 1-673,904 attached.

4. The array of claim 3 wherein the plurality of beads is associated with a solid support to form an array of beads.

* * * * *